United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 79

SEQ ID NO: 3608103 - RNA, 18 nt, Human
auuccccaucucaggcca

SEQ ID NO: 3608104 - RNA, 14 nt, Human
auuccccauucuuc

SEQ ID NO: 3608105 - RNA, 13 nt, Human
auuccccauugcc

SEQ ID NO: 3608106 - RNA, 20 nt, Human
auuccccauugccuccuccu

SEQ ID NO: 3608107 - RNA, 20 nt, Human
auuccccggggcguuucuuu

SEQ ID NO: 3608108 - RNA, 23 nt, Human
auuccccgucucugguuccuccc

SEQ ID NO: 3608109 - RNA, 16 nt, Human
auucccguuuugucac

SEQ ID NO: 3608110 - RNA, 17 nt, Human
auucccuagaucuuucu

SEQ ID NO: 3608111 - RNA, 11 nt, Human
auucccucacu

SEQ ID NO: 3608112 - RNA, 21 nt, Human
auucccuccugcuacucuguu

SEQ ID NO: 3608113 - RNA, 17 nt, Human
auucccucgucuuuccc

SEQ ID NO: 3608114 - RNA, 18 nt, Human
auucccucucccaggccc

SEQ ID NO: 3608115 - RNA, 13 nt, Human
auucccucucucu

SEQ ID NO: 3608116 - RNA, 19 nt, Human
auucccucucucugacucu

SEQ ID NO: 3608117 - RNA, 20 nt, Human
auucccucucucugacucuc

SEQ ID NO: 3608118 - RNA, 20 nt, Human
auucccugagucaccaggaa

SEQ ID NO: 3608119 - RNA, 19 nt, Human
auucccuggaccagaugcu

SEQ ID NO: 3608120 - RNA, 21 nt, Human
auucccuggccuuucauauuu

SEQ ID NO: 3608121 - RNA, 16 nt, Human
auucccuucaucugga

SEQ ID NO: 3608122 - RNA, 23 nt, Human
auucccuuccugccagccccugc

SEQ ID NO: 3608123 - RNA, 14 nt, Human
auuccgcaucccua

SEQ ID NO: 3608124 - RNA, 23 nt, Human
auuccggaaacuaguguacauuu

SEQ ID NO: 3608125 - RNA, 13 nt, Human
auuccggauccua

SEQ ID NO: 3608126 - RNA, 16 nt, Human
auuccggauccuaagc

SEQ ID NO: 3608127 - RNA, 14 nt, Human
auuccguuuacauu

SEQ ID NO: 3608128 - RNA, 14 nt, Human
auuccuaaaauuau

SEQ ID NO: 3608129 - RNA, 17 nt, Human
auuccuaaacuaucuuu

SEQ ID NO: 3608130 - RNA, 19 nt, Human
auuccuaaacuaucuuuuu

SEQ ID NO: 3608131 - RNA, 20 nt, Human
auuccuaaacuaucuuuuuu

SEQ ID NO: 3608132 - RNA, 18 nt, Human
auuccuaaagaaaaauau

SEQ ID NO: 3608133 - RNA, 20 nt, Human
auuccuaacacagcaugugu

SEQ ID NO: 3608134 - RNA, 18 nt, Human
auuccuaacuuuucaaug

SEQ ID NO: 3608135 - RNA, 18 nt, Human
auuccuacaaagauguuu

SEQ ID NO: 3608136 - RNA, 17 nt, Human
auuccuacaauauauau

SEQ ID NO: 3608137 - RNA, 13 nt, Human
auuccuacagcac

SEQ ID NO: 3608138 - RNA, 16 nt, Human
auuccuagaauuaaac

SEQ ID NO: 3608139 - RNA, 21 nt, Human
auuccuagaauuaaaccagau

SEQ ID NO: 3608140 - RNA, 14 nt, Human
auuccuauugugau

SEQ ID NO: 3608141 - RNA, 17 nt, Human
auuccuauugugauuug

SEQ ID NO: 3608142 - RNA, 17 nt, Human
auuccucaacguauugu

SEQ ID NO: 3608143 - RNA, 18 nt, Human
auuccucaugaauguaaa

SEQ ID NO: 3608144 - RNA, 19 nt, Human
auuccucaugaauguaaau

SEQ ID NO: 3608145 - RNA, 13 nt, Human
auuccuccugcuc

SEQ ID NO: 3608146 - RNA, 16 nt, Human
auuccuccugcucaua

SEQ ID NO: 3608147 - RNA, 13 nt, Human
auuccucugggaa

SEQ ID NO: 3608148 - RNA, 22 nt, Human
auuccucugggaauguuacauu

SEQ ID NO: 3608149 - RNA, 18 nt, Human
auuccucuuugcuuugcu

SEQ ID NO: 3608150 - RNA, 12 nt, Human
auuccucuuuuc

SEQ ID NO: 3608151 - RNA, 17 nt, Human
auuccucuuuucucugc

SEQ ID NO: 3608152 - RNA, 13 nt, Human
auuccugaacagg

SEQ ID NO: 3608153 - RNA, 24 nt, Human
auuccugaacuauaacaccugcca

SEQ ID NO: 3608154 - RNA, 19 nt, Human
auuccugaagaaccagucc

SEQ ID NO: 3608155 - RNA, 11 nt, Human
auuccugaccc

SEQ ID NO: 3608156 - RNA, 12 nt, Human
auuccugaccca

SEQ ID NO: 3608157 - RNA, 15 nt, Human
auuccugacccaggc

SEQ ID NO: 3608158 - RNA, 16 nt, Human
auuccugacccaggcc

SEQ ID NO: 3608159 - RNA, 17 nt, Human
auuccugacccaggccg

SEQ ID NO: 3608160 - RNA, 16 nt, Human
auuccugauaugauuu

SEQ ID NO: 3608161 - RNA, 22 nt, Human
auuccugauaugauuuaaaaca

SEQ ID NO: 3608162 - RNA, 23 nt, Human
auuccugauaugauuuaaaacau

SEQ ID NO: 3608163 - RNA, 13 nt, Human
auuccugcagccu

SEQ ID NO: 3608164 - RNA, 14 nt, Human
auuccugcagccug

SEQ ID NO: 3608165 - RNA, 15 nt, Human
auuccugcagccugg

SEQ ID NO: 3608166 - RNA, 19 nt, Human
auuccugcagccuggaggc

SEQ ID NO: 3608167 - RNA, 18 nt, Human
auuccugcauuugugaaa

SEQ ID NO: 3608168 - RNA, 15 nt, Human
auuccuggagcccga

SEQ ID NO: 3608169 - RNA, 21 nt, Human
auuccuggagcccgaggcacc

SEQ ID NO: 3608170 - RNA, 16 nt, Human
auuccuguagcaucuu

SEQ ID NO: 3608171 - RNA, 17 nt, Human
auuccuguagcaucuuc

SEQ ID NO: 3608172 - RNA, 13 nt, Human
auuccuguauguu

SEQ ID NO: 3608173 - RNA, 22 nt, Human
auuccuuagacucuuuuccuuc

SEQ ID NO: 3608174 - RNA, 14 nt, Human
auuccuucagggug

SEQ ID NO: 3608175 - RNA, 15 nt, Human
auuccuucaggguga

SEQ ID NO: 3608176 - RNA, 12 nt, Human
auuccuuccugu

SEQ ID NO: 3608177 - RNA, 14 nt, Human
auuccuuccuguuc

SEQ ID NO: 3608178 - RNA, 23 nt, Human
auuccuucucccaucucuuccuu

SEQ ID NO: 3608179 - RNA, 11 nt, Human
auuccuucucu

SEQ ID NO: 3608180 - RNA, 15 nt, Human
auuccuucuuugaua

SEQ ID NO: 3608181 - RNA, 16 nt, Human
auuccuucuuugauaa

SEQ ID NO: 3608182 - RNA, 21 nt, Human
auuccuucuuugauaauguua

SEQ ID NO: 3608183 - RNA, 22 nt, Human
auuccuucuuugauaauguuaa

SEQ ID NO: 3608184 - RNA, 23 nt, Human
auuccuucuuugauaauguuaaa

SEQ ID NO: 3608185 - RNA, 21 nt, Human
auuccuuggcaugccuuccag

SEQ ID NO: 3608186 - RNA, 12 nt, Human
auuccuuuccag

SEQ ID NO: 3608187 - RNA, 11 nt, Human
auuccuuuccc

SEQ ID NO: 3608188 - RNA, 15 nt, Human
auuccuuucccuucc

SEQ ID NO: 3608189 - RNA, 17 nt, Human
auuccuuucccuuccuc

SEQ ID NO: 3608190 - RNA, 20 nt, Human
auuccuuucccuuccucuuc

SEQ ID NO: 3608191 - RNA, 16 nt, Human
auuccuuucuaucauu

SEQ ID NO: 3608192 - RNA, 17 nt, Human
auuccuuucuaucauuu

SEQ ID NO: 3608193 - RNA, 18 nt, Human
auuccuuuguguuucuau

SEQ ID NO: 3608194 - RNA, 19 nt, Human
auuccuuuucuuguuuauc

SEQ ID NO: 3608195 - RNA, 18 nt, Human
auuccuuuuuauuuauau

SEQ ID NO: 3608196 - RNA, 17 nt, Human
auucgagacagaaccuu

SEQ ID NO: 3608197 - RNA, 17 nt, Human
auugacaauaauuucag

SEQ ID NO: 3608198 - RNA, 18 nt, Human
auugacaauaauuucagg

SEQ ID NO: 3608199 - RNA, 17 nt, Human
auugacacagaaaaugu

SEQ ID NO: 3608200 - RNA, 12 nt, Human
auugacacugaa

SEQ ID NO: 3608201 - RNA, 20 nt, Human
auugacacuuaaaaaugguu

SEQ ID NO: 3608202 - RNA, 18 nt, Human
auugacagaucaagcugu

SEQ ID NO: 3608203 - RNA, 15 nt, Human
auugacagcuuugcu

SEQ ID NO: 3608204 - RNA, 17 nt, Human
auugacaggcgaaagaa

SEQ ID NO: 3608205 - RNA, 17 nt, Human
auugacaucagcaucac

SEQ ID NO: 3608206 - RNA, 15 nt, Human
auugacauguacaga

SEQ ID NO: 3608207 - RNA, 15 nt, Human
auugacauugaaauc

SEQ ID NO: 3608208 - RNA, 18 nt, Human
auugacauugaaaucuag

SEQ ID NO: 3608209 - RNA, 17 nt, Human
auugacauuuguaguug

SEQ ID NO: 3608210 - RNA, 18 nt, Human
auugacauuuguaguuga

SEQ ID NO: 3608211 - RNA, 15 nt, Human
auugaccaagaacug

SEQ ID NO: 3608212 - RNA, 13 nt, Human
auugaccauuuuu

SEQ ID NO: 3608213 - RNA, 21 nt, Human
auugaccguguuggucuguac

SEQ ID NO: 3608214 - RNA, 13 nt, Human
auugaccugaggc

SEQ ID NO: 3608215 - RNA, 14 nt, Human
auugaccuggaugg

SEQ ID NO: 3608216 - RNA, 20 nt, Human
auugaccuuuagguauuaca

SEQ ID NO: 3608217 - RNA, 16 nt, Human
auugacgauuccuucu

SEQ ID NO: 3608218 - RNA, 22 nt, Human
auugacuauuuucguucauuac

SEQ ID NO: 3608219 - RNA, 20 nt, Human
auugacucuggguccuuccu

SEQ ID NO: 3608220 - RNA, 21 nt, Human
auugacugguuuacaggcccu

SEQ ID NO: 3608221 - RNA, 21 nt, Human
auugacuuuagaaagcugaca

SEQ ID NO: 3608222 - RNA, 15 nt, Human
auugacuuucaguaa

SEQ ID NO: 3608223 - RNA, 13 nt, Human
auugacuuugucu

SEQ ID NO: 3608224 - RNA, 20 nt, Human
auugagaaaaauauauacua

SEQ ID NO: 3608225 - RNA, 22 nt, Human
auugagaaagagcacuuaagag

SEQ ID NO: 3608226 - RNA, 13 nt, Human
auugagaaaugug

SEQ ID NO: 3608227 - RNA, 16 nt, Human
auugagaaguucauug

SEQ ID NO: 3608228 - RNA, 13 nt, Human
auugagaauuuua

SEQ ID NO: 3608229 - RNA, 17 nt, Human
auugagaauuuuaaauu

SEQ ID NO: 3608230 - RNA, 19 nt, Human
auugagacaaaaauuaucu

SEQ ID NO: 3608231 - RNA, 20 nt, Human
auugagacaaaaauuaucua

SEQ ID NO: 3608232 - RNA, 19 nt, Human
auugagacagugcacauga

SEQ ID NO: 3608233 - RNA, 21 nt, Human
auugagaccgugaagauacuu

SEQ ID NO: 3608234 - RNA, 23 nt, Human
auugagaccgugaagauacuuug

SEQ ID NO: 3608235 - RNA, 21 nt, Human
auugagagagauguguaauuu

SEQ ID NO: 3608236 - RNA, 14 nt, Human
auugagaguuuugu

SEQ ID NO: 3608237 - RNA, 22 nt, Human
auugagauuguccucauuucuc

SEQ ID NO: 3608238 - RNA, 12 nt, Human
auugagauuucu

SEQ ID NO: 3608239 - RNA, 15 nt, Human
auugagcucucucau

SEQ ID NO: 3608240 - RNA, 20 nt, Human
auugagcucucugcccuuga

SEQ ID NO: 3608241 - RNA, 20 nt, Human
auugagcugauauaaauucu

SEQ ID NO: 3608242 - RNA, 19 nt, Human
auugagcugcagaaacgaa

SEQ ID NO: 3608243 - RNA, 22 nt, Human
auugagcugcuuuuuuugaaac

SEQ ID NO: 3608244 - RNA, 17 nt, Human
auugaggaaaaauaugu

SEQ ID NO: 3608245 - RNA, 21 nt, Human
auugaggaaaaauaugugaag

SEQ ID NO: 3608246 - RNA, 15 nt, Human
auugaggaagagucu

SEQ ID NO: 3608247 - RNA, 22 nt, Human
auugaggacacugauauggguc

SEQ ID NO: 3608248 - RNA, 18 nt, Human
auugaggccaagaauauu

SEQ ID NO: 3608249 - RNA, 14 nt, Human
auugaggcuuugug

SEQ ID NO: 3608250 - RNA, 15 nt, Human
auugaggcuuugugu

SEQ ID NO: 3608251 - RNA, 16 nt, Human
auugaggcuuuguguu

SEQ ID NO: 3608252 - RNA, 13 nt, Human
auugaguauuguu

SEQ ID NO: 3608253 - RNA, 16 nt, Human
auugaguauuguuuaa

SEQ ID NO: 3608254 - RNA, 20 nt, Human
auugaguauuguuuaaaaug

SEQ ID NO: 3608255 - RNA, 21 nt, Human
auugaguauuguuuaaaaugu

SEQ ID NO: 3608256 - RNA, 22 nt, Human
auugagucauuuuauauaugaa

SEQ ID NO: 3608257 - RNA, 14 nt, Human
auugaguuuguagg

SEQ ID NO: 3608258 - RNA, 21 nt, Human
auugaguuuguagguaaaaug

SEQ ID NO: 3608259 - RNA, 19 nt, Human
auugauaacagcacugacu

SEQ ID NO: 3608260 - RNA, 17 nt, Human
auugauaaccauagcau

SEQ ID NO: 3608261 - RNA, 17 nt, Human
auugauaagaucuuuua

SEQ ID NO: 3608262 - RNA, 17 nt, Human
auugauaaguucauaca

SEQ ID NO: 3608263 - RNA, 18 nt, Human
auugauaaugcuuucaca

SEQ ID NO: 3608264 - RNA, 21 nt, Human
auugauauacacggaugacuu

SEQ ID NO: 3608265 - RNA, 17 nt, Human
auugauaugaaaaauau

SEQ ID NO: 3608266 - RNA, 13 nt, Human
auugauauuugug

SEQ ID NO: 3608267 - RNA, 15 nt, Human
auugaucauaaacug

SEQ ID NO: 3608268 - RNA, 21 nt, Human
auugaucauuuuccccccacu

SEQ ID NO: 3608269 - RNA, 18 nt, Human
auugauccagaaagaaaa

SEQ ID NO: 3608270 - RNA, 21 nt, Human
auugaugaaaagauuuaagca

SEQ ID NO: 3608271 - RNA, 13 nt, Human
auugauggggaag

SEQ ID NO: 3608272 - RNA, 21 nt, Human
auugauguacagucugucaug

SEQ ID NO: 3608273 - RNA, 18 nt, Human
auugaugugcaaaaauuu

SEQ ID NO: 3608274 - RNA, 12 nt, Human
auugauguguuu

SEQ ID NO: 3608275 - RNA, 12 nt, Human
auugauguugau

SEQ ID NO: 3608276 - RNA, 14 nt, Human
auugauguuuccuu

SEQ ID NO: 3608277 - RNA, 16 nt, Human
auugauguuuucauag

SEQ ID NO: 3608278 - RNA, 22 nt, Human
auugauuccuuuuuucaaaauc

SEQ ID NO: 3608279 - RNA, 23 nt, Human
auugauugcuguguccaacucca

SEQ ID NO: 3608280 - RNA, 18 nt, Human
auugauugggaaaacauu

SEQ ID NO: 3608281 - RNA, 20 nt, Human
auugauugggaaaacauuug

SEQ ID NO: 3608282 - RNA, 22 nt, Human
auugauugggaaaacauuugcu

SEQ ID NO: 3608283 - RNA, 19 nt, Human
auugauugggcacaucauu

SEQ ID NO: 3608284 - RNA, 13 nt, Human
auugauuguauug

SEQ ID NO: 3608285 - RNA, 16 nt, Human
auugauuguauuguug

SEQ ID NO: 3608286 - RNA, 18 nt, Human
auugauuucccuucuucu

SEQ ID NO: 3608287 - RNA, 13 nt, Human
auugauuuccugu

SEQ ID NO: 3608288 - RNA, 16 nt, Human
auugauuuccuguguc

SEQ ID NO: 3608289 - RNA, 15 nt, Human
auugauuucugccuu

SEQ ID NO: 3608290 - RNA, 15 nt, Human
auugauuucuuuucu

SEQ ID NO: 3608291 - RNA, 14 nt, Human
auugauuugaagaa

SEQ ID NO: 3608292 - RNA, 16 nt, Human
auugauuugaagaaca

SEQ ID NO: 3608293 - RNA, 19 nt, Human
auugauuuuaaaauguaca

SEQ ID NO: 3608294 - RNA, 20 nt, Human
auugauuuuaaaauguacau

SEQ ID NO: 3608295 - RNA, 19 nt, Human
auugcaaaauacaugaagc

SEQ ID NO: 3608296 - RNA, 12 nt, Human
auugcaaaucuu

SEQ ID NO: 3608297 - RNA, 16 nt, Human
auugcaaaucuugaaa

SEQ ID NO: 3608298 - RNA, 17 nt, Human
auugcaacaaaauacau

SEQ ID NO: 3608299 - RNA, 22 nt, Human
auugcaacaaaauacauucuuu

SEQ ID NO: 3608300 - RNA, 19 nt, Human
auugcaacaggcugggcuu

SEQ ID NO: 3608301 - RNA, 14 nt, Human
auugcaauaaagua

SEQ ID NO: 3608302 - RNA, 14 nt, Human
auugcaauaucuga

SEQ ID NO: 3608303 - RNA, 17 nt, Human
auugcaauaucugaagc

SEQ ID NO: 3608304 - RNA, 17 nt, Human
auugcaauuuuaacaca

SEQ ID NO: 3608305 - RNA, 14 nt, Human
auugcacauuguuc

SEQ ID NO: 3608306 - RNA, 15 nt, Human
auugcacguggccuc

SEQ ID NO: 3608307 - RNA, 17 nt, Human
auugcagaaaauucugu

SEQ ID NO: 3608308 - RNA, 20 nt, Human
auugcagaacuaaacucauu

SEQ ID NO: 3608309 - RNA, 13 nt, Human
auugcagaauugu

SEQ ID NO: 3608310 - RNA, 19 nt, Human
auugcagcugggagaaggg

SEQ ID NO: 3608311 - RNA, 16 nt, Human
auugcagcuuuauguu

SEQ ID NO: 3608312 - RNA, 20 nt, Human
auugcagcuuuauguucauu

SEQ ID NO: 3608313 - RNA, 23 nt, Human
auugcaggagucccugccaucau

SEQ ID NO: 3608314 - RNA, 17 nt, Human
auugcaguuuaucauuc

SEQ ID NO: 3608315 - RNA, 18 nt, Human
auugcaguuuaucauuca

SEQ ID NO: 3608316 - RNA, 19 nt, Human
auugcaguuuaucauucaa

SEQ ID NO: 3608317 - RNA, 13 nt, Human
auugcauaaagca

SEQ ID NO: 3608318 - RNA, 15 nt, Human
auugcauaaagcaua

SEQ ID NO: 3608319 - RNA, 17 nt, Human
auugcauacuauuaaac

SEQ ID NO: 3608320 - RNA, 18 nt, Human
auugcauacuauuaaaca

SEQ ID NO: 3608321 - RNA, 21 nt, Human
auugcauacuuuguauuuuga

SEQ ID NO: 3608322 - RNA, 22 nt, Human
auugcaucaccucuguaauuuu

SEQ ID NO: 3608323 - RNA, 14 nt, Human
auugcaucacugua

SEQ ID NO: 3608324 - RNA, 15 nt, Human
auugcaucacuguau

SEQ ID NO: 3608325 - RNA, 16 nt, Human
auugcaucacuguauc

SEQ ID NO: 3608326 - RNA, 20 nt, Human
auugcaucuggguagcugua

SEQ ID NO: 3608327 - RNA, 22 nt, Human
auugcaucuggguagcuguaag

SEQ ID NO: 3608328 - RNA, 16 nt, Human
auugcaugcugcuuua

SEQ ID NO: 3608329 - RNA, 17 nt, Human
auugcaugcugcuuuaa

SEQ ID NO: 3608330 - RNA, 19 nt, Human
auugcauggguuuuguagg

SEQ ID NO: 3608331 - RNA, 14 nt, Human
auugcaugugacuc

SEQ ID NO: 3608332 - RNA, 23 nt, Human
auugcauuaaauauaauaugcac

SEQ ID NO: 3608333 - RNA, 13 nt, Human
auugcauucuauu

SEQ ID NO: 3608334 - RNA, 23 nt, Human
auugcauucuauugccuucuuug

SEQ ID NO: 3608335 - RNA, 16 nt, Human
auugcauuuccugaca

SEQ ID NO: 3608336 - RNA, 18 nt, Human
auugcauuuuuuaaaaca

SEQ ID NO: 3608337 - RNA, 20 nt, Human
auugcauuuuuuaaaacaag

SEQ ID NO: 3608338 - RNA, 21 nt, Human
auugcauuuuuuaaaacaaga

SEQ ID NO: 3608339 - RNA, 16 nt, Human
auugccaaaacccagc

SEQ ID NO: 3608340 - RNA, 20 nt, Human
auugccaaaacccagcugca

SEQ ID NO: 3608341 - RNA, 14 nt, Human
auugccaaacauua

SEQ ID NO: 3608342 - RNA, 19 nt, Human
auugccaaacauuaauguu

SEQ ID NO: 3608343 - RNA, 14 nt, Human
auugccaagggcuu

SEQ ID NO: 3608344 - RNA, 21 nt, Human
auugccaccucuaacagcacc

SEQ ID NO: 3608345 - RNA, 22 nt, Human
auugccaccucuaacagcacca

SEQ ID NO: 3608346 - RNA, 14 nt, Human
auugccagugacau

SEQ ID NO: 3608347 - RNA, 14 nt, Human
auugccagugucuu

SEQ ID NO: 3608348 - RNA, 15 nt, Human
auugccauauugcac

SEQ ID NO: 3608349 - RNA, 21 nt, Human
auugcccacgcuggagugcag

SEQ ID NO: 3608350 - RNA, 15 nt, Human
auugcccagucuuuc

SEQ ID NO: 3608351 - RNA, 18 nt, Human
auugccccaucuagacua

SEQ ID NO: 3608352 - RNA, 15 nt, Human
auugcccccagggca

SEQ ID NO: 3608353 - RNA, 11 nt, Human
auugcccuggu

SEQ ID NO: 3608354 - RNA, 14 nt, Human
auugccuauuucag

SEQ ID NO: 3608355 - RNA, 23 nt, Human
auugccucggcuggcuccccugc

SEQ ID NO: 3608356 - RNA, 18 nt, Human
auugccucugaaaagugu

SEQ ID NO: 3608357 - RNA, 14 nt, Human
auugccugcagaga

SEQ ID NO: 3608358 - RNA, 14 nt, Human
auugccuguuucug

SEQ ID NO: 3608359 - RNA, 21 nt, Human
auugccuguuucugauuugcu

SEQ ID NO: 3608360 - RNA, 18 nt, Human
auugccuuaacuggagcc

SEQ ID NO: 3608361 - RNA, 20 nt, Human
auugccuucauuuuaugaua

SEQ ID NO: 3608362 - RNA, 18 nt, Human
auugccuucuuugaagaa

SEQ ID NO: 3608363 - RNA, 13 nt, Human
auugccuuucugu

SEQ ID NO: 3608364 - RNA, 18 nt, Human
auugccuuugaauguuaa

SEQ ID NO: 3608365 - RNA, 19 nt, Human
auugccuuuuuauaacuuu

SEQ ID NO: 3608366 - RNA, 20 nt, Human
auugccuuuuuauaacuuuu

SEQ ID NO: 3608367 - RNA, 21 nt, Human
auugccuuuuuauaacuuuuu

SEQ ID NO: 3608368 - RNA, 17 nt, Human
auugccuuuuuucugua

SEQ ID NO: 3608369 - RNA, 23 nt, Human
auugccuuuuuucuguauaaaug

SEQ ID NO: 3608370 - RNA, 14 nt, Human
auugcgagagaugu

SEQ ID NO: 3608371 - RNA, 15 nt, Human
auugcgagagaugug

SEQ ID NO: 3608372 - RNA, 18 nt, Human
auugcgagagaugugugu

SEQ ID NO: 3608373 - RNA, 20 nt, Human
auugcgagagauguguguug

SEQ ID NO: 3608374 - RNA, 21 nt, Human
auugcgagagauguguguuga

SEQ ID NO: 3608375 - RNA, 13 nt, Human
auugcgcugcuac

SEQ ID NO: 3608376 - RNA, 16 nt, Human
auugcggacagccacg

SEQ ID NO: 3608377 - RNA, 20 nt, Human
auugcguuggucucugcauu

SEQ ID NO: 3608378 - RNA, 13 nt, Human
auugcuaaaugua

SEQ ID NO: 3608379 - RNA, 21 nt, Human
auugcuaaucaccaaaggcuc

SEQ ID NO: 3608380 - RNA, 16 nt, Human
auugcuaauguugcug

SEQ ID NO: 3608381 - RNA, 19 nt, Human
auugcuaauugcuguugaa

SEQ ID NO: 3608382 - RNA, 20 nt, Human
auugcuaauugcuguugaaa

SEQ ID NO: 3608383 - RNA, 14 nt, Human
auugcuacuguccu

SEQ ID NO: 3608384 - RNA, 15 nt, Human
auugcuacuguccua

SEQ ID NO: 3608385 - RNA, 15 nt, Human
auugcuagagcuccu

SEQ ID NO: 3608386 - RNA, 18 nt, Human
auugcuagagcuccuccc

SEQ ID NO: 3608387 - RNA, 19 nt, Human
auugcuagagcuccucccu

SEQ ID NO: 3608388 - RNA, 23 nt, Human
auugcuagagcuccucccucuca

SEQ ID NO: 3608389 - RNA, 17 nt, Human
auugcuagauaaaagcu

SEQ ID NO: 3608390 - RNA, 15 nt, Human
auugcuaguauuuga

SEQ ID NO: 3608391 - RNA, 17 nt, Human
auugcuaguauuugaau

SEQ ID NO: 3608392 - RNA, 21 nt, Human
auugcuaucuauugauaauuu

SEQ ID NO: 3608393 - RNA, 21 nt, Human
auugcucacaguuauuacaua

SEQ ID NO: 3608394 - RNA, 16 nt, Human
auugcucacccagugc

SEQ ID NO: 3608395 - RNA, 23 nt, Human
auugcucacccagugcccucucc

SEQ ID NO: 3608396 - RNA, 14 nt, Human
auugcucauuuuuu

SEQ ID NO: 3608397 - RNA, 16 nt, Human
auugcucccuaagacu

SEQ ID NO: 3608398 - RNA, 20 nt, Human
auugcuccugcucagaucuu

SEQ ID NO: 3608399 - RNA, 12 nt, Human
auugcuccuuga

SEQ ID NO: 3608400 - RNA, 16 nt, Human
auugcugaaauuuuau

SEQ ID NO: 3608401 - RNA, 21 nt, Human
auugcugaagggcauucuuuc

SEQ ID NO: 3608402 - RNA, 21 nt, Human
auugcugaauggaguuaaacu

SEQ ID NO: 3608403 - RNA, 16 nt, Human
auugcugacuguagcu

SEQ ID NO: 3608404 - RNA, 15 nt, Human
auugcugacugugua

SEQ ID NO: 3608405 - RNA, 21 nt, Human
auugcugagagaaauauggaa

SEQ ID NO: 3608406 - RNA, 12 nt, Human
auugcugauuuu

SEQ ID NO: 3608407 - RNA, 14 nt, Human
auugcugccacuuu

SEQ ID NO: 3608408 - RNA, 21 nt, Human
auugcugccacuuuuuaacua

SEQ ID NO: 3608409 - RNA, 20 nt, Human
auugcugcuugaggcaacuc

SEQ ID NO: 3608410 - RNA, 18 nt, Human
auugcuggcuggaaggga

SEQ ID NO: 3608411 - RNA, 15 nt, Human
auugcuggucuugua

SEQ ID NO: 3608412 - RNA, 17 nt, Human
auugcuggucuuguaag

SEQ ID NO: 3608413 - RNA, 21 nt, Human
auugcugguucuauuuaaugg

SEQ ID NO: 3608414 - RNA, 14 nt, Human
auugcuguccugga

SEQ ID NO: 3608415 - RNA, 19 nt, Human
auugcugugaauuagcuca

SEQ ID NO: 3608416 - RNA, 11 nt, Human
auugcugugcc

SEQ ID NO: 3608417 - RNA, 15 nt, Human
auugcuguguaucug

SEQ ID NO: 3608418 - RNA, 15 nt, Human
auugcuguugaaagc

SEQ ID NO: 3608419 - RNA, 17 nt, Human
auugcuguugcuugaau

SEQ ID NO: 3608420 - RNA, 17 nt, Human
auugcuguugucccucu

SEQ ID NO: 3608421 - RNA, 21 nt, Human
auugcuguugucccucugcua

SEQ ID NO: 3608422 - RNA, 17 nt, Human
auugcuuaaaauagcaa

SEQ ID NO: 3608423 - RNA, 20 nt, Human
auugcuuacauuuuuacaau

SEQ ID NO: 3608424 - RNA, 23 nt, Human
auugcuuaguaaaauuuauuuca

SEQ ID NO: 3608425 - RNA, 17 nt, Human
auugcuuauuuauugua

SEQ ID NO: 3608426 - RNA, 16 nt, Human
auugcuuccuccuccc

SEQ ID NO: 3608427 - RNA, 22 nt, Human
auugcuucuguaguacuccuua

SEQ ID NO: 3608428 - RNA, 17 nt, Human
auugcuucuucuccuau

SEQ ID NO: 3608429 - RNA, 17 nt, Human
auugcuugagcccagga

SEQ ID NO: 3608430 - RNA, 13 nt, Human
auugcuuuacugg

SEQ ID NO: 3608431 - RNA, 16 nt, Human
auugcuuuauaaauaa

SEQ ID NO: 3608432 - RNA, 17 nt, Human
auugcuuuauaaauaaa

SEQ ID NO: 3608433 - RNA, 18 nt, Human
auugcuuucguguaaauu

SEQ ID NO: 3608434 - RNA, 16 nt, Human
auugcuuucugaaauu

SEQ ID NO: 3608435 - RNA, 16 nt, Human
auugcuuugaaaaagu

SEQ ID NO: 3608436 - RNA, 17 nt, Human
auugcuuugaaaaaguu

SEQ ID NO: 3608437 - RNA, 21 nt, Human
auugcuuugaagcaguugugu

SEQ ID NO: 3608438 - RNA, 12 nt, Human
auugcuuugagc

SEQ ID NO: 3608439 - RNA, 21 nt, Human
auugcuuugauuaauccagaa

SEQ ID NO: 3608440 - RNA, 14 nt, Human
auugcuuuggucau

SEQ ID NO: 3608441 - RNA, 16 nt, Human
auugcuuuuaaaacua

SEQ ID NO: 3608442 - RNA, 19 nt, Human
auugcuuuuaaaauuuuaa

SEQ ID NO: 3608443 - RNA, 16 nt, Human
auugcuuuuauuuuga

SEQ ID NO: 3608444 - RNA, 18 nt, Human
auugcuuuuauuuugaaa

SEQ ID NO: 3608445 - RNA, 19 nt, Human
auugcuuuuauuuugaaaa

SEQ ID NO: 3608446 - RNA, 14 nt, Human
auugcuuuugugca

SEQ ID NO: 3608447 - RNA, 20 nt, Human
auugcuuuuucuaauguggu

SEQ ID NO: 3608448 - RNA, 14 nt, Human
auugcuuuuuuaaa

SEQ ID NO: 3608449 - RNA, 17 nt, Human
auugcuuuuuuaaauau

SEQ ID NO: 3608450 - RNA, 21 nt, Human
auugcuuuuuuccaaaacaaa

SEQ ID NO: 3608451 - RNA, 13 nt, Human
auuggaaacaagu

SEQ ID NO: 3608452 - RNA, 13 nt, Human
auuggaaauuuca

SEQ ID NO: 3608453 - RNA, 14 nt, Human
auuggaaauuucac

SEQ ID NO: 3608454 - RNA, 15 nt, Human
auuggaaauuucacg

SEQ ID NO: 3608455 - RNA, 16 nt, Human
auuggaacagaauguu

SEQ ID NO: 3608456 - RNA, 15 nt, Human
auuggaacagugaau

SEQ ID NO: 3608457 - RNA, 14 nt, Human
auuggaacuggagg

SEQ ID NO: 3608458 - RNA, 21 nt, Human
auuggaagagcagcaccuccu

SEQ ID NO: 3608459 - RNA, 12 nt, Human
auuggaagcagg

SEQ ID NO: 3608460 - RNA, 14 nt, Human
auuggaaggagaca

SEQ ID NO: 3608461 - RNA, 14 nt, Human
auuggaauuaaccu

SEQ ID NO: 3608462 - RNA, 16 nt, Human
auuggaauuaaccugg

SEQ ID NO: 3608463 - RNA, 20 nt, Human
auuggaauuaaccuggugcu

SEQ ID NO: 3608464 - RNA, 17 nt, Human
auuggacaaagaaccuu

SEQ ID NO: 3608465 - RNA, 19 nt, Human
auuggacaguaaaauccac

SEQ ID NO: 3608466 - RNA, 19 nt, Human
auuggacauuaagcaucac

SEQ ID NO: 3608467 - RNA, 15 nt, Human
auuggacccuuccau

SEQ ID NO: 3608468 - RNA, 15 nt, Human
auuggaggaaagcaa

SEQ ID NO: 3608469 - RNA, 22 nt, Human
auuggaggguaaaugauguggu

SEQ ID NO: 3608470 - RNA, 23 nt, Human
auuggagggugggagagcccagc

SEQ ID NO: 3608471 - RNA, 16 nt, Human
auuggauaaagcagcu

SEQ ID NO: 3608472 - RNA, 23 nt, Human
auuggauacagcaguagacauuu

SEQ ID NO: 3608473 - RNA, 22 nt, Human
auuggauauuuuuuacuuuaga

SEQ ID NO: 3608474 - RNA, 16 nt, Human
auuggauuauuuaaua

SEQ ID NO: 3608475 - RNA, 18 nt, Human
auuggauuuuauguugac

SEQ ID NO: 3608476 - RNA, 19 nt, Human
auuggcaccgaagcccaga

SEQ ID NO: 3608477 - RNA, 15 nt, Human
auuggcauggaaauu

SEQ ID NO: 3608478 - RNA, 21 nt, Human
auuggcauggaaauuuaaagc

SEQ ID NO: 3608479 - RNA, 22 nt, Human
auuggcauggaaauuuaaagca

SEQ ID NO: 3608480 - RNA, 21 nt, Human
auuggcauggauuucugucuu

SEQ ID NO: 3608481 - RNA, 17 nt, Human
auuggcauguguauguu

SEQ ID NO: 3608482 - RNA, 11 nt, Human
auuggccugga

SEQ ID NO: 3608483 - RNA, 21 nt, Human
auuggccuguagaguugcuga

SEQ ID NO: 3608484 - RNA, 19 nt, Human
auuggcuauuuaaagacaa

SEQ ID NO: 3608485 - RNA, 15 nt, Human
auuggcucacacuga

SEQ ID NO: 3608486 - RNA, 16 nt, Human
auuggcucacacugag

SEQ ID NO: 3608487 - RNA, 18 nt, Human
auuggcuuguagaauugu

SEQ ID NO: 3608488 - RNA, 22 nt, Human
auuggcuuguagaauuguuaua

SEQ ID NO: 3608489 - RNA, 17 nt, Human
auuggcuuguguguuuc

SEQ ID NO: 3608490 - RNA, 18 nt, Human
auuggcuuguguguuuca

SEQ ID NO: 3608491 - RNA, 17 nt, Human
auuggcuuuauccucuu

SEQ ID NO: 3608492 - RNA, 13 nt, Human
auuggcuuuucug

SEQ ID NO: 3608493 - RNA, 16 nt, Human
auuggcuuuucugauc

SEQ ID NO: 3608494 - RNA, 15 nt, Human
auugggaaaacauuu

SEQ ID NO: 3608495 - RNA, 21 nt, Human
auugggagcuugggaauggau

SEQ ID NO: 3608496 - RNA, 19 nt, Human
auaacauuuguguguuaua

SEQ ID NO: 3608497 - RNA, 16 nt, Human
auaaccaaucuacaau

SEQ ID NO: 3608498 - RNA, 15 nt, Human
auaaccaauguuuaa

SEQ ID NO: 3608499 - RNA, 14 nt, Human
auaaccagcuguaa

SEQ ID NO: 3608500 - RNA, 19 nt, Human
auaaccagcuguaacacag

SEQ ID NO: 3608501 - RNA, 20 nt, Human
auaaccaguguuguggauuu

SEQ ID NO: 3608502 - RNA, 16 nt, Human
auaaccaucugaaagu

SEQ ID NO: 3608503 - RNA, 15 nt, Human
auaacccacuuguca

SEQ ID NO: 3608504 - RNA, 12 nt, Human
auaacccacuuu

SEQ ID NO: 3608505 - RNA, 20 nt, Human
auaaccccagcucccuagga

SEQ ID NO: 3608506 - RNA, 16 nt, Human
auaaccccauucuuug

SEQ ID NO: 3608507 - RNA, 22 nt, Human
auaaccugucucaccuggacuu

SEQ ID NO: 3608508 - RNA, 14 nt, Human
auaaccuuaauuua

SEQ ID NO: 3608509 - RNA, 18 nt, Human
auaacgcuuaaaggaagu

SEQ ID NO: 3608510 - RNA, 20 nt, Human
auaacggaucagaaauacag

SEQ ID NO: 3608511 - RNA, 14 nt, Human
auaacguauaaaag

SEQ ID NO: 3608512 - RNA, 18 nt, Human
auaacguuuuuccuuuaa

SEQ ID NO: 3608513 - RNA, 14 nt, Human
auaacuaaauaaag

SEQ ID NO: 3608514 - RNA, 19 nt, Human
auaacuaaauuugauacuu

SEQ ID NO: 3608515 - RNA, 20 nt, Human
auaacuaaauuugauacuua

SEQ ID NO: 3608516 - RNA, 16 nt, Human
auaacuaagcauccuu

SEQ ID NO: 3608517 - RNA, 17 nt, Human
auaacuacauauugaau

SEQ ID NO: 3608518 - RNA, 16 nt, Human
auaacuacuguguucc

SEQ ID NO: 3608519 - RNA, 16 nt, Human
auaacuaguguugcuu

SEQ ID NO: 3608520 - RNA, 19 nt, Human
auaacuaguguugcuugga

SEQ ID NO: 3608521 - RNA, 12 nt, Human
auaacuccuccc

SEQ ID NO: 3608522 - RNA, 16 nt, Human
auaacuccucccaggg

SEQ ID NO: 3608523 - RNA, 12 nt, Human
auaacuccuucu

SEQ ID NO: 3608524 - RNA, 19 nt, Human
auaacucugcacuacuccu

SEQ ID NO: 3608525 - RNA, 21 nt, Human
auaacucugcacuacuccucu

SEQ ID NO: 3608526 - RNA, 13 nt, Human
auaacucuguaaa

SEQ ID NO: 3608527 - RNA, 13 nt, Human
auaacucuuugga

SEQ ID NO: 3608528 - RNA, 22 nt, Human
auaacucuuuggauagcauguc

SEQ ID NO: 3608529 - RNA, 21 nt, Human
auaacugaaaauuauuuaaac

SEQ ID NO: 3608530 - RNA, 14 nt, Human
auaacugaaggaga

SEQ ID NO: 3608531 - RNA, 15 nt, Human
auaacugaauuugga

SEQ ID NO: 3608532 - RNA, 15 nt, Human
auaacugacuuaguu

SEQ ID NO: 3608533 - RNA, 23 nt, Human
auaacugcccagcggacaguggc

SEQ ID NO: 3608534 - RNA, 23 nt, Human
auaacuggaaaacagaacacuua

SEQ ID NO: 3608535 - RNA, 16 nt, Human
auaacuggaacacucu

SEQ ID NO: 3608536 - RNA, 20 nt, Human
auaacuguaaaugugacauu

SEQ ID NO: 3608537 - RNA, 18 nt, Human
auaacuguaauuauuuga

SEQ ID NO: 3608538 - RNA, 22 nt, Human
auaacuguaauuauuugaauga

SEQ ID NO: 3608539 - RNA, 22 nt, Human
auaacuguuauuuauaaucacu

SEQ ID NO: 3608540 - RNA, 19 nt, Human
auaacuuaaaaaaaugaca

SEQ ID NO: 3608541 - RNA, 20 nt, Human
auaacuuaaaaauguaaaua

SEQ ID NO: 3608542 - RNA, 15 nt, Human
auaacuuaaugaaaa

SEQ ID NO: 3608543 - RNA, 20 nt, Human
auaacuuauauuguaagaaa

SEQ ID NO: 3608544 - RNA, 21 nt, Human
auaacuuauauuguaagaaau

SEQ ID NO: 3608545 - RNA, 22 nt, Human
auaacuuauauuguaagaaaua

SEQ ID NO: 3608546 - RNA, 23 nt, Human
auaacuuauauuguaagaaauac

SEQ ID NO: 3608547 - RNA, 14 nt, Human
auaacuuauugcug

SEQ ID NO: 3608548 - RNA, 15 nt, Human
auaacuuauugcuga

SEQ ID NO: 3608549 - RNA, 18 nt, Human
auaacuuauugcugauuu

SEQ ID NO: 3608550 - RNA, 16 nt, Human
auaacuucaaauuuuu

SEQ ID NO: 3608551 - RNA, 16 nt, Human
auaacuucaagcaaac

SEQ ID NO: 3608552 - RNA, 12 nt, Human
auaacuucaguc

SEQ ID NO: 3608553 - RNA, 14 nt, Human
auaacuucaguccu

SEQ ID NO: 3608554 - RNA, 20 nt, Human
auaacuucaguccugcucca

SEQ ID NO: 3608555 - RNA, 11 nt, Human
auaacuucuga

SEQ ID NO: 3608556 - RNA, 14 nt, Human
auaacuucugaccu

SEQ ID NO: 3608557 - RNA, 17 nt, Human
auaacuucuuaaaaguu

SEQ ID NO: 3608558 - RNA, 21 nt, Human
auaacuugagaccuaaucucu

SEQ ID NO: 3608559 - RNA, 11 nt, Human
auaacuugaug

SEQ ID NO: 3608560 - RNA, 13 nt, Human
auaacuugucuaa

SEQ ID NO: 3608561 - RNA, 17 nt, Human
auaacuuuaacuucugu

SEQ ID NO: 3608562 - RNA, 16 nt, Human
auaacuuuagaaauaa

SEQ ID NO: 3608563 - RNA, 18 nt, Human
auaacuuuuuuuuaaguu

SEQ ID NO: 3608564 - RNA, 12 nt, Human
auaagaaaaacu

SEQ ID NO: 3608565 - RNA, 16 nt, Human
auaagaaaauauauuc

SEQ ID NO: 3608566 - RNA, 14 nt, Human
auaagaaacuuuuu

SEQ ID NO: 3608567 - RNA, 13 nt, Human
auaagaaagccug

SEQ ID NO: 3608568 - RNA, 22 nt, Human
auaagaaccuuuugagugccuu

SEQ ID NO: 3608569 - RNA, 11 nt, Human
auaagaagaau

SEQ ID NO: 3608570 - RNA, 13 nt, Human
auaagaagaaugc

SEQ ID NO: 3608571 - RNA, 19 nt, Human
auaagaagaaugcuuaauc

SEQ ID NO: 3608572 - RNA, 20 nt, Human
auaagaagaaugcuuaauca

SEQ ID NO: 3608573 - RNA, 20 nt, Human
auaagaagggauggauucca

SEQ ID NO: 3608574 - RNA, 15 nt, Human
auaagaauaaaaugu

SEQ ID NO: 3608575 - RNA, 20 nt, Human
auaagaauagaacaacauau

SEQ ID NO: 3608576 - RNA, 16 nt, Human
auaagaaugcugguuu

SEQ ID NO: 3608577 - RNA, 19 nt, Human
auaagaaugcugguuuucc

SEQ ID NO: 3608578 - RNA, 21 nt, Human
auaagaaugcugguuuuccua

SEQ ID NO: 3608579 - RNA, 15 nt, Human
auaagaauuugcaua

SEQ ID NO: 3608580 - RNA, 23 nt, Human
auaagacaaauauuccuuugcau

SEQ ID NO: 3608581 - RNA, 14 nt, Human
auaagacauaacgu

SEQ ID NO: 3608582 - RNA, 18 nt, Human
auaagagaaagaaaauga

SEQ ID NO: 3608583 - RNA, 20 nt, Human
auaagagaccuguuuuaaaa

SEQ ID NO: 3608584 - RNA, 12 nt, Human
auaagagauuug

SEQ ID NO: 3608585 - RNA, 16 nt, Human
auaagaguuggcuggu

SEQ ID NO: 3608586 - RNA, 13 nt, Human
auaagauaaaugu

SEQ ID NO: 3608587 - RNA, 15 nt, Human
auaagauauuuuauu

SEQ ID NO: 3608588 - RNA, 16 nt, Human
auaagauauuuuucau

SEQ ID NO: 3608589 - RNA, 13 nt, Human
auaagaucuuuua

SEQ ID NO: 3608590 - RNA, 15 nt, Human
auaagaucuuuuauu

SEQ ID NO: 3608591 - RNA, 20 nt, Human
auaagaucuuuuauuuugcc

SEQ ID NO: 3608592 - RNA, 14 nt, Human
auaagauucauauu

SEQ ID NO: 3608593 - RNA, 21 nt, Human
auaagauucauauuuacuucu

SEQ ID NO: 3608594 - RNA, 19 nt, Human
auaagauuccaaaaagcac

SEQ ID NO: 3608595 - RNA, 21 nt, Human
auaagauuccaaaaagcacau

SEQ ID NO: 3608596 - RNA, 13 nt, Human
auaagauucuaac

SEQ ID NO: 3608597 - RNA, 23 nt, Human
auaagcaaagggagcacuggguu

SEQ ID NO: 3608598 - RNA, 15 nt, Human
auaagcaaauuucaa

SEQ ID NO: 3608599 - RNA, 17 nt, Human
auaagcaacaauuuuca

SEQ ID NO: 3608600 - RNA, 22 nt, Human
auaagcaacaauuuucagauuu

SEQ ID NO: 3608601 - RNA, 16 nt, Human
auaagcaagaaggcaa

SEQ ID NO: 3608602 - RNA, 21 nt, Human
auaagcaagaaggcaaaaaua

SEQ ID NO: 3608603 - RNA, 20 nt, Human
auaagcacugaaaaacaaca

SEQ ID NO: 3608604 - RNA, 13 nt, Human
auaagcaggugga

SEQ ID NO: 3608605 - RNA, 17 nt, Human
auaagcagguggaucua

SEQ ID NO: 3608606 - RNA, 17 nt, Human
auaagcaucaaacucuu

SEQ ID NO: 3608607 - RNA, 18 nt, Human
auaagcauugaaauuaua

SEQ ID NO: 3608608 - RNA, 19 nt, Human
auaagccaaaacugagcau

SEQ ID NO: 3608609 - RNA, 14 nt, Human
auaagccaaaauua

SEQ ID NO: 3608610 - RNA, 14 nt, Human
auaagccaauuuuu

SEQ ID NO: 3608611 - RNA, 23 nt, Human
auaagccaauuuuucugcacuga

SEQ ID NO: 3608612 - RNA, 21 nt, Human
auaagccagacaucaacagau

SEQ ID NO: 3608613 - RNA, 18 nt, Human
auaagccaugagaauguu

SEQ ID NO: 3608614 - RNA, 14 nt, Human
auaagcuaguugaa

SEQ ID NO: 3608615 - RNA, 22 nt, Human
auaagcuaguugaauacuugaa

SEQ ID NO: 3608616 - RNA, 20 nt, Human
auaagcuauccguguugcag

SEQ ID NO: 3608617 - RNA, 13 nt, Human
auaagcuauuuga

SEQ ID NO: 3608618 - RNA, 18 nt, Human
auaagcuauuuuucuaac

SEQ ID NO: 3608619 - RNA, 22 nt, Human
auaagcuuccauuuuaauuuua

SEQ ID NO: 3608620 - RNA, 13 nt, Human
auaagcuuuucuu

SEQ ID NO: 3608621 - RNA, 14 nt, Human
auaagcuuuucuuu

SEQ ID NO: 3608622 - RNA, 16 nt, Human
auaaggaaaaguuuaa

SEQ ID NO: 3608623 - RNA, 20 nt, Human
auaaggaaaucaacuugcuu

SEQ ID NO: 3608624 - RNA, 22 nt, Human
auaaggaaaucaacuugcuuau

SEQ ID NO: 3608625 - RNA, 12 nt, Human
auaaggaaauuu

SEQ ID NO: 3608626 - RNA, 13 nt, Human
auaaggaagaaac

SEQ ID NO: 3608627 - RNA, 14 nt, Human
auaaggacugcaug

SEQ ID NO: 3608628 - RNA, 15 nt, Human
auaaggacuuccuga

SEQ ID NO: 3608629 - RNA, 13 nt, Human
auaaggauuuuuc

SEQ ID NO: 3608630 - RNA, 11 nt, Human
auaaggcaggg

SEQ ID NO: 3608631 - RNA, 19 nt, Human
auaaggccauaaaacaggu

SEQ ID NO: 3608632 - RNA, 18 nt, Human
auaaggccuuaauauguu

SEQ ID NO: 3608633 - RNA, 15 nt, Human
auaagggaaaagaua

SEQ ID NO: 3608634 - RNA, 16 nt, Human
auaagggaaaagauaa

SEQ ID NO: 3608635 - RNA, 21 nt, Human
auaagggagcguagaaucugu

SEQ ID NO: 3608636 - RNA, 15 nt, Human
auaagggcagaguca

SEQ ID NO: 3608637 - RNA, 16 nt, Human
auaaggggagaguaac

SEQ ID NO: 3608638 - RNA, 20 nt, Human
auaagggguuugccauuuga

SEQ ID NO: 3608639 - RNA, 23 nt, Human
auaagggucccccacucuaaagc

SEQ ID NO: 3608640 - RNA, 21 nt, Human
auaagguguuuucuguguaac

SEQ ID NO: 3608641 - RNA, 17 nt, Human
auaagguuuaaaaagau

SEQ ID NO: 3608642 - RNA, 19 nt, Human
auaagguuuuaauuuagua

SEQ ID NO: 3608643 - RNA, 23 nt, Human
auaaguaaagugauuaaagugcu

SEQ ID NO: 3608644 - RNA, 13 nt, Human
auaaguaagaaaa

SEQ ID NO: 3608645 - RNA, 14 nt, Human
auaaguaagaaaau

SEQ ID NO: 3608646 - RNA, 17 nt, Human
auaaguaagaaaauauu

SEQ ID NO: 3608647 - RNA, 20 nt, Human
auucgagcuauauuuaagua

SEQ ID NO: 3608648 - RNA, 17 nt, Human
auucgcucccacauucu

SEQ ID NO: 3608649 - RNA, 20 nt, Human
auucggaacuguccuuuccu

SEQ ID NO: 3608650 - RNA, 21 nt, Human
auucggugugcaccaggguug

SEQ ID NO: 3608651 - RNA, 23 nt, Human
auucgguguggugcagugugaaa

SEQ ID NO: 3608652 - RNA, 19 nt, Human
auucgugaaaacacauuug

SEQ ID NO: 3608653 - RNA, 21 nt, Human
auucgugcagcauaugaggau

SEQ ID NO: 3608654 - RNA, 13 nt, Human
auucguucugugg

SEQ ID NO: 3608655 - RNA, 20 nt, Human
auucguuguguuuuuuaaga

SEQ ID NO: 3608656 - RNA, 20 nt, Human
auucuaaaaugugauguucu

SEQ ID NO: 3608657 - RNA, 22 nt, Human
auucuaaaaugugauguucuaa

SEQ ID NO: 3608658 - RNA, 17 nt, Human
auucuaaacagacucau

SEQ ID NO: 3608659 - RNA, 18 nt, Human
auucuaaagauucuauag

SEQ ID NO: 3608660 - RNA, 20 nt, Human
auucuaaagauucuauaguu

SEQ ID NO: 3608661 - RNA, 16 nt, Human
auucuaaauaaaauau

SEQ ID NO: 3608662 - RNA, 19 nt, Human
auucuaaauaaaauauaau

SEQ ID NO: 3608663 - RNA, 20 nt, Human
auucuaaauaaaauauaauu

SEQ ID NO: 3608664 - RNA, 21 nt, Human
auucuaaauaaaauauaauug

SEQ ID NO: 3608665 - RNA, 15 nt, Human
auucuaaaugaaugu

SEQ ID NO: 3608666 - RNA, 15 nt, Human
auucuaaccuggagg

SEQ ID NO: 3608667 - RNA, 18 nt, Human
auucuaacggucuguucu

SEQ ID NO: 3608668 - RNA, 20 nt, Human
auucuaagaaauaucuguga

SEQ ID NO: 3608669 - RNA, 21 nt, Human
auucuaagaaauaucugugaa

SEQ ID NO: 3608670 - RNA, 23 nt, Human
auucuaagaaauaucugugaaau

SEQ ID NO: 3608671 - RNA, 15 nt, Human
auucuaagugaaauu

SEQ ID NO: 3608672 - RNA, 16 nt, Human
auucuaauaagcuagu

SEQ ID NO: 3608673 - RNA, 20 nt, Human
auucuaauaagcuaguugaa

SEQ ID NO: 3608674 - RNA, 21 nt, Human
auucuaaugauggcccauucu

SEQ ID NO: 3608675 - RNA, 18 nt, Human
auucuaaugucuucauuu

SEQ ID NO: 3608676 - RNA, 13 nt, Human
auucuacuugcuc

SEQ ID NO: 3608677 - RNA, 17 nt, Human
auucuacuugcucugga

SEQ ID NO: 3608678 - RNA, 21 nt, Human
auucuacuugcucuggaccug

SEQ ID NO: 3608679 - RNA, 22 nt, Human
auucuacuugcucuggaccugc

SEQ ID NO: 3608680 - RNA, 16 nt, Human
auucuacuuugagugc

SEQ ID NO: 3608681 - RNA, 23 nt, Human
auucuagaucagaugcuccaaga

SEQ ID NO: 3608682 - RNA, 18 nt, Human
auucuagcuaauguaaua

SEQ ID NO: 3608683 - RNA, 16 nt, Human
auucuaggcaucccag

SEQ ID NO: 3608684 - RNA, 20 nt, Human
auucuaggccuccuggccca

SEQ ID NO: 3608685 - RNA, 14 nt, Human
auucuagugcugcu

SEQ ID NO: 3608686 - RNA, 15 nt, Human
auucuagugcugcug

SEQ ID NO: 3608687 - RNA, 16 nt, Human
auucuaguuuugucaa

SEQ ID NO: 3608688 - RNA, 15 nt, Human
auucuauaaggccau

SEQ ID NO: 3608689 - RNA, 12 nt, Human
auucuauaauuu

SEQ ID NO: 3608690 - RNA, 17 nt, Human
auucuauaugaauuuaa

SEQ ID NO: 3608691 - RNA, 19 nt, Human
auucuauaugaauuuaaau

SEQ ID NO: 3608692 - RNA, 15 nt, Human
auucuaucuacugau

SEQ ID NO: 3608693 - RNA, 17 nt, Human
auucuaucuacugauuu

SEQ ID NO: 3608694 - RNA, 15 nt, Human
auucuaucuauuccu

SEQ ID NO: 3608695 - RNA, 17 nt, Human
auucuauggagcuauuu

SEQ ID NO: 3608696 - RNA, 13 nt, Human
auucuauguguca

SEQ ID NO: 3608697 - RNA, 14 nt, Human
auucuaugugucau

SEQ ID NO: 3608698 - RNA, 15 nt, Human
auucuauguuaauau

SEQ ID NO: 3608699 - RNA, 18 nt, Human
auucuauguuaauauuuu

SEQ ID NO: 3608700 - RNA, 14 nt, Human
auucuauuaacuuu

SEQ ID NO: 3608701 - RNA, 18 nt, Human
auucuauuacauuuucag

SEQ ID NO: 3608702 - RNA, 22 nt, Human
auucuauugcaguuauagaaaa

SEQ ID NO: 3608703 - RNA, 22 nt, Human
auucuauugccuucuuugaaga

SEQ ID NO: 3608704 - RNA, 12 nt, Human
auucuauuucaa

SEQ ID NO: 3608705 - RNA, 15 nt, Human
auucucaaacacagu

SEQ ID NO: 3608706 - RNA, 13 nt, Human
auucucaaagcag

SEQ ID NO: 3608707 - RNA, 19 nt, Human
auucucaaaguuuccuaau

SEQ ID NO: 3608708 - RNA, 16 nt, Human
auucucaagcccugca

SEQ ID NO: 3608709 - RNA, 19 nt, Human
auucucaagccgcauccca

SEQ ID NO: 3608710 - RNA, 21 nt, Human
auucucaagggacguccucca

SEQ ID NO: 3608711 - RNA, 21 nt, Human
auucucacagcuccaagaauu

SEQ ID NO: 3608712 - RNA, 22 nt, Human
auucucacagcuccaagaauuu

SEQ ID NO: 3608713 - RNA, 18 nt, Human
auucucaccagcuguguc

SEQ ID NO: 3608714 - RNA, 14 nt, Human
auucucaccaggaa

SEQ ID NO: 3608715 - RNA, 16 nt, Human
auucucaccaggaagg

SEQ ID NO: 3608716 - RNA, 14 nt, Human
auucucacuccacc

SEQ ID NO: 3608717 - RNA, 16 nt, Human
auucucagauauuuau

SEQ ID NO: 3608718 - RNA, 14 nt, Human
auucucagcagagu

SEQ ID NO: 3608719 - RNA, 18 nt, Human
auucucagggucucugcu

SEQ ID NO: 3608720 - RNA, 19 nt, Human
auucucagggucucugcug

SEQ ID NO: 3608721 - RNA, 14 nt, Human
auucucaguuuuuc

SEQ ID NO: 3608722 - RNA, 16 nt, Human
auucucauaauuccua

SEQ ID NO: 3608723 - RNA, 22 nt, Human
auucucauaauuccuacagcac

SEQ ID NO: 3608724 - RNA, 13 nt, Human
auucucaucugca

SEQ ID NO: 3608725 - RNA, 21 nt, Human
auucucaugccucagccuccu

SEQ ID NO: 3608726 - RNA, 16 nt, Human
auucucauggagaagu

SEQ ID NO: 3608727 - RNA, 12 nt, Human
auucucauguga

SEQ ID NO: 3608728 - RNA, 16 nt, Human
auucuccacagcaacc

SEQ ID NO: 3608729 - RNA, 17 nt, Human
auucuccaccugccagg

SEQ ID NO: 3608730 - RNA, 23 nt, Human
auucucccgggacucugcauauu

SEQ ID NO: 3608731 - RNA, 17 nt, Human
auucuccuccucccucc

SEQ ID NO: 3608732 - RNA, 11 nt, Human
auucuccugcc

SEQ ID NO: 3608733 - RNA, 12 nt, Human
auucuccugccu

SEQ ID NO: 3608734 - RNA, 13 nt, Human
auucuccugccuc

SEQ ID NO: 3608735 - RNA, 14 nt, Human
auucuccugccuca

SEQ ID NO: 3608736 - RNA, 15 nt, Human
auucuccugccucag

SEQ ID NO: 3608737 - RNA, 17 nt, Human
auucuccugccucagcc

SEQ ID NO: 3608738 - RNA, 11 nt, Human
auucuccugga

SEQ ID NO: 3608739 - RNA, 13 nt, Human
auucuccugugcu

SEQ ID NO: 3608740 - RNA, 18 nt, Human
auucuccuucagcccuca

SEQ ID NO: 3608741 - RNA, 19 nt, Human
auucuccuuguguuacuaa

SEQ ID NO: 3608742 - RNA, 19 nt, Human
auucucgugagucauuuaa

SEQ ID NO: 3608743 - RNA, 14 nt, Human
auucucuccaaaaa

SEQ ID NO: 3608744 - RNA, 16 nt, Human
auucucuccucagacu

SEQ ID NO: 3608745 - RNA, 18 nt, Human
auucucuccucagacugc

SEQ ID NO: 3608746 - RNA, 10 nt, Human
auucucucuc

SEQ ID NO: 3608747 - RNA, 22 nt, Human
auucucuggcuguaaggcucua

SEQ ID NO: 3608748 - RNA, 13 nt, Human
auucucugucuca

SEQ ID NO: 3608749 - RNA, 15 nt, Human
auucucuuguauaag

SEQ ID NO: 3608750 - RNA, 18 nt, Human
auucucuuguauaagauc

SEQ ID NO: 3608751 - RNA, 22 nt, Human
auucucuuguauaagauccuag

SEQ ID NO: 3608752 - RNA, 12 nt, Human
auucucuuuggu

SEQ ID NO: 3608753 - RNA, 12 nt, Human
auucucuuuuca

SEQ ID NO: 3608754 - RNA, 19 nt, Human
auucugaagcaacauuuua

SEQ ID NO: 3608755 - RNA, 16 nt, Human
auucugaaggagcccc

SEQ ID NO: 3608756 - RNA, 15 nt, Human
auucugaaguuauau

SEQ ID NO: 3608757 - RNA, 18 nt, Human
auucugaaguuauauuuc

SEQ ID NO: 3608758 - RNA, 22 nt, Human
auucugaaguuauauuuccuau

SEQ ID NO: 3608759 - RNA, 14 nt, Human
auucugaaucucaa

SEQ ID NO: 3608760 - RNA, 10 nt, Human
auucugaaug

SEQ ID NO: 3608761 - RNA, 16 nt, Human
auucugaaugcuucua

SEQ ID NO: 3608762 - RNA, 17 nt, Human
auucugaaugcuucuaa

SEQ ID NO: 3608763 - RNA, 22 nt, Human
auucugaaugcuucuaaguaaa

SEQ ID NO: 3608764 - RNA, 23 nt, Human
auucugaauuaauuaauuuggag

SEQ ID NO: 3608765 - RNA, 20 nt, Human
auucugaccacccuucucau

SEQ ID NO: 3608766 - RNA, 18 nt, Human
auucugacucgguuucuc

SEQ ID NO: 3608767 - RNA, 14 nt, Human
auucugagaaaaca

SEQ ID NO: 3608768 - RNA, 17 nt, Human
auucugagccugauauu

SEQ ID NO: 3608769 - RNA, 18 nt, Human
auucugaggcccugccca

SEQ ID NO: 3608770 - RNA, 17 nt, Human
auucugaguuuuguguu

SEQ ID NO: 3608771 - RNA, 23 nt, Human
auucugauuauugaguuccaguu

SEQ ID NO: 3608772 - RNA, 13 nt, Human
auucugauuccac

SEQ ID NO: 3608773 - RNA, 22 nt, Human
auucugauucgaaugacacugu

SEQ ID NO: 3608774 - RNA, 21 nt, Human
auucugauucuggcuuuaagc

SEQ ID NO: 3608775 - RNA, 20 nt, Human
auucugauuucuuuucacca

SEQ ID NO: 3608776 - RNA, 15 nt, Human
auucugcagcaugac

SEQ ID NO: 3608777 - RNA, 18 nt, Human
auucugcaguaaaucuuu

SEQ ID NO: 3608778 - RNA, 23 nt, Human
auucugcaguaaaucuuuuacaa

SEQ ID NO: 3608779 - RNA, 18 nt, Human
auucugcccaaaaauaug

SEQ ID NO: 3608780 - RNA, 17 nt, Human
auucugcccuccuuaau

SEQ ID NO: 3608781 - RNA, 17 nt, Human
auucugccucucuagga

SEQ ID NO: 3608782 - RNA, 11 nt, Human
auucugccugc

SEQ ID NO: 3608783 - RNA, 20 nt, Human
auucugccugcccaggcccc

SEQ ID NO: 3608784 - RNA, 20 nt, Human
auucugccuuugcagaaaca

SEQ ID NO: 3608785 - RNA, 22 nt, Human
auucugccuuugcagaaacaga

SEQ ID NO: 3608786 - RNA, 19 nt, Human
auucugccuuugccaggug

SEQ ID NO: 3608787 - RNA, 13 nt, Human
auucugcuccuuc

SEQ ID NO: 3608788 - RNA, 22 nt, Human
auucuggacaggauguguuugc

SEQ ID NO: 3608789 - RNA, 16 nt, Human
auucuggaccucuggg

SEQ ID NO: 3608790 - RNA, 17 nt, Human
auucuggauaaagccac

SEQ ID NO: 3608791 - RNA, 22 nt, Human
auucuggauggauuugaagcaa

SEQ ID NO: 3608792 - RNA, 18 nt, Human
auucuggcugauaaaaga

SEQ ID NO: 3608793 - RNA, 16 nt, Human
auucuggcuuuaagcc

SEQ ID NO: 3608794 - RNA, 16 nt, Human
auucugggggcugcag

SEQ ID NO: 3608795 - RNA, 17 nt, Human
auucuguaaaagaaaaa

SEQ ID NO: 3608796 - RNA, 20 nt, Human
auucuguaaaaugucuguua

SEQ ID NO: 3608797 - RNA, 17 nt, Human
ccuugcuuuucccucuu

SEQ ID NO: 3608798 - RNA, 18 nt, Human
ccuugcuuuucccucuuu

SEQ ID NO: 3608799 - RNA, 15 nt, Human
ccuugcuuuugcuuc

SEQ ID NO: 3608800 - RNA, 17 nt, Human
ccuuggaaaccugcccu

SEQ ID NO: 3608801 - RNA, 18 nt, Human
ccuuggaaaccugcccug

SEQ ID NO: 3608802 - RNA, 13 nt, Human
ccuuggacuugag

SEQ ID NO: 3608803 - RNA, 19 nt, Human
ccuuggagagacacagcgu

SEQ ID NO: 3608804 - RNA, 22 nt, Human
ccuuggauaaugcuguugccuc

SEQ ID NO: 3608805 - RNA, 19 nt, Human
ccuuggauuguccccgacc

SEQ ID NO: 3608806 - RNA, 23 nt, Human
ccuuggcaccaaagaugcagccg

SEQ ID NO: 3608807 - RNA, 19 nt, Human
ccuuggcaucacagggcag

SEQ ID NO: 3608808 - RNA, 18 nt, Human
ccuuggcaucuagagcuu

SEQ ID NO: 3608809 - RNA, 18 nt, Human
ccuuggccagaagucaag

SEQ ID NO: 3608810 - RNA, 17 nt, Human
ccuuggccaugcagaaa

SEQ ID NO: 3608811 - RNA, 21 nt, Human
ccuuggcccccuuucccgggc

SEQ ID NO: 3608812 - RNA, 23 nt, Human
ccuuggccgcaccuaaagcagcc

SEQ ID NO: 3608813 - RNA, 16 nt, Human
ccuuggccggcugugc

SEQ ID NO: 3608814 - RNA, 22 nt, Human
ccuuggccuagcccacccugcu

SEQ ID NO: 3608815 - RNA, 23 nt, Human
ccuuggccugucucauccccagg

SEQ ID NO: 3608816 - RNA, 12 nt, Human
ccuuggcuggug

SEQ ID NO: 3608817 - RNA, 21 nt, Human
ccuuggcugugaggccccugg

SEQ ID NO: 3608818 - RNA, 18 nt, Human
ccuuggcuuaccugaccu

SEQ ID NO: 3608819 - RNA, 18 nt, Human
ccuuggcuuggcccuggc

SEQ ID NO: 3608820 - RNA, 19 nt, Human
ccuuggcuuggcccuggca

SEQ ID NO: 3608821 - RNA, 20 nt, Human
ccuuggcuuggcccuggcag

SEQ ID NO: 3608822 - RNA, 19 nt, Human
ccuuggcuuuaugcacauu

SEQ ID NO: 3608823 - RNA, 21 nt, Human
ccuuggcuuuuacugaagccu

SEQ ID NO: 3608824 - RNA, 12 nt, Human
ccuugggacccc

SEQ ID NO: 3608825 - RNA, 15 nt, Human
ccuugggaggaagca

SEQ ID NO: 3608826 - RNA, 20 nt, Human
ccuugggaggaagcagaaua

SEQ ID NO: 3608827 - RNA, 15 nt, Human
ccuugggaggcccca

SEQ ID NO: 3608828 - RNA, 23 nt, Human
ccuugggccagaaguaccagacu

SEQ ID NO: 3608829 - RNA, 23 nt, Human
ccuugggcccacaccuccuuccc

SEQ ID NO: 3608830 - RNA, 12 nt, Human
ccuugggcccuu

SEQ ID NO: 3608831 - RNA, 14 nt, Human
ccuugggcggcuga

SEQ ID NO: 3608832 - RNA, 12 nt, Human
ccuugggcuccc

SEQ ID NO: 3608833 - RNA, 21 nt, Human
ccuugggcuccgugugggaga

SEQ ID NO: 3608834 - RNA, 14 nt, Human
ccuugggcucugau

SEQ ID NO: 3608835 - RNA, 14 nt, Human
ccuugggcugcucc

SEQ ID NO: 3608836 - RNA, 18 nt, Human
ccuugggcugcuccucau

SEQ ID NO: 3608837 - RNA, 17 nt, Human
ccuuggggaauuuccuc

SEQ ID NO: 3608838 - RNA, 23 nt, Human
ccuuggggaggacaaaacuucuu

SEQ ID NO: 3608839 - RNA, 14 nt, Human
ccuuggggcaggca

SEQ ID NO: 3608840 - RNA, 16 nt, Human
ccuuggggcaggcagu

SEQ ID NO: 3608841 - RNA, 21 nt, Human
ccuuggguauuugcaauauuc

SEQ ID NO: 3608842 - RNA, 18 nt, Human
ccuuggguuagaccuaca

SEQ ID NO: 3608843 - RNA, 22 nt, Human
ccuuggguuagaccuacagggg

SEQ ID NO: 3608844 - RNA, 21 nt, Human
ccuuggucuuuguaucuucca

SEQ ID NO: 3608845 - RNA, 17 nt, Human
ccuugguggcaagagcc

SEQ ID NO: 3608846 - RNA, 18 nt, Human
ccuugguguaguugaacu

SEQ ID NO: 3608847 - RNA, 15 nt, Human
ccuugguguccaccu

SEQ ID NO: 3608848 - RNA, 19 nt, Human
ccuugguguccaccuggcc

SEQ ID NO: 3608849 - RNA, 21 nt, Human
ccuuggugucgggcaugacac

SEQ ID NO: 3608850 - RNA, 19 nt, Human
ccuuggugugacccucuga

SEQ ID NO: 3608851 - RNA, 18 nt, Human
ccuugguucaucaguguu

SEQ ID NO: 3608852 - RNA, 21 nt, Human
ccuugguuuuuacugcucuga

SEQ ID NO: 3608853 - RNA, 23 nt, Human
ccuugguuuuuacugcucugaga

SEQ ID NO: 3608854 - RNA, 16 nt, Human
ccuuguaauguaacug

SEQ ID NO: 3608855 - RNA, 19 nt, Human
ccuuguaauucuaaaugaa

SEQ ID NO: 3608856 - RNA, 14 nt, Human
ccuuguagcuccuc

SEQ ID NO: 3608857 - RNA, 15 nt, Human
ccuuguagcuccucc

SEQ ID NO: 3608858 - RNA, 17 nt, Human
ccuuguagcuccucccc

SEQ ID NO: 3608859 - RNA, 17 nt, Human
ccuuguauccccugcag

SEQ ID NO: 3608860 - RNA, 13 nt, Human
ccuuguauuuaaa

SEQ ID NO: 3608861 - RNA, 21 nt, Human
ccuuguauuuaaauauuaaau

SEQ ID NO: 3608862 - RNA, 13 nt, Human
ccuuguccccaca

SEQ ID NO: 3608863 - RNA, 16 nt, Human
ccuuguccccacacuc

SEQ ID NO: 3608864 - RNA, 17 nt, Human
ccuuguccccacacucc

SEQ ID NO: 3608865 - RNA, 15 nt, Human
ccuuguccccugccu

SEQ ID NO: 3608866 - RNA, 21 nt, Human
ccuugucggccccaccagugc

SEQ ID NO: 3608867 - RNA, 23 nt, Human
ccuugucggccccaccagugccu

SEQ ID NO: 3608868 - RNA, 21 nt, Human
ccuugucguugacuuuaggga

SEQ ID NO: 3608869 - RNA, 20 nt, Human
ccuugucuccuacuccugac

SEQ ID NO: 3608870 - RNA, 17 nt, Human
ccuugucugaacuggag

SEQ ID NO: 3608871 - RNA, 13 nt, Human
ccuugucugagau

SEQ ID NO: 3608872 - RNA, 18 nt, Human
ccuugugaucacuuucug

SEQ ID NO: 3608873 - RNA, 20 nt, Human
ccuugugaucacuuucugaa

SEQ ID NO: 3608874 - RNA, 17 nt, Human
ccuugugccuggcucag

SEQ ID NO: 3608875 - RNA, 15 nt, Human
ccuuguggcacauuu

SEQ ID NO: 3608876 - RNA, 14 nt, Human
cgcauuccaggcuc

SEQ ID NO: 3608877 - RNA, 13 nt, Human
cgcauucucaugg

SEQ ID NO: 3608878 - RNA, 19 nt, Human
cgccaagcaaccugggucc

SEQ ID NO: 3608879 - RNA, 16 nt, Human
cgccaauaaaccaaug

SEQ ID NO: 3608880 - RNA, 21 nt, Human
cgccacagcccagccacggac

SEQ ID NO: 3608881 - RNA, 20 nt, Human
cgccacagcccuuuugucuc

SEQ ID NO: 3608882 - RNA, 13 nt, Human
cgccacaggaccc

SEQ ID NO: 3608883 - RNA, 11 nt, Human
cgccacauccc

SEQ ID NO: 3608884 - RNA, 15 nt, Human
cgccacauggcuucc

SEQ ID NO: 3608885 - RNA, 17 nt, Human
cgccacauggcuuccuc

SEQ ID NO: 3608886 - RNA, 13 nt, Human
cgccaccauccug

SEQ ID NO: 3608887 - RNA, 23 nt, Human
cgccaccauccugcagccuccuc

SEQ ID NO: 3608888 - RNA, 13 nt, Human
cgccacugcacuc

SEQ ID NO: 3608889 - RNA, 20 nt, Human
cgccacugcacuccggccug

SEQ ID NO: 3608890 - RNA, 15 nt, Human
cgccacuggggcuca

SEQ ID NO: 3608891 - RNA, 23 nt, Human
cgccagaacugcuuuaucccacg

SEQ ID NO: 3608892 - RNA, 14 nt, Human
cgccagagggcuug

SEQ ID NO: 3608893 - RNA, 15 nt, Human
cgccagauggggccu

SEQ ID NO: 3608894 - RNA, 19 nt, Human
cgccagauucuuuccugag

SEQ ID NO: 3608895 - RNA, 21 nt, Human
cgccagauucuuuccugaggc

SEQ ID NO: 3608896 - RNA, 22 nt, Human
cgccagauucuuuccugaggcu

SEQ ID NO: 3608897 - RNA, 12 nt, Human
cgccagcagaca

SEQ ID NO: 3608898 - RNA, 12 nt, Human
cgccagcucugu

SEQ ID NO: 3608899 - RNA, 19 nt, Human
cgccagcucuguucuuccu

SEQ ID NO: 3608900 - RNA, 13 nt, Human
cgccagcugauga

SEQ ID NO: 3608901 - RNA, 16 nt, Human
cgccaggacuuggccu

SEQ ID NO: 3608902 - RNA, 23 nt, Human
cgccaggcugaccacagcacagc

SEQ ID NO: 3608903 - RNA, 18 nt, Human
cgccagggagaccuggac

SEQ ID NO: 3608904 - RNA, 14 nt, Human
cgccaguacuuguc

SEQ ID NO: 3608905 - RNA, 14 nt, Human
cgccauugccacca

SEQ ID NO: 3608906 - RNA, 18 nt, Human
cgccauugccaccaggag

SEQ ID NO: 3608907 - RNA, 17 nt, Human
cgcccaaagccagacag

SEQ ID NO: 3608908 - RNA, 18 nt, Human
cgcccaaaggacgcacug

SEQ ID NO: 3608909 - RNA, 16 nt, Human
cgcccaacccuucccc

SEQ ID NO: 3608910 - RNA, 18 nt, Human
cgcccaacuaauuuuugu

SEQ ID NO: 3608911 - RNA, 12 nt, Human
cgcccaaggccc

SEQ ID NO: 3608912 - RNA, 18 nt, Human
cgcccacaggaagccugc

SEQ ID NO: 3608913 - RNA, 20 nt, Human
cgcccacaggaagccugcag

SEQ ID NO: 3608914 - RNA, 22 nt, Human
cgcccacaggaagccugcaguc

SEQ ID NO: 3608915 - RNA, 21 nt, Human
cgcccaccgcaugcccccucg

SEQ ID NO: 3608916 - RNA, 12 nt, Human
cgcccacugucc

SEQ ID NO: 3608917 - RNA, 15 nt, Human
cgcccacuguccugg

SEQ ID NO: 3608918 - RNA, 16 nt, Human
cgcccacuguccuggg

SEQ ID NO: 3608919 - RNA, 19 nt, Human
cgcccacuguccugggcgc

SEQ ID NO: 3608920 - RNA, 12 nt, Human
cgcccacuuccc

SEQ ID NO: 3608921 - RNA, 13 nt, Human
cgcccacuucccu

SEQ ID NO: 3608922 - RNA, 22 nt, Human
cgcccagcuccugacacugcug

SEQ ID NO: 3608923 - RNA, 20 nt, Human
cgcccagcugcaccugccag

SEQ ID NO: 3608924 - RNA, 14 nt, Human
cgcccaggacccca

SEQ ID NO: 3608925 - RNA, 23 nt, Human
cgcccaggaucagauugcaugug

SEQ ID NO: 3608926 - RNA, 12 nt, Human
cgcccaggcugg

SEQ ID NO: 3608927 - RNA, 15 nt, Human
cgcccaggcuggcca

SEQ ID NO: 3608928 - RNA, 19 nt, Human
cgcccaggcuggccagccc

SEQ ID NO: 3608929 - RNA, 22 nt, Human
cgcccaggcuggccagccccac

SEQ ID NO: 3608930 - RNA, 22 nt, Human
cgcccaggcuuagucacugaga

SEQ ID NO: 3608931 - RNA, 14 nt, Human
cgcccagucccagc

SEQ ID NO: 3608932 - RNA, 16 nt, Human
cgcccagucccagcag

SEQ ID NO: 3608933 - RNA, 17 nt, Human
cgcccagucccagcagc

SEQ ID NO: 3608934 - RNA, 13 nt, Human
cgcccagucugga

SEQ ID NO: 3608935 - RNA, 21 nt, Human
cgcccagucuggaaugcagug

SEQ ID NO: 3608936 - RNA, 23 nt, Human
cgcccaguuggguggaugccugg

SEQ ID NO: 3608937 - RNA, 13 nt, Human
cgcccauguguga

SEQ ID NO: 3608938 - RNA, 12 nt, Human
cgccccacccag

SEQ ID NO: 3608939 - RNA, 19 nt, Human
cgccccagauaccagcccc

SEQ ID NO: 3608940 - RNA, 20 nt, Human
cgccccagauaccagccccu

SEQ ID NO: 3608941 - RNA, 14 nt, Human
cgggcucucugcug

SEQ ID NO: 3608942 - RNA, 16 nt, Human
cgggcugagggccugc

SEQ ID NO: 3608943 - RNA, 14 nt, Human
cgggcugccugggc

SEQ ID NO: 3608944 - RNA, 15 nt, Human
cgggcugggcagcug

SEQ ID NO: 3608945 - RNA, 14 nt, Human
cggggaacuccugg

SEQ ID NO: 3608946 - RNA, 15 nt, Human
cggggaacuccugga

SEQ ID NO: 3608947 - RNA, 16 nt, Human
cggggaacuccuggaa

SEQ ID NO: 3608948 - RNA, 22 nt, Human
cggggaacuggccaagcugagg

SEQ ID NO: 3608949 - RNA, 12 nt, Human
cggggaagagau

SEQ ID NO: 3608950 - RNA, 19 nt, Human
cggggaagagauccaaaga

SEQ ID NO: 3608951 - RNA, 20 nt, Human
cggggaagagauccaaagac

SEQ ID NO: 3608952 - RNA, 13 nt, Human
cggggaaggauuu

SEQ ID NO: 3608953 - RNA, 14 nt, Human
cggggacagaggcc

SEQ ID NO: 3608954 - RNA, 18 nt, Human
cggggacagaggccugcc

SEQ ID NO: 3608955 - RNA, 21 nt, Human
cggggacagaggccugcccgg

SEQ ID NO: 3608956 - RNA, 14 nt, Human
cggggacagcuccu

SEQ ID NO: 3608957 - RNA, 15 nt, Human
cggggacagcuccuu

SEQ ID NO: 3608958 - RNA, 22 nt, Human
cggggacagcuccuucuguccu

SEQ ID NO: 3608959 - RNA, 21 nt, Human
cggggaggccaagugcaggcu

SEQ ID NO: 3608960 - RNA, 23 nt, Human
cggggaggccaagugcaggcugg

SEQ ID NO: 3608961 - RNA, 18 nt, Human
cggggcagcagcagcccu

SEQ ID NO: 3608962 - RNA, 21 nt, Human
cggggcagcagcagcccugcc

SEQ ID NO: 3608963 - RNA, 12 nt, Human
cggggcagggca

SEQ ID NO: 3608964 - RNA, 17 nt, Human
cggggcaugcuggggca

SEQ ID NO: 3608965 - RNA, 14 nt, Human
cggggccagaggca

SEQ ID NO: 3608966 - RNA, 14 nt, Human
cggggcccagggca

SEQ ID NO: 3608967 - RNA, 19 nt, Human
cggggccugggcaggaggg

SEQ ID NO: 3608968 - RNA, 22 nt, Human
cggggccuugcgguauccgccc

SEQ ID NO: 3608969 - RNA, 16 nt, Human
cggggcucuucucauu

SEQ ID NO: 3608970 - RNA, 22 nt, Human
cggggcuucugugcaccugggc

SEQ ID NO: 3608971 - RNA, 16 nt, Human
cggggcuugccuucug

SEQ ID NO: 3608972 - RNA, 18 nt, Human
cggggcuugccuucuggu

SEQ ID NO: 3608973 - RNA, 15 nt, Human
cggggcuuggcugag

SEQ ID NO: 3608974 - RNA, 15 nt, Human
cgggggcagagaggg

SEQ ID NO: 3608975 - RNA, 13 nt, Human
cgggggcagcuga

SEQ ID NO: 3608976 - RNA, 18 nt, Human
cgggggcagucugagaga

SEQ ID NO: 3608977 - RNA, 13 nt, Human
cgggggcuggggc

SEQ ID NO: 3608978 - RNA, 22 nt, Human
cggggggaggguuggggagggg

SEQ ID NO: 3608979 - RNA, 15 nt, Human
cgggguauccugggg

SEQ ID NO: 3608980 - RNA, 15 nt, Human
cggggugcacaggag

SEQ ID NO: 3608981 - RNA, 16 nt, Human
cggggugcacaggagg

SEQ ID NO: 3608982 - RNA, 18 nt, Human
cggggugcacaggagggg

SEQ ID NO: 3608983 - RNA, 12 nt, Human
cgggguggagca

SEQ ID NO: 3608984 - RNA, 22 nt, Human
cggggugggguggcugcagccu

SEQ ID NO: 3608985 - RNA, 18 nt, Human
cgggguggugggaaccau

SEQ ID NO: 3608986 - RNA, 21 nt, Human
cggggugucugucuuccuuug

SEQ ID NO: 3608987 - RNA, 11 nt, Human
cgggucacagg

SEQ ID NO: 3608988 - RNA, 22 nt, Human
cgggucaucuguaccucugccu

SEQ ID NO: 3608989 - RNA, 17 nt, Human
cgggucccuucaccucc

SEQ ID NO: 3608990 - RNA, 13 nt, Human
cgggucugccucu

SEQ ID NO: 3608991 - RNA, 14 nt, Human
cgggucugcuccca

SEQ ID NO: 3608992 - RNA, 16 nt, Human
cgggucuuccuacucu

SEQ ID NO: 3608993 - RNA, 18 nt, Human
cgggugcucagggcugac

SEQ ID NO: 3608994 - RNA, 15 nt, Human
cggguggcaggugga

SEQ ID NO: 3608995 - RNA, 14 nt, Human
cggguggggaaagg

SEQ ID NO: 3608996 - RNA, 22 nt, Human
cgggugugcaaugucugaguga

SEQ ID NO: 3608997 - RNA, 15 nt, Human
cgggugugggaaagc

SEQ ID NO: 3608998 - RNA, 13 nt, Human
cgguacccaccac

SEQ ID NO: 3608999 - RNA, 12 nt, Human
cgguacucccau

SEQ ID NO: 3609000 - RNA, 16 nt, Human
cgguagggaggcagcc

SEQ ID NO: 3609001 - RNA, 16 nt, Human
cgguauuaugcuucuu

SEQ ID NO: 3609002 - RNA, 12 nt, Human
cggucacugaug

SEQ ID NO: 3609003 - RNA, 16 nt, Human
cggucagguuuaacau

SEQ ID NO: 3609004 - RNA, 18 nt, Human
cggucagguuuaacauuu

SEQ ID NO: 3609005 - RNA, 16 nt, Human
cgguccagcuggccug

SEQ ID NO: 3609006 - RNA, 21 nt, Human
cgguccagcuggccuggacag

SEQ ID NO: 3609007 - RNA, 12 nt, Human
cggucccagcuc

SEQ ID NO: 3609008 - RNA, 21 nt, Human
cggucccaguuuuguugcccc

SEQ ID NO: 3609009 - RNA, 18 nt, Human
cgguccccuccgccaggc

SEQ ID NO: 3609010 - RNA, 19 nt, Human
cggucccuugagaccucag

SEQ ID NO: 3609011 - RNA, 23 nt, Human
cggucccuugagaccucagccau

SEQ ID NO: 3609012 - RNA, 11 nt, Human
cgguccugucu

SEQ ID NO: 3609013 - RNA, 22 nt, Human
cggucggguuuuauuguuuaaa

SEQ ID NO: 3609014 - RNA, 22 nt, Human
cggucucggaucaggcucccag

SEQ ID NO: 3609015 - RNA, 14 nt, Human
cggucugugccccu

SEQ ID NO: 3609016 - RNA, 16 nt, Human
cggucuugacagcuca

SEQ ID NO: 3609017 - RNA, 13 nt, Human
cggugaauggcuu

SEQ ID NO: 3609018 - RNA, 14 nt, Human
cggugaauggcuuu

SEQ ID NO: 3609019 - RNA, 16 nt, Human
cggugagaacucugcc

SEQ ID NO: 3609020 - RNA, 21 nt, Human
cggugagaggggaacagacug

SEQ ID NO: 3609021 - RNA, 14 nt, Human
cggugcagucuggg

SEQ ID NO: 3609022 - RNA, 16 nt, Human
cggugcagucugggug

SEQ ID NO: 3609023 - RNA, 17 nt, Human
cggugccagguuuucug

SEQ ID NO: 3609024 - RNA, 14 nt, Human
cggugccaugucug

SEQ ID NO: 3609025 - RNA, 15 nt, Human
cggugcccaagccag

SEQ ID NO: 3609026 - RNA, 18 nt, Human
cggugcccaagccagagg

SEQ ID NO: 3609027 - RNA, 23 nt, Human
cggugcccaagccagaggcuggg

SEQ ID NO: 3609028 - RNA, 17 nt, Human
cggugcggcagggaaga

SEQ ID NO: 3609029 - RNA, 18 nt, Human
cggugcucggagaagagc

SEQ ID NO: 3609030 - RNA, 17 nt, Human
cggugcuguccucaggu

SEQ ID NO: 3609031 - RNA, 16 nt, Human
cggugcugugagggag

SEQ ID NO: 3609032 - RNA, 14 nt, Human
cgguggcccugucc

SEQ ID NO: 3609033 - RNA, 20 nt, Human
cgguggcuagucaagcuccu

SEQ ID NO: 3609034 - RNA, 22 nt, Human
cgguggcuagucaagcuccucc

SEQ ID NO: 3609035 - RNA, 11 nt, Human
cgguggcucac

SEQ ID NO: 3609036 - RNA, 20 nt, Human
cgguggcucacgccuguaau

SEQ ID NO: 3609037 - RNA, 23 nt, Human
cggugggcacccacccugggacc

SEQ ID NO: 3609038 - RNA, 21 nt, Human
cggugguaccaggucuccucc

SEQ ID NO: 3609039 - RNA, 15 nt, Human
cgguggugaggcagu

SEQ ID NO: 3609040 - RNA, 19 nt, Human
cgguguccccaccaucugc

SEQ ID NO: 3609041 - RNA, 17 nt, Human
cggugugccugcagccc

SEQ ID NO: 3609042 - RNA, 18 nt, Human
cgguguggagaagcggcu

SEQ ID NO: 3609043 - RNA, 18 nt, Human
cgguguuauuccaaggga

SEQ ID NO: 3609044 - RNA, 13 nt, Human
cgguguucuaaga

SEQ ID NO: 3609045 - RNA, 19 nt, Human
cgguucaguguuucugggg

SEQ ID NO: 3609046 - RNA, 21 nt, Human
cgguuccucguucucccuggg

SEQ ID NO: 3609047 - RNA, 16 nt, Human
cgguuccugucccugc

SEQ ID NO: 3609048 - RNA, 14 nt, Human
cgguugaaaccugu

SEQ ID NO: 3609049 - RNA, 15 nt, Human
cgguugcuucuggga

SEQ ID NO: 3609050 - RNA, 21 nt, Human
cgguuggagcgagcauccccc

SEQ ID NO: 3609051 - RNA, 20 nt, Human
cgguuuaucgcccuggcagg

SEQ ID NO: 3609052 - RNA, 17 nt, Human
cguaaaaacugaaguuc

SEQ ID NO: 3609053 - RNA, 13 nt, Human
cguaagcacuguu

SEQ ID NO: 3609054 - RNA, 15 nt, Human
cguaagcacuguuuu

SEQ ID NO: 3609055 - RNA, 13 nt, Human
cguaagcaguaua

SEQ ID NO: 3609056 - RNA, 23 nt, Human
cguaagcaguauauuaguauuau

SEQ ID NO: 3609057 - RNA, 16 nt, Human
cguaaguacagagaag

SEQ ID NO: 3609058 - RNA, 18 nt, Human
cguaaguacagagaagcc

SEQ ID NO: 3609059 - RNA, 20 nt, Human
cguaaguacagagaagccau

SEQ ID NO: 3609060 - RNA, 17 nt, Human
cguaauaauuauuauua

SEQ ID NO: 3609061 - RNA, 16 nt, Human
cguaauuaaaagaauu

SEQ ID NO: 3609062 - RNA, 19 nt, Human
cguacaaguaguucuguau

SEQ ID NO: 3609063 - RNA, 16 nt, Human
cguacacauuuuauuu

SEQ ID NO: 3609064 - RNA, 22 nt, Human
cguacacauuuuauuuuauuau

SEQ ID NO: 3609065 - RNA, 22 nt, Human
cguacaguucuucgggaagaga

SEQ ID NO: 3609066 - RNA, 15 nt, Human
cguacauaauacuga

SEQ ID NO: 3609067 - RNA, 14 nt, Human
cguacaugugaggc

SEQ ID NO: 3609068 - RNA, 13 nt, Human
cguacauguuuau

SEQ ID NO: 3609069 - RNA, 15 nt, Human
cguacauucaauguu

SEQ ID NO: 3609070 - RNA, 17 nt, Human
cguacucuuuggggcag

SEQ ID NO: 3609071 - RNA, 22 nt, Human
cguagauauuggacaaagaacc

SEQ ID NO: 3609072 - RNA, 18 nt, Human
cguagaucaccagaauaa

SEQ ID NO: 3609073 - RNA, 16 nt, Human
cguagccagcugcucc

SEQ ID NO: 3609074 - RNA, 22 nt, Human
cguagcuucuaccaugaacaga

SEQ ID NO: 3609075 - RNA, 21 nt, Human
cguaggaugaaaagauucuuc

SEQ ID NO: 3609076 - RNA, 14 nt, Human
cguaggcuacagag

SEQ ID NO: 3609077 - RNA, 16 nt, Human
cguaggcuacagagaa

SEQ ID NO: 3609078 - RNA, 19 nt, Human
cguaggcuacagagaagcc

SEQ ID NO: 3609079 - RNA, 23 nt, Human
cguaggcuacagagaagccuuca

SEQ ID NO: 3609080 - RNA, 18 nt, Human
cguagucggcacagccug

SEQ ID NO: 3609081 - RNA, 15 nt, Human
cguauagcuguauug

SEQ ID NO: 3609082 - RNA, 16 nt, Human
cguauaggcauguaaa

SEQ ID NO: 3609083 - RNA, 17 nt, Human
cguauauauaagaaaga

SEQ ID NO: 3609084 - RNA, 16 nt, Human
cguaucccgagucugg

SEQ ID NO: 3609085 - RNA, 12 nt, Human
cguaugaaaaug

SEQ ID NO: 3609086 - RNA, 20 nt, Human
cguaugcaguguagauuuua

SEQ ID NO: 3609087 - RNA, 17 nt, Human
cgugccguuacucucca

SEQ ID NO: 3609088 - RNA, 13 nt, Human
cgugccuucagcu

SEQ ID NO: 3609089 - RNA, 23 nt, Human
cgugcuacccccaugcuggaggu

SEQ ID NO: 3609090 - RNA, 16 nt, Human
cgugcugacagcugcu

SEQ ID NO: 3609091 - RNA, 13 nt, Human
cgugcugggcagc

SEQ ID NO: 3609092 - RNA, 19 nt, Human
cgugcugggcggcugugcu

SEQ ID NO: 3609093 - RNA, 18 nt, Human
cgugcuuagccuccugac

SEQ ID NO: 3609094 - RNA, 16 nt, Human
cguggaaccucugucu

SEQ ID NO: 3609095 - RNA, 18 nt, Human
cguggaaccucugucuca

SEQ ID NO: 3609096 - RNA, 15 nt, Human
cguggaacguuuuuc

SEQ ID NO: 3609097 - RNA, 14 nt, Human
cguggacaccugcc

SEQ ID NO: 3609098 - RNA, 20 nt, Human
cguggacuccagacucucug

SEQ ID NO: 3609099 - RNA, 22 nt, Human
cguggacuccagacucucugug

SEQ ID NO: 3609100 - RNA, 21 nt, Human
cguggacugagugggaagccc

SEQ ID NO: 3609101 - RNA, 22 nt, Human
cguggacuuggggucagagacu

SEQ ID NO: 3609102 - RNA, 17 nt, Human
cguggagaaucacaggc

SEQ ID NO: 3609103 - RNA, 18 nt, Human
cguggagagcuaggagca

SEQ ID NO: 3609104 - RNA, 13 nt, Human
cgccucccuccac

SEQ ID NO: 3609105 - RNA, 15 nt, Human
cgccucccuccaccc

SEQ ID NO: 3609106 - RNA, 22 nt, Human
cgccuccgggacccccaggaca

SEQ ID NO: 3609107 - RNA, 19 nt, Human
cgccucgcccaccgcaugc

SEQ ID NO: 3609108 - RNA, 22 nt, Human
cgccucugcaagggcagaacac

SEQ ID NO: 3609109 - RNA, 21 nt, Human
cgccugacaaccacuggucug

SEQ ID NO: 3609110 - RNA, 11 nt, Human
cgccugagccc

SEQ ID NO: 3609111 - RNA, 13 nt, Human
cgccugagcccag

SEQ ID NO: 3609112 - RNA, 19 nt, Human
cgccugagcccagggaggc

SEQ ID NO: 3609113 - RNA, 21 nt, Human
cgccugagcccagggaggccg

SEQ ID NO: 3609114 - RNA, 22 nt, Human
cgccugcaaacgcugccugccc

SEQ ID NO: 3609115 - RNA, 15 nt, Human
cgccugccaguccua

SEQ ID NO: 3609116 - RNA, 17 nt, Human
cgccugcccaccugccu

SEQ ID NO: 3609117 - RNA, 21 nt, Human
cgccugcccaccugccuggcc

SEQ ID NO: 3609118 - RNA, 23 nt, Human
cgccugcccgucucucucccaug

SEQ ID NO: 3609119 - RNA, 21 nt, Human
cgccuggcaguccgugggacg

SEQ ID NO: 3609120 - RNA, 13 nt, Human
cgccuggccagga

SEQ ID NO: 3609121 - RNA, 11 nt, Human
cgccuggccuc

SEQ ID NO: 3609122 - RNA, 13 nt, Human
cgccuggccucca

SEQ ID NO: 3609123 - RNA, 15 nt, Human
cgccuggccuccagg

SEQ ID NO: 3609124 - RNA, 16 nt, Human
cgccuggccuccaggc

SEQ ID NO: 3609125 - RNA, 17 nt, Human
cgccuggccuccaggcc

SEQ ID NO: 3609126 - RNA, 20 nt, Human
cgccuggccuccaggcccgu

SEQ ID NO: 3609127 - RNA, 17 nt, Human
cgccuggguccagggga

SEQ ID NO: 3609128 - RNA, 17 nt, Human
cgccuguaaucccagcu

SEQ ID NO: 3609129 - RNA, 20 nt, Human
cgccuguaaucccagcuacu

SEQ ID NO: 3609130 - RNA, 18 nt, Human
cgccuguagucccagcca

SEQ ID NO: 3609131 - RNA, 15 nt, Human
cgccugugaugcugg

SEQ ID NO: 3609132 - RNA, 13 nt, Human
cgccugugcacac

SEQ ID NO: 3609133 - RNA, 14 nt, Human
cgccugugcacaca

SEQ ID NO: 3609134 - RNA, 19 nt, Human
cgccuguggagcucagccc

SEQ ID NO: 3609135 - RNA, 13 nt, Human
cgccuucccuccu

SEQ ID NO: 3609136 - RNA, 22 nt, Human
cgccuuccgccccuucccuucc

SEQ ID NO: 3609137 - RNA, 13 nt, Human
cgccuucuccccc

SEQ ID NO: 3609138 - RNA, 21 nt, Human
cgccuucucccccccggggcu

SEQ ID NO: 3609139 - RNA, 16 nt, Human
cgccuuggccuguguu

SEQ ID NO: 3609140 - RNA, 21 nt, Human
cgccuugucuccuacuccuga

SEQ ID NO: 3609141 - RNA, 19 nt, Human
cgccuuuccucucuauauu

SEQ ID NO: 3609142 - RNA, 23 nt, Human
cgccuuuccuuuucgccuuuccu

SEQ ID NO: 3609143 - RNA, 13 nt, Human
cgccuuuuguaua

SEQ ID NO: 3609144 - RNA, 14 nt, Human
cgcgacaaugcaaa

SEQ ID NO: 3609145 - RNA, 16 nt, Human
cgcgaccauguggcca

SEQ ID NO: 3609146 - RNA, 14 nt, Human
cgcgaucucagcuc

SEQ ID NO: 3609147 - RNA, 20 nt, Human
cgcgauguggaacugcugcc

SEQ ID NO: 3609148 - RNA, 21 nt, Human
cgcgauguggaacugcugcca

SEQ ID NO: 3609149 - RNA, 23 nt, Human
cgcgauguggaacugcugccacu

SEQ ID NO: 3609150 - RNA, 18 nt, Human
cgcgcacacacacacaua

SEQ ID NO: 3609151 - RNA, 19 nt, Human
cgcgcagaugugcagcaga

SEQ ID NO: 3609152 - RNA, 23 nt, Human
cgcgccacuacacuccagccuga

SEQ ID NO: 3609153 - RNA, 15 nt, Human
cgcgccacucgcuuc

SEQ ID NO: 3609154 - RNA, 20 nt, Human
cgcgccacucgcuuccccca

SEQ ID NO: 3609155 - RNA, 18 nt, Human
cgcgccccccucccagag

SEQ ID NO: 3609156 - RNA, 19 nt, Human
cgcgccccccucccagagg

SEQ ID NO: 3609157 - RNA, 13 nt, Human
cgcgccccuagcc

SEQ ID NO: 3609158 - RNA, 17 nt, Human
cgcgcccgccccugcag

SEQ ID NO: 3609159 - RNA, 19 nt, Human
cgcgccuucucccccccgg

SEQ ID NO: 3609160 - RNA, 23 nt, Human
cgcgccuucucccccccggggcu

SEQ ID NO: 3609161 - RNA, 19 nt, Human
cgcgcgucccccugccggc

SEQ ID NO: 3609162 - RNA, 13 nt, Human
cgcgcucugcuca

SEQ ID NO: 3609163 - RNA, 17 nt, Human
cgcggacauccccugcu

SEQ ID NO: 3609164 - RNA, 15 nt, Human
cgcggcggagcuggc

SEQ ID NO: 3609165 - RNA, 19 nt, Human
cgcggcucccggggcaggg

SEQ ID NO: 3609166 - RNA, 11 nt, Human
cgcggcuggga

SEQ ID NO: 3609167 - RNA, 20 nt, Human
cgcggggcugucggcgcugc

SEQ ID NO: 3609168 - RNA, 17 nt, Human
cgcgguacaaaggaaaa

SEQ ID NO: 3609169 - RNA, 13 nt, Human
cgcgguggcucac

SEQ ID NO: 3609170 - RNA, 13 nt, Human
cgcgucuccuguu

SEQ ID NO: 3609171 - RNA, 13 nt, Human
cgcgucuuccuga

SEQ ID NO: 3609172 - RNA, 16 nt, Human
cgcgucuuccugagug

SEQ ID NO: 3609173 - RNA, 13 nt, Human
cgcguugaaauug

SEQ ID NO: 3609174 - RNA, 21 nt, Human
cgcguugaaauuguaauuaua

SEQ ID NO: 3609175 - RNA, 22 nt, Human
cgcguugaaauuguaauuauau

SEQ ID NO: 3609176 - RNA, 16 nt, Human
cgcguuguaaaauaua

SEQ ID NO: 3609177 - RNA, 17 nt, Human
cgcuaaacuuuucugau

SEQ ID NO: 3609178 - RNA, 22 nt, Human
cgcuaaagagcccuugccuccc

SEQ ID NO: 3609179 - RNA, 19 nt, Human
cgcuaacuugcuuaaaugu

SEQ ID NO: 3609180 - RNA, 20 nt, Human
cgcuaacuugcuuaaaugug

SEQ ID NO: 3609181 - RNA, 16 nt, Human
cgcuaagagggaggga

SEQ ID NO: 3609182 - RNA, 21 nt, Human
cgcuaagagggagggagggcu

SEQ ID NO: 3609183 - RNA, 20 nt, Human
cgcuacccgggaagggggcu

SEQ ID NO: 3609184 - RNA, 17 nt, Human
cgcuagagcagcccaaa

SEQ ID NO: 3609185 - RNA, 18 nt, Human
cgcuagaggaagcagcca

SEQ ID NO: 3609186 - RNA, 20 nt, Human
cgcuagaugggcauggggug

SEQ ID NO: 3609187 - RNA, 23 nt, Human
cgcuagaugggcauggggugggc

SEQ ID NO: 3609188 - RNA, 16 nt, Human
cgcuagcacagcuccc

SEQ ID NO: 3609189 - RNA, 15 nt, Human
cgcuaggcucgccuu

SEQ ID NO: 3609190 - RNA, 18 nt, Human
cgcuaggcucgccuuccc

SEQ ID NO: 3609191 - RNA, 22 nt, Human
cgcuaggcucgccuucccuccu

SEQ ID NO: 3609192 - RNA, 20 nt, Human
cgcuagguagagucugaggg

SEQ ID NO: 3609193 - RNA, 16 nt, Human
cgcuauuccagcuguc

SEQ ID NO: 3609194 - RNA, 17 nt, Human
cgcucaccuagagccag

SEQ ID NO: 3609195 - RNA, 18 nt, Human
cgcucaccuagagccaga

SEQ ID NO: 3609196 - RNA, 16 nt, Human
cgcucagcccucccug

SEQ ID NO: 3609197 - RNA, 20 nt, Human
cgcucagggccaugcugagg

SEQ ID NO: 3609198 - RNA, 21 nt, Human
cgcucagggccaugcugaggc

SEQ ID NO: 3609199 - RNA, 22 nt, Human
cgcucagggccaugcugaggcc

SEQ ID NO: 3609200 - RNA, 20 nt, Human
cgcucaugggccccucugac

SEQ ID NO: 3609201 - RNA, 17 nt, Human
cgcuccccgccuguucc

SEQ ID NO: 3609202 - RNA, 13 nt, Human
cgcucccgggacu

SEQ ID NO: 3609203 - RNA, 15 nt, Human
cgcucccucccagga

SEQ ID NO: 3609204 - RNA, 21 nt, Human
cgcucccucccaggacucuga

SEQ ID NO: 3609205 - RNA, 18 nt, Human
cgcuccugcagccccagc

SEQ ID NO: 3609206 - RNA, 18 nt, Human
cgcuccugccgcagagcu

SEQ ID NO: 3609207 - RNA, 19 nt, Human
cgcuccugccgcagagcug

SEQ ID NO: 3609208 - RNA, 22 nt, Human
cgcuccugcuaacggugcucag

SEQ ID NO: 3609209 - RNA, 23 nt, Human
cgcuccugcuaacggugcucagg

SEQ ID NO: 3609210 - RNA, 17 nt, Human
cgcuccuggcccagccu

SEQ ID NO: 3609211 - RNA, 15 nt, Human
cgcucgccccaccgg

SEQ ID NO: 3609212 - RNA, 14 nt, Human
cgcucggaggcccc

SEQ ID NO: 3609213 - RNA, 15 nt, Human
cgcucguguguucua

SEQ ID NO: 3609214 - RNA, 14 nt, Human
cgcucucuuccugc

SEQ ID NO: 3609215 - RNA, 23 nt, Human
cgcucucuuccugccccucuuuc

SEQ ID NO: 3609216 - RNA, 22 nt, Human
cgcucugcaugcggcccagccc

SEQ ID NO: 3609217 - RNA, 23 nt, Human
cgcucugcaugcggcccagcccg

SEQ ID NO: 3609218 - RNA, 16 nt, Human
cgcucugcuggccugg

SEQ ID NO: 3609219 - RNA, 18 nt, Human
cgcucugcuggccuggcc

SEQ ID NO: 3609220 - RNA, 21 nt, Human
cgcucugcuggccuggccggc

SEQ ID NO: 3609221 - RNA, 15 nt, Human
cgcucugucacccag

SEQ ID NO: 3609222 - RNA, 20 nt, Human
cgcucuguggaugccagggc

SEQ ID NO: 3609223 - RNA, 21 nt, Human
cgcucuguggaugccagggcc

SEQ ID NO: 3609224 - RNA, 19 nt, Human
cgcucuguugcccaggcug

SEQ ID NO: 3609225 - RNA, 21 nt, Human
cgcucuuggcagguacucagc

SEQ ID NO: 3609226 - RNA, 13 nt, Human
cgcucuuuuccua

SEQ ID NO: 3609227 - RNA, 14 nt, Human
cgcugaauaaaugu

SEQ ID NO: 3609228 - RNA, 15 nt, Human
cgcugaauaaauguc

SEQ ID NO: 3609229 - RNA, 16 nt, Human
cgcugacuucauggaa

SEQ ID NO: 3609230 - RNA, 17 nt, Human
cgcugagacugugcugu

SEQ ID NO: 3609231 - RNA, 16 nt, Human
cuaaguugggaucuag

SEQ ID NO: 3609232 - RNA, 13 nt, Human
cuaaguuucuaag

SEQ ID NO: 3609233 - RNA, 14 nt, Human
cuaaguuucuaaga

SEQ ID NO: 3609234 - RNA, 17 nt, Human
cuaaguuucuaagauuc

SEQ ID NO: 3609235 - RNA, 20 nt, Human
cuaaguuuuaggguacaugu

SEQ ID NO: 3609236 - RNA, 14 nt, Human
cuaaguuuuuaugg

SEQ ID NO: 3609237 - RNA, 11 nt, Human
cuaauaaaaag

SEQ ID NO: 3609238 - RNA, 18 nt, Human
cuaauaaaaagcuuuugu

SEQ ID NO: 3609239 - RNA, 10 nt, Human
cuaauaaaac

SEQ ID NO: 3609240 - RNA, 14 nt, Human
cuaauaaaacugau

SEQ ID NO: 3609241 - RNA, 18 nt, Human
cuaauaaaacugauguga

SEQ ID NO: 3609242 - RNA, 13 nt, Human
cuaauaaaauauc

SEQ ID NO: 3609243 - RNA, 15 nt, Human
cuaauaaaauaucau

SEQ ID NO: 3609244 - RNA, 19 nt, Human
cuaauaaaauaucauucag

SEQ ID NO: 3609245 - RNA, 22 nt, Human
cuaauaaaauaucauucagcaa

SEQ ID NO: 3609246 - RNA, 14 nt, Human
cuaauaaaauauuu

SEQ ID NO: 3609247 - RNA, 18 nt, Human
cuaauaaacuaauaauug

SEQ ID NO: 3609248 - RNA, 17 nt, Human
cuaauaaauuauacaaa

SEQ ID NO: 3609249 - RNA, 17 nt, Human
cuaauaacaugugaaaa

SEQ ID NO: 3609250 - RNA, 16 nt, Human
cuaauaauaaauaguu

SEQ ID NO: 3609251 - RNA, 15 nt, Human
cuaauaaucuuguuu

SEQ ID NO: 3609252 - RNA, 21 nt, Human
cuaauaaucuuguuucugaaa

SEQ ID NO: 3609253 - RNA, 22 nt, Human
cuaauaaugagcuauuaaaacu

SEQ ID NO: 3609254 - RNA, 15 nt, Human
cuaauaauuucuaau

SEQ ID NO: 3609255 - RNA, 17 nt, Human
cuaauaauuucuaaugu

SEQ ID NO: 3609256 - RNA, 18 nt, Human
cuaauaauuucuaauguu

SEQ ID NO: 3609257 - RNA, 19 nt, Human
cuaauacagcaacaauuua

SEQ ID NO: 3609258 - RNA, 23 nt, Human
cuaauacagcaacaauuuaugaa

SEQ ID NO: 3609259 - RNA, 17 nt, Human
cuaauacagcugagcua

SEQ ID NO: 3609260 - RNA, 18 nt, Human
cuaauacauuaaagcagu

SEQ ID NO: 3609261 - RNA, 15 nt, Human
cuaauaccucugugu

SEQ ID NO: 3609262 - RNA, 20 nt, Human
cuaauagaauaaaggcaguu

SEQ ID NO: 3609263 - RNA, 17 nt, Human
cuaauagacaauuuauu

SEQ ID NO: 3609264 - RNA, 19 nt, Human
cuaauagacaauuuauuau

SEQ ID NO: 3609265 - RNA, 23 nt, Human
cuaauagugaucaagaagacuuu

SEQ ID NO: 3609266 - RNA, 23 nt, Human
cuaauaguuuuauuaauaaacau

SEQ ID NO: 3609267 - RNA, 13 nt, Human
cuaauauauauga

SEQ ID NO: 3609268 - RNA, 15 nt, Human
cuaauauauaugaau

SEQ ID NO: 3609269 - RNA, 18 nt, Human
cuaauauauaugaauaaa

SEQ ID NO: 3609270 - RNA, 13 nt, Human
cuaauauauuuaa

SEQ ID NO: 3609271 - RNA, 14 nt, Human
cuaauauauuuaaa

SEQ ID NO: 3609272 - RNA, 12 nt, Human
cuaauauauuuu

SEQ ID NO: 3609273 - RNA, 21 nt, Human
cuaauauauuuuuauauuuag

SEQ ID NO: 3609274 - RNA, 16 nt, Human
cuaauauccacuuguc

SEQ ID NO: 3609275 - RNA, 17 nt, Human
cuaauauggcaaccauu

SEQ ID NO: 3609276 - RNA, 13 nt, Human
cuaauauuaaaaa

SEQ ID NO: 3609277 - RNA, 16 nt, Human
cuaauauuuauugcuu

SEQ ID NO: 3609278 - RNA, 14 nt, Human
cuaauauuuuaugu

SEQ ID NO: 3609279 - RNA, 17 nt, Human
cuaauauuuuccuccug

SEQ ID NO: 3609280 - RNA, 19 nt, Human
cuaaucaaagccagggucu

SEQ ID NO: 3609281 - RNA, 21 nt, Human
cuaaucacaguuuuuccugga

SEQ ID NO: 3609282 - RNA, 15 nt, Human
cuaaucaccauguaa

SEQ ID NO: 3609283 - RNA, 18 nt, Human
cuaaucaccauguaagca

SEQ ID NO: 3609284 - RNA, 17 nt, Human
cuaaucagcauucucac

SEQ ID NO: 3609285 - RNA, 20 nt, Human
cuaaucagggaggucauuuu

SEQ ID NO: 3609286 - RNA, 15 nt, Human
cuaaucagugucuca

SEQ ID NO: 3609287 - RNA, 20 nt, Human
cuaaucagugucucacacug

SEQ ID NO: 3609288 - RNA, 15 nt, Human
cuaauccaacccaug

SEQ ID NO: 3609289 - RNA, 23 nt, Human
cuaauccaggcagauccaggacu

SEQ ID NO: 3609290 - RNA, 20 nt, Human
cuaauccccuucuccccugc

SEQ ID NO: 3609291 - RNA, 23 nt, Human
cuaaucccugggcauugcuuucc

SEQ ID NO: 3609292 - RNA, 15 nt, Human
cuaaucgaacuauga

SEQ ID NO: 3609293 - RNA, 18 nt, Human
cuaaucuaacaauggaag

SEQ ID NO: 3609294 - RNA, 16 nt, Human
cuaaucuacuuucugu

SEQ ID NO: 3609295 - RNA, 19 nt, Human
cuaaucuauuggguucauu

SEQ ID NO: 3609296 - RNA, 20 nt, Human
cuaaucuauuggguucauua

SEQ ID NO: 3609297 - RNA, 21 nt, Human
cuaaucuguagggcuggaccu

SEQ ID NO: 3609298 - RNA, 19 nt, Human
cuaaucugugcuguuucaa

SEQ ID NO: 3609299 - RNA, 12 nt, Human
cgggcaugacac

SEQ ID NO: 3609300 - RNA, 15 nt, Human
cgggcaugacacgaa

SEQ ID NO: 3609301 - RNA, 16 nt, Human
cgggcauggcagcccu

SEQ ID NO: 3609302 - RNA, 12 nt, Human
cgggccaaggac

SEQ ID NO: 3609303 - RNA, 14 nt, Human
cgggccacagagaa

SEQ ID NO: 3609304 - RNA, 18 nt, Human
cgggccacuccuuccugc

SEQ ID NO: 3609305 - RNA, 14 nt, Human
cgggccagccaggc

SEQ ID NO: 3609306 - RNA, 18 nt, Human
cgggccagccaggcgggc

SEQ ID NO: 3609307 - RNA, 14 nt, Human
cgggccagugcucc

SEQ ID NO: 3609308 - RNA, 18 nt, Human
cgggccagugcuccagcc

SEQ ID NO: 3609309 - RNA, 15 nt, Human
cgggcccaccuggcc

SEQ ID NO: 3609310 - RNA, 18 nt, Human
cgggcccaccuggccacc

SEQ ID NO: 3609311 - RNA, 14 nt, Human
cgggcccagaggag

SEQ ID NO: 3609312 - RNA, 15 nt, Human
cgggcccagaggagc

SEQ ID NO: 3609313 - RNA, 17 nt, Human
cgggccccaccugcagc

SEQ ID NO: 3609314 - RNA, 17 nt, Human
cgggcccucccuuggaa

SEQ ID NO: 3609315 - RNA, 15 nt, Human
cgggcccuggguucc

SEQ ID NO: 3609316 - RNA, 19 nt, Human
cgggcccuucuugcugccc

SEQ ID NO: 3609317 - RNA, 21 nt, Human
cgggcccuucuugcugcccug

SEQ ID NO: 3609318 - RNA, 23 nt, Human
cgggcccuucuugcugcccugcc

SEQ ID NO: 3609319 - RNA, 16 nt, Human
cgggccuggagaacua

SEQ ID NO: 3609320 - RNA, 15 nt, Human
cgggccuguccacag

SEQ ID NO: 3609321 - RNA, 19 nt, Human
cgggcgagucacugccucu

SEQ ID NO: 3609322 - RNA, 17 nt, Human
cgggcgcacugccucuc

SEQ ID NO: 3609323 - RNA, 18 nt, Human
cgggcgcacugccucuca

SEQ ID NO: 3609324 - RNA, 17 nt, Human
cgggcgugguggcgggc

SEQ ID NO: 3609325 - RNA, 14 nt, Human
cgggcucagcucug

SEQ ID NO: 3609326 - RNA, 15 nt, Human
cgggcucagcucugg

SEQ ID NO: 3609327 - RNA, 22 nt, Human
cgggcuccgacuugugcacagg

SEQ ID NO: 3609328 - RNA, 14 nt, Human
cgggcuccugugcc

SEQ ID NO: 3609329 - RNA, 15 nt, Human
cgggcuccugugccc

SEQ ID NO: 3609330 - RNA, 15 nt, Human
cgggcucucugcugu

SEQ ID NO: 3609331 - RNA, 13 nt, Human
cgggcucugccuc

SEQ ID NO: 3609332 - RNA, 14 nt, Human
cgggcucugccucc

SEQ ID NO: 3609333 - RNA, 17 nt, Human
cgggcucugccucccau

SEQ ID NO: 3609334 - RNA, 14 nt, Human
cgggcugagggccu

SEQ ID NO: 3609335 - RNA, 14 nt, Human
cgggcugcccugcc

SEQ ID NO: 3609336 - RNA, 16 nt, Human
cgggcugggagcucug

SEQ ID NO: 3609337 - RNA, 20 nt, Human
cgggcugggagcucugcaga

SEQ ID NO: 3609338 - RNA, 16 nt, Human
cgggcugggcagcugu

SEQ ID NO: 3609339 - RNA, 12 nt, Human
cgggcugugccc

SEQ ID NO: 3609340 - RNA, 22 nt, Human
cgggcuuugugugaaggcagag

SEQ ID NO: 3609341 - RNA, 20 nt, Human
cggggaacuggccaagcuga

SEQ ID NO: 3609342 - RNA, 23 nt, Human
cggggacagcuccuucuguccua

SEQ ID NO: 3609343 - RNA, 12 nt, Human
cggggacccugu

SEQ ID NO: 3609344 - RNA, 14 nt, Human
cggggacccuguga

SEQ ID NO: 3609345 - RNA, 16 nt, Human
cggggagcccccgccc

SEQ ID NO: 3609346 - RNA, 15 nt, Human
cggggagggugacag

SEQ ID NO: 3609347 - RNA, 22 nt, Human
cggggagggugacaguggccgc

SEQ ID NO: 3609348 - RNA, 17 nt, Human
cggggaguuucuuuccu

SEQ ID NO: 3609349 - RNA, 14 nt, Human
cggggauguguccu

SEQ ID NO: 3609350 - RNA, 14 nt, Human
cggggcagcugcca

SEQ ID NO: 3609351 - RNA, 13 nt, Human
cggggccagaggc

SEQ ID NO: 3609352 - RNA, 17 nt, Human
cggggccucgggaccuc

SEQ ID NO: 3609353 - RNA, 18 nt, Human
cggggccucgggaccuca

SEQ ID NO: 3609354 - RNA, 15 nt, Human
cggggccugccuagc

SEQ ID NO: 3609355 - RNA, 21 nt, Human
cggggccuuaucgggcuccag

SEQ ID NO: 3609356 - RNA, 14 nt, Human
cggggcguuucuuu

SEQ ID NO: 3609357 - RNA, 19 nt, Human
cggggcuccccuucgcgua

SEQ ID NO: 3609358 - RNA, 17 nt, Human
cggggcucuucucauuu

SEQ ID NO: 3609359 - RNA, 23 nt, Human
cggggcucuucucauuucacccc

SEQ ID NO: 3609360 - RNA, 12 nt, Human
cggggcuggguu

SEQ ID NO: 3609361 - RNA, 21 nt, Human
cggggcuggguuggcgcaccc

SEQ ID NO: 3609362 - RNA, 14 nt, Human
cggggcugucggcg

SEQ ID NO: 3609363 - RNA, 21 nt, Human
cggggcugucggcgcugcccc

SEQ ID NO: 3609364 - RNA, 23 nt, Human
cggggcuucaaccuugagacagc

SEQ ID NO: 3609365 - RNA, 12 nt, Human
cggggcuugccu

SEQ ID NO: 3609366 - RNA, 14 nt, Human
cggggcuuggcuga

SEQ ID NO: 3609367 - RNA, 17 nt, Human
cgggggcagucugagag

SEQ ID NO: 3609368 - RNA, 14 nt, Human
cgggggcagugcuc

SEQ ID NO: 3609369 - RNA, 20 nt, Human
cgggggcugcccuugggcca

SEQ ID NO: 3609370 - RNA, 12 nt, Human
cgggggcuggcc

SEQ ID NO: 3609371 - RNA, 18 nt, Human
cgggggcuggccuaggag

SEQ ID NO: 3609372 - RNA, 11 nt, Human
cggggggaggg

SEQ ID NO: 3609373 - RNA, 20 nt, Human
cggggguuccguguccaccc

SEQ ID NO: 3609374 - RNA, 21 nt, Human
cgggguauccugggggaccca

SEQ ID NO: 3609375 - RNA, 16 nt, Human
cgggguauuuuaggca

SEQ ID NO: 3609376 - RNA, 17 nt, Human
cgggguccuguggcagg

SEQ ID NO: 3609377 - RNA, 22 nt, Human
cgucaagagugaauucccucac

SEQ ID NO: 3609378 - RNA, 13 nt, Human
cgucaccaccacc

SEQ ID NO: 3609379 - RNA, 16 nt, Human
cgucaccaucucaggc

SEQ ID NO: 3609380 - RNA, 20 nt, Human
cgucaccaucucaggccacc

SEQ ID NO: 3609381 - RNA, 21 nt, Human
cgucaccaucucaggccaccu

SEQ ID NO: 3609382 - RNA, 19 nt, Human
cgucacgugcgcugggcac

SEQ ID NO: 3609383 - RNA, 20 nt, Human
cgucacgugcgcugggcacu

SEQ ID NO: 3609384 - RNA, 17 nt, Human
cgucacuuuauuucauu

SEQ ID NO: 3609385 - RNA, 17 nt, Human
cgucagaagcacccagg

SEQ ID NO: 3609386 - RNA, 14 nt, Human
cgucagccuccagc

SEQ ID NO: 3609387 - RNA, 16 nt, Human
cgucagccuccagccu

SEQ ID NO: 3609388 - RNA, 17 nt, Human
cgucagccuccagccuc

SEQ ID NO: 3609389 - RNA, 19 nt, Human
cgucagcugggacaccccg

SEQ ID NO: 3609390 - RNA, 18 nt, Human
cgucaggguuggugugcu

SEQ ID NO: 3609391 - RNA, 19 nt, Human
cgucaggguuggugugcug

SEQ ID NO: 3609392 - RNA, 17 nt, Human
cgucaguaucaggccug

SEQ ID NO: 3609393 - RNA, 15 nt, Human
cgucaguauuuuccc

SEQ ID NO: 3609394 - RNA, 14 nt, Human
cgucauaacuagaa

SEQ ID NO: 3609395 - RNA, 15 nt, Human
cgucauguuccucaa

SEQ ID NO: 3609396 - RNA, 16 nt, Human
cguccacagcuuccug

SEQ ID NO: 3609397 - RNA, 22 nt, Human
cguccaccaugggguccuacca

SEQ ID NO: 3609398 - RNA, 22 nt, Human
cguccacggcucuagguggggc

SEQ ID NO: 3609399 - RNA, 13 nt, Human
cguccagccugcc

SEQ ID NO: 3609400 - RNA, 16 nt, Human
cguccagcugcccuuc

SEQ ID NO: 3609401 - RNA, 22 nt, Human
cguccaggccgcgcccuuuccc

SEQ ID NO: 3609402 - RNA, 11 nt, Human
cguccagggag

SEQ ID NO: 3609403 - RNA, 21 nt, Human
cguccagguucaacccacagc

SEQ ID NO: 3609404 - RNA, 20 nt, Human
cguccauaucagaacugugc

SEQ ID NO: 3609405 - RNA, 17 nt, Human
cgucccauauccugccu

SEQ ID NO: 3609406 - RNA, 17 nt, Human
cguccccccccaaccuu

SEQ ID NO: 3609407 - RNA, 22 nt, Human
cguccccucccccaccccugcu

SEQ ID NO: 3609408 - RNA, 14 nt, Human
cguccccugucccc

SEQ ID NO: 3609409 - RNA, 15 nt, Human
cgucccuagcaguga

SEQ ID NO: 3609410 - RNA, 14 nt, Human
cgucccugcccaug

SEQ ID NO: 3609411 - RNA, 11 nt, Human
cgucccuggcg

SEQ ID NO: 3609412 - RNA, 14 nt, Human
cgucccuggcgcag

SEQ ID NO: 3609413 - RNA, 22 nt, Human
cguccgcccugcuccucccugg

SEQ ID NO: 3609414 - RNA, 20 nt, Human
cguccguggguugcuaacug

SEQ ID NO: 3609415 - RNA, 17 nt, Human
cguccucaccccugucc

SEQ ID NO: 3609416 - RNA, 22 nt, Human
cguccucccccugccagugccu

SEQ ID NO: 3609417 - RNA, 17 nt, Human
cguccucccgggcccuc

SEQ ID NO: 3609418 - RNA, 16 nt, Human
cguccucgagcaacug

SEQ ID NO: 3609419 - RNA, 23 nt, Human
cguccugacggcgcccccagugu

SEQ ID NO: 3609420 - RNA, 13 nt, Human
cguccugccugug

SEQ ID NO: 3609421 - RNA, 14 nt, Human
cguccugccugugg

SEQ ID NO: 3609422 - RNA, 15 nt, Human
cguccugccuguggc

SEQ ID NO: 3609423 - RNA, 23 nt, Human
cguccuguccacacccagcucag

SEQ ID NO: 3609424 - RNA, 17 nt, Human
cguccuuacuccugugg

SEQ ID NO: 3609425 - RNA, 21 nt, Human
cguccuuacuccugugggagc

SEQ ID NO: 3609426 - RNA, 17 nt, Human
cgucgaggggcucucag

SEQ ID NO: 3609427 - RNA, 19 nt, Human
cgucgggggcugaggggca

SEQ ID NO: 3609428 - RNA, 21 nt, Human
cgucuaaccacagcuccuuuu

SEQ ID NO: 3609429 - RNA, 13 nt, Human
cgucuacagcucc

SEQ ID NO: 3609430 - RNA, 19 nt, Human
cgucuacauuucacauuau

SEQ ID NO: 3609431 - RNA, 21 nt, Human
cgucuacucauuccccggggc

SEQ ID NO: 3609432 - RNA, 14 nt, Human
cgucuauccugugu

SEQ ID NO: 3609433 - RNA, 23 nt, Human
cgucucaaaaaaaaaaaaaugca

SEQ ID NO: 3609434 - RNA, 16 nt, Human
cgucucauacucaccu

SEQ ID NO: 3609435 - RNA, 10 nt, Human
cgucuccccc

SEQ ID NO: 3609436 - RNA, 22 nt, Human
cgucucccccguguuccccucu

SEQ ID NO: 3609437 - RNA, 13 nt, Human
cgucucucuccca

SEQ ID NO: 3609438 - RNA, 18 nt, Human
cgucugaagcuugacucc

SEQ ID NO: 3609439 - RNA, 21 nt, Human
cgucugaagcuugacucccaa

SEQ ID NO: 3609440 - RNA, 13 nt, Human
cgucugacaggca

SEQ ID NO: 3609441 - RNA, 18 nt, Human
cgucugccggacccggag

SEQ ID NO: 3609442 - RNA, 17 nt, Human
cgucugcuccugcgagg

SEQ ID NO: 3609443 - RNA, 15 nt, Human
cgucuggaaguccaa

SEQ ID NO: 3609444 - RNA, 14 nt, Human
cgucuggaggggcc

SEQ ID NO: 3609445 - RNA, 17 nt, Human
cgucuggcccaccaggg

SEQ ID NO: 3609446 - RNA, 14 nt, Human
cgucugggagaaau

SEQ ID NO: 3609447 - RNA, 19 nt, Human
cgucugggguucagccccu

SEQ ID NO: 3609448 - RNA, 23 nt, Human
cgucugggguucagccccuccuc

SEQ ID NO: 3609449 - RNA, 22 nt, Human
cgucugugugugaccccuccug

SEQ ID NO: 3609450 - RNA, 14 nt, Human
cgucuucagccuag

SEQ ID NO: 3609451 - RNA, 15 nt, Human
cgucuucagccuagc

SEQ ID NO: 3609452 - RNA, 19 nt, Human
cgucuucuguauacugugg

SEQ ID NO: 3609453 - RNA, 17 nt, Human
cgucuugcuugggaagg

SEQ ID NO: 3609454 - RNA, 11 nt, Human
cgucuuuccca

SEQ ID NO: 3609455 - RNA, 19 nt, Human
cgugaaaacacauuugcuu

SEQ ID NO: 3609456 - RNA, 22 nt, Human
cgugaaacacaccaggcugugg

SEQ ID NO: 3609457 - RNA, 23 nt, Human
cgugaaagugcauuuuuguaaau

SEQ ID NO: 3609458 - RNA, 13 nt, Human
cgugaagcaucca

SEQ ID NO: 3609459 - RNA, 17 nt, Human
cgugaaguauacuguau

SEQ ID NO: 3609460 - RNA, 12 nt, Human
cgugacaacacu

SEQ ID NO: 3609461 - RNA, 17 nt, Human
cgugacaauguuuacaa

SEQ ID NO: 3609462 - RNA, 13 nt, Human
cgugacacaaaca

SEQ ID NO: 3609463 - RNA, 21 nt, Human
cgugacacucuccuugcaguu

SEQ ID NO: 3609464 - RNA, 16 nt, Human
cgugacagacuccuga

SEQ ID NO: 3609465 - RNA, 20 nt, Human
cgugacccucugcugaagac

SEQ ID NO: 3609466 - RNA, 15 nt, Human
cuacagcaaauuuau

SEQ ID NO: 3609467 - RNA, 20 nt, Human
cuacagcaaauuuauaauuu

SEQ ID NO: 3609468 - RNA, 20 nt, Human
cuacagcacuacuggguguc

SEQ ID NO: 3609469 - RNA, 22 nt, Human
cuacagcacuacugggugucau

SEQ ID NO: 3609470 - RNA, 23 nt, Human
cuacagcacuacugggugucauu

SEQ ID NO: 3609471 - RNA, 19 nt, Human
cuacagccuugucccccuc

SEQ ID NO: 3609472 - RNA, 19 nt, Human
cuacagcuaaucagcauuc

SEQ ID NO: 3609473 - RNA, 13 nt, Human
cuacagcuaugaa

SEQ ID NO: 3609474 - RNA, 19 nt, Human
cuacagcucccccagcucc

SEQ ID NO: 3609475 - RNA, 19 nt, Human
cuacagcucuuaaauguag

SEQ ID NO: 3609476 - RNA, 19 nt, Human
cuacagcuugaccgugagg

SEQ ID NO: 3609477 - RNA, 22 nt, Human
cuacaggaagcaccccaugcca

SEQ ID NO: 3609478 - RNA, 21 nt, Human
cuacaggagagggaagagugc

SEQ ID NO: 3609479 - RNA, 15 nt, Human
cuacaggagugagca

SEQ ID NO: 3609480 - RNA, 16 nt, Human
cuacaggccucacaca

SEQ ID NO: 3609481 - RNA, 20 nt, Human
cuacaggccucacacacaau

SEQ ID NO: 3609482 - RNA, 12 nt, Human
cuacagggccaa

SEQ ID NO: 3609483 - RNA, 13 nt, Human
cuacaggggccag

SEQ ID NO: 3609484 - RNA, 16 nt, Human
cuacaggggccagaag

SEQ ID NO: 3609485 - RNA, 21 nt, Human
cuacagggggucuggcuggug

SEQ ID NO: 3609486 - RNA, 16 nt, Human
cuacaggugugaguca

SEQ ID NO: 3609487 - RNA, 20 nt, Human
cuacagguuacaacagauuu

SEQ ID NO: 3609488 - RNA, 17 nt, Human
cuacagguuuggguaca

SEQ ID NO: 3609489 - RNA, 15 nt, Human
cuacagucaggaaag

SEQ ID NO: 3609490 - RNA, 16 nt, Human
cuacagucucgucucu

SEQ ID NO: 3609491 - RNA, 12 nt, Human
cuacagugccaa

SEQ ID NO: 3609492 - RNA, 19 nt, Human
cuacagugccaacuccuca

SEQ ID NO: 3609493 - RNA, 20 nt, Human
cuacagugccaacuccucac

SEQ ID NO: 3609494 - RNA, 21 nt, Human
cuacagugguuuuauacugaa

SEQ ID NO: 3609495 - RNA, 14 nt, Human
cuacaguguacagu

SEQ ID NO: 3609496 - RNA, 15 nt, Human
cuacaguguacaguc

SEQ ID NO: 3609497 - RNA, 16 nt, Human
cuacaguguacagucu

SEQ ID NO: 3609498 - RNA, 23 nt, Human
cuacaguuaggguugaguuacuu

SEQ ID NO: 3609499 - RNA, 21 nt, Human
cuacaguugaaaaacagcuga

SEQ ID NO: 3609500 - RNA, 22 nt, Human
cuacaguuggaaauccauccag

SEQ ID NO: 3609501 - RNA, 15 nt, Human
cuacauaaacugacu

SEQ ID NO: 3609502 - RNA, 22 nt, Human
cuacauaaguaauucaagaaaa

SEQ ID NO: 3609503 - RNA, 12 nt, Human
cuacauauugaa

SEQ ID NO: 3609504 - RNA, 15 nt, Human
cuacaucgcccucca

SEQ ID NO: 3609505 - RNA, 15 nt, Human
cuacaucuucugccu

SEQ ID NO: 3609506 - RNA, 18 nt, Human
cuacaucuuuuuucacaa

SEQ ID NO: 3609507 - RNA, 21 nt, Human
cuacaugacgacaaagcugcu

SEQ ID NO: 3609508 - RNA, 18 nt, Human
cuacaugagguacugaga

SEQ ID NO: 3609509 - RNA, 20 nt, Human
cuacaugagguacugagagu

SEQ ID NO: 3609510 - RNA, 17 nt, Human
cuacaugcagcccaugc

SEQ ID NO: 3609511 - RNA, 19 nt, Human
cuacaugcuuguugacaga

SEQ ID NO: 3609512 - RNA, 20 nt, Human
cuacauggaguauaugucaa

SEQ ID NO: 3609513 - RNA, 13 nt, Human
cuacaugugagug

SEQ ID NO: 3609514 - RNA, 23 nt, Human
cuacauuauugcuuauugcuuag

SEQ ID NO: 3609515 - RNA, 22 nt, Human
cuacauugaguagacacauuua

SEQ ID NO: 3609516 - RNA, 11 nt, Human
cuacauuuuaa

SEQ ID NO: 3609517 - RNA, 12 nt, Human
cuacauuuuaac

SEQ ID NO: 3609518 - RNA, 14 nt, Human
cuacauuuuuucau

SEQ ID NO: 3609519 - RNA, 14 nt, Human
cuaccaaagcaccu

SEQ ID NO: 3609520 - RNA, 15 nt, Human
cuaccaaagcaccuu

SEQ ID NO: 3609521 - RNA, 23 nt, Human
cuaggcuucagcauauuuauagc

SEQ ID NO: 3609522 - RNA, 17 nt, Human
cuagggaaacuucccgu

SEQ ID NO: 3609523 - RNA, 20 nt, Human
cuagggaaaugaucaguuuu

SEQ ID NO: 3609524 - RNA, 21 nt, Human
cuagggaaggccaccugcagg

SEQ ID NO: 3609525 - RNA, 14 nt, Human
cuagggaagggugg

SEQ ID NO: 3609526 - RNA, 15 nt, Human
cuagggagagacccu

SEQ ID NO: 3609527 - RNA, 15 nt, Human
cuagggauucaggcu

SEQ ID NO: 3609528 - RNA, 16 nt, Human
cuagggauucaggcug

SEQ ID NO: 3609529 - RNA, 16 nt, Human
cuagggccaagcccag

SEQ ID NO: 3609530 - RNA, 18 nt, Human
cuagggccaagcccagca

SEQ ID NO: 3609531 - RNA, 14 nt, Human
cuagggcugggaaa

SEQ ID NO: 3609532 - RNA, 13 nt, Human
cuaggggaaugag

SEQ ID NO: 3609533 - RNA, 19 nt, Human
cuaggggaaugagggggcu

SEQ ID NO: 3609534 - RNA, 17 nt, Human
cuaggggagcagggggc

SEQ ID NO: 3609535 - RNA, 19 nt, Human
cuaggguuaggagguccuu

SEQ ID NO: 3609536 - RNA, 19 nt, Human
cuaggguugcuggagccug

SEQ ID NO: 3609537 - RNA, 14 nt, Human
cuagguacgaugac

SEQ ID NO: 3609538 - RNA, 20 nt, Human
cuagguacgaugacaguguu

SEQ ID NO: 3609539 - RNA, 18 nt, Human
cuagguagaaaaaggguc

SEQ ID NO: 3609540 - RNA, 19 nt, Human
cuagguagaaaaaggguca

SEQ ID NO: 3609541 - RNA, 20 nt, Human
cuagguagcccccucuuccc

SEQ ID NO: 3609542 - RNA, 16 nt, Human
cuaggucaaggccugu

SEQ ID NO: 3609543 - RNA, 17 nt, Human
cuaggucagcuugcugc

SEQ ID NO: 3609544 - RNA, 12 nt, Human
cuaggucugaua

SEQ ID NO: 3609545 - RNA, 18 nt, Human
cuaggugcuauuugucau

SEQ ID NO: 3609546 - RNA, 15 nt, Human
cuagguggaaaagcc

SEQ ID NO: 3609547 - RNA, 19 nt, Human
cuagguggcaaggcugugc

SEQ ID NO: 3609548 - RNA, 23 nt, Human
cuaggugggccagccccucccac

SEQ ID NO: 3609549 - RNA, 18 nt, Human
cuagguggguugaaagcc

SEQ ID NO: 3609550 - RNA, 21 nt, Human
cuagguucccuguucuuccuc

SEQ ID NO: 3609551 - RNA, 14 nt, Human
cuagguuuaacuca

SEQ ID NO: 3609552 - RNA, 18 nt, Human
cuagguuuaacucagauc

SEQ ID NO: 3609553 - RNA, 20 nt, Human
cuagguuuaacucagaucac

SEQ ID NO: 3609554 - RNA, 22 nt, Human
cuaguaagaagacaaacugcuu

SEQ ID NO: 3609555 - RNA, 18 nt, Human
cuaguaagcaucuacuuc

SEQ ID NO: 3609556 - RNA, 16 nt, Human
cuaguaauaaagacuc

SEQ ID NO: 3609557 - RNA, 16 nt, Human
cuaguaauauauuuaa

SEQ ID NO: 3609558 - RNA, 20 nt, Human
cuaguaauauauuuaaaggg

SEQ ID NO: 3609559 - RNA, 22 nt, Human
cuaguacuguguacuguauaga

SEQ ID NO: 3609560 - RNA, 22 nt, Human
cuaguacuugggagaccuguaa

SEQ ID NO: 3609561 - RNA, 21 nt, Human
cuaguagggguaccacugaau

SEQ ID NO: 3609562 - RNA, 23 nt, Human
cuaguauuccagaccugaagaau

SEQ ID NO: 3609563 - RNA, 21 nt, Human
cuaguauuucaugcugggaau

SEQ ID NO: 3609564 - RNA, 18 nt, Human
cuaguauuugaauuaaaa

SEQ ID NO: 3609565 - RNA, 23 nt, Human
cuaguauuugaauuaaaacuucu

SEQ ID NO: 3609566 - RNA, 23 nt, Human
cuagucaagcuccuccucccugc

SEQ ID NO: 3609567 - RNA, 15 nt, Human
cuagucaaugacaug

SEQ ID NO: 3609568 - RNA, 17 nt, Human
cuagucaccccaaguag

SEQ ID NO: 3609569 - RNA, 13 nt, Human
cuagucagagaga

SEQ ID NO: 3609570 - RNA, 14 nt, Human
cuagucagccacau

SEQ ID NO: 3609571 - RNA, 13 nt, Human
cuagucauaaccu

SEQ ID NO: 3609572 - RNA, 14 nt, Human
cuagucauauauua

SEQ ID NO: 3609573 - RNA, 20 nt, Human
cuagucccuuccacaccccc

SEQ ID NO: 3609574 - RNA, 14 nt, Human
cuagucccuucccc

SEQ ID NO: 3609575 - RNA, 20 nt, Human
cuagucccuuccccucccug

SEQ ID NO: 3609576 - RNA, 21 nt, Human
cuagucccuuccccucccugg

SEQ ID NO: 3609577 - RNA, 14 nt, Human
cuaguccggaccca

SEQ ID NO: 3609578 - RNA, 21 nt, Human
cuaguccggacccaccucacc

SEQ ID NO: 3609579 - RNA, 23 nt, Human
cuaguccggacccaccucacccc

SEQ ID NO: 3609580 - RNA, 18 nt, Human
cuaguccuauucuauugc

SEQ ID NO: 3609581 - RNA, 19 nt, Human
cuagucuccuuugcacuga

SEQ ID NO: 3609582 - RNA, 20 nt, Human
cuagucuccuuugcacugag

SEQ ID NO: 3609583 - RNA, 12 nt, Human
cuagucucuccu

SEQ ID NO: 3609584 - RNA, 14 nt, Human
cuagucucucuggg

SEQ ID NO: 3609585 - RNA, 20 nt, Human
cuagucugugugggacugua

SEQ ID NO: 3609586 - RNA, 15 nt, Human
cuagucuuuugcuuu

SEQ ID NO: 3609587 - RNA, 16 nt, Human
cuagugacagcuugug

SEQ ID NO: 3609588 - RNA, 18 nt, Human
cuagugagcugggcaugg

SEQ ID NO: 3609589 - RNA, 17 nt, Human
cuagugauuucuggggc

SEQ ID NO: 3609590 - RNA, 16 nt, Human
cuagugcagcugaaau

SEQ ID NO: 3609591 - RNA, 14 nt, Human
cuagugcagcugau

SEQ ID NO: 3609592 - RNA, 19 nt, Human
cuagugcagcugauuuuaa

SEQ ID NO: 3609593 - RNA, 17 nt, Human
cuagugccuucuaaagg

SEQ ID NO: 3609594 - RNA, 16 nt, Human
cuagugcugaagcuua

SEQ ID NO: 3609595 - RNA, 17 nt, Human
cuagugcugaagcuuau

SEQ ID NO: 3609596 - RNA, 16 nt, Human
cuaguggcuguccagu

SEQ ID NO: 3609597 - RNA, 14 nt, Human
cuaguggcuugucc

SEQ ID NO: 3609598 - RNA, 13 nt, Human
cuagugggacagc

SEQ ID NO: 3609599 - RNA, 18 nt, Human
cuagugggacagcccaga

SEQ ID NO: 3609600 - RNA, 18 nt, Human
cuaguggggucucccucu

SEQ ID NO: 3609601 - RNA, 22 nt, Human
cuaguggggucucccucuccug

SEQ ID NO: 3609602 - RNA, 15 nt, Human
cuaguggucuuugua

SEQ ID NO: 3609603 - RNA, 16 nt, Human
cuaguggucuuuguaa

SEQ ID NO: 3609604 - RNA, 12 nt, Human
cuagugguggcu

SEQ ID NO: 3609605 - RNA, 19 nt, Human
cuagugguggcucugagaa

SEQ ID NO: 3609606 - RNA, 20 nt, Human
cuaguguagaauugugcaac

SEQ ID NO: 3609607 - RNA, 23 nt, Human
cuagugugguguuuccuggcacu

SEQ ID NO: 3609608 - RNA, 23 nt, Human
cuaguguucugucuaaaaaccag

SEQ ID NO: 3609609 - RNA, 23 nt, Human
cuaguuaccacauuacucugccu

SEQ ID NO: 3609610 - RNA, 22 nt, Human
cuaguuauuuacaggaacuuca

SEQ ID NO: 3609611 - RNA, 16 nt, Human
cuaguuauuuauucug

SEQ ID NO: 3609612 - RNA, 12 nt, Human
cuaguucacucu

SEQ ID NO: 3609613 - RNA, 24 nt, Human
cuaguucauccaauccucacuggg

SEQ ID NO: 3609614 - RNA, 18 nt, Human
cuaguucaucccuucucu

SEQ ID NO: 3609615 - RNA, 20 nt, Human
cuaguucaucccuucucuuc

SEQ ID NO: 3609616 - RNA, 22 nt, Human
cuaguuccaccaucaagccacc

SEQ ID NO: 3609617 - RNA, 20 nt, Human
cuaguucccucugcucagcc

SEQ ID NO: 3609618 - RNA, 21 nt, Human
cuaguucccucugcucagcca

SEQ ID NO: 3609619 - RNA, 15 nt, Human
cuaguuccuucaugu

SEQ ID NO: 3609620 - RNA, 16 nt, Human
cuaguucuagaaaaac

SEQ ID NO: 3609621 - RNA, 23 nt, Human
cuaguucuagaaaaacaggcacu

SEQ ID NO: 3609622 - RNA, 13 nt, Human
cuaguucugccag

SEQ ID NO: 3609623 - RNA, 14 nt, Human
cuaguucugccagg

SEQ ID NO: 3609624 - RNA, 15 nt, Human
cuaguucugccagga

SEQ ID NO: 3609625 - RNA, 23 nt, Human
cuaguucuguagaaaugguugua

SEQ ID NO: 3609626 - RNA, 17 nt, Human
cuaguugaauacuugaa

SEQ ID NO: 3609627 - RNA, 23 nt, Human
cuaguugaauacuugaaccauaa

SEQ ID NO: 3609628 - RNA, 22 nt, Human
cuaguuugaccucacagugacc

SEQ ID NO: 3609629 - RNA, 21 nt, Human
cuaguuugauuaaauucuugc

SEQ ID NO: 3609630 - RNA, 22 nt, Human
cuaguuugauuaaauucuugca

SEQ ID NO: 3609631 - RNA, 18 nt, Human
cuaguuugugagaaacau

SEQ ID NO: 3609632 - RNA, 20 nt, Human
cuaguuuucaguuuguauau

SEQ ID NO: 3609633 - RNA, 14 nt, Human
cuaguuuuuaguaa

SEQ ID NO: 3609634 - RNA, 19 nt, Human
cuaguuuuuucuuccuuuu

SEQ ID NO: 3609635 - RNA, 15 nt, Human
cuauaaaaaauaugu

SEQ ID NO: 3609636 - RNA, 13 nt, Human
cuauaaaacucug

SEQ ID NO: 3609637 - RNA, 12 nt, Human
cuauaaaagcuu

SEQ ID NO: 3609638 - RNA, 19 nt, Human
cuauaaaagcuuucugcca

SEQ ID NO: 3609639 - RNA, 16 nt, Human
cuauaaaauguaucaa

SEQ ID NO: 3609640 - RNA, 16 nt, Human
cuauaaaaugucuuca

SEQ ID NO: 3609641 - RNA, 14 nt, Human
cuauaaagcauuua

SEQ ID NO: 3609642 - RNA, 17 nt, Human
cuauaaauuccucuuug

SEQ ID NO: 3609643 - RNA, 22 nt, Human
cuauaaauuccucuuugcuuug

SEQ ID NO: 3609644 - RNA, 18 nt, Human
cuauaacaaaggauacuu

SEQ ID NO: 3609645 - RNA, 13 nt, Human
cuauaacacugug

SEQ ID NO: 3609646 - RNA, 17 nt, Human
cuauaaccaaaugaaau

SEQ ID NO: 3609647 - RNA, 19 nt, Human
cuauaaccaaaugaaauau

SEQ ID NO: 3609648 - RNA, 22 nt, Human
cuauaaccccagcucccuagga

SEQ ID NO: 3609649 - RNA, 22 nt, Human
cuauaacuugaugcaugugguu

SEQ ID NO: 3609650 - RNA, 23 nt, Human
cuauaagauuccaaaaagcacau

SEQ ID NO: 3609651 - RNA, 21 nt, Human
cuauaagcaaauugcuuuuuu

SEQ ID NO: 3609652 - RNA, 17 nt, Human
cuauaagccaaaauuaa

SEQ ID NO: 3609653 - RNA, 17 nt, Human
cuauaauaccagcuacu

SEQ ID NO: 3609654 - RNA, 13 nt, Human
cuauaaucuguca

SEQ ID NO: 3609655 - RNA, 22 nt, Human
cuauaaucugucaaaacacugu

SEQ ID NO: 3609656 - RNA, 21 nt, Human
cuauaauguaagcucuacuga

SEQ ID NO: 3609657 - RNA, 14 nt, Human
cuauaaugugaaau

SEQ ID NO: 3609658 - RNA, 17 nt, Human
cuauaaugugaaaugua

SEQ ID NO: 3609659 - RNA, 21 nt, Human
cuauaaugugaaauguaacug

SEQ ID NO: 3609660 - RNA, 18 nt, Human
cuauaauuauuauucaga

SEQ ID NO: 3609661 - RNA, 13 nt, Human
cuauaauuuaaau

SEQ ID NO: 3609662 - RNA, 19 nt, Human
cuauaauuuccauuuacuu

SEQ ID NO: 3609663 - RNA, 23 nt, Human
cuauaauuuugauagugggacca

SEQ ID NO: 3609664 - RNA, 15 nt, Human
cuaccgacccagggu

SEQ ID NO: 3609665 - RNA, 17 nt, Human
cuaccgagucucuucuc

SEQ ID NO: 3609666 - RNA, 22 nt, Human
cuaccgagucucuucuccacug

SEQ ID NO: 3609667 - RNA, 14 nt, Human
cuaccuaacccaga

SEQ ID NO: 3609668 - RNA, 15 nt, Human
cuaccucagccuaga

SEQ ID NO: 3609669 - RNA, 17 nt, Human
cuaccucagguugcugg

SEQ ID NO: 3609670 - RNA, 22 nt, Human
cuaccuccaaagcuucccacgg

SEQ ID NO: 3609671 - RNA, 13 nt, Human
cuaccucccuccc

SEQ ID NO: 3609672 - RNA, 15 nt, Human
cuaccuccucuccug

SEQ ID NO: 3609673 - RNA, 18 nt, Human
cuaccucgcaucauugca

SEQ ID NO: 3609674 - RNA, 16 nt, Human
cuaccucucugucccu

SEQ ID NO: 3609675 - RNA, 19 nt, Human
cuaccugacacucccuugg

SEQ ID NO: 3609676 - RNA, 19 nt, Human
cuaccugccacucacacag

SEQ ID NO: 3609677 - RNA, 20 nt, Human
cuaccuguauuuaaaaauag

SEQ ID NO: 3609678 - RNA, 21 nt, Human
cuaccuguauuuaaaaauaga

SEQ ID NO: 3609679 - RNA, 13 nt, Human
cuaccugugccug

SEQ ID NO: 3609680 - RNA, 18 nt, Human
cuaccugugugguacucu

SEQ ID NO: 3609681 - RNA, 21 nt, Human
cuaccuguucagugucccggg

SEQ ID NO: 3609682 - RNA, 22 nt, Human
cuaccuguucagugucccgggc

SEQ ID NO: 3609683 - RNA, 21 nt, Human
cuaccuguugagcaucacaga

SEQ ID NO: 3609684 - RNA, 19 nt, Human
cuaccuuaaaauguaaaac

SEQ ID NO: 3609685 - RNA, 19 nt, Human
cuaccuuccagucaggaug

SEQ ID NO: 3609686 - RNA, 21 nt, Human
cuaccuucuccccagcuccca

SEQ ID NO: 3609687 - RNA, 19 nt, Human
cuaccuugaaaauaagaau

SEQ ID NO: 3609688 - RNA, 17 nt, Human
cuaccuugcuuuugcuu

SEQ ID NO: 3609689 - RNA, 16 nt, Human
cuaccuugggggaacc

SEQ ID NO: 3609690 - RNA, 20 nt, Human
cuaccuuuggcuuaauucca

SEQ ID NO: 3609691 - RNA, 13 nt, Human
cuaugaaggcugu

SEQ ID NO: 3609692 - RNA, 15 nt, Human
cuaugaaugcuuugc

SEQ ID NO: 3609693 - RNA, 15 nt, Human
cuaugacugcucccc

SEQ ID NO: 3609694 - RNA, 18 nt, Human
cuaugagcauccugagcc

SEQ ID NO: 3609695 - RNA, 13 nt, Human
cuaugagggccuu

SEQ ID NO: 3609696 - RNA, 13 nt, Human
cuaugagucuaga

SEQ ID NO: 3609697 - RNA, 16 nt, Human
cuaugagucuagaugu

SEQ ID NO: 3609698 - RNA, 17 nt, Human
cuaugagucuagauguu

SEQ ID NO: 3609699 - RNA, 16 nt, Human
cuaugaguggaaaaag

SEQ ID NO: 3609700 - RNA, 17 nt, Human
cuaugaucucagguucu

SEQ ID NO: 3609701 - RNA, 20 nt, Human
cuaugauguauacugccacu

SEQ ID NO: 3609702 - RNA, 19 nt, Human
cuaugaugugaaacacuuu

SEQ ID NO: 3609703 - RNA, 20 nt, Human
cuaugauguuaguuuuccuu

SEQ ID NO: 3609704 - RNA, 14 nt, Human
cuaugauuauuaac

SEQ ID NO: 3609705 - RNA, 15 nt, Human
cuaugauuuggaaaa

SEQ ID NO: 3609706 - RNA, 13 nt, Human
cuaugcacauaug

SEQ ID NO: 3609707 - RNA, 21 nt, Human
cuaugcacauauggacucugc

SEQ ID NO: 3609708 - RNA, 22 nt, Human
cuaugcauggugccccaggacc

SEQ ID NO: 3609709 - RNA, 18 nt, Human
cuaugcaugguuucagca

SEQ ID NO: 3609710 - RNA, 19 nt, Human
cuaugcaugguuucagcac

SEQ ID NO: 3609711 - RNA, 23 nt, Human
cuaugcaugguuucagcacuagc

SEQ ID NO: 3609712 - RNA, 21 nt, Human
cuaugcauuugaaaauuuuga

SEQ ID NO: 3609713 - RNA, 17 nt, Human
cuaugccaaagaucacu

SEQ ID NO: 3609714 - RNA, 17 nt, Human
cuaugccccaaauauag

SEQ ID NO: 3609715 - RNA, 15 nt, Human
cuaugccucucuaca

SEQ ID NO: 3609716 - RNA, 14 nt, Human
cuaugccugugucu

SEQ ID NO: 3609717 - RNA, 13 nt, Human
cuaugcguuuuua

SEQ ID NO: 3609718 - RNA, 17 nt, Human
cuaugcuauugacaaua

SEQ ID NO: 3609719 - RNA, 22 nt, Human
cuaugcucaggggcccuggagc

SEQ ID NO: 3609720 - RNA, 13 nt, Human
cuaugcugaguuu

SEQ ID NO: 3609721 - RNA, 14 nt, Human
cuaugcugaguuug

SEQ ID NO: 3609722 - RNA, 14 nt, Human
cuaugcugccuagg

SEQ ID NO: 3609723 - RNA, 20 nt, Human
cuaugcugcuuuuauaucug

SEQ ID NO: 3609724 - RNA, 14 nt, Human
cuaugcuguaucug

SEQ ID NO: 3609725 - RNA, 13 nt, Human
cuaugcuguuugu

SEQ ID NO: 3609726 - RNA, 17 nt, Human
cuaugcuuuccaaaccu

SEQ ID NO: 3609727 - RNA, 19 nt, Human
cuaugcuuugaaacagaaa

SEQ ID NO: 3609728 - RNA, 15 nt, Human
cuauggaaagauggc

SEQ ID NO: 3609729 - RNA, 15 nt, Human
cuauggagagcccug

SEQ ID NO: 3609730 - RNA, 16 nt, Human
cuauggagagcccugg

SEQ ID NO: 3609731 - RNA, 23 nt, Human
cuauggagccuggcacaggacug

SEQ ID NO: 3609732 - RNA, 19 nt, Human
cuauggagugcaccaaaga

SEQ ID NO: 3609733 - RNA, 11 nt, Human
cuauggaugug

SEQ ID NO: 3609734 - RNA, 20 nt, Human
cuauggauuuucuaaggaag

SEQ ID NO: 3609735 - RNA, 14 nt, Human
cuauggcagaaaaa

SEQ ID NO: 3609736 - RNA, 13 nt, Human
cuaugggaacaau

SEQ ID NO: 3609737 - RNA, 18 nt, Human
cuaugggacucaaugcac

SEQ ID NO: 3609738 - RNA, 21 nt, Human
cuaugggagagugucaaccag

SEQ ID NO: 3609739 - RNA, 14 nt, Human
cuaugggagcccca

SEQ ID NO: 3609740 - RNA, 23 nt, Human
cuaugggccugccgggcugaggg

SEQ ID NO: 3609741 - RNA, 17 nt, Human
cuauggggagaaaagac

SEQ ID NO: 3609742 - RNA, 19 nt, Human
cuauggggauagaugugug

SEQ ID NO: 3609743 - RNA, 20 nt, Human
cuauggggauagaugugugg

SEQ ID NO: 3609744 - RNA, 21 nt, Human
cuauggggauagaugugugga

SEQ ID NO: 3609745 - RNA, 22 nt, Human
cuaugggguaaaagggguaggg

SEQ ID NO: 3609746 - RNA, 22 nt, Human
cuauggguaucaaacagcucag

SEQ ID NO: 3609747 - RNA, 13 nt, Human
cuaugguaaagau

SEQ ID NO: 3609748 - RNA, 11 nt, Human
cuauggucuua

SEQ ID NO: 3609749 - RNA, 22 nt, Human
cuauggucuuauauuuacaaca

SEQ ID NO: 3609750 - RNA, 19 nt, Human
cuauggugagaugcagcug

SEQ ID NO: 3609751 - RNA, 15 nt, Human
cuauggugccaaugg

SEQ ID NO: 3609752 - RNA, 14 nt, Human
cuauggugcucugu

SEQ ID NO: 3609753 - RNA, 14 nt, Human
cuaugguuaugaaa

SEQ ID NO: 3609754 - RNA, 18 nt, Human
cuauguacaauauuuuaa

SEQ ID NO: 3609755 - RNA, 22 nt, Human
cuauguacaauauuuuaagcau

SEQ ID NO: 3609756 - RNA, 20 nt, Human
cuauguacuaguacugugua

SEQ ID NO: 3609757 - RNA, 23 nt, Human
cuauguacuaguacuguguacug

SEQ ID NO: 3609758 - RNA, 22 nt, Human
cuauguaggaaagaccauuuuu

SEQ ID NO: 3609759 - RNA, 23 nt, Human
cuauguaggaaagaccauuuuuc

SEQ ID NO: 3609760 - RNA, 17 nt, Human
cuauguauaaaauacau

SEQ ID NO: 3609761 - RNA, 16 nt, Human
cuauguaucaaaugua

SEQ ID NO: 3609762 - RNA, 13 nt, Human
cuauguaucaaug

SEQ ID NO: 3609763 - RNA, 14 nt, Human
cuauguauggaaua

SEQ ID NO: 3609764 - RNA, 13 nt, Human
cuaugucauuuca

SEQ ID NO: 3609765 - RNA, 18 nt, Human
cuaugucauuucauuucc

SEQ ID NO: 3609766 - RNA, 18 nt, Human
cuauguccuaaggacaca

SEQ ID NO: 3609767 - RNA, 21 nt, Human
cuauguccuaaggacacacua

SEQ ID NO: 3609768 - RNA, 16 nt, Human
cuauguccuaauaaua

SEQ ID NO: 3609769 - RNA, 12 nt, Human
cuaugugacaau

SEQ ID NO: 3609770 - RNA, 17 nt, Human
cuaugugagcacaaagg

SEQ ID NO: 3609771 - RNA, 16 nt, Human
cuaugugauuuuaacu

SEQ ID NO: 3609772 - RNA, 17 nt, Human
cuaugugccuuauguug

SEQ ID NO: 3609773 - RNA, 17 nt, Human
cuauguguuuuucucau

SEQ ID NO: 3609774 - RNA, 13 nt, Human
cuauguuaauauu

SEQ ID NO: 3609775 - RNA, 17 nt, Human
cuauguuaauauuuuag

SEQ ID NO: 3609776 - RNA, 22 nt, Human
cuauguugauccauccagcuug

SEQ ID NO: 3609777 - RNA, 15 nt, Human
cuauguugcccaggc

SEQ ID NO: 3609778 - RNA, 17 nt, Human
cuauguugcccaggcag

SEQ ID NO: 3609779 - RNA, 19 nt, Human
cuauguugcccaggcaggu

SEQ ID NO: 3609780 - RNA, 21 nt, Human
cuauguugcccaggcaggucu

SEQ ID NO: 3609781 - RNA, 18 nt, Human
cuauguuuugacauuuuu

SEQ ID NO: 3609782 - RNA, 20 nt, Human
cuauguuuuuguucaaagcc

SEQ ID NO: 3609783 - RNA, 13 nt, Human
cuauuaaaaaagu

SEQ ID NO: 3609784 - RNA, 16 nt, Human
cuauuaaaagacucau

SEQ ID NO: 3609785 - RNA, 18 nt, Human
cuauuaaaagacucaucc

SEQ ID NO: 3609786 - RNA, 19 nt, Human
cuauuaaaagacucauccg

SEQ ID NO: 3609787 - RNA, 19 nt, Human
cuauuaaagugcuaagguu

SEQ ID NO: 3609788 - RNA, 22 nt, Human
cuauuaaagugcuaagguucua

SEQ ID NO: 3609789 - RNA, 23 nt, Human
cuauuaaaguggagaagcacacu

SEQ ID NO: 3609790 - RNA, 21 nt, Human
cuauuaacaauuaauugucuu

SEQ ID NO: 3609791 - RNA, 23 nt, Human
cuauuaagaggcagaaaauugca

SEQ ID NO: 3609792 - RNA, 23 nt, Human
cuauuaaggugauauauuuaaaa

SEQ ID NO: 3609793 - RNA, 11 nt, Human
cuauuaauaua

SEQ ID NO: 3609794 - RNA, 12 nt, Human
cuauuaauauau

SEQ ID NO: 3609795 - RNA, 15 nt, Human
cuauuaauauaugua

SEQ ID NO: 3609796 - RNA, 22 nt, Human
cuauuacgaaguucaagaucaa

SEQ ID NO: 3609797 - RNA, 22 nt, Human
cuauuagacuuuagaaauaaau

SEQ ID NO: 3609798 - RNA, 15 nt, Human
cuauuagagaagaga

SEQ ID NO: 3609799 - RNA, 21 nt, Human
cuauuagcuuacugauuaacu

SEQ ID NO: 3609800 - RNA, 15 nt, Human
cuauuaguguuauau

SEQ ID NO: 3609801 - RNA, 16 nt, Human
cuauuaguguuauaug

SEQ ID NO: 3609802 - RNA, 16 nt, Human
cuauuauaauuuaaug

SEQ ID NO: 3609803 - RNA, 16 nt, Human
cuauuauccccauuuc

SEQ ID NO: 3609804 - RNA, 17 nt, Human
cuauuauccccauuucu

SEQ ID NO: 3609805 - RNA, 21 nt, Human
cuauuaugaaugugaagccuu

SEQ ID NO: 3609806 - RNA, 20 nt, Human
cuauuauguuguuagagaaa

SEQ ID NO: 3609807 - RNA, 18 nt, Human
cuauucaaacagucucag

SEQ ID NO: 3609808 - RNA, 12 nt, Human
caggugcagugg

SEQ ID NO: 3609809 - RNA, 18 nt, Human
caggugccagccugaggc

SEQ ID NO: 3609810 - RNA, 19 nt, Human
caggugccaguuauggcua

SEQ ID NO: 3609811 - RNA, 20 nt, Human
caggugcccaucccuggaag

SEQ ID NO: 3609812 - RNA, 18 nt, Human
caggugccccucucucca

SEQ ID NO: 3609813 - RNA, 14 nt, Human
caggugcccgccac

SEQ ID NO: 3609814 - RNA, 18 nt, Human
caggugcccgccaccaca

SEQ ID NO: 3609815 - RNA, 19 nt, Human
caggugccuccaggugugc

SEQ ID NO: 3609816 - RNA, 21 nt, Human
caggugccuccaggugugcac

SEQ ID NO: 3609817 - RNA, 12 nt, Human
caggugccugga

SEQ ID NO: 3609818 - RNA, 15 nt, Human
caggugccuuucaaa

SEQ ID NO: 3609819 - RNA, 21 nt, Human
caggugccuuucaaauuuaga

SEQ ID NO: 3609820 - RNA, 14 nt, Human
caggugcgaaagga

SEQ ID NO: 3609821 - RNA, 20 nt, Human
caggugcuaggaacacuccu

SEQ ID NO: 3609822 - RNA, 18 nt, Human
caggugcuauuguuacuc

SEQ ID NO: 3609823 - RNA, 20 nt, Human
caggugcuauuguuacucuu

SEQ ID NO: 3609824 - RNA, 17 nt, Human
caggugcucaaaaugca

SEQ ID NO: 3609825 - RNA, 14 nt, Human
caggugcuccccug

SEQ ID NO: 3609826 - RNA, 20 nt, Human
caggugcugacuucaucucc

SEQ ID NO: 3609827 - RNA, 21 nt, Human
caggugcugacuucaucuccc

SEQ ID NO: 3609828 - RNA, 23 nt, Human
caggugcugacuucaucucccac

SEQ ID NO: 3609829 - RNA, 20 nt, Human
caggugcugcuacccucccu

SEQ ID NO: 3609830 - RNA, 17 nt, Human
caggugcuggggccugg

SEQ ID NO: 3609831 - RNA, 18 nt, Human
caggugcuggggccuggu

SEQ ID NO: 3609832 - RNA, 13 nt, Human
caggugcugucca

SEQ ID NO: 3609833 - RNA, 14 nt, Human
caggugcuguccau

SEQ ID NO: 3609834 - RNA, 19 nt, Human
cagguggaaggcagacagc

SEQ ID NO: 3609835 - RNA, 21 nt, Human
ccggccucuccagccucagcc

SEQ ID NO: 3609836 - RNA, 12 nt, Human
ccggccucucug

SEQ ID NO: 3609837 - RNA, 13 nt, Human
ccggccucucugg

SEQ ID NO: 3609838 - RNA, 21 nt, Human
ccggccucucuggccucccac

SEQ ID NO: 3609839 - RNA, 22 nt, Human
ccggccucucuggccucccacc

SEQ ID NO: 3609840 - RNA, 14 nt, Human
ccggcgcccucugu

SEQ ID NO: 3609841 - RNA, 17 nt, Human
ccggcgcccucuguccu

SEQ ID NO: 3609842 - RNA, 19 nt, Human
ccggcgcccucuguccuga

SEQ ID NO: 3609843 - RNA, 21 nt, Human
ccggcgcccucuguccugacu

SEQ ID NO: 3609844 - RNA, 19 nt, Human
ccggcgucagccuccagcc

SEQ ID NO: 3609845 - RNA, 21 nt, Human
ccggcuaagcaggcgcaaggg

SEQ ID NO: 3609846 - RNA, 19 nt, Human
ccggcuaauuuuuguauuu

SEQ ID NO: 3609847 - RNA, 17 nt, Human
ccggcuaugggggcacu

SEQ ID NO: 3609848 - RNA, 12 nt, Human
ccggcuccaggc

SEQ ID NO: 3609849 - RNA, 13 nt, Human
ccggcucccagcc

SEQ ID NO: 3609850 - RNA, 15 nt, Human
ccggcuccuggucac

SEQ ID NO: 3609851 - RNA, 17 nt, Human
ccggcucucaccuggcc

SEQ ID NO: 3609852 - RNA, 15 nt, Human
ccggcucugugggug

SEQ ID NO: 3609853 - RNA, 18 nt, Human
ccggcugcauacccgggc

SEQ ID NO: 3609854 - RNA, 22 nt, Human
ccggcugcauacccgggcaggg

SEQ ID NO: 3609855 - RNA, 15 nt, Human
ccggcuggccuggcc

SEQ ID NO: 3609856 - RNA, 17 nt, Human
ccggcugugcugggaga

SEQ ID NO: 3609857 - RNA, 19 nt, Human
ccggcuuccuuucccaagc

SEQ ID NO: 3609858 - RNA, 16 nt, Human
ccggcuuuguggcacu

SEQ ID NO: 3609859 - RNA, 22 nt, Human
ccgggaaccuccccagccugcg

SEQ ID NO: 3609860 - RNA, 21 nt, Human
ccgggaagugagggcucacuc

SEQ ID NO: 3609861 - RNA, 19 nt, Human
ccgggacaccuaggcuagg

SEQ ID NO: 3609862 - RNA, 20 nt, Human
ccgggaccacccugagccgg

SEQ ID NO: 3609863 - RNA, 14 nt, Human
ccgggaccccgagc

SEQ ID NO: 3609864 - RNA, 18 nt, Human
ccgggaccccgagccugg

SEQ ID NO: 3609865 - RNA, 19 nt, Human
ccgggacucacuggcagcc

SEQ ID NO: 3609866 - RNA, 12 nt, Human
ccgggacucugc

SEQ ID NO: 3609867 - RNA, 19 nt, Human
ccgggagccuaggaccacu

SEQ ID NO: 3609868 - RNA, 16 nt, Human
ccgggagccugaucac

SEQ ID NO: 3609869 - RNA, 13 nt, Human
ccgggagcucagg

SEQ ID NO: 3609870 - RNA, 16 nt, Human
ccgggaggggcccgcu

SEQ ID NO: 3609871 - RNA, 22 nt, Human
ccgggagggugcggcugugcag

SEQ ID NO: 3609872 - RNA, 18 nt, Human
ccgggcaaaugccagggc

SEQ ID NO: 3609873 - RNA, 19 nt, Human
ccgggcaaaugccagggcc

SEQ ID NO: 3609874 - RNA, 17 nt, Human
ccgggcacagcuguggu

SEQ ID NO: 3609875 - RNA, 20 nt, Human
ccgggcacucagaagacacu

SEQ ID NO: 3609876 - RNA, 15 nt, Human
ccgggcagaggggca

SEQ ID NO: 3609877 - RNA, 20 nt, Human
ccgggccacuccuuccugcc

SEQ ID NO: 3609878 - RNA, 10 nt, Human
ccgggcccag

SEQ ID NO: 3609879 - RNA, 20 nt, Human
ccgggcccagaggagcuggg

SEQ ID NO: 3609880 - RNA, 19 nt, Human
ccgggccccugggcuuggc

SEQ ID NO: 3609881 - RNA, 18 nt, Human
ccgggcccucccuuggaa

SEQ ID NO: 3609882 - RNA, 23 nt, Human
ccgggccgaauccccucccuguc

SEQ ID NO: 3609883 - RNA, 19 nt, Human
ccgggccuggagaacuaga

SEQ ID NO: 3609884 - RNA, 14 nt, Human
ccgggccuguacag

SEQ ID NO: 3609885 - RNA, 17 nt, Human
ccgggcgcggccagccc

SEQ ID NO: 3609886 - RNA, 20 nt, Human
ccgggcucagggaccacagc

SEQ ID NO: 3609887 - RNA, 13 nt, Human
ccgggcucucugc

SEQ ID NO: 3609888 - RNA, 16 nt, Human
ccgggcucucugcugu

SEQ ID NO: 3609889 - RNA, 14 nt, Human
ccgggcucugccuc

SEQ ID NO: 3609890 - RNA, 18 nt, Human
ccgggcucugccucccau

SEQ ID NO: 3609891 - RNA, 22 nt, Human
ccgggcucugccucccaucacc

SEQ ID NO: 3609892 - RNA, 12 nt, Human
ccgggcugccug

SEQ ID NO: 3609893 - RNA, 18 nt, Human
ccgggcugccugggcugu

SEQ ID NO: 3609894 - RNA, 20 nt, Human
ccggggaacuggccaagcug

SEQ ID NO: 3609895 - RNA, 15 nt, Human
ccggggacccuguga

SEQ ID NO: 3609896 - RNA, 23 nt, Human
ccggggaggagagagcagcuucu

SEQ ID NO: 3609897 - RNA, 15 nt, Human
ccggggaggggcgcu

SEQ ID NO: 3609898 - RNA, 22 nt, Human
ccggggaguuucuuuccugccu

SEQ ID NO: 3609899 - RNA, 19 nt, Human
ccggggcagcagcagcccu

SEQ ID NO: 3609900 - RNA, 15 nt, Human
ccggggccagcacuu

SEQ ID NO: 3609901 - RNA, 13 nt, Human
ccggggcuggguu

SEQ ID NO: 3609902 - RNA, 16 nt, Human
ccggggggucucuucu

SEQ ID NO: 3609903 - RNA, 21 nt, Human
ccggggugggguggcugcagc

SEQ ID NO: 3609904 - RNA, 14 nt, Human
ccgggucugccucu

SEQ ID NO: 3609905 - RNA, 14 nt, Human
ccgggugggcggca

SEQ ID NO: 3609906 - RNA, 22 nt, Human
ccggguguccccaacagcgccc

SEQ ID NO: 3609907 - RNA, 23 nt, Human
ccggguguccccaacagcgccca

SEQ ID NO: 3609908 - RNA, 12 nt, Human
ccggguuccagc

SEQ ID NO: 3609909 - RNA, 15 nt, Human
ccggguuccagcacc

SEQ ID NO: 3609910 - RNA, 19 nt, Human
ccggguuuggcgggccaag

SEQ ID NO: 3609911 - RNA, 18 nt, Human
ccgguaacuguccugucc

SEQ ID NO: 3609912 - RNA, 21 nt, Human
ccgguaacuguccuguccugc

SEQ ID NO: 3609913 - RNA, 23 nt, Human
ccggucaggcacacaaggggccc

SEQ ID NO: 3609914 - RNA, 20 nt, Human
ccggucccaccccucccucu

SEQ ID NO: 3609915 - RNA, 18 nt, Human
ccggucccuugagaccuc

SEQ ID NO: 3609916 - RNA, 18 nt, Human
ccggucgcccuuugcugc

SEQ ID NO: 3609917 - RNA, 20 nt, Human
ccggucugcaagucagagga

SEQ ID NO: 3609918 - RNA, 21 nt, Human
ccggucugcaagucagaggau

SEQ ID NO: 3609919 - RNA, 15 nt, Human
ccgguggaaggccuu

SEQ ID NO: 3609920 - RNA, 18 nt, Human
ccgguggcggccccagca

SEQ ID NO: 3609921 - RNA, 14 nt, Human
ccgguggcugggca

SEQ ID NO: 3609922 - RNA, 22 nt, Human
ccggugggacccccguggggca

SEQ ID NO: 3609923 - RNA, 16 nt, Human
ccggugggggggcaga

SEQ ID NO: 3609924 - RNA, 21 nt, Human
ccggugggggggcagagcccu

SEQ ID NO: 3609925 - RNA, 11 nt, Human
ccgguguccuu

SEQ ID NO: 3609926 - RNA, 15 nt, Human
ccggugugccugcag

SEQ ID NO: 3609927 - RNA, 17 nt, Human
ccggugugccugcagcc

SEQ ID NO: 3609928 - RNA, 12 nt, Human
ccgguguucuaa

SEQ ID NO: 3609929 - RNA, 17 nt, Human
ccgguuccugucccugc

SEQ ID NO: 3609930 - RNA, 19 nt, Human
ccgguuccugucccugcgc

SEQ ID NO: 3609931 - RNA, 20 nt, Human
ccgguucuuccagugguuug

SEQ ID NO: 3609932 - RNA, 20 nt, Human
ccgguuucgaaguugaugca

SEQ ID NO: 3609933 - RNA, 15 nt, Human
ccgguuucuuuuuaa

SEQ ID NO: 3609934 - RNA, 16 nt, Human
ccguaaaaacugaagu

SEQ ID NO: 3609935 - RNA, 18 nt, Human
ccguaaagugagcaugcu

SEQ ID NO: 3609936 - RNA, 23 nt, Human
ccguaaagugagcaugcuuucug

SEQ ID NO: 3609937 - RNA, 15 nt, Human
ccguaacccaacucu

SEQ ID NO: 3609938 - RNA, 20 nt, Human
ccguaauaacacccuuccuu

SEQ ID NO: 3609939 - RNA, 17 nt, Human
ccguaauaauuauuauu

SEQ ID NO: 3609940 - RNA, 13 nt, Human
ccguaauuuaacu

SEQ ID NO: 3609941 - RNA, 18 nt, Human
ccguacauucaauguuua

SEQ ID NO: 3609942 - RNA, 18 nt, Human
ccguagaaaucccccuuu

SEQ ID NO: 3609943 - RNA, 17 nt, Human
ccguaggacccaagcag

SEQ ID NO: 3609944 - RNA, 22 nt, Human
ccguaguagauguucuacuuug

SEQ ID NO: 3609945 - RNA, 22 nt, Human
ccguaguaucagagauguccau

SEQ ID NO: 3609946 - RNA, 14 nt, Human
ccguaguucccuga

SEQ ID NO: 3609947 - RNA, 15 nt, Human
ccguaguucccugaa

SEQ ID NO: 3609948 - RNA, 16 nt, Human
ccguaguucccugaaa

SEQ ID NO: 3609949 - RNA, 22 nt, Human
ccguaguucccugaaaacccag

SEQ ID NO: 3609950 - RNA, 20 nt, Human
ccguaucuccggcucccagc

SEQ ID NO: 3609951 - RNA, 22 nt, Human
ccgucaccaccaccccuaccac

SEQ ID NO: 3609952 - RNA, 19 nt, Human
ccgucaccacgacuggcca

SEQ ID NO: 3609953 - RNA, 20 nt, Human
ccgucaccacgacuggccag

SEQ ID NO: 3609954 - RNA, 17 nt, Human
ccgucagccaaauguaa

SEQ ID NO: 3609955 - RNA, 16 nt, Human
ccgucauguuccucaa

SEQ ID NO: 3609956 - RNA, 14 nt, Human
ccguccagaccuug

SEQ ID NO: 3609957 - RNA, 21 nt, Human
ccguccauaucagaacugugc

SEQ ID NO: 3609958 - RNA, 14 nt, Human
ccgucccccucugg

SEQ ID NO: 3609959 - RNA, 15 nt, Human
ccguccccuagaguc

SEQ ID NO: 3609960 - RNA, 15 nt, Human
ccguccccucccagg

SEQ ID NO: 3609961 - RNA, 13 nt, Human
ccguccgcccugc

SEQ ID NO: 3609962 - RNA, 14 nt, Human
ccguccgcccugcu

SEQ ID NO: 3609963 - RNA, 19 nt, Human
ccguccucaccccuguccu

SEQ ID NO: 3609964 - RNA, 24 nt, Human
ccguccucaccccuguccucacug

SEQ ID NO: 3609965 - RNA, 19 nt, Human
ccguccucccgggcccucc

SEQ ID NO: 3609966 - RNA, 15 nt, Human
ccguccugccugugg

SEQ ID NO: 3609967 - RNA, 22 nt, Human
ccgucgaggggcucucagcuca

SEQ ID NO: 3609968 - RNA, 11 nt, Human
ccgucuacauu

SEQ ID NO: 3609969 - RNA, 17 nt, Human
ccgucuaccugaggggc

SEQ ID NO: 3609970 - RNA, 19 nt, Human
ccgucuaguuaacauuuca

SEQ ID NO: 3609971 - RNA, 21 nt, Human
ccgucucaguguugagccuuu

SEQ ID NO: 3609972 - RNA, 15 nt, Human
ccgucuccagcugcu

SEQ ID NO: 3609973 - RNA, 20 nt, Human
ccgucuccaggggcugcuuc

SEQ ID NO: 3609974 - RNA, 14 nt, Human
ccgucucucuccca

SEQ ID NO: 3609975 - RNA, 22 nt, Human
ccgucucucucccauggagccc

SEQ ID NO: 3609976 - RNA, 16 nt, Human
ccgucuggcccaccag

SEQ ID NO: 3609977 - RNA, 18 nt, Human
ccgucuggcccaccaggg

SEQ ID NO: 3609978 - RNA, 22 nt, Human
ccgucugggguucagccccucc

SEQ ID NO: 3609979 - RNA, 13 nt, Human
ccgucuguccauc

SEQ ID NO: 3609980 - RNA, 22 nt, Human
ccgucuguccaucugcccgccu

SEQ ID NO: 3609981 - RNA, 22 nt, Human
ccgucuuagaaguggaccagga

SEQ ID NO: 3609982 - RNA, 18 nt, Human
ccgugaaaacggagcuga

SEQ ID NO: 3609983 - RNA, 16 nt, Human
ccgugaacugugcaua

SEQ ID NO: 3609984 - RNA, 21 nt, Human
ccuccaaggaggggcuguaaa

SEQ ID NO: 3609985 - RNA, 13 nt, Human
ccuccaaggccag

SEQ ID NO: 3609986 - RNA, 14 nt, Human
ccuccaaggccagg

SEQ ID NO: 3609987 - RNA, 18 nt, Human
ccuccaaguccacagugg

SEQ ID NO: 3609988 - RNA, 13 nt, Human
ccuccacaccugc

SEQ ID NO: 3609989 - RNA, 15 nt, Human
ccuccacaccugcgg

SEQ ID NO: 3609990 - RNA, 16 nt, Human
ccuccacagccgcagc

SEQ ID NO: 3609991 - RNA, 17 nt, Human
ccuccacagccgcagcc

SEQ ID NO: 3609992 - RNA, 11 nt, Human
ccuccacagcu

SEQ ID NO: 3609993 - RNA, 15 nt, Human
ccuccacauccucca

SEQ ID NO: 3609994 - RNA, 16 nt, Human
ccuccacauccuuucu

SEQ ID NO: 3609995 - RNA, 14 nt, Human
ccuccaccaccacu

SEQ ID NO: 3609996 - RNA, 17 nt, Human
ccuccaccaccacuggc

SEQ ID NO: 3609997 - RNA, 20 nt, Human
ccuccaccaccacuggccac

SEQ ID NO: 3609998 - RNA, 16 nt, Human
ccuccaccacccuuuc

SEQ ID NO: 3609999 - RNA, 14 nt, Human
ccuccaccaccgcc

SEQ ID NO: 3610000 - RNA, 14 nt, Human
ccuccacccucuga

SEQ ID NO: 3610001 - RNA, 15 nt, Human
ccuccacccucugag

SEQ ID NO: 3610002 - RNA, 16 nt, Human
ccuccacccucugagc

SEQ ID NO: 3610003 - RNA, 11 nt, Human
ccuccacccug

SEQ ID NO: 3610004 - RNA, 15 nt, Human
ccuccacccuguccc

SEQ ID NO: 3610005 - RNA, 19 nt, Human
ccuccacccugucccccag

SEQ ID NO: 3610006 - RNA, 19 nt, Human
ccuccaccgccauggcuuc

SEQ ID NO: 3610007 - RNA, 21 nt, Human
ccuccaccgccauggcuucca

SEQ ID NO: 3610008 - RNA, 13 nt, Human
ccuccaccgcugc

SEQ ID NO: 3610009 - RNA, 15 nt, Human
ccuccaccgcugccu

SEQ ID NO: 3610010 - RNA, 12 nt, Human
ccuccaccucaa

SEQ ID NO: 3610011 - RNA, 15 nt, Human
ccuccaccucccugc

SEQ ID NO: 3610012 - RNA, 14 nt, Human
ccuccaccucuuca

SEQ ID NO: 3610013 - RNA, 15 nt, Human
ccuccaccugccgug

SEQ ID NO: 3610014 - RNA, 18 nt, Human
ccuccacguucaccccuc

SEQ ID NO: 3610015 - RNA, 21 nt, Human
ccuccacguucugcucaucau

SEQ ID NO: 3610016 - RNA, 17 nt, Human
ccuccacucucccccac

SEQ ID NO: 3610017 - RNA, 14 nt, Human
ccuccacugcccuc

SEQ ID NO: 3610018 - RNA, 18 nt, Human
ccuccagaacucuuccuc

SEQ ID NO: 3610019 - RNA, 13 nt, Human
ccuccagaagccu

SEQ ID NO: 3610020 - RNA, 17 nt, Human
ccuccagaagccucugg

SEQ ID NO: 3610021 - RNA, 22 nt, Human
ccuccagagcugcggugucucc

SEQ ID NO: 3610022 - RNA, 20 nt, Human
ccuccagcacaaacacaagg

SEQ ID NO: 3610023 - RNA, 13 nt, Human
ccuccagccccug

SEQ ID NO: 3610024 - RNA, 12 nt, Human
ccuccagcccgg

SEQ ID NO: 3610025 - RNA, 14 nt, Human
ccuccagcccggga

SEQ ID NO: 3610026 - RNA, 15 nt, Human
ccuccagcccgggag

SEQ ID NO: 3610027 - RNA, 12 nt, Human
ccuccagccucu

SEQ ID NO: 3610028 - RNA, 13 nt, Human
ccuccagccucug

SEQ ID NO: 3610029 - RNA, 14 nt, Human
ccuccagccucugu

SEQ ID NO: 3610030 - RNA, 13 nt, Human
ccuccagcucagc

SEQ ID NO: 3610031 - RNA, 17 nt, Human
ccuccagcucuuuccuc

SEQ ID NO: 3610032 - RNA, 22 nt, Human
ccuccagcucuuuccuccuucc

SEQ ID NO: 3610033 - RNA, 20 nt, Human
ccuccagcugcaccagagca

SEQ ID NO: 3610034 - RNA, 12 nt, Human
ccuccagcuguu

SEQ ID NO: 3610035 - RNA, 12 nt, Human
ccuccagcuucu

SEQ ID NO: 3610036 - RNA, 21 nt, Human
ccuccagcuucugguacucuc

SEQ ID NO: 3610037 - RNA, 13 nt, Human
ccuccagcuuucc

SEQ ID NO: 3610038 - RNA, 14 nt, Human
ccuccagcuuuccu

SEQ ID NO: 3610039 - RNA, 16 nt, Human
ccuccaggcccgucug

SEQ ID NO: 3610040 - RNA, 15 nt, Human
ccuccaggccugccu

SEQ ID NO: 3610041 - RNA, 20 nt, Human
ccuccaggccugccucccac

SEQ ID NO: 3610042 - RNA, 13 nt, Human
ccuccagggacag

SEQ ID NO: 3610043 - RNA, 12 nt, Human
ccuccagggcca

SEQ ID NO: 3610044 - RNA, 17 nt, Human
ccuccagggccacgugc

SEQ ID NO: 3610045 - RNA, 18 nt, Human
ccuccagggccacgugcc

SEQ ID NO: 3610046 - RNA, 12 nt, Human
ccuccagggcug

SEQ ID NO: 3610047 - RNA, 13 nt, Human
ccuccagggcugg

SEQ ID NO: 3610048 - RNA, 16 nt, Human
ccuccagggcuggacu

SEQ ID NO: 3610049 - RNA, 20 nt, Human
ccuccagggcuggacugagg

SEQ ID NO: 3610050 - RNA, 17 nt, Human
ccuccagggugugugcu

SEQ ID NO: 3610051 - RNA, 19 nt, Human
ccuccaggugcacaagcuc

SEQ ID NO: 3610052 - RNA, 14 nt, Human
ccuccaggugcaga

SEQ ID NO: 3610053 - RNA, 17 nt, Human
ccuccaggugcagaggu

SEQ ID NO: 3610054 - RNA, 11 nt, Human
ccuccagguuu

SEQ ID NO: 3610055 - RNA, 23 nt, Human
ccuccaguccaaggaaaccacag

SEQ ID NO: 3610056 - RNA, 14 nt, Human
ccuccagucccccu

SEQ ID NO: 3610057 - RNA, 22 nt, Human
ccuccauccuacccccugugcc

SEQ ID NO: 3610058 - RNA, 23 nt, Human
ccuccauccuacccccugugccu

SEQ ID NO: 3610059 - RNA, 13 nt, Human
ccuccauccuagu

SEQ ID NO: 3610060 - RNA, 18 nt, Human
ccuccauccuccuccuuc

SEQ ID NO: 3610061 - RNA, 21 nt, Human
ccuccauccuccuccuuccua

SEQ ID NO: 3610062 - RNA, 14 nt, Human
ccuccauccugagg

SEQ ID NO: 3610063 - RNA, 14 nt, Human
ccuccaugcugccu

SEQ ID NO: 3610064 - RNA, 16 nt, Human
ccuccaugcugccucc

SEQ ID NO: 3610065 - RNA, 15 nt, Human
ccuccauggugccuc

SEQ ID NO: 3610066 - RNA, 15 nt, Human
ccuccaugugggcua

SEQ ID NO: 3610067 - RNA, 23 nt, Human
ccuccaugugggcuaguugggcu

SEQ ID NO: 3610068 - RNA, 20 nt, Human
ccuccauucuauuuuagaau

SEQ ID NO: 3610069 - RNA, 15 nt, Human
ccuccauucugacca

SEQ ID NO: 3610070 - RNA, 17 nt, Human
ccucccaaagugcuggg

SEQ ID NO: 3610071 - RNA, 14 nt, Human
ccucccaaggagaa

SEQ ID NO: 3610072 - RNA, 15 nt, Human
ccucccaaggagaac

SEQ ID NO: 3610073 - RNA, 21 nt, Human
ccucccaaggagaacaaauau

SEQ ID NO: 3610074 - RNA, 17 nt, Human
ccucccaaguggugccu

SEQ ID NO: 3610075 - RNA, 11 nt, Human
ccucccacaca

SEQ ID NO: 3610076 - RNA, 15 nt, Human
ccucccacacuccca

SEQ ID NO: 3610077 - RNA, 19 nt, Human
ccucccacacucccaaggu

SEQ ID NO: 3610078 - RNA, 12 nt, Human
ccucccacagug

SEQ ID NO: 3610079 - RNA, 23 nt, Human
ccucccacagugacucgggcucc

SEQ ID NO: 3610080 - RNA, 15 nt, Human
ccucccacagugcug

SEQ ID NO: 3610081 - RNA, 12 nt, Human
ccucccaccaca

SEQ ID NO: 3610082 - RNA, 14 nt, Human
ccucccaccacagc

SEQ ID NO: 3610083 - RNA, 13 nt, Human
ccucccacccacc

SEQ ID NO: 3610084 - RNA, 12 nt, Human
ccucccaccccc

SEQ ID NO: 3610085 - RNA, 14 nt, Human
ccucccacccccag

SEQ ID NO: 3610086 - RNA, 16 nt, Human
ccucccacccccagcc

SEQ ID NO: 3610087 - RNA, 17 nt, Human
ccucccacccccaucuc

SEQ ID NO: 3610088 - RNA, 21 nt, Human
ccucccacccccuucucugcu

SEQ ID NO: 3610089 - RNA, 19 nt, Human
ccucccacccgaugcugcu

SEQ ID NO: 3610090 - RNA, 17 nt, Human
ccucccaccucagccuc

SEQ ID NO: 3610091 - RNA, 15 nt, Human
ccucccaccuccagu

SEQ ID NO: 3610092 - RNA, 13 nt, Human
ccucccaccucug

SEQ ID NO: 3610093 - RNA, 15 nt, Human
ccucccacugcccac

SEQ ID NO: 3610094 - RNA, 19 nt, Human
ccucccacugcccacuggc

SEQ ID NO: 3610095 - RNA, 23 nt, Human
ccucccacugcccacuggccggc

SEQ ID NO: 3610096 - RNA, 20 nt, Human
ccucccagagcaccugcugu

SEQ ID NO: 3610097 - RNA, 23 nt, Human
ccucccagagcugguggacccag

SEQ ID NO: 3610098 - RNA, 20 nt, Human
ccucccagaggagccaccag

SEQ ID NO: 3610099 - RNA, 22 nt, Human
ccucccagagguccagcccauc

SEQ ID NO: 3610100 - RNA, 23 nt, Human
ccucccagagguccagcccaucu

SEQ ID NO: 3610101 - RNA, 15 nt, Human
ccucccagcccauaa

SEQ ID NO: 3610102 - RNA, 12 nt, Human
ccucccagccug

SEQ ID NO: 3610103 - RNA, 12 nt, Human
ccucccagcucc

SEQ ID NO: 3610104 - RNA, 12 nt, Human
ccucccagcucu

SEQ ID NO: 3610105 - RNA, 16 nt, Human
ccucccagcugacagu

SEQ ID NO: 3610106 - RNA, 16 nt, Human
ccucccaggaagccca

SEQ ID NO: 3610107 - RNA, 19 nt, Human
ccucccaggguuuuaacuu

SEQ ID NO: 3610108 - RNA, 12 nt, Human
ccucccaucacc

SEQ ID NO: 3610109 - RNA, 17 nt, Human
ccucccaucacccgcua

SEQ ID NO: 3610110 - RNA, 23 nt, Human
ccucccaucauuacccuucccug

SEQ ID NO: 3610111 - RNA, 15 nt, Human
ccucccauccagggc

SEQ ID NO: 3610112 - RNA, 13 nt, Human
ccucccaucucac

SEQ ID NO: 3610113 - RNA, 16 nt, Human
ccucccaucucacaca

SEQ ID NO: 3610114 - RNA, 16 nt, Human
ccucccaucugggagu

SEQ ID NO: 3610115 - RNA, 15 nt, Human
ccucccauggcaccu

SEQ ID NO: 3610116 - RNA, 15 nt, Human
ccucccaugucacug

SEQ ID NO: 3610117 - RNA, 20 nt, Human
ccuccccaaaucaauacacu

SEQ ID NO: 3610118 - RNA, 17 nt, Human
ccuccccacgcccuccc

SEQ ID NO: 3610119 - RNA, 22 nt, Human
ccuccccagcauuccagccccu

SEQ ID NO: 3610120 - RNA, 17 nt, Human
ccuccccagccccuagc

SEQ ID NO: 3610121 - RNA, 21 nt, Human
ccuccccagccugcgccugcu

SEQ ID NO: 3610122 - RNA, 22 nt, Human
ccuccccagccugcgccugcug

SEQ ID NO: 3610123 - RNA, 22 nt, Human
ccuccccaggggagagggucug

SEQ ID NO: 3610124 - RNA, 19 nt, Human
ccuccccagugcaaaugca

SEQ ID NO: 3610125 - RNA, 16 nt, Human
ccuccccauggagcca

SEQ ID NO: 3610126 - RNA, 21 nt, Human
ccuccccauuucccaucugca

SEQ ID NO: 3610127 - RNA, 13 nt, Human
ccucccccaaccc

SEQ ID NO: 3610128 - RNA, 18 nt, Human
ccucccccaacccccacc

SEQ ID NO: 3610129 - RNA, 15 nt, Human
ccucccccacugcca

SEQ ID NO: 3610130 - RNA, 18 nt, Human
ccucccccagccacuccc

SEQ ID NO: 3610131 - RNA, 16 nt, Human
ccuccccccacugcag

SEQ ID NO: 3610132 - RNA, 17 nt, Human
ccuccccccacugcagg

SEQ ID NO: 3610133 - RNA, 17 nt, Human
ccucccccccaugcacu

SEQ ID NO: 3610134 - RNA, 14 nt, Human
ccucccccuccuuc

SEQ ID NO: 3610135 - RNA, 21 nt, Human
ccuccccgcaccccccaagcu

SEQ ID NO: 3610136 - RNA, 14 nt, Human
ccuccccggcccua

SEQ ID NO: 3610137 - RNA, 23 nt, Human
cagguggaggugucaggcugcug

SEQ ID NO: 3610138 - RNA, 16 nt, Human
cagguggcaggaccag

SEQ ID NO: 3610139 - RNA, 17 nt, Human
cagguggcaggaccagg

SEQ ID NO: 3610140 - RNA, 17 nt, Human
cagguggccaaguuccu

SEQ ID NO: 3610141 - RNA, 20 nt, Human
cagguggccaaguuccucua

SEQ ID NO: 3610142 - RNA, 15 nt, Human
cagguggccacucca

SEQ ID NO: 3610143 - RNA, 16 nt, Human
cagguggccacuccag

SEQ ID NO: 3610144 - RNA, 19 nt, Human
cagguggccaugccucagc

SEQ ID NO: 3610145 - RNA, 14 nt, Human
cagguggcugaccc

SEQ ID NO: 3610146 - RNA, 15 nt, Human
cagguggcugaccca

SEQ ID NO: 3610147 - RNA, 14 nt, Human
caggugggaggugu

SEQ ID NO: 3610148 - RNA, 21 nt, Human
caggugggcgggcagcacagc

SEQ ID NO: 3610149 - RNA, 22 nt, Human
caggugggcgggcagcacagca

SEQ ID NO: 3610150 - RNA, 23 nt, Human
caggugggcguggucacugcugu

SEQ ID NO: 3610151 - RNA, 22 nt, Human
caggugggcuucccaguggcug

SEQ ID NO: 3610152 - RNA, 12 nt, Human
cagguggggagg

SEQ ID NO: 3610153 - RNA, 13 nt, Human
cagguggggcagc

SEQ ID NO: 3610154 - RNA, 14 nt, Human
cagguggggcagcu

SEQ ID NO: 3610155 - RNA, 13 nt, Human
caggugggucccg

SEQ ID NO: 3610156 - RNA, 20 nt, Human
caggugguccugagaccuga

SEQ ID NO: 3610157 - RNA, 21 nt, Human
caggugguggcacugagcccc

SEQ ID NO: 3610158 - RNA, 18 nt, Human
caggugguuauggagagg

SEQ ID NO: 3610159 - RNA, 14 nt, Human
caggugucagccau

SEQ ID NO: 3610160 - RNA, 21 nt, Human
caggugucauauauggggggc

SEQ ID NO: 3610161 - RNA, 14 nt, Human
cagguguccccagc

SEQ ID NO: 3610162 - RNA, 18 nt, Human
cagguguccccagcccac

SEQ ID NO: 3610163 - RNA, 20 nt, Human
cagguguccccagcccacug

SEQ ID NO: 3610164 - RNA, 16 nt, Human
caggugucccugcacu

SEQ ID NO: 3610165 - RNA, 12 nt, Human
caggugugaacc

SEQ ID NO: 3610166 - RNA, 19 nt, Human
caggugugaaccaccacac

SEQ ID NO: 3610167 - RNA, 13 nt, Human
caggugugcacgu

SEQ ID NO: 3610168 - RNA, 14 nt, Human
cagguguugccaaa

SEQ ID NO: 3610169 - RNA, 14 nt, Human
cagguuaaauguuu

SEQ ID NO: 3610170 - RNA, 16 nt, Human
cagguuaaauguuuug

SEQ ID NO: 3610171 - RNA, 19 nt, Human
cagguuacaacagauuugu

SEQ ID NO: 3610172 - RNA, 19 nt, Human
cagguuagaaccuagaagg

SEQ ID NO: 3610173 - RNA, 11 nt, Human
cagguuagaga

SEQ ID NO: 3610174 - RNA, 23 nt, Human
cagguuaucgaaauaacaauguu

SEQ ID NO: 3610175 - RNA, 17 nt, Human
cagguucaacccacagc

SEQ ID NO: 3610176 - RNA, 22 nt, Human
cagguucacaggcgaggccugg

SEQ ID NO: 3610177 - RNA, 12 nt, Human
cagguucagcuu

SEQ ID NO: 3610178 - RNA, 16 nt, Human
cagguucaguauuaug

SEQ ID NO: 3610179 - RNA, 19 nt, Human
cagguuccacagaggacac

SEQ ID NO: 3610180 - RNA, 23 nt, Human
cagguucccucccagaggagcca

SEQ ID NO: 3610181 - RNA, 17 nt, Human
cagguuccuauggcugg

SEQ ID NO: 3610182 - RNA, 15 nt, Human
cagguucuauuugga

SEQ ID NO: 3610183 - RNA, 17 nt, Human
cagguucuauuuggaau

SEQ ID NO: 3610184 - RNA, 24 nt, Human
cagguucuccguuagcuccugugg

SEQ ID NO: 3610185 - RNA, 17 nt, Human
cagguucucucucacug

SEQ ID NO: 3610186 - RNA, 14 nt, Human
cagguucugaaaga

SEQ ID NO: 3610187 - RNA, 23 nt, Human
cagguucugaaagagucuuucuu

SEQ ID NO: 3610188 - RNA, 15 nt, Human
cagguugaagaccua

SEQ ID NO: 3610189 - RNA, 18 nt, Human
cagguugaagccaugucu

SEQ ID NO: 3610190 - RNA, 21 nt, Human
cagguugaggggcuccuggaa

SEQ ID NO: 3610191 - RNA, 22 nt, Human
cagguugaggggcuccuggaaa

SEQ ID NO: 3610192 - RNA, 15 nt, Human
cagguugauaaauca

SEQ ID NO: 3610193 - RNA, 21 nt, Human
cagguuggcucugccaguccu

SEQ ID NO: 3610194 - RNA, 20 nt, Human
cagguugggaaugaggcuug

SEQ ID NO: 3610195 - RNA, 15 nt, Human
cagguugggauggga

SEQ ID NO: 3610196 - RNA, 21 nt, Human
cagguugggccauacuggccu

SEQ ID NO: 3610197 - RNA, 22 nt, Human
cagguugggccauacuggccuc

SEQ ID NO: 3610198 - RNA, 17 nt, Human
cagguuuaacauuugcc

SEQ ID NO: 3610199 - RNA, 18 nt, Human
cagguuuaagcuguuacu

SEQ ID NO: 3610200 - RNA, 17 nt, Human
cagguuucuggucucua

SEQ ID NO: 3610201 - RNA, 15 nt, Human
cagguuugggacccc

SEQ ID NO: 3610202 - RNA, 19 nt, Human
cagguuuucuuuuaagaau

SEQ ID NO: 3610203 - RNA, 20 nt, Human
cagguuuuguuuuuuuucag

SEQ ID NO: 3610204 - RNA, 23 nt, Human
cagguuuuguuuuuuuucagcca

SEQ ID NO: 3610205 - RNA, 14 nt, Human
cagguuuuucaauu

SEQ ID NO: 3610206 - RNA, 22 nt, Human
cagguuuuucaauuaaacggau

SEQ ID NO: 3610207 - RNA, 23 nt, Human
cagguuuuucaauuaaacggauu

SEQ ID NO: 3610208 - RNA, 14 nt, Human
caguaaaauagcug

SEQ ID NO: 3610209 - RNA, 18 nt, Human
caguaaaauugccauauu

SEQ ID NO: 3610210 - RNA, 10 nt, Human
caguaaacau

SEQ ID NO: 3610211 - RNA, 21 nt, Human
caguaaaccacugaaaaaaua

SEQ ID NO: 3610212 - RNA, 16 nt, Human
caguaaaccugucuga

SEQ ID NO: 3610213 - RNA, 21 nt, Human
caguaaacgggaacaugcccc

SEQ ID NO: 3610214 - RNA, 14 nt, Human
caguaaacuuuuaa

SEQ ID NO: 3610215 - RNA, 18 nt, Human
caguaaagagaaacuuug

SEQ ID NO: 3610216 - RNA, 23 nt, Human
caguaaagagaaacuuugugcua

SEQ ID NO: 3610217 - RNA, 14 nt, Human
caguaaauaaauug

SEQ ID NO: 3610218 - RNA, 17 nt, Human
caguaaauaaauuguuu

SEQ ID NO: 3610219 - RNA, 14 nt, Human
caguaaauaacagg

SEQ ID NO: 3610220 - RNA, 20 nt, Human
caguaaaucuuuuacaacug

SEQ ID NO: 3610221 - RNA, 20 nt, Human
caguaaaugggggugcauuu

SEQ ID NO: 3610222 - RNA, 12 nt, Human
caguaacacgcu

SEQ ID NO: 3610223 - RNA, 20 nt, Human
caguaacagggccuugcuaa

SEQ ID NO: 3610224 - RNA, 18 nt, Human
caguaacccccuuaaauu

SEQ ID NO: 3610225 - RNA, 18 nt, Human
caguaacgcgucuuccug

SEQ ID NO: 3610226 - RNA, 19 nt, Human
caguaacgcgucuuccuga

SEQ ID NO: 3610227 - RNA, 22 nt, Human
caguaacgggucguaaugacuu

SEQ ID NO: 3610228 - RNA, 16 nt, Human
caguaacucaucuguc

SEQ ID NO: 3610229 - RNA, 9 nt, Human
caguaacug

SEQ ID NO: 3610230 - RNA, 10 nt, Human
caguaacugu

SEQ ID NO: 3610231 - RNA, 19 nt, Human
caguaacuuuauguguaaa

SEQ ID NO: 3610232 - RNA, 20 nt, Human
caguaacuuuauguguaaau

SEQ ID NO: 3610233 - RNA, 16 nt, Human
caguaagaccggaagc

SEQ ID NO: 3610234 - RNA, 17 nt, Human
caguaagaccggaagcu

SEQ ID NO: 3610235 - RNA, 23 nt, Human
caguaagaccggaagcuccuggu

SEQ ID NO: 3610236 - RNA, 20 nt, Human
caguaagauaucucaaugaa

SEQ ID NO: 3610237 - RNA, 15 nt, Human
caguaagaucacugu

SEQ ID NO: 3610238 - RNA, 17 nt, Human
caguaagaucacuguuu

SEQ ID NO: 3610239 - RNA, 20 nt, Human
caguaagaucacuguuuaga

SEQ ID NO: 3610240 - RNA, 19 nt, Human
caguaagcugcucuauugu

SEQ ID NO: 3610241 - RNA, 13 nt, Human
caguaaggcaggg

SEQ ID NO: 3610242 - RNA, 18 nt, Human
caguaagggaaauagaaa

SEQ ID NO: 3610243 - RNA, 19 nt, Human
ccuccuaaaaggcccagag

SEQ ID NO: 3610244 - RNA, 15 nt, Human
ccuccuaagagagag

SEQ ID NO: 3610245 - RNA, 16 nt, Human
ccuccuacccugcgcc

SEQ ID NO: 3610246 - RNA, 19 nt, Human
ccuccuaucagaaguuucu

SEQ ID NO: 3610247 - RNA, 12 nt, Human
ccuccuauucua

SEQ ID NO: 3610248 - RNA, 12 nt, Human
ccuccucaccuc

SEQ ID NO: 3610249 - RNA, 14 nt, Human
ccuccucaccucau

SEQ ID NO: 3610250 - RNA, 17 nt, Human
ccuccucaccucaugcc

SEQ ID NO: 3610251 - RNA, 19 nt, Human
ccuccucaccucaugccca

SEQ ID NO: 3610252 - RNA, 16 nt, Human
ccuccucaccucugga

SEQ ID NO: 3610253 - RNA, 21 nt, Human
ccuccucaccucuggacuggc

SEQ ID NO: 3610254 - RNA, 14 nt, Human
ccuccucacucccu

SEQ ID NO: 3610255 - RNA, 17 nt, Human
ccuccucacuggccauc

SEQ ID NO: 3610256 - RNA, 11 nt, Human
ccuccucagau

SEQ ID NO: 3610257 - RNA, 12 nt, Human
ccuccucagccu

SEQ ID NO: 3610258 - RNA, 15 nt, Human
ccuccucagccugaa

SEQ ID NO: 3610259 - RNA, 22 nt, Human
ccuccucagccugaaccccagg

SEQ ID NO: 3610260 - RNA, 12 nt, Human
ccuccucaggga

SEQ ID NO: 3610261 - RNA, 13 nt, Human
ccuccucaucccg

SEQ ID NO: 3610262 - RNA, 16 nt, Human
ccuccuccagccccug

SEQ ID NO: 3610263 - RNA, 21 nt, Human
ccuccuccagccgccaugcuc

SEQ ID NO: 3610264 - RNA, 15 nt, Human
ccuccuccaggccug

SEQ ID NO: 3610265 - RNA, 16 nt, Human
ccuccuccagggacag

SEQ ID NO: 3610266 - RNA, 21 nt, Human
ccuccuccccaacuguggggg

SEQ ID NO: 3610267 - RNA, 13 nt, Human
ccuccucccuccc

SEQ ID NO: 3610268 - RNA, 15 nt, Human
ccuccucccuuagcu

SEQ ID NO: 3610269 - RNA, 14 nt, Human
ccuccuccuuccua

SEQ ID NO: 3610270 - RNA, 23 nt, Human
ccuccucggaaccgcucaccuag

SEQ ID NO: 3610271 - RNA, 21 nt, Human
ccuccucggcuggcuguccac

SEQ ID NO: 3610272 - RNA, 14 nt, Human
ccuccucucagugu

SEQ ID NO: 3610273 - RNA, 15 nt, Human
ccuccucucccaucc

SEQ ID NO: 3610274 - RNA, 19 nt, Human
ccuccucucccaucccccu

SEQ ID NO: 3610275 - RNA, 13 nt, Human
ccuccucugaaac

SEQ ID NO: 3610276 - RNA, 16 nt, Human
ccuccucugaaacagc

SEQ ID NO: 3610277 - RNA, 20 nt, Human
ccuccucugaaacagcugcc

SEQ ID NO: 3610278 - RNA, 18 nt, Human
ccuccucugcuugccauc

SEQ ID NO: 3610279 - RNA, 21 nt, Human
ccuccucuggacggcaggcuc

SEQ ID NO: 3610280 - RNA, 16 nt, Human
ccuccucuguccaggg

SEQ ID NO: 3610281 - RNA, 13 nt, Human
ccuccucugucug

SEQ ID NO: 3610282 - RNA, 16 nt, Human
ccuccucuucaccccg

SEQ ID NO: 3610283 - RNA, 19 nt, Human
ccuccucuucaccccggca

SEQ ID NO: 3610284 - RNA, 14 nt, Human
ccuccucuucugac

SEQ ID NO: 3610285 - RNA, 21 nt, Human
ccuccucuuucucuccccaac

SEQ ID NO: 3610286 - RNA, 19 nt, Human
ccuccugacacaccugcag

SEQ ID NO: 3610287 - RNA, 15 nt, Human
ccuccugaccuguca

SEQ ID NO: 3610288 - RNA, 12 nt, Human
ccuccugagaaa

SEQ ID NO: 3610289 - RNA, 16 nt, Human
ccuccugagggaggac

SEQ ID NO: 3610290 - RNA, 12 nt, Human
ccuccugcccac

SEQ ID NO: 3610291 - RNA, 14 nt, Human
ccuccugcccaccu

SEQ ID NO: 3610292 - RNA, 17 nt, Human
ccuccugcccaccuguc

SEQ ID NO: 3610293 - RNA, 23 nt, Human
caguagaggcuauggacagggca

SEQ ID NO: 3610294 - RNA, 17 nt, Human
caguagagucaucucca

SEQ ID NO: 3610295 - RNA, 16 nt, Human
caguagauuuuccaaa

SEQ ID NO: 3610296 - RNA, 19 nt, Human
caguagauuuucuuuaaaa

SEQ ID NO: 3610297 - RNA, 19 nt, Human
caguagcugggaccacagg

SEQ ID NO: 3610298 - RNA, 20 nt, Human
caguagcuguggugaggugg

SEQ ID NO: 3610299 - RNA, 13 nt, Human
caguaggccggug

SEQ ID NO: 3610300 - RNA, 18 nt, Human
caguaggcucaacuaggg

SEQ ID NO: 3610301 - RNA, 22 nt, Human
caguaggugacacuauaguuua

SEQ ID NO: 3610302 - RNA, 22 nt, Human
caguagguuauuuagcuuggga

SEQ ID NO: 3610303 - RNA, 14 nt, Human
caguaguaccaaau

SEQ ID NO: 3610304 - RNA, 22 nt, Human
caguaguagccuccagguuucc

SEQ ID NO: 3610305 - RNA, 17 nt, Human
caguagucucugugcuu

SEQ ID NO: 3610306 - RNA, 12 nt, Human
caguagugauag

SEQ ID NO: 3610307 - RNA, 20 nt, Human
caguaguuugcauuucagaa

SEQ ID NO: 3610308 - RNA, 13 nt, Human
caguauaaaauua

SEQ ID NO: 3610309 - RNA, 19 nt, Human
caguauaaacaaaguuacu

SEQ ID NO: 3610310 - RNA, 14 nt, Human
caguauaaagaaua

SEQ ID NO: 3610311 - RNA, 15 nt, Human
caguauaaagaauag

SEQ ID NO: 3610312 - RNA, 18 nt, Human
caguauaaagaauaggac

SEQ ID NO: 3610313 - RNA, 21 nt, Human
caguauaaagaauaggacuug

SEQ ID NO: 3610314 - RNA, 14 nt, Human
caguauaauuaaca

SEQ ID NO: 3610315 - RNA, 14 nt, Human
caguauaauucugu

SEQ ID NO: 3610316 - RNA, 20 nt, Human
caguauaauucuguacugau

SEQ ID NO: 3610317 - RNA, 17 nt, Human
caguauacaagauaagc

SEQ ID NO: 3610318 - RNA, 18 nt, Human
caguauagaauaggcacu

SEQ ID NO: 3610319 - RNA, 16 nt, Human
caguauauuaguauua

SEQ ID NO: 3610320 - RNA, 14 nt, Human
caguauauuuaaac

SEQ ID NO: 3610321 - RNA, 16 nt, Human
caguauauuuaaacuc

SEQ ID NO: 3610322 - RNA, 22 nt, Human
caguauauuuauagucacaaga

SEQ ID NO: 3610323 - RNA, 18 nt, Human
caguauauuuuauuucaa

SEQ ID NO: 3610324 - RNA, 14 nt, Human
caguaucacugucu

SEQ ID NO: 3610325 - RNA, 22 nt, Human
caguaucacugucuuuccuaga

SEQ ID NO: 3610326 - RNA, 17 nt, Human
caguaucaggccugcca

SEQ ID NO: 3610327 - RNA, 20 nt, Human
caguaucaggccugccagac

SEQ ID NO: 3610328 - RNA, 14 nt, Human
caguaucaugaagc

SEQ ID NO: 3610329 - RNA, 17 nt, Human
caguaucaugcccugug

SEQ ID NO: 3610330 - RNA, 19 nt, Human
caguaucaugcccugugca

SEQ ID NO: 3610331 - RNA, 13 nt, Human
caguaucccacau

SEQ ID NO: 3610332 - RNA, 14 nt, Human
caguaucccacauc

SEQ ID NO: 3610333 - RNA, 23 nt, Human
caguaucuauauauguguaugua

SEQ ID NO: 3610334 - RNA, 22 nt, Human
caguaucucuucagucucuaua

SEQ ID NO: 3610335 - RNA, 12 nt, Human
caguaucuugaa

SEQ ID NO: 3610336 - RNA, 18 nt, Human
caguaucuuugcacucca

SEQ ID NO: 3610337 - RNA, 16 nt, Human
caguaugcugccccug

SEQ ID NO: 3610338 - RNA, 12 nt, Human
caguauggcagc

SEQ ID NO: 3610339 - RNA, 18 nt, Human
caguauggggguuguaaa

SEQ ID NO: 3610340 - RNA, 19 nt, Human
caguauggggguuguaaau

SEQ ID NO: 3610341 - RNA, 16 nt, Human
caguauggguuaggga

SEQ ID NO: 3610342 - RNA, 23 nt, Human
caguauggguuagggaaaacauu

SEQ ID NO: 3610343 - RNA, 18 nt, Human
caguaugguacauuuuuc

SEQ ID NO: 3610344 - RNA, 15 nt, Human
caguaugugggauau

SEQ ID NO: 3610345 - RNA, 21 nt, Human
caguauuaaaggggggagggg

SEQ ID NO: 3610346 - RNA, 19 nt, Human
caguauuaauacuaaaaua

SEQ ID NO: 3610347 - RNA, 16 nt, Human
caguauuacuucugcu

SEQ ID NO: 3610348 - RNA, 14 nt, Human
caguauuauaugua

SEQ ID NO: 3610349 - RNA, 13 nt, Human
caguauucuuguc

SEQ ID NO: 3610350 - RNA, 16 nt, Human
caguauucuugucaaa

SEQ ID NO: 3610351 - RNA, 17 nt, Human
caguauugaagcauuuu

SEQ ID NO: 3610352 - RNA, 12 nt, Human
caguauuguaca

SEQ ID NO: 3610353 - RNA, 16 nt, Human
caguauuguacaaagu

SEQ ID NO: 3610354 - RNA, 16 nt, Human
caguauuuauuuugua

SEQ ID NO: 3610355 - RNA, 18 nt, Human
caguauuuauuuuguaau

SEQ ID NO: 3610356 - RNA, 22 nt, Human
caguauuuauuuuguaauuaug

SEQ ID NO: 3610357 - RNA, 21 nt, Human
caguauuuucccaauagcacu

SEQ ID NO: 3610358 - RNA, 16 nt, Human
caguauuuucccugcu

SEQ ID NO: 3610359 - RNA, 18 nt, Human
caguauuuuggagaaauu

SEQ ID NO: 3610360 - RNA, 20 nt, Human
caguauuuuggagaaauuau

SEQ ID NO: 3610361 - RNA, 21 nt, Human
caguauuuuggagaaauuauu

SEQ ID NO: 3610362 - RNA, 23 nt, Human
caguauuuuggagaaauuauuua

SEQ ID NO: 3610363 - RNA, 16 nt, Human
caguauuuuguguccu

SEQ ID NO: 3610364 - RNA, 17 nt, Human
caguauuuuguguccuc

SEQ ID NO: 3610365 - RNA, 15 nt, Human
cagucaacaagccug

SEQ ID NO: 3610366 - RNA, 14 nt, Human
cagucaaccugggc

SEQ ID NO: 3610367 - RNA, 20 nt, Human
cagucaagcuguugaagucu

SEQ ID NO: 3610368 - RNA, 15 nt, Human
cagucaaggaguggc

SEQ ID NO: 3610369 - RNA, 15 nt, Human
cagucaauauuuuua

SEQ ID NO: 3610370 - RNA, 14 nt, Human
cagucaauuaacaa

SEQ ID NO: 3610371 - RNA, 12 nt, Human
cagucacagcca

SEQ ID NO: 3610372 - RNA, 17 nt, Human
cagucacaugaccugau

SEQ ID NO: 3610373 - RNA, 17 nt, Human
cagucaccccaggacuc

SEQ ID NO: 3610374 - RNA, 16 nt, Human
cagucaccucauggaa

SEQ ID NO: 3610375 - RNA, 19 nt, Human
cagucaccucauggaauug

SEQ ID NO: 3610376 - RNA, 17 nt, Human
cagucaccugcccagau

SEQ ID NO: 3610377 - RNA, 23 nt, Human
cagucacguggaggagcagugca

SEQ ID NO: 3610378 - RNA, 22 nt, Human
cagucacugccacuuugcacau

SEQ ID NO: 3610379 - RNA, 22 nt, Human
cagucacugucccucaaaugac

SEQ ID NO: 3610380 - RNA, 20 nt, Human
cagucagauuuccagucucc

SEQ ID NO: 3610381 - RNA, 13 nt, Human
cagucagccucuc

SEQ ID NO: 3610382 - RNA, 21 nt, Human
cagucagccucucucccaguc

SEQ ID NO: 3610383 - RNA, 22 nt, Human
cagucagccucucucccagucu

SEQ ID NO: 3610384 - RNA, 16 nt, Human
cagucaggcucucugg

SEQ ID NO: 3610385 - RNA, 12 nt, Human
cagucaggggca

SEQ ID NO: 3610386 - RNA, 15 nt, Human
cagucagguugaaga

SEQ ID NO: 3610387 - RNA, 16 nt, Human
cagucaguaauugcca

SEQ ID NO: 3610388 - RNA, 15 nt, Human
cagucaguauuguuu

SEQ ID NO: 3610389 - RNA, 18 nt, Human
cagucagugcaaauguca

SEQ ID NO: 3610390 - RNA, 18 nt, Human
cagucaucaucagggccu

SEQ ID NO: 3610391 - RNA, 21 nt, Human
cagucaucuugaccaagcagg

SEQ ID NO: 3610392 - RNA, 22 nt, Human
cagucaucuugaccaagcagga

SEQ ID NO: 3610393 - RNA, 13 nt, Human
cagucaugcauaa

SEQ ID NO: 3610394 - RNA, 22 nt, Human
cagucauguuuuaaauguacag

SEQ ID NO: 3610395 - RNA, 18 nt, Human
cagucauuagacuccucc

SEQ ID NO: 3610396 - RNA, 23 nt, Human
cagucauuaugagaggcaaugau

SEQ ID NO: 3610397 - RNA, 17 nt, Human
cagucauucagauauga

SEQ ID NO: 3610398 - RNA, 12 nt, Human
cagucauuuaaa

SEQ ID NO: 3610399 - RNA, 17 nt, Human
caguccaaauguccucc

SEQ ID NO: 3610400 - RNA, 23 nt, Human
caguccaaauguccuccagaagc

SEQ ID NO: 3610401 - RNA, 19 nt, Human
caguccaaggaaaccacag

SEQ ID NO: 3610402 - RNA, 13 nt, Human
caguccacaaaau

SEQ ID NO: 3610403 - RNA, 18 nt, Human
caguccaccugagcugcc

SEQ ID NO: 3610404 - RNA, 21 nt, Human
caguccacuucugacagccuc

SEQ ID NO: 3610405 - RNA, 13 nt, Human
caguccagccugg

SEQ ID NO: 3610406 - RNA, 15 nt, Human
caguccaggcugccg

SEQ ID NO: 3610407 - RNA, 20 nt, Human
caguccaguccuaucugggc

SEQ ID NO: 3610408 - RNA, 13 nt, Human
caguccaugaaga

SEQ ID NO: 3610409 - RNA, 19 nt, Human
caguccaugcaugacagcc

SEQ ID NO: 3610410 - RNA, 23 nt, Human
caguccaugcaugacagccucua

SEQ ID NO: 3610411 - RNA, 15 nt, Human
cagucccacugugca

SEQ ID NO: 3610412 - RNA, 23 nt, Human
cagucccacugugcaggugcuau

SEQ ID NO: 3610413 - RNA, 17 nt, Human
cagucccagcagccagc

SEQ ID NO: 3610414 - RNA, 18 nt, Human
cagucccagcagccagcc

SEQ ID NO: 3610415 - RNA, 19 nt, Human
cagucccagcagccagcca

SEQ ID NO: 3610416 - RNA, 13 nt, Human
cagucccaggggc

SEQ ID NO: 3610417 - RNA, 13 nt, Human
caguccccacccc

SEQ ID NO: 3610418 - RNA, 13 nt, Human
caguccccagaac

SEQ ID NO: 3610419 - RNA, 15 nt, Human
caguccccagaacuc

SEQ ID NO: 3610420 - RNA, 19 nt, Human
caguccccagcccuucaca

SEQ ID NO: 3610421 - RNA, 23 nt, Human
caguccccgugaaggagagcccu

SEQ ID NO: 3610422 - RNA, 16 nt, Human
caguccccucccaucu

SEQ ID NO: 3610423 - RNA, 17 nt, Human
caguccccucccaucug

SEQ ID NO: 3610424 - RNA, 22 nt, Human
caguccccucccaucugggagu

SEQ ID NO: 3610425 - RNA, 14 nt, Human
cagucccuaaagaa

SEQ ID NO: 3610426 - RNA, 13 nt, Human
cagucccuccaca

SEQ ID NO: 3610427 - RNA, 17 nt, Human
cagucccugccaaugga

SEQ ID NO: 3610428 - RNA, 22 nt, Human
cagucccuuccccaugcuuccu

SEQ ID NO: 3610429 - RNA, 19 nt, Human
caguccgucaaaacagauu

SEQ ID NO: 3610430 - RNA, 20 nt, Human
caguccguguggauccaaug

SEQ ID NO: 3610431 - RNA, 19 nt, Human
caguccuaagaaagaggag

SEQ ID NO: 3610432 - RNA, 17 nt, Human
caguccuagaauguuuc

SEQ ID NO: 3610433 - RNA, 20 nt, Human
caguccuaucugggcuuccu

SEQ ID NO: 3610434 - RNA, 22 nt, Human
caguccuaucugggcuuccugg

SEQ ID NO: 3610435 - RNA, 17 nt, Human
caguccucccaucucac

SEQ ID NO: 3610436 - RNA, 15 nt, Human
caguccugcccgcca

SEQ ID NO: 3610437 - RNA, 14 nt, Human
caguccugccuggc

SEQ ID NO: 3610438 - RNA, 14 nt, Human
caguccugcucucu

SEQ ID NO: 3610439 - RNA, 17 nt, Human
caguccugcucucuacc

SEQ ID NO: 3610440 - RNA, 15 nt, Human
caguccuuaccagca

SEQ ID NO: 3610441 - RNA, 13 nt, Human
caguccuuggccu

SEQ ID NO: 3610442 - RNA, 16 nt, Human
caguccuuggccugcu

SEQ ID NO: 3610443 - RNA, 21 nt, Human
ccgugagcaggaaggccuggg

SEQ ID NO: 3610444 - RNA, 21 nt, Human
ccgugagcagugugucuccug

SEQ ID NO: 3610445 - RNA, 16 nt, Human
ccgugaggccagagac

SEQ ID NO: 3610446 - RNA, 14 nt, Human
ccgugaguucucag

SEQ ID NO: 3610447 - RNA, 23 nt, Human
ccgugauguaggguaaggugccu

SEQ ID NO: 3610448 - RNA, 14 nt, Human
ccgugcagacugga

SEQ ID NO: 3610449 - RNA, 17 nt, Human
ccgugcagacuggaggg

SEQ ID NO: 3610450 - RNA, 18 nt, Human
ccgugcauuagcacagau

SEQ ID NO: 3610451 - RNA, 22 nt, Human
ccgugcauuagcacagauuuua

SEQ ID NO: 3610452 - RNA, 21 nt, Human
ccgugccaaguccagguccug

SEQ ID NO: 3610453 - RNA, 17 nt, Human
ccgugccgccugcacuc

SEQ ID NO: 3610454 - RNA, 22 nt, Human
ccgugccuccaccaccacuggc

SEQ ID NO: 3610455 - RNA, 23 nt, Human
ccgugccuccaccaccacuggcc

SEQ ID NO: 3610456 - RNA, 14 nt, Human
ccgugccuucagcu

SEQ ID NO: 3610457 - RNA, 16 nt, Human
ccgugccuucagcucu

SEQ ID NO: 3610458 - RNA, 13 nt, Human
ccgugcuaaggac

SEQ ID NO: 3610459 - RNA, 16 nt, Human
ccgugcugacagcugc

SEQ ID NO: 3610460 - RNA, 17 nt, Human
ccgugcugacagcugcu

SEQ ID NO: 3610461 - RNA, 12 nt, Human
ccgugcugggca

SEQ ID NO: 3610462 - RNA, 14 nt, Human
ccgugcugggcagc

SEQ ID NO: 3610463 - RNA, 15 nt, Human
ccgugcugggcagcc

SEQ ID NO: 3610464 - RNA, 16 nt, Human
ccguggaccuuccugc

SEQ ID NO: 3610465 - RNA, 22 nt, Human
ccguggaggaggaaggcaagag

SEQ ID NO: 3610466 - RNA, 20 nt, Human
ccguggaggagguugggagg

SEQ ID NO: 3610467 - RNA, 22 nt, Human
ccguggaggcugcucggggugc

SEQ ID NO: 3610468 - RNA, 11 nt, Human
ccguggaugcg

SEQ ID NO: 3610469 - RNA, 20 nt, Human
ccguggauugcacguggccu

SEQ ID NO: 3610470 - RNA, 16 nt, Human
ccguggccccagccug

SEQ ID NO: 3610471 - RNA, 21 nt, Human
ccguggccccagccuggccca

SEQ ID NO: 3610472 - RNA, 23 nt, Human
ccguggccccagccuggcccagc

SEQ ID NO: 3610473 - RNA, 15 nt, Human
ccguggcccugcccu

SEQ ID NO: 3610474 - RNA, 20 nt, Human
ccguggcccugcccucuccu

SEQ ID NO: 3610475 - RNA, 16 nt, Human
ccguggcccuuccugg

SEQ ID NO: 3610476 - RNA, 14 nt, Human
ccguggcugcggca

SEQ ID NO: 3610477 - RNA, 23 nt, Human
ccguggcuguugacgcaccugug

SEQ ID NO: 3610478 - RNA, 11 nt, Human
ccguggcuucc

SEQ ID NO: 3610479 - RNA, 23 nt, Human
ccguggcuucccgcucagcccuc

SEQ ID NO: 3610480 - RNA, 14 nt, Human
ccgugggcucccug

SEQ ID NO: 3610481 - RNA, 14 nt, Human
ccguggggcaggga

SEQ ID NO: 3610482 - RNA, 23 nt, Human
ccguggggcagggagcugggccc

SEQ ID NO: 3610483 - RNA, 15 nt, Human
ccgugguaugucugc

SEQ ID NO: 3610484 - RNA, 18 nt, Human
ccgugguaugucugccau

SEQ ID NO: 3610485 - RNA, 15 nt, Human
ccguguccaccccca

SEQ ID NO: 3610486 - RNA, 17 nt, Human
ccguguccccugacagg

SEQ ID NO: 3610487 - RNA, 16 nt, Human
ccgugugcccucgggc

SEQ ID NO: 3610488 - RNA, 23 nt, Human
ccgugugguaagcaacauggcuu

SEQ ID NO: 3610489 - RNA, 18 nt, Human
ccguguuggucuguacug

SEQ ID NO: 3610490 - RNA, 14 nt, Human
ccguuacucuccaa

SEQ ID NO: 3610491 - RNA, 17 nt, Human
ccguuacucuccaaccu

SEQ ID NO: 3610492 - RNA, 14 nt, Human
ccguuagcuccugu

SEQ ID NO: 3610493 - RNA, 12 nt, Human
ccguuauuaaaa

SEQ ID NO: 3610494 - RNA, 14 nt, Human
ccguucacaugugu

SEQ ID NO: 3610495 - RNA, 14 nt, Human
ccguucacauuuuu

SEQ ID NO: 3610496 - RNA, 17 nt, Human
ccguuccaccccaagag

SEQ ID NO: 3610497 - RNA, 19 nt, Human
ccguuccugacaucacagc

SEQ ID NO: 3610498 - RNA, 22 nt, Human
ccguuccugacaucacagcagc

SEQ ID NO: 3610499 - RNA, 19 nt, Human
ccguugauguuggcuggga

SEQ ID NO: 3610500 - RNA, 12 nt, Human
ccguugcauuug

SEQ ID NO: 3610501 - RNA, 23 nt, Human
ccguuggaaacauaaccauuaca

SEQ ID NO: 3610502 - RNA, 18 nt, Human
ccguugucucccuggccc

SEQ ID NO: 3610503 - RNA, 19 nt, Human
ccguugucucccuggcccu

SEQ ID NO: 3610504 - RNA, 12 nt, Human
ccguuguuuacu

SEQ ID NO: 3610505 - RNA, 20 nt, Human
ccguuguuuacuuaaagauu

SEQ ID NO: 3610506 - RNA, 17 nt, Human
ccguuuaccuagaagaa

SEQ ID NO: 3610507 - RNA, 13 nt, Human
ccguuucuucccu

SEQ ID NO: 3610508 - RNA, 23 nt, Human
ccguuugauuugucacugcuuca

SEQ ID NO: 3610509 - RNA, 12 nt, Human
ccuaaaaauaaa

SEQ ID NO: 3610510 - RNA, 14 nt, Human
ccuaaaaauaaagc

SEQ ID NO: 3610511 - RNA, 15 nt, Human
ccuaaaaauaaagca

SEQ ID NO: 3610512 - RNA, 12 nt, Human
ccuaaaacaaau

SEQ ID NO: 3610513 - RNA, 16 nt, Human
ccuaaaacuggccuga

SEQ ID NO: 3610514 - RNA, 18 nt, Human
ccuaaaagaaacccugca

SEQ ID NO: 3610515 - RNA, 13 nt, Human
ccuaaaagcaaaa

SEQ ID NO: 3610516 - RNA, 22 nt, Human
ccuaaaagcaaaauaaaaacua

SEQ ID NO: 3610517 - RNA, 15 nt, Human
ccuaaaaguaaacau

SEQ ID NO: 3610518 - RNA, 23 nt, Human
ccuaaaauaacaguaugugggau

SEQ ID NO: 3610519 - RNA, 15 nt, Human
ccuaaaauaagaaua

SEQ ID NO: 3610520 - RNA, 15 nt, Human
ccuaaaauacauuua

SEQ ID NO: 3610521 - RNA, 23 nt, Human
ccuaaacagauauaaauggcugg

SEQ ID NO: 3610522 - RNA, 17 nt, Human
ccuaaaccccuguccca

SEQ ID NO: 3610523 - RNA, 16 nt, Human
ccuaaagaaaaacaaa

SEQ ID NO: 3610524 - RNA, 22 nt, Human
ccuaaagaaaaauaucuuggcc

SEQ ID NO: 3610525 - RNA, 19 nt, Human
ccuaaaguagacuucauuu

SEQ ID NO: 3610526 - RNA, 14 nt, Human
ccuaaaguguauuu

SEQ ID NO: 3610527 - RNA, 19 nt, Human
ccuaaauaaacacauagau

SEQ ID NO: 3610528 - RNA, 21 nt, Human
ccuaaauccacucugcaggaa

SEQ ID NO: 3610529 - RNA, 12 nt, Human
ccuaaauccauu

SEQ ID NO: 3610530 - RNA, 18 nt, Human
ccuaaauggccucaugug

SEQ ID NO: 3610531 - RNA, 20 nt, Human
ccuaaauuuaaugcugccuu

SEQ ID NO: 3610532 - RNA, 14 nt, Human
ccuaaauuuauuaa

SEQ ID NO: 3610533 - RNA, 19 nt, Human
ccuaacauaccuaagcaaa

SEQ ID NO: 3610534 - RNA, 14 nt, Human
ccucggagccucau

SEQ ID NO: 3610535 - RNA, 16 nt, Human
ccucggagccucaucc

SEQ ID NO: 3610536 - RNA, 17 nt, Human
ccucggaucaccgagag

SEQ ID NO: 3610537 - RNA, 16 nt, Human
ccucggcuccugcugc

SEQ ID NO: 3610538 - RNA, 17 nt, Human
ccucggcuccugcugca

SEQ ID NO: 3610539 - RNA, 20 nt, Human
ccucggcuccugcugcacca

SEQ ID NO: 3610540 - RNA, 22 nt, Human
ccucggcuccugcugcaccaac

SEQ ID NO: 3610541 - RNA, 17 nt, Human
ccucggcuggcuccccu

SEQ ID NO: 3610542 - RNA, 13 nt, Human
ccucgggcccacc

SEQ ID NO: 3610543 - RNA, 13 nt, Human
ccucgggcccagc

SEQ ID NO: 3610544 - RNA, 16 nt, Human
ccucgggcccagcccc

SEQ ID NO: 3610545 - RNA, 17 nt, Human
ccucgggcccagccccc

SEQ ID NO: 3610546 - RNA, 13 nt, Human
ccucgggccugcu

SEQ ID NO: 3610547 - RNA, 14 nt, Human
ccucgggucuccuc

SEQ ID NO: 3610548 - RNA, 18 nt, Human
ccucgggucuccucacuc

SEQ ID NO: 3610549 - RNA, 19 nt, Human
ccucguccucccccugcca

SEQ ID NO: 3610550 - RNA, 21 nt, Human
ccucguccucccccugccagu

SEQ ID NO: 3610551 - RNA, 14 nt, Human
ccucgucuuuccca

SEQ ID NO: 3610552 - RNA, 15 nt, Human
ccucguggacaccug

SEQ ID NO: 3610553 - RNA, 22 nt, Human
ccucguggacaccugcccugcc

SEQ ID NO: 3610554 - RNA, 14 nt, Human
ccucguggccagcc

SEQ ID NO: 3610555 - RNA, 18 nt, Human
ccucguggccagcccggc

SEQ ID NO: 3610556 - RNA, 23 nt, Human
ccucguuagggaagagaaacagg

SEQ ID NO: 3610557 - RNA, 21 nt, Human
ccucguuccuuucuccuguuu

SEQ ID NO: 3610558 - RNA, 16 nt, Human
ccucguucucccuggg

SEQ ID NO: 3610559 - RNA, 18 nt, Human
ccucguucucccugggag

SEQ ID NO: 3610560 - RNA, 20 nt, Human
ccucguucucccugggaggc

SEQ ID NO: 3610561 - RNA, 15 nt, Human
ccucguuggaagagg

SEQ ID NO: 3610562 - RNA, 20 nt, Human
ccucguuggaagaggaacag

SEQ ID NO: 3610563 - RNA, 13 nt, Human
ccucguuuguguu

SEQ ID NO: 3610564 - RNA, 18 nt, Human
ccucuaacaggggcuggu

SEQ ID NO: 3610565 - RNA, 16 nt, Human
ccucuaaccccaggcc

SEQ ID NO: 3610566 - RNA, 19 nt, Human
ccucuaagccacucuucca

SEQ ID NO: 3610567 - RNA, 16 nt, Human
ccucuacccaaacccu

SEQ ID NO: 3610568 - RNA, 17 nt, Human
ccucuacuaaaaagaag

SEQ ID NO: 3610569 - RNA, 18 nt, Human
ccucuacuuuccaggcua

SEQ ID NO: 3610570 - RNA, 22 nt, Human
ccucuagaaacgaguugguguc

SEQ ID NO: 3610571 - RNA, 17 nt, Human
ccucuagaaauuuuuca

SEQ ID NO: 3610572 - RNA, 15 nt, Human
ccucuagaagccaag

SEQ ID NO: 3610573 - RNA, 22 nt, Human
ccucuagagaaauaagaucuuu

SEQ ID NO: 3610574 - RNA, 14 nt, Human
ccucuagagccuuc

SEQ ID NO: 3610575 - RNA, 22 nt, Human
ccucuagagccuucagccuuaa

SEQ ID NO: 3610576 - RNA, 10 nt, Human
ccucuagcug

SEQ ID NO: 3610577 - RNA, 23 nt, Human
ccucuagcugaauugagccuaaa

SEQ ID NO: 3610578 - RNA, 19 nt, Human
ccucuaggcucugccuucg

SEQ ID NO: 3610579 - RNA, 22 nt, Human
ccucuagguccccauacuccua

SEQ ID NO: 3610580 - RNA, 21 nt, Human
ccucuagugaauguaggcugg

SEQ ID NO: 3610581 - RNA, 22 nt, Human
ccucuaguuuuuucuuccuuuu

SEQ ID NO: 3610582 - RNA, 20 nt, Human
ccucuauugauguacagucu

SEQ ID NO: 3610583 - RNA, 21 nt, Human
ccucuauuuauguuugcacuu

SEQ ID NO: 3610584 - RNA, 13 nt, Human
ccucucacacaca

SEQ ID NO: 3610585 - RNA, 16 nt, Human
ccucucaccucagccu

SEQ ID NO: 3610586 - RNA, 19 nt, Human
ccucucacugucugagagu

SEQ ID NO: 3610587 - RNA, 21 nt, Human
ccucucagagcuacuugggcc

SEQ ID NO: 3610588 - RNA, 23 nt, Human
ccucucaggauccaagcuaagca

SEQ ID NO: 3610589 - RNA, 14 nt, Human
ccucucaggcaugc

SEQ ID NO: 3610590 - RNA, 21 nt, Human
ccucucaggcaugccugugug

SEQ ID NO: 3610591 - RNA, 16 nt, Human
ccucucagugcccucc

SEQ ID NO: 3610592 - RNA, 13 nt, Human
ccucucaguguuu

SEQ ID NO: 3610593 - RNA, 23 nt, Human
ccucucauauauagacagcuuug

SEQ ID NO: 3610594 - RNA, 19 nt, Human
ccucucauuuagccugucc

SEQ ID NO: 3610595 - RNA, 12 nt, Human
ccucuccaaggg

SEQ ID NO: 3610596 - RNA, 13 nt, Human
ccucuccaagggc

SEQ ID NO: 3610597 - RNA, 12 nt, Human
ccuacagcauug

SEQ ID NO: 3610598 - RNA, 15 nt, Human
ccuacagcccaccug

SEQ ID NO: 3610599 - RNA, 19 nt, Human
ccuacagcuugaccgugag

SEQ ID NO: 3610600 - RNA, 20 nt, Human
ccuacagcuuugaucccuga

SEQ ID NO: 3610601 - RNA, 14 nt, Human
ccuacaggcugacg

SEQ ID NO: 3610602 - RNA, 21 nt, Human
ccuacaggcugacguuccggg

SEQ ID NO: 3610603 - RNA, 16 nt, Human
ccuacagggggucugg

SEQ ID NO: 3610604 - RNA, 22 nt, Human
ccuacaguuuuaacuguggaua

SEQ ID NO: 3610605 - RNA, 18 nt, Human
ccuacaugcuuugugaac

SEQ ID NO: 3610606 - RNA, 13 nt, Human
ccuaccaaccucu

SEQ ID NO: 3610607 - RNA, 18 nt, Human
ccuaccaauagauucccc

SEQ ID NO: 3610608 - RNA, 16 nt, Human
ccuaccaauauuaggu

SEQ ID NO: 3610609 - RNA, 22 nt, Human
ccuaccaaugcaugcagccacu

SEQ ID NO: 3610610 - RNA, 16 nt, Human
ccuaccacagugucug

SEQ ID NO: 3610611 - RNA, 23 nt, Human
ccuaccagcgcccgcugggcuga

SEQ ID NO: 3610612 - RNA, 16 nt, Human
ccuacccacaccucug

SEQ ID NO: 3610613 - RNA, 17 nt, Human
ccuacccacaccucugc

SEQ ID NO: 3610614 - RNA, 20 nt, Human
ccuacccacaccucugccag

SEQ ID NO: 3610615 - RNA, 13 nt, Human
ccuacccacccuc

SEQ ID NO: 3610616 - RNA, 12 nt, Human
ccuaccccacac

SEQ ID NO: 3610617 - RNA, 11 nt, Human
ccuaccccacc

SEQ ID NO: 3610618 - RNA, 12 nt, Human
ccuaccccauag

SEQ ID NO: 3610619 - RNA, 19 nt, Human
ccuacccccuccucucugc

SEQ ID NO: 3610620 - RNA, 15 nt, Human
ccuaccccucccagc

SEQ ID NO: 3610621 - RNA, 16 nt, Human
ccuaccccucccagcu

SEQ ID NO: 3610622 - RNA, 18 nt, Human
ccuaccccucccagcuga

SEQ ID NO: 3610623 - RNA, 15 nt, Human
ccuaccccuggcugu

SEQ ID NO: 3610624 - RNA, 16 nt, Human
ccuaccgacccagggu

SEQ ID NO: 3610625 - RNA, 19 nt, Human
ccuaccgagucucuucucc

SEQ ID NO: 3610626 - RNA, 17 nt, Human
ccuaccucaaccuguaa

SEQ ID NO: 3610627 - RNA, 12 nt, Human
ccuaccucagcc

SEQ ID NO: 3610628 - RNA, 16 nt, Human
ccuaccucagccuaga

SEQ ID NO: 3610629 - RNA, 18 nt, Human
ccuaccucagccuagacc

SEQ ID NO: 3610630 - RNA, 19 nt, Human
ccuaccucagguugcuggu

SEQ ID NO: 3610631 - RNA, 23 nt, Human
ccuaccucagguugcugguugcu

SEQ ID NO: 3610632 - RNA, 21 nt, Human
ccuaccugauuggugcaaccc

SEQ ID NO: 3610633 - RNA, 13 nt, Human
ccuaccuguucag

SEQ ID NO: 3610634 - RNA, 17 nt, Human
ccuaccuguucaguguc

SEQ ID NO: 3610635 - RNA, 23 nt, Human
ccuaccuguucagugucccgggc

SEQ ID NO: 3610636 - RNA, 17 nt, Human
ccuaccuucuucaggcu

SEQ ID NO: 3610637 - RNA, 13 nt, Human
ccuacggaccagg

SEQ ID NO: 3610638 - RNA, 17 nt, Human
ccuacuacaucgcccuc

SEQ ID NO: 3610639 - RNA, 18 nt, Human
ccuacuacaucgcccucc

SEQ ID NO: 3610640 - RNA, 16 nt, Human
ccuacuccaaaauguu

SEQ ID NO: 3610641 - RNA, 20 nt, Human
ccuacucccugcagaugcca

SEQ ID NO: 3610642 - RNA, 15 nt, Human
ccuacuccugucuuc

SEQ ID NO: 3610643 - RNA, 18 nt, Human
ccuacuccugucuucugc

SEQ ID NO: 3610644 - RNA, 21 nt, Human
ccuacucuccuugaguguaug

SEQ ID NO: 3610645 - RNA, 14 nt, Human
ccuacugaggauau

SEQ ID NO: 3610646 - RNA, 13 nt, Human
ccuacugcccagg

SEQ ID NO: 3610647 - RNA, 19 nt, Human
ccuacuguaauuugugaua

SEQ ID NO: 3610648 - RNA, 16 nt, Human
ccuacuguucuaaagc

SEQ ID NO: 3610649 - RNA, 22 nt, Human
ccuacuuacccagguggguccc

SEQ ID NO: 3610650 - RNA, 12 nt, Human
ccuacuucucca

SEQ ID NO: 3610651 - RNA, 14 nt, Human
ccuacuuugacuuu

SEQ ID NO: 3610652 - RNA, 14 nt, Human
ccuacuuuuccuuc

SEQ ID NO: 3610653 - RNA, 15 nt, Human
ccuagaaacaacacu

SEQ ID NO: 3610654 - RNA, 16 nt, Human
ccuagaaacaacacug

SEQ ID NO: 3610655 - RNA, 21 nt, Human
ccuagaaauuccccacccuga

SEQ ID NO: 3610656 - RNA, 21 nt, Human
ccuagaagagugugaaaagga

SEQ ID NO: 3610657 - RNA, 19 nt, Human
ccuagaaguuacugaaugc

SEQ ID NO: 3610658 - RNA, 13 nt, Human
ccuagaccagcag

SEQ ID NO: 3610659 - RNA, 23 nt, Human
ccuagaccagcagacagagccag

SEQ ID NO: 3610660 - RNA, 21 nt, Human
ccuagacucggggugcuuccu

SEQ ID NO: 3610661 - RNA, 19 nt, Human
ccuagacuggugcuaaugu

SEQ ID NO: 3610662 - RNA, 17 nt, Human
ccuagagaacgcagccc

SEQ ID NO: 3610663 - RNA, 24 nt, Human
ccuagagaagacaggcuggaagau

SEQ ID NO: 3610664 - RNA, 21 nt, Human
ccuagagaagauaauuguuga

SEQ ID NO: 3610665 - RNA, 23 nt, Human
ccuagagaagcuaaaaccugagc

SEQ ID NO: 3610666 - RNA, 21 nt, Human
ccuagagacagaagcaggcug

SEQ ID NO: 3610667 - RNA, 15 nt, Human
ccuagagccagacca

SEQ ID NO: 3610668 - RNA, 14 nt, Human
ccuagagccugccu

SEQ ID NO: 3610669 - RNA, 17 nt, Human
ccuagagccugccugga

SEQ ID NO: 3610670 - RNA, 18 nt, Human
ccuagagccugccuggag

SEQ ID NO: 3610671 - RNA, 19 nt, Human
ccuagagccugccuggagc

SEQ ID NO: 3610672 - RNA, 13 nt, Human
ccuagaggcccca

SEQ ID NO: 3610673 - RNA, 20 nt, Human
ccuagaggcccuuugcuguc

SEQ ID NO: 3610674 - RNA, 23 nt, Human
ccuagagguacuuuccacuugau

SEQ ID NO: 3610675 - RNA, 12 nt, Human
ccuagaguccca

SEQ ID NO: 3610676 - RNA, 23 nt, Human
ccuagagugagggccugaggucu

SEQ ID NO: 3610677 - RNA, 15 nt, Human
ccuagauaugaauau

SEQ ID NO: 3610678 - RNA, 20 nt, Human
ccugaagucacacagugagu

SEQ ID NO: 3610679 - RNA, 20 nt, Human
ccugaaguuauguguaugug

SEQ ID NO: 3610680 - RNA, 21 nt, Human
ccugaauacccuuuucugacc

SEQ ID NO: 3610681 - RNA, 20 nt, Human
ccugaaucccccuugccacc

SEQ ID NO: 3610682 - RNA, 13 nt, Human
ccugaaugaaaua

SEQ ID NO: 3610683 - RNA, 15 nt, Human
ccugaaugcucugua

SEQ ID NO: 3610684 - RNA, 22 nt, Human
ccugaaugguuccaugccugag

SEQ ID NO: 3610685 - RNA, 23 nt, Human
ccugaaugguuccaugccugagg

SEQ ID NO: 3610686 - RNA, 23 nt, Human
ccugaauguauugaacuuggaaa

SEQ ID NO: 3610687 - RNA, 21 nt, Human
ccugaauucuauuugcugggc

SEQ ID NO: 3610688 - RNA, 12 nt, Human
ccugacaacacu

SEQ ID NO: 3610689 - RNA, 15 nt, Human
ccugacacaccaggc

SEQ ID NO: 3610690 - RNA, 17 nt, Human
ccugacacaccaggcgc

SEQ ID NO: 3610691 - RNA, 13 nt, Human
ccugacacccuuc

SEQ ID NO: 3610692 - RNA, 12 nt, Human
ccugacacugca

SEQ ID NO: 3610693 - RNA, 13 nt, Human
ccugacacuuuaa

SEQ ID NO: 3610694 - RNA, 15 nt, Human
ccugacagaaggugc

SEQ ID NO: 3610695 - RNA, 22 nt, Human
ccugacaggugaggucuguucc

SEQ ID NO: 3610696 - RNA, 19 nt, Human
ccugacaucaaaaaaggca

SEQ ID NO: 3610697 - RNA, 21 nt, Human
ccugacaucaaaaaaggcagu

SEQ ID NO: 3610698 - RNA, 18 nt, Human
ccugacaucacagcagcc

SEQ ID NO: 3610699 - RNA, 21 nt, Human
ccugacaucacagcagccucc

SEQ ID NO: 3610700 - RNA, 17 nt, Human
ccugacauuccuugcug

SEQ ID NO: 3610701 - RNA, 18 nt, Human
ccugacauuccuugcuga

SEQ ID NO: 3610702 - RNA, 16 nt, Human
ccugacauuggagccu

SEQ ID NO: 3610703 - RNA, 21 nt, Human
ccugaccacccuccccucucu

SEQ ID NO: 3610704 - RNA, 23 nt, Human
ccugaccacccuccccucucuug

SEQ ID NO: 3610705 - RNA, 15 nt, Human
ccugaccacucagag

SEQ ID NO: 3610706 - RNA, 22 nt, Human
ccugaccagcugcuccgaggac

SEQ ID NO: 3610707 - RNA, 20 nt, Human
ccugaccaguugcagucacu

SEQ ID NO: 3610708 - RNA, 21 nt, Human
ccugaccaguugcagucacuc

SEQ ID NO: 3610709 - RNA, 13 nt, Human
ccugacccaggcc

SEQ ID NO: 3610710 - RNA, 18 nt, Human
ccugacccaggccgcagc

SEQ ID NO: 3610711 - RNA, 19 nt, Human
ccugacccaggccgcagcu

SEQ ID NO: 3610712 - RNA, 21 nt, Human
ccugacccaggccgcagcucu

SEQ ID NO: 3610713 - RNA, 15 nt, Human
ccugacccagucccc

SEQ ID NO: 3610714 - RNA, 22 nt, Human
ccugacccgucuaauauauaaa

SEQ ID NO: 3610715 - RNA, 19 nt, Human
ccugacccucaucuuucuu

SEQ ID NO: 3610716 - RNA, 23 nt, Human
ccugacccuccaccgcagaagga

SEQ ID NO: 3610717 - RNA, 13 nt, Human
ccugacccugcag

SEQ ID NO: 3610718 - RNA, 14 nt, Human
ccugacccugcaga

SEQ ID NO: 3610719 - RNA, 22 nt, Human
ccugaccucaaaugaugugccu

SEQ ID NO: 3610720 - RNA, 13 nt, Human
ccugaccucccag

SEQ ID NO: 3610721 - RNA, 15 nt, Human
ccugaccucccagcc

SEQ ID NO: 3610722 - RNA, 17 nt, Human
ccugaccucccccuccu

SEQ ID NO: 3610723 - RNA, 15 nt, Human
ccugaccucuugcug

SEQ ID NO: 3610724 - RNA, 16 nt, Human
ccugaccucuugcugu

SEQ ID NO: 3610725 - RNA, 17 nt, Human
ccugaccucuugcuguc

SEQ ID NO: 3610726 - RNA, 13 nt, Human
ccugaccugaggc

SEQ ID NO: 3610727 - RNA, 14 nt, Human
ccugaccugucuca

SEQ ID NO: 3610728 - RNA, 18 nt, Human
ccugaccugugagcccag

SEQ ID NO: 3610729 - RNA, 20 nt, Human
ccugaccugugagcccagcu

SEQ ID NO: 3610730 - RNA, 22 nt, Human
ccugaccuugaggagucuugug

SEQ ID NO: 3610731 - RNA, 17 nt, Human
ccugacgaaacuggccc

SEQ ID NO: 3610732 - RNA, 19 nt, Human
ccugacggcgcccccagug

SEQ ID NO: 3610733 - RNA, 21 nt, Human
ccugacggcgcccccagugug

SEQ ID NO: 3610734 - RNA, 19 nt, Human
ccugacuagggagccaugu

SEQ ID NO: 3610735 - RNA, 14 nt, Human
ccugacucucagca

SEQ ID NO: 3610736 - RNA, 13 nt, Human
ccugacucucugu

SEQ ID NO: 3610737 - RNA, 15 nt, Human
ccugacucucuguga

SEQ ID NO: 3610738 - RNA, 14 nt, Human
ccugacucugcccc

SEQ ID NO: 3610739 - RNA, 16 nt, Human
ccugacugccaagcca

SEQ ID NO: 3610740 - RNA, 16 nt, Human
ccugacugggggcaga

SEQ ID NO: 3610741 - RNA, 17 nt, Human
ccugacugggggcagac

SEQ ID NO: 3610742 - RNA, 12 nt, Human
ccugacuggugc

SEQ ID NO: 3610743 - RNA, 21 nt, Human
ccugacuucaggggcugcccg

SEQ ID NO: 3610744 - RNA, 19 nt, Human
ccugacuuggggagaugga

SEQ ID NO: 3610745 - RNA, 23 nt, Human
ccugacuuggggagauggaguuc

SEQ ID NO: 3610746 - RNA, 17 nt, Human
ccugagaagcugcucca

SEQ ID NO: 3610747 - RNA, 19 nt, Human
ccugagaagcugcuccagg

SEQ ID NO: 3610748 - RNA, 22 nt, Human
ccugagaagcugcuccaggccu

SEQ ID NO: 3610749 - RNA, 23 nt, Human
ccugagaagcugcuccaggccug

SEQ ID NO: 3610750 - RNA, 22 nt, Human
ccugagaagugucuaaaaacac

SEQ ID NO: 3610751 - RNA, 22 nt, Human
ccugagaauaagaaaguuucac

SEQ ID NO: 3610752 - RNA, 18 nt, Human
ccugagaccccuggccuc

SEQ ID NO: 3610753 - RNA, 15 nt, Human
ccugagagaauuggc

SEQ ID NO: 3610754 - RNA, 18 nt, Human
ccugagagaauuggcuca

SEQ ID NO: 3610755 - RNA, 18 nt, Human
ccugagagacauggcuuu

SEQ ID NO: 3610756 - RNA, 18 nt, Human
ccugagagauuuaacauu

SEQ ID NO: 3610757 - RNA, 12 nt, Human
ccugagagcugc

SEQ ID NO: 3610758 - RNA, 15 nt, Human
ccugagaggcaggca

SEQ ID NO: 3610759 - RNA, 17 nt, Human
ccugagaggcaggcaua

SEQ ID NO: 3610760 - RNA, 17 nt, Human
ccugagaucagaguccu

SEQ ID NO: 3610761 - RNA, 17 nt, Human
ccugagauccccugagc

SEQ ID NO: 3610762 - RNA, 14 nt, Human
ccugagauggcccu

SEQ ID NO: 3610763 - RNA, 14 nt, Human
ccugagauuuacac

SEQ ID NO: 3610764 - RNA, 14 nt, Human
ccugagauuuauua

SEQ ID NO: 3610765 - RNA, 11 nt, Human
ccugagauuuc

SEQ ID NO: 3610766 - RNA, 18 nt, Human
ccugagauuucaucugcu

SEQ ID NO: 3610767 - RNA, 23 nt, Human
ccugagcaacagagugagacccu

SEQ ID NO: 3610768 - RNA, 13 nt, Human
ccugagcaacucu

SEQ ID NO: 3610769 - RNA, 16 nt, Human
ccugagcacugccagg

SEQ ID NO: 3610770 - RNA, 17 nt, Human
ccugagcacugccagga

SEQ ID NO: 3610771 - RNA, 19 nt, Human
ccugagcaguccuuggccu

SEQ ID NO: 3610772 - RNA, 22 nt, Human
ccugagcaguccuuggccugcu

SEQ ID NO: 3610773 - RNA, 23 nt, Human
ccugagccaagcuagaauucccu

SEQ ID NO: 3610774 - RNA, 12 nt, Human
ccugagccagau

SEQ ID NO: 3610775 - RNA, 13 nt, Human
ccugagccagggu

SEQ ID NO: 3610776 - RNA, 19 nt, Human
ccugagccagggucuccag

SEQ ID NO: 3610777 - RNA, 20 nt, Human
ccugagccagggucuccaga

SEQ ID NO: 3610778 - RNA, 21 nt, Human
ccugagccagggucuccagaa

SEQ ID NO: 3610779 - RNA, 16 nt, Human
ccugagcccacugugc

SEQ ID NO: 3610780 - RNA, 18 nt, Human
ccugagcccagggaggcc

SEQ ID NO: 3610781 - RNA, 15 nt, Human
ccugagccccaggga

SEQ ID NO: 3610782 - RNA, 16 nt, Human
ccugagccccagggag

SEQ ID NO: 3610783 - RNA, 21 nt, Human
ccugagccccagggugcccag

SEQ ID NO: 3610784 - RNA, 13 nt, Human
ccugagcccccag

SEQ ID NO: 3610785 - RNA, 14 nt, Human
ccugagccccgccc

SEQ ID NO: 3610786 - RNA, 16 nt, Human
ccugagccggccccag

SEQ ID NO: 3610787 - RNA, 13 nt, Human
ccugagccugccg

SEQ ID NO: 3610788 - RNA, 14 nt, Human
ccugagccugccga

SEQ ID NO: 3610789 - RNA, 21 nt, Human
ccugagccugccgagcaaccg

SEQ ID NO: 3610790 - RNA, 19 nt, Human
ccugagcgaguggagucug

SEQ ID NO: 3610791 - RNA, 20 nt, Human
ccugagcgaguggagucugc

SEQ ID NO: 3610792 - RNA, 21 nt, Human
ccugagcgccuggauuucugg

SEQ ID NO: 3610793 - RNA, 19 nt, Human
ccuccaugacugcacagua

SEQ ID NO: 3610794 - RNA, 21 nt, Human
ccuccauggugccucuggagg

SEQ ID NO: 3610795 - RNA, 16 nt, Human
ccuccauuugagaaaa

SEQ ID NO: 3610796 - RNA, 17 nt, Human
ccuccauuugagaaaau

SEQ ID NO: 3610797 - RNA, 15 nt, Human
ccucccaaagugcug

SEQ ID NO: 3610798 - RNA, 18 nt, Human
ccucccaaagugcugaga

SEQ ID NO: 3610799 - RNA, 13 nt, Human
ccucccaacccag

SEQ ID NO: 3610800 - RNA, 22 nt, Human
ccucccaaggggcccaaauucu

SEQ ID NO: 3610801 - RNA, 16 nt, Human
ccucccacccaccgcc

SEQ ID NO: 3610802 - RNA, 15 nt, Human
ccucccacccccagc

SEQ ID NO: 3610803 - RNA, 12 nt, Human
ccucccacccga

SEQ ID NO: 3610804 - RNA, 21 nt, Human
ccucccacccgaugcugcuuu

SEQ ID NO: 3610805 - RNA, 15 nt, Human
ccucccaccucagcc

SEQ ID NO: 3610806 - RNA, 15 nt, Human
ccucccaccucugug

SEQ ID NO: 3610807 - RNA, 19 nt, Human
ccucccaccucugugaccu

SEQ ID NO: 3610808 - RNA, 11 nt, Human
ccucccaccuu

SEQ ID NO: 3610809 - RNA, 14 nt, Human
ccucccacugccca

SEQ ID NO: 3610810 - RNA, 16 nt, Human
ccucccacuucacugc

SEQ ID NO: 3610811 - RNA, 19 nt, Human
ccucccacuuugcuguucc

SEQ ID NO: 3610812 - RNA, 11 nt, Human
ccucccagaaa

SEQ ID NO: 3610813 - RNA, 21 nt, Human
ccucccagaccugccucuucc

SEQ ID NO: 3610814 - RNA, 16 nt, Human
ccucccagagcaccug

SEQ ID NO: 3610815 - RNA, 11 nt, Human
ccucccagagg

SEQ ID NO: 3610816 - RNA, 21 nt, Human
ccucccagaggagccaccagu

SEQ ID NO: 3610817 - RNA, 12 nt, Human
ccucccagaggu

SEQ ID NO: 3610818 - RNA, 21 nt, Human
ccucccagaucggaucuguug

SEQ ID NO: 3610819 - RNA, 13 nt, Human
ccucccagcccua

SEQ ID NO: 3610820 - RNA, 18 nt, Human
ccucccagcccuauggau

SEQ ID NO: 3610821 - RNA, 19 nt, Human
ccucccagcccuauggaug

SEQ ID NO: 3610822 - RNA, 14 nt, Human
ccucccagcucuga

SEQ ID NO: 3610823 - RNA, 14 nt, Human
caguuuauguuuug

SEQ ID NO: 3610824 - RNA, 19 nt, Human
caguuuauguuuuggucca

SEQ ID NO: 3610825 - RNA, 14 nt, Human
caguuuauuccaga

SEQ ID NO: 3610826 - RNA, 18 nt, Human
caguuuauuugaaccaau

SEQ ID NO: 3610827 - RNA, 12 nt, Human
caguuucaauaa

SEQ ID NO: 3610828 - RNA, 13 nt, Human
caguuucaauaaa

SEQ ID NO: 3610829 - RNA, 17 nt, Human
caguuucaauaaaguuu

SEQ ID NO: 3610830 - RNA, 18 nt, Human
caguuucaauaaaguuug

SEQ ID NO: 3610831 - RNA, 15 nt, Human
caguuucagguguuu

SEQ ID NO: 3610832 - RNA, 17 nt, Human
caguuucuaaacuggag

SEQ ID NO: 3610833 - RNA, 19 nt, Human
caguuucuaaacuggagac

SEQ ID NO: 3610834 - RNA, 14 nt, Human
caguuucugccucu

SEQ ID NO: 3610835 - RNA, 22 nt, Human
caguuucuucugcgccucaggc

SEQ ID NO: 3610836 - RNA, 16 nt, Human
caguuucuuucaaaga

SEQ ID NO: 3610837 - RNA, 13 nt, Human
caguuugaaauaa

SEQ ID NO: 3610838 - RNA, 20 nt, Human
caguuugaaauaagcuauuu

SEQ ID NO: 3610839 - RNA, 13 nt, Human
caguuugaaauuc

SEQ ID NO: 3610840 - RNA, 20 nt, Human
caguuugaaauucugaauuu

SEQ ID NO: 3610841 - RNA, 13 nt, Human
caguuugaacaaa

SEQ ID NO: 3610842 - RNA, 24 nt, Human
caguuugaaugcagucuguccagg

SEQ ID NO: 3610843 - RNA, 23 nt, Human
caguuugaggauuaguuuagaac

SEQ ID NO: 3610844 - RNA, 15 nt, Human
caguuugauaacuag

SEQ ID NO: 3610845 - RNA, 21 nt, Human
caguuugaucacacuauuuua

SEQ ID NO: 3610846 - RNA, 22 nt, Human
caguuugcagaaaagcaccugc

SEQ ID NO: 3610847 - RNA, 19 nt, Human
caguuugcuguacuagaga

SEQ ID NO: 3610848 - RNA, 16 nt, Human
caguuugcuuugcccu

SEQ ID NO: 3610849 - RNA, 14 nt, Human
caguuugcuuugua

SEQ ID NO: 3610850 - RNA, 14 nt, Human
caguuuguaaaugu

SEQ ID NO: 3610851 - RNA, 22 nt, Human
caguuuguaaauguuauuucug

SEQ ID NO: 3610852 - RNA, 18 nt, Human
caguuuguagugccacug

SEQ ID NO: 3610853 - RNA, 13 nt, Human
caguuugucagac

SEQ ID NO: 3610854 - RNA, 15 nt, Human
caguuugugugucuu

SEQ ID NO: 3610855 - RNA, 21 nt, Human
caguuugugugucuuaauuau

SEQ ID NO: 3610856 - RNA, 23 nt, Human
caguuuguuaguaugaggcauuu

SEQ ID NO: 3610857 - RNA, 14 nt, Human
caguuuguuggaaa

SEQ ID NO: 3610858 - RNA, 14 nt, Human
caguuuguuuacac

SEQ ID NO: 3610859 - RNA, 12 nt, Human
caguuuuaaaga

SEQ ID NO: 3610860 - RNA, 13 nt, Human
caguuuucagaaa

SEQ ID NO: 3610861 - RNA, 17 nt, Human
caguuuuccaugaaaac

SEQ ID NO: 3610862 - RNA, 11 nt, Human
caguuuuccuu

SEQ ID NO: 3610863 - RNA, 19 nt, Human
caguuuucugagaaagacu

SEQ ID NO: 3610864 - RNA, 20 nt, Human
caguuuucugagaaagacua

SEQ ID NO: 3610865 - RNA, 17 nt, Human
caguuuugguugcuuua

SEQ ID NO: 3610866 - RNA, 12 nt, Human
caguuuuucauu

SEQ ID NO: 3610867 - RNA, 10 nt, Human
caguuuuucu

SEQ ID NO: 3610868 - RNA, 18 nt, Human
caguuuuucuguauuuua

SEQ ID NO: 3610869 - RNA, 13 nt, Human
caguuuuucuuaa

SEQ ID NO: 3610870 - RNA, 19 nt, Human
caguuuuuuuccuucaaga

SEQ ID NO: 3610871 - RNA, 15 nt, Human
cauaaaaacaacuuu

SEQ ID NO: 3610872 - RNA, 17 nt, Human
cauaaaaacaacuuuau

SEQ ID NO: 3610873 - RNA, 20 nt, Human
cauaaaaacaacuuuauacc

SEQ ID NO: 3610874 - RNA, 19 nt, Human
cauaaaaacauuuuaaaaa

SEQ ID NO: 3610875 - RNA, 19 nt, Human
cauaaaaaggacaucagca

SEQ ID NO: 3610876 - RNA, 21 nt, Human
cauaaaaaggacaucagcaaa

SEQ ID NO: 3610877 - RNA, 15 nt, Human
cauaaaaaugaucua

SEQ ID NO: 3610878 - RNA, 11 nt, Human
cauaaaacauu

SEQ ID NO: 3610879 - RNA, 19 nt, Human
cauaaaacauuaagaaaau

SEQ ID NO: 3610880 - RNA, 22 nt, Human
cauaaaaucaaaacaagugaaa

SEQ ID NO: 3610881 - RNA, 21 nt, Human
cauaaacaagaccacguuucu

SEQ ID NO: 3610882 - RNA, 18 nt, Human
cauaaacaaugaugcccu

SEQ ID NO: 3610883 - RNA, 20 nt, Human
cauaaacacaucacagauga

SEQ ID NO: 3610884 - RNA, 20 nt, Human
cauaaaccauuuuuguuacu

SEQ ID NO: 3610885 - RNA, 12 nt, Human
cauaaaccuuaa

SEQ ID NO: 3610886 - RNA, 20 nt, Human
cauaaaccuuaaguaagcaa

SEQ ID NO: 3610887 - RNA, 15 nt, Human
cauaaacugacuuua

SEQ ID NO: 3610888 - RNA, 12 nt, Human
cauaaacuucau

SEQ ID NO: 3610889 - RNA, 19 nt, Human
cauaaagaagauguuuaac

SEQ ID NO: 3610890 - RNA, 20 nt, Human
cauaaagcaaauagacacag

SEQ ID NO: 3610891 - RNA, 18 nt, Human
cauaaagcauaaguauac

SEQ ID NO: 3610892 - RNA, 17 nt, Human
cauaaagcucaaaugaa

SEQ ID NO: 3610893 - RNA, 13 nt, Human
cauaaaggaaaag

SEQ ID NO: 3610894 - RNA, 22 nt, Human
cauaaaggugguaugugugugu

SEQ ID NO: 3610895 - RNA, 22 nt, Human
cauaaagguuauuuucuccuga

SEQ ID NO: 3610896 - RNA, 22 nt, Human
cauaaaguuagaaucuauuuuc

SEQ ID NO: 3610897 - RNA, 11 nt, Human
cauaaaucaac

SEQ ID NO: 3610898 - RNA, 16 nt, Human
cauaaauccaguucua

SEQ ID NO: 3610899 - RNA, 16 nt, Human
cauaaaucuuccaaag

SEQ ID NO: 3610900 - RNA, 13 nt, Human
cauaaaugaauuu

SEQ ID NO: 3610901 - RNA, 16 nt, Human
cauaaaugcagcccau

SEQ ID NO: 3610902 - RNA, 18 nt, Human
cauaaauucaacuuugua

SEQ ID NO: 3610903 - RNA, 22 nt, Human
cauaaauuuuuugaagucuuua

SEQ ID NO: 3610904 - RNA, 15 nt, Human
cauaacaauuccucu

SEQ ID NO: 3610905 - RNA, 16 nt, Human
cauaacaauuccucua

SEQ ID NO: 3610906 - RNA, 17 nt, Human
cauaacagaaugcacca

SEQ ID NO: 3610907 - RNA, 20 nt, Human
cauaacagauuuuuuuugga

SEQ ID NO: 3610908 - RNA, 19 nt, Human
cauaacaggguaaauuauu

SEQ ID NO: 3610909 - RNA, 15 nt, Human
cauaacagugcaggg

SEQ ID NO: 3610910 - RNA, 13 nt, Human
cauaacagugcca

SEQ ID NO: 3610911 - RNA, 14 nt, Human
cauaacagugccau

SEQ ID NO: 3610912 - RNA, 19 nt, Human
cauaacauaaaucugugaa

SEQ ID NO: 3610913 - RNA, 14 nt, Human
cauaacauccagag

SEQ ID NO: 3610914 - RNA, 14 nt, Human
cauaaccacugcuu

SEQ ID NO: 3610915 - RNA, 22 nt, Human
cauaacccaagguaccauccua

SEQ ID NO: 3610916 - RNA, 12 nt, Human
cauaaccccacc

SEQ ID NO: 3610917 - RNA, 16 nt, Human
cauaaccuagccuuag

SEQ ID NO: 3610918 - RNA, 23 nt, Human
cauaaccugucucaccuggacuu

SEQ ID NO: 3610919 - RNA, 17 nt, Human
cauaacggaucagaaau

SEQ ID NO: 3610920 - RNA, 21 nt, Human
cauaacggaucagaaauacag

SEQ ID NO: 3610921 - RNA, 16 nt, Human
cauaacguuuuuccuu

SEQ ID NO: 3610922 - RNA, 17 nt, Human
cauaacguuuuuccuuu

SEQ ID NO: 3610923 - RNA, 21 nt, Human
cauaacguuuuuccuuuaaaa

SEQ ID NO: 3610924 - RNA, 14 nt, Human
cauaacuaaauuug

SEQ ID NO: 3610925 - RNA, 16 nt, Human
cauaacuaaauuugau

SEQ ID NO: 3610926 - RNA, 17 nt, Human
cauaacuaauacagcug

SEQ ID NO: 3610927 - RNA, 22 nt, Human
cauaacuaauacagcugagcua

SEQ ID NO: 3610928 - RNA, 13 nt, Human
cauaacuagaacu

SEQ ID NO: 3610929 - RNA, 18 nt, Human
cauaacucuguaaaaaca

SEQ ID NO: 3610930 - RNA, 23 nt, Human
cauaacuuccuguacuugaaguc

SEQ ID NO: 3610931 - RNA, 20 nt, Human
cauaagaccauaacagccaa

SEQ ID NO: 3610932 - RNA, 15 nt, Human
cauaagauauuuuau

SEQ ID NO: 3610933 - RNA, 20 nt, Human
cauaagccaauuuuucugca

SEQ ID NO: 3610934 - RNA, 23 nt, Human
cauaagccuccauuuaguucuuu

SEQ ID NO: 3610935 - RNA, 19 nt, Human
cauaagcggcguaaguuua

SEQ ID NO: 3610936 - RNA, 14 nt, Human
cauaagcuacugcc

SEQ ID NO: 3610937 - RNA, 17 nt, Human
cauaagcuacugccauc

SEQ ID NO: 3610938 - RNA, 16 nt, Human
cauaagcuuuuucucu

SEQ ID NO: 3610939 - RNA, 21 nt, Human
cauaaggccaguaugauuuau

SEQ ID NO: 3610940 - RNA, 23 nt, Human
cauaagggguuugccauuugaua

SEQ ID NO: 3610941 - RNA, 15 nt, Human
cauaagguuucguuu

SEQ ID NO: 3610942 - RNA, 11 nt, Human
cauaagguuuu

SEQ ID NO: 3610943 - RNA, 16 nt, Human
cauaagguuuuuaugc

SEQ ID NO: 3610944 - RNA, 17 nt, Human
cauaaguaauucaagaa

SEQ ID NO: 3610945 - RNA, 15 nt, Human
cauaaguauuucaaa

SEQ ID NO: 3610946 - RNA, 22 nt, Human
cauaaguccucuagugaaugua

SEQ ID NO: 3610947 - RNA, 21 nt, Human
cauaauaaaaaauuaugacaa

SEQ ID NO: 3610948 - RNA, 18 nt, Human
cauaauaauccugcaaag

SEQ ID NO: 3610949 - RNA, 15 nt, Human
ccuccggacuggugc

SEQ ID NO: 3610950 - RNA, 16 nt, Human
ccuccggacuggugcc

SEQ ID NO: 3610951 - RNA, 18 nt, Human
ccuccggcgucagccucc

SEQ ID NO: 3610952 - RNA, 22 nt, Human
ccuccggcgucagccuccagcc

SEQ ID NO: 3610953 - RNA, 14 nt, Human
ccuccggcuaagca

SEQ ID NO: 3610954 - RNA, 15 nt, Human
ccuccgggucuuccu

SEQ ID NO: 3610955 - RNA, 16 nt, Human
ccuccgggucuuccua

SEQ ID NO: 3610956 - RNA, 15 nt, Human
ccuccguauuucaga

SEQ ID NO: 3610957 - RNA, 16 nt, Human
ccuccgucacuaccug

SEQ ID NO: 3610958 - RNA, 18 nt, Human
ccuccguccaggagccug

SEQ ID NO: 3610959 - RNA, 14 nt, Human
ccuccgugcuuccu

SEQ ID NO: 3610960 - RNA, 13 nt, Human
ccuccguuuuucu

SEQ ID NO: 3610961 - RNA, 21 nt, Human
ccuccuaaaaggcccagagag

SEQ ID NO: 3610962 - RNA, 15 nt, Human
ccuccuaccccuccc

SEQ ID NO: 3610963 - RNA, 17 nt, Human
ccuccuaccccucccag

SEQ ID NO: 3610964 - RNA, 18 nt, Human
ccuccuaccccucccagc

SEQ ID NO: 3610965 - RNA, 22 nt, Human
ccuccuaccgaaaccuugccuu

SEQ ID NO: 3610966 - RNA, 18 nt, Human
ccuccuaucaccuccccu

SEQ ID NO: 3610967 - RNA, 22 nt, Human
ccuccuauucaguucccagaau

SEQ ID NO: 3610968 - RNA, 23 nt, Human
ccugaggaaggaggggaagcugc

SEQ ID NO: 3610969 - RNA, 15 nt, Human
ccugaggacagcugu

SEQ ID NO: 3610970 - RNA, 20 nt, Human
ccugaggacagcuguccucu

SEQ ID NO: 3610971 - RNA, 14 nt, Human
ccugaggagucuga

SEQ ID NO: 3610972 - RNA, 16 nt, Human
ccugaggagucugagg

SEQ ID NO: 3610973 - RNA, 19 nt, Human
ccugaggagucugaggucc

SEQ ID NO: 3610974 - RNA, 16 nt, Human
ccugaggaucagaaag

SEQ ID NO: 3610975 - RNA, 16 nt, Human
ccugaggaugagcugg

SEQ ID NO: 3610976 - RNA, 17 nt, Human
ccugaggaugagcugga

SEQ ID NO: 3610977 - RNA, 14 nt, Human
ccugaggcccagag

SEQ ID NO: 3610978 - RNA, 16 nt, Human
ccugaggcccagaggg

SEQ ID NO: 3610979 - RNA, 11 nt, Human
ccugaggcccu

SEQ ID NO: 3610980 - RNA, 17 nt, Human
ccugaggcccuucucuc

SEQ ID NO: 3610981 - RNA, 19 nt, Human
ccugaggcccuucucucca

SEQ ID NO: 3610982 - RNA, 20 nt, Human
ccugaggcccuucucuccag

SEQ ID NO: 3610983 - RNA, 21 nt, Human
ccugaggcccuucucuccagc

SEQ ID NO: 3610984 - RNA, 18 nt, Human
ccugaggccuagacucug

SEQ ID NO: 3610985 - RNA, 18 nt, Human
ccugaggcuggacuccag

SEQ ID NO: 3610986 - RNA, 19 nt, Human
ccugaggcuggacuccaga

SEQ ID NO: 3610987 - RNA, 15 nt, Human
ccugaggcugggcuc

SEQ ID NO: 3610988 - RNA, 14 nt, Human
ccugaggcuguggu

SEQ ID NO: 3610989 - RNA, 16 nt, Human
ccugaggcugugguca

SEQ ID NO: 3610990 - RNA, 18 nt, Human
ccugagggaaaggccagc

SEQ ID NO: 3610991 - RNA, 18 nt, Human
ccugagggaggaccuggg

SEQ ID NO: 3610992 - RNA, 22 nt, Human
ccugagggaggaccuggggcac

SEQ ID NO: 3610993 - RNA, 22 nt, Human
ccugagggcagaaagguucugc

SEQ ID NO: 3610994 - RNA, 13 nt, Human
ccugagggccccu

SEQ ID NO: 3610995 - RNA, 20 nt, Human
ccugagggccccucugccca

SEQ ID NO: 3610996 - RNA, 18 nt, Human
ccugagggcggggugucu

SEQ ID NO: 3610997 - RNA, 21 nt, Human
ccugaggggcagccugccuug

SEQ ID NO: 3610998 - RNA, 22 nt, Human
ccugaggggcaucugccccucc

SEQ ID NO: 3610999 - RNA, 22 nt, Human
ccugaggucagggagugcuggc

SEQ ID NO: 3611000 - RNA, 16 nt, Human
ccugaggucucgcuga

SEQ ID NO: 3611001 - RNA, 19 nt, Human
ccugaggucuggcugcuug

SEQ ID NO: 3611002 - RNA, 20 nt, Human
ccugaggugaaagggagcua

SEQ ID NO: 3611003 - RNA, 23 nt, Human
ccugaggugaugaagacagcccg

SEQ ID NO: 3611004 - RNA, 15 nt, Human
ccugaggugggccca

SEQ ID NO: 3611005 - RNA, 18 nt, Human
ccugaggugggcccagga

SEQ ID NO: 3611006 - RNA, 15 nt, Human
ccugagguguggggg

SEQ ID NO: 3611007 - RNA, 19 nt, Human
ccugaggugugggggcugc

SEQ ID NO: 3611008 - RNA, 23 nt, Human
ccugaggugugggggcugcagca

SEQ ID NO: 3611009 - RNA, 20 nt, Human
ccugaguaaucgcuuaaaga

SEQ ID NO: 3611010 - RNA, 23 nt, Human
ccugaguaaucgcuuaaagaugu

SEQ ID NO: 3611011 - RNA, 18 nt, Human
ccugaguacuccacacug

SEQ ID NO: 3611012 - RNA, 21 nt, Human
ccugaguagcugggauuacag

SEQ ID NO: 3611013 - RNA, 13 nt, Human
ccugagucaccag

SEQ ID NO: 3611014 - RNA, 15 nt, Human
ccugagucaccagga

SEQ ID NO: 3611015 - RNA, 16 nt, Human
ccugagucagggccca

SEQ ID NO: 3611016 - RNA, 17 nt, Human
ccugagucagggcccag

SEQ ID NO: 3611017 - RNA, 18 nt, Human
ccugagucagggcccaga

SEQ ID NO: 3611018 - RNA, 23 nt, Human
ccugagucagggcccagaggcug

SEQ ID NO: 3611019 - RNA, 22 nt, Human
ccugagucguacagaaagcugc

SEQ ID NO: 3611020 - RNA, 18 nt, Human
ccugagucgugaccugcu

SEQ ID NO: 3611021 - RNA, 14 nt, Human
ccugagucuccugu

SEQ ID NO: 3611022 - RNA, 15 nt, Human
ccugagucuccugug

SEQ ID NO: 3611023 - RNA, 16 nt, Human
ccugagucuccugugc

SEQ ID NO: 3611024 - RNA, 16 nt, Human
ccugagugagagggga

SEQ ID NO: 3611025 - RNA, 21 nt, Human
ccugagugagaggggaggcca

SEQ ID NO: 3611026 - RNA, 22 nt, Human
ccugagugagaggggaggccaa

SEQ ID NO: 3611027 - RNA, 23 nt, Human
ccugagugagaggggaggccaag

SEQ ID NO: 3611028 - RNA, 14 nt, Human
ccugagugccuggc

SEQ ID NO: 3611029 - RNA, 17 nt, Human
ccugagugcuugcuuuu

SEQ ID NO: 3611030 - RNA, 14 nt, Human
ccugaguggugcca

SEQ ID NO: 3611031 - RNA, 18 nt, Human
ccugaguuaggcuuucuc

SEQ ID NO: 3611032 - RNA, 22 nt, Human
ccugaguuaggcuuucucuuca

SEQ ID NO: 3611033 - RNA, 21 nt, Human
ccugaguuccuagccaccgcc

SEQ ID NO: 3611034 - RNA, 14 nt, Human
ccugaguuccugag

SEQ ID NO: 3611035 - RNA, 18 nt, Human
ccugaguugaagagggga

SEQ ID NO: 3611036 - RNA, 19 nt, Human
ccugaguuucaaguauccu

SEQ ID NO: 3611037 - RNA, 19 nt, Human
ccugauaaagaacaucugu

SEQ ID NO: 3611038 - RNA, 17 nt, Human
ccugauaaagcacagcu

SEQ ID NO: 3611039 - RNA, 20 nt, Human
ccugauaugauuuaaaacau

SEQ ID NO: 3611040 - RNA, 22 nt, Human
ccugauauugaaguaaaaaauu

SEQ ID NO: 3611041 - RNA, 20 nt, Human
ccugaucaagucaccggagc

SEQ ID NO: 3611042 - RNA, 17 nt, Human
ccugaucacuagccugu

SEQ ID NO: 3611043 - RNA, 18 nt, Human
ccugaucagaccacggcu

SEQ ID NO: 3611044 - RNA, 19 nt, Human
ccugaucagaccacggcuc

SEQ ID NO: 3611045 - RNA, 14 nt, Human
ccugaucccagaga

SEQ ID NO: 3611046 - RNA, 19 nt, Human
ccugaucccuuccaccugc

SEQ ID NO: 3611047 - RNA, 15 nt, Human
ccugauccuggaggc

SEQ ID NO: 3611048 - RNA, 18 nt, Human
ccugauccuggaggccca

SEQ ID NO: 3611049 - RNA, 15 nt, Human
ccugauccugugaag

SEQ ID NO: 3611050 - RNA, 23 nt, Human
ccugaucgccaaccuuuccccca

SEQ ID NO: 3611051 - RNA, 16 nt, Human
ccugaucucuuccugu

SEQ ID NO: 3611052 - RNA, 14 nt, Human
ccugaugaaaauaa

SEQ ID NO: 3611053 - RNA, 18 nt, Human
ccugaugaaaauaaagaa

SEQ ID NO: 3611054 - RNA, 14 nt, Human
ccugaugacccagg

SEQ ID NO: 3611055 - RNA, 17 nt, Human
ccugaugacccaggcug

SEQ ID NO: 3611056 - RNA, 17 nt, Human
ccugaugagauuuuuaa

SEQ ID NO: 3611057 - RNA, 13 nt, Human
ccugaugcugaca

SEQ ID NO: 3611058 - RNA, 21 nt, Human
ccugaugcuucuucagagacu

SEQ ID NO: 3611059 - RNA, 18 nt, Human
ccugaugcuuuugucuaa

SEQ ID NO: 3611060 - RNA, 17 nt, Human
ccugauggccaggccag

SEQ ID NO: 3611061 - RNA, 16 nt, Human
ccugauggucagcucc

SEQ ID NO: 3611062 - RNA, 22 nt, Human
ccugauggucagcucccuucuc

SEQ ID NO: 3611063 - RNA, 16 nt, Human
ccugauguuaaaauuc

SEQ ID NO: 3611064 - RNA, 13 nt, Human
ccugauuaaagaa

SEQ ID NO: 3611065 - RNA, 13 nt, Human
ccugauugaccug

SEQ ID NO: 3611066 - RNA, 17 nt, Human
ccugauugaccugcucc

SEQ ID NO: 3611067 - RNA, 18 nt, Human
ccugauugguuucucuuc

SEQ ID NO: 3611068 - RNA, 23 nt, Human
ccugauugugucucuugguccug

SEQ ID NO: 3611069 - RNA, 18 nt, Human
ccugauuuaggagaagcc

SEQ ID NO: 3611070 - RNA, 15 nt, Human
ccugauuucuucagg

SEQ ID NO: 3611071 - RNA, 22 nt, Human
ccugauuuuuuuuccuuuuaau

SEQ ID NO: 3611072 - RNA, 17 nt, Human
ccugcaaaaggacucuc

SEQ ID NO: 3611073 - RNA, 19 nt, Human
ccugcaaaaggacucucag

SEQ ID NO: 3611074 - RNA, 19 nt, Human
ccugcaaacagaacagggu

SEQ ID NO: 3611075 - RNA, 20 nt, Human
ccugcaaacagaacaggguc

SEQ ID NO: 3611076 - RNA, 17 nt, Human
ccugcaaacgcugccug

SEQ ID NO: 3611077 - RNA, 14 nt, Human
ccugcaaacucacu

SEQ ID NO: 3611078 - RNA, 22 nt, Human
ccugcaaacucacugcucaaga

SEQ ID NO: 3611079 - RNA, 12 nt, Human
ccugcaaacugg

SEQ ID NO: 3611080 - RNA, 13 nt, Human
ccugcaaacuggg

SEQ ID NO: 3611081 - RNA, 16 nt, Human
ccugcaaacugggaac

SEQ ID NO: 3611082 - RNA, 22 nt, Human
ccugcaaacugggaaccccuuu

SEQ ID NO: 3611083 - RNA, 19 nt, Human
ccugcaaagcccagcuuga

SEQ ID NO: 3611084 - RNA, 22 nt, Human
ccugcaaaguacagguacuuug

SEQ ID NO: 3611085 - RNA, 19 nt, Human
ccugcaacaccuuguuucc

SEQ ID NO: 3611086 - RNA, 20 nt, Human
ccugcaaccaaacucccauc

SEQ ID NO: 3611087 - RNA, 20 nt, Human
ccugcaacucaaggacuuug

SEQ ID NO: 3611088 - RNA, 21 nt, Human
ccugcaagccugucugagacu

SEQ ID NO: 3611089 - RNA, 13 nt, Human
ccugcaaggccca

SEQ ID NO: 3611090 - RNA, 15 nt, Human
ccugcaaggcccaca

SEQ ID NO: 3611091 - RNA, 19 nt, Human
ccugcaaggcccacaggag

SEQ ID NO: 3611092 - RNA, 17 nt, Human
ccugcaagucaguccag

SEQ ID NO: 3611093 - RNA, 19 nt, Human
ccugcaaugaagucucuga

SEQ ID NO: 3611094 - RNA, 21 nt, Human
ccugcaaugaagucucugaag

SEQ ID NO: 3611095 - RNA, 22 nt, Human
ccugcacacaagcccacagcac

SEQ ID NO: 3611096 - RNA, 19 nt, Human
ccugcacagcaggcugcca

SEQ ID NO: 3611097 - RNA, 21 nt, Human
ccugcacagcaggcugccagu

SEQ ID NO: 3611098 - RNA, 19 nt, Human
ccugcacagugucccccag

SEQ ID NO: 3611099 - RNA, 14 nt, Human
ccugcaccaggaga

SEQ ID NO: 3611100 - RNA, 17 nt, Human
ccugcaccaggagacag

SEQ ID NO: 3611101 - RNA, 11 nt, Human
ccugcacccuc

SEQ ID NO: 3611102 - RNA, 16 nt, Human
ccugcacccuccuagg

SEQ ID NO: 3611103 - RNA, 14 nt, Human
cauaauacaaaagg

SEQ ID NO: 3611104 - RNA, 22 nt, Human
cauaauagacuucccacucuag

SEQ ID NO: 3611105 - RNA, 18 nt, Human
cauaaucacaacccuuca

SEQ ID NO: 3611106 - RNA, 16 nt, Human
cauaaucacucuaauu

SEQ ID NO: 3611107 - RNA, 18 nt, Human
cauaauccaguaaaauaa

SEQ ID NO: 3611108 - RNA, 20 nt, Human
cauaaucuaccaacgaaaga

SEQ ID NO: 3611109 - RNA, 23 nt, Human
cauaaucuggacuccucugucca

SEQ ID NO: 3611110 - RNA, 18 nt, Human
cauaaucuguacaaugaa

SEQ ID NO: 3611111 - RNA, 18 nt, Human
aaaguucaacauguuauu

SEQ ID NO: 3611112 - RNA, 20 nt, Human
aaaguucagaguuuucuggg

SEQ ID NO: 3611113 - RNA, 19 nt, Human
aaaguucauaacagugcca

SEQ ID NO: 3611114 - RNA, 21 nt, Human
aaaguucccuacuuccuguga

SEQ ID NO: 3611115 - RNA, 23 nt, Human
aaaguucccuacuuccugugacu

SEQ ID NO: 3611116 - RNA, 12 nt, Human
aaaguucuaaga

SEQ ID NO: 3611117 - RNA, 17 nt, Human
aaaguucuaagauucug

SEQ ID NO: 3611118 - RNA, 21 nt, Human
aaaguucuguacucaaaugua

SEQ ID NO: 3611119 - RNA, 16 nt, Human
aaaguucuguguauuu

SEQ ID NO: 3611120 - RNA, 17 nt, Human
aaaguucuguguuuaau

SEQ ID NO: 3611121 - RNA, 12 nt, Human
aaaguugaauuu

SEQ ID NO: 3611122 - RNA, 19 nt, Human
aaaguugacaccugagaaa

SEQ ID NO: 3611123 - RNA, 20 nt, Human
aaaguugauaaagauuuuuu

SEQ ID NO: 3611124 - RNA, 23 nt, Human
aaaguugauaaagauuuuuuaau

SEQ ID NO: 3611125 - RNA, 14 nt, Human
aaaguugcaaggca

SEQ ID NO: 3611126 - RNA, 21 nt, Human
aaaguugcaaggcaaauguuu

SEQ ID NO: 3611127 - RNA, 18 nt, Human
aaaguugcacggcugcug

SEQ ID NO: 3611128 - RNA, 19 nt, Human
aaaguugcagcuguuuugu

SEQ ID NO: 3611129 - RNA, 20 nt, Human
aaaguugcagcuguuuuguu

SEQ ID NO: 3611130 - RNA, 23 nt, Human
aaaguugcagcuguuuuguugac

SEQ ID NO: 3611131 - RNA, 17 nt, Human
aaaguugccuaaaucca

SEQ ID NO: 3611132 - RNA, 17 nt, Human
aaaguugguaaaccuuu

SEQ ID NO: 3611133 - RNA, 18 nt, Human
aaaguugguauuaauaaa

SEQ ID NO: 3611134 - RNA, 16 nt, Human
aaaguuggugacagau

SEQ ID NO: 3611135 - RNA, 14 nt, Human
aaaguuguacuuua

SEQ ID NO: 3611136 - RNA, 19 nt, Human
aaaguuguacuuuaaaaau

SEQ ID NO: 3611137 - RNA, 17 nt, Human
aaaguuguaugaucugu

SEQ ID NO: 3611138 - RNA, 19 nt, Human
aaaguuguaugaucugugc

SEQ ID NO: 3611139 - RNA, 13 nt, Human
aaaguuguuguaa

SEQ ID NO: 3611140 - RNA, 13 nt, Human
aaaguuuaaaaug

SEQ ID NO: 3611141 - RNA, 16 nt, Human
aaaguuuaauauuaaa

SEQ ID NO: 3611142 - RNA, 12 nt, Human
aaaguuuacaac

SEQ ID NO: 3611143 - RNA, 16 nt, Human
aaaguuuacaacauaa

SEQ ID NO: 3611144 - RNA, 15 nt, Human
aaaguuuacaguaaa

SEQ ID NO: 3611145 - RNA, 14 nt, Human
aaaguuuccauaug

SEQ ID NO: 3611146 - RNA, 10 nt, Human
aaaguuuccg

SEQ ID NO: 3611147 - RNA, 12 nt, Human
aaaguuucucag

SEQ ID NO: 3611148 - RNA, 13 nt, Human
aaaguuugaucuu

SEQ ID NO: 3611149 - RNA, 13 nt, Human
aaaguuugccaga

SEQ ID NO: 3611150 - RNA, 16 nt, Human
aaaguuuuacaaaggg

SEQ ID NO: 3611151 - RNA, 13 nt, Human
aaaguuuuauaua

SEQ ID NO: 3611152 - RNA, 16 nt, Human
aaaguuuuauauauua

SEQ ID NO: 3611153 - RNA, 12 nt, Human
aaaguuuugaaa

SEQ ID NO: 3611154 - RNA, 13 nt, Human
aaaguuuuguaaa

SEQ ID NO: 3611155 - RNA, 11 nt, Human
aaaguuuuuua

SEQ ID NO: 3611156 - RNA, 18 nt, Human
aaauaaaaaagucucuau

SEQ ID NO: 3611157 - RNA, 13 nt, Human
aaauaaaaacaaa

SEQ ID NO: 3611158 - RNA, 23 nt, Human
aaauaaaaacuaaauuguaaacu

SEQ ID NO: 3611159 - RNA, 15 nt, Human
aaauaaaaacuaauu

SEQ ID NO: 3611160 - RNA, 13 nt, Human
aaauaaaaacuau

SEQ ID NO: 3611161 - RNA, 14 nt, Human
aaauaaaaagugac

SEQ ID NO: 3611162 - RNA, 12 nt, Human
aaauaaaaaguu

SEQ ID NO: 3611163 - RNA, 13 nt, Human
aaauaaaaaguua

SEQ ID NO: 3611164 - RNA, 15 nt, Human
aaauaaaaaguuaaa

SEQ ID NO: 3611165 - RNA, 16 nt, Human
aaauaaaaauaaauuc

SEQ ID NO: 3611166 - RNA, 15 nt, Human
aaauaaaaauggaua

SEQ ID NO: 3611167 - RNA, 16 nt, Human
aaauaaaaauucugaa

SEQ ID NO: 3611168 - RNA, 12 nt, Human
aaauaaaacauu

SEQ ID NO: 3611169 - RNA, 15 nt, Human
aaauaaaacauuuua

SEQ ID NO: 3611170 - RNA, 13 nt, Human
aaauaaaaccuuu

SEQ ID NO: 3611171 - RNA, 14 nt, Human
aaauaaaaccuuuc

SEQ ID NO: 3611172 - RNA, 17 nt, Human
aaauaaaaggaagccaa

SEQ ID NO: 3611173 - RNA, 19 nt, Human
aaauaaaaggacugugauu

SEQ ID NO: 3611174 - RNA, 13 nt, Human
aaauaaaauaacc

SEQ ID NO: 3611175 - RNA, 12 nt, Human
aaauaaaauaua

SEQ ID NO: 3611176 - RNA, 14 nt, Human
aaauaaaaugaaaa

SEQ ID NO: 3611177 - RNA, 15 nt, Human
aaauaaaaugaaaau

SEQ ID NO: 3611178 - RNA, 21 nt, Human
aaauaaaaugaaaauuguauu

SEQ ID NO: 3611179 - RNA, 15 nt, Human
aaauaaaauuaagaa

SEQ ID NO: 3611180 - RNA, 16 nt, Human
aaauaaaauuguacau

SEQ ID NO: 3611181 - RNA, 15 nt, Human
aaauaaaauuuguug

SEQ ID NO: 3611182 - RNA, 19 nt, Human
aaauaaaauuuguugcaua

SEQ ID NO: 3611183 - RNA, 19 nt, Human
aaauaaacacauagauuca

SEQ ID NO: 3611184 - RNA, 12 nt, Human
aaauaaacacug

SEQ ID NO: 3611185 - RNA, 14 nt, Human
aaauaaaccacugu

SEQ ID NO: 3611186 - RNA, 14 nt, Human
aaauaaaccuuaau

SEQ ID NO: 3611187 - RNA, 16 nt, Human
aaauaaacgucuuaaa

SEQ ID NO: 3611188 - RNA, 13 nt, Human
aaauaaacuuucu

SEQ ID NO: 3611189 - RNA, 21 nt, Human
aaauaaacuuucuuaauauuu

SEQ ID NO: 3611190 - RNA, 15 nt, Human
aaauaaagaaaagau

SEQ ID NO: 3611191 - RNA, 14 nt, Human
aaauaaagaaguau

SEQ ID NO: 3611192 - RNA, 13 nt, Human
aaauaaagaaugg

SEQ ID NO: 3611193 - RNA, 14 nt, Human
aaauaaagaaugga

SEQ ID NO: 3611194 - RNA, 16 nt, Human
aaauaaagaauggaaa

SEQ ID NO: 3611195 - RNA, 23 nt, Human
aaauaaaggaugugauuguggaa

SEQ ID NO: 3611196 - RNA, 16 nt, Human
aaauaaaguauauaua

SEQ ID NO: 3611197 - RNA, 18 nt, Human
aaauaaaguaucaugcau

SEQ ID NO: 3611198 - RNA, 20 nt, Human
aaauaaaguuugcuuagaaa

SEQ ID NO: 3611199 - RNA, 16 nt, Human
aaauaaauagcuauau

SEQ ID NO: 3611200 - RNA, 12 nt, Human
aaauaaauauca

SEQ ID NO: 3611201 - RNA, 22 nt, Human
aaauaaaugagcuauguauuaa

SEQ ID NO: 3611202 - RNA, 13 nt, Human
aaauaaaugcaau

SEQ ID NO: 3611203 - RNA, 21 nt, Human
aaauaaaugguuuggugcuuu

SEQ ID NO: 3611204 - RNA, 12 nt, Human
aaauaaauguac

SEQ ID NO: 3611205 - RNA, 18 nt, Human
aaauaaauuguauauuca

SEQ ID NO: 3611206 - RNA, 19 nt, Human
aaauaaauuguauauucac

SEQ ID NO: 3611207 - RNA, 21 nt, Human
aaauaaauuguauauucacuu

SEQ ID NO: 3611208 - RNA, 13 nt, Human
aaauaaauuguuu

SEQ ID NO: 3611209 - RNA, 15 nt, Human
aaauaacaaaaugga

SEQ ID NO: 3611210 - RNA, 20 nt, Human
aaauaacaacuuuuuuuucu

SEQ ID NO: 3611211 - RNA, 15 nt, Human
aaauaacaauguuaa

SEQ ID NO: 3611212 - RNA, 16 nt, Human
aaauaacaauguuaag

SEQ ID NO: 3611213 - RNA, 19 nt, Human
aaauaacaauguuaaggaa

SEQ ID NO: 3611214 - RNA, 21 nt, Human
aaauaacacacauauaaacau

SEQ ID NO: 3611215 - RNA, 15 nt, Human
aaauaacacagagag

SEQ ID NO: 3611216 - RNA, 23 nt, Human
aaauaacacagagagacagacuu

SEQ ID NO: 3611217 - RNA, 17 nt, Human
aaauaacagaagaaaau

SEQ ID NO: 3611218 - RNA, 17 nt, Human
aaauaacagauuucuca

SEQ ID NO: 3611219 - RNA, 18 nt, Human
aaauaaccaaucuacaau

SEQ ID NO: 3611220 - RNA, 18 nt, Human
aaauaacugaauuuggag

SEQ ID NO: 3611221 - RNA, 16 nt, Human
aaauaacuggaaaaca

SEQ ID NO: 3611222 - RNA, 15 nt, Human
aaauaacuguaauua

SEQ ID NO: 3611223 - RNA, 24 nt, Human
aaauaagaaacaacucuuugagaa

SEQ ID NO: 3611224 - RNA, 14 nt, Human
aaauaagaaacuuu

SEQ ID NO: 3611225 - RNA, 16 nt, Human
aaauaagaaauaaugc

SEQ ID NO: 3611226 - RNA, 15 nt, Human
aaauaagaagaaugc

SEQ ID NO: 3611227 - RNA, 20 nt, Human
aaauaagaagaaugcuuaau

SEQ ID NO: 3611228 - RNA, 12 nt, Human
aaauaagagaga

SEQ ID NO: 3611229 - RNA, 16 nt, Human
aaauaagauucuaacg

SEQ ID NO: 3611230 - RNA, 16 nt, Human
aaauaaggaaaagcuu

SEQ ID NO: 3611231 - RNA, 19 nt, Human
aaauaaggcacccaucugu

SEQ ID NO: 3611232 - RNA, 18 nt, Human
aaauaagggcagagucac

SEQ ID NO: 3611233 - RNA, 16 nt, Human
aaauaagguguauugc

SEQ ID NO: 3611234 - RNA, 15 nt, Human
aaauaaguauuuaua

SEQ ID NO: 3611235 - RNA, 15 nt, Human
aaauaagucaacagu

SEQ ID NO: 3611236 - RNA, 18 nt, Human
aaauaagucaacaguaaa

SEQ ID NO: 3611237 - RNA, 20 nt, Human
aaauaaguguauuuugaaau

SEQ ID NO: 3611238 - RNA, 12 nt, Human
aaauaauaaauu

SEQ ID NO: 3611239 - RNA, 17 nt, Human
aaauaauacugcugaga

SEQ ID NO: 3611240 - RNA, 12 nt, Human
aaauaauaugca

SEQ ID NO: 3611241 - RNA, 13 nt, Human
aaauaauaugcau

SEQ ID NO: 3611242 - RNA, 13 nt, Human
aaauaaucuauuu

SEQ ID NO: 3611243 - RNA, 22 nt, Human
aaauaaucuauuucuaugagaa

SEQ ID NO: 3611244 - RNA, 15 nt, Human
aaauaaucucugauu

SEQ ID NO: 3611245 - RNA, 19 nt, Human
aaauaaugaauacauuucc

SEQ ID NO: 3611246 - RNA, 12 nt, Human
aaauaaugcaaa

SEQ ID NO: 3611247 - RNA, 13 nt, Human
aaauaaugcuaca

SEQ ID NO: 3611248 - RNA, 12 nt, Human
aaauaaugcuuu

SEQ ID NO: 3611249 - RNA, 13 nt, Human
aaauaaugucucu

SEQ ID NO: 3611250 - RNA, 13 nt, Human
aaauaaugucuug

SEQ ID NO: 3611251 - RNA, 15 nt, Human
aaauaaugucuuguu

SEQ ID NO: 3611252 - RNA, 13 nt, Human
aaauaaugugaaa

SEQ ID NO: 3611253 - RNA, 17 nt, Human
aaauaauuagguauuuu

SEQ ID NO: 3611254 - RNA, 12 nt, Human
aaauaauuauuu

SEQ ID NO: 3611255 - RNA, 13 nt, Human
aaauaauucuaaa

SEQ ID NO: 3611256 - RNA, 18 nt, Human
aaauaauucuuuuuuauu

SEQ ID NO: 3611257 - RNA, 19 nt, Human
aaauaauucuuuuuuauua

SEQ ID NO: 3611258 - RNA, 22 nt, Human
aaauaauucuuuuuuauuaauc

SEQ ID NO: 3611259 - RNA, 19 nt, Human
ccugcuucagauguggagc

SEQ ID NO: 3611260 - RNA, 20 nt, Human
ccugcuucagccucccacag

SEQ ID NO: 3611261 - RNA, 16 nt, Human
ccugcuucaugcucag

SEQ ID NO: 3611262 - RNA, 19 nt, Human
ccugcuuccaccucacccc

SEQ ID NO: 3611263 - RNA, 20 nt, Human
ccugcuuccaccucacccca

SEQ ID NO: 3611264 - RNA, 22 nt, Human
ccugcuuccaggaaacuccaca

SEQ ID NO: 3611265 - RNA, 18 nt, Human
ccugcuucccaccucccu

SEQ ID NO: 3611266 - RNA, 23 nt, Human
ccugcuucccaccucccugccca

SEQ ID NO: 3611267 - RNA, 14 nt, Human
ccugcuuccugcuu

SEQ ID NO: 3611268 - RNA, 18 nt, Human
ccugcuuccugcuugcca

SEQ ID NO: 3611269 - RNA, 16 nt, Human
ccugcuucuccagccu

SEQ ID NO: 3611270 - RNA, 12 nt, Human
ccugcuucucug

SEQ ID NO: 3611271 - RNA, 21 nt, Human
ccugcuugaugggauucugga

SEQ ID NO: 3611272 - RNA, 23 nt, Human
ccugcuugccaaggcagaggccu

SEQ ID NO: 3611273 - RNA, 23 nt, Human
ccugcuuggggggugaugagggc

SEQ ID NO: 3611274 - RNA, 20 nt, Human
ccugcuuggguggagaagcc

SEQ ID NO: 3611275 - RNA, 18 nt, Human
ccugcuugucccugccca

SEQ ID NO: 3611276 - RNA, 19 nt, Human
ccugcuuuaaccaccccau

SEQ ID NO: 3611277 - RNA, 21 nt, Human
ccugcuuuagaauguuuuccu

SEQ ID NO: 3611278 - RNA, 22 nt, Human
ccugcuuucaagaccccugucu

SEQ ID NO: 3611279 - RNA, 16 nt, Human
ccugcuuucagauacu

SEQ ID NO: 3611280 - RNA, 18 nt, Human
ccugcuuugcgugcccgg

SEQ ID NO: 3611281 - RNA, 17 nt, Human
ccugcuuugggcugccc

SEQ ID NO: 3611282 - RNA, 18 nt, Human
ccugcuuugggcugcccu

SEQ ID NO: 3611283 - RNA, 21 nt, Human
ccugcuuugggcugcccuggu

SEQ ID NO: 3611284 - RNA, 15 nt, Human
ccugcuuuucacugc

SEQ ID NO: 3611285 - RNA, 19 nt, Human
ccugcuuuucacugcugca

SEQ ID NO: 3611286 - RNA, 15 nt, Human
ccugcuuuuuggaaa

SEQ ID NO: 3611287 - RNA, 16 nt, Human
ccugcuuuuuguguuu

SEQ ID NO: 3611288 - RNA, 17 nt, Human
ccuggaaaaauuccaga

SEQ ID NO: 3611289 - RNA, 16 nt, Human
ccuggaaaccacaguc

SEQ ID NO: 3611290 - RNA, 23 nt, Human
ccuggaaaggcucagucucagga

SEQ ID NO: 3611291 - RNA, 17 nt, Human
ccuggaaccuugcuguc

SEQ ID NO: 3611292 - RNA, 20 nt, Human
ccuggaacugucucucauga

SEQ ID NO: 3611293 - RNA, 12 nt, Human
ccuggaagacag

SEQ ID NO: 3611294 - RNA, 14 nt, Human
ccuggaagacagag

SEQ ID NO: 3611295 - RNA, 17 nt, Human
ccuggaagagcagcccu

SEQ ID NO: 3611296 - RNA, 18 nt, Human
ccuggaagcagugcccag

SEQ ID NO: 3611297 - RNA, 20 nt, Human
ccuggaagcagugcccaggu

SEQ ID NO: 3611298 - RNA, 23 nt, Human
ccuggaagcagugcccagguggc

SEQ ID NO: 3611299 - RNA, 23 nt, Human
ccuggaagcauuuguuucuacuu

SEQ ID NO: 3611300 - RNA, 15 nt, Human
ccuggaagccagcuu

SEQ ID NO: 3611301 - RNA, 20 nt, Human
ccuggaagcccucucuggcu

SEQ ID NO: 3611302 - RNA, 18 nt, Human
ccuggaagcuguguccuu

SEQ ID NO: 3611303 - RNA, 20 nt, Human
ccuggaagcuguguccuugc

SEQ ID NO: 3611304 - RNA, 15 nt, Human
ccuggaagcuuuguc

SEQ ID NO: 3611305 - RNA, 13 nt, Human
ccuggaagggcua

SEQ ID NO: 3611306 - RNA, 18 nt, Human
ccuggaauauauaaccag

SEQ ID NO: 3611307 - RNA, 23 nt, Human
ccuggaauuagcuuggggccagg

SEQ ID NO: 3611308 - RNA, 20 nt, Human
ccugaccucuugcugucucu

SEQ ID NO: 3611309 - RNA, 24 nt, Human
ccugaccucuugcugucucugcuc

SEQ ID NO: 3611310 - RNA, 14 nt, Human
ccugaccugaggcu

SEQ ID NO: 3611311 - RNA, 14 nt, Human
ccugaccuggcccc

SEQ ID NO: 3611312 - RNA, 23 nt, Human
ccugaccuugaggagucuugugu

SEQ ID NO: 3611313 - RNA, 18 nt, Human
ccugacgaaacuggcccc

SEQ ID NO: 3611314 - RNA, 19 nt, Human
ccugacgagauaagcaguu

SEQ ID NO: 3611315 - RNA, 20 nt, Human
ccugacggcgcccccagugu

SEQ ID NO: 3611316 - RNA, 20 nt, Human
ccugacgucugaagcuugac

SEQ ID NO: 3611317 - RNA, 10 nt, Human
ccugacucaa

SEQ ID NO: 3611318 - RNA, 16 nt, Human
ccugacucaucauuug

SEQ ID NO: 3611319 - RNA, 13 nt, Human
ccugacucauucu

SEQ ID NO: 3611320 - RNA, 13 nt, Human
ccugacuccccca

SEQ ID NO: 3611321 - RNA, 13 nt, Human
ccugacuccucua

SEQ ID NO: 3611322 - RNA, 15 nt, Human
ccugacuccucuaag

SEQ ID NO: 3611323 - RNA, 17 nt, Human
ccugacucugcccccug

SEQ ID NO: 3611324 - RNA, 22 nt, Human
ccugacucugcccccugcuggc

SEQ ID NO: 3611325 - RNA, 14 nt, Human
ccugacugccaagc

SEQ ID NO: 3611326 - RNA, 15 nt, Human
ccugacugccaagcc

SEQ ID NO: 3611327 - RNA, 16 nt, Human
ccugacugcccagcau

SEQ ID NO: 3611328 - RNA, 22 nt, Human
ccugacugcccagcauuugggu

SEQ ID NO: 3611329 - RNA, 13 nt, Human
ccugacugcucag

SEQ ID NO: 3611330 - RNA, 23 nt, Human
ccugacuggugcuauaggcugga

SEQ ID NO: 3611331 - RNA, 20 nt, Human
ccugacuucaggggcugccc

SEQ ID NO: 3611332 - RNA, 18 nt, Human
ccugacuuuucuguggau

SEQ ID NO: 3611333 - RNA, 14 nt, Human
ccugagaaauguua

SEQ ID NO: 3611334 - RNA, 15 nt, Human
ccugagaagcugcuc

SEQ ID NO: 3611335 - RNA, 20 nt, Human
ccugagacaaauggaggccu

SEQ ID NO: 3611336 - RNA, 18 nt, Human
ccugagacccaggacucc

SEQ ID NO: 3611337 - RNA, 12 nt, Human
ccugagaggcag

SEQ ID NO: 3611338 - RNA, 20 nt, Human
ccugagagucagcucucugc

SEQ ID NO: 3611339 - RNA, 15 nt, Human
ccugagauccccuga

SEQ ID NO: 3611340 - RNA, 18 nt, Human
ccugagauccccugagcc

SEQ ID NO: 3611341 - RNA, 18 nt, Human
ccugagaucucugcagga

SEQ ID NO: 3611342 - RNA, 18 nt, Human
ccugagaugggcuuccca

SEQ ID NO: 3611343 - RNA, 22 nt, Human
ccugagaugguaugcacaauuc

SEQ ID NO: 3611344 - RNA, 19 nt, Human
ccugagauuuauuaaagaa

SEQ ID NO: 3611345 - RNA, 17 nt, Human
ccugagauuucaucugc

SEQ ID NO: 3611346 - RNA, 22 nt, Human
ccugagauuucaucugcucucc

SEQ ID NO: 3611347 - RNA, 18 nt, Human
ccugagcaacucuugauu

SEQ ID NO: 3611348 - RNA, 19 nt, Human
ccugagcaaugucugugcu

SEQ ID NO: 3611349 - RNA, 16 nt, Human
ccugagcaccucccag

SEQ ID NO: 3611350 - RNA, 22 nt, Human
ccugagcaccucccagccccug

SEQ ID NO: 3611351 - RNA, 15 nt, Human
ccugagcacugccag

SEQ ID NO: 3611352 - RNA, 20 nt, Human
ccugagcacugccaggaggg

SEQ ID NO: 3611353 - RNA, 14 nt, Human
ccugagcaguccuu

SEQ ID NO: 3611354 - RNA, 13 nt, Human
ccugagccaagcu

SEQ ID NO: 3611355 - RNA, 20 nt, Human
ccugagccagauuucacucu

SEQ ID NO: 3611356 - RNA, 23 nt, Human
ccugagccagggucuccagaaag

SEQ ID NO: 3611357 - RNA, 12 nt, Human
ccugagcccacu

SEQ ID NO: 3611358 - RNA, 14 nt, Human
ccugagcccaggga

SEQ ID NO: 3611359 - RNA, 15 nt, Human
ccugagcccagggag

SEQ ID NO: 3611360 - RNA, 11 nt, Human
ccugagcccca

SEQ ID NO: 3611361 - RNA, 17 nt, Human
ccugagccccagggaga

SEQ ID NO: 3611362 - RNA, 21 nt, Human
ccugagccccgcccucuuccu

SEQ ID NO: 3611363 - RNA, 23 nt, Human
ccugagccccgcccucuuccuga

SEQ ID NO: 3611364 - RNA, 12 nt, Human
ccugagccccuu

SEQ ID NO: 3611365 - RNA, 16 nt, Human
ccugagccccuuccuu

SEQ ID NO: 3611366 - RNA, 22 nt, Human
ccugagcccuacucccugcaga

SEQ ID NO: 3611367 - RNA, 12 nt, Human
ccugagccugcc

SEQ ID NO: 3611368 - RNA, 20 nt, Human
ccugagccugccgagcaacc

SEQ ID NO: 3611369 - RNA, 12 nt, Human
ccugagcgcucc

SEQ ID NO: 3611370 - RNA, 11 nt, Human
ccugagcuaga

SEQ ID NO: 3611371 - RNA, 13 nt, Human
ccugagcucagcg

SEQ ID NO: 3611372 - RNA, 12 nt, Human
ccugagcucccc

SEQ ID NO: 3611373 - RNA, 15 nt, Human
ccugagcucggugga

SEQ ID NO: 3611374 - RNA, 19 nt, Human
ccugagcucgguggaccca

SEQ ID NO: 3611375 - RNA, 12 nt, Human
ccugagcuggga

SEQ ID NO: 3611376 - RNA, 16 nt, Human
ccugagcuuggccaga

SEQ ID NO: 3611377 - RNA, 18 nt, Human
ccugagcuuuggacacac

SEQ ID NO: 3611378 - RNA, 18 nt, Human
ccugagcuuuggacgcac

SEQ ID NO: 3611379 - RNA, 18 nt, Human
ccugaggaacccuuacag

SEQ ID NO: 3611380 - RNA, 19 nt, Human
ccugaggaagagggacugu

SEQ ID NO: 3611381 - RNA, 19 nt, Human
ccugaggacagaugccucc

SEQ ID NO: 3611382 - RNA, 16 nt, Human
ccugaggacagcuguc

SEQ ID NO: 3611383 - RNA, 17 nt, Human
ccugaggacagcugucc

SEQ ID NO: 3611384 - RNA, 13 nt, Human
ccugaggagucug

SEQ ID NO: 3611385 - RNA, 18 nt, Human
ccugaggagucugagguc

SEQ ID NO: 3611386 - RNA, 20 nt, Human
ccugaggagucugagguccu

SEQ ID NO: 3611387 - RNA, 18 nt, Human
ccugaggaucagaaagua

SEQ ID NO: 3611388 - RNA, 15 nt, Human
ccugaggaugagcug

SEQ ID NO: 3611389 - RNA, 20 nt, Human
ccugaggaugagcuggaagg

SEQ ID NO: 3611390 - RNA, 12 nt, Human
ccugaggcccag

SEQ ID NO: 3611391 - RNA, 13 nt, Human
ccugaggcccaga

SEQ ID NO: 3611392 - RNA, 18 nt, Human
ccugaggcccagagggcc

SEQ ID NO: 3611393 - RNA, 16 nt, Human
ccugaggcccuucucu

SEQ ID NO: 3611394 - RNA, 22 nt, Human
ccugaggcccuucucuccagcc

SEQ ID NO: 3611395 - RNA, 19 nt, Human
ccugaggccuagacucugu

SEQ ID NO: 3611396 - RNA, 17 nt, Human
ccugaggcucagggaaa

SEQ ID NO: 3611397 - RNA, 17 nt, Human
ccugaggcuccacuugg

SEQ ID NO: 3611398 - RNA, 18 nt, Human
ccugaggcuccacuuggu

SEQ ID NO: 3611399 - RNA, 21 nt, Human
ccugaggcugagacugcggga

SEQ ID NO: 3611400 - RNA, 14 nt, Human
ccugaggcugggcu

SEQ ID NO: 3611401 - RNA, 16 nt, Human
ccugaggcugggcucc

SEQ ID NO: 3611402 - RNA, 17 nt, Human
ccugaggcugggcuccc

SEQ ID NO: 3611403 - RNA, 19 nt, Human
ccuggcacccggccccugc

SEQ ID NO: 3611404 - RNA, 22 nt, Human
ccuggcacccggccccugcugg

SEQ ID NO: 3611405 - RNA, 18 nt, Human
ccuggcacgguggcucag

SEQ ID NO: 3611406 - RNA, 23 nt, Human
ccuggcacuaacguugagccccu

SEQ ID NO: 3611407 - RNA, 15 nt, Human
ccuggcacugcugug

SEQ ID NO: 3611408 - RNA, 15 nt, Human
ccuggcacuggaccc

SEQ ID NO: 3611409 - RNA, 23 nt, Human
ccuggcacuggcaaacagggccu

SEQ ID NO: 3611410 - RNA, 23 nt, Human
ccuggcagaacugagcuccucug

SEQ ID NO: 3611411 - RNA, 13 nt, Human
ccuggcagaaugc

SEQ ID NO: 3611412 - RNA, 12 nt, Human
ccuggcagagau

SEQ ID NO: 3611413 - RNA, 11 nt, Human
ccuggcagccc

SEQ ID NO: 3611414 - RNA, 18 nt, Human
ccuggcagcccagagacu

SEQ ID NO: 3611415 - RNA, 12 nt, Human
ccuggcagcccc

SEQ ID NO: 3611416 - RNA, 14 nt, Human
ccuggcagccccug

SEQ ID NO: 3611417 - RNA, 18 nt, Human
ccuggcagccgugccuuc

SEQ ID NO: 3611418 - RNA, 14 nt, Human
ccuggcagcucugg

SEQ ID NO: 3611419 - RNA, 15 nt, Human
ccuggcagcucugga

SEQ ID NO: 3611420 - RNA, 19 nt, Human
ccuggcagcucuggacagc

SEQ ID NO: 3611421 - RNA, 20 nt, Human
ccuggcagcucuggacagcc

SEQ ID NO: 3611422 - RNA, 17 nt, Human
ccuggcaggaugacccu

SEQ ID NO: 3611423 - RNA, 13 nt, Human
ccuggcaggcagg

SEQ ID NO: 3611424 - RNA, 21 nt, Human
ccuggcaggcaggggcccugc

SEQ ID NO: 3611425 - RNA, 23 nt, Human
ccuggcaggcaggggcccugcag

SEQ ID NO: 3611426 - RNA, 21 nt, Human
ccuggcagggaggucaggccc

SEQ ID NO: 3611427 - RNA, 21 nt, Human
ccuggcaguccgugggacggg

SEQ ID NO: 3611428 - RNA, 15 nt, Human
ccuggcauggcaccu

SEQ ID NO: 3611429 - RNA, 23 nt, Human
ccuggcaugggaaugaaugucag

SEQ ID NO: 3611430 - RNA, 13 nt, Human
ccuggcauuucac

SEQ ID NO: 3611431 - RNA, 13 nt, Human
ccuggccaccucu

SEQ ID NO: 3611432 - RNA, 15 nt, Human
ccuggccaccucucu

SEQ ID NO: 3611433 - RNA, 17 nt, Human
ccuggccaccugaggug

SEQ ID NO: 3611434 - RNA, 13 nt, Human
ccuggccagacac

SEQ ID NO: 3611435 - RNA, 15 nt, Human
ccuggccagacacag

SEQ ID NO: 3611436 - RNA, 15 nt, Human
ccuggccagaugcac

SEQ ID NO: 3611437 - RNA, 22 nt, Human
ccuggccaggagcucuucaggc

SEQ ID NO: 3611438 - RNA, 13 nt, Human
ccuggccaggcac

SEQ ID NO: 3611439 - RNA, 14 nt, Human
ccuggccaggcaga

SEQ ID NO: 3611440 - RNA, 15 nt, Human
ccuggccagggccug

SEQ ID NO: 3611441 - RNA, 19 nt, Human
ccuggccagggccuggaag

SEQ ID NO: 3611442 - RNA, 20 nt, Human
ccuggccagggccuggaaga

SEQ ID NO: 3611443 - RNA, 17 nt, Human
ccuggccaucccacaag

SEQ ID NO: 3611444 - RNA, 14 nt, Human
ccuggcccacccca

SEQ ID NO: 3611445 - RNA, 21 nt, Human
ccuggcccaccccacccacuu

SEQ ID NO: 3611446 - RNA, 14 nt, Human
ccuggcccacugca

SEQ ID NO: 3611447 - RNA, 20 nt, Human
ccuggcccagcggccccucc

SEQ ID NO: 3611448 - RNA, 12 nt, Human
ccuggcccaggg

SEQ ID NO: 3611449 - RNA, 18 nt, Human
ccuggcccauagaaacau

SEQ ID NO: 3611450 - RNA, 24 nt, Human
ccuggcccauagaaacaugacacu

SEQ ID NO: 3611451 - RNA, 12 nt, Human
ccuggccccagg

SEQ ID NO: 3611452 - RNA, 12 nt, Human
ccuggccccaug

SEQ ID NO: 3611453 - RNA, 18 nt, Human
ccuggccccaugucucuc

SEQ ID NO: 3611454 - RNA, 15 nt, Human
ccuggcccccacaug

SEQ ID NO: 3611455 - RNA, 12 nt, Human
ccuggcccccuc

SEQ ID NO: 3611456 - RNA, 18 nt, Human
ccuggccccucaaccucc

SEQ ID NO: 3611457 - RNA, 20 nt, Human
ccuggccccucagggucccu

SEQ ID NO: 3611458 - RNA, 15 nt, Human
ccuggccccucuccc

SEQ ID NO: 3611459 - RNA, 17 nt, Human
ccuggccccucucccuu

SEQ ID NO: 3611460 - RNA, 23 nt, Human
ccuggcccucaaggccucccaca

SEQ ID NO: 3611461 - RNA, 16 nt, Human
ccuggcccugaggugu

SEQ ID NO: 3611462 - RNA, 14 nt, Human
ccuggcccugcuuc

SEQ ID NO: 3611463 - RNA, 16 nt, Human
ccuggcccuggggccu

SEQ ID NO: 3611464 - RNA, 14 nt, Human
cauccgaggcaggg

SEQ ID NO: 3611465 - RNA, 14 nt, Human
cauccgccagggcc

SEQ ID NO: 3611466 - RNA, 16 nt, Human
cauccgccuuuuguau

SEQ ID NO: 3611467 - RNA, 19 nt, Human
cauccgccuuuuguauaca

SEQ ID NO: 3611468 - RNA, 16 nt, Human
cauccggcagccugga

SEQ ID NO: 3611469 - RNA, 16 nt, Human
cauccggcccccagag

SEQ ID NO: 3611470 - RNA, 18 nt, Human
cauccggggccagcuccg

SEQ ID NO: 3611471 - RNA, 16 nt, Human
cauccguaguucccug

SEQ ID NO: 3611472 - RNA, 21 nt, Human
cauccguaguucccugaaaac

SEQ ID NO: 3611473 - RNA, 20 nt, Human
cauccgugagcagugugucu

SEQ ID NO: 3611474 - RNA, 23 nt, Human
cauccgugagcagugugucuccu

SEQ ID NO: 3611475 - RNA, 19 nt, Human
cauccuaaaagccacccca

SEQ ID NO: 3611476 - RNA, 18 nt, Human
cauccuaaagaacaaagu

SEQ ID NO: 3611477 - RNA, 19 nt, Human
cauccuaaagaacaaagua

SEQ ID NO: 3611478 - RNA, 17 nt, Human
cauccuaagaaauaugu

SEQ ID NO: 3611479 - RNA, 20 nt, Human
cauccuaagaaauaugugag

SEQ ID NO: 3611480 - RNA, 22 nt, Human
cauccuaagaaauaugugagau

SEQ ID NO: 3611481 - RNA, 16 nt, Human
cauccuacaagacaca

SEQ ID NO: 3611482 - RNA, 21 nt, Human
cauccuaccacaaugcagugc

SEQ ID NO: 3611483 - RNA, 15 nt, Human
cauccuacccucggg

SEQ ID NO: 3611484 - RNA, 13 nt, Human
cauccuagucucu

SEQ ID NO: 3611485 - RNA, 17 nt, Human
cauccucaaacacugca

SEQ ID NO: 3611486 - RNA, 20 nt, Human
cauccucaaagaaaguguau

SEQ ID NO: 3611487 - RNA, 22 nt, Human
cauccucaaagaaaguguauug

SEQ ID NO: 3611488 - RNA, 18 nt, Human
cauccucauacccacccc

SEQ ID NO: 3611489 - RNA, 21 nt, Human
cauccucauacccacccccac

SEQ ID NO: 3611490 - RNA, 20 nt, Human
cauccuccacguucugcuca

SEQ ID NO: 3611491 - RNA, 21 nt, Human
cauccuccacguucugcucau

SEQ ID NO: 3611492 - RNA, 13 nt, Human
cauccuccagcag

SEQ ID NO: 3611493 - RNA, 14 nt, Human
cauccuccagcagg

SEQ ID NO: 3611494 - RNA, 15 nt, Human
cauccuccagccccu

SEQ ID NO: 3611495 - RNA, 12 nt, Human
cauccuccccuu

SEQ ID NO: 3611496 - RNA, 15 nt, Human
cauccuccccuuccc

SEQ ID NO: 3611497 - RNA, 16 nt, Human
cauccuccccuucccu

SEQ ID NO: 3611498 - RNA, 20 nt, Human
cauccuccccuucccugcaa

SEQ ID NO: 3611499 - RNA, 15 nt, Human
cauccuccucagauc

SEQ ID NO: 3611500 - RNA, 18 nt, Human
cauccuccucagaucuuc

SEQ ID NO: 3611501 - RNA, 19 nt, Human
cauccuccucagaucuucu

SEQ ID NO: 3611502 - RNA, 14 nt, Human
cauccuccuggaac

SEQ ID NO: 3611503 - RNA, 21 nt, Human
cauccuccuggaaccuugcug

SEQ ID NO: 3611504 - RNA, 19 nt, Human
cauccucuggagccagccg

SEQ ID NO: 3611505 - RNA, 23 nt, Human
cauccucuggcuuggccacagcc

SEQ ID NO: 3611506 - RNA, 22 nt, Human
cauccucuguacagagcccacg

SEQ ID NO: 3611507 - RNA, 14 nt, Human
cauccucuucugcu

SEQ ID NO: 3611508 - RNA, 13 nt, Human
cauccucuuucuc

SEQ ID NO: 3611509 - RNA, 12 nt, Human
cauccugaacag

SEQ ID NO: 3611510 - RNA, 14 nt, Human
cauccugaacagca

SEQ ID NO: 3611511 - RNA, 19 nt, Human
cauccugaccagcugcucc

SEQ ID NO: 3611512 - RNA, 16 nt, Human
cauccugagccccgcc

SEQ ID NO: 3611513 - RNA, 22 nt, Human
cauccugagccccgcccucuuc

SEQ ID NO: 3611514 - RNA, 18 nt, Human
cauccugaggcuccacuu

SEQ ID NO: 3611515 - RNA, 20 nt, Human
cauccugcagccuccuccug

SEQ ID NO: 3611516 - RNA, 19 nt, Human
cauccugccagccccacac

SEQ ID NO: 3611517 - RNA, 21 nt, Human
cauccugccagccccacacag

SEQ ID NO: 3611518 - RNA, 22 nt, Human
cauccugccagccccacacagc

SEQ ID NO: 3611519 - RNA, 22 nt, Human
cauccugccuuagagccaggca

SEQ ID NO: 3611520 - RNA, 23 nt, Human
cauccugccuuagagccaggcac

SEQ ID NO: 3611521 - RNA, 22 nt, Human
cauccugccuucauggaacuca

SEQ ID NO: 3611522 - RNA, 15 nt, Human
cauccuggcccaggg

SEQ ID NO: 3611523 - RNA, 18 nt, Human
cauccuggcccagggcau

SEQ ID NO: 3611524 - RNA, 13 nt, Human
cauccuggcugcg

SEQ ID NO: 3611525 - RNA, 17 nt, Human
cauccuggcuggagaau

SEQ ID NO: 3611526 - RNA, 15 nt, Human
cauccuguauaagca

SEQ ID NO: 3611527 - RNA, 16 nt, Human
cauccugucaucugag

SEQ ID NO: 3611528 - RNA, 18 nt, Human
cauccugucccaccaugc

SEQ ID NO: 3611529 - RNA, 23 nt, Human
cauccugugccacuaaacuacau

SEQ ID NO: 3611530 - RNA, 15 nt, Human
cauccuguguuucua

SEQ ID NO: 3611531 - RNA, 21 nt, Human
cauccuguguuucuagggaaa

SEQ ID NO: 3611532 - RNA, 22 nt, Human
cauccuguguuucuagggaaau

SEQ ID NO: 3611533 - RNA, 15 nt, Human
cauccuucccugucu

SEQ ID NO: 3611534 - RNA, 21 nt, Human
cauccuucccugucugccagg

SEQ ID NO: 3611535 - RNA, 23 nt, Human
cauccuugacuuugaacuaauga

SEQ ID NO: 3611536 - RNA, 14 nt, Human
cauccuugagucaa

SEQ ID NO: 3611537 - RNA, 20 nt, Human
cauccuuucacuucuuuccc

SEQ ID NO: 3611538 - RNA, 19 nt, Human
cauccuuucugccucucaa

SEQ ID NO: 3611539 - RNA, 17 nt, Human
cauccuuugcagggcag

SEQ ID NO: 3611540 - RNA, 18 nt, Human
cauccuuuucuccuaucu

SEQ ID NO: 3611541 - RNA, 20 nt, Human
caucgaaaauucauuucaca

SEQ ID NO: 3611542 - RNA, 21 nt, Human
caucgaaucuacuaauuccac

SEQ ID NO: 3611543 - RNA, 16 nt, Human
caucgccagcugauga

SEQ ID NO: 3611544 - RNA, 21 nt, Human
caucgccagcugaugacucaa

SEQ ID NO: 3611545 - RNA, 16 nt, Human
caucgcucguguguuc

SEQ ID NO: 3611546 - RNA, 15 nt, Human
caucggaaaaauaau

SEQ ID NO: 3611547 - RNA, 21 nt, Human
ccuggcuuugcccaaccucag

SEQ ID NO: 3611548 - RNA, 22 nt, Human
ccuggcuuugcccaaccucagc

SEQ ID NO: 3611549 - RNA, 23 nt, Human
ccugggaaaccccuucucuguga

SEQ ID NO: 3611550 - RNA, 18 nt, Human
ccugggaaagccccugcc

SEQ ID NO: 3611551 - RNA, 22 nt, Human
ccugggaaggcuacucaccuug

SEQ ID NO: 3611552 - RNA, 12 nt, Human
ccugggaagggg

SEQ ID NO: 3611553 - RNA, 15 nt, Human
ccugggacaacugcu

SEQ ID NO: 3611554 - RNA, 23 nt, Human
ccugggacaguuuaucaugaagc

SEQ ID NO: 3611555 - RNA, 17 nt, Human
ccugggacugcugcuuc

SEQ ID NO: 3611556 - RNA, 16 nt, Human
ccugggaggcggagag

SEQ ID NO: 3611557 - RNA, 22 nt, Human
ccugggagggacaugcuuagca

SEQ ID NO: 3611558 - RNA, 22 nt, Human
ccugggaggucaaggcugcagu

SEQ ID NO: 3611559 - RNA, 15 nt, Human
ccugggagguggagg

SEQ ID NO: 3611560 - RNA, 15 nt, Human
ccugggaucuggugg

SEQ ID NO: 3611561 - RNA, 23 nt, Human
ccugggauguggcugcagcagcg

SEQ ID NO: 3611562 - RNA, 18 nt, Human
ccugggauucaggaaaag

SEQ ID NO: 3611563 - RNA, 23 nt, Human
ccugggauucaggaaaaggccug

SEQ ID NO: 3611564 - RNA, 21 nt, Human
ccugggcaaaugaauggcuca

SEQ ID NO: 3611565 - RNA, 15 nt, Human
ccugggcacacgcug

SEQ ID NO: 3611566 - RNA, 20 nt, Human
ccugggcaccuggggagugg

SEQ ID NO: 3611567 - RNA, 15 nt, Human
ccugggcagcugccu

SEQ ID NO: 3611568 - RNA, 17 nt, Human
ccugggcauacuaauaa

SEQ ID NO: 3611569 - RNA, 23 nt, Human
ccugggcauauccaccaccuccc

SEQ ID NO: 3611570 - RNA, 16 nt, Human
ccugggcauugcuuuc

SEQ ID NO: 3611571 - RNA, 14 nt, Human
ccugggccaggguc

SEQ ID NO: 3611572 - RNA, 13 nt, Human
ccugggccccacc

SEQ ID NO: 3611573 - RNA, 15 nt, Human
ccugggccccucccu

SEQ ID NO: 3611574 - RNA, 11 nt, Human
ccugggcccuc

SEQ ID NO: 3611575 - RNA, 14 nt, Human
ccugggcccugggg

SEQ ID NO: 3611576 - RNA, 16 nt, Human
ccugggcccuggggcc

SEQ ID NO: 3611577 - RNA, 20 nt, Human
ccugggcccuggggccugua

SEQ ID NO: 3611578 - RNA, 20 nt, Human
ccugggccguaucuccggcu

SEQ ID NO: 3611579 - RNA, 19 nt, Human
ccugggccuauggagagcc

SEQ ID NO: 3611580 - RNA, 12 nt, Human
ccugggccugca

SEQ ID NO: 3611581 - RNA, 13 nt, Human
ccugggccugccu

SEQ ID NO: 3611582 - RNA, 14 nt, Human
ccugggccugcugc

SEQ ID NO: 3611583 - RNA, 16 nt, Human
ccugggccugcugcug

SEQ ID NO: 3611584 - RNA, 14 nt, Human
ccugggccuggcuc

SEQ ID NO: 3611585 - RNA, 13 nt, Human
ccugggccuuggg

SEQ ID NO: 3611586 - RNA, 13 nt, Human
ccugggcgcccug

SEQ ID NO: 3611587 - RNA, 18 nt, Human
ccugggcgcccuggaagc

SEQ ID NO: 3611588 - RNA, 15 nt, Human
ccugggcgcuggucc

SEQ ID NO: 3611589 - RNA, 15 nt, Human
ccugggcuccuggac

SEQ ID NO: 3611590 - RNA, 14 nt, Human
ccugggcucggagg

SEQ ID NO: 3611591 - RNA, 19 nt, Human
ccugggcucggaggcugcc

SEQ ID NO: 3611592 - RNA, 21 nt, Human
ccugggcucggaggcugcccc

SEQ ID NO: 3611593 - RNA, 19 nt, Human
ccugggcucucgcggccuc

SEQ ID NO: 3611594 - RNA, 16 nt, Human
ccugggcucugggagc

SEQ ID NO: 3611595 - RNA, 19 nt, Human
ccugggcucugggagcagc

SEQ ID NO: 3611596 - RNA, 22 nt, Human
ccugggcugagagaaccucacg

SEQ ID NO: 3611597 - RNA, 14 nt, Human
ccugggcugggaaa

SEQ ID NO: 3611598 - RNA, 14 nt, Human
ccugggcugugcua

SEQ ID NO: 3611599 - RNA, 14 nt, Human
ccugggcuguuggc

SEQ ID NO: 3611600 - RNA, 16 nt, Human
ccugggcuguuggcac

SEQ ID NO: 3611601 - RNA, 14 nt, Human
ccugggcuuggccu

SEQ ID NO: 3611602 - RNA, 12 nt, Human
ccuggggaagga

SEQ ID NO: 3611603 - RNA, 17 nt, Human
ccuggggacccacgugg

SEQ ID NO: 3611604 - RNA, 23 nt, Human
ccuggggagugggacagagucug

SEQ ID NO: 3611605 - RNA, 22 nt, Human
ccuggggcacaguccaggaaca

SEQ ID NO: 3611606 - RNA, 17 nt, Human
ccuggggcauccauggg

SEQ ID NO: 3611607 - RNA, 21 nt, Human
ccuggggcauccauggggucu

SEQ ID NO: 3611608 - RNA, 12 nt, Human
ccuggggccagg

SEQ ID NO: 3611609 - RNA, 14 nt, Human
ccuggggccaggcc

SEQ ID NO: 3611610 - RNA, 13 nt, Human
ccuggggccucuu

SEQ ID NO: 3611611 - RNA, 16 nt, Human
ccuggggccugacugc

SEQ ID NO: 3611612 - RNA, 13 nt, Human
ccuggggccugag

SEQ ID NO: 3611613 - RNA, 15 nt, Human
ccuggggccugagag

SEQ ID NO: 3611614 - RNA, 12 nt, Human
ccuggggccugg

SEQ ID NO: 3611615 - RNA, 18 nt, Human
ccuggggccuggaccugc

SEQ ID NO: 3611616 - RNA, 21 nt, Human
ccuggggccuggaccugccuc

SEQ ID NO: 3611617 - RNA, 18 nt, Human
ccuggggccuguacugcc

SEQ ID NO: 3611618 - RNA, 22 nt, Human
ccuggggccuguacugccugcu

SEQ ID NO: 3611619 - RNA, 17 nt, Human
ccuggggcgcgugaggc

SEQ ID NO: 3611620 - RNA, 22 nt, Human
ccuggggcgcgugaggcccgug

SEQ ID NO: 3611621 - RNA, 17 nt, Human
ccuggggcgggccccuc

SEQ ID NO: 3611622 - RNA, 19 nt, Human
caucucccuggugcuuaug

SEQ ID NO: 3611623 - RNA, 23 nt, Human
caucucccuggugcuuaugcucu

SEQ ID NO: 3611624 - RNA, 20 nt, Human
caucuccuccauacucagga

SEQ ID NO: 3611625 - RNA, 16 nt, Human
caucuccugccuuccu

SEQ ID NO: 3611626 - RNA, 19 nt, Human
caucuccugccuuccuccu

SEQ ID NO: 3611627 - RNA, 20 nt, Human
caucucgcucccucccagga

SEQ ID NO: 3611628 - RNA, 21 nt, Human
caucucgcucccucccaggac

SEQ ID NO: 3611629 - RNA, 19 nt, Human
caucucuaauuggaagaaa

SEQ ID NO: 3611630 - RNA, 13 nt, Human
caucucuaccuuc

SEQ ID NO: 3611631 - RNA, 18 nt, Human
caucucuaccuucucccc

SEQ ID NO: 3611632 - RNA, 15 nt, Human
caucucucagaaggg

SEQ ID NO: 3611633 - RNA, 20 nt, Human
caucucucccuccccugcca

SEQ ID NO: 3611634 - RNA, 15 nt, Human
caucucuccuccuuu

SEQ ID NO: 3611635 - RNA, 22 nt, Human
caucucucuacuccuaccucag

SEQ ID NO: 3611636 - RNA, 16 nt, Human
caucucucugcccaac

SEQ ID NO: 3611637 - RNA, 12 nt, Human
caucucugcucc

SEQ ID NO: 3611638 - RNA, 13 nt, Human
caucucugcuuga

SEQ ID NO: 3611639 - RNA, 19 nt, Human
caucucugggcuggaugag

SEQ ID NO: 3611640 - RNA, 23 nt, Human
caucucuuacgcccaacccuucc

SEQ ID NO: 3611641 - RNA, 16 nt, Human
caucucuuagcucccc

SEQ ID NO: 3611642 - RNA, 23 nt, Human
caucucuuagcuccccuccaacc

SEQ ID NO: 3611643 - RNA, 15 nt, Human
caucucuugaggcca

SEQ ID NO: 3611644 - RNA, 14 nt, Human
caucucuuuguaca

SEQ ID NO: 3611645 - RNA, 12 nt, Human
caucugaaagcc

SEQ ID NO: 3611646 - RNA, 13 nt, Human
caucugaaagcca

SEQ ID NO: 3611647 - RNA, 21 nt, Human
caucugaaggggcaaauucuu

SEQ ID NO: 3611648 - RNA, 20 nt, Human
caucugaauuugcccuggga

SEQ ID NO: 3611649 - RNA, 14 nt, Human
caucugacacaaaa

SEQ ID NO: 3611650 - RNA, 19 nt, Human
caucugaccagcagcgccu

SEQ ID NO: 3611651 - RNA, 16 nt, Human
caucugagaaugaaca

SEQ ID NO: 3611652 - RNA, 22 nt, Human
caucugagagaggcuaaaaugu

SEQ ID NO: 3611653 - RNA, 20 nt, Human
caucugagguccugugaucu

SEQ ID NO: 3611654 - RNA, 21 nt, Human
caucugagguuuuauuucauu

SEQ ID NO: 3611655 - RNA, 15 nt, Human
caucugaguccugga

SEQ ID NO: 3611656 - RNA, 14 nt, Human
caucugauuccagc

SEQ ID NO: 3611657 - RNA, 12 nt, Human
caucugcaaaag

SEQ ID NO: 3611658 - RNA, 22 nt, Human
caucugcaaaaggccucuugua

SEQ ID NO: 3611659 - RNA, 18 nt, Human
caucugcaccccccuggg

SEQ ID NO: 3611660 - RNA, 19 nt, Human
caucugcaccccccugggc

SEQ ID NO: 3611661 - RNA, 16 nt, Human
caucugcacccucgau

SEQ ID NO: 3611662 - RNA, 17 nt, Human
caucugcacccuucuuu

SEQ ID NO: 3611663 - RNA, 13 nt, Human
caucugcccagga

SEQ ID NO: 3611664 - RNA, 16 nt, Human
caucugcccaggggug

SEQ ID NO: 3611665 - RNA, 11 nt, Human
caucugccccu

SEQ ID NO: 3611666 - RNA, 13 nt, Human
caucugccccucc

SEQ ID NO: 3611667 - RNA, 14 nt, Human
caucugcccgccug

SEQ ID NO: 3611668 - RNA, 19 nt, Human
caucugcccgccugcccac

SEQ ID NO: 3611669 - RNA, 21 nt, Human
caucugcccgccugcccaccu

SEQ ID NO: 3611670 - RNA, 20 nt, Human
caucugccgugccuggaucc

SEQ ID NO: 3611671 - RNA, 18 nt, Human
caucugccuuaaaaccaa

SEQ ID NO: 3611672 - RNA, 21 nt, Human
caucugcgggggcagugcuca

SEQ ID NO: 3611673 - RNA, 19 nt, Human
caucugcgugacaauaaaa

SEQ ID NO: 3611674 - RNA, 10 nt, Human
caucugcucc

SEQ ID NO: 3611675 - RNA, 22 nt, Human
caucugcuccuggaucucccug

SEQ ID NO: 3611676 - RNA, 13 nt, Human
caucugcucuccu

SEQ ID NO: 3611677 - RNA, 14 nt, Human
caucugcucuccuu

SEQ ID NO: 3611678 - RNA, 20 nt, Human
caucugcucuccuuccugga

SEQ ID NO: 3611679 - RNA, 20 nt, Human
caucugcuuacaauucccug

SEQ ID NO: 3611680 - RNA, 16 nt, Human
caucugcuuuuauuaa

SEQ ID NO: 3611681 - RNA, 17 nt, Human
caucuggaaaauaaaag

SEQ ID NO: 3611682 - RNA, 22 nt, Human
caucuggaagagcuaggcaggg

SEQ ID NO: 3611683 - RNA, 17 nt, Human
caucuggagagaacagg

SEQ ID NO: 3611684 - RNA, 12 nt, Human
caucuggagagc

SEQ ID NO: 3611685 - RNA, 21 nt, Human
caucuggauaggagccugcug

SEQ ID NO: 3611686 - RNA, 14 nt, Human
caucuggccuggcc

SEQ ID NO: 3611687 - RNA, 14 nt, Human
caucuggccuuaca

SEQ ID NO: 3611688 - RNA, 15 nt, Human
caucuggccuuacac

SEQ ID NO: 3611689 - RNA, 18 nt, Human
caucuggcucuaauucac

SEQ ID NO: 3611690 - RNA, 17 nt, Human
caucuggcugccuuugc

SEQ ID NO: 3611691 - RNA, 19 nt, Human
caucuggcuuauuuuaaug

SEQ ID NO: 3611692 - RNA, 16 nt, Human
ccuggcaugggaauga

SEQ ID NO: 3611693 - RNA, 17 nt, Human
ccuggcaugggaaugaa

SEQ ID NO: 3611694 - RNA, 18 nt, Human
ccuggcaugggaaugaau

SEQ ID NO: 3611695 - RNA, 19 nt, Human
ccuggcaugucaacagcgu

SEQ ID NO: 3611696 - RNA, 17 nt, Human
ccuggcauucuuguaca

SEQ ID NO: 3611697 - RNA, 20 nt, Human
ccuggcauucuuguacagug

SEQ ID NO: 3611698 - RNA, 17 nt, Human
ccuggccaccacccccc

SEQ ID NO: 3611699 - RNA, 14 nt, Human
ccuggccaccucuc

SEQ ID NO: 3611700 - RNA, 18 nt, Human
ccuggccaccucucuccu

SEQ ID NO: 3611701 - RNA, 13 nt, Human
ccuggccaccuga

SEQ ID NO: 3611702 - RNA, 15 nt, Human
ccuggccacgcagcc

SEQ ID NO: 3611703 - RNA, 22 nt, Human
ccuggccacgcagccaggacac

SEQ ID NO: 3611704 - RNA, 13 nt, Human
ccuggccacugcu

SEQ ID NO: 3611705 - RNA, 14 nt, Human
ccuggccagacaca

SEQ ID NO: 3611706 - RNA, 13 nt, Human
ccuggccagaggc

SEQ ID NO: 3611707 - RNA, 21 nt, Human
ccuggccagaugcaccagccc

SEQ ID NO: 3611708 - RNA, 13 nt, Human
ccuggccaggagc

SEQ ID NO: 3611709 - RNA, 16 nt, Human
ccuggccaggagcagg

SEQ ID NO: 3611710 - RNA, 18 nt, Human
ccuggccaggagcucuuc

SEQ ID NO: 3611711 - RNA, 19 nt, Human
ccuggccaggagcucuuca

SEQ ID NO: 3611712 - RNA, 23 nt, Human
ccuggccagggccuggaagacag

SEQ ID NO: 3611713 - RNA, 16 nt, Human
ccuggccagugcccug

SEQ ID NO: 3611714 - RNA, 15 nt, Human
ccuggccaucccaca

SEQ ID NO: 3611715 - RNA, 19 nt, Human
ccuggccaucccacaagug

SEQ ID NO: 3611716 - RNA, 13 nt, Human
ccuggccaucucu

SEQ ID NO: 3611717 - RNA, 21 nt, Human
ccuggcccacagcaggugcug

SEQ ID NO: 3611718 - RNA, 13 nt, Human
ccuggcccacugc

SEQ ID NO: 3611719 - RNA, 16 nt, Human
ccuggcccagccuuug

SEQ ID NO: 3611720 - RNA, 12 nt, Human
ccuggcccagcu

SEQ ID NO: 3611721 - RNA, 20 nt, Human
ccuggcccagcucccccggg

SEQ ID NO: 3611722 - RNA, 14 nt, Human
ccuggcccagggca

SEQ ID NO: 3611723 - RNA, 16 nt, Human
ccuggcccagggcauc

SEQ ID NO: 3611724 - RNA, 21 nt, Human
ccuggcccagggcaucuggga

SEQ ID NO: 3611725 - RNA, 13 nt, Human
ccuggcccaugua

SEQ ID NO: 3611726 - RNA, 14 nt, Human
ccuggccccauguc

SEQ ID NO: 3611727 - RNA, 20 nt, Human
ccuggccccaugucucucag

SEQ ID NO: 3611728 - RNA, 16 nt, Human
ccuggcccccaaccuc

SEQ ID NO: 3611729 - RNA, 19 nt, Human
ccuggcccccaaccucagg

SEQ ID NO: 3611730 - RNA, 22 nt, Human
ccuggcccccaaccucagggcu

SEQ ID NO: 3611731 - RNA, 14 nt, Human
ccuggcccccagcu

SEQ ID NO: 3611732 - RNA, 20 nt, Human
ccuggcccccucccuggaug

SEQ ID NO: 3611733 - RNA, 15 nt, Human
ccuggcccccugagu

SEQ ID NO: 3611734 - RNA, 14 nt, Human
ccuggccccucagg

SEQ ID NO: 3611735 - RNA, 18 nt, Human
ccuggccccucagggucc

SEQ ID NO: 3611736 - RNA, 21 nt, Human
ccuggccccucagggucccug

SEQ ID NO: 3611737 - RNA, 14 nt, Human
ccuggccccucgcc

SEQ ID NO: 3611738 - RNA, 15 nt, Human
ccuggccccucgccu

SEQ ID NO: 3611739 - RNA, 12 nt, Human
ccuggccccucu

SEQ ID NO: 3611740 - RNA, 13 nt, Human
ccuggcccucugu

SEQ ID NO: 3611741 - RNA, 15 nt, Human
ccuggcccugaggug

SEQ ID NO: 3611742 - RNA, 12 nt, Human
ccuggcccugcc

SEQ ID NO: 3611743 - RNA, 20 nt, Human
ccuggcccuggggccuguac

SEQ ID NO: 3611744 - RNA, 18 nt, Human
ccuggccgaguccaagcu

SEQ ID NO: 3611745 - RNA, 19 nt, Human
ccuggccgaguccaagcug

SEQ ID NO: 3611746 - RNA, 18 nt, Human
ccuggccgccugggucca

SEQ ID NO: 3611747 - RNA, 21 nt, Human
ccuggccgcguuuagaccaag

SEQ ID NO: 3611748 - RNA, 12 nt, Human
ccuggccggcca

SEQ ID NO: 3611749 - RNA, 14 nt, Human
ccuggccggccagc

SEQ ID NO: 3611750 - RNA, 15 nt, Human
ccuggccggccagcc

SEQ ID NO: 3611751 - RNA, 16 nt, Human
ccuggccggccagcca

SEQ ID NO: 3611752 - RNA, 18 nt, Human
ccuggccggccagccagc

SEQ ID NO: 3611753 - RNA, 23 nt, Human
ccuggccggccagccagccacuc

SEQ ID NO: 3611754 - RNA, 18 nt, Human
ccuggccggugugggggc

SEQ ID NO: 3611755 - RNA, 21 nt, Human
ccuggccggugugggggcccc

SEQ ID NO: 3611756 - RNA, 22 nt, Human
ccuggccggugugggggccccg

SEQ ID NO: 3611757 - RNA, 16 nt, Human
ccuggccuagaccagc

SEQ ID NO: 3611758 - RNA, 22 nt, Human
ccuggccuagcauacguacaca

SEQ ID NO: 3611759 - RNA, 22 nt, Human
ccuggccucaagugauucuccu

SEQ ID NO: 3611760 - RNA, 15 nt, Human
ccuggccucagacug

SEQ ID NO: 3611761 - RNA, 16 nt, Human
ccuggccucagacugc

SEQ ID NO: 3611762 - RNA, 23 nt, Human
ccuggccucagacugcacccagg

SEQ ID NO: 3611763 - RNA, 15 nt, Human
ccuggccuccaggcc

SEQ ID NO: 3611764 - RNA, 16 nt, Human
ccuggccuccaggccc

SEQ ID NO: 3611765 - RNA, 17 nt, Human
ccuggccuccaggcccg

SEQ ID NO: 3611766 - RNA, 18 nt, Human
ccuggccucccccacuuu

SEQ ID NO: 3611767 - RNA, 20 nt, Human
ccuggccuccccugccacca

SEQ ID NO: 3611768 - RNA, 13 nt, Human
ccuggccuccggc

SEQ ID NO: 3611769 - RNA, 22 nt, Human
ccuggccuccggcgucagccuc

SEQ ID NO: 3611770 - RNA, 16 nt, Human
ccuggccuccugccuc

SEQ ID NO: 3611771 - RNA, 20 nt, Human
ccuggccucugcacuccccu

SEQ ID NO: 3611772 - RNA, 13 nt, Human
ccuggccucugug

SEQ ID NO: 3611773 - RNA, 13 nt, Human
ccuggccugagag

SEQ ID NO: 3611774 - RNA, 16 nt, Human
ccuggccugaggucuc

SEQ ID NO: 3611775 - RNA, 13 nt, Human
ccuggccuggcac

SEQ ID NO: 3611776 - RNA, 16 nt, Human
ccuggccuggcccugc

SEQ ID NO: 3611777 - RNA, 17 nt, Human
ccuggccuggcccugcc

SEQ ID NO: 3611778 - RNA, 22 nt, Human
ccuggccuggcccugcccugag

SEQ ID NO: 3611779 - RNA, 15 nt, Human
ccuggccuggcuucu

SEQ ID NO: 3611780 - RNA, 13 nt, Human
ccuggccugucug

SEQ ID NO: 3611781 - RNA, 14 nt, Human
ccuggccugugccu

SEQ ID NO: 3611782 - RNA, 15 nt, Human
ccuggccuuccuguc

SEQ ID NO: 3611783 - RNA, 22 nt, Human
ccuggccuugggauccaggccc

SEQ ID NO: 3611784 - RNA, 14 nt, Human
ccuggccuuucaua

SEQ ID NO: 3611785 - RNA, 15 nt, Human
ccuggccuuucauau

SEQ ID NO: 3611786 - RNA, 15 nt, Human
ccuggcgccuggcag

SEQ ID NO: 3611787 - RNA, 15 nt, Human
ccuggcggccccaac

SEQ ID NO: 3611788 - RNA, 18 nt, Human
ccuggcgggguggggugg

SEQ ID NO: 3611789 - RNA, 23 nt, Human
ccuggcguccccucccucugucu

SEQ ID NO: 3611790 - RNA, 16 nt, Human
ccuggcuauguccuaa

SEQ ID NO: 3611791 - RNA, 17 nt, Human
ccuggcucaccuugugc

SEQ ID NO: 3611792 - RNA, 13 nt, Human
ccuggcucagagc

SEQ ID NO: 3611793 - RNA, 12 nt, Human
ccuggcucagcc

SEQ ID NO: 3611794 - RNA, 16 nt, Human
ccuggcucccacaggc

SEQ ID NO: 3611795 - RNA, 23 nt, Human
ccuggcucccacaggcccuuccu

SEQ ID NO: 3611796 - RNA, 17 nt, Human
ccuggcucccaggacac

SEQ ID NO: 3611797 - RNA, 15 nt, Human
ccuggcucccaugac

SEQ ID NO: 3611798 - RNA, 13 nt, Human
ccuggcuccccug

SEQ ID NO: 3611799 - RNA, 15 nt, Human
ccuggcuccccuggg

SEQ ID NO: 3611800 - RNA, 16 nt, Human
ccuggcuccccugggg

SEQ ID NO: 3611801 - RNA, 20 nt, Human
ccuggcucccucacucucag

SEQ ID NO: 3611802 - RNA, 21 nt, Human
ccuggcucccucacucucagg

SEQ ID NO: 3611803 - RNA, 18 nt, Human
ccuggcuccuacccaccg

SEQ ID NO: 3611804 - RNA, 21 nt, Human
ccuggcuccuugugccagaga

SEQ ID NO: 3611805 - RNA, 16 nt, Human
ccuggcucucagaagg

SEQ ID NO: 3611806 - RNA, 18 nt, Human
ccuggcucuguggcgagc

SEQ ID NO: 3611807 - RNA, 22 nt, Human
ccuggcucuuucgucacccuug

SEQ ID NO: 3611808 - RNA, 13 nt, Human
ccuggcugaagga

SEQ ID NO: 3611809 - RNA, 19 nt, Human
ccuggcugaaggacuguga

SEQ ID NO: 3611810 - RNA, 20 nt, Human
ccuggcugaaggacugugac

SEQ ID NO: 3611811 - RNA, 22 nt, Human
ccuggcugagguuccucugccu

SEQ ID NO: 3611812 - RNA, 23 nt, Human
ccuggcugagguuccucugccug

SEQ ID NO: 3611813 - RNA, 24 nt, Human
ccuggcugagguuccucugccugc

SEQ ID NO: 3611814 - RNA, 18 nt, Human
ccuggcugcagccugcgc

SEQ ID NO: 3611815 - RNA, 12 nt, Human
ccuggcugccca

SEQ ID NO: 3611816 - RNA, 15 nt, Human
ccuggcugcccuggc

SEQ ID NO: 3611817 - RNA, 15 nt, Human
caugcgcucagggcc

SEQ ID NO: 3611818 - RNA, 15 nt, Human
caugcggcccagccc

SEQ ID NO: 3611819 - RNA, 21 nt, Human
caugcggcccagcccggcucc

SEQ ID NO: 3611820 - RNA, 18 nt, Human
caugcgggcugggcagcu

SEQ ID NO: 3611821 - RNA, 15 nt, Human
caugcgguagccagc

SEQ ID NO: 3611822 - RNA, 16 nt, Human
caugcgguagccagca

SEQ ID NO: 3611823 - RNA, 19 nt, Human
caugcgguagccagcacac

SEQ ID NO: 3611824 - RNA, 23 nt, Human
caugcggugccaugaagggaccc

SEQ ID NO: 3611825 - RNA, 23 nt, Human
caugcguggguggggagggaggu

SEQ ID NO: 3611826 - RNA, 16 nt, Human
caugcuaagagaagua

SEQ ID NO: 3611827 - RNA, 17 nt, Human
caugcuaagagaaguag

SEQ ID NO: 3611828 - RNA, 15 nt, Human
caugcuaagcaagcu

SEQ ID NO: 3611829 - RNA, 22 nt, Human
caugcuaagcaagcuaaccuua

SEQ ID NO: 3611830 - RNA, 14 nt, Human
caugcuacacacug

SEQ ID NO: 3611831 - RNA, 23 nt, Human
caugcuacacacugcauguuugu

SEQ ID NO: 3611832 - RNA, 22 nt, Human
caugcuaccugaucccacuccu

SEQ ID NO: 3611833 - RNA, 16 nt, Human
caugcuaucucugugu

SEQ ID NO: 3611834 - RNA, 23 nt, Human
caugcuaucucugugugcacaaa

SEQ ID NO: 3611835 - RNA, 22 nt, Human
caugcuauuuguucuucaagaa

SEQ ID NO: 3611836 - RNA, 23 nt, Human
caugcucagcccugacuggugcu

SEQ ID NO: 3611837 - RNA, 14 nt, Human
ccuggcuucaggca

SEQ ID NO: 3611838 - RNA, 22 nt, Human
ccuggcuucaggcaauucuccu

SEQ ID NO: 3611839 - RNA, 15 nt, Human
ccuggcuucccaucc

SEQ ID NO: 3611840 - RNA, 20 nt, Human
ccuggcuucccauccccagc

SEQ ID NO: 3611841 - RNA, 21 nt, Human
ccuggcuucccauccccagcg

SEQ ID NO: 3611842 - RNA, 16 nt, Human
ccuggcuucuggagcc

SEQ ID NO: 3611843 - RNA, 17 nt, Human
ccuggcuucuggagccc

SEQ ID NO: 3611844 - RNA, 13 nt, Human
ccuggcuucugug

SEQ ID NO: 3611845 - RNA, 22 nt, Human
ccuggcuucuuucucucagccu

SEQ ID NO: 3611846 - RNA, 22 nt, Human
ccuggcuuucauuuucucucag

SEQ ID NO: 3611847 - RNA, 23 nt, Human
ccuggcuuucauuuucucucagg

SEQ ID NO: 3611848 - RNA, 15 nt, Human
ccuggcuuugcccaa

SEQ ID NO: 3611849 - RNA, 18 nt, Human
ccuggcuuugcccaaccu

SEQ ID NO: 3611850 - RNA, 23 nt, Human
ccuggcuuugcccaaccucagca

SEQ ID NO: 3611851 - RNA, 18 nt, Human
ccuggcuuuucacugcug

SEQ ID NO: 3611852 - RNA, 23 nt, Human
ccuggcuuuucacugcuggcugc

SEQ ID NO: 3611853 - RNA, 17 nt, Human
ccugggaaauauucccu

SEQ ID NO: 3611854 - RNA, 21 nt, Human
ccugggaaggcuacucaccuu

SEQ ID NO: 3611855 - RNA, 22 nt, Human
ccugggacaacugcucccaccu

SEQ ID NO: 3611856 - RNA, 17 nt, Human
ccugggaccuccccuga

SEQ ID NO: 3611857 - RNA, 18 nt, Human
ccugggagaaccucaggc

SEQ ID NO: 3611858 - RNA, 19 nt, Human
ccugggagaaccucaggcu

SEQ ID NO: 3611859 - RNA, 19 nt, Human
ccugggaggaaauuugaau

SEQ ID NO: 3611860 - RNA, 17 nt, Human
ccugggaggagagacac

SEQ ID NO: 3611861 - RNA, 13 nt, Human
ccugggaggcaca

SEQ ID NO: 3611862 - RNA, 21 nt, Human
ccugggaggcucuggagccca

SEQ ID NO: 3611863 - RNA, 16 nt, Human
ccugggagugagcugg

SEQ ID NO: 3611864 - RNA, 20 nt, Human
ccugggaucccucauccuca

SEQ ID NO: 3611865 - RNA, 20 nt, Human
ccugggaucugguggucagc

SEQ ID NO: 3611866 - RNA, 21 nt, Human
ccugggaucugguggucagcc

SEQ ID NO: 3611867 - RNA, 21 nt, Human
ccugggaugagaguuuuggau

SEQ ID NO: 3611868 - RNA, 22 nt, Human
ccugggauguccacagaugccu

SEQ ID NO: 3611869 - RNA, 21 nt, Human
ccugggauguggcugcagcag

SEQ ID NO: 3611870 - RNA, 16 nt, Human
ccugggauucaggaaa

SEQ ID NO: 3611871 - RNA, 12 nt, Human
ccugggcagaag

SEQ ID NO: 3611872 - RNA, 15 nt, Human
ccugggcagaaggaa

SEQ ID NO: 3611873 - RNA, 16 nt, Human
ccugggcagaaggaag

SEQ ID NO: 3611874 - RNA, 14 nt, Human
ccugggcagcugcc

SEQ ID NO: 3611875 - RNA, 18 nt, Human
ccugggcagcugccuccc

SEQ ID NO: 3611876 - RNA, 12 nt, Human
ccugggcaggag

SEQ ID NO: 3611877 - RNA, 22 nt, Human
ccugggcauauccaccaccucc

SEQ ID NO: 3611878 - RNA, 17 nt, Human
ccugggcauugcuuucc

SEQ ID NO: 3611879 - RNA, 14 nt, Human
ccugggccccacca

SEQ ID NO: 3611880 - RNA, 21 nt, Human
ccugggccccaccaccuaggc

SEQ ID NO: 3611881 - RNA, 18 nt, Human
ccugggccccucccuacc

SEQ ID NO: 3611882 - RNA, 20 nt, Human
ccugggccccucccuaccuc

SEQ ID NO: 3611883 - RNA, 16 nt, Human
ccugggcccugggcug

SEQ ID NO: 3611884 - RNA, 17 nt, Human
ccugggcccuggggccu

SEQ ID NO: 3611885 - RNA, 21 nt, Human
ccugggcccuggggccuguac

SEQ ID NO: 3611886 - RNA, 13 nt, Human
ccugggccgcugc

SEQ ID NO: 3611887 - RNA, 17 nt, Human
ccugggccgcugccacg

SEQ ID NO: 3611888 - RNA, 21 nt, Human
ccugggccuauggagagcccu

SEQ ID NO: 3611889 - RNA, 15 nt, Human
ccugggccugcugcu

SEQ ID NO: 3611890 - RNA, 20 nt, Human
ccugggccugcugcugagaa

SEQ ID NO: 3611891 - RNA, 13 nt, Human
ccugggccuggcu

SEQ ID NO: 3611892 - RNA, 19 nt, Human
ccugggccuggcucccuca

SEQ ID NO: 3611893 - RNA, 19 nt, Human
ccugggcgcccuggaagcc

SEQ ID NO: 3611894 - RNA, 16 nt, Human
ccugggcgcugguccu

SEQ ID NO: 3611895 - RNA, 15 nt, Human
ccugggcuacaagga

SEQ ID NO: 3611896 - RNA, 22 nt, Human
ccugggcucaagcaauccuccu

SEQ ID NO: 3611897 - RNA, 14 nt, Human
ccugggcuccugga

SEQ ID NO: 3611898 - RNA, 15 nt, Human
ccugggcucggaggc

SEQ ID NO: 3611899 - RNA, 22 nt, Human
ccugggcucggaggcugccccc

SEQ ID NO: 3611900 - RNA, 12 nt, Human
ccugggcucugc

SEQ ID NO: 3611901 - RNA, 14 nt, Human
ccugggcucugccc

SEQ ID NO: 3611902 - RNA, 20 nt, Human
ccugggcucugccccagcuc

SEQ ID NO: 3611903 - RNA, 22 nt, Human
ccugggcucugccccagcucug

SEQ ID NO: 3611904 - RNA, 17 nt, Human
ccugggcucugggagca

SEQ ID NO: 3611905 - RNA, 13 nt, Human
ccugggcucugug

SEQ ID NO: 3611906 - RNA, 15 nt, Human
ccugggcucuguggg

SEQ ID NO: 3611907 - RNA, 19 nt, Human
ccugggcucugugggcugc

SEQ ID NO: 3611908 - RNA, 20 nt, Human
ccugggcuggaaucaggaau

SEQ ID NO: 3611909 - RNA, 21 nt, Human
ccugggcuguuggcacucaca

SEQ ID NO: 3611910 - RNA, 23 nt, Human
ccugggcuguuggcacucacaga

SEQ ID NO: 3611911 - RNA, 16 nt, Human
ccugggcuuggccugc

SEQ ID NO: 3611912 - RNA, 18 nt, Human
ccugggcuuggccugcug

SEQ ID NO: 3611913 - RNA, 20 nt, Human
ccugggcuuggccugcugug

SEQ ID NO: 3611914 - RNA, 18 nt, Human
ccuggggaaccugacccc

SEQ ID NO: 3611915 - RNA, 17 nt, Human
ccuggggaaggagccag

SEQ ID NO: 3611916 - RNA, 18 nt, Human
ccuggggaaggagccagu

SEQ ID NO: 3611917 - RNA, 15 nt, Human
ccuggggagaaagua

SEQ ID NO: 3611918 - RNA, 24 nt, Human
ccuggggagugggacagagucugg

SEQ ID NO: 3611919 - RNA, 19 nt, Human
ccuggggcagucaccugcc

SEQ ID NO: 3611920 - RNA, 12 nt, Human
ccuggggccucg

SEQ ID NO: 3611921 - RNA, 18 nt, Human
ccuggggccugacugcuc

SEQ ID NO: 3611922 - RNA, 17 nt, Human
ccuggggccuggaccug

SEQ ID NO: 3611923 - RNA, 19 nt, Human
ccuggggccuggaccugcc

SEQ ID NO: 3611924 - RNA, 13 nt, Human
ccuggggccuggc

SEQ ID NO: 3611925 - RNA, 14 nt, Human
ccuggggccuggca

SEQ ID NO: 3611926 - RNA, 15 nt, Human
ccuggggccuggcag

SEQ ID NO: 3611927 - RNA, 19 nt, Human
ccuggggccuguacugccu

SEQ ID NO: 3611928 - RNA, 18 nt, Human
ccuggggcgcgugaggcc

SEQ ID NO: 3611929 - RNA, 22 nt, Human
ccuggggcuaggcuggagccca

SEQ ID NO: 3611930 - RNA, 16 nt, Human
ccuggggcuccuuucu

SEQ ID NO: 3611931 - RNA, 21 nt, Human
ccuggggcuccuuucuccagc

SEQ ID NO: 3611932 - RNA, 22 nt, Human
ccuggggcuccuuucuccagcc

SEQ ID NO: 3611933 - RNA, 12 nt, Human
ccuggggcucua

SEQ ID NO: 3611934 - RNA, 23 nt, Human
ccuggggcucuaacgccugagcc

SEQ ID NO: 3611935 - RNA, 15 nt, Human
ccuggggcugaucuc

SEQ ID NO: 3611936 - RNA, 20 nt, Human
ccuggggcugaucucaggga

SEQ ID NO: 3611937 - RNA, 22 nt, Human
ccuggggcugaucucagggaag

SEQ ID NO: 3611938 - RNA, 17 nt, Human
ccuggggcugcuggccu

SEQ ID NO: 3611939 - RNA, 17 nt, Human
ccuggggcuggccuccc

SEQ ID NO: 3611940 - RNA, 14 nt, Human
ccuggggcuggcuu

SEQ ID NO: 3611941 - RNA, 16 nt, Human
ccugggggaagcccug

SEQ ID NO: 3611942 - RNA, 20 nt, Human
ccugggggaguuuuccucua

SEQ ID NO: 3611943 - RNA, 18 nt, Human
ccugggggcacaggaggc

SEQ ID NO: 3611944 - RNA, 23 nt, Human
ccugggggcacaggaggcaggca

SEQ ID NO: 3611945 - RNA, 17 nt, Human
ccugggggccuggcugg

SEQ ID NO: 3611946 - RNA, 16 nt, Human
ccugggggcucucaug

SEQ ID NO: 3611947 - RNA, 19 nt, Human
ccugggggcugggcagagg

SEQ ID NO: 3611948 - RNA, 12 nt, Human
ccuggggggcag

SEQ ID NO: 3611949 - RNA, 22 nt, Human
ccuggggguucuuucuuccucu

SEQ ID NO: 3611950 - RNA, 22 nt, Human
ccugggguaccaagagacuccu

SEQ ID NO: 3611951 - RNA, 18 nt, Human
ccugggguguuaguggca

SEQ ID NO: 3611952 - RNA, 20 nt, Human
ccugggguguuaguggcacc

SEQ ID NO: 3611953 - RNA, 15 nt, Human
ccuggguccaaauaa

SEQ ID NO: 3611954 - RNA, 22 nt, Human
ccugggucccaggacccuggac

SEQ ID NO: 3611955 - RNA, 18 nt, Human
ccugggucuaagggguug

SEQ ID NO: 3611956 - RNA, 15 nt, Human
ccugggucugugucu

SEQ ID NO: 3611957 - RNA, 16 nt, Human
ccugggucugugucuc

SEQ ID NO: 3611958 - RNA, 15 nt, Human
ccugggugacauuug

SEQ ID NO: 3611959 - RNA, 16 nt, Human
ccugggugcuggcugc

SEQ ID NO: 3611960 - RNA, 18 nt, Human
ccuggguggaucggccuc

SEQ ID NO: 3611961 - RNA, 15 nt, Human
ccugggugggcucug

SEQ ID NO: 3611962 - RNA, 17 nt, Human
ccugggugggcucugug

SEQ ID NO: 3611963 - RNA, 15 nt, Human
ccuggguggggcugc

SEQ ID NO: 3611964 - RNA, 16 nt, Human
ccuggguggggcugcu

SEQ ID NO: 3611965 - RNA, 20 nt, Human
ccuggguggggcugcuccuc

SEQ ID NO: 3611966 - RNA, 21 nt, Human
ccuggguggggcugcuccucc

SEQ ID NO: 3611967 - RNA, 23 nt, Human
ccuggguggggcugcuccuccag

SEQ ID NO: 3611968 - RNA, 17 nt, Human
ccugggugggugguggg

SEQ ID NO: 3611969 - RNA, 14 nt, Human
ccuggguggucugc

SEQ ID NO: 3611970 - RNA, 18 nt, Human
ccuggguggucugcaggc

SEQ ID NO: 3611971 - RNA, 19 nt, Human
ccuggguggucugcaggca

SEQ ID NO: 3611972 - RNA, 20 nt, Human
ccuggguggucugcaggcag

SEQ ID NO: 3611973 - RNA, 22 nt, Human
ccuggguggucugcaggcaggg

SEQ ID NO: 3611974 - RNA, 18 nt, Human
ccuucccaaucagcacug

SEQ ID NO: 3611975 - RNA, 17 nt, Human
ccuucccaauccagugg

SEQ ID NO: 3611976 - RNA, 22 nt, Human
ccuucccacccaucgcugugug

SEQ ID NO: 3611977 - RNA, 20 nt, Human
ccuucccagaggggccugcc

SEQ ID NO: 3611978 - RNA, 12 nt, Human
ccuucccagcuc

SEQ ID NO: 3611979 - RNA, 17 nt, Human
ccuucccagcucucccu

SEQ ID NO: 3611980 - RNA, 14 nt, Human
cauguauuugagca

SEQ ID NO: 3611981 - RNA, 14 nt, Human
caugucaaacguga

SEQ ID NO: 3611982 - RNA, 14 nt, Human
caugucaacagcgu

SEQ ID NO: 3611983 - RNA, 18 nt, Human
caugucaacuucuggcuc

SEQ ID NO: 3611984 - RNA, 21 nt, Human
caugucaagagucgcugugcc

SEQ ID NO: 3611985 - RNA, 16 nt, Human
ccuggguuaaguauua

SEQ ID NO: 3611986 - RNA, 21 nt, Human
ccuggguuagacugccagcuc

SEQ ID NO: 3611987 - RNA, 22 nt, Human
ccuggguucagaaaugcugccu

SEQ ID NO: 3611988 - RNA, 23 nt, Human
ccuggguucagaaaugcugccug

SEQ ID NO: 3611989 - RNA, 19 nt, Human
ccuggguuuuguauucucu

SEQ ID NO: 3611990 - RNA, 21 nt, Human
ccuggguuuuguauucucuga

SEQ ID NO: 3611991 - RNA, 14 nt, Human
ccugguaagaaaaa

SEQ ID NO: 3611992 - RNA, 17 nt, Human
ccugguacccagccauc

SEQ ID NO: 3611993 - RNA, 18 nt, Human
ccugguacccagccaucu

SEQ ID NO: 3611994 - RNA, 19 nt, Human
ccugguacccagccaucug

SEQ ID NO: 3611995 - RNA, 14 nt, Human
ccugguacccuccu

SEQ ID NO: 3611996 - RNA, 17 nt, Human
ccugguacccuccuggc

SEQ ID NO: 3611997 - RNA, 19 nt, Human
ccugguacucaagcccgcg

SEQ ID NO: 3611998 - RNA, 18 nt, Human
ccugguagaccacugcca

SEQ ID NO: 3611999 - RNA, 13 nt, Human
ccugguagggcag

SEQ ID NO: 3612000 - RNA, 16 nt, Human
ccugguauggcugcag

SEQ ID NO: 3612001 - RNA, 22 nt, Human
ccuggucacaggacucugccuc

SEQ ID NO: 3612002 - RNA, 21 nt, Human
ccugguccagggaagcuggcc

SEQ ID NO: 3612003 - RNA, 13 nt, Human
ccugguccaugca

SEQ ID NO: 3612004 - RNA, 19 nt, Human
ccugguccccuccuuccca

SEQ ID NO: 3612005 - RNA, 20 nt, Human
ccugguccucacacucaccc

SEQ ID NO: 3612006 - RNA, 13 nt, Human
ccuggucucaccc

SEQ ID NO: 3612007 - RNA, 17 nt, Human
ccuggucucacccugga

SEQ ID NO: 3612008 - RNA, 19 nt, Human
ccuggucucacccuggagg

SEQ ID NO: 3612009 - RNA, 23 nt, Human
ccuggucucagcagcgaccaccc

SEQ ID NO: 3612010 - RNA, 22 nt, Human
ccuggucuccugcccccacacc

SEQ ID NO: 3612011 - RNA, 13 nt, Human
ccuggucucuggu

SEQ ID NO: 3612012 - RNA, 20 nt, Human
ccuggucuuugagcucccac

SEQ ID NO: 3612013 - RNA, 14 nt, Human
ccuggugaccccuu

SEQ ID NO: 3612014 - RNA, 20 nt, Human
ccuggugaggaagcuccagu

SEQ ID NO: 3612015 - RNA, 15 nt, Human
ccuggugcugccucu

SEQ ID NO: 3612016 - RNA, 13 nt, Human
ccuggugcuggag

SEQ ID NO: 3612017 - RNA, 14 nt, Human
ccuggugcuggagg

SEQ ID NO: 3612018 - RNA, 15 nt, Human
ccuggugcuggaggu

SEQ ID NO: 3612019 - RNA, 16 nt, Human
ccuggugcuucuccuc

SEQ ID NO: 3612020 - RNA, 12 nt, Human
ccugguggacag

SEQ ID NO: 3612021 - RNA, 14 nt, Human
ccugguggacaguc

SEQ ID NO: 3612022 - RNA, 16 nt, Human
ccugguggcagcucac

SEQ ID NO: 3612023 - RNA, 14 nt, Human
ccugguggcagcug

SEQ ID NO: 3612024 - RNA, 15 nt, Human
ccugguggcaguggg

SEQ ID NO: 3612025 - RNA, 20 nt, Human
ccugguggcagugggagcug

SEQ ID NO: 3612026 - RNA, 14 nt, Human
ccugguggccaugc

SEQ ID NO: 3612027 - RNA, 16 nt, Human
ccugguggccaugcuc

SEQ ID NO: 3612028 - RNA, 13 nt, Human
ccugguggggcag

SEQ ID NO: 3612029 - RNA, 23 nt, Human
ccugguggggcagcuccucuguc

SEQ ID NO: 3612030 - RNA, 18 nt, Human
ccugguggguccaggggc

SEQ ID NO: 3612031 - RNA, 21 nt, Human
ccuggugguauuuucaauagc

SEQ ID NO: 3612032 - RNA, 12 nt, Human
ccuggugguuca

SEQ ID NO: 3612033 - RNA, 13 nt, Human
ccuggugucaccc

SEQ ID NO: 3612034 - RNA, 19 nt, Human
ccugguguuucuagcacug

SEQ ID NO: 3612035 - RNA, 18 nt, Human
ccugguuauugauguggc

SEQ ID NO: 3612036 - RNA, 22 nt, Human
ccugguucccguuucuccaccu

SEQ ID NO: 3612037 - RNA, 20 nt, Human
ccugguuccggaauccuguc

SEQ ID NO: 3612038 - RNA, 21 nt, Human
ccugguucugaugaugugccu

SEQ ID NO: 3612039 - RNA, 15 nt, Human
ccugguuuagccugg

SEQ ID NO: 3612040 - RNA, 13 nt, Human
ccugguuuccugc

SEQ ID NO: 3612041 - RNA, 15 nt, Human
ccugguuuccugccc

SEQ ID NO: 3612042 - RNA, 20 nt, Human
ccugguuuccugcccuggga

SEQ ID NO: 3612043 - RNA, 21 nt, Human
ccugguuuccugcccugggag

SEQ ID NO: 3612044 - RNA, 22 nt, Human
ccugguuuuuaaauagaguuug

SEQ ID NO: 3612045 - RNA, 22 nt, Human
ccugguuuuuguagccuuccuc

SEQ ID NO: 3612046 - RNA, 18 nt, Human
ccuguaaaacuuuauuuu

SEQ ID NO: 3612047 - RNA, 20 nt, Human
ccuguaaacacucagcuguu

SEQ ID NO: 3612048 - RNA, 12 nt, Human
ccuguaaacuuu

SEQ ID NO: 3612049 - RNA, 19 nt, Human
ccuguaaacuuuaucacuu

SEQ ID NO: 3612050 - RNA, 20 nt, Human
ccuguaaacuuuaucacuua

SEQ ID NO: 3612051 - RNA, 14 nt, Human
ccuguaaauuauuu

SEQ ID NO: 3612052 - RNA, 15 nt, Human
ccuguaaauuauuuu

SEQ ID NO: 3612053 - RNA, 16 nt, Human
ccuguaacaagccaga

SEQ ID NO: 3612054 - RNA, 18 nt, Human
ccuguaacacaagccaca

SEQ ID NO: 3612055 - RNA, 19 nt, Human
ccuguaacacaagccacag

SEQ ID NO: 3612056 - RNA, 19 nt, Human
ccuguaacauacuggccug

SEQ ID NO: 3612057 - RNA, 23 nt, Human
ccuguaacauacuggccuggacu

SEQ ID NO: 3612058 - RNA, 16 nt, Human
ccuguaaccucuucag

SEQ ID NO: 3612059 - RNA, 10 nt, Human
ccuguaacuu

SEQ ID NO: 3612060 - RNA, 16 nt, Human
ccuguaagaaacagag

SEQ ID NO: 3612061 - RNA, 23 nt, Human
ccuguaagccaaagaaaugaaca

SEQ ID NO: 3612062 - RNA, 12 nt, Human
ccuguaauaaau

SEQ ID NO: 3612063 - RNA, 13 nt, Human
ccuguaauaaaua

SEQ ID NO: 3612064 - RNA, 20 nt, Human
ccuguaaucauauaauaaau

SEQ ID NO: 3612065 - RNA, 16 nt, Human
ccuguaaucccagcac

SEQ ID NO: 3612066 - RNA, 18 nt, Human
ccuguaaucccagcacuu

SEQ ID NO: 3612067 - RNA, 20 nt, Human
ccuguaaucccagcacuugg

SEQ ID NO: 3612068 - RNA, 16 nt, Human
ccuguaaucccagcua

SEQ ID NO: 3612069 - RNA, 21 nt, Human
ccuguacacugaauauuuaua

SEQ ID NO: 3612070 - RNA, 20 nt, Human
ccuguacaguagauuuucca

SEQ ID NO: 3612071 - RNA, 21 nt, Human
ccuguacaguagauuuuccaa

SEQ ID NO: 3612072 - RNA, 22 nt, Human
ccuguacaguagauuuuccaaa

SEQ ID NO: 3612073 - RNA, 11 nt, Human
ccuguacaguc

SEQ ID NO: 3612074 - RNA, 22 nt, Human
ccuguacagucugucuucugua

SEQ ID NO: 3612075 - RNA, 17 nt, Human
ccuguacucgcuugugc

SEQ ID NO: 3612076 - RNA, 19 nt, Human
ccuguacucgcuugugcag

SEQ ID NO: 3612077 - RNA, 15 nt, Human
ccuguacucuuccga

SEQ ID NO: 3612078 - RNA, 15 nt, Human
ccuguacugccugcu

SEQ ID NO: 3612079 - RNA, 16 nt, Human
ccuguacugccugcuu

SEQ ID NO: 3612080 - RNA, 14 nt, Human
ccuguacuggagag

SEQ ID NO: 3612081 - RNA, 17 nt, Human
ccuguacuguucugugu

SEQ ID NO: 3612082 - RNA, 15 nt, Human
ccuguagcacuuacu

SEQ ID NO: 3612083 - RNA, 17 nt, Human
ccuguagcacuuacugg

SEQ ID NO: 3612084 - RNA, 12 nt, Human
ccuguagcccac

SEQ ID NO: 3612085 - RNA, 20 nt, Human
ccuguagccccagugacagc

SEQ ID NO: 3612086 - RNA, 16 nt, Human
ccuguagccuucugua

SEQ ID NO: 3612087 - RNA, 22 nt, Human
ccuguaggguccaaccagaccu

SEQ ID NO: 3612088 - RNA, 23 nt, Human
ccuguaggguccaaccagaccug

SEQ ID NO: 3612089 - RNA, 19 nt, Human
ccuguagucccagccacuc

SEQ ID NO: 3612090 - RNA, 17 nt, Human
ccuguaguuaggaaaua

SEQ ID NO: 3612091 - RNA, 18 nt, Human
ccuguaguuaggaaauaa

SEQ ID NO: 3612092 - RNA, 21 nt, Human
ccuguaguuaggaaauaaaac

SEQ ID NO: 3612093 - RNA, 19 nt, Human
ccuguaguugcguggacuc

SEQ ID NO: 3612094 - RNA, 21 nt, Human
ccuguaguugcguggacucug

SEQ ID NO: 3612095 - RNA, 23 nt, Human
ccuguaguugcguggacucugca

SEQ ID NO: 3612096 - RNA, 17 nt, Human
ccuguauaacccuguua

SEQ ID NO: 3612097 - RNA, 18 nt, Human
ccuguauaaguggaggca

SEQ ID NO: 3612098 - RNA, 16 nt, Human
ccuguauacagugcag

SEQ ID NO: 3612099 - RNA, 18 nt, Human
ccuguauacagugcagag

SEQ ID NO: 3612100 - RNA, 21 nt, Human
ccuguauacagugcagagccu

SEQ ID NO: 3612101 - RNA, 14 nt, Human
ccuguauacuuuag

SEQ ID NO: 3612102 - RNA, 13 nt, Human
ccuguauauagcc

SEQ ID NO: 3612103 - RNA, 17 nt, Human
ccuguaugucuccagua

SEQ ID NO: 3612104 - RNA, 14 nt, Human
ccuguaugucuguc

SEQ ID NO: 3612105 - RNA, 18 nt, Human
ccuguaugucugucauug

SEQ ID NO: 3612106 - RNA, 15 nt, Human
ccuguauucagacag

SEQ ID NO: 3612107 - RNA, 19 nt, Human
ccuguauuccugaccuccg

SEQ ID NO: 3612108 - RNA, 20 nt, Human
ccuguauuuaaaaauagaaa

SEQ ID NO: 3612109 - RNA, 18 nt, Human
ccuguauuuaagcaaaua

SEQ ID NO: 3612110 - RNA, 20 nt, Human
ccugucaaacaaagccagaa

SEQ ID NO: 3612111 - RNA, 14 nt, Human
ccugucaaacauua

SEQ ID NO: 3612112 - RNA, 14 nt, Human
ccugucacauugca

SEQ ID NO: 3612113 - RNA, 17 nt, Human
ccugucaccucuuccga

SEQ ID NO: 3612114 - RNA, 17 nt, Human
ccugucagauccaggag

SEQ ID NO: 3612115 - RNA, 23 nt, Human
ccugucagauccaggagcuccag

SEQ ID NO: 3612116 - RNA, 17 nt, Human
ccugucauacuuuguua

SEQ ID NO: 3612117 - RNA, 21 nt, Human
ccugucaucugagaaugaaca

SEQ ID NO: 3612118 - RNA, 12 nt, Human
ccugucaugccc

SEQ ID NO: 3612119 - RNA, 18 nt, Human
ccugucaugccccccuca

SEQ ID NO: 3612120 - RNA, 19 nt, Human
ccugucaugccccccucaa

SEQ ID NO: 3612121 - RNA, 21 nt, Human
ccugucaugccccccucaaac

SEQ ID NO: 3612122 - RNA, 20 nt, Human
ccugucaugguguccagaca

SEQ ID NO: 3612123 - RNA, 22 nt, Human
ccugucauucccaccacccuga

SEQ ID NO: 3612124 - RNA, 24 nt, Human
caaacccacgauuuucuccagcuc

SEQ ID NO: 3612125 - RNA, 24 nt, Human
caaacccagacggcuccacuagga

SEQ ID NO: 3612126 - RNA, 13 nt, Human
caaacccaugagg

SEQ ID NO: 3612127 - RNA, 17 nt, Human
caaacccccuuugugcu

SEQ ID NO: 3612128 - RNA, 13 nt, Human
caaaccccugacc

SEQ ID NO: 3612129 - RNA, 17 nt, Human
caaaccgccagcgaacu

SEQ ID NO: 3612130 - RNA, 21 nt, Human
caaaccgccagcgaacuugac

SEQ ID NO: 3612131 - RNA, 18 nt, Human
caaaccuccaaaagcccu

SEQ ID NO: 3612132 - RNA, 11 nt, Human
caaaccucugu

SEQ ID NO: 3612133 - RNA, 20 nt, Human
caaaccucuguucaguguaa

SEQ ID NO: 3612134 - RNA, 20 nt, Human
caaaccugaccccugcucag

SEQ ID NO: 3612135 - RNA, 12 nt, Human
caaaccugccug

SEQ ID NO: 3612136 - RNA, 13 nt, Human
caaaccugccugg

SEQ ID NO: 3612137 - RNA, 13 nt, Human
caaaccuggagau

SEQ ID NO: 3612138 - RNA, 13 nt, Human
caaaccugugaag

SEQ ID NO: 3612139 - RNA, 19 nt, Human
caaaccuguuuaaauauuu

SEQ ID NO: 3612140 - RNA, 22 nt, Human
caaaccuguuuaaauauuucaa

SEQ ID NO: 3612141 - RNA, 16 nt, Human
caaaccuugaugugcc

SEQ ID NO: 3612142 - RNA, 18 nt, Human
caaaccuuuauuuuagaa

SEQ ID NO: 3612143 - RNA, 12 nt, Human
caaaccuuuccc

SEQ ID NO: 3612144 - RNA, 13 nt, Human
caaaccuuucccc

SEQ ID NO: 3612145 - RNA, 22 nt, Human
caaaccuuucuauaauuuuaca

SEQ ID NO: 3612146 - RNA, 22 nt, Human
caaacgcccuuuccuccucagg

SEQ ID NO: 3612147 - RNA, 14 nt, Human
caaacgccuccccu

SEQ ID NO: 3612148 - RNA, 21 nt, Human
caaacgcuaaagagcccuugc

SEQ ID NO: 3612149 - RNA, 20 nt, Human
caaacgcugagccaccugcc

SEQ ID NO: 3612150 - RNA, 14 nt, Human
caaacgcugccugc

SEQ ID NO: 3612151 - RNA, 16 nt, Human
caaacgcugccugccc

SEQ ID NO: 3612152 - RNA, 20 nt, Human
caaacuaaaagacauuuguu

SEQ ID NO: 3612153 - RNA, 16 nt, Human
caaacuaacaggcuua

SEQ ID NO: 3612154 - RNA, 13 nt, Human
caaacuaagcccc

SEQ ID NO: 3612155 - RNA, 19 nt, Human
caaacuaagcccccgcugu

SEQ ID NO: 3612156 - RNA, 20 nt, Human
caaacuaagcccccgcugua

SEQ ID NO: 3612157 - RNA, 16 nt, Human
caaacuacauguaauc

SEQ ID NO: 3612158 - RNA, 22 nt, Human
caaacuacugaaugaagcagua

SEQ ID NO: 3612159 - RNA, 19 nt, Human
caaacuagggccaagccca

SEQ ID NO: 3612160 - RNA, 22 nt, Human
caaacuaggggacaaagcaaaa

SEQ ID NO: 3612161 - RNA, 19 nt, Human
caaacucacugcucaagaa

SEQ ID NO: 3612162 - RNA, 12 nt, Human
caaacucugcug

SEQ ID NO: 3612163 - RNA, 18 nt, Human
caaacucugcugucuaac

SEQ ID NO: 3612164 - RNA, 17 nt, Human
caaacucuugaccucag

SEQ ID NO: 3612165 - RNA, 19 nt, Human
caaacucuugaccucaggu

SEQ ID NO: 3612166 - RNA, 21 nt, Human
caaacucuugaccucagguga

SEQ ID NO: 3612167 - RNA, 14 nt, Human
caaacucuuugguc

SEQ ID NO: 3612168 - RNA, 14 nt, Human
caaacugaagccag

SEQ ID NO: 3612169 - RNA, 21 nt, Human
caaacugaaugaaacccccac

SEQ ID NO: 3612170 - RNA, 15 nt, Human
caaacugcacaugau

SEQ ID NO: 3612171 - RNA, 19 nt, Human
caaacugcacaugauuuca

SEQ ID NO: 3612172 - RNA, 18 nt, Human
caaacugccuaagcccuc

SEQ ID NO: 3612173 - RNA, 14 nt, Human
caaacugccuucuu

SEQ ID NO: 3612174 - RNA, 16 nt, Human
caaacuggagucugga

SEQ ID NO: 3612175 - RNA, 17 nt, Human
caaacuggcaaacuuca

SEQ ID NO: 3612176 - RNA, 20 nt, Human
caaacugggaaccccuuucc

SEQ ID NO: 3612177 - RNA, 23 nt, Human
caaacugggaaccccuuucccac

SEQ ID NO: 3612178 - RNA, 12 nt, Human
caaacuguaaau

SEQ ID NO: 3612179 - RNA, 14 nt, Human
caaacuguaaauaa

SEQ ID NO: 3612180 - RNA, 18 nt, Human
caaacuguguaacugccc

SEQ ID NO: 3612181 - RNA, 16 nt, Human
caaacuguucaagaaa

SEQ ID NO: 3612182 - RNA, 21 nt, Human
caaacuuaauguucuuaugca

SEQ ID NO: 3612183 - RNA, 14 nt, Human
caaacuuacuauuu

SEQ ID NO: 3612184 - RNA, 13 nt, Human
caaacuugcuuua

SEQ ID NO: 3612185 - RNA, 21 nt, Human
caaagaaaaugaaaugcauau

SEQ ID NO: 3612186 - RNA, 13 nt, Human
caaagaaaauucc

SEQ ID NO: 3612187 - RNA, 17 nt, Human
caaagaaaauuccuaua

SEQ ID NO: 3612188 - RNA, 19 nt, Human
caaagaaaauuccuauaag

SEQ ID NO: 3612189 - RNA, 17 nt, Human
caaagaaacaaagaugu

SEQ ID NO: 3612190 - RNA, 13 nt, Human
caaagaaagugua

SEQ ID NO: 3612191 - RNA, 14 nt, Human
caaagaaauauuaa

SEQ ID NO: 3612192 - RNA, 13 nt, Human
caaagaaaugaac

SEQ ID NO: 3612193 - RNA, 15 nt, Human
caaagaaaugaacau

SEQ ID NO: 3612194 - RNA, 14 nt, Human
caaagaaauguaag

SEQ ID NO: 3612195 - RNA, 13 nt, Human
caaagaaauuaug

SEQ ID NO: 3612196 - RNA, 18 nt, Human
caaagaaccuucucuaug

SEQ ID NO: 3612197 - RNA, 14 nt, Human
caaagaagacaaca

SEQ ID NO: 3612198 - RNA, 13 nt, Human
caaagaagacaug

SEQ ID NO: 3612199 - RNA, 20 nt, Human
caaagaauguuagagcacag

SEQ ID NO: 3612200 - RNA, 22 nt, Human
caaagaauuucaauuuguucag

SEQ ID NO: 3612201 - RNA, 19 nt, Human
caaagacaaaagucugucu

SEQ ID NO: 3612202 - RNA, 23 nt, Human
caaagacaaauaguaggcaagau

SEQ ID NO: 3612203 - RNA, 16 nt, Human
caaagacccuggcuuu

SEQ ID NO: 3612204 - RNA, 17 nt, Human
caaagacccuggcuuuc

SEQ ID NO: 3612205 - RNA, 16 nt, Human
caaagacuuaguauau

SEQ ID NO: 3612206 - RNA, 20 nt, Human
caaagagaaaaagaaaugca

SEQ ID NO: 3612207 - RNA, 14 nt, Human
caaagagaaaacau

SEQ ID NO: 3612208 - RNA, 18 nt, Human
caaagagacuggagcauc

SEQ ID NO: 3612209 - RNA, 19 nt, Human
caaagagaguuaaucaacu

SEQ ID NO: 3612210 - RNA, 19 nt, Human
caaagagcacaaacauuuu

SEQ ID NO: 3612211 - RNA, 20 nt, Human
caaagagcacaaacauuuuu

SEQ ID NO: 3612212 - RNA, 15 nt, Human
caaagagccuggaga

SEQ ID NO: 3612213 - RNA, 17 nt, Human
caaagagccuggagaag

SEQ ID NO: 3612214 - RNA, 20 nt, Human
caaagaggcaagaggcugga

SEQ ID NO: 3612215 - RNA, 19 nt, Human
caaagaggccuuuaaccau

SEQ ID NO: 3612216 - RNA, 15 nt, Human
caaagaggcugcccc

SEQ ID NO: 3612217 - RNA, 22 nt, Human
caaagaggcugccccucucacc

SEQ ID NO: 3612218 - RNA, 16 nt, Human
caaagagggcuuccuc

SEQ ID NO: 3612219 - RNA, 14 nt, Human
caaagaguagaauu

SEQ ID NO: 3612220 - RNA, 16 nt, Human
caaagaguuaauauau

SEQ ID NO: 3612221 - RNA, 16 nt, Human
caaagaguucaagaaa

SEQ ID NO: 3612222 - RNA, 17 nt, Human
caaagaguucaagaaau

SEQ ID NO: 3612223 - RNA, 24 nt, Human
caaagaguucuggaaaagaacugu

SEQ ID NO: 3612224 - RNA, 18 nt, Human
caaagauagacagguccu

SEQ ID NO: 3612225 - RNA, 17 nt, Human
caaagauaucucaucuc

SEQ ID NO: 3612226 - RNA, 22 nt, Human
caaagauauuuugcuuugugau

SEQ ID NO: 3612227 - RNA, 13 nt, Human
caaagaucaaaau

SEQ ID NO: 3612228 - RNA, 15 nt, Human
caaagaucacuuguu

SEQ ID NO: 3612229 - RNA, 13 nt, Human
caaagaugcagcc

SEQ ID NO: 3612230 - RNA, 16 nt, Human
caaagaugcugugagu

SEQ ID NO: 3612231 - RNA, 20 nt, Human
caaagaugggugaaggcugg

SEQ ID NO: 3612232 - RNA, 16 nt, Human
caaagauucaugauuu

SEQ ID NO: 3612233 - RNA, 13 nt, Human
caaagcaaggaaa

SEQ ID NO: 3612234 - RNA, 15 nt, Human
caaagcaaggaaacu

SEQ ID NO: 3612235 - RNA, 18 nt, Human
caaagcaauugaaaugca

SEQ ID NO: 3612236 - RNA, 22 nt, Human
caaagcacaguguuaaaugaaa

SEQ ID NO: 3612237 - RNA, 18 nt, Human
caaagcaccaaaauaaga

SEQ ID NO: 3612238 - RNA, 19 nt, Human
caaagcaccaaaauaagaa

SEQ ID NO: 3612239 - RNA, 21 nt, Human
caaagcacuuggacucuugcu

SEQ ID NO: 3612240 - RNA, 12 nt, Human
caaagcagacag

SEQ ID NO: 3612241 - RNA, 15 nt, Human
caaagcagacagcuc

SEQ ID NO: 3612242 - RNA, 17 nt, Human
caaagcagacagcucca

SEQ ID NO: 3612243 - RNA, 15 nt, Human
caaagcagagagcau

SEQ ID NO: 3612244 - RNA, 13 nt, Human
caaagcagccacg

SEQ ID NO: 3612245 - RNA, 22 nt, Human
caaagcaggggaguaugcaaaa

SEQ ID NO: 3612246 - RNA, 15 nt, Human
caaagcagugcaugc

SEQ ID NO: 3612247 - RNA, 17 nt, Human
caaagcagugcaugcug

SEQ ID NO: 3612248 - RNA, 18 nt, Human
caaagcagugcaugcugu

SEQ ID NO: 3612249 - RNA, 15 nt, Human
caaagcaguggagcc

SEQ ID NO: 3612250 - RNA, 17 nt, Human
caaagcauugagcaaag

SEQ ID NO: 3612251 - RNA, 20 nt, Human
caaagccaaagcuaggccug

SEQ ID NO: 3612252 - RNA, 21 nt, Human
caaagccaaagcuaggccugg

SEQ ID NO: 3612253 - RNA, 22 nt, Human
caaagccaacagucaaaacaga

SEQ ID NO: 3612254 - RNA, 16 nt, Human
caaagccaagaccuca

SEQ ID NO: 3612255 - RNA, 21 nt, Human
caaagccaccaacagccacuc

SEQ ID NO: 3612256 - RNA, 20 nt, Human
caaagccaccucugucauuu

SEQ ID NO: 3612257 - RNA, 12 nt, Human
caaagccagaac

SEQ ID NO: 3612258 - RNA, 14 nt, Human
caaagccagaagcu

SEQ ID NO: 3612259 - RNA, 16 nt, Human
caaagccagaagcuga

SEQ ID NO: 3612260 - RNA, 15 nt, Human
caaagccagacagca

SEQ ID NO: 3612261 - RNA, 23 nt, Human
caaagccagggucucucccucag

SEQ ID NO: 3612262 - RNA, 17 nt, Human
caaagccaggucccucu

SEQ ID NO: 3612263 - RNA, 19 nt, Human
caaagccaggucccucuca

SEQ ID NO: 3612264 - RNA, 14 nt, Human
caaagcccaaggga

SEQ ID NO: 3612265 - RNA, 22 nt, Human
caaagccccaugcuggagccug

SEQ ID NO: 3612266 - RNA, 15 nt, Human
caaagcccuuuuaua

SEQ ID NO: 3612267 - RNA, 19 nt, Human
caaagccuguucauggcag

SEQ ID NO: 3612268 - RNA, 20 nt, Human
caaagccuguucauggcaga

SEQ ID NO: 3612269 - RNA, 18 nt, Human
caggcuacucuccucggc

SEQ ID NO: 3612270 - RNA, 11 nt, Human
caggcuacugu

SEQ ID NO: 3612271 - RNA, 15 nt, Human
caggcuagaaccugg

SEQ ID NO: 3612272 - RNA, 13 nt, Human
caggcuagaugua

SEQ ID NO: 3612273 - RNA, 17 nt, Human
caggcuagcuggagccu

SEQ ID NO: 3612274 - RNA, 15 nt, Human
caggcucacucacag

SEQ ID NO: 3612275 - RNA, 13 nt, Human
caggcucacugcc

SEQ ID NO: 3612276 - RNA, 14 nt, Human
caggcucacugcca

SEQ ID NO: 3612277 - RNA, 18 nt, Human
caggcucacugccaggcc

SEQ ID NO: 3612278 - RNA, 20 nt, Human
caggcucacugccaggccag

SEQ ID NO: 3612279 - RNA, 23 nt, Human
caggcucacugccaggccagccu

SEQ ID NO: 3612280 - RNA, 22 nt, Human
caggcucccaggagccugccca

SEQ ID NO: 3612281 - RNA, 14 nt, Human
caggcucccaggga

SEQ ID NO: 3612282 - RNA, 14 nt, Human
caggcuccucccuc

SEQ ID NO: 3612283 - RNA, 14 nt, Human
caggcuccugccac

SEQ ID NO: 3612284 - RNA, 12 nt, Human
caggcuccuucc

SEQ ID NO: 3612285 - RNA, 14 nt, Human
caggcuccuuccug

SEQ ID NO: 3612286 - RNA, 14 nt, Human
caggcuccuuuagc

SEQ ID NO: 3612287 - RNA, 21 nt, Human
caggcuccuuuagcgcccagu

SEQ ID NO: 3612288 - RNA, 16 nt, Human
caggcucggccugccc

SEQ ID NO: 3612289 - RNA, 19 nt, Human
caggcucggccugccccca

SEQ ID NO: 3612290 - RNA, 13 nt, Human
caggcucucaaca

SEQ ID NO: 3612291 - RNA, 13 nt, Human
caggcucucaggc

SEQ ID NO: 3612292 - RNA, 15 nt, Human
caggcucucaggcca

SEQ ID NO: 3612293 - RNA, 18 nt, Human
caggcucucaggccagcu

SEQ ID NO: 3612294 - RNA, 20 nt, Human
caggcucucaggccagcugc

SEQ ID NO: 3612295 - RNA, 21 nt, Human
caggcucucaggccagcugcu

SEQ ID NO: 3612296 - RNA, 23 nt, Human
caggcucucaggccagcugcuug

SEQ ID NO: 3612297 - RNA, 15 nt, Human
caggcucugcccugc

SEQ ID NO: 3612298 - RNA, 22 nt, Human
caggcucuuagcagcuuccaga

SEQ ID NO: 3612299 - RNA, 14 nt, Human
caggcugacaucug

SEQ ID NO: 3612300 - RNA, 16 nt, Human
caggcugacaucugug

SEQ ID NO: 3612301 - RNA, 15 nt, Human
caggcugaccacagc

SEQ ID NO: 3612302 - RNA, 20 nt, Human
caggcugaccacagcacagc

SEQ ID NO: 3612303 - RNA, 21 nt, Human
caggcugaccacagcacagcc

SEQ ID NO: 3612304 - RNA, 14 nt, Human
caggcugagccuca

SEQ ID NO: 3612305 - RNA, 17 nt, Human
caggcugagccucaguc

SEQ ID NO: 3612306 - RNA, 21 nt, Human
caggcugagccucagucuccc

SEQ ID NO: 3612307 - RNA, 15 nt, Human
caggcugagugcagg

SEQ ID NO: 3612308 - RNA, 22 nt, Human
caggcugagugcaggcccaccc

SEQ ID NO: 3612309 - RNA, 18 nt, Human
caggcugcagcuggacag

SEQ ID NO: 3612310 - RNA, 17 nt, Human
caggcugcauagaagga

SEQ ID NO: 3612311 - RNA, 22 nt, Human
caggcugccaaggccagagugg

SEQ ID NO: 3612312 - RNA, 12 nt, Human
caggcugccagu

SEQ ID NO: 3612313 - RNA, 14 nt, Human
caggcugccagugc

SEQ ID NO: 3612314 - RNA, 21 nt, Human
caggcugccagugccugggug

SEQ ID NO: 3612315 - RNA, 16 nt, Human
caggcugccguggggc

SEQ ID NO: 3612316 - RNA, 13 nt, Human
caggcugccugag

SEQ ID NO: 3612317 - RNA, 20 nt, Human
caggcugccugagcaccucc

SEQ ID NO: 3612318 - RNA, 17 nt, Human
caggcugcucagggcug

SEQ ID NO: 3612319 - RNA, 22 nt, Human
caggcugcucucaaaccccuga

SEQ ID NO: 3612320 - RNA, 12 nt, Human
caggcugcucuu

SEQ ID NO: 3612321 - RNA, 11 nt, Human
caggcugcugg

SEQ ID NO: 3612322 - RNA, 15 nt, Human
caggcugcuggagga

SEQ ID NO: 3612323 - RNA, 12 nt, Human
caggcugcuggc

SEQ ID NO: 3612324 - RNA, 12 nt, Human
caggcugcuugg

SEQ ID NO: 3612325 - RNA, 19 nt, Human
caggcuggaagauagcugu

SEQ ID NO: 3612326 - RNA, 22 nt, Human
caggcuggacaugcugacuguc

SEQ ID NO: 3612327 - RNA, 21 nt, Human
caggcuggccagccccacagc

SEQ ID NO: 3612328 - RNA, 17 nt, Human
caggcuggccagccgcu

SEQ ID NO: 3612329 - RNA, 21 nt, Human
caggcuggccaguccaggcug

SEQ ID NO: 3612330 - RNA, 14 nt, Human
caggcuggcccugc

SEQ ID NO: 3612331 - RNA, 16 nt, Human
caggcuggcccugccc

SEQ ID NO: 3612332 - RNA, 13 nt, Human
caggcuggcgcag

SEQ ID NO: 3612333 - RNA, 17 nt, Human
caggcuggcgcagccaa

SEQ ID NO: 3612334 - RNA, 20 nt, Human
caggcuggcgcagccaaggc

SEQ ID NO: 3612335 - RNA, 21 nt, Human
caggcuggcgcagccaaggcc

SEQ ID NO: 3612336 - RNA, 15 nt, Human
caggcuggcgugcag

SEQ ID NO: 3612337 - RNA, 17 nt, Human
caggcuggcuccagaug

SEQ ID NO: 3612338 - RNA, 18 nt, Human
caggcuggcuccagaugc

SEQ ID NO: 3612339 - RNA, 20 nt, Human
caggcuggcuccagaugcag

SEQ ID NO: 3612340 - RNA, 12 nt, Human
caggcugggaac

SEQ ID NO: 3612341 - RNA, 16 nt, Human
caggcugggagagccu

SEQ ID NO: 3612342 - RNA, 18 nt, Human
caggcugggagagccuuc

SEQ ID NO: 3612343 - RNA, 19 nt, Human
caggcugggagagccuucc

SEQ ID NO: 3612344 - RNA, 18 nt, Human
caggcugggcaaggaggc

SEQ ID NO: 3612345 - RNA, 13 nt, Human
caggcugggccau

SEQ ID NO: 3612346 - RNA, 20 nt, Human
caggcugggccauguccaaa

SEQ ID NO: 3612347 - RNA, 12 nt, Human
caggcugggcug

SEQ ID NO: 3612348 - RNA, 13 nt, Human
caggcugggcugg

SEQ ID NO: 3612349 - RNA, 16 nt, Human
caggcugggcugggca

SEQ ID NO: 3612350 - RNA, 19 nt, Human
caggcugggcugggcacug

SEQ ID NO: 3612351 - RNA, 21 nt, Human
caggcugggcugggcacugcu

SEQ ID NO: 3612352 - RNA, 20 nt, Human
caggcugggcuucaguggca

SEQ ID NO: 3612353 - RNA, 21 nt, Human
caggcugggcuucaguggcag

SEQ ID NO: 3612354 - RNA, 22 nt, Human
caggcugggcuucaguggcagc

SEQ ID NO: 3612355 - RNA, 12 nt, Human
caggcuggggcc

SEQ ID NO: 3612356 - RNA, 17 nt, Human
caggcuggucuaaaacu

SEQ ID NO: 3612357 - RNA, 18 nt, Human
caggcuggucuaaaacuc

SEQ ID NO: 3612358 - RNA, 12 nt, Human
caggcuggucuc

SEQ ID NO: 3612359 - RNA, 13 nt, Human
caggcuggucuca

SEQ ID NO: 3612360 - RNA, 21 nt, Human
caggcuggucuugaaguccug

SEQ ID NO: 3612361 - RNA, 14 nt, Human
caggcuguauccca

SEQ ID NO: 3612362 - RNA, 17 nt, Human
caggcugucuggccagg

SEQ ID NO: 3612363 - RNA, 22 nt, Human
caggcugugcgcugacaaccac

SEQ ID NO: 3612364 - RNA, 17 nt, Human
caggcuguucugcacug

SEQ ID NO: 3612365 - RNA, 18 nt, Human
caggcuguuuuugggugc

SEQ ID NO: 3612366 - RNA, 20 nt, Human
caggcuuaauaaaaaugaca

SEQ ID NO: 3612367 - RNA, 17 nt, Human
caggcuuagucacugag

SEQ ID NO: 3612368 - RNA, 20 nt, Human
caggcuuagucacugagaca

SEQ ID NO: 3612369 - RNA, 22 nt, Human
caggcuuagucacugagacagc

SEQ ID NO: 3612370 - RNA, 16 nt, Human
caggcuucugagcagc

SEQ ID NO: 3612371 - RNA, 23 nt, Human
caggcuucugagcagcgagccug

SEQ ID NO: 3612372 - RNA, 18 nt, Human
caggcuuucuagaaagaa

SEQ ID NO: 3612373 - RNA, 14 nt, Human
caggcuuuuguuuc

SEQ ID NO: 3612374 - RNA, 15 nt, Human
cagggaaaagcagcu

SEQ ID NO: 3612375 - RNA, 21 nt, Human
cagggaaaagcagcucucccc

SEQ ID NO: 3612376 - RNA, 18 nt, Human
cagggaaaauaggcagga

SEQ ID NO: 3612377 - RNA, 20 nt, Human
cagggaaaaugcagcaggga

SEQ ID NO: 3612378 - RNA, 20 nt, Human
cagggaaaauuauuugcaua

SEQ ID NO: 3612379 - RNA, 16 nt, Human
cagggaaacagcuaau

SEQ ID NO: 3612380 - RNA, 22 nt, Human
cagggaaccguuauuauaauug

SEQ ID NO: 3612381 - RNA, 19 nt, Human
cagggaacgugauuaguga

SEQ ID NO: 3612382 - RNA, 19 nt, Human
cagggaagauaaguuggaa

SEQ ID NO: 3612383 - RNA, 14 nt, Human
cagggaagcccagc

SEQ ID NO: 3612384 - RNA, 15 nt, Human
cagggaagcccagcu

SEQ ID NO: 3612385 - RNA, 16 nt, Human
cagggaagcccagcuc

SEQ ID NO: 3612386 - RNA, 19 nt, Human
cagggaagcccagcuccag

SEQ ID NO: 3612387 - RNA, 12 nt, Human
caguguguaaac

SEQ ID NO: 3612388 - RNA, 14 nt, Human
caguguguaaacaa

SEQ ID NO: 3612389 - RNA, 14 nt, Human
cagugugucuccug

SEQ ID NO: 3612390 - RNA, 22 nt, Human
caguguguggcuuucagagccu

SEQ ID NO: 3612391 - RNA, 17 nt, Human
caguguguggucaacau

SEQ ID NO: 3612392 - RNA, 16 nt, Human
caguguuaaaugaaau

SEQ ID NO: 3612393 - RNA, 19 nt, Human
caguguuaaaugugaugaa

SEQ ID NO: 3612394 - RNA, 17 nt, Human
caguguuaccugugugc

SEQ ID NO: 3612395 - RNA, 13 nt, Human
caguguuagcuua

SEQ ID NO: 3612396 - RNA, 23 nt, Human
caguguuaggccuggcacagugu

SEQ ID NO: 3612397 - RNA, 14 nt, Human
caguguuauuuucu

SEQ ID NO: 3612398 - RNA, 14 nt, Human
caguguuccccauc

SEQ ID NO: 3612399 - RNA, 15 nt, Human
caguguucgcuuggc

SEQ ID NO: 3612400 - RNA, 19 nt, Human
caguguuguggauuuaaca

SEQ ID NO: 3612401 - RNA, 14 nt, Human
caguguuguuugua

SEQ ID NO: 3612402 - RNA, 17 nt, Human
caguguuguuuguaaau

SEQ ID NO: 3612403 - RNA, 23 nt, Human
caguguuguuuguaaauaagaga

SEQ ID NO: 3612404 - RNA, 14 nt, Human
caguguuuaaaacu

SEQ ID NO: 3612405 - RNA, 14 nt, Human
caguguuuccuuuu

SEQ ID NO: 3612406 - RNA, 13 nt, Human
caguguuugugug

SEQ ID NO: 3612407 - RNA, 21 nt, Human
caguguuuugaccuuugauac

SEQ ID NO: 3612408 - RNA, 22 nt, Human
caguguuuuggacuccaucucu

SEQ ID NO: 3612409 - RNA, 20 nt, Human
caguguuuuuguaaagugug

SEQ ID NO: 3612410 - RNA, 19 nt, Human
caguuaaaaaaaauuuuaa

SEQ ID NO: 3612411 - RNA, 14 nt, Human
caguuaaaauguga

SEQ ID NO: 3612412 - RNA, 22 nt, Human
caguuaacuuucagaagagaug

SEQ ID NO: 3612413 - RNA, 14 nt, Human
caguuaagaaaaaa

SEQ ID NO: 3612414 - RNA, 20 nt, Human
aaaccgaguagaaaauguga

SEQ ID NO: 3612415 - RNA, 19 nt, Human
aaaccgccagcucuguucu

SEQ ID NO: 3612416 - RNA, 16 nt, Human
aaaccgccuaguuuac

SEQ ID NO: 3612417 - RNA, 19 nt, Human
aaaccguccuguguacaca

SEQ ID NO: 3612418 - RNA, 18 nt, Human
aaaccuauccucacugcc

SEQ ID NO: 3612419 - RNA, 14 nt, Human
aaaccucaccaacu

SEQ ID NO: 3612420 - RNA, 19 nt, Human
aaaccucuaauuuauuuug

SEQ ID NO: 3612421 - RNA, 16 nt, Human
aaaccucuacuaaaaa

SEQ ID NO: 3612422 - RNA, 14 nt, Human
aaaccucuguucag

SEQ ID NO: 3612423 - RNA, 17 nt, Human
aaaccucuguucagugu

SEQ ID NO: 3612424 - RNA, 12 nt, Human
aaaccugaagac

SEQ ID NO: 3612425 - RNA, 19 nt, Human
aaaccugauguuaaaauuc

SEQ ID NO: 3612426 - RNA, 17 nt, Human
aaaccugcccugccuga

SEQ ID NO: 3612427 - RNA, 12 nt, Human
aaaccugccugg

SEQ ID NO: 3612428 - RNA, 20 nt, Human
aaaccugcuuuucaaugugu

SEQ ID NO: 3612429 - RNA, 18 nt, Human
aaaccugggauuauauau

SEQ ID NO: 3612430 - RNA, 16 nt, Human
aaaccuguagaaucaa

SEQ ID NO: 3612431 - RNA, 12 nt, Human
aaaccuguaucu

SEQ ID NO: 3612432 - RNA, 13 nt, Human
aaaccuguaucuu

SEQ ID NO: 3612433 - RNA, 18 nt, Human
aaaccugugaagcugaaa

SEQ ID NO: 3612434 - RNA, 22 nt, Human
aaaccuuaucuccacaaccucu

SEQ ID NO: 3612435 - RNA, 18 nt, Human
aaaccuuauuguaccucu

SEQ ID NO: 3612436 - RNA, 20 nt, Human
aaaccuucacacacagacug

SEQ ID NO: 3612437 - RNA, 16 nt, Human
aaaccuuccacccagu

SEQ ID NO: 3612438 - RNA, 14 nt, Human
aaaccuucugccuu

SEQ ID NO: 3612439 - RNA, 20 nt, Human
aaaccuugcuaauuuucuca

SEQ ID NO: 3612440 - RNA, 15 nt, Human
aaaccuuuaagaaaa

SEQ ID NO: 3612441 - RNA, 16 nt, Human
aaaccuuuagggcagc

SEQ ID NO: 3612442 - RNA, 11 nt, Human
aaaccuuucaa

SEQ ID NO: 3612443 - RNA, 12 nt, Human
aaaccuuucccc

SEQ ID NO: 3612444 - RNA, 18 nt, Human
aaaccuuucuauaauuuu

SEQ ID NO: 3612445 - RNA, 21 nt, Human
aaaccuuucuauaauuuuaca

SEQ ID NO: 3612446 - RNA, 18 nt, Human
aaaccuuuguuugcaucu

SEQ ID NO: 3612447 - RNA, 12 nt, Human
aaaccuuuuauu

SEQ ID NO: 3612448 - RNA, 20 nt, Human
aaaccuuuuggaaaaucugc

SEQ ID NO: 3612449 - RNA, 18 nt, Human
aaaccuuuuuuaagauuu

SEQ ID NO: 3612450 - RNA, 19 nt, Human
aaaccuuuuuuaagauuuu

SEQ ID NO: 3612451 - RNA, 23 nt, Human
aaaccuuuuuuaagauuuuucuc

SEQ ID NO: 3612452 - RNA, 14 nt, Human
aaacgaaggccucu

SEQ ID NO: 3612453 - RNA, 18 nt, Human
aaacgacaaaucugucug

SEQ ID NO: 3612454 - RNA, 19 nt, Human
aaacgacaaaucugucugc

SEQ ID NO: 3612455 - RNA, 17 nt, Human
aaacgagacuuuccauu

SEQ ID NO: 3612456 - RNA, 15 nt, Human
aaacgauuuaauucu

SEQ ID NO: 3612457 - RNA, 17 nt, Human
aaacgauuuaauucucu

SEQ ID NO: 3612458 - RNA, 19 nt, Human
aaacgauuuaauucucuug

SEQ ID NO: 3612459 - RNA, 19 nt, Human
aaacgcaaagggcugaaag

SEQ ID NO: 3612460 - RNA, 13 nt, Human
aaacgcagacacu

SEQ ID NO: 3612461 - RNA, 14 nt, Human
aaacgcgcagaugu

SEQ ID NO: 3612462 - RNA, 16 nt, Human
aaacgcuaccucucug

SEQ ID NO: 3612463 - RNA, 14 nt, Human
aaacgcuccuuugu

SEQ ID NO: 3612464 - RNA, 14 nt, Human
aaacgcugccugcc

SEQ ID NO: 3612465 - RNA, 16 nt, Human
aaacggauuauuuuuu

SEQ ID NO: 3612466 - RNA, 18 nt, Human
aaacggauuauuuuuuca

SEQ ID NO: 3612467 - RNA, 22 nt, Human
aaacggauuauuuuuucagacc

SEQ ID NO: 3612468 - RNA, 19 nt, Human
aaacgggaacaugcccccu

SEQ ID NO: 3612469 - RNA, 15 nt, Human
aaacgguuaaaacug

SEQ ID NO: 3612470 - RNA, 14 nt, Human
aaacgguucaguuu

SEQ ID NO: 3612471 - RNA, 13 nt, Human
aaacgucuuaaau

SEQ ID NO: 3612472 - RNA, 18 nt, Human
aaacgucuuauuguggua

SEQ ID NO: 3612473 - RNA, 16 nt, Human
aaacguggcugcuuca

SEQ ID NO: 3612474 - RNA, 20 nt, Human
aaacguggcuuuuagacaga

SEQ ID NO: 3612475 - RNA, 22 nt, Human
aaacguuucaguaauaaaacau

SEQ ID NO: 3612476 - RNA, 19 nt, Human
aaacuaaagaaauuucuca

SEQ ID NO: 3612477 - RNA, 20 nt, Human
aaacuaaagcaauagaaaca

SEQ ID NO: 3612478 - RNA, 16 nt, Human
aaacuaaauagcaugu

SEQ ID NO: 3612479 - RNA, 13 nt, Human
aaacuaaauugua

SEQ ID NO: 3612480 - RNA, 13 nt, Human
aaacuaaggugcu

SEQ ID NO: 3612481 - RNA, 15 nt, Human
aaacuaaggugcuaa

SEQ ID NO: 3612482 - RNA, 14 nt, Human
aaacuaauaaaaua

SEQ ID NO: 3612483 - RNA, 19 nt, Human
aaacuaauaaaauauuuuc

SEQ ID NO: 3612484 - RNA, 21 nt, Human
aaacuaauaaaauauuuucug

SEQ ID NO: 3612485 - RNA, 22 nt, Human
aaacuacauuagguugugaaug

SEQ ID NO: 3612486 - RNA, 21 nt, Human
aaacuaccuguauuuaaaaau

SEQ ID NO: 3612487 - RNA, 16 nt, Human
aaacuacugaaugaag

SEQ ID NO: 3612488 - RNA, 21 nt, Human
aaacuacugaaugaagcagua

SEQ ID NO: 3612489 - RNA, 20 nt, Human
aaacuacuugauuuuauugu

SEQ ID NO: 3612490 - RNA, 23 nt, Human
aaacuagaaagcagagauuuuca

SEQ ID NO: 3612491 - RNA, 16 nt, Human
aaacuagaauuucauu

SEQ ID NO: 3612492 - RNA, 15 nt, Human
aaacuagaugaccuc

SEQ ID NO: 3612493 - RNA, 22 nt, Human
aaacuagaugaccucauuaacc

SEQ ID NO: 3612494 - RNA, 14 nt, Human
aaacuagcauaucu

SEQ ID NO: 3612495 - RNA, 15 nt, Human
aaacuagcucgugau

SEQ ID NO: 3612496 - RNA, 19 nt, Human
aaacuaggcauuuguaaau

SEQ ID NO: 3612497 - RNA, 20 nt, Human
aaacuaggcauuuguaaaua

SEQ ID NO: 3612498 - RNA, 18 nt, Human
aaacuagggccaagccca

SEQ ID NO: 3612499 - RNA, 13 nt, Human
aaacuauaaaaca

SEQ ID NO: 3612500 - RNA, 17 nt, Human
aaacuauaaaacaaaaa

SEQ ID NO: 3612501 - RNA, 18 nt, Human
aaacuauacuugaacaaa

SEQ ID NO: 3612502 - RNA, 20 nt, Human
aaacuauacuugaacaaaag

SEQ ID NO: 3612503 - RNA, 18 nt, Human
aaacuauauuuugucaua

SEQ ID NO: 3612504 - RNA, 16 nt, Human
aaacuaucaguuuguc

SEQ ID NO: 3612505 - RNA, 14 nt, Human
aaacuaugaaaccu

SEQ ID NO: 3612506 - RNA, 16 nt, Human
aaacuauguguuuuuc

SEQ ID NO: 3612507 - RNA, 19 nt, Human
aaacuauguguuuuucuca

SEQ ID NO: 3612508 - RNA, 21 nt, Human
aaacuauguguuuuucucaua

SEQ ID NO: 3612509 - RNA, 14 nt, Human
aaacuauuaaggau

SEQ ID NO: 3612510 - RNA, 22 nt, Human
aaacuauuaaggauguagcuuu

SEQ ID NO: 3612511 - RNA, 22 nt, Human
aaacucaaaacuuaacauauuu

SEQ ID NO: 3612512 - RNA, 17 nt, Human
aaacucaaccaaauggu

SEQ ID NO: 3612513 - RNA, 14 nt, Human
aaacucaagacaau

SEQ ID NO: 3612514 - RNA, 23 nt, Human
aaacucaaugcuuuauuuguaaa

SEQ ID NO: 3612515 - RNA, 13 nt, Human
aaacucacaaaug

SEQ ID NO: 3612516 - RNA, 16 nt, Human
aaacucaccauguaaa

SEQ ID NO: 3612517 - RNA, 19 nt, Human
aaacucaccugcuggcccc

SEQ ID NO: 3612518 - RNA, 20 nt, Human
aaacucaccugcuggccccu

SEQ ID NO: 3612519 - RNA, 22 nt, Human
aaacucaccugcuggccccuca

SEQ ID NO: 3612520 - RNA, 13 nt, Human
aaacucagggaca

SEQ ID NO: 3612521 - RNA, 19 nt, Human
aaacucagggacagagcca

SEQ ID NO: 3612522 - RNA, 16 nt, Human
aaacucagggcuucua

SEQ ID NO: 3612523 - RNA, 22 nt, Human
aaacucauauuacaaaaacaaa

SEQ ID NO: 3612524 - RNA, 17 nt, Human
aaacucaucugaaaugu

SEQ ID NO: 3612525 - RNA, 15 nt, Human
aaacucauuuugcuu

SEQ ID NO: 3612526 - RNA, 17 nt, Human
aaacuccacaucugccu

SEQ ID NO: 3612527 - RNA, 15 nt, Human
aaacuccagaugcca

SEQ ID NO: 3612528 - RNA, 22 nt, Human
aaacuccagaugccacaaugga

SEQ ID NO: 3612529 - RNA, 23 nt, Human
aaacucccacuugucaugugaca

SEQ ID NO: 3612530 - RNA, 23 nt, Human
aaacucccauuuacgugucugaa

SEQ ID NO: 3612531 - RNA, 16 nt, Human
aaacuccgcccccagc

SEQ ID NO: 3612532 - RNA, 19 nt, Human
aaacuccgucuuagaagug

SEQ ID NO: 3612533 - RNA, 14 nt, Human
aaacuccuuccugg

SEQ ID NO: 3612534 - RNA, 23 nt, Human
aaacucgaggacuguauuuguga

SEQ ID NO: 3612535 - RNA, 24 nt, Human
aaacucgaggacuguauuugugac

SEQ ID NO: 3612536 - RNA, 13 nt, Human
aaacucuaugguc

SEQ ID NO: 3612537 - RNA, 18 nt, Human
aaacucuauuuagaugca

SEQ ID NO: 3612538 - RNA, 13 nt, Human
aaacucuccucug

SEQ ID NO: 3612539 - RNA, 12 nt, Human
aaacucucugaa

SEQ ID NO: 3612540 - RNA, 13 nt, Human
aaacucucugaac

SEQ ID NO: 3612541 - RNA, 17 nt, Human
aaacucucuuugggaau

SEQ ID NO: 3612542 - RNA, 21 nt, Human
caguuuaaugaagaucuaaau

SEQ ID NO: 3612543 - RNA, 18 nt, Human
caguuuauacccuaguua

SEQ ID NO: 3612544 - RNA, 14 nt, Human
caguuuauauggaa

SEQ ID NO: 3612545 - RNA, 17 nt, Human
caguuuauauuuaacuc

SEQ ID NO: 3612546 - RNA, 16 nt, Human
caguuuaucaugaagc

SEQ ID NO: 3612547 - RNA, 20 nt, Human
caguuuaucaugaagccugu

SEQ ID NO: 3612548 - RNA, 14 nt, Human
caguuuaucauuca

SEQ ID NO: 3612549 - RNA, 22 nt, Human
caguuuauuccagagcugccag

SEQ ID NO: 3612550 - RNA, 20 nt, Human
caguuucaauaaaguuugau

SEQ ID NO: 3612551 - RNA, 21 nt, Human
caguuucacagaaaauaaggc

SEQ ID NO: 3612552 - RNA, 17 nt, Human
caguuuccucaucuguc

SEQ ID NO: 3612553 - RNA, 14 nt, Human
caguuuccuuggga

SEQ ID NO: 3612554 - RNA, 18 nt, Human
caguuucuaaacuggaga

SEQ ID NO: 3612555 - RNA, 17 nt, Human
caguuugaaauucugaa

SEQ ID NO: 3612556 - RNA, 21 nt, Human
caguuugaaauucugaauuug

SEQ ID NO: 3612557 - RNA, 22 nt, Human
caguuugaaauucugaauuugc

SEQ ID NO: 3612558 - RNA, 15 nt, Human
caguuugagacagga

SEQ ID NO: 3612559 - RNA, 18 nt, Human
caaauaaaaauauugugu

SEQ ID NO: 3612560 - RNA, 10 nt, Human
caaauaaaau

SEQ ID NO: 3612561 - RNA, 21 nt, Human
caaauaaaauucccuaaagcc

SEQ ID NO: 3612562 - RNA, 12 nt, Human
caaauaaacacu

SEQ ID NO: 3612563 - RNA, 15 nt, Human
caaauaaacacugug

SEQ ID NO: 3612564 - RNA, 23 nt, Human
caaauaaagagagaacaggacua

SEQ ID NO: 3612565 - RNA, 18 nt, Human
caaauaaaguuaaaagua

SEQ ID NO: 3612566 - RNA, 19 nt, Human
caaauaaaguuaaaaguaa

SEQ ID NO: 3612567 - RNA, 17 nt, Human
caaauaaauaauuuuca

SEQ ID NO: 3612568 - RNA, 16 nt, Human
caaauaacaacuuuuu

SEQ ID NO: 3612569 - RNA, 18 nt, Human
caaauaaguauuuauaau

SEQ ID NO: 3612570 - RNA, 13 nt, Human
caaauaaguguau

SEQ ID NO: 3612571 - RNA, 16 nt, Human
caaauaaguguauuuu

SEQ ID NO: 3612572 - RNA, 14 nt, Human
caaauaauaagcaa

SEQ ID NO: 3612573 - RNA, 23 nt, Human
caaauaaugaucgaaaaaauaau

SEQ ID NO: 3612574 - RNA, 21 nt, Human
caaauacuaaaaagaagugcu

SEQ ID NO: 3612575 - RNA, 14 nt, Human
caaauacucaugug

SEQ ID NO: 3612576 - RNA, 16 nt, Human
caaauacucaugugua

SEQ ID NO: 3612577 - RNA, 15 nt, Human
caaauacuuagcaaa

SEQ ID NO: 3612578 - RNA, 19 nt, Human
caaauacuuuaaaggaaaa

SEQ ID NO: 3612579 - RNA, 16 nt, Human
caaauagaaaaugguc

SEQ ID NO: 3612580 - RNA, 13 nt, Human
caaauagcaaaga

SEQ ID NO: 3612581 - RNA, 13 nt, Human
caaauaguugcau

SEQ ID NO: 3612582 - RNA, 20 nt, Human
caaauaguuuauaaauguga

SEQ ID NO: 3612583 - RNA, 16 nt, Human
caaauauaaaucuuaa

SEQ ID NO: 3612584 - RNA, 14 nt, Human
caaauauaagaaua

SEQ ID NO: 3612585 - RNA, 23 nt, Human
caaauauauucagccuggcuuca

SEQ ID NO: 3612586 - RNA, 17 nt, Human
caaauaucucuauuuaa

SEQ ID NO: 3612587 - RNA, 15 nt, Human
caaauaucuuguguu

SEQ ID NO: 3612588 - RNA, 21 nt, Human
caaauaucuuguguuguccuu

SEQ ID NO: 3612589 - RNA, 22 nt, Human
caaauaugaguacaaaugccuu

SEQ ID NO: 3612590 - RNA, 23 nt, Human
caaauaugaguacaaaugccuua

SEQ ID NO: 3612591 - RNA, 13 nt, Human
caaauaugcaaag

SEQ ID NO: 3612592 - RNA, 19 nt, Human
caaauaugcaaagcacuga

SEQ ID NO: 3612593 - RNA, 15 nt, Human
caaauauguccuggg

SEQ ID NO: 3612594 - RNA, 17 nt, Human
caaauauguccuggggu

SEQ ID NO: 3612595 - RNA, 22 nt, Human
caaauauuaaaaagucuuuuaa

SEQ ID NO: 3612596 - RNA, 15 nt, Human
caaauauuagaugug

SEQ ID NO: 3612597 - RNA, 19 nt, Human
caaauauuagaugugauuu

SEQ ID NO: 3612598 - RNA, 15 nt, Human
caaauauucagaaua

SEQ ID NO: 3612599 - RNA, 17 nt, Human
caaauauuccagagacu

SEQ ID NO: 3612600 - RNA, 22 nt, Human
caaauauuuagauguaauuuug

SEQ ID NO: 3612601 - RNA, 12 nt, Human
caaauauuuauu

SEQ ID NO: 3612602 - RNA, 14 nt, Human
caaauauuuauuuu

SEQ ID NO: 3612603 - RNA, 19 nt, Human
caaauauuucuagacacuu

SEQ ID NO: 3612604 - RNA, 15 nt, Human
caaaucaaagcagau

SEQ ID NO: 3612605 - RNA, 13 nt, Human
caaaucaacagaa

SEQ ID NO: 3612606 - RNA, 14 nt, Human
caaaucaacagaag

SEQ ID NO: 3612607 - RNA, 15 nt, Human
caaaucaacagaagc

SEQ ID NO: 3612608 - RNA, 22 nt, Human
caaaucaaguuuccaagcaaau

SEQ ID NO: 3612609 - RNA, 14 nt, Human
caaaucaauacacu

SEQ ID NO: 3612610 - RNA, 15 nt, Human
caaaucaauacacua

SEQ ID NO: 3612611 - RNA, 14 nt, Human
caaaucacugaacu

SEQ ID NO: 3612612 - RNA, 15 nt, Human
caaaucacugaacuu

SEQ ID NO: 3612613 - RNA, 22 nt, Human
caaaucagaagucaucuugcua

SEQ ID NO: 3612614 - RNA, 16 nt, Human
caaaucagcugcuacu

SEQ ID NO: 3612615 - RNA, 17 nt, Human
caaaucagcugcuacua

SEQ ID NO: 3612616 - RNA, 23 nt, Human
caaaucagucagugcaaauguca

SEQ ID NO: 3612617 - RNA, 21 nt, Human
caaaucaguuacuaagaagaa

SEQ ID NO: 3612618 - RNA, 14 nt, Human
caaaucauuuguuu

SEQ ID NO: 3612619 - RNA, 18 nt, Human
caaaucauuuguuuaaaa

SEQ ID NO: 3612620 - RNA, 22 nt, Human
caaauccagccugcugccugcu

SEQ ID NO: 3612621 - RNA, 18 nt, Human
caaauccgcucucuuccu

SEQ ID NO: 3612622 - RNA, 19 nt, Human
caaauccgcucucuuccug

SEQ ID NO: 3612623 - RNA, 20 nt, Human
caaauccgcucucuuccugc

SEQ ID NO: 3612624 - RNA, 17 nt, Human
caaauccuaugugauuu

SEQ ID NO: 3612625 - RNA, 15 nt, Human
caaauccuugaagau

SEQ ID NO: 3612626 - RNA, 20 nt, Human
caaaucuaggaaaauauuuu

SEQ ID NO: 3612627 - RNA, 23 nt, Human
caaaucuaggaaaauauuuugau

SEQ ID NO: 3612628 - RNA, 23 nt, Human
caaaucuauuuaauuaggaaaaa

SEQ ID NO: 3612629 - RNA, 14 nt, Human
caaaucugaagauu

SEQ ID NO: 3612630 - RNA, 18 nt, Human
caaaucugcaaagcaugu

SEQ ID NO: 3612631 - RNA, 20 nt, Human
caaaucugcaaagcauguuu

SEQ ID NO: 3612632 - RNA, 21 nt, Human
caaaucugcuuuuuaaagaau

SEQ ID NO: 3612633 - RNA, 13 nt, Human
caaaucuggaagc

SEQ ID NO: 3612634 - RNA, 18 nt, Human
caaaucuguguauauuau

SEQ ID NO: 3612635 - RNA, 13 nt, Human
caaaucuuaagaa

SEQ ID NO: 3612636 - RNA, 23 nt, Human
caaaugaauaaugccuuuguaac

SEQ ID NO: 3612637 - RNA, 22 nt, Human
caaaugaauguugucuguuugu

SEQ ID NO: 3612638 - RNA, 14 nt, Human
caaaugacuuuauu

SEQ ID NO: 3612639 - RNA, 18 nt, Human
caaaugacuuuauuauuu

SEQ ID NO: 3612640 - RNA, 21 nt, Human
caaaugacuuuauuauuuauu

SEQ ID NO: 3612641 - RNA, 22 nt, Human
caaaugagaaaaugucuuuauu

SEQ ID NO: 3612642 - RNA, 20 nt, Human
caaaugagaucuaagccuuu

SEQ ID NO: 3612643 - RNA, 14 nt, Human
caaaugaguaacau

SEQ ID NO: 3612644 - RNA, 21 nt, Human
caaaugaguaacauuugcugu

SEQ ID NO: 3612645 - RNA, 21 nt, Human
caaaugaugugcaaaaccuuu

SEQ ID NO: 3612646 - RNA, 17 nt, Human
caaaugauugcuuuuaa

SEQ ID NO: 3612647 - RNA, 18 nt, Human
caaaugauugcuuuuaaa

SEQ ID NO: 3612648 - RNA, 20 nt, Human
caaaugauugcuuuuaaaau

SEQ ID NO: 3612649 - RNA, 21 nt, Human
caaaugauugcuuuuaaaauu

SEQ ID NO: 3612650 - RNA, 22 nt, Human
caaaugauugcuuuuaaaauuu

SEQ ID NO: 3612651 - RNA, 15 nt, Human
caaaugcaauuugau

SEQ ID NO: 3612652 - RNA, 13 nt, Human
caaaugcagcuuu

SEQ ID NO: 3612653 - RNA, 22 nt, Human
caaaugcagggauugcugccac

SEQ ID NO: 3612654 - RNA, 18 nt, Human
caaaugccuuaaaaugga

SEQ ID NO: 3612655 - RNA, 16 nt, Human
caaaugcucaaagaaa

SEQ ID NO: 3612656 - RNA, 18 nt, Human
caaaugcuuggcuucuca

SEQ ID NO: 3612657 - RNA, 23 nt, Human
caaauggaaaugggcagagcaga

SEQ ID NO: 3612658 - RNA, 18 nt, Human
caaauggagaagcugcag

SEQ ID NO: 3612659 - RNA, 18 nt, Human
caaaugggugauauccug

SEQ ID NO: 3612660 - RNA, 18 nt, Human
caaauggguuuuccacgc

SEQ ID NO: 3612661 - RNA, 24 nt, Human
caaaugguacaaaaccacagugua

SEQ ID NO: 3612662 - RNA, 21 nt, Human
caaauggugguuguuucuucc

SEQ ID NO: 3612663 - RNA, 18 nt, Human
caaauguaauugaauaaa

SEQ ID NO: 3612664 - RNA, 23 nt, Human
caaauguaguauggccuguguca

SEQ ID NO: 3612665 - RNA, 16 nt, Human
caaaugucagauacaa

SEQ ID NO: 3612666 - RNA, 18 nt, Human
caaaugucaugcugccuu

SEQ ID NO: 3612667 - RNA, 15 nt, Human
caaaugugaagaugc

SEQ ID NO: 3612668 - RNA, 14 nt, Human
caaaugugaccugu

SEQ ID NO: 3612669 - RNA, 17 nt, Human
caaaugugaccuguguc

SEQ ID NO: 3612670 - RNA, 17 nt, Human
caaauguggcauuugug

SEQ ID NO: 3612671 - RNA, 20 nt, Human
caaauguguacauggcagag

SEQ ID NO: 3612672 - RNA, 15 nt, Human
caaaugugugcccag

SEQ ID NO: 3612673 - RNA, 18 nt, Human
caaaugugugcccagcuu

SEQ ID NO: 3612674 - RNA, 19 nt, Human
caaauguuaaaauguguug

SEQ ID NO: 3612675 - RNA, 15 nt, Human
caaauguuacauagu

SEQ ID NO: 3612676 - RNA, 21 nt, Human
caaauguuaugcauaaaguca

SEQ ID NO: 3612677 - RNA, 20 nt, Human
caaauguucaucaaugaaug

SEQ ID NO: 3612678 - RNA, 12 nt, Human
caaauguucuaa

SEQ ID NO: 3612679 - RNA, 15 nt, Human
caaauguucuaaguu

SEQ ID NO: 3612680 - RNA, 22 nt, Human
caaauguucuaaguuucuaaga

SEQ ID NO: 3612681 - RNA, 15 nt, Human
caaauguuuaaucau

SEQ ID NO: 3612682 - RNA, 17 nt, Human
caaauguuuaaucauau

SEQ ID NO: 3612683 - RNA, 20 nt, Human
caaauguuuaaucauauaaa

SEQ ID NO: 3612684 - RNA, 22 nt, Human
caaauguuuaaucauauaaaua

SEQ ID NO: 3612685 - RNA, 18 nt, Human
caaauguuuacagggagc

SEQ ID NO: 3612686 - RNA, 20 nt, Human
caaauguuuacagggagccu

SEQ ID NO: 3612687 - RNA, 17 nt, Human
caaauguuuauuuaaaa

SEQ ID NO: 3612688 - RNA, 18 nt, Human
caaauguuuauuuaaaag

SEQ ID NO: 3612689 - RNA, 11 nt, Human
caaauguuucu

SEQ ID NO: 3612690 - RNA, 12 nt, Human
caaauguuucua

SEQ ID NO: 3612691 - RNA, 15 nt, Human
caaauuaaaaaagau

SEQ ID NO: 3612692 - RNA, 14 nt, Human
caaauuaaaaagau

SEQ ID NO: 3612693 - RNA, 22 nt, Human
caaauuaaaaagauucuuuuuc

SEQ ID NO: 3612694 - RNA, 20 nt, Human
caaauuaauuggcagcagau

SEQ ID NO: 3612695 - RNA, 16 nt, Human
caaauuaauuguguga

SEQ ID NO: 3612696 - RNA, 21 nt, Human
cagggaagcccagcuccaggg

SEQ ID NO: 3612697 - RNA, 17 nt, Human
cagggaagcuacagguu

SEQ ID NO: 3612698 - RNA, 18 nt, Human
cagggaagcuacagguua

SEQ ID NO: 3612699 - RNA, 19 nt, Human
cagggaagcuacagguuac

SEQ ID NO: 3612700 - RNA, 24 nt, Human
cagggaagcuacagguuacaacag

SEQ ID NO: 3612701 - RNA, 14 nt, Human
cagggaagcuggcc

SEQ ID NO: 3612702 - RNA, 21 nt, Human
cagggaaggaggagccugucc

SEQ ID NO: 3612703 - RNA, 22 nt, Human
caaccuuggcuuggcccuggca

SEQ ID NO: 3612704 - RNA, 18 nt, Human
caaccuuucccucacccc

SEQ ID NO: 3612705 - RNA, 19 nt, Human
caaccuuucccucaccccc

SEQ ID NO: 3612706 - RNA, 13 nt, Human
caacgacaaagcc

SEQ ID NO: 3612707 - RNA, 20 nt, Human
caacggaggccugcgacccu

SEQ ID NO: 3612708 - RNA, 13 nt, Human
caacggagucaaa

SEQ ID NO: 3612709 - RNA, 14 nt, Human
caacggcagugaag

SEQ ID NO: 3612710 - RNA, 20 nt, Human
caacggcccugcagccagcu

SEQ ID NO: 3612711 - RNA, 17 nt, Human
caacgggaagcaaccuc

SEQ ID NO: 3612712 - RNA, 15 nt, Human
caacguagcuucuac

SEQ ID NO: 3612713 - RNA, 13 nt, Human
caacgucugugcc

SEQ ID NO: 3612714 - RNA, 17 nt, Human
caacgugcauugugcuu

SEQ ID NO: 3612715 - RNA, 18 nt, Human
caacgugcauugugcuuc

SEQ ID NO: 3612716 - RNA, 18 nt, Human
caacgugcucuuuguuuu

SEQ ID NO: 3612717 - RNA, 17 nt, Human
caacguggcccagagaa

SEQ ID NO: 3612718 - RNA, 12 nt, Human
caacguggggca

SEQ ID NO: 3612719 - RNA, 15 nt, Human
caacguggggcagca

SEQ ID NO: 3612720 - RNA, 17 nt, Human
caacguggggcagcaca

SEQ ID NO: 3612721 - RNA, 18 nt, Human
caacguggggcagcacag

SEQ ID NO: 3612722 - RNA, 15 nt, Human
caacguuacucaggg

SEQ ID NO: 3612723 - RNA, 18 nt, Human
caacguuacucagggcuc

SEQ ID NO: 3612724 - RNA, 18 nt, Human
caacguuucuucacuuuu

SEQ ID NO: 3612725 - RNA, 16 nt, Human
caacuaagcagucccu

SEQ ID NO: 3612726 - RNA, 17 nt, Human
caacuacagaaaaacca

SEQ ID NO: 3612727 - RNA, 16 nt, Human
caacuacccaaaacaa

SEQ ID NO: 3612728 - RNA, 17 nt, Human
caacuacccaaaacaag

SEQ ID NO: 3612729 - RNA, 17 nt, Human
caacuacccccagcugu

SEQ ID NO: 3612730 - RNA, 11 nt, Human
caacuaccuga

SEQ ID NO: 3612731 - RNA, 13 nt, Human
caacuacuaauag

SEQ ID NO: 3612732 - RNA, 21 nt, Human
caacuacuaauagaauaaagg

SEQ ID NO: 3612733 - RNA, 20 nt, Human
caacuacuaucucagagaua

SEQ ID NO: 3612734 - RNA, 17 nt, Human
caacuacuguguuaugc

SEQ ID NO: 3612735 - RNA, 15 nt, Human
caacuagacauucug

SEQ ID NO: 3612736 - RNA, 18 nt, Human
caacuagccccuggggug

SEQ ID NO: 3612737 - RNA, 19 nt, Human
caacuauauuguuugcuaa

SEQ ID NO: 3612738 - RNA, 21 nt, Human
caacuaucagacuaagccagc

SEQ ID NO: 3612739 - RNA, 19 nt, Human
caacuaucucauuuccaag

SEQ ID NO: 3612740 - RNA, 22 nt, Human
caacuaugauaugguaaaaguu

SEQ ID NO: 3612741 - RNA, 23 nt, Human
caggugaucugcugcagagcagu

SEQ ID NO: 3612742 - RNA, 18 nt, Human
caggugcaaccagggagc

SEQ ID NO: 3612743 - RNA, 24 nt, Human
caggugcaaccagggagcugcagg

SEQ ID NO: 3612744 - RNA, 17 nt, Human
caggugcacaagcucca

SEQ ID NO: 3612745 - RNA, 19 nt, Human
caggugcacaagcuccaag

SEQ ID NO: 3612746 - RNA, 22 nt, Human
caggugcacaagcuccaagcuc

SEQ ID NO: 3612747 - RNA, 14 nt, Human
caggugcagaggaa

SEQ ID NO: 3612748 - RNA, 19 nt, Human
caggugcagaggaaguaca

SEQ ID NO: 3612749 - RNA, 16 nt, Human
caggugcagagguacc

SEQ ID NO: 3612750 - RNA, 23 nt, Human
caggugcccagcuauaccugugc

SEQ ID NO: 3612751 - RNA, 17 nt, Human
caggugcccaucccugg

SEQ ID NO: 3612752 - RNA, 16 nt, Human
caggugccccucucuc

SEQ ID NO: 3612753 - RNA, 22 nt, Human
caggugccccucucuccaucag

SEQ ID NO: 3612754 - RNA, 13 nt, Human
caggugccuccag

SEQ ID NO: 3612755 - RNA, 15 nt, Human
caggugccuccaggu

SEQ ID NO: 3612756 - RNA, 16 nt, Human
caggugccuccaggug

SEQ ID NO: 3612757 - RNA, 15 nt, Human
caggugccuccugac

SEQ ID NO: 3612758 - RNA, 15 nt, Human
caggugccuggacau

SEQ ID NO: 3612759 - RNA, 13 nt, Human
caggugccuugga

SEQ ID NO: 3612760 - RNA, 14 nt, Human
caggugccuuggag

SEQ ID NO: 3612761 - RNA, 14 nt, Human
caggugccuuucaa

SEQ ID NO: 3612762 - RNA, 14 nt, Human
caggugcugccauc

SEQ ID NO: 3612763 - RNA, 21 nt, Human
caggugcugcuacccucccug

SEQ ID NO: 3612764 - RNA, 18 nt, Human
caggugcuggagcacugg

SEQ ID NO: 3612765 - RNA, 23 nt, Human
caggugcuggagcacugggcucc

SEQ ID NO: 3612766 - RNA, 14 nt, Human
caggugcugguccc

SEQ ID NO: 3612767 - RNA, 17 nt, Human
cagguggagguggcauc

SEQ ID NO: 3612768 - RNA, 18 nt, Human
cagguggcaggaccagga

SEQ ID NO: 3612769 - RNA, 18 nt, Human
cagguggccaaguuccuc

SEQ ID NO: 3612770 - RNA, 19 nt, Human
cagguggccacuccagacc

SEQ ID NO: 3612771 - RNA, 21 nt, Human
cagguggccacuccagacccc

SEQ ID NO: 3612772 - RNA, 16 nt, Human
cagguggcugacccag

SEQ ID NO: 3612773 - RNA, 23 nt, Human
cagguggcugacccagucccugg

SEQ ID NO: 3612774 - RNA, 12 nt, Human
caggugggcugg

SEQ ID NO: 3612775 - RNA, 22 nt, Human
caggugggcuggacuucuaccu

SEQ ID NO: 3612776 - RNA, 23 nt, Human
caggugggcuggacuucuaccug

SEQ ID NO: 3612777 - RNA, 20 nt, Human
cagguggggagacugggcug

SEQ ID NO: 3612778 - RNA, 15 nt, Human
cagguggggaggggg

SEQ ID NO: 3612779 - RNA, 15 nt, Human
cagguggggcagcuu

SEQ ID NO: 3612780 - RNA, 17 nt, Human
cagguggggcagcuuga

SEQ ID NO: 3612781 - RNA, 17 nt, Human
cagguggggguugcugu

SEQ ID NO: 3612782 - RNA, 21 nt, Human
cagguggggguugcuguauaa

SEQ ID NO: 3612783 - RNA, 18 nt, Human
cagguggggucacucugg

SEQ ID NO: 3612784 - RNA, 17 nt, Human
cagguggggugaggcag

SEQ ID NO: 3612785 - RNA, 21 nt, Human
cagguggugagaaauuucugu

SEQ ID NO: 3612786 - RNA, 15 nt, Human
caggugguggcacug

SEQ ID NO: 3612787 - RNA, 16 nt, Human
cagguggugucacugu

SEQ ID NO: 3612788 - RNA, 17 nt, Human
caggugucagccauugc

SEQ ID NO: 3612789 - RNA, 15 nt, Human
cagguguccccagcc

SEQ ID NO: 3612790 - RNA, 17 nt, Human
cagguguccccagccca

SEQ ID NO: 3612791 - RNA, 21 nt, Human
cagguguccccagcccacugg

SEQ ID NO: 3612792 - RNA, 15 nt, Human
caggugucccugcac

SEQ ID NO: 3612793 - RNA, 16 nt, Human
caggugugaaccacca

SEQ ID NO: 3612794 - RNA, 23 nt, Human
caggugugaaccaccacacccag

SEQ ID NO: 3612795 - RNA, 23 nt, Human
caggugugagccaccacaccugg

SEQ ID NO: 3612796 - RNA, 22 nt, Human
caggugugagucaccaagccca

SEQ ID NO: 3612797 - RNA, 15 nt, Human
caggugugcacgugg

SEQ ID NO: 3612798 - RNA, 19 nt, Human
caggugugccgacagaagg

SEQ ID NO: 3612799 - RNA, 17 nt, Human
cagguguuaacauucca

SEQ ID NO: 3612800 - RNA, 19 nt, Human
cagguguuaacauuccaag

SEQ ID NO: 3612801 - RNA, 20 nt, Human
cagguguuaacauuccaaga

SEQ ID NO: 3612802 - RNA, 12 nt, Human
cagguguucuuc

SEQ ID NO: 3612803 - RNA, 16 nt, Human
cagguguuuaguugca

SEQ ID NO: 3612804 - RNA, 12 nt, Human
cagguguuuaua

SEQ ID NO: 3612805 - RNA, 20 nt, Human
cagguguuuauaucuccuuu

SEQ ID NO: 3612806 - RNA, 13 nt, Human
cagguuaaauguu

SEQ ID NO: 3612807 - RNA, 14 nt, Human
cagguuacaacaga

SEQ ID NO: 3612808 - RNA, 17 nt, Human
cagguuacaacagauuu

SEQ ID NO: 3612809 - RNA, 21 nt, Human
cagguuacaacagauuuguga

SEQ ID NO: 3612810 - RNA, 22 nt, Human
cagguuacaacagauuugugaa

SEQ ID NO: 3612811 - RNA, 23 nt, Human
cagguuacaacagauuugugaac

SEQ ID NO: 3612812 - RNA, 23 nt, Human
cagguuagaaccuagaagggcua

SEQ ID NO: 3612813 - RNA, 12 nt, Human
cagguuagagaa

SEQ ID NO: 3612814 - RNA, 22 nt, Human
cagguuaggcaguauaaagaau

SEQ ID NO: 3612815 - RNA, 17 nt, Human
cagguuauacuccuccu

SEQ ID NO: 3612816 - RNA, 19 nt, Human
cagguuaucgaaauaacaa

SEQ ID NO: 3612817 - RNA, 19 nt, Human
cagguucaacccacagcua

SEQ ID NO: 3612818 - RNA, 13 nt, Human
cagguucauggau

SEQ ID NO: 3612819 - RNA, 14 nt, Human
cagguucccaagcu

SEQ ID NO: 3612820 - RNA, 15 nt, Human
cagguucccucccag

SEQ ID NO: 3612821 - RNA, 18 nt, Human
cagguucccucccagagg

SEQ ID NO: 3612822 - RNA, 16 nt, Human
cagguucuauuuggaa

SEQ ID NO: 3612823 - RNA, 19 nt, Human
cagguucuauuuggaauuu

SEQ ID NO: 3612824 - RNA, 20 nt, Human
cagguucuccguuagcuccu

SEQ ID NO: 3612825 - RNA, 21 nt, Human
cagguucuccguuagcuccug

SEQ ID NO: 3612826 - RNA, 22 nt, Human
cagguucuccguuagcuccugu

SEQ ID NO: 3612827 - RNA, 23 nt, Human
cagguucuccguuagcuccugug

SEQ ID NO: 3612828 - RNA, 18 nt, Human
cagguucugaaagagucu

SEQ ID NO: 3612829 - RNA, 20 nt, Human
cagguucugguuagcucagc

SEQ ID NO: 3612830 - RNA, 22 nt, Human
cagguucugguuagcucagccc

SEQ ID NO: 3612831 - RNA, 18 nt, Human
cagguucuucuuccugaa

SEQ ID NO: 3612832 - RNA, 12 nt, Human
cagguucuuguu

SEQ ID NO: 3612833 - RNA, 18 nt, Human
cagguucuuguuggugca

SEQ ID NO: 3612834 - RNA, 23 nt, Human
cagguugaagaccuaaccagggc

SEQ ID NO: 3612835 - RNA, 16 nt, Human
cagguugacaggaggu

SEQ ID NO: 3612836 - RNA, 18 nt, Human
cagguugauaaaucauuu

SEQ ID NO: 3612837 - RNA, 19 nt, Human
cagguugcugguugcugug

SEQ ID NO: 3612838 - RNA, 17 nt, Human
cagguugcuuugcccug

SEQ ID NO: 3612839 - RNA, 18 nt, Human
cagguugcuuugcccugg

SEQ ID NO: 3612840 - RNA, 19 nt, Human
cagguugcuuugcccuggu

SEQ ID NO: 3612841 - RNA, 14 nt, Human
cagguuggacccca

SEQ ID NO: 3612842 - RNA, 17 nt, Human
cagguuggaccccagag

SEQ ID NO: 3612843 - RNA, 16 nt, Human
cagguuggcucugcca

SEQ ID NO: 3612844 - RNA, 22 nt, Human
cagguuggcucugccaguccug

SEQ ID NO: 3612845 - RNA, 17 nt, Human
cagguugggccauacug

SEQ ID NO: 3612846 - RNA, 21 nt, Human
cagguuggugggggccucggu

SEQ ID NO: 3612847 - RNA, 22 nt, Human
caagaaaaauaaagaaaagaug

SEQ ID NO: 3612848 - RNA, 18 nt, Human
caagaaaacaacuucaau

SEQ ID NO: 3612849 - RNA, 20 nt, Human
caagaaaacaggcacugccc

SEQ ID NO: 3612850 - RNA, 22 nt, Human
caagaaaacaggcacugcccug

SEQ ID NO: 3612851 - RNA, 20 nt, Human
caagaaaauaagagcucagg

SEQ ID NO: 3612852 - RNA, 20 nt, Human
caagaaacaaacaaaagcug

SEQ ID NO: 3612853 - RNA, 13 nt, Human
caagaaacagcca

SEQ ID NO: 3612854 - RNA, 14 nt, Human
caagaaacagccag

SEQ ID NO: 3612855 - RNA, 15 nt, Human
caagaaacucacccc

SEQ ID NO: 3612856 - RNA, 17 nt, Human
caagaaacucaccccca

SEQ ID NO: 3612857 - RNA, 18 nt, Human
caagaaacugaggaauuu

SEQ ID NO: 3612858 - RNA, 22 nt, Human
caagaaagaaacccgacagagg

SEQ ID NO: 3612859 - RNA, 19 nt, Human
caagaaagccagucuuaac

SEQ ID NO: 3612860 - RNA, 16 nt, Human
caagaaagcugguaaa

SEQ ID NO: 3612861 - RNA, 14 nt, Human
caagaaaggagagu

SEQ ID NO: 3612862 - RNA, 21 nt, Human
caagaaaggagagucuugcag

SEQ ID NO: 3612863 - RNA, 12 nt, Human
caagaaagucca

SEQ ID NO: 3612864 - RNA, 13 nt, Human
caagaaaguuucc

SEQ ID NO: 3612865 - RNA, 14 nt, Human
caagaaaguuuccc

SEQ ID NO: 3612866 - RNA, 19 nt, Human
caagaaauaaaaggaagcc

SEQ ID NO: 3612867 - RNA, 20 nt, Human
caagaaauaaaaggaagcca

SEQ ID NO: 3612868 - RNA, 13 nt, Human
caagaaaugaaga

SEQ ID NO: 3612869 - RNA, 16 nt, Human
caagaaauuugauuuc

SEQ ID NO: 3612870 - RNA, 14 nt, Human
caagaacagcaggc

SEQ ID NO: 3612871 - RNA, 16 nt, Human
caagaacucaucacug

SEQ ID NO: 3612872 - RNA, 21 nt, Human
caagaacugaaaacauaaaaa

SEQ ID NO: 3612873 - RNA, 12 nt, Human
caagaacugcau

SEQ ID NO: 3612874 - RNA, 16 nt, Human
caagaacugcauggac

SEQ ID NO: 3612875 - RNA, 23 nt, Human
caagaacugcauggaccuaacau

SEQ ID NO: 3612876 - RNA, 17 nt, Human
caagaagaauuugaaga

SEQ ID NO: 3612877 - RNA, 12 nt, Human
caagaagacaug

SEQ ID NO: 3612878 - RNA, 18 nt, Human
caagaagacauggagacu

SEQ ID NO: 3612879 - RNA, 13 nt, Human
caagaagcaggcu

SEQ ID NO: 3612880 - RNA, 20 nt, Human
caagaagcaggcuacacuga

SEQ ID NO: 3612881 - RNA, 17 nt, Human
caagaagcauuuuguaa

SEQ ID NO: 3612882 - RNA, 22 nt, Human
caagaagcuuuaauauuuaaau

SEQ ID NO: 3612883 - RNA, 12 nt, Human
caagaaggcugg

SEQ ID NO: 3612884 - RNA, 16 nt, Human
caagaagggacugaga

SEQ ID NO: 3612885 - RNA, 23 nt, Human
caagaagggcuagaaccuggagg

SEQ ID NO: 3612886 - RNA, 17 nt, Human
caagaagggcugcauga

SEQ ID NO: 3612887 - RNA, 19 nt, Human
caagaagucaaaguaaaac

SEQ ID NO: 3612888 - RNA, 14 nt, Human
caagaaguuuauuc

SEQ ID NO: 3612889 - RNA, 17 nt, Human
caagaaguuuauucuca

SEQ ID NO: 3612890 - RNA, 19 nt, Human
caagaauaaaggcagcugu

SEQ ID NO: 3612891 - RNA, 23 nt, Human
caagaauaauucaauuuuaaaga

SEQ ID NO: 3612892 - RNA, 18 nt, Human
caagaauagaugcugacu

SEQ ID NO: 3612893 - RNA, 19 nt, Human
caagaauagcaucuguaca

SEQ ID NO: 3612894 - RNA, 14 nt, Human
caagaauccacauu

SEQ ID NO: 3612895 - RNA, 22 nt, Human
caagaauccacauuucuaaaau

SEQ ID NO: 3612896 - RNA, 14 nt, Human
caagaaugcauuga

SEQ ID NO: 3612897 - RNA, 14 nt, Human
caagaaugcugaaa

SEQ ID NO: 3612898 - RNA, 16 nt, Human
caagaaugcugaaacc

SEQ ID NO: 3612899 - RNA, 21 nt, Human
caagaauggaucacaagaugg

SEQ ID NO: 3612900 - RNA, 21 nt, Human
caagaauggggaucacagaga

SEQ ID NO: 3612901 - RNA, 20 nt, Human
caagaaugguggcuucuuuu

SEQ ID NO: 3612902 - RNA, 21 nt, Human
caagaauuuccuguuggauuu

SEQ ID NO: 3612903 - RNA, 22 nt, Human
caagaauuucuugguaagaagc

SEQ ID NO: 3612904 - RNA, 23 nt, Human
caagaauuucuugguaagaagcc

SEQ ID NO: 3612905 - RNA, 18 nt, Human
caucuggauaggagccug

SEQ ID NO: 3612906 - RNA, 22 nt, Human
caucuggauaggagccugcugg

SEQ ID NO: 3612907 - RNA, 20 nt, Human
caucuggcaacaucuuuauc

SEQ ID NO: 3612908 - RNA, 17 nt, Human
caucuggccuggccagu

SEQ ID NO: 3612909 - RNA, 16 nt, Human
caucuggccuggccug

SEQ ID NO: 3612910 - RNA, 18 nt, Human
caucuggccuggccuggc

SEQ ID NO: 3612911 - RNA, 11 nt, Human
caucuggccuu

SEQ ID NO: 3612912 - RNA, 14 nt, Human
caucugggaaagac

SEQ ID NO: 3612913 - RNA, 19 nt, Human
caucugggaguccccuuuu

SEQ ID NO: 3612914 - RNA, 16 nt, Human
caucugggauucccac

SEQ ID NO: 3612915 - RNA, 13 nt, Human
caucugggcuccu

SEQ ID NO: 3612916 - RNA, 16 nt, Human
caucuggguagcugua

SEQ ID NO: 3612917 - RNA, 23 nt, Human
caucugguagaagggaaagccca

SEQ ID NO: 3612918 - RNA, 22 nt, Human
caucugguugaacucugguggc

SEQ ID NO: 3612919 - RNA, 12 nt, Human
caucuguacaaa

SEQ ID NO: 3612920 - RNA, 20 nt, Human
caucugucccuccgggaccu

SEQ ID NO: 3612921 - RNA, 12 nt, Human
caucuguccuca

SEQ ID NO: 3612922 - RNA, 16 nt, Human
caucugucuggagggg

SEQ ID NO: 3612923 - RNA, 15 nt, Human
caucugugcacgcag

SEQ ID NO: 3612924 - RNA, 17 nt, Human
caucuguggacugaccu

SEQ ID NO: 3612925 - RNA, 14 nt, Human
caucuguguccugg

SEQ ID NO: 3612926 - RNA, 11 nt, Human
caucugugucu

SEQ ID NO: 3612927 - RNA, 13 nt, Human
caucugugucuug

SEQ ID NO: 3612928 - RNA, 15 nt, Human
caucuguuagggccu

SEQ ID NO: 3612929 - RNA, 12 nt, Human
caucuguuguuu

SEQ ID NO: 3612930 - RNA, 20 nt, Human
caucuuaaaagcuaucuuca

SEQ ID NO: 3612931 - RNA, 13 nt, Human
caucuuaacucuu

SEQ ID NO: 3612932 - RNA, 15 nt, Human
caucuuaagagaugc

SEQ ID NO: 3612933 - RNA, 13 nt, Human
caucuuacugaag

SEQ ID NO: 3612934 - RNA, 15 nt, Human
caucuuacugaaggu

SEQ ID NO: 3612935 - RNA, 15 nt, Human
caucuuauagcacuu

SEQ ID NO: 3612936 - RNA, 18 nt, Human
caucuuaucaaggacucu

SEQ ID NO: 3612937 - RNA, 20 nt, Human
caucuuaugcuaacuguaga

SEQ ID NO: 3612938 - RNA, 14 nt, Human
caucuucacuucua

SEQ ID NO: 3612939 - RNA, 22 nt, Human
caucuuccaaggguacuaagga

SEQ ID NO: 3612940 - RNA, 19 nt, Human
caucuuccagaagugugau

SEQ ID NO: 3612941 - RNA, 21 nt, Human
caucuuccagguggggugagg

SEQ ID NO: 3612942 - RNA, 23 nt, Human
caucuuccccaacgaaaagcaca

SEQ ID NO: 3612943 - RNA, 22 nt, Human
caucuucccuagaggguuccug

SEQ ID NO: 3612944 - RNA, 12 nt, Human
caucuuccugug

SEQ ID NO: 3612945 - RNA, 19 nt, Human
caucuucgucuucacucuu

SEQ ID NO: 3612946 - RNA, 18 nt, Human
caucuucucagcucccau

SEQ ID NO: 3612947 - RNA, 16 nt, Human
caucuucuccaucugg

SEQ ID NO: 3612948 - RNA, 19 nt, Human
caucuucuggagucuccag

SEQ ID NO: 3612949 - RNA, 22 nt, Human
caucuucuggagucuccagugg

SEQ ID NO: 3612950 - RNA, 14 nt, Human
caucuucuucacca

SEQ ID NO: 3612951 - RNA, 19 nt, Human
caucuucuucaccauuugg

SEQ ID NO: 3612952 - RNA, 21 nt, Human
caucuucuuugcagccugggu

SEQ ID NO: 3612953 - RNA, 22 nt, Human
caucuucuuuuugaaaucagca

SEQ ID NO: 3612954 - RNA, 13 nt, Human
caucuugaauccu

SEQ ID NO: 3612955 - RNA, 18 nt, Human
caucuugaauccuuccau

SEQ ID NO: 3612956 - RNA, 23 nt, Human
caucuugaauccuuccauuccac

SEQ ID NO: 3612957 - RNA, 22 nt, Human
caucuugacagagccugcccca

SEQ ID NO: 3612958 - RNA, 16 nt, Human
caucuugaccaagcag

SEQ ID NO: 3612959 - RNA, 17 nt, Human
caucuugaccaagcagg

SEQ ID NO: 3612960 - RNA, 18 nt, Human
caucuugaccaagcagga

SEQ ID NO: 3612961 - RNA, 20 nt, Human
caucuugaccaagcaggaag

SEQ ID NO: 3612962 - RNA, 23 nt, Human
caucuugaucugcucagcccugg

SEQ ID NO: 3612963 - RNA, 20 nt, Human
caucuugcccgcucaggcug

SEQ ID NO: 3612964 - RNA, 12 nt, Human
caucuugcuacc

SEQ ID NO: 3612965 - RNA, 18 nt, Human
caucuugcuaccaguauu

SEQ ID NO: 3612966 - RNA, 20 nt, Human
caucuugcuaccaguauuua

SEQ ID NO: 3612967 - RNA, 14 nt, Human
caucuugcucugcu

SEQ ID NO: 3612968 - RNA, 19 nt, Human
caucuugcucugcugacag

SEQ ID NO: 3612969 - RNA, 14 nt, Human
caucuugcuggcua

SEQ ID NO: 3612970 - RNA, 15 nt, Human
caucuugcuucccua

SEQ ID NO: 3612971 - RNA, 16 nt, Human
caucuuggagggacca

SEQ ID NO: 3612972 - RNA, 18 nt, Human
caucuuggggacaucucu

SEQ ID NO: 3612973 - RNA, 12 nt, Human
caucuugugaaa

SEQ ID NO: 3612974 - RNA, 17 nt, Human
caucuuuaaacaguauu

SEQ ID NO: 3612975 - RNA, 22 nt, Human
caucuuuacaaaacuacaugag

SEQ ID NO: 3612976 - RNA, 17 nt, Human
caucuuuaucuguucuu

SEQ ID NO: 3612977 - RNA, 14 nt, Human
caucuuucacacuu

SEQ ID NO: 3612978 - RNA, 18 nt, Human
caucuuucccuccuuggu

SEQ ID NO: 3612979 - RNA, 21 nt, Human
caucuuuccugauggcaggau

SEQ ID NO: 3612980 - RNA, 11 nt, Human
caucuuucucu

SEQ ID NO: 3612981 - RNA, 21 nt, Human
caucuuucuucuauuuuauuc

SEQ ID NO: 3612982 - RNA, 16 nt, Human
caucuuugauguguug

SEQ ID NO: 3612983 - RNA, 18 nt, Human
caucuuuggggagguguu

SEQ ID NO: 3612984 - RNA, 21 nt, Human
caucuuuggggagguguucac

SEQ ID NO: 3612985 - RNA, 22 nt, Human
caucuuugugaaggccucgcag

SEQ ID NO: 3612986 - RNA, 13 nt, Human
caucuuuuaaaga

SEQ ID NO: 3612987 - RNA, 17 nt, Human
caucuuuuauucuuuuu

SEQ ID NO: 3612988 - RNA, 13 nt, Human
caucuuuuguauu

SEQ ID NO: 3612989 - RNA, 19 nt, Human
caucuuuuguauuaagaaa

SEQ ID NO: 3612990 - RNA, 14 nt, Human
caucuuuugugaga

SEQ ID NO: 3612991 - RNA, 11 nt, Human
caucuuuuuaa

SEQ ID NO: 3612992 - RNA, 18 nt, Human
caguugcccagccucuuu

SEQ ID NO: 3612993 - RNA, 19 nt, Human
caguugcccagccucuuuc

SEQ ID NO: 3612994 - RNA, 21 nt, Human
caguugcccagccucuuuccc

SEQ ID NO: 3612995 - RNA, 16 nt, Human
caguugcuaaacacug

SEQ ID NO: 3612996 - RNA, 18 nt, Human
caguugcugcuucaauuu

SEQ ID NO: 3612997 - RNA, 14 nt, Human
caguugcugguaaa

SEQ ID NO: 3612998 - RNA, 17 nt, Human
caguugcugguaaaaug

SEQ ID NO: 3612999 - RNA, 18 nt, Human
caguugcugguaaaauga

SEQ ID NO: 3613000 - RNA, 21 nt, Human
caguugcugguaaaaugaaga

SEQ ID NO: 3613001 - RNA, 13 nt, Human
caguugcuugucu

SEQ ID NO: 3613002 - RNA, 21 nt, Human
caguuggagcuccagccugac

SEQ ID NO: 3613003 - RNA, 15 nt, Human
caguugggagcacug

SEQ ID NO: 3613004 - RNA, 20 nt, Human
caguugggagcacuggagug

SEQ ID NO: 3613005 - RNA, 16 nt, Human
caguugguaacuuuug

SEQ ID NO: 3613006 - RNA, 18 nt, Human
caguuggucccccuucca

SEQ ID NO: 3613007 - RNA, 21 nt, Human
caguuggucccccuuccaugg

SEQ ID NO: 3613008 - RNA, 14 nt, Human
caguuguagaaugu

SEQ ID NO: 3613009 - RNA, 15 nt, Human
caguuguagaaugua

SEQ ID NO: 3613010 - RNA, 17 nt, Human
caguuguagaauguauu

SEQ ID NO: 3613011 - RNA, 18 nt, Human
caguuguagaauguauug

SEQ ID NO: 3613012 - RNA, 21 nt, Human
caguuguagaauguauuguac

SEQ ID NO: 3613013 - RNA, 18 nt, Human
caguuguauuuaacagaa

SEQ ID NO: 3613014 - RNA, 21 nt, Human
caguuguauuuaacagaaauu

SEQ ID NO: 3613015 - RNA, 23 nt, Human
caguuguguuuguugcuggcuug

SEQ ID NO: 3613016 - RNA, 18 nt, Human
caguuguuagugugucuu

SEQ ID NO: 3613017 - RNA, 19 nt, Human
caguuguuauuuauugaaa

SEQ ID NO: 3613018 - RNA, 13 nt, Human
caguuguucuuuu

SEQ ID NO: 3613019 - RNA, 15 nt, Human
caguuguucuuuuua

SEQ ID NO: 3613020 - RNA, 14 nt, Human
caguuguuggccuc

SEQ ID NO: 3613021 - RNA, 20 nt, Human
caguuguuggccuccggccu

SEQ ID NO: 3613022 - RNA, 13 nt, Human
caguuguuugaug

SEQ ID NO: 3613023 - RNA, 18 nt, Human
caguuguuuguuuuugcu

SEQ ID NO: 3613024 - RNA, 13 nt, Human
caguuguuuuccc

SEQ ID NO: 3613025 - RNA, 14 nt, Human
caguuguuuucccg

SEQ ID NO: 3613026 - RNA, 18 nt, Human
caguuuaaugaagaucua

SEQ ID NO: 3613027 - RNA, 19 nt, Human
caguuuaaugaagaucuaa

SEQ ID NO: 3613028 - RNA, 23 nt, Human
caguuuaccaguugccuuuuauc

SEQ ID NO: 3613029 - RNA, 19 nt, Human
caguuuagauuucaagaaa

SEQ ID NO: 3613030 - RNA, 19 nt, Human
caguuuauauuuaacucuc

SEQ ID NO: 3613031 - RNA, 19 nt, Human
caguuuaucaugaagccug

SEQ ID NO: 3613032 - RNA, 22 nt, Human
caguuuaucaugaagccugugg

SEQ ID NO: 3613033 - RNA, 13 nt, Human
caguuuaucauuc

SEQ ID NO: 3613034 - RNA, 18 nt, Human
caguuuaucauucaagug

SEQ ID NO: 3613035 - RNA, 13 nt, Human
caguuuauguuuu

SEQ ID NO: 3613036 - RNA, 18 nt, Human
caguuuauuccagagcug

SEQ ID NO: 3613037 - RNA, 19 nt, Human
caguuuauuugaaccaaua

SEQ ID NO: 3613038 - RNA, 14 nt, Human
caguuuauuuguug

SEQ ID NO: 3613039 - RNA, 18 nt, Human
caguuuauuuuuaaagau

SEQ ID NO: 3613040 - RNA, 21 nt, Human
caguuuauuuuuaaagauaga

SEQ ID NO: 3613041 - RNA, 16 nt, Human
caguuucaauaaaguu

SEQ ID NO: 3613042 - RNA, 18 nt, Human
caguuucaauucagugcu

SEQ ID NO: 3613043 - RNA, 14 nt, Human
caguuucacagaaa

SEQ ID NO: 3613044 - RNA, 23 nt, Human
caguuucacuuucacauagaugu

SEQ ID NO: 3613045 - RNA, 22 nt, Human
caguuucagguguuuaguugca

SEQ ID NO: 3613046 - RNA, 23 nt, Human
caguuucauaaaaggagaaccag

SEQ ID NO: 3613047 - RNA, 20 nt, Human
caguuucuaaacuggagacu

SEQ ID NO: 3613048 - RNA, 15 nt, Human
caguuucuguccugc

SEQ ID NO: 3613049 - RNA, 19 nt, Human
caguuucuguccugcuggu

SEQ ID NO: 3613050 - RNA, 15 nt, Human
caguuucuuagcuuu

SEQ ID NO: 3613051 - RNA, 18 nt, Human
caguuucuuagcuuuuua

SEQ ID NO: 3613052 - RNA, 16 nt, Human
caguuugaaauucuga

SEQ ID NO: 3613053 - RNA, 19 nt, Human
caguuugaaauucugaauu

SEQ ID NO: 3613054 - RNA, 23 nt, Human
caguuugcagaaaagcaccugcc

SEQ ID NO: 3613055 - RNA, 21 nt, Human
caguuugcuuuguaugcacuu

SEQ ID NO: 3613056 - RNA, 22 nt, Human
caguuuggagagucagaucuuu

SEQ ID NO: 3613057 - RNA, 20 nt, Human
caguuuggguaaaauacuuu

SEQ ID NO: 3613058 - RNA, 21 nt, Human
caguuuguaaauguuauuucu

SEQ ID NO: 3613059 - RNA, 21 nt, Human
caguuuguacagacguaugcu

SEQ ID NO: 3613060 - RNA, 16 nt, Human
caguuuuaacuagaau

SEQ ID NO: 3613061 - RNA, 17 nt, Human
caguuuuaacuguggau

SEQ ID NO: 3613062 - RNA, 20 nt, Human
caguuuuaacuguggauauu

SEQ ID NO: 3613063 - RNA, 15 nt, Human
caguuuuacucugcu

SEQ ID NO: 3613064 - RNA, 18 nt, Human
caguuuuauagcuuuauu

SEQ ID NO: 3613065 - RNA, 15 nt, Human
caguuuuaucauuuu

SEQ ID NO: 3613066 - RNA, 18 nt, Human
caguuuuauccacagaaa

SEQ ID NO: 3613067 - RNA, 15 nt, Human
caguuuuaugcucuu

SEQ ID NO: 3613068 - RNA, 23 nt, Human
caguuuucaagucaaauuaauaa

SEQ ID NO: 3613069 - RNA, 12 nt, Human
caguuuucauaa

SEQ ID NO: 3613070 - RNA, 13 nt, Human
caguuuuccauga

SEQ ID NO: 3613071 - RNA, 13 nt, Human
caguuuuccauug

SEQ ID NO: 3613072 - RNA, 22 nt, Human
caguuuuccuucucaucuguga

SEQ ID NO: 3613073 - RNA, 19 nt, Human
caguuuugacaucagccag

SEQ ID NO: 3613074 - RNA, 19 nt, Human
caguuuugguugcuuuaau

SEQ ID NO: 3613075 - RNA, 21 nt, Human
caguuuuguuuggaccaaaaa

SEQ ID NO: 3613076 - RNA, 19 nt, Human
caguuuuuaacucuacugu

SEQ ID NO: 3613077 - RNA, 13 nt, Human
caguuuuuauuaa

SEQ ID NO: 3613078 - RNA, 15 nt, Human
caguuuuuauugcuu

SEQ ID NO: 3613079 - RNA, 15 nt, Human
caguuuuucaggagc

SEQ ID NO: 3613080 - RNA, 16 nt, Human
caguuuuucuguauuu

SEQ ID NO: 3613081 - RNA, 17 nt, Human
caguuuuucuguauuuu

SEQ ID NO: 3613082 - RNA, 16 nt, Human
caguuuuucuuaauau

SEQ ID NO: 3613083 - RNA, 19 nt, Human
caguuuuucuuaauauaua

SEQ ID NO: 3613084 - RNA, 17 nt, Human
caguuuuuggaguguua

SEQ ID NO: 3613085 - RNA, 19 nt, Human
caguuuuuucaccuggaag

SEQ ID NO: 3613086 - RNA, 18 nt, Human
caguuuuuuuuuucuugu

SEQ ID NO: 3613087 - RNA, 21 nt, Human
caguuuuuuuuuucuugucua

SEQ ID NO: 3613088 - RNA, 14 nt, Human
cauaaaaaguuaaa

SEQ ID NO: 3613089 - RNA, 21 nt, Human
cauaaaaauuagccaagugug

SEQ ID NO: 3613090 - RNA, 22 nt, Human
cauaaaacauuaagaaaaucau

SEQ ID NO: 3613091 - RNA, 23 nt, Human
cauaaaacauuaagaaaaucaua

SEQ ID NO: 3613092 - RNA, 13 nt, Human
cauaaaauuggau

SEQ ID NO: 3613093 - RNA, 22 nt, Human
cauaaaauuuucuacucuuuuu

SEQ ID NO: 3613094 - RNA, 21 nt, Human
cauaaaccauuuuuguuacuc

SEQ ID NO: 3613095 - RNA, 14 nt, Human
cauaaaccuuaagu

SEQ ID NO: 3613096 - RNA, 21 nt, Human
cauaaagaagauguuuaacuu

SEQ ID NO: 3613097 - RNA, 13 nt, Human
cauaaagaauuug

SEQ ID NO: 3613098 - RNA, 14 nt, Human
cauaaagcaggcag

SEQ ID NO: 3613099 - RNA, 15 nt, Human
cauaaaggaaaagac

SEQ ID NO: 3613100 - RNA, 21 nt, Human
cauaaaggaaaagacacauuu

SEQ ID NO: 3613101 - RNA, 23 nt, Human
cauaaaggauaaacuuuuagaaa

SEQ ID NO: 3613102 - RNA, 20 nt, Human
cauaaaggugguaugugugu

SEQ ID NO: 3613103 - RNA, 21 nt, Human
cauaaagguuauuuucuccug

SEQ ID NO: 3613104 - RNA, 15 nt, Human
cauaaagucagugcc

SEQ ID NO: 3613105 - RNA, 14 nt, Human
cauaaagucuugcc

SEQ ID NO: 3613106 - RNA, 21 nt, Human
cauaaaguugauaaagauuuu

SEQ ID NO: 3613107 - RNA, 14 nt, Human
cauaaauaaaauga

SEQ ID NO: 3613108 - RNA, 22 nt, Human
cauaaauaaauuaaauaaaaua

SEQ ID NO: 3613109 - RNA, 13 nt, Human
cauaaauaugcag

SEQ ID NO: 3613110 - RNA, 18 nt, Human
cauaaauaugcagugaua

SEQ ID NO: 3613111 - RNA, 16 nt, Human
cauggugcccuggcuu

SEQ ID NO: 3613112 - RNA, 14 nt, Human
cauggugccucugg

SEQ ID NO: 3613113 - RNA, 14 nt, Human
cauggugccugaga

SEQ ID NO: 3613114 - RNA, 15 nt, Human
cauggugccugagag

SEQ ID NO: 3613115 - RNA, 16 nt, Human
cauggugccugagagg

SEQ ID NO: 3613116 - RNA, 17 nt, Human
cauggugccugagaggc

SEQ ID NO: 3613117 - RNA, 18 nt, Human
cauggugccugagaggca

SEQ ID NO: 3613118 - RNA, 19 nt, Human
cauggugccugagaggcag

SEQ ID NO: 3613119 - RNA, 21 nt, Human
cauggugccugagaggcaggc

SEQ ID NO: 3613120 - RNA, 13 nt, Human
cauggugcuagga

SEQ ID NO: 3613121 - RNA, 22 nt, Human
cauggugcuaggaagaggagug

SEQ ID NO: 3613122 - RNA, 15 nt, Human
caugguggggucucc

SEQ ID NO: 3613123 - RNA, 21 nt, Human
caugguggggucuccucagga

SEQ ID NO: 3613124 - RNA, 21 nt, Human
caugguggguccaugggcaga

SEQ ID NO: 3613125 - RNA, 22 nt, Human
caugguggguccaugggcagag

SEQ ID NO: 3613126 - RNA, 13 nt, Human
caugguguaauaa

SEQ ID NO: 3613127 - RNA, 14 nt, Human
caugguguaauaag

SEQ ID NO: 3613128 - RNA, 21 nt, Human
caugguguaauaagacauaac

SEQ ID NO: 3613129 - RNA, 14 nt, Human
caugguguucuccu

SEQ ID NO: 3613130 - RNA, 15 nt, Human
caugguguucuccug

SEQ ID NO: 3613131 - RNA, 17 nt, Human
caugguguucuccugcu

SEQ ID NO: 3613132 - RNA, 16 nt, Human
caugguuaagagucca

SEQ ID NO: 3613133 - RNA, 13 nt, Human
caugguuucagca

SEQ ID NO: 3613134 - RNA, 14 nt, Human
caugguuugacuca

SEQ ID NO: 3613135 - RNA, 14 nt, Human
caugguuuggagcu

SEQ ID NO: 3613136 - RNA, 19 nt, Human
caaugugaacuuuauuaaa

SEQ ID NO: 3613137 - RNA, 14 nt, Human
cauacuuucauccu

SEQ ID NO: 3613138 - RNA, 21 nt, Human
cauacuuucauccugacucug

SEQ ID NO: 3613139 - RNA, 22 nt, Human
cauacuuuguaaauaggauuuu

SEQ ID NO: 3613140 - RNA, 18 nt, Human
cauacuuuguauuuugau

SEQ ID NO: 3613141 - RNA, 13 nt, Human
cauacuuugucug

SEQ ID NO: 3613142 - RNA, 19 nt, Human
cauacuuuguuaggaaggg

SEQ ID NO: 3613143 - RNA, 22 nt, Human
cauacuuuuuaaauguaaagau

SEQ ID NO: 3613144 - RNA, 12 nt, Human
cauacuuuuugg

SEQ ID NO: 3613145 - RNA, 19 nt, Human
cauagaaaacacuacagug

SEQ ID NO: 3613146 - RNA, 16 nt, Human
cauagaaacaugacac

SEQ ID NO: 3613147 - RNA, 20 nt, Human
cauagaaacaugacacugac

SEQ ID NO: 3613148 - RNA, 23 nt, Human
cauagaaauggaaauuuugcuau

SEQ ID NO: 3613149 - RNA, 23 nt, Human
cauagaaauguagguccucagaa

SEQ ID NO: 3613150 - RNA, 21 nt, Human
cauagaaggaggagagggaaa

SEQ ID NO: 3613151 - RNA, 14 nt, Human
cauagaaggcaggu

SEQ ID NO: 3613152 - RNA, 16 nt, Human
cauagaaggcagguga

SEQ ID NO: 3613153 - RNA, 16 nt, Human
cauagaauagcauguu

SEQ ID NO: 3613154 - RNA, 18 nt, Human
cauagaauagcauguugu

SEQ ID NO: 3613155 - RNA, 22 nt, Human
cauagaauugcaaucuauaaua

SEQ ID NO: 3613156 - RNA, 16 nt, Human
cauagacaugaaaggu

SEQ ID NO: 3613157 - RNA, 17 nt, Human
cauagacuagagaaacc

SEQ ID NO: 3613158 - RNA, 23 nt, Human
cauagagagcaagacgcugugcu

SEQ ID NO: 3613159 - RNA, 18 nt, Human
cauagagagggagaagaa

SEQ ID NO: 3613160 - RNA, 17 nt, Human
cauagagauuugucuaa

SEQ ID NO: 3613161 - RNA, 20 nt, Human
cauagagccgggugucccca

SEQ ID NO: 3613162 - RNA, 19 nt, Human
cauagaggcuucuccgcca

SEQ ID NO: 3613163 - RNA, 20 nt, Human
cauagaggcuucuccgccag

SEQ ID NO: 3613164 - RNA, 18 nt, Human
cauagaguacacugccug

SEQ ID NO: 3613165 - RNA, 23 nt, Human
cauagagugacuccaagaacaau

SEQ ID NO: 3613166 - RNA, 19 nt, Human
cauagauaauauuguuugg

SEQ ID NO: 3613167 - RNA, 16 nt, Human
cauagauuaauggcac

SEQ ID NO: 3613168 - RNA, 17 nt, Human
cauagauucaccuguaa

SEQ ID NO: 3613169 - RNA, 20 nt, Human
cauagauuuauuuuucaguu

SEQ ID NO: 3613170 - RNA, 19 nt, Human
cauagauuucugauuuuau

SEQ ID NO: 3613171 - RNA, 14 nt, Human
cauagcaagacaca

SEQ ID NO: 3613172 - RNA, 23 nt, Human
cauagcaagauugcuuaaaauag

SEQ ID NO: 3613173 - RNA, 22 nt, Human
cauagcagagaaugaaagggcc

SEQ ID NO: 3613174 - RNA, 17 nt, Human
cauagcagaucuguuuu

SEQ ID NO: 3613175 - RNA, 16 nt, Human
cauagcagauuuuaau

SEQ ID NO: 3613176 - RNA, 17 nt, Human
cauagcagauuuuaauu

SEQ ID NO: 3613177 - RNA, 17 nt, Human
cauagcaugacauuucu

SEQ ID NO: 3613178 - RNA, 11 nt, Human
cauagcauuaa

SEQ ID NO: 3613179 - RNA, 14 nt, Human
cauagccaaaaugu

SEQ ID NO: 3613180 - RNA, 15 nt, Human
cauagccaggaaacu

SEQ ID NO: 3613181 - RNA, 13 nt, Human
cauagccauaaau

SEQ ID NO: 3613182 - RNA, 15 nt, Human
cauagcccaguagac

SEQ ID NO: 3613183 - RNA, 18 nt, Human
cauagccuaaucccuggg

SEQ ID NO: 3613184 - RNA, 21 nt, Human
cauagcuacccaaaagagaaa

SEQ ID NO: 3613185 - RNA, 20 nt, Human
cauagcuaucaagugugcuu

SEQ ID NO: 3613186 - RNA, 17 nt, Human
cauagcuccuucucucu

SEQ ID NO: 3613187 - RNA, 13 nt, Human
cauagcucugggg

SEQ ID NO: 3613188 - RNA, 20 nt, Human
cauagcucuggggugggcag

SEQ ID NO: 3613189 - RNA, 16 nt, Human
cauagcuguacuucuu

SEQ ID NO: 3613190 - RNA, 21 nt, Human
cauagcuguacuucuugaaua

SEQ ID NO: 3613191 - RNA, 15 nt, Human
cauagcugugauuuu

SEQ ID NO: 3613192 - RNA, 22 nt, Human
cauagcuuacaagccagcugga

SEQ ID NO: 3613193 - RNA, 20 nt, Human
cauagcuugauaaagggcca

SEQ ID NO: 3613194 - RNA, 12 nt, Human
cauaggaaaagu

SEQ ID NO: 3613195 - RNA, 18 nt, Human
cauaggaaaaguacauuu

SEQ ID NO: 3613196 - RNA, 19 nt, Human
cauaggaaaaguacauuua

SEQ ID NO: 3613197 - RNA, 22 nt, Human
cauaggaaaaguacauuuaaua

SEQ ID NO: 3613198 - RNA, 20 nt, Human
cauaggaguuuggaggaagu

SEQ ID NO: 3613199 - RNA, 20 nt, Human
cauaggcaccuuuuacugug

SEQ ID NO: 3613200 - RNA, 16 nt, Human
cauaggcccacacaca

SEQ ID NO: 3613201 - RNA, 18 nt, Human
cauaggcccacacacagg

SEQ ID NO: 3613202 - RNA, 21 nt, Human
cauaggcccacacacaggugg

SEQ ID NO: 3613203 - RNA, 13 nt, Human
cauaggcccagug

SEQ ID NO: 3613204 - RNA, 17 nt, Human
cauagguagaauguaaa

SEQ ID NO: 3613205 - RNA, 18 nt, Human
cauaggugauccauguaa

SEQ ID NO: 3613206 - RNA, 21 nt, Human
cauaggugauccauguaacug

SEQ ID NO: 3613207 - RNA, 16 nt, Human
cauagguuagauauag

SEQ ID NO: 3613208 - RNA, 16 nt, Human
cauagguuuaauaauu

SEQ ID NO: 3613209 - RNA, 13 nt, Human
cauaguaaaagaa

SEQ ID NO: 3613210 - RNA, 19 nt, Human
cauaguaaauguaguucau

SEQ ID NO: 3613211 - RNA, 20 nt, Human
cauaguaaauguaguucaua

SEQ ID NO: 3613212 - RNA, 24 nt, Human
cauaguaacuucuuauggaauuga

SEQ ID NO: 3613213 - RNA, 14 nt, Human
cauaguaagauuga

SEQ ID NO: 3613214 - RNA, 16 nt, Human
cauaguaccaaucauu

SEQ ID NO: 3613215 - RNA, 18 nt, Human
cauaguaccaaucauuuu

SEQ ID NO: 3613216 - RNA, 22 nt, Human
cauaguaccaaucauuuuaauu

SEQ ID NO: 3613217 - RNA, 20 nt, Human
cauaguagaacuuuauaaaa

SEQ ID NO: 3613218 - RNA, 13 nt, Human
cauaguaguuuuu

SEQ ID NO: 3613219 - RNA, 20 nt, Human
cauaguaguuuuuacagcug

SEQ ID NO: 3613220 - RNA, 15 nt, Human
cauaguaugguggcu

SEQ ID NO: 3613221 - RNA, 18 nt, Human
cauaguaugguggcuggg

SEQ ID NO: 3613222 - RNA, 21 nt, Human
cauaguauuccauugugugag

SEQ ID NO: 3613223 - RNA, 22 nt, Human
cauagucaccugacuaagaaau

SEQ ID NO: 3613224 - RNA, 23 nt, Human
cauagucauguaagcugaaaaua

SEQ ID NO: 3613225 - RNA, 12 nt, Human
cauagucccugc

SEQ ID NO: 3613226 - RNA, 20 nt, Human
cauagugagaccccugucuc

SEQ ID NO: 3613227 - RNA, 18 nt, Human
cauagugcuaacaugaag

SEQ ID NO: 3613228 - RNA, 13 nt, Human
cauagugcuggga

SEQ ID NO: 3613229 - RNA, 23 nt, Human
cauaguggacauuguuggcagca

SEQ ID NO: 3613230 - RNA, 19 nt, Human
cauaguuacuguaaaaugc

SEQ ID NO: 3613231 - RNA, 19 nt, Human
cauaguucguuuaccuuca

SEQ ID NO: 3613232 - RNA, 22 nt, Human
cauaguuggggucauagauguu

SEQ ID NO: 3613233 - RNA, 12 nt, Human
cauaguuucuuu

SEQ ID NO: 3613234 - RNA, 22 nt, Human
cauaguuucuuuauuuugugua

SEQ ID NO: 3613235 - RNA, 23 nt, Human
cauaguuucuuuauuuuguguaa

SEQ ID NO: 3613236 - RNA, 13 nt, Human
cauaguuuggcau

SEQ ID NO: 3613237 - RNA, 19 nt, Human
cauaguuuuaaacucauuu

SEQ ID NO: 3613238 - RNA, 19 nt, Human
cauaguuuuauuuauauuu

SEQ ID NO: 3613239 - RNA, 23 nt, Human
cauauaaaauaaugcaaagaauc

SEQ ID NO: 3613240 - RNA, 17 nt, Human
cauauaaaauggcaaca

SEQ ID NO: 3613241 - RNA, 20 nt, Human
cauauaaacaucacacacac

SEQ ID NO: 3613242 - RNA, 15 nt, Human
cauauaaauagaaug

SEQ ID NO: 3613243 - RNA, 16 nt, Human
cauauaaauagaaugu

SEQ ID NO: 3613244 - RNA, 21 nt, Human
cauauaaauagaauguaaaug

SEQ ID NO: 3613245 - RNA, 21 nt, Human
cauauaaauugucuuaaugga

SEQ ID NO: 3613246 - RNA, 23 nt, Human
cauauaagggaaguaguuaucau

SEQ ID NO: 3613247 - RNA, 15 nt, Human
cauauaauguuguua

SEQ ID NO: 3613248 - RNA, 18 nt, Human
cauauaauguuguuauuu

SEQ ID NO: 3613249 - RNA, 15 nt, Human
cauauaauuauaugu

SEQ ID NO: 3613250 - RNA, 16 nt, Human
cauauaauuauauguu

SEQ ID NO: 3613251 - RNA, 22 nt, Human
cauauaauuauauguuguaagc

SEQ ID NO: 3613252 - RNA, 13 nt, Human
cauauacacuugg

SEQ ID NO: 3613253 - RNA, 20 nt, Human
cauauaccuauaaugugugu

SEQ ID NO: 3613254 - RNA, 15 nt, Human
cauauagaaagcuuu

SEQ ID NO: 3613255 - RNA, 14 nt, Human
cauauagagaugaa

SEQ ID NO: 3613256 - RNA, 18 nt, Human
cauauagcaaaacuuuua

SEQ ID NO: 3613257 - RNA, 21 nt, Human
cauauagcaaaacuuuuaaac

SEQ ID NO: 3613258 - RNA, 20 nt, Human
cauauauaacaaugcuguau

SEQ ID NO: 3613259 - RNA, 17 nt, Human
cauauauauaugugugu

SEQ ID NO: 3613260 - RNA, 16 nt, Human
cauauauauuacaagg

SEQ ID NO: 3613261 - RNA, 22 nt, Human
cauauauccuuuucuucuaugu

SEQ ID NO: 3613262 - RNA, 21 nt, Human
cauauauggggggccaacacc

SEQ ID NO: 3613263 - RNA, 18 nt, Human
cauauauuggguuccauu

SEQ ID NO: 3613264 - RNA, 22 nt, Human
cauauauuuuuauauuuacuaa

SEQ ID NO: 3613265 - RNA, 16 nt, Human
cauauauuuuuuaaaa

SEQ ID NO: 3613266 - RNA, 20 nt, Human
cauauauuuuuuaaaauaag

SEQ ID NO: 3613267 - RNA, 20 nt, Human
cauaucaacuuagucaauaa

SEQ ID NO: 3613268 - RNA, 16 nt, Human
cauaucacacacauug

SEQ ID NO: 3613269 - RNA, 18 nt, Human
cauaucacacacauugcu

SEQ ID NO: 3613270 - RNA, 19 nt, Human
cauaucaccucauggccua

SEQ ID NO: 3613271 - RNA, 14 nt, Human
cauaucauccacac

SEQ ID NO: 3613272 - RNA, 14 nt, Human
cauaucaugcuuug

SEQ ID NO: 3613273 - RNA, 15 nt, Human
cauaucauguacagu

SEQ ID NO: 3613274 - RNA, 14 nt, Human
cauaucauuucuua

SEQ ID NO: 3613275 - RNA, 18 nt, Human
cauauccaguauuguucc

SEQ ID NO: 3613276 - RNA, 19 nt, Human
cauauccauagugacuuuu

SEQ ID NO: 3613277 - RNA, 14 nt, Human
cauaucccuuccag

SEQ ID NO: 3613278 - RNA, 15 nt, Human
cauaucccuuccaga

SEQ ID NO: 3613279 - RNA, 16 nt, Human
caucuggaguucucaa

SEQ ID NO: 3613280 - RNA, 16 nt, Human
caucuggauaggagcc

SEQ ID NO: 3613281 - RNA, 20 nt, Human
caucuggauaggagccugcu

SEQ ID NO: 3613282 - RNA, 16 nt, Human
caucuggauuccagag

SEQ ID NO: 3613283 - RNA, 11 nt, Human
caucuggccug

SEQ ID NO: 3613284 - RNA, 13 nt, Human
caucuggccuggc

SEQ ID NO: 3613285 - RNA, 18 nt, Human
caucuggccuggccagug

SEQ ID NO: 3613286 - RNA, 15 nt, Human
caucuggccuggccu

SEQ ID NO: 3613287 - RNA, 20 nt, Human
caucuggccuggccuggccc

SEQ ID NO: 3613288 - RNA, 21 nt, Human
caucuggccuggccuggcccu

SEQ ID NO: 3613289 - RNA, 23 nt, Human
caucuggccuggccuggcccugc

SEQ ID NO: 3613290 - RNA, 17 nt, Human
caucuggcuuauuuuaa

SEQ ID NO: 3613291 - RNA, 18 nt, Human
caucuggcuuauuuuaau

SEQ ID NO: 3613292 - RNA, 22 nt, Human
caucuggcuuauuuuaauguga

SEQ ID NO: 3613293 - RNA, 20 nt, Human
caucugggaacuugucacag

SEQ ID NO: 3613294 - RNA, 21 nt, Human
caucugggaagauuucuaccu

SEQ ID NO: 3613295 - RNA, 15 nt, Human
caucugggauuccca

SEQ ID NO: 3613296 - RNA, 15 nt, Human
caucugggccuuggc

SEQ ID NO: 3613297 - RNA, 11 nt, Human
caucugggcuc

SEQ ID NO: 3613298 - RNA, 20 nt, Human
caucugggcuccuccagggu

SEQ ID NO: 3613299 - RNA, 18 nt, Human
caucuggggagcaggcag

SEQ ID NO: 3613300 - RNA, 17 nt, Human
caucugggggaguggaa

SEQ ID NO: 3613301 - RNA, 19 nt, Human
caucugguuuucucuccag

SEQ ID NO: 3613302 - RNA, 15 nt, Human
caucuguaagcuguu

SEQ ID NO: 3613303 - RNA, 17 nt, Human
caucuguacuuggucca

SEQ ID NO: 3613304 - RNA, 12 nt, Human
caucuguagaua

SEQ ID NO: 3613305 - RNA, 14 nt, Human
caucuguagucagc

SEQ ID NO: 3613306 - RNA, 17 nt, Human
caucuguagucagccga

SEQ ID NO: 3613307 - RNA, 22 nt, Human
caucuguauaaguaagaaaaua

SEQ ID NO: 3613308 - RNA, 20 nt, Human
caucugucaccaauugguua

SEQ ID NO: 3613309 - RNA, 18 nt, Human
caucugucccuccgggac

SEQ ID NO: 3613310 - RNA, 17 nt, Human
caucugucccugccuca

SEQ ID NO: 3613311 - RNA, 18 nt, Human
caucugucuaaagauaga

SEQ ID NO: 3613312 - RNA, 18 nt, Human
caucugucuauauuuuau

SEQ ID NO: 3613313 - RNA, 15 nt, Human
caucugucuggaggg

SEQ ID NO: 3613314 - RNA, 14 nt, Human
caucugugaauaag

SEQ ID NO: 3613315 - RNA, 18 nt, Human
caucugugcacugcccau

SEQ ID NO: 3613316 - RNA, 14 nt, Human
caucugugucuugu

SEQ ID NO: 3613317 - RNA, 15 nt, Human
caucugugugaaaau

SEQ ID NO: 3613318 - RNA, 12 nt, Human
caucuguucugg

SEQ ID NO: 3613319 - RNA, 20 nt, Human
caucuguuguuuuguuuuaa

SEQ ID NO: 3613320 - RNA, 15 nt, Human
caucuuaaaaacaac

SEQ ID NO: 3613321 - RNA, 19 nt, Human
caucuuaacucuuugccuu

SEQ ID NO: 3613322 - RNA, 19 nt, Human
caucuuacuugagccuuua

SEQ ID NO: 3613323 - RNA, 17 nt, Human
caucuuagaccuccaca

SEQ ID NO: 3613324 - RNA, 18 nt, Human
caucuuauagcacuuuga

SEQ ID NO: 3613325 - RNA, 21 nt, Human
caucuuauagcacuuugaaau

SEQ ID NO: 3613326 - RNA, 14 nt, Human
caucuucaaagcuu

SEQ ID NO: 3613327 - RNA, 13 nt, Human
caucuucacccag

SEQ ID NO: 3613328 - RNA, 21 nt, Human
caucuucacuucuaaaugcau

SEQ ID NO: 3613329 - RNA, 13 nt, Human
caucuucagcuuc

SEQ ID NO: 3613330 - RNA, 14 nt, Human
caucuucagcuucu

SEQ ID NO: 3613331 - RNA, 14 nt, Human
caucuucaguuguc

SEQ ID NO: 3613332 - RNA, 15 nt, Human
caucuucaguugucu

SEQ ID NO: 3613333 - RNA, 22 nt, Human
caucuucaguugucucugaugc

SEQ ID NO: 3613334 - RNA, 19 nt, Human
caucuuccaacucaaacuc

SEQ ID NO: 3613335 - RNA, 21 nt, Human
caucuuccacaggucucagaa

SEQ ID NO: 3613336 - RNA, 12 nt, Human
caucuuccagaa

SEQ ID NO: 3613337 - RNA, 13 nt, Human
caucuuccagaag

SEQ ID NO: 3613338 - RNA, 18 nt, Human
caucuuccagaaguguga

SEQ ID NO: 3613339 - RNA, 21 nt, Human
caucuuccagaagugugauug

SEQ ID NO: 3613340 - RNA, 15 nt, Human
caucuuccugugucc

SEQ ID NO: 3613341 - RNA, 16 nt, Human
caucuuccuguguccu

SEQ ID NO: 3613342 - RNA, 15 nt, Human
caucuucgucuucac

SEQ ID NO: 3613343 - RNA, 21 nt, Human
cauuuacuuuguguucaccuu

SEQ ID NO: 3613344 - RNA, 15 nt, Human
cauuuagaaaauaga

SEQ ID NO: 3613345 - RNA, 13 nt, Human
cauuuagaagaaa

SEQ ID NO: 3613346 - RNA, 17 nt, Human
cauuuagaagaaagaug

SEQ ID NO: 3613347 - RNA, 21 nt, Human
cauuuagaauggugauuuuaa

SEQ ID NO: 3613348 - RNA, 20 nt, Human
cauuuagagaggaaaaguaa

SEQ ID NO: 3613349 - RNA, 21 nt, Human
cauuuagagaggaaaaguaac

SEQ ID NO: 3613350 - RNA, 20 nt, Human
cauuuagauugaaaacuuuu

SEQ ID NO: 3613351 - RNA, 22 nt, Human
cauuuagccaccaucuuugcag

SEQ ID NO: 3613352 - RNA, 22 nt, Human
cauuuagcuaaacggauuccaa

SEQ ID NO: 3613353 - RNA, 20 nt, Human
cauuuaggccaugggacagg

SEQ ID NO: 3613354 - RNA, 15 nt, Human
cauuuaguaagaaua

SEQ ID NO: 3613355 - RNA, 13 nt, Human
cauuuagucucuu

SEQ ID NO: 3613356 - RNA, 21 nt, Human
cauuuagucucuuuauuccua

SEQ ID NO: 3613357 - RNA, 23 nt, Human
cauuuagucucuuuauuccuagu

SEQ ID NO: 3613358 - RNA, 20 nt, Human
cauuuaguucuuuguuauuu

SEQ ID NO: 3613359 - RNA, 17 nt, Human
cauuuaguuugauuauu

SEQ ID NO: 3613360 - RNA, 21 nt, Human
cauuuauaaagcuaaaauaac

SEQ ID NO: 3613361 - RNA, 12 nt, Human
cauuuauauauu

SEQ ID NO: 3613362 - RNA, 15 nt, Human
cauuuauauuuuuau

SEQ ID NO: 3613363 - RNA, 12 nt, Human
cauuuaucauuc

SEQ ID NO: 3613364 - RNA, 21 nt, Human
cauuuaucuauaauuuaccua

SEQ ID NO: 3613365 - RNA, 23 nt, Human
cauuuaucuugaaggaaaaauuc

SEQ ID NO: 3613366 - RNA, 18 nt, Human
cauuuaugauuuaauaaa

SEQ ID NO: 3613367 - RNA, 20 nt, Human
cauuuaugguaaucauauua

SEQ ID NO: 3613368 - RNA, 18 nt, Human
cauuuaugugucaguuca

SEQ ID NO: 3613369 - RNA, 14 nt, Human
cauuuauguuuauu

SEQ ID NO: 3613370 - RNA, 19 nt, Human
cauuuauuuuuuacauuau

SEQ ID NO: 3613371 - RNA, 19 nt, Human
cauuuauuuuuuuuaaaga

SEQ ID NO: 3613372 - RNA, 18 nt, Human
cauuucaaaugugcuguc

SEQ ID NO: 3613373 - RNA, 14 nt, Human
cauuucaaugugua

SEQ ID NO: 3613374 - RNA, 18 nt, Human
cauuucaauguguauaaa

SEQ ID NO: 3613375 - RNA, 16 nt, Human
cauuucacaggcuaau

SEQ ID NO: 3613376 - RNA, 13 nt, Human
cauuucacauuaa

SEQ ID NO: 3613377 - RNA, 15 nt, Human
cauuucacauuaaug

SEQ ID NO: 3613378 - RNA, 15 nt, Human
cauuucaccccuccc

SEQ ID NO: 3613379 - RNA, 16 nt, Human
cauuucaccccucccu

SEQ ID NO: 3613380 - RNA, 17 nt, Human
cauuucaccccucccuu

SEQ ID NO: 3613381 - RNA, 18 nt, Human
cauuucaccccucccuuu

SEQ ID NO: 3613382 - RNA, 13 nt, Human
cauuucagaaguu

SEQ ID NO: 3613383 - RNA, 15 nt, Human
cauuucauaaacuaa

SEQ ID NO: 3613384 - RNA, 14 nt, Human
cauuucauccuuuc

SEQ ID NO: 3613385 - RNA, 16 nt, Human
cauuucaucucauuua

SEQ ID NO: 3613386 - RNA, 14 nt, Human
cauuucaugcucug

SEQ ID NO: 3613387 - RNA, 16 nt, Human
cauuucauguauaguu

SEQ ID NO: 3613388 - RNA, 21 nt, Human
cauuucauuccauugccuagc

SEQ ID NO: 3613389 - RNA, 23 nt, Human
cauuucauuguaugauguguugu

SEQ ID NO: 3613390 - RNA, 17 nt, Human
cauuuccaaauucacaa

SEQ ID NO: 3613391 - RNA, 13 nt, Human
cauuuccaacacc

SEQ ID NO: 3613392 - RNA, 18 nt, Human
cauuuccaacaccacaga

SEQ ID NO: 3613393 - RNA, 21 nt, Human
cauuuccaacaccacagacac

SEQ ID NO: 3613394 - RNA, 19 nt, Human
cauuuccacaccaagcagc

SEQ ID NO: 3613395 - RNA, 14 nt, Human
cauuuccauguaug

SEQ ID NO: 3613396 - RNA, 20 nt, Human
cauuucccaucugcaccccu

SEQ ID NO: 3613397 - RNA, 20 nt, Human
cauuucccccaccccauuuc

SEQ ID NO: 3613398 - RNA, 15 nt, Human
cauuuccccuccuuc

SEQ ID NO: 3613399 - RNA, 22 nt, Human
cauuuccucagacucuaagaaa

SEQ ID NO: 3613400 - RNA, 20 nt, Human
cauuuccugacagaaggacu

SEQ ID NO: 3613401 - RNA, 17 nt, Human
cauuuccugcccuuccu

SEQ ID NO: 3613402 - RNA, 21 nt, Human
cauuuccugcccuuccucagu

SEQ ID NO: 3613403 - RNA, 20 nt, Human
cauuuccuggguggcuacuc

SEQ ID NO: 3613404 - RNA, 12 nt, Human
cauuuccugugu

SEQ ID NO: 3613405 - RNA, 19 nt, Human
cauuucgugagccccaucu

SEQ ID NO: 3613406 - RNA, 14 nt, Human
cauuucuaaaagaa

SEQ ID NO: 3613407 - RNA, 22 nt, Human
cauuucuaaaagaauauucaga

SEQ ID NO: 3613408 - RNA, 23 nt, Human
cauuucuaacucugauguaaaug

SEQ ID NO: 3613409 - RNA, 11 nt, Human
cauuucuaauu

SEQ ID NO: 3613410 - RNA, 13 nt, Human
cauuucuaauuaa

SEQ ID NO: 3613411 - RNA, 22 nt, Human
cauuucuaccaaggcauaucau

SEQ ID NO: 3613412 - RNA, 21 nt, Human
cauuucuacucucccauggcu

SEQ ID NO: 3613413 - RNA, 23 nt, Human
cauuucuagaacaucccugccag

SEQ ID NO: 3613414 - RNA, 21 nt, Human
cauuucucauguuuuccauug

SEQ ID NO: 3613415 - RNA, 12 nt, Human
cauuucuccaga

SEQ ID NO: 3613416 - RNA, 12 nt, Human
cauuucuccguu

SEQ ID NO: 3613417 - RNA, 15 nt, Human
cauuucucuaagaga

SEQ ID NO: 3613418 - RNA, 10 nt, Human
cauuucucuc

SEQ ID NO: 3613419 - RNA, 15 nt, Human
cauuucucuccucac

SEQ ID NO: 3613420 - RNA, 11 nt, Human
cauuucucucu

SEQ ID NO: 3613421 - RNA, 17 nt, Human
cauuucucucuccaguc

SEQ ID NO: 3613422 - RNA, 18 nt, Human
cauuucugaggugcacug

SEQ ID NO: 3613423 - RNA, 21 nt, Human
cauuucugauauagaauugca

SEQ ID NO: 3613424 - RNA, 18 nt, Human
cacaggguugggcccaga

SEQ ID NO: 3613425 - RNA, 14 nt, Human
cacaggucaggcua

SEQ ID NO: 3613426 - RNA, 20 nt, Human
cacaggucaggggugacaca

SEQ ID NO: 3613427 - RNA, 21 nt, Human
cacaggucaggggugacacag

SEQ ID NO: 3613428 - RNA, 22 nt, Human
cacaggucaggggugacacaga

SEQ ID NO: 3613429 - RNA, 12 nt, Human
cacaggucccac

SEQ ID NO: 3613430 - RNA, 14 nt, Human
cacaggucccaccu

SEQ ID NO: 3613431 - RNA, 14 nt, Human
cacaggucuuuccu

SEQ ID NO: 3613432 - RNA, 20 nt, Human
cacaggucuuuccuaaggcu

SEQ ID NO: 3613433 - RNA, 16 nt, Human
cacagguggugucacu

SEQ ID NO: 3613434 - RNA, 14 nt, Human
cacaggugucagcc

SEQ ID NO: 3613435 - RNA, 17 nt, Human
cacaggugucagccauu

SEQ ID NO: 3613436 - RNA, 15 nt, Human
cacagguguuuauac

SEQ ID NO: 3613437 - RNA, 15 nt, Human
cacaguaaaaauaaa

SEQ ID NO: 3613438 - RNA, 17 nt, Human
cacaguaaaaauaaaau

SEQ ID NO: 3613439 - RNA, 13 nt, Human
cacaguaaauauc

SEQ ID NO: 3613440 - RNA, 17 nt, Human
cacaguacagcaugugc

SEQ ID NO: 3613441 - RNA, 18 nt, Human
cacaguacagcaugugcc

SEQ ID NO: 3613442 - RNA, 19 nt, Human
cacaguacgaaccuacagu

SEQ ID NO: 3613443 - RNA, 20 nt, Human
cacaguagaacugucuguga

SEQ ID NO: 3613444 - RNA, 16 nt, Human
cacaguauauuuuauu

SEQ ID NO: 3613445 - RNA, 18 nt, Human
cacaguauuacuucugcu

SEQ ID NO: 3613446 - RNA, 19 nt, Human
cacaguauuacuucugcua

SEQ ID NO: 3613447 - RNA, 21 nt, Human
cacaguauuacuucugcuaca

SEQ ID NO: 3613448 - RNA, 15 nt, Human
cacaguauuuguaau

SEQ ID NO: 3613449 - RNA, 14 nt, Human
cacagucaaaauaa

SEQ ID NO: 3613450 - RNA, 22 nt, Human
cacagucaccuucucggcaacu

SEQ ID NO: 3613451 - RNA, 19 nt, Human
cacagucacugauguacaa

SEQ ID NO: 3613452 - RNA, 14 nt, Human
cacagucagguuga

SEQ ID NO: 3613453 - RNA, 16 nt, Human
cacaguccaggaacaa

SEQ ID NO: 3613454 - RNA, 23 nt, Human
cacaguccuuaccagcagagcac

SEQ ID NO: 3613455 - RNA, 17 nt, Human
cacagucuaauuuuuau

SEQ ID NO: 3613456 - RNA, 14 nt, Human
cacagucucucucu

SEQ ID NO: 3613457 - RNA, 22 nt, Human
cacagucucuuuaaucuucagu

SEQ ID NO: 3613458 - RNA, 22 nt, Human
cacagugacucgggcuccugug

SEQ ID NO: 3613459 - RNA, 16 nt, Human
cacagugacuucugag

SEQ ID NO: 3613460 - RNA, 17 nt, Human
cacagugacuucugaga

SEQ ID NO: 3613461 - RNA, 19 nt, Human
cacagugagggagauccca

SEQ ID NO: 3613462 - RNA, 18 nt, Human
cacagugccuucaauaaa

SEQ ID NO: 3613463 - RNA, 16 nt, Human
cacagugcucuuuucu

SEQ ID NO: 3613464 - RNA, 14 nt, Human
cacagugggagcca

SEQ ID NO: 3613465 - RNA, 18 nt, Human
cacagugggagccagggc

SEQ ID NO: 3613466 - RNA, 20 nt, Human
cacagugggaugaaccagcc

SEQ ID NO: 3613467 - RNA, 17 nt, Human
cacagugucaggcacug

SEQ ID NO: 3613468 - RNA, 13 nt, Human
cacagugucuggg

SEQ ID NO: 3613469 - RNA, 14 nt, Human
cacagugucugggc

SEQ ID NO: 3613470 - RNA, 18 nt, Human
cacagugucuguaucgga

SEQ ID NO: 3613471 - RNA, 23 nt, Human
cacaguguguggucaacauuucu

SEQ ID NO: 3613472 - RNA, 13 nt, Human
cacaguguguuug

SEQ ID NO: 3613473 - RNA, 23 nt, Human
cacaguguuaaaugaaauuguaa

SEQ ID NO: 3613474 - RNA, 19 nt, Human
cacaguguugcccaggcug

SEQ ID NO: 3613475 - RNA, 16 nt, Human
cacaguguuggagguu

SEQ ID NO: 3613476 - RNA, 17 nt, Human
cacaguucaauucucau

SEQ ID NO: 3613477 - RNA, 19 nt, Human
cacaguucgaccugcggcu

SEQ ID NO: 3613478 - RNA, 15 nt, Human
cacaguucucuccuu

SEQ ID NO: 3613479 - RNA, 20 nt, Human
cacaguucuuugggccagac

SEQ ID NO: 3613480 - RNA, 18 nt, Human
cacaguugaagggagggg

SEQ ID NO: 3613481 - RNA, 23 nt, Human
cacaguugccaccaccucugugg

SEQ ID NO: 3613482 - RNA, 23 nt, Human
cacaguuggccuucagaaccauc

SEQ ID NO: 3613483 - RNA, 14 nt, Human
cacaguuuucugag

SEQ ID NO: 3613484 - RNA, 17 nt, Human
cacaguuuucugagaaa

SEQ ID NO: 3613485 - RNA, 21 nt, Human
cacaguuuucugagaaagacu

SEQ ID NO: 3613486 - RNA, 22 nt, Human
cacaguuuucugagaaagacua

SEQ ID NO: 3613487 - RNA, 21 nt, Human
cacaguuuucuggcuggagcc

SEQ ID NO: 3613488 - RNA, 19 nt, Human
cacaguuuugguugcuuua

SEQ ID NO: 3613489 - RNA, 12 nt, Human
cacauaaaacuu

SEQ ID NO: 3613490 - RNA, 19 nt, Human
cacauaagccaaaacugag

SEQ ID NO: 3613491 - RNA, 21 nt, Human
cacauaagccaaaacugagca

SEQ ID NO: 3613492 - RNA, 15 nt, Human
cacauaauuaacacu

SEQ ID NO: 3613493 - RNA, 22 nt, Human
cacauacaacacaaagagaaaa

SEQ ID NO: 3613494 - RNA, 15 nt, Human
cacauacacgaaaga

SEQ ID NO: 3613495 - RNA, 16 nt, Human
cacauacaguuuuaug

SEQ ID NO: 3613496 - RNA, 16 nt, Human
cacauacccugaccug

SEQ ID NO: 3613497 - RNA, 20 nt, Human
cacauagauuaauggcacug

SEQ ID NO: 3613498 - RNA, 22 nt, Human
cacauagauuaauggcacugau

SEQ ID NO: 3613499 - RNA, 17 nt, Human
cacauagauucaccugu

SEQ ID NO: 3613500 - RNA, 18 nt, Human
cacauagcauguaauggu

SEQ ID NO: 3613501 - RNA, 21 nt, Human
cacauagcccacuuacauuua

SEQ ID NO: 3613502 - RNA, 22 nt, Human
cacauagcuacccaaaagagaa

SEQ ID NO: 3613503 - RNA, 20 nt, Human
cacauaguucuccaguugua

SEQ ID NO: 3613504 - RNA, 22 nt, Human
cacauaguuuuuaagguuauuu

SEQ ID NO: 3613505 - RNA, 20 nt, Human
cacauaguuuuucagucuau

SEQ ID NO: 3613506 - RNA, 22 nt, Human
cacauauaaauguacuuuuucu

SEQ ID NO: 3613507 - RNA, 22 nt, Human
caugagcauuggauacagcagu

SEQ ID NO: 3613508 - RNA, 23 nt, Human
caugagcauuggauacagcagua

SEQ ID NO: 3613509 - RNA, 15 nt, Human
caugagccucagcau

SEQ ID NO: 3613510 - RNA, 19 nt, Human
caugagccucagcauccug

SEQ ID NO: 3613511 - RNA, 23 nt, Human
caugagccucagcauccuggcac

SEQ ID NO: 3613512 - RNA, 19 nt, Human
caugagccugcuggaagcc

SEQ ID NO: 3613513 - RNA, 23 nt, Human
caugagccugcuggaagcccagc

SEQ ID NO: 3613514 - RNA, 21 nt, Human
caugagcuccagacccccagc

SEQ ID NO: 3613515 - RNA, 23 nt, Human
caugagcuccagacccccagcaa

SEQ ID NO: 3613516 - RNA, 14 nt, Human
caugagcuuuuaua

SEQ ID NO: 3613517 - RNA, 20 nt, Human
caugaggaacaaggcaaggc

SEQ ID NO: 3613518 - RNA, 12 nt, Human
caugaggaacua

SEQ ID NO: 3613519 - RNA, 21 nt, Human
caugaggacaugauggagcgc

SEQ ID NO: 3613520 - RNA, 21 nt, Human
caugaggacucuauucuuuaa

SEQ ID NO: 3613521 - RNA, 23 nt, Human
caugaggagauucugccuuugcc

SEQ ID NO: 3613522 - RNA, 22 nt, Human
caugaggcaaugucaggaacag

SEQ ID NO: 3613523 - RNA, 21 nt, Human
caugagggguuccuccccucc

SEQ ID NO: 3613524 - RNA, 19 nt, Human
caugagguacugagaguga

SEQ ID NO: 3613525 - RNA, 21 nt, Human
caugaguagauaauuucaggg

SEQ ID NO: 3613526 - RNA, 14 nt, Human
caugagucccagug

SEQ ID NO: 3613527 - RNA, 16 nt, Human
caugagucccaguggg

SEQ ID NO: 3613528 - RNA, 13 nt, Human
caugaguccccug

SEQ ID NO: 3613529 - RNA, 17 nt, Human
caugaguccuugaaaau

SEQ ID NO: 3613530 - RNA, 19 nt, Human
caugaguccuugaaaauau

SEQ ID NO: 3613531 - RNA, 18 nt, Human
caugaguuaucaugaauu

SEQ ID NO: 3613532 - RNA, 19 nt, Human
caugaguuccagaaaguaa

SEQ ID NO: 3613533 - RNA, 16 nt, Human
caugaguuuaaaucaa

SEQ ID NO: 3613534 - RNA, 15 nt, Human
caugaguuugcccug

SEQ ID NO: 3613535 - RNA, 19 nt, Human
caugaguuuuuucucuugg

SEQ ID NO: 3613536 - RNA, 18 nt, Human
caugauaaugaacagaac

SEQ ID NO: 3613537 - RNA, 15 nt, Human
caugauauaacuuua

SEQ ID NO: 3613538 - RNA, 18 nt, Human
caugauauaacuuuagaa

SEQ ID NO: 3613539 - RNA, 13 nt, Human
caugauauuuugu

SEQ ID NO: 3613540 - RNA, 21 nt, Human
caugaucccuguguugucucu

SEQ ID NO: 3613541 - RNA, 18 nt, Human
caugaucucccugccgcc

SEQ ID NO: 3613542 - RNA, 15 nt, Human
caugaucuugagcaa

SEQ ID NO: 3613543 - RNA, 20 nt, Human
caugaugacuuaguacaaag

SEQ ID NO: 3613544 - RNA, 15 nt, Human
caugaugagcuccuc

SEQ ID NO: 3613545 - RNA, 19 nt, Human
caugaugagcuccucuucc

SEQ ID NO: 3613546 - RNA, 11 nt, Human
caugaugcagu

SEQ ID NO: 3613547 - RNA, 12 nt, Human
caugaugcaguc

SEQ ID NO: 3613548 - RNA, 15 nt, Human
caugaugcagucucc

SEQ ID NO: 3613549 - RNA, 22 nt, Human
caugaugccucugucuucugga

SEQ ID NO: 3613550 - RNA, 23 nt, Human
caugaugccucugucuucuggac

SEQ ID NO: 3613551 - RNA, 20 nt, Human
caugaugcgggccagugcuc

SEQ ID NO: 3613552 - RNA, 17 nt, Human
caugaugcuuuuacuga

SEQ ID NO: 3613553 - RNA, 18 nt, Human
caugaugcuuuuacugaa

SEQ ID NO: 3613554 - RNA, 14 nt, Human
caugauggaauuuc

SEQ ID NO: 3613555 - RNA, 23 nt, Human
caugauggagucagguuuggggu

SEQ ID NO: 3613556 - RNA, 13 nt, Human
caugauggccagg

SEQ ID NO: 3613557 - RNA, 21 nt, Human
caugauggccaggcugaucuc

SEQ ID NO: 3613558 - RNA, 20 nt, Human
caugauguagugccucuuuc

SEQ ID NO: 3613559 - RNA, 20 nt, Human
caugauguggaguggggcag

SEQ ID NO: 3613560 - RNA, 19 nt, Human
caugauguuaaccagaaua

SEQ ID NO: 3613561 - RNA, 22 nt, Human
caugauguuaaccagaauaaag

SEQ ID NO: 3613562 - RNA, 14 nt, Human
caugauguuuagaa

SEQ ID NO: 3613563 - RNA, 13 nt, Human
caugauguuuucc

SEQ ID NO: 3613564 - RNA, 17 nt, Human
caugauguuuuuaaaau

SEQ ID NO: 3613565 - RNA, 18 nt, Human
caugauguuuuuaaaauc

SEQ ID NO: 3613566 - RNA, 19 nt, Human
caugauguuuuuaaaaucu

SEQ ID NO: 3613567 - RNA, 13 nt, Human
cacccuccuuccc

SEQ ID NO: 3613568 - RNA, 12 nt, Human
cacccuccuuuc

SEQ ID NO: 3613569 - RNA, 21 nt, Human
cacccucggggauguguccug

SEQ ID NO: 3613570 - RNA, 19 nt, Human
cacccucguggacaccugc

SEQ ID NO: 3613571 - RNA, 17 nt, Human
ccacacuauuaccauga

SEQ ID NO: 3613572 - RNA, 24 nt, Human
ccacacucacuccugagaccccug

SEQ ID NO: 3613573 - RNA, 11 nt, Human
ccacacucaga

SEQ ID NO: 3613574 - RNA, 19 nt, Human
ccacacucagauccuccuc

SEQ ID NO: 3613575 - RNA, 13 nt, Human
ccacacuccagcu

SEQ ID NO: 3613576 - RNA, 13 nt, Human
ccacacucuccau

SEQ ID NO: 3613577 - RNA, 16 nt, Human
ccacacucuuucuccu

SEQ ID NO: 3613578 - RNA, 19 nt, Human
ccacacucuuucuccugcu

SEQ ID NO: 3613579 - RNA, 12 nt, Human
ccacacugcaca

SEQ ID NO: 3613580 - RNA, 21 nt, Human
ccacacuggacuccggcccuc

SEQ ID NO: 3613581 - RNA, 13 nt, Human
ccacacuggugac

SEQ ID NO: 3613582 - RNA, 17 nt, Human
ccacacugugacacacu

SEQ ID NO: 3613583 - RNA, 17 nt, Human
ccacacuucaaacuacu

SEQ ID NO: 3613584 - RNA, 16 nt, Human
ccacacuucaggcucu

SEQ ID NO: 3613585 - RNA, 22 nt, Human
ccacacuucaggcucuucuccu

SEQ ID NO: 3613586 - RNA, 11 nt, Human
ccacacuuccc

SEQ ID NO: 3613587 - RNA, 12 nt, Human
ccacacuuccug

SEQ ID NO: 3613588 - RNA, 14 nt, Human
ccacacuucucagg

SEQ ID NO: 3613589 - RNA, 17 nt, Human
ccacacuugagaggaug

SEQ ID NO: 3613590 - RNA, 21 nt, Human
ccacacuuguuccagcucuuu

SEQ ID NO: 3613591 - RNA, 18 nt, Human
ccacagaagcuccaggua

SEQ ID NO: 3613592 - RNA, 14 nt, Human
ccacagacacacac

SEQ ID NO: 3613593 - RNA, 21 nt, Human
ccacagacggaaggguaaaca

SEQ ID NO: 3613594 - RNA, 23 nt, Human
ccacagacggaaggguaaacaau

SEQ ID NO: 3613595 - RNA, 16 nt, Human
ccacagacugguuuug

SEQ ID NO: 3613596 - RNA, 21 nt, Human
ccacagagagggagagcagag

SEQ ID NO: 3613597 - RNA, 13 nt, Human
ccacagagagucc

SEQ ID NO: 3613598 - RNA, 18 nt, Human
ccacagaguaagacauug

SEQ ID NO: 3613599 - RNA, 22 nt, Human
ccacagaguguagccagguccc

SEQ ID NO: 3613600 - RNA, 23 nt, Human
ccacagaguguagccaggucccc

SEQ ID NO: 3613601 - RNA, 16 nt, Human
ccacagauaacugaaa

SEQ ID NO: 3613602 - RNA, 18 nt, Human
ccacagauaacugaaaau

SEQ ID NO: 3613603 - RNA, 19 nt, Human
ccacagauuguuucuauac

SEQ ID NO: 3613604 - RNA, 20 nt, Human
ccacagcaaccccaggcuga

SEQ ID NO: 3613605 - RNA, 22 nt, Human
ccacagcaacgaucacaaauga

SEQ ID NO: 3613606 - RNA, 17 nt, Human
ccacagcaaggcaccug

SEQ ID NO: 3613607 - RNA, 15 nt, Human
ccacagcagcauuuu

SEQ ID NO: 3613608 - RNA, 17 nt, Human
ccacagcagccucugaa

SEQ ID NO: 3613609 - RNA, 12 nt, Human
ccacagcaggcc

SEQ ID NO: 3613610 - RNA, 12 nt, Human
ccacagcaguug

SEQ ID NO: 3613611 - RNA, 23 nt, Human
ccacagcaguugaaaagacucca

SEQ ID NO: 3613612 - RNA, 20 nt, Human
ccacagcaucauuuugcauu

SEQ ID NO: 3613613 - RNA, 23 nt, Human
ccacagccagaaccccgagcccu

SEQ ID NO: 3613614 - RNA, 17 nt, Human
ccacagccagcaccugg

SEQ ID NO: 3613615 - RNA, 11 nt, Human
ccacagccagg

SEQ ID NO: 3613616 - RNA, 19 nt, Human
ccacagcccacguccuguc

SEQ ID NO: 3613617 - RNA, 21 nt, Human
ccacagcccacguccugucag

SEQ ID NO: 3613618 - RNA, 20 nt, Human
ccacagcccagccacggacg

SEQ ID NO: 3613619 - RNA, 15 nt, Human
ccacagcccaggccu

SEQ ID NO: 3613620 - RNA, 14 nt, Human
ccacagcccuguca

SEQ ID NO: 3613621 - RNA, 15 nt, Human
ccacagcccugucag

SEQ ID NO: 3613622 - RNA, 21 nt, Human
ccacagcccugucagugcagc

SEQ ID NO: 3613623 - RNA, 23 nt, Human
ccacagcccugucagugcagccc

SEQ ID NO: 3613624 - RNA, 18 nt, Human
ccacagcccuuuugucuc

SEQ ID NO: 3613625 - RNA, 12 nt, Human
ccacagccgcag

SEQ ID NO: 3613626 - RNA, 15 nt, Human
ccacagccgcagccu

SEQ ID NO: 3613627 - RNA, 17 nt, Human
ccacagccucugccugu

SEQ ID NO: 3613628 - RNA, 23 nt, Human
ccacagcgccagccucagacugg

SEQ ID NO: 3613629 - RNA, 15 nt, Human
ccacagcgucccugg

SEQ ID NO: 3613630 - RNA, 14 nt, Human
ccacagcuccuuuu

SEQ ID NO: 3613631 - RNA, 14 nt, Human
ccacagcugcucaa

SEQ ID NO: 3613632 - RNA, 12 nt, Human
ccacagcuuccu

SEQ ID NO: 3613633 - RNA, 19 nt, Human
ccacagcuuggggccaucg

SEQ ID NO: 3613634 - RNA, 13 nt, Human
ccacagcuuuugc

SEQ ID NO: 3613635 - RNA, 15 nt, Human
ccacagcuuuugcaa

SEQ ID NO: 3613636 - RNA, 19 nt, Human
ccacaggaagccugcaguc

SEQ ID NO: 3613637 - RNA, 17 nt, Human
ccacaggaagugaagaa

SEQ ID NO: 3613638 - RNA, 17 nt, Human
ccacaggacccucgccg

SEQ ID NO: 3613639 - RNA, 16 nt, Human
ccacaggaucagucug

SEQ ID NO: 3613640 - RNA, 13 nt, Human
ccacaggcagcuu

SEQ ID NO: 3613641 - RNA, 14 nt, Human
ccacaggcagcuuu

SEQ ID NO: 3613642 - RNA, 16 nt, Human
ccacaggcccacagua

SEQ ID NO: 3613643 - RNA, 18 nt, Human
ccacaggcccuuccucuc

SEQ ID NO: 3613644 - RNA, 19 nt, Human
ccacaggcccuuuccucag

SEQ ID NO: 3613645 - RNA, 13 nt, Human
ccacaggccuccc

SEQ ID NO: 3613646 - RNA, 18 nt, Human
ccacaggccucccuguuu

SEQ ID NO: 3613647 - RNA, 11 nt, Human
ccacaggccug

SEQ ID NO: 3613648 - RNA, 12 nt, Human
ccacaggccuga

SEQ ID NO: 3613649 - RNA, 16 nt, Human
ccacaggcucaggcag

SEQ ID NO: 3613650 - RNA, 11 nt, Human
ccacagggcac

SEQ ID NO: 3613651 - RNA, 14 nt, Human
ccacagggcuaaga

SEQ ID NO: 3613652 - RNA, 17 nt, Human
ccacagggcuaagagcu

SEQ ID NO: 3613653 - RNA, 11 nt, Human
ccacagggucu

SEQ ID NO: 3613654 - RNA, 18 nt, Human
ccacaggguucaaaaugu

SEQ ID NO: 3613655 - RNA, 22 nt, Human
ccacaggguucaaaaugucugu

SEQ ID NO: 3613656 - RNA, 18 nt, Human
ccacagguaauuucuccu

SEQ ID NO: 3613657 - RNA, 21 nt, Human
ccacagguguccccagcccac

SEQ ID NO: 3613658 - RNA, 17 nt, Human
ccacaggugugagccac

SEQ ID NO: 3613659 - RNA, 17 nt, Human
ccacaguagucuugaug

SEQ ID NO: 3613660 - RNA, 23 nt, Human
ccacaguauauuuuauuucaaug

SEQ ID NO: 3613661 - RNA, 22 nt, Human
ccacagugacucgggcuccugu

SEQ ID NO: 3613662 - RNA, 14 nt, Human
ccacagugcugucu

SEQ ID NO: 3613663 - RNA, 21 nt, Human
ccacaguguaccauuaaaaua

SEQ ID NO: 3613664 - RNA, 14 nt, Human
ccacagugucaggc

SEQ ID NO: 3613665 - RNA, 22 nt, Human
ccacaguguuggcgagaggagg

SEQ ID NO: 3613666 - RNA, 22 nt, Human
ccacaguugccaccaccucugu

SEQ ID NO: 3613667 - RNA, 22 nt, Human
ccacaguuuccucaucugucca

SEQ ID NO: 3613668 - RNA, 19 nt, Human
ccacauagugaugguuccc

SEQ ID NO: 3613669 - RNA, 21 nt, Human
ccacauagugaugguuccccu

SEQ ID NO: 3613670 - RNA, 15 nt, Human
ccacauccacacacg

SEQ ID NO: 3613671 - RNA, 13 nt, Human
ccacaucccaggc

SEQ ID NO: 3613672 - RNA, 18 nt, Human
ccacaucccaggcuucac

SEQ ID NO: 3613673 - RNA, 21 nt, Human
ccacauccccgcuggcugggg

SEQ ID NO: 3613674 - RNA, 20 nt, Human
ccacaucccgggacgcagca

SEQ ID NO: 3613675 - RNA, 14 nt, Human
ccacaucccucucu

SEQ ID NO: 3613676 - RNA, 14 nt, Human
ccacaucccugggc

SEQ ID NO: 3613677 - RNA, 17 nt, Human
ccacaucccugggccug

SEQ ID NO: 3613678 - RNA, 13 nt, Human
ccacauccuccac

SEQ ID NO: 3613679 - RNA, 19 nt, Human
ccacauccuccguccagcc

SEQ ID NO: 3613680 - RNA, 12 nt, Human
ccacaucugccu

SEQ ID NO: 3613681 - RNA, 22 nt, Human
ccacaucugccuuaaaaccaaa

SEQ ID NO: 3613682 - RNA, 18 nt, Human
ccacaucuuccauuucca

SEQ ID NO: 3613683 - RNA, 14 nt, Human
ccacaucuugcucu

SEQ ID NO: 3613684 - RNA, 18 nt, Human
ccacaucuugcucugcug

SEQ ID NO: 3613685 - RNA, 23 nt, Human
ccacaucuugcucugcugacaga

SEQ ID NO: 3613686 - RNA, 13 nt, Human
ccacaugaguccc

SEQ ID NO: 3613687 - RNA, 17 nt, Human
ccacaugagucccagug

SEQ ID NO: 3613688 - RNA, 22 nt, Human
ccacaugagucccagugggagg

SEQ ID NO: 3613689 - RNA, 16 nt, Human
ccacaugccaggggcc

SEQ ID NO: 3613690 - RNA, 20 nt, Human
ccacaugccauuuguacuga

SEQ ID NO: 3613691 - RNA, 22 nt, Human
ccacaugccauuuguacugacc

SEQ ID NO: 3613692 - RNA, 12 nt, Human
ccacaugcccca

SEQ ID NO: 3613693 - RNA, 17 nt, Human
ccacauggcuuccuccu

SEQ ID NO: 3613694 - RNA, 21 nt, Human
ccacauggcuuccuccugcgc

SEQ ID NO: 3613695 - RNA, 21 nt, Human
ccacauggggcugggcagcua

SEQ ID NO: 3613696 - RNA, 19 nt, Human
ccacaugugacacauaugc

SEQ ID NO: 3613697 - RNA, 16 nt, Human
ccacaugugcacaugc

SEQ ID NO: 3613698 - RNA, 14 nt, Human
ccacauuaaagaag

SEQ ID NO: 3613699 - RNA, 16 nt, Human
ccacauuaaagaagac

SEQ ID NO: 3613700 - RNA, 20 nt, Human
ccacauuaaagaagaccuga

SEQ ID NO: 3613701 - RNA, 15 nt, Human
ccacauuucuaaaau

SEQ ID NO: 3613702 - RNA, 14 nt, Human
ccaccaaaaacaaa

SEQ ID NO: 3613703 - RNA, 15 nt, Human
ccaccaaaacugcuc

SEQ ID NO: 3613704 - RNA, 16 nt, Human
ccaccaaaacugcucc

SEQ ID NO: 3613705 - RNA, 18 nt, Human
ccaccaaagcugcccacu

SEQ ID NO: 3613706 - RNA, 20 nt, Human
ccaccaacauacucccaucu

SEQ ID NO: 3613707 - RNA, 13 nt, Human
ccaccaacccuca

SEQ ID NO: 3613708 - RNA, 14 nt, Human
ccaccaacccucag

SEQ ID NO: 3613709 - RNA, 16 nt, Human
ccaccaacccucaggg

SEQ ID NO: 3613710 - RNA, 18 nt, Human
ccaccaacccucagggca

SEQ ID NO: 3613711 - RNA, 19 nt, Human
ccaccaacuggcccucuuc

SEQ ID NO: 3613712 - RNA, 19 nt, Human
cacuaacgacuucagggca

SEQ ID NO: 3613713 - RNA, 21 nt, Human
cacuaacgguugaguuuugac

SEQ ID NO: 3613714 - RNA, 20 nt, Human
cacuaacguugagccccugg

SEQ ID NO: 3613715 - RNA, 13 nt, Human
cacuaagcagagg

SEQ ID NO: 3613716 - RNA, 18 nt, Human
cacuaaggugugcucuga

SEQ ID NO: 3613717 - RNA, 16 nt, Human
cacuaagucucuuuuu

SEQ ID NO: 3613718 - RNA, 21 nt, Human
cacuaagucucuuuuuuacaa

SEQ ID NO: 3613719 - RNA, 22 nt, Human
cacuaaguuauaguauaucugg

SEQ ID NO: 3613720 - RNA, 17 nt, Human
cacuaauauauuuaaaa

SEQ ID NO: 3613721 - RNA, 19 nt, Human
cacuaauauauuuaaaaau

SEQ ID NO: 3613722 - RNA, 23 nt, Human
cacuaauuuuuguauuauuuuug

SEQ ID NO: 3613723 - RNA, 13 nt, Human
cacuacaccacac

SEQ ID NO: 3613724 - RNA, 20 nt, Human
cacuacaccacacacaacag

SEQ ID NO: 3613725 - RNA, 18 nt, Human
cacuacacccagcaauag

SEQ ID NO: 3613726 - RNA, 15 nt, Human
cacuacaccuggcug

SEQ ID NO: 3613727 - RNA, 14 nt, Human
cacuacaccuugcc

SEQ ID NO: 3613728 - RNA, 23 nt, Human
cacuacaugcagcccaugcccac

SEQ ID NO: 3613729 - RNA, 21 nt, Human
cacuacauuauaaaugucucu

SEQ ID NO: 3613730 - RNA, 15 nt, Human
cacuacauucauuua

SEQ ID NO: 3613731 - RNA, 14 nt, Human
cacuacauucuguu

SEQ ID NO: 3613732 - RNA, 22 nt, Human
cacuaccaaaggacacuuaucc

SEQ ID NO: 3613733 - RNA, 15 nt, Human
cacuaccccuugauu

SEQ ID NO: 3613734 - RNA, 23 nt, Human
cacuaccgaaugugucuuuagau

SEQ ID NO: 3613735 - RNA, 20 nt, Human
cacuaccuccucagggaugg

SEQ ID NO: 3613736 - RNA, 23 nt, Human
cacuacgccuggcugauuuuugu

SEQ ID NO: 3613737 - RNA, 23 nt, Human
cacuacggaauaguuggcuagga

SEQ ID NO: 3613738 - RNA, 13 nt, Human
cacuacucagcau

SEQ ID NO: 3613739 - RNA, 14 nt, Human
cacuacucagcaug

SEQ ID NO: 3613740 - RNA, 19 nt, Human
cacuacuccucugcagugc

SEQ ID NO: 3613741 - RNA, 20 nt, Human
cacuacuccucugcagugcc

SEQ ID NO: 3613742 - RNA, 17 nt, Human
cacuacugcagcaccuc

SEQ ID NO: 3613743 - RNA, 19 nt, Human
cacuacugcagcaccucca

SEQ ID NO: 3613744 - RNA, 12 nt, Human
cacuacugggug

SEQ ID NO: 3613745 - RNA, 21 nt, Human
cacuacugggugucauuucau

SEQ ID NO: 3613746 - RNA, 16 nt, Human
cacuagacaagccaga

SEQ ID NO: 3613747 - RNA, 17 nt, Human
cacuagacaagccagaa

SEQ ID NO: 3613748 - RNA, 12 nt, Human
cacuagccaaac

SEQ ID NO: 3613749 - RNA, 20 nt, Human
cacuagccagacacucugcu

SEQ ID NO: 3613750 - RNA, 15 nt, Human
cacuagccucagggg

SEQ ID NO: 3613751 - RNA, 17 nt, Human
cacuagccuuuggcucu

SEQ ID NO: 3613752 - RNA, 22 nt, Human
cacuagccuuuggcucuggaga

SEQ ID NO: 3613753 - RNA, 19 nt, Human
cacuaggcacccagcugcc

SEQ ID NO: 3613754 - RNA, 22 nt, Human
cacuaggcccccacuugccucu

SEQ ID NO: 3613755 - RNA, 13 nt, Human
cacuaggcugggu

SEQ ID NO: 3613756 - RNA, 14 nt, Human
cacuaggcugggug

SEQ ID NO: 3613757 - RNA, 20 nt, Human
cacuaggggauauaggagag

SEQ ID NO: 3613758 - RNA, 15 nt, Human
cacuagugcaaauca

SEQ ID NO: 3613759 - RNA, 16 nt, Human
cacuagugcaaaucau

SEQ ID NO: 3613760 - RNA, 12 nt, Human
cacuaguuuugu

SEQ ID NO: 3613761 - RNA, 14 nt, Human
cacuauagccuagg

SEQ ID NO: 3613762 - RNA, 14 nt, Human
cacuauaucuguau

SEQ ID NO: 3613763 - RNA, 19 nt, Human
cacuauccaugcaccaaac

SEQ ID NO: 3613764 - RNA, 18 nt, Human
cacuaucccggcugcccu

SEQ ID NO: 3613765 - RNA, 15 nt, Human
cacuauguugcccag

SEQ ID NO: 3613766 - RNA, 19 nt, Human
cacuauguugcccaggcag

SEQ ID NO: 3613767 - RNA, 12 nt, Human
cacuauuuuaga

SEQ ID NO: 3613768 - RNA, 12 nt, Human
cacuauuuucag

SEQ ID NO: 3613769 - RNA, 23 nt, Human
cacuauuuuuauuuauauuuuug

SEQ ID NO: 3613770 - RNA, 15 nt, Human
cacucaaaagcuggg

SEQ ID NO: 3613771 - RNA, 20 nt, Human
cacucaaaggccagaccugc

SEQ ID NO: 3613772 - RNA, 18 nt, Human
cacucaaaucuuaagaaa

SEQ ID NO: 3613773 - RNA, 16 nt, Human
cacucaaauuaaucuu

SEQ ID NO: 3613774 - RNA, 20 nt, Human
cacucaaauuaaucuuucuu

SEQ ID NO: 3613775 - RNA, 17 nt, Human
cacucaagaagcaggcu

SEQ ID NO: 3613776 - RNA, 15 nt, Human
cacucaagccaagca

SEQ ID NO: 3613777 - RNA, 11 nt, Human
ccaaagaaugu

SEQ ID NO: 3613778 - RNA, 19 nt, Human
ccaaagaauguuagagcac

SEQ ID NO: 3613779 - RNA, 14 nt, Human
ccaaagaauucuua

SEQ ID NO: 3613780 - RNA, 13 nt, Human
ccaaagacaaaua

SEQ ID NO: 3613781 - RNA, 20 nt, Human
ccaaagagcacaaacauuuu

SEQ ID NO: 3613782 - RNA, 22 nt, Human
ccaaagagcacaaacauuuuuc

SEQ ID NO: 3613783 - RNA, 12 nt, Human
ccaaagagccug

SEQ ID NO: 3613784 - RNA, 16 nt, Human
ccaaagagccuggaga

SEQ ID NO: 3613785 - RNA, 17 nt, Human
ccaaagagccuggagaa

SEQ ID NO: 3613786 - RNA, 14 nt, Human
ccaaagagcugccu

SEQ ID NO: 3613787 - RNA, 15 nt, Human
ccaaagagcugccua

SEQ ID NO: 3613788 - RNA, 16 nt, Human
ccaaagaggcugcccc

SEQ ID NO: 3613789 - RNA, 16 nt, Human
ccaaagagggcuuccu

SEQ ID NO: 3613790 - RNA, 17 nt, Human
ccaaagagggcuuccuc

SEQ ID NO: 3613791 - RNA, 13 nt, Human
ccaaagaugcagc

SEQ ID NO: 3613792 - RNA, 23 nt, Human
ccaaagaugcagccgccuuccuu

SEQ ID NO: 3613793 - RNA, 19 nt, Human
ccaaagcagugcaugcugu

SEQ ID NO: 3613794 - RNA, 19 nt, Human
ccaaagcaguggagcccag

SEQ ID NO: 3613795 - RNA, 23 nt, Human
ccaaagcaguggagcccaggagu

SEQ ID NO: 3613796 - RNA, 19 nt, Human
ccaaagccaaagcuaggcc

SEQ ID NO: 3613797 - RNA, 21 nt, Human
ccaaagccaauaacacacagc

SEQ ID NO: 3613798 - RNA, 15 nt, Human
ccaaagccagacagc

SEQ ID NO: 3613799 - RNA, 23 nt, Human
ccaaagccccuugcucuccccug

SEQ ID NO: 3613800 - RNA, 17 nt, Human
ccaaagccuccuccagc

SEQ ID NO: 3613801 - RNA, 17 nt, Human
ccaaagcgaauuuuaaa

SEQ ID NO: 3613802 - RNA, 16 nt, Human
ccaaagcuaggccugg

SEQ ID NO: 3613803 - RNA, 17 nt, Human
ccaaagcuaggccuggc

SEQ ID NO: 3613804 - RNA, 21 nt, Human
ccaaagcuaggccuggccaga

SEQ ID NO: 3613805 - RNA, 18 nt, Human
ccaaagcuaggguggccc

SEQ ID NO: 3613806 - RNA, 19 nt, Human
ccaaagcuaggguggcccu

SEQ ID NO: 3613807 - RNA, 21 nt, Human
ccaaagcugacgaggcugggc

SEQ ID NO: 3613808 - RNA, 18 nt, Human
ccaaagcugcccacuguu

SEQ ID NO: 3613809 - RNA, 21 nt, Human
ccaaagcugcccacuguuucu

SEQ ID NO: 3613810 - RNA, 17 nt, Human
ccaaagcuucccacggc

SEQ ID NO: 3613811 - RNA, 12 nt, Human
ccaaagcuuuau

SEQ ID NO: 3613812 - RNA, 16 nt, Human
ccaaagcuuucaugua

SEQ ID NO: 3613813 - RNA, 17 nt, Human
ccaaagcuuuccugccc

SEQ ID NO: 3613814 - RNA, 20 nt, Human
ccaaagcuuuccugccccag

SEQ ID NO: 3613815 - RNA, 14 nt, Human
ccaaaggaaaaugu

SEQ ID NO: 3613816 - RNA, 15 nt, Human
ccaaaggaagcacau

SEQ ID NO: 3613817 - RNA, 20 nt, Human
ccaaaggacauuaugugugc

SEQ ID NO: 3613818 - RNA, 17 nt, Human
ccaaaggacuccaccca

SEQ ID NO: 3613819 - RNA, 14 nt, Human
ccaaaggaggaugg

SEQ ID NO: 3613820 - RNA, 20 nt, Human
ccaaaggccauggagagcug

SEQ ID NO: 3613821 - RNA, 21 nt, Human
ccaaaggccauggagagcugg

SEQ ID NO: 3613822 - RNA, 15 nt, Human
ccaaaggcugguggc

SEQ ID NO: 3613823 - RNA, 21 nt, Human
ccaaagggagaguuccagagg

SEQ ID NO: 3613824 - RNA, 13 nt, Human
ccaaagggagucu

SEQ ID NO: 3613825 - RNA, 17 nt, Human
ccaaaggggacaggccu

SEQ ID NO: 3613826 - RNA, 23 nt, Human
ccaaaggggacaggccucaccuc

SEQ ID NO: 3613827 - RNA, 23 nt, Human
ccaaagggugaagcuauuuaucu

SEQ ID NO: 3613828 - RNA, 15 nt, Human
ccaaaggugaaggaa

SEQ ID NO: 3613829 - RNA, 20 nt, Human
ccaaaggugaaggaauauau

SEQ ID NO: 3613830 - RNA, 14 nt, Human
ccaaaguaaaagaa

SEQ ID NO: 3613831 - RNA, 22 nt, Human
ccaaaguacagaauuugaauua

SEQ ID NO: 3613832 - RNA, 13 nt, Human
ccaaagucauaau

SEQ ID NO: 3613833 - RNA, 16 nt, Human
ccaaagucucuaauuc

SEQ ID NO: 3613834 - RNA, 22 nt, Human
ccaaagugcugggauuacaggc

SEQ ID NO: 3613835 - RNA, 11 nt, Human
ccaaaguucua

SEQ ID NO: 3613836 - RNA, 20 nt, Human
ccaaaguucuaauaauuucu

SEQ ID NO: 3613837 - RNA, 11 nt, Human
ccaaauaaaaa

SEQ ID NO: 3613838 - RNA, 13 nt, Human
ccaaauauguccu

SEQ ID NO: 3613839 - RNA, 15 nt, Human
ccaaaucaaaauaug

SEQ ID NO: 3613840 - RNA, 20 nt, Human
ccaaaucaauaagaagguag

SEQ ID NO: 3613841 - RNA, 15 nt, Human
ccaaaucagcugcua

SEQ ID NO: 3613842 - RNA, 18 nt, Human
ccaaaucauacuuuuucu

SEQ ID NO: 3613843 - RNA, 16 nt, Human
ccaaaucauaguggcu

SEQ ID NO: 3613844 - RNA, 17 nt, Human
ccaaauccgaaccuccu

SEQ ID NO: 3613845 - RNA, 18 nt, Human
ccaaauccgcucucuucc

SEQ ID NO: 3613846 - RNA, 22 nt, Human
ccaaaucucaaugaagccagcu

SEQ ID NO: 3613847 - RNA, 19 nt, Human
ccaaaucucucaaaucugu

SEQ ID NO: 3613848 - RNA, 18 nt, Human
ccaaaugaaauauauuua

SEQ ID NO: 3613849 - RNA, 15 nt, Human
ccaaaugcaauuuga

SEQ ID NO: 3613850 - RNA, 17 nt, Human
ccaaaugcauggugcag

SEQ ID NO: 3613851 - RNA, 23 nt, Human
ccaaauggaaaugggcagagcag

SEQ ID NO: 3613852 - RNA, 18 nt, Human
ccaaauggagaagcugca

SEQ ID NO: 3613853 - RNA, 20 nt, Human
ccaaauggagaagcugcagg

SEQ ID NO: 3613854 - RNA, 19 nt, Human
ccaaauggauuccuguuuc

SEQ ID NO: 3613855 - RNA, 18 nt, Human
ccaaauguaauugaauaa

SEQ ID NO: 3613856 - RNA, 17 nt, Human
ccaacuuucuguaaacu

SEQ ID NO: 3613857 - RNA, 14 nt, Human
ccaagaacugcaug

SEQ ID NO: 3613858 - RNA, 14 nt, Human
ccaagaagcagugg

SEQ ID NO: 3613859 - RNA, 18 nt, Human
ccaagaagcaguggccuu

SEQ ID NO: 3613860 - RNA, 15 nt, Human
ccaagaagcccagga

SEQ ID NO: 3613861 - RNA, 13 nt, Human
ccaagaaguugga

SEQ ID NO: 3613862 - RNA, 17 nt, Human
ccaagaaguuuaaggaa

SEQ ID NO: 3613863 - RNA, 20 nt, Human
ccaagaauagcaucuguaca

SEQ ID NO: 3613864 - RNA, 18 nt, Human
ccaagaauccacauuucu

SEQ ID NO: 3613865 - RNA, 21 nt, Human
ccaagaauccacauuucuaaa

SEQ ID NO: 3613866 - RNA, 12 nt, Human
ccaagaauguac

SEQ ID NO: 3613867 - RNA, 14 nt, Human
ccaagacaaaucaa

SEQ ID NO: 3613868 - RNA, 11 nt, Human
ccaagacauug

SEQ ID NO: 3613869 - RNA, 12 nt, Human
ccaagacuccca

SEQ ID NO: 3613870 - RNA, 14 nt, Human
ccaagacucccaug

SEQ ID NO: 3613871 - RNA, 22 nt, Human
ccaagacugcuguggccaggag

SEQ ID NO: 3613872 - RNA, 18 nt, Human
ccaagacuuggcaacaga

SEQ ID NO: 3613873 - RNA, 20 nt, Human
ccaagacuugguguccuuuc

SEQ ID NO: 3613874 - RNA, 21 nt, Human
ccaagagaaaggccugcacac

SEQ ID NO: 3613875 - RNA, 22 nt, Human
ccaagagaaaggccugcacaca

SEQ ID NO: 3613876 - RNA, 23 nt, Human
ccaagagaacucgcgcucaguaa

SEQ ID NO: 3613877 - RNA, 14 nt, Human
ccaagagaugaaga

SEQ ID NO: 3613878 - RNA, 16 nt, Human
ccaagagauugcuaau

SEQ ID NO: 3613879 - RNA, 17 nt, Human
ccaagagauugcuaauu

SEQ ID NO: 3613880 - RNA, 18 nt, Human
ccaagagcaucaugccuc

SEQ ID NO: 3613881 - RNA, 19 nt, Human
ccaagagcaucaugccucu

SEQ ID NO: 3613882 - RNA, 22 nt, Human
ccaagagcaucaugccucugag

SEQ ID NO: 3613883 - RNA, 10 nt, Human
ccaagaggcu

SEQ ID NO: 3613884 - RNA, 23 nt, Human
ccaagagguuuggcuccugccca

SEQ ID NO: 3613885 - RNA, 11 nt, Human
ccaagagucua

SEQ ID NO: 3613886 - RNA, 16 nt, Human
ccaagagucugaugau

SEQ ID NO: 3613887 - RNA, 13 nt, Human
ccaagaguggccc

SEQ ID NO: 3613888 - RNA, 15 nt, Human
ccaagaguggcccca

SEQ ID NO: 3613889 - RNA, 18 nt, Human
ccaagaguggccccaccu

SEQ ID NO: 3613890 - RNA, 18 nt, Human
ccaagauacuuaagugcu

SEQ ID NO: 3613891 - RNA, 16 nt, Human
ccaagaucgcgccacu

SEQ ID NO: 3613892 - RNA, 17 nt, Human
ccaagaugacuggggug

SEQ ID NO: 3613893 - RNA, 18 nt, Human
ccaagaugggcaucuuuu

SEQ ID NO: 3613894 - RNA, 15 nt, Human
ccaagauucuagaug

SEQ ID NO: 3613895 - RNA, 17 nt, Human
ccaagauucuagaugau

SEQ ID NO: 3613896 - RNA, 18 nt, Human
ccaagauugagcucucug

SEQ ID NO: 3613897 - RNA, 21 nt, Human
ccaagauuggccugaggcugc

SEQ ID NO: 3613898 - RNA, 17 nt, Human
ccaagauuuaaaugcca

SEQ ID NO: 3613899 - RNA, 19 nt, Human
ccaagauuuuccucuugug

SEQ ID NO: 3613900 - RNA, 17 nt, Human
ccaagcaaaaucaugga

SEQ ID NO: 3613901 - RNA, 17 nt, Human
ccaagcaaccugggucc

SEQ ID NO: 3613902 - RNA, 18 nt, Human
ccaagcaaccugggucca

SEQ ID NO: 3613903 - RNA, 14 nt, Human
ccaagcacagcagc

SEQ ID NO: 3613904 - RNA, 15 nt, Human
ccaagcacagcagcc

SEQ ID NO: 3613905 - RNA, 21 nt, Human
ccaagcacagugguggcaggg

SEQ ID NO: 3613906 - RNA, 22 nt, Human
ccaagcacagugguggcagggc

SEQ ID NO: 3613907 - RNA, 14 nt, Human
ccaagcacugugcu

SEQ ID NO: 3613908 - RNA, 22 nt, Human
ccaagcacugugcucagggcua

SEQ ID NO: 3613909 - RNA, 21 nt, Human
ccaagcagagcaaucaguuag

SEQ ID NO: 3613910 - RNA, 16 nt, Human
ccaagcagccaagcuc

SEQ ID NO: 3613911 - RNA, 12 nt, Human
ccaagcaggaag

SEQ ID NO: 3613912 - RNA, 20 nt, Human
ccaagcaggaagcucagacu

SEQ ID NO: 3613913 - RNA, 14 nt, Human
ccaagcaggacaug

SEQ ID NO: 3613914 - RNA, 14 nt, Human
ccaagcaggagacg

SEQ ID NO: 3613915 - RNA, 13 nt, Human
ccaagcaggaggc

SEQ ID NO: 3613916 - RNA, 14 nt, Human
ccaagcaggaggcu

SEQ ID NO: 3613917 - RNA, 21 nt, Human
ccaagcaguugggacuacagg

SEQ ID NO: 3613918 - RNA, 16 nt, Human
ccaagcauauaaaauu

SEQ ID NO: 3613919 - RNA, 18 nt, Human
ccaagcauauaaaauuuu

SEQ ID NO: 3613920 - RNA, 23 nt, Human
ccaagcaucuuggggggguggcc

SEQ ID NO: 3613921 - RNA, 15 nt, Human
ccaagccaaaaaccu

SEQ ID NO: 3613922 - RNA, 21 nt, Human
ccaagccaaaaaccuuagcuc

SEQ ID NO: 3613923 - RNA, 20 nt, Human
ccaagccaagggaaccugug

SEQ ID NO: 3613924 - RNA, 16 nt, Human
ccaagccagaggcugg

SEQ ID NO: 3613925 - RNA, 19 nt, Human
ccaagccagaggcuggguu

SEQ ID NO: 3613926 - RNA, 17 nt, Human
ccaagccguggcuuccc

SEQ ID NO: 3613927 - RNA, 13 nt, Human
ccaagccuccaca

SEQ ID NO: 3613928 - RNA, 14 nt, Human
ccaagccuccacag

SEQ ID NO: 3613929 - RNA, 14 nt, Human
ccaagccugcaacu

SEQ ID NO: 3613930 - RNA, 15 nt, Human
ccaagccuggcaagg

SEQ ID NO: 3613931 - RNA, 22 nt, Human
ccaagccuugauugguguugcc

SEQ ID NO: 3613932 - RNA, 21 nt, Human
ccaagcgaggucaacagagaa

SEQ ID NO: 3613933 - RNA, 16 nt, Human
ccaagcgcccuggccc

SEQ ID NO: 3613934 - RNA, 20 nt, Human
ccaagcuaagcacugccacu

SEQ ID NO: 3613935 - RNA, 16 nt, Human
ccaagcuauccuggcu

SEQ ID NO: 3613936 - RNA, 19 nt, Human
ccaagcuauuccuuucccu

SEQ ID NO: 3613937 - RNA, 23 nt, Human
ccaagcuauuccuuucccuuccu

SEQ ID NO: 3613938 - RNA, 13 nt, Human
ccaagcucacagu

SEQ ID NO: 3613939 - RNA, 17 nt, Human
ccaagcucacaguuccu

SEQ ID NO: 3613940 - RNA, 12 nt, Human
ccaagcucagaa

SEQ ID NO: 3613941 - RNA, 13 nt, Human
ccaagcuccaagc

SEQ ID NO: 3613942 - RNA, 22 nt, Human
ccagaggagagaggacccccug

SEQ ID NO: 3613943 - RNA, 16 nt, Human
ccagaggagccuuuuu

SEQ ID NO: 3613944 - RNA, 14 nt, Human
ccagaggcacagcc

SEQ ID NO: 3613945 - RNA, 21 nt, Human
ccagaggcacagccggggccu

SEQ ID NO: 3613946 - RNA, 18 nt, Human
ccagaggcagaacccugg

SEQ ID NO: 3613947 - RNA, 15 nt, Human
ccagaggccaaggag

SEQ ID NO: 3613948 - RNA, 19 nt, Human
ccagaggccaaggaggccu

SEQ ID NO: 3613949 - RNA, 19 nt, Human
ccagaggcuauuauuuuca

SEQ ID NO: 3613950 - RNA, 14 nt, Human
ccagaggcugcaga

SEQ ID NO: 3613951 - RNA, 12 nt, Human
ccagaggcuggg

SEQ ID NO: 3613952 - RNA, 23 nt, Human
ccagagggagugacagaggcagc

SEQ ID NO: 3613953 - RNA, 17 nt, Human
ccagagggcccaggcag

SEQ ID NO: 3613954 - RNA, 18 nt, Human
ccagagggcccaggcagg

SEQ ID NO: 3613955 - RNA, 13 nt, Human
ccagagggccugc

SEQ ID NO: 3613956 - RNA, 13 nt, Human
ccagaggggaagg

SEQ ID NO: 3613957 - RNA, 13 nt, Human
ccagaggggccug

SEQ ID NO: 3613958 - RNA, 15 nt, Human
ccagaggggccugcc

SEQ ID NO: 3613959 - RNA, 20 nt, Human
ccagaggggccugccaccug

SEQ ID NO: 3613960 - RNA, 14 nt, Human
ccagagggucuggg

SEQ ID NO: 3613961 - RNA, 22 nt, Human
ccagagguaacagaacagcuuc

SEQ ID NO: 3613962 - RNA, 14 nt, Human
ccagagguccagcc

SEQ ID NO: 3613963 - RNA, 19 nt, Human
ccagaggucuagauuaaua

SEQ ID NO: 3613964 - RNA, 15 nt, Human
ccagaggugggcagg

SEQ ID NO: 3613965 - RNA, 16 nt, Human
ccagaggugggcaggu

SEQ ID NO: 3613966 - RNA, 17 nt, Human
ccagaggugggcaggug

SEQ ID NO: 3613967 - RNA, 19 nt, Human
ccagaggugggcagguggu

SEQ ID NO: 3613968 - RNA, 22 nt, Human
ccagagucuagcguagugcagc

SEQ ID NO: 3613969 - RNA, 23 nt, Human
ccagagucuagcguagugcagca

SEQ ID NO: 3613970 - RNA, 16 nt, Human
ccagaguggccuggcc

SEQ ID NO: 3613971 - RNA, 20 nt, Human
ccagaguuuuuauguagcag

SEQ ID NO: 3613972 - RNA, 19 nt, Human
ccagauaaaauuauagaug

SEQ ID NO: 3613973 - RNA, 16 nt, Human
ccagauaacugaggag

SEQ ID NO: 3613974 - RNA, 21 nt, Human
ccagauacacccaaaguauca

SEQ ID NO: 3613975 - RNA, 13 nt, Human
ccagauccagccu

SEQ ID NO: 3613976 - RNA, 13 nt, Human
ccagaucccagaa

SEQ ID NO: 3613977 - RNA, 17 nt, Human
ccagaucccagaaggac

SEQ ID NO: 3613978 - RNA, 18 nt, Human
ccagaucccagaaggacc

SEQ ID NO: 3613979 - RNA, 13 nt, Human
ccagaucccaggc

SEQ ID NO: 3613980 - RNA, 19 nt, Human
ccagaucccaggccccugg

SEQ ID NO: 3613981 - RNA, 14 nt, Human
ccagauccucacaa

SEQ ID NO: 3613982 - RNA, 15 nt, Human
ccagauccucuuggu

SEQ ID NO: 3613983 - RNA, 13 nt, Human
ccagauccugggu

SEQ ID NO: 3613984 - RNA, 21 nt, Human
ccagaucuuucagaaauauaa

SEQ ID NO: 3613985 - RNA, 19 nt, Human
ccagaugaggcuggccaag

SEQ ID NO: 3613986 - RNA, 17 nt, Human
ccagaugcaccagcccu

SEQ ID NO: 3613987 - RNA, 18 nt, Human
ccagaugcaccagcccuu

SEQ ID NO: 3613988 - RNA, 21 nt, Human
ccagaugcgucccaagauguu

SEQ ID NO: 3613989 - RNA, 15 nt, Human
ccagaugcugauguu

SEQ ID NO: 3613990 - RNA, 22 nt, Human
ccagauggcuggaaggggucca

SEQ ID NO: 3613991 - RNA, 16 nt, Human
ccagaugggggaaagc

SEQ ID NO: 3613992 - RNA, 18 nt, Human
ccagauggucauccagac

SEQ ID NO: 3613993 - RNA, 17 nt, Human
ccagauguuuccagacu

SEQ ID NO: 3613994 - RNA, 17 nt, Human
ccagauuagagccugua

SEQ ID NO: 3613995 - RNA, 23 nt, Human
ccagauuaucuauuugugugugu

SEQ ID NO: 3613996 - RNA, 17 nt, Human
ccagauuccccuguguc

SEQ ID NO: 3613997 - RNA, 13 nt, Human
ccagauugacgac

SEQ ID NO: 3613998 - RNA, 16 nt, Human
ccagauugcaacaggc

SEQ ID NO: 3613999 - RNA, 16 nt, Human
ccagauuggcucacac

SEQ ID NO: 3614000 - RNA, 21 nt, Human
ccagauuggcucacacugaga

SEQ ID NO: 3614001 - RNA, 16 nt, Human
ccaggccagccuccga

SEQ ID NO: 3614002 - RNA, 18 nt, Human
ccaggccaggacucugca

SEQ ID NO: 3614003 - RNA, 18 nt, Human
ccaggccaggccaccagg

SEQ ID NO: 3614004 - RNA, 19 nt, Human
ccaggccagggggccaguc

SEQ ID NO: 3614005 - RNA, 21 nt, Human
ccaggccauccggcccccaga

SEQ ID NO: 3614006 - RNA, 18 nt, Human
ccaggccaucuuccaggu

SEQ ID NO: 3614007 - RNA, 15 nt, Human
ccaggcccaaggcuc

SEQ ID NO: 3614008 - RNA, 17 nt, Human
ccaggcccaaggcuccc

SEQ ID NO: 3614009 - RNA, 18 nt, Human
ccaggcccaaggcucccg

SEQ ID NO: 3614010 - RNA, 20 nt, Human
ccaggccccaaaaccacagc

SEQ ID NO: 3614011 - RNA, 16 nt, Human
ccaggccccaggaagc

SEQ ID NO: 3614012 - RNA, 17 nt, Human
ccaggccccaugaccuc

SEQ ID NO: 3614013 - RNA, 20 nt, Human
ccaggccccaugaccuccag

SEQ ID NO: 3614014 - RNA, 19 nt, Human
ccaggcccccaagccugca

SEQ ID NO: 3614015 - RNA, 15 nt, Human
ccaggcccccaccac

SEQ ID NO: 3614016 - RNA, 15 nt, Human
ccaggccccccuguc

SEQ ID NO: 3614017 - RNA, 16 nt, Human
ccaggccccccuguca

SEQ ID NO: 3614018 - RNA, 22 nt, Human
ccaggccccgaggacccagacc

SEQ ID NO: 3614019 - RNA, 13 nt, Human
ccaggccccugcc

SEQ ID NO: 3614020 - RNA, 15 nt, Human
ccaggccccugccac

SEQ ID NO: 3614021 - RNA, 16 nt, Human
ccaggccccugccacc

SEQ ID NO: 3614022 - RNA, 21 nt, Human
ccaggccccugccacccuggg

SEQ ID NO: 3614023 - RNA, 15 nt, Human
ccaggcccggggcug

SEQ ID NO: 3614024 - RNA, 21 nt, Human
ccaggcccggggcuggcggcu

SEQ ID NO: 3614025 - RNA, 20 nt, Human
ccaggcccgucuguccaucu

SEQ ID NO: 3614026 - RNA, 18 nt, Human
ccaggcccuccucuccca

SEQ ID NO: 3614027 - RNA, 18 nt, Human
ccaggcccucugcccacu

SEQ ID NO: 3614028 - RNA, 21 nt, Human
ccaggcccucugcccacuccc

SEQ ID NO: 3614029 - RNA, 18 nt, Human
ccaggccgagaagccagu

SEQ ID NO: 3614030 - RNA, 15 nt, Human
ccaggccgccccagc

SEQ ID NO: 3614031 - RNA, 21 nt, Human
ccaggccgccccagccucuga

SEQ ID NO: 3614032 - RNA, 14 nt, Human
ccaggccggccagc

SEQ ID NO: 3614033 - RNA, 21 nt, Human
ccaggccgggaaaaagcccac

SEQ ID NO: 3614034 - RNA, 17 nt, Human
ccaggccgggccuguac

SEQ ID NO: 3614035 - RNA, 23 nt, Human
ccaggccgggccuguacagucug

SEQ ID NO: 3614036 - RNA, 21 nt, Human
ccaggccgggguggagcaugg

SEQ ID NO: 3614037 - RNA, 16 nt, Human
ccaggccguggcugcc

SEQ ID NO: 3614038 - RNA, 16 nt, Human
ccaggccuacuccugu

SEQ ID NO: 3614039 - RNA, 17 nt, Human
ccaggccuacuccuguc

SEQ ID NO: 3614040 - RNA, 18 nt, Human
ccaggccuacuccugucu

SEQ ID NO: 3614041 - RNA, 13 nt, Human
ccaggccuccuac

SEQ ID NO: 3614042 - RNA, 13 nt, Human
ccaggccucugug

SEQ ID NO: 3614043 - RNA, 16 nt, Human
ccaggccucugugucc

SEQ ID NO: 3614044 - RNA, 13 nt, Human
ccaggccugccuc

SEQ ID NO: 3614045 - RNA, 17 nt, Human
ccaggccugggucugug

SEQ ID NO: 3614046 - RNA, 13 nt, Human
ccaggccuguugc

SEQ ID NO: 3614047 - RNA, 18 nt, Human
ccaggccuuaucuccaag

SEQ ID NO: 3614048 - RNA, 18 nt, Human
ccaggcgccccuuccccc

SEQ ID NO: 3614049 - RNA, 19 nt, Human
ccaggcgccccuucccccu

SEQ ID NO: 3614050 - RNA, 23 nt, Human
ccaggcgcuagcacagcucccuu

SEQ ID NO: 3614051 - RNA, 21 nt, Human
ccaggcgggagcgguggcccu

SEQ ID NO: 3614052 - RNA, 18 nt, Human
ccaggcgggcucaaggaa

SEQ ID NO: 3614053 - RNA, 19 nt, Human
ccaggcuagcuggagccug

SEQ ID NO: 3614054 - RNA, 15 nt, Human
ccaggcuccuuccug

SEQ ID NO: 3614055 - RNA, 21 nt, Human
ccaggcuccuuuagcgcccag

SEQ ID NO: 3614056 - RNA, 17 nt, Human
ccaggcucggccugccc

SEQ ID NO: 3614057 - RNA, 18 nt, Human
ccaggcucguggacugag

SEQ ID NO: 3614058 - RNA, 13 nt, Human
ccaggcucugugc

SEQ ID NO: 3614059 - RNA, 19 nt, Human
ccaggcucugugcugaccc

SEQ ID NO: 3614060 - RNA, 22 nt, Human
ccaggcucuuuggggucagcca

SEQ ID NO: 3614061 - RNA, 13 nt, Human
ccaggcugaagca

SEQ ID NO: 3614062 - RNA, 18 nt, Human
ccaggcugaccacagcac

SEQ ID NO: 3614063 - RNA, 22 nt, Human
ccaggcugagccucagucuccc

SEQ ID NO: 3614064 - RNA, 18 nt, Human
ccaggcugcauagaagga

SEQ ID NO: 3614065 - RNA, 21 nt, Human
ccaggcugcauagaaggagga

SEQ ID NO: 3614066 - RNA, 13 nt, Human
ccaggcugccaag

SEQ ID NO: 3614067 - RNA, 19 nt, Human
ccaggcugccaaggccaga

SEQ ID NO: 3614068 - RNA, 15 nt, Human
ccaggcugccugagc

SEQ ID NO: 3614069 - RNA, 17 nt, Human
ccaggcugccugagcac

SEQ ID NO: 3614070 - RNA, 13 nt, Human
ccaggcugcucag

SEQ ID NO: 3614071 - RNA, 14 nt, Human
ccaggcugcucuca

SEQ ID NO: 3614072 - RNA, 21 nt, Human
ccaggcugcucuugaacuccu

SEQ ID NO: 3614073 - RNA, 14 nt, Human
ccaggcugcuggac

SEQ ID NO: 3614074 - RNA, 13 nt, Human
ccaggcuggacau

SEQ ID NO: 3614075 - RNA, 17 nt, Human
ccaggcuggagugcagu

SEQ ID NO: 3614076 - RNA, 18 nt, Human
ccaggcuggagugcagug

SEQ ID NO: 3614077 - RNA, 14 nt, Human
ccaggcuggccagc

SEQ ID NO: 3614078 - RNA, 15 nt, Human
ccaggcuggccagcc

SEQ ID NO: 3614079 - RNA, 18 nt, Human
ccaggcuggccagcccca

SEQ ID NO: 3614080 - RNA, 13 nt, Human
ccaggcuggcgca

SEQ ID NO: 3614081 - RNA, 15 nt, Human
ccaggcuggcgcagc

SEQ ID NO: 3614082 - RNA, 18 nt, Human
ccaggcuggcgcagccaa

SEQ ID NO: 3614083 - RNA, 23 nt, Human
ccaggcuggcgcagccaaggccg

SEQ ID NO: 3614084 - RNA, 14 nt, Human
ccaggcugggagag

SEQ ID NO: 3614085 - RNA, 20 nt, Human
ccaggcugggagagccuucc

SEQ ID NO: 3614086 - RNA, 21 nt, Human
ccaggcugggagagccuucca

SEQ ID NO: 3614087 - RNA, 18 nt, Human
ccaggcugggcaaggagg

SEQ ID NO: 3614088 - RNA, 12 nt, Human
ccaggcuggguc

SEQ ID NO: 3614089 - RNA, 17 nt, Human
ccaggcuggucuaaaac

SEQ ID NO: 3614090 - RNA, 20 nt, Human
ccaggcuggucuaaaacucc

SEQ ID NO: 3614091 - RNA, 13 nt, Human
ccaggcuggucuu

SEQ ID NO: 3614092 - RNA, 22 nt, Human
ccaggcugugggccucaaggac

SEQ ID NO: 3614093 - RNA, 17 nt, Human
ccaggcuuagucacuga

SEQ ID NO: 3614094 - RNA, 20 nt, Human
ccaggcuuagucacugagac

SEQ ID NO: 3614095 - RNA, 22 nt, Human
ccaggcuuagucacugagacag

SEQ ID NO: 3614096 - RNA, 15 nt, Human
ccaggcuucugcugg

SEQ ID NO: 3614097 - RNA, 16 nt, Human
ccaggcuucugcuggg

SEQ ID NO: 3614098 - RNA, 12 nt, Human
ccaggcuuggaa

SEQ ID NO: 3614099 - RNA, 19 nt, Human
ccaggcuuucuagaaagaa

SEQ ID NO: 3614100 - RNA, 18 nt, Human
ccaggcuuuguacagagu

SEQ ID NO: 3614101 - RNA, 17 nt, Human
ccagggaagcuggccga

SEQ ID NO: 3614102 - RNA, 17 nt, Human
ccagggaagcugucccu

SEQ ID NO: 3614103 - RNA, 16 nt, Human
ccagggaaguccccga

SEQ ID NO: 3614104 - RNA, 14 nt, Human
ccagggacaccagc

SEQ ID NO: 3614105 - RNA, 15 nt, Human
ccagggacaccagcc

SEQ ID NO: 3614106 - RNA, 16 nt, Human
ccagggacaccagcca

SEQ ID NO: 3614107 - RNA, 18 nt, Human
ccagggacaccagccagg

SEQ ID NO: 3614108 - RNA, 21 nt, Human
ccagggacagaggccccagcc

SEQ ID NO: 3614109 - RNA, 15 nt, Human
ccagggacagagggg

SEQ ID NO: 3614110 - RNA, 18 nt, Human
ccagggacgaagaagagc

SEQ ID NO: 3614111 - RNA, 17 nt, Human
ccagggagagcccagga

SEQ ID NO: 3614112 - RNA, 14 nt, Human
ccagggagaggcca

SEQ ID NO: 3614113 - RNA, 13 nt, Human
ccagggagagggg

SEQ ID NO: 3614114 - RNA, 18 nt, Human
ccagggagagggggcugg

SEQ ID NO: 3614115 - RNA, 19 nt, Human
ccagggagcaugagaggag

SEQ ID NO: 3614116 - RNA, 21 nt, Human
ccagggagcauuuuccuccau

SEQ ID NO: 3614117 - RNA, 14 nt, Human
ccagggagccuaga

SEQ ID NO: 3614118 - RNA, 16 nt, Human
ccagggagccuagaag

SEQ ID NO: 3614119 - RNA, 15 nt, Human
ccagggagcugcagg

SEQ ID NO: 3614120 - RNA, 19 nt, Human
ccagggagcugcaggggca

SEQ ID NO: 3614121 - RNA, 22 nt, Human
ccagggagcuugaaaguuuuca

SEQ ID NO: 3614122 - RNA, 23 nt, Human
ccagggaggggccggcccugugu

SEQ ID NO: 3614123 - RNA, 17 nt, Human
ccagggaguccccuccc

SEQ ID NO: 3614124 - RNA, 20 nt, Human
ccagggaugauucaagccau

SEQ ID NO: 3614125 - RNA, 23 nt, Human
ccagggaugccaucugugggcac

SEQ ID NO: 3614126 - RNA, 20 nt, Human
ccagggauggggccacagcc

SEQ ID NO: 3614127 - RNA, 20 nt, Human
ccagggcaagcuccgcagga

SEQ ID NO: 3614128 - RNA, 10 nt, Human
ccagggcaca

SEQ ID NO: 3614129 - RNA, 13 nt, Human
ccagggcacagga

SEQ ID NO: 3614130 - RNA, 14 nt, Human
ccagggcacaggag

SEQ ID NO: 3614131 - RNA, 20 nt, Human
ccagggcacaggagcuaccu

SEQ ID NO: 3614132 - RNA, 22 nt, Human
ccagggcaccaagcccacaggu

SEQ ID NO: 3614133 - RNA, 19 nt, Human
ccagggcacuucacagagu

SEQ ID NO: 3614134 - RNA, 15 nt, Human
ccagggcagccaggg

SEQ ID NO: 3614135 - RNA, 12 nt, Human
ccagggcagugc

SEQ ID NO: 3614136 - RNA, 14 nt, Human
ccagggcagugcua

SEQ ID NO: 3614137 - RNA, 14 nt, Human
ccagggcaucucug

SEQ ID NO: 3614138 - RNA, 17 nt, Human
ccagggcaucucugggc

SEQ ID NO: 3614139 - RNA, 18 nt, Human
ccagggcaucucugggcu

SEQ ID NO: 3614140 - RNA, 19 nt, Human
ccagggcaucucugggcug

SEQ ID NO: 3614141 - RNA, 20 nt, Human
ccagggcaucucugggcugg

SEQ ID NO: 3614142 - RNA, 15 nt, Human
ccagggcaucuggga

SEQ ID NO: 3614143 - RNA, 19 nt, Human
ccagggccacgcuccagcu

SEQ ID NO: 3614144 - RNA, 19 nt, Human
ccagggccacgugccaggc

SEQ ID NO: 3614145 - RNA, 17 nt, Human
ccagggccacucugccu

SEQ ID NO: 3614146 - RNA, 14 nt, Human
ccagucaaccuggg

SEQ ID NO: 3614147 - RNA, 13 nt, Human
ccagucaccccgg

SEQ ID NO: 3614148 - RNA, 19 nt, Human
ccagucaccccggccaccu

SEQ ID NO: 3614149 - RNA, 21 nt, Human
ccagucaccccggccaccugc

SEQ ID NO: 3614150 - RNA, 15 nt, Human
ccagucagccucucu

SEQ ID NO: 3614151 - RNA, 18 nt, Human
ccagucagccucucuccc

SEQ ID NO: 3614152 - RNA, 22 nt, Human
ccagucagccucucucccaguc

SEQ ID NO: 3614153 - RNA, 22 nt, Human
ccagucauuauguuaauauuuc

SEQ ID NO: 3614154 - RNA, 21 nt, Human
ccaguccaaauguccuccaga

SEQ ID NO: 3614155 - RNA, 21 nt, Human
ccaguccaaucucauggagaa

SEQ ID NO: 3614156 - RNA, 22 nt, Human
ccaguccaaucucauggagaag

SEQ ID NO: 3614157 - RNA, 17 nt, Human
ccaguccacccugccug

SEQ ID NO: 3614158 - RNA, 16 nt, Human
ccaguccaggcugccg

SEQ ID NO: 3614159 - RNA, 13 nt, Human
ccagucccagagc

SEQ ID NO: 3614160 - RNA, 20 nt, Human
ccagucccagcagccagcca

SEQ ID NO: 3614161 - RNA, 17 nt, Human
ccaguccccaccccugc

SEQ ID NO: 3614162 - RNA, 16 nt, Human
ccaguccccagaacuc

SEQ ID NO: 3614163 - RNA, 21 nt, Human
ccaguccccagaacucugccu

SEQ ID NO: 3614164 - RNA, 16 nt, Human
ccagucccccaacccc

SEQ ID NO: 3614165 - RNA, 20 nt, Human
cacuuggggguucaggcccg

SEQ ID NO: 3614166 - RNA, 20 nt, Human
cacuuggucugugagaugcu

SEQ ID NO: 3614167 - RNA, 17 nt, Human
cacuuggugcugggaac

SEQ ID NO: 3614168 - RNA, 17 nt, Human
cacuuguacaaaauaaa

SEQ ID NO: 3614169 - RNA, 16 nt, Human
cacuuguagauuugau

SEQ ID NO: 3614170 - RNA, 15 nt, Human
cacuuguauaaaugu

SEQ ID NO: 3614171 - RNA, 22 nt, Human
cacuugucacugacacaaagga

SEQ ID NO: 3614172 - RNA, 19 nt, Human
cacuugucccacuaucugg

SEQ ID NO: 3614173 - RNA, 22 nt, Human
cacuugucccacuaucugggug

SEQ ID NO: 3614174 - RNA, 12 nt, Human
cacuugucccca

SEQ ID NO: 3614175 - RNA, 21 nt, Human
cacuuguccuuagccuggacc

SEQ ID NO: 3614176 - RNA, 12 nt, Human
cacuugugaaua

SEQ ID NO: 3614177 - RNA, 17 nt, Human
cacuugugacuuuugcu

SEQ ID NO: 3614178 - RNA, 21 nt, Human
cacuugugacuuuugcuuuaa

SEQ ID NO: 3614179 - RNA, 18 nt, Human
cacuugugccaacacuca

SEQ ID NO: 3614180 - RNA, 22 nt, Human
cacuugugccaacacucaagaa

SEQ ID NO: 3614181 - RNA, 24 nt, Human
cacuugugccaacacucaagaagc

SEQ ID NO: 3614182 - RNA, 15 nt, Human
cacuugugcuuugcu

SEQ ID NO: 3614183 - RNA, 13 nt, Human
cacuugugugugg

SEQ ID NO: 3614184 - RNA, 15 nt, Human
cacuugugugugggc

SEQ ID NO: 3614185 - RNA, 22 nt, Human
cacuugugugugggcugugagu

SEQ ID NO: 3614186 - RNA, 15 nt, Human
cacuuguuccagcuc

SEQ ID NO: 3614187 - RNA, 16 nt, Human
cacuuguuccagcucu

SEQ ID NO: 3614188 - RNA, 19 nt, Human
cacuuguugauuaauggaa

SEQ ID NO: 3614189 - RNA, 13 nt, Human
cacuuuaaaccug

SEQ ID NO: 3614190 - RNA, 22 nt, Human
cacuuuaauucucaugugaucc

SEQ ID NO: 3614191 - RNA, 22 nt, Human
cacuuuacaauguucaucccau

SEQ ID NO: 3614192 - RNA, 19 nt, Human
cacuuuacccaccuagaac

SEQ ID NO: 3614193 - RNA, 20 nt, Human
cacuuuacccaccuagaaca

SEQ ID NO: 3614194 - RNA, 22 nt, Human
cacuuuacccaccuagaacacu

SEQ ID NO: 3614195 - RNA, 14 nt, Human
cacuuuagaugcug

SEQ ID NO: 3614196 - RNA, 17 nt, Human
cacuuuagggcuguaaa

SEQ ID NO: 3614197 - RNA, 18 nt, Human
cacuuuagggcuguaaaa

SEQ ID NO: 3614198 - RNA, 23 nt, Human
cacuuuagggcuguaaaaugcau

SEQ ID NO: 3614199 - RNA, 22 nt, Human
cacuuuauaagucauuguaugu

SEQ ID NO: 3614200 - RNA, 13 nt, Human
cacuuuauugcca

SEQ ID NO: 3614201 - RNA, 23 nt, Human
cacuuuauugccuuuuaauuuuu

SEQ ID NO: 3614202 - RNA, 14 nt, Human
cacuuuauuuacuu

SEQ ID NO: 3614203 - RNA, 17 nt, Human
cacuuucaggaacacuc

SEQ ID NO: 3614204 - RNA, 17 nt, Human
cacuuucagugaaagca

SEQ ID NO: 3614205 - RNA, 18 nt, Human
cacuuucagugaaagcau

SEQ ID NO: 3614206 - RNA, 19 nt, Human
cacuuucagugaaagcauc

SEQ ID NO: 3614207 - RNA, 15 nt, Human
cacuuucauaaucuu

SEQ ID NO: 3614208 - RNA, 21 nt, Human
cacuuucauugccagugucuu

SEQ ID NO: 3614209 - RNA, 23 nt, Human
cacuuucauugccagugucuuuc

SEQ ID NO: 3614210 - RNA, 18 nt, Human
cacuuuccacuucuuccu

SEQ ID NO: 3614211 - RNA, 17 nt, Human
cacuuucuaauguuucu

SEQ ID NO: 3614212 - RNA, 18 nt, Human
cacuuucuaauguuucug

SEQ ID NO: 3614213 - RNA, 19 nt, Human
cacuuucuacaaugugaac

SEQ ID NO: 3614214 - RNA, 16 nt, Human
cacuuucuagccagag

SEQ ID NO: 3614215 - RNA, 19 nt, Human
cacuuucuagccagaggag

SEQ ID NO: 3614216 - RNA, 16 nt, Human
cacuuucuauagcaga

SEQ ID NO: 3614217 - RNA, 20 nt, Human
cacuuucuauccucuguaaa

SEQ ID NO: 3614218 - RNA, 19 nt, Human
cacuuucucaguuuucaua

SEQ ID NO: 3614219 - RNA, 22 nt, Human
cacuuucucaugauuuacagag

SEQ ID NO: 3614220 - RNA, 15 nt, Human
cacuuugaaauaccu

SEQ ID NO: 3614221 - RNA, 21 nt, Human
cacuuugaaauaccucauguu

SEQ ID NO: 3614222 - RNA, 23 nt, Human
cacuuugaugucauguguucccu

SEQ ID NO: 3614223 - RNA, 18 nt, Human
cacuuugcacauuuugau

SEQ ID NO: 3614224 - RNA, 23 nt, Human
cacuuugcacgacgcccucuccc

SEQ ID NO: 3614225 - RNA, 22 nt, Human
cacuuugcacugauauaucaug

SEQ ID NO: 3614226 - RNA, 12 nt, Human
cacuuugcauaa

SEQ ID NO: 3614227 - RNA, 23 nt, Human
cacuuugcauaugagccgugaac

SEQ ID NO: 3614228 - RNA, 13 nt, Human
cacuuugcucuga

SEQ ID NO: 3614229 - RNA, 13 nt, Human
cacuuugggaggc

SEQ ID NO: 3614230 - RNA, 12 nt, Human
cacuuuguaaau

SEQ ID NO: 3614231 - RNA, 20 nt, Human
cacuuugucgcccaggcugg

SEQ ID NO: 3614232 - RNA, 14 nt, Human
cacuuuguucuuua

SEQ ID NO: 3614233 - RNA, 23 nt, Human
cacuuuguugcaagaugugaauu

SEQ ID NO: 3614234 - RNA, 21 nt, Human
cacuuuguuucguggggaggu

SEQ ID NO: 3614235 - RNA, 16 nt, Human
cacuuuuaugagcuuc

SEQ ID NO: 3614236 - RNA, 17 nt, Human
cacuuuucauaucauuu

SEQ ID NO: 3614237 - RNA, 18 nt, Human
cacuuuucauaucauuuc

SEQ ID NO: 3614238 - RNA, 13 nt, Human
cacuuuucccacu

SEQ ID NO: 3614239 - RNA, 14 nt, Human
cacuuuucccacuc

SEQ ID NO: 3614240 - RNA, 17 nt, Human
cacuuuugacaaaggca

SEQ ID NO: 3614241 - RNA, 15 nt, Human
cacuuuugagacuuu

SEQ ID NO: 3614242 - RNA, 21 nt, Human
cacuuuugcaagguuccacag

SEQ ID NO: 3614243 - RNA, 13 nt, Human
cacuuuuugaacu

SEQ ID NO: 3614244 - RNA, 16 nt, Human
cacuuuuugaggcaaa

SEQ ID NO: 3614245 - RNA, 15 nt, Human
cacuuuuugcagcuu

SEQ ID NO: 3614246 - RNA, 14 nt, Human
cacuuuuuuccaca

SEQ ID NO: 3614247 - RNA, 14 nt, Human
cacuuuuuuuuucc

SEQ ID NO: 3614248 - RNA, 16 nt, Human
cacuuuuuuuuuccaa

SEQ ID NO: 3614249 - RNA, 23 nt, Human
cacuuuuuuuuuuaaucuccacc

SEQ ID NO: 3614250 - RNA, 19 nt, Human
cagaaaaaaugucuguaaa

SEQ ID NO: 3614251 - RNA, 14 nt, Human
cagaaaaacaauaa

SEQ ID NO: 3614252 - RNA, 13 nt, Human
cagaaaaaccaga

SEQ ID NO: 3614253 - RNA, 21 nt, Human
cagaaaaauaacuucaagcaa

SEQ ID NO: 3614254 - RNA, 18 nt, Human
cagaaaaauauguaccaa

SEQ ID NO: 3614255 - RNA, 22 nt, Human
cagaaaaauauguaccaagaau

SEQ ID NO: 3614256 - RNA, 13 nt, Human
cagaaaaauggag

SEQ ID NO: 3614257 - RNA, 20 nt, Human
cagaaaaauggagcaaagug

SEQ ID NO: 3614258 - RNA, 17 nt, Human
cagaaaacaacaaaaaa

SEQ ID NO: 3614259 - RNA, 20 nt, Human
cagaaaacaacaaaaaauaa

SEQ ID NO: 3614260 - RNA, 11 nt, Human
cagaaaacaga

SEQ ID NO: 3614261 - RNA, 12 nt, Human
cagaaaacagaa

SEQ ID NO: 3614262 - RNA, 14 nt, Human
cagaaaacagaaaa

SEQ ID NO: 3614263 - RNA, 20 nt, Human
cagaaaacagaaaaaaaaca

SEQ ID NO: 3614264 - RNA, 16 nt, Human
cagaaaacauguuucc

SEQ ID NO: 3614265 - RNA, 13 nt, Human
cagaaaacauugu

SEQ ID NO: 3614266 - RNA, 15 nt, Human
cagaaaagcaccugc

SEQ ID NO: 3614267 - RNA, 17 nt, Human
cagaaaagcaccugccg

SEQ ID NO: 3614268 - RNA, 18 nt, Human
cagaaaagggaaguugug

SEQ ID NO: 3614269 - RNA, 21 nt, Human
cagaaaauaaggcacccaucu

SEQ ID NO: 3614270 - RNA, 12 nt, Human
cagaaaauauac

SEQ ID NO: 3614271 - RNA, 13 nt, Human
cagaaaauauacu

SEQ ID NO: 3614272 - RNA, 14 nt, Human
cagaaaauauacug

SEQ ID NO: 3614273 - RNA, 15 nt, Human
cagaaaauauacugu

SEQ ID NO: 3614274 - RNA, 18 nt, Human
cagaaaauauacuguaaa

SEQ ID NO: 3614275 - RNA, 19 nt, Human
cagaaaauauacuguaaag

SEQ ID NO: 3614276 - RNA, 19 nt, Human
cagaaaauaucccuccugu

SEQ ID NO: 3614277 - RNA, 22 nt, Human
cagaaaauauguauuaacacua

SEQ ID NO: 3614278 - RNA, 16 nt, Human
cagaaaauggaagaca

SEQ ID NO: 3614279 - RNA, 22 nt, Human
cagaaaauggaagacagcucuu

SEQ ID NO: 3614280 - RNA, 14 nt, Human
cagaaaauguugag

SEQ ID NO: 3614281 - RNA, 23 nt, Human
cagaaaauguugagaaucccaaa

SEQ ID NO: 3614282 - RNA, 13 nt, Human
cagaaaauucugu

SEQ ID NO: 3614283 - RNA, 15 nt, Human
cagaaaauucugugc

SEQ ID NO: 3614284 - RNA, 17 nt, Human
cagaaaauucugugccu

SEQ ID NO: 3614285 - RNA, 19 nt, Human
cagaaaauuguacaaccug

SEQ ID NO: 3614286 - RNA, 20 nt, Human
cagaaacaaaaacacuaaaa

SEQ ID NO: 3614287 - RNA, 18 nt, Human
cagaaacacccacaggca

SEQ ID NO: 3614288 - RNA, 18 nt, Human
cagaaacacccucacacu

SEQ ID NO: 3614289 - RNA, 22 nt, Human
cagaaacacccucacacuggga

SEQ ID NO: 3614290 - RNA, 20 nt, Human
cagaauuucccaaagcagug

SEQ ID NO: 3614291 - RNA, 13 nt, Human
cagaauuugaauu

SEQ ID NO: 3614292 - RNA, 15 nt, Human
cagaauuugaauuau

SEQ ID NO: 3614293 - RNA, 22 nt, Human
cagaauuuggaaauccuaguuu

SEQ ID NO: 3614294 - RNA, 19 nt, Human
cagaauuuggguucugccu

SEQ ID NO: 3614295 - RNA, 23 nt, Human
cagaauuuuaggaacuucagaga

SEQ ID NO: 3614296 - RNA, 20 nt, Human
cagacaaaaacagccucaca

SEQ ID NO: 3614297 - RNA, 17 nt, Human
cagacaaaccagaagca

SEQ ID NO: 3614298 - RNA, 22 nt, Human
cagacaaaugugguuacacacu

SEQ ID NO: 3614299 - RNA, 16 nt, Human
cagacaacaaaccugu

SEQ ID NO: 3614300 - RNA, 19 nt, Human
cagacaagcaacagguuuu

SEQ ID NO: 3614301 - RNA, 19 nt, Human
cagacaagcuguugaccag

SEQ ID NO: 3614302 - RNA, 17 nt, Human
cagacaaggaaauaccc

SEQ ID NO: 3614303 - RNA, 23 nt, Human
cagacaauaaacccucagagccu

SEQ ID NO: 3614304 - RNA, 21 nt, Human
cagacacaaagagacaaagcu

SEQ ID NO: 3614305 - RNA, 11 nt, Human
cagacacacac

SEQ ID NO: 3614306 - RNA, 14 nt, Human
cagacacacacacg

SEQ ID NO: 3614307 - RNA, 21 nt, Human
cagacacacacacgcacgcac

SEQ ID NO: 3614308 - RNA, 22 nt, Human
cagacacacacacgcacgcaca

SEQ ID NO: 3614309 - RNA, 18 nt, Human
cagacacacgcacacaca

SEQ ID NO: 3614310 - RNA, 14 nt, Human
cagacacagaagag

SEQ ID NO: 3614311 - RNA, 13 nt, Human
cagacacaggccc

SEQ ID NO: 3614312 - RNA, 17 nt, Human
cagacacaggcccggcu

SEQ ID NO: 3614313 - RNA, 21 nt, Human
cagacacaggcccggcuccag

SEQ ID NO: 3614314 - RNA, 23 nt, Human
cagacacaggcccggcuccaggc

SEQ ID NO: 3614315 - RNA, 14 nt, Human
cagacacaggcccu

SEQ ID NO: 3614316 - RNA, 18 nt, Human
cagacacaggcccucccu

SEQ ID NO: 3614317 - RNA, 14 nt, Human
cagacacaugucca

SEQ ID NO: 3614318 - RNA, 17 nt, Human
cagacacccaggacuua

SEQ ID NO: 3614319 - RNA, 20 nt, Human
cagacaccuugacagggcac

SEQ ID NO: 3614320 - RNA, 19 nt, Human
cagacacgccuuccccuca

SEQ ID NO: 3614321 - RNA, 22 nt, Human
cagacacggaucugagaaucuu

SEQ ID NO: 3614322 - RNA, 14 nt, Human
cagacacucugcuc

SEQ ID NO: 3614323 - RNA, 19 nt, Human
cagacacucugcucugccc

SEQ ID NO: 3614324 - RNA, 20 nt, Human
cagacacucugcucugcccu

SEQ ID NO: 3614325 - RNA, 14 nt, Human
cagacacucuggcu

SEQ ID NO: 3614326 - RNA, 22 nt, Human
cagacagaacuugaauguguca

SEQ ID NO: 3614327 - RNA, 23 nt, Human
cagacagaacuugaaugugucag

SEQ ID NO: 3614328 - RNA, 13 nt, Human
cagacagaagucu

SEQ ID NO: 3614329 - RNA, 19 nt, Human
cagacagacaucucugcac

SEQ ID NO: 3614330 - RNA, 22 nt, Human
cagacagagaauaugucugcuc

SEQ ID NO: 3614331 - RNA, 18 nt, Human
cagacagagccaggagaa

SEQ ID NO: 3614332 - RNA, 20 nt, Human
cagacagagccaggagaagc

SEQ ID NO: 3614333 - RNA, 12 nt, Human
cagacagaggau

SEQ ID NO: 3614334 - RNA, 19 nt, Human
cagacagaggaugagcucu

SEQ ID NO: 3614335 - RNA, 17 nt, Human
cagacagaugaggcuuu

SEQ ID NO: 3614336 - RNA, 18 nt, Human
cagacagaugaggcuuuc

SEQ ID NO: 3614337 - RNA, 21 nt, Human
cagacagcaacggggaggcca

SEQ ID NO: 3614338 - RNA, 13 nt, Human
cagacagcagcuc

SEQ ID NO: 3614339 - RNA, 15 nt, Human
cagacagcagcucag

SEQ ID NO: 3614340 - RNA, 17 nt, Human
cagacagcaggcagcgc

SEQ ID NO: 3614341 - RNA, 14 nt, Human
cagacagccuguau

SEQ ID NO: 3614342 - RNA, 18 nt, Human
cagacaggaccccugcag

SEQ ID NO: 3614343 - RNA, 11 nt, Human
cagacaggcaa

SEQ ID NO: 3614344 - RNA, 18 nt, Human
cagacaggcaagcaccuc

SEQ ID NO: 3614345 - RNA, 21 nt, Human
cagacaggcaagcaccuccug

SEQ ID NO: 3614346 - RNA, 23 nt, Human
cagacaggcaagcaccuccugcc

SEQ ID NO: 3614347 - RNA, 15 nt, Human
cagacaggccccgug

SEQ ID NO: 3614348 - RNA, 22 nt, Human
cagacagggaauuaggccccca

SEQ ID NO: 3614349 - RNA, 18 nt, Human
cagacagggggccagaac

SEQ ID NO: 3614350 - RNA, 21 nt, Human
cagacagguuuucacauaaau

SEQ ID NO: 3614351 - RNA, 23 nt, Human
cagacagguuuucacauaaaugc

SEQ ID NO: 3614352 - RNA, 18 nt, Human
cagacaguggaugagaca

SEQ ID NO: 3614353 - RNA, 19 nt, Human
cagacaguguuuucuggga

SEQ ID NO: 3614354 - RNA, 13 nt, Human
cagacauaaagcc

SEQ ID NO: 3614355 - RNA, 14 nt, Human
cagacauaaagcca

SEQ ID NO: 3614356 - RNA, 15 nt, Human
cagacauaaagccau

SEQ ID NO: 3614357 - RNA, 14 nt, Human
cagacauaaaggaa

SEQ ID NO: 3614358 - RNA, 20 nt, Human
cagacauaaaggaaaagaca

SEQ ID NO: 3614359 - RNA, 18 nt, Human
cagacauacgaaacacaa

SEQ ID NO: 3614360 - RNA, 17 nt, Human
cagacauagaauuaaca

SEQ ID NO: 3614361 - RNA, 15 nt, Human
cagacaucucugcac

SEQ ID NO: 3614362 - RNA, 14 nt, Human
cagacauugucagc

SEQ ID NO: 3614363 - RNA, 17 nt, Human
cagacauugucagcaaa

SEQ ID NO: 3614364 - RNA, 13 nt, Human
cagacauuguuuu

SEQ ID NO: 3614365 - RNA, 14 nt, Human
cagaccacaaaacu

SEQ ID NO: 3614366 - RNA, 19 nt, Human
cagaccagcaggcuggccu

SEQ ID NO: 3614367 - RNA, 12 nt, Human
cagacccagugg

SEQ ID NO: 3614368 - RNA, 16 nt, Human
cagaccccagcggcug

SEQ ID NO: 3614369 - RNA, 13 nt, Human
cagaccccaggcu

SEQ ID NO: 3614370 - RNA, 13 nt, Human
cagacccccaccc

SEQ ID NO: 3614371 - RNA, 21 nt, Human
ccauucucacaggucccaaau

SEQ ID NO: 3614372 - RNA, 16 nt, Human
ccauucucaucugcac

SEQ ID NO: 3614373 - RNA, 22 nt, Human
ccauucucaucugcacccuucu

SEQ ID NO: 3614374 - RNA, 16 nt, Human
ccauucuccacagcaa

SEQ ID NO: 3614375 - RNA, 18 nt, Human
ccauucuccacagcaacc

SEQ ID NO: 3614376 - RNA, 17 nt, Human
ccauucuccaccugcca

SEQ ID NO: 3614377 - RNA, 17 nt, Human
ccauucuccauuuguua

SEQ ID NO: 3614378 - RNA, 14 nt, Human
ccauucucccaggu

SEQ ID NO: 3614379 - RNA, 13 nt, Human
ccauucuccugag

SEQ ID NO: 3614380 - RNA, 16 nt, Human
ccauucucucuccugu

SEQ ID NO: 3614381 - RNA, 19 nt, Human
ccauucucucuccugucca

SEQ ID NO: 3614382 - RNA, 16 nt, Human
ccauucugaccauuuc

SEQ ID NO: 3614383 - RNA, 12 nt, Human
ccauucugacuc

SEQ ID NO: 3614384 - RNA, 21 nt, Human
ccauucugccugcccaggccc

SEQ ID NO: 3614385 - RNA, 13 nt, Human
ccauucugcuccu

SEQ ID NO: 3614386 - RNA, 23 nt, Human
ccauucuuacuuacuaaaauaua

SEQ ID NO: 3614387 - RNA, 14 nt, Human
ccauucuuccuagu

SEQ ID NO: 3614388 - RNA, 19 nt, Human
ccauucuuccuaguuuucu

SEQ ID NO: 3614389 - RNA, 12 nt, Human
ccauucuuucug

SEQ ID NO: 3614390 - RNA, 17 nt, Human
ccauucuuucugauaac

SEQ ID NO: 3614391 - RNA, 15 nt, Human
ccauucuuugcuuga

SEQ ID NO: 3614392 - RNA, 16 nt, Human
ccauucuuuuguaauu

SEQ ID NO: 3614393 - RNA, 22 nt, Human
ccauucuuuuguaauuuaaaug

SEQ ID NO: 3614394 - RNA, 14 nt, Human
ccauugaaaaugua

SEQ ID NO: 3614395 - RNA, 15 nt, Human
ccauugaacucugag

SEQ ID NO: 3614396 - RNA, 20 nt, Human
ccauugaagccgacucuggc

SEQ ID NO: 3614397 - RNA, 11 nt, Human
ccauugaaggc

SEQ ID NO: 3614398 - RNA, 22 nt, Human
ccauugaauucuugguugagga

SEQ ID NO: 3614399 - RNA, 16 nt, Human
ccauugcacccagccc

SEQ ID NO: 3614400 - RNA, 19 nt, Human
ccauugcacuccagccugg

SEQ ID NO: 3614401 - RNA, 21 nt, Human
ccauugccaccaggagaacca

SEQ ID NO: 3614402 - RNA, 15 nt, Human
ccauugcugcuccuu

SEQ ID NO: 3614403 - RNA, 20 nt, Human
ccauugcuguucuacuuuuu

SEQ ID NO: 3614404 - RNA, 18 nt, Human
ccauugcuuauuauguag

SEQ ID NO: 3614405 - RNA, 10 nt, Human
ccauugcuuc

SEQ ID NO: 3614406 - RNA, 14 nt, Human
ccauugcuucacua

SEQ ID NO: 3614407 - RNA, 19 nt, Human
ccauuggggcucccagcca

SEQ ID NO: 3614408 - RNA, 20 nt, Human
ccauuggggcucccagccag

SEQ ID NO: 3614409 - RNA, 23 nt, Human
ccauuguaacuuggauguagcca

SEQ ID NO: 3614410 - RNA, 20 nt, Human
ccauuguagcgucuuucuuu

SEQ ID NO: 3614411 - RNA, 19 nt, Human
ccauugucccucugcccca

SEQ ID NO: 3614412 - RNA, 10 nt, Human
ccauugucuu

SEQ ID NO: 3614413 - RNA, 17 nt, Human
ccauugugcauucuaga

SEQ ID NO: 3614414 - RNA, 20 nt, Human
ccauuguggccuaagaggcu

SEQ ID NO: 3614415 - RNA, 15 nt, Human
ccauuguuuaaaaau

SEQ ID NO: 3614416 - RNA, 14 nt, Human
ccauuuaaaaaguu

SEQ ID NO: 3614417 - RNA, 20 nt, Human
ccauuuaaacagauguccau

SEQ ID NO: 3614418 - RNA, 13 nt, Human
ccauuuacacuuu

SEQ ID NO: 3614419 - RNA, 22 nt, Human
ccauuuacauguuuuaaagaaa

SEQ ID NO: 3614420 - RNA, 16 nt, Human
ccauuuagguuucuga

SEQ ID NO: 3614421 - RNA, 23 nt, Human
ccauuuauaugugaucuuuguuu

SEQ ID NO: 3614422 - RNA, 16 nt, Human
ccauuuauccaccucc

SEQ ID NO: 3614423 - RNA, 15 nt, Human
ccauuuaucuugaag

SEQ ID NO: 3614424 - RNA, 17 nt, Human
ccauuucaauucucaaa

SEQ ID NO: 3614425 - RNA, 17 nt, Human
ccauuucacaccugaaa

SEQ ID NO: 3614426 - RNA, 21 nt, Human
ccauuucaguaaaccugucug

SEQ ID NO: 3614427 - RNA, 16 nt, Human
ccauuucaucuauuuc

SEQ ID NO: 3614428 - RNA, 15 nt, Human
ccauuuccauugcuu

SEQ ID NO: 3614429 - RNA, 14 nt, Human
ccauuucccaucug

SEQ ID NO: 3614430 - RNA, 15 nt, Human
ccauuucccaucugc

SEQ ID NO: 3614431 - RNA, 16 nt, Human
ccauuucccaucugca

SEQ ID NO: 3614432 - RNA, 18 nt, Human
ccauuucccaucugcacc

SEQ ID NO: 3614433 - RNA, 15 nt, Human
ccauuuccccagggc

SEQ ID NO: 3614434 - RNA, 16 nt, Human
ccauuuccccagggca

SEQ ID NO: 3614435 - RNA, 21 nt, Human
ccagccuuucucccaggccag

SEQ ID NO: 3614436 - RNA, 16 nt, Human
ccagccuuuguucccc

SEQ ID NO: 3614437 - RNA, 21 nt, Human
ccagccuuuguuccccacugg

SEQ ID NO: 3614438 - RNA, 13 nt, Human
ccagcgagcccug

SEQ ID NO: 3614439 - RNA, 21 nt, Human
ccagcgaucucuccacugugc

SEQ ID NO: 3614440 - RNA, 14 nt, Human
ccagcgcccgcugg

SEQ ID NO: 3614441 - RNA, 22 nt, Human
ccagcgccuaguggggucuccc

SEQ ID NO: 3614442 - RNA, 13 nt, Human
ccagcgccucccu

SEQ ID NO: 3614443 - RNA, 15 nt, Human
ccagcgccucccucc

SEQ ID NO: 3614444 - RNA, 16 nt, Human
ccagcgccucccucca

SEQ ID NO: 3614445 - RNA, 17 nt, Human
ccagcgccucccuccac

SEQ ID NO: 3614446 - RNA, 22 nt, Human
ccagcgccucccuccaccccag

SEQ ID NO: 3614447 - RNA, 14 nt, Human
ccagcgcucugccu

SEQ ID NO: 3614448 - RNA, 15 nt, Human
ccagcgcugacgugu

SEQ ID NO: 3614449 - RNA, 16 nt, Human
ccagcggacaguggca

SEQ ID NO: 3614450 - RNA, 22 nt, Human
ccagcggcuggugcagggccuc

SEQ ID NO: 3614451 - RNA, 22 nt, Human
ccagcgggaauggcagcugcca

SEQ ID NO: 3614452 - RNA, 15 nt, Human
ccagcggugggaccu

SEQ ID NO: 3614453 - RNA, 17 nt, Human
ccagcguccuccucugu

SEQ ID NO: 3614454 - RNA, 17 nt, Human
ccagcgucggucugugc

SEQ ID NO: 3614455 - RNA, 19 nt, Human
ccagcgucggucugugccc

SEQ ID NO: 3614456 - RNA, 17 nt, Human
ccagcguuugaggggcu

SEQ ID NO: 3614457 - RNA, 22 nt, Human
ccagcguuugaggggcuggccu

SEQ ID NO: 3614458 - RNA, 15 nt, Human
ccagcuaagaaccug

SEQ ID NO: 3614459 - RNA, 18 nt, Human
ccagcuaauaacugaucu

SEQ ID NO: 3614460 - RNA, 20 nt, Human
ccagcuaaucuguagggcug

SEQ ID NO: 3614461 - RNA, 21 nt, Human
ccagcuaaucuguagggcugg

SEQ ID NO: 3614462 - RNA, 17 nt, Human
ccagcuacaccuuucuc

SEQ ID NO: 3614463 - RNA, 19 nt, Human
ccagcuacaccuuucuccu

SEQ ID NO: 3614464 - RNA, 20 nt, Human
ccagcuacucagaagccuga

SEQ ID NO: 3614465 - RNA, 23 nt, Human
ccagcuacucagaagccugaggc

SEQ ID NO: 3614466 - RNA, 13 nt, Human
ccagcuacucagg

SEQ ID NO: 3614467 - RNA, 15 nt, Human
ccagcuacucaggag

SEQ ID NO: 3614468 - RNA, 21 nt, Human
ccagcuacucgggaggcugag

SEQ ID NO: 3614469 - RNA, 23 nt, Human
ccagcuacucgggaggcugaggc

SEQ ID NO: 3614470 - RNA, 15 nt, Human
ccagcuacuuccucc

SEQ ID NO: 3614471 - RNA, 14 nt, Human
ccagcuacuuggga

SEQ ID NO: 3614472 - RNA, 15 nt, Human
ccagcuauaccugug

SEQ ID NO: 3614473 - RNA, 15 nt, Human
ccagcuauacuguau

SEQ ID NO: 3614474 - RNA, 17 nt, Human
ccagcucaauggacugg

SEQ ID NO: 3614475 - RNA, 22 nt, Human
ccagcucaauggacuggaaggg

SEQ ID NO: 3614476 - RNA, 16 nt, Human
ccagcucaccagcccc

SEQ ID NO: 3614477 - RNA, 22 nt, Human
ccagcucaccagccccagugcc

SEQ ID NO: 3614478 - RNA, 14 nt, Human
ccagcucacgucac

SEQ ID NO: 3614479 - RNA, 14 nt, Human
ccagcucagaaccc

SEQ ID NO: 3614480 - RNA, 15 nt, Human
ccagcucagaaccca

SEQ ID NO: 3614481 - RNA, 16 nt, Human
ccagcucagaacccag

SEQ ID NO: 3614482 - RNA, 17 nt, Human
ccagcucagaacccagg

SEQ ID NO: 3614483 - RNA, 19 nt, Human
ccagcucagaacccagggc

SEQ ID NO: 3614484 - RNA, 13 nt, Human
ccagcucagaggg

SEQ ID NO: 3614485 - RNA, 15 nt, Human
ccagcucagcacugc

SEQ ID NO: 3614486 - RNA, 13 nt, Human
ccagcucaggaca

SEQ ID NO: 3614487 - RNA, 20 nt, Human
ccagcucaggacagaugcca

SEQ ID NO: 3614488 - RNA, 14 nt, Human
ccagcucaggggca

SEQ ID NO: 3614489 - RNA, 18 nt, Human
ccagcucaggggcagcuc

SEQ ID NO: 3614490 - RNA, 19 nt, Human
ccagcucaggggcagcuca

SEQ ID NO: 3614491 - RNA, 22 nt, Human
ccagcucagucccaucagagag

SEQ ID NO: 3614492 - RNA, 17 nt, Human
ccagcucagucuucccu

SEQ ID NO: 3614493 - RNA, 14 nt, Human
ccagcuccaaccug

SEQ ID NO: 3614494 - RNA, 21 nt, Human
ccagcuccaagaccuguuggu

SEQ ID NO: 3614495 - RNA, 12 nt, Human
ccagcuccaccc

SEQ ID NO: 3614496 - RNA, 15 nt, Human
ccagcuccaccccgc

SEQ ID NO: 3614497 - RNA, 18 nt, Human
ccagcuccagggccagau

SEQ ID NO: 3614498 - RNA, 19 nt, Human
ccagcucccaccuccccuu

SEQ ID NO: 3614499 - RNA, 20 nt, Human
ccagcucccaggaccacagg

SEQ ID NO: 3614500 - RNA, 21 nt, Human
ccagcucccaggaccacaggc

SEQ ID NO: 3614501 - RNA, 23 nt, Human
ccagcuccccaagaaagccucag

SEQ ID NO: 3614502 - RNA, 18 nt, Human
ccagcucccugugccccc

SEQ ID NO: 3614503 - RNA, 19 nt, Human
ccagcuccggccuguccuc

SEQ ID NO: 3614504 - RNA, 12 nt, Human
ccagcuccucau

SEQ ID NO: 3614505 - RNA, 20 nt, Human
ccagcuccucccuuguucuc

SEQ ID NO: 3614506 - RNA, 20 nt, Human
ccagcuccugacacugcugg

SEQ ID NO: 3614507 - RNA, 14 nt, Human
ccagcuccuuuggg

SEQ ID NO: 3614508 - RNA, 20 nt, Human
ccagcucuacccugcauggc

SEQ ID NO: 3614509 - RNA, 18 nt, Human
ccagcucuagacaacccu

SEQ ID NO: 3614510 - RNA, 19 nt, Human
ccagcucuagacaacccug

SEQ ID NO: 3614511 - RNA, 21 nt, Human
ccagcucuagacaacccugca

SEQ ID NO: 3614512 - RNA, 13 nt, Human
ccagcucucagcc

SEQ ID NO: 3614513 - RNA, 15 nt, Human
ccagcucucagccaa

SEQ ID NO: 3614514 - RNA, 16 nt, Human
ccagcucucccucugg

SEQ ID NO: 3614515 - RNA, 15 nt, Human
ccagcucugaaacca

SEQ ID NO: 3614516 - RNA, 21 nt, Human
ccagcucugaaaccaguguua

SEQ ID NO: 3614517 - RNA, 21 nt, Human
ccagcucugaggacugcacca

SEQ ID NO: 3614518 - RNA, 22 nt, Human
ccagcucugccgucucuggagc

SEQ ID NO: 3614519 - RNA, 22 nt, Human
ccagcucugcgucgguccuggu

SEQ ID NO: 3614520 - RNA, 12 nt, Human
ccagcucuggcu

SEQ ID NO: 3614521 - RNA, 14 nt, Human
ccagcucuggcuuc

SEQ ID NO: 3614522 - RNA, 17 nt, Human
ccagcucugguccauag

SEQ ID NO: 3614523 - RNA, 23 nt, Human
ccagcucuguucuuccucagcca

SEQ ID NO: 3614524 - RNA, 20 nt, Human
ccagcucuuccuagcuggag

SEQ ID NO: 3614525 - RNA, 19 nt, Human
ccagcucuucuccccaggu

SEQ ID NO: 3614526 - RNA, 22 nt, Human
ccagcugacaguccucuccacc

SEQ ID NO: 3614527 - RNA, 22 nt, Human
ccagcugacccugguucucucu

SEQ ID NO: 3614528 - RNA, 15 nt, Human
ccagcugagcgccag

SEQ ID NO: 3614529 - RNA, 15 nt, Human
ccagcugaugacuca

SEQ ID NO: 3614530 - RNA, 12 nt, Human
cccaaccagugc

SEQ ID NO: 3614531 - RNA, 18 nt, Human
cccaaccccaagccagcc

SEQ ID NO: 3614532 - RNA, 12 nt, Human
cccaaccccagc

SEQ ID NO: 3614533 - RNA, 22 nt, Human
cccaaccccagccgcucggagg

SEQ ID NO: 3614534 - RNA, 12 nt, Human
cccaacccccac

SEQ ID NO: 3614535 - RNA, 13 nt, Human
cccaacccccacc

SEQ ID NO: 3614536 - RNA, 14 nt, Human
cccaacccccagca

SEQ ID NO: 3614537 - RNA, 15 nt, Human
cccaaccccugagga

SEQ ID NO: 3614538 - RNA, 20 nt, Human
cccaacccguggaggcugcu

SEQ ID NO: 3614539 - RNA, 13 nt, Human
cccaacccugccc

SEQ ID NO: 3614540 - RNA, 16 nt, Human
cccaacccugccccug

SEQ ID NO: 3614541 - RNA, 15 nt, Human
cccaacccuggcacc

SEQ ID NO: 3614542 - RNA, 20 nt, Human
cccaacccuggcuugggguc

SEQ ID NO: 3614543 - RNA, 20 nt, Human
cccaacccuucuucauguuc

SEQ ID NO: 3614544 - RNA, 12 nt, Human
cccaaccucagc

SEQ ID NO: 3614545 - RNA, 13 nt, Human
cccaaccucaggg

SEQ ID NO: 3614546 - RNA, 15 nt, Human
cccaaccucagggcu

SEQ ID NO: 3614547 - RNA, 22 nt, Human
cccaaccucagggcucccaggg

SEQ ID NO: 3614548 - RNA, 18 nt, Human
cccaaccucuuccuccug

SEQ ID NO: 3614549 - RNA, 19 nt, Human
cccaaccucuuccuccuga

SEQ ID NO: 3614550 - RNA, 15 nt, Human
cccaacgaaaagcac

SEQ ID NO: 3614551 - RNA, 16 nt, Human
cccaacgaaaagcaca

SEQ ID NO: 3614552 - RNA, 19 nt, Human
cccaacgaaaagcacaucc

SEQ ID NO: 3614553 - RNA, 20 nt, Human
cccaacggcccugcagccag

SEQ ID NO: 3614554 - RNA, 20 nt, Human
cccaacuccaccagauagca

SEQ ID NO: 3614555 - RNA, 23 nt, Human
cccaacuccuggaagcugugucc

SEQ ID NO: 3614556 - RNA, 16 nt, Human
cccaacucgggcuccc

SEQ ID NO: 3614557 - RNA, 15 nt, Human
cccaacucuagcugg

SEQ ID NO: 3614558 - RNA, 21 nt, Human
cccaacucuagcugggggugg

SEQ ID NO: 3614559 - RNA, 20 nt, Human
cccaacucuccccugaccug

SEQ ID NO: 3614560 - RNA, 12 nt, Human
cccaacucuccu

SEQ ID NO: 3614561 - RNA, 18 nt, Human
cccaacucugagcccaug

SEQ ID NO: 3614562 - RNA, 19 nt, Human
cccaacucugagcccaugu

SEQ ID NO: 3614563 - RNA, 12 nt, Human
cccaacuguuau

SEQ ID NO: 3614564 - RNA, 14 nt, Human
cccaagaacagcag

SEQ ID NO: 3614565 - RNA, 14 nt, Human
cccaagaaggcugg

SEQ ID NO: 3614566 - RNA, 15 nt, Human
cccaagaaggcuggg

SEQ ID NO: 3614567 - RNA, 15 nt, Human
cccaagaaugggagg

SEQ ID NO: 3614568 - RNA, 20 nt, Human
cccaagacuucauugucccu

SEQ ID NO: 3614569 - RNA, 20 nt, Human
cccaagauucacaccugacu

SEQ ID NO: 3614570 - RNA, 19 nt, Human
cccaagcaaaaucauggaa

SEQ ID NO: 3614571 - RNA, 14 nt, Human
cccaagcagagaag

SEQ ID NO: 3614572 - RNA, 14 nt, Human
cccaagcaggaggc

SEQ ID NO: 3614573 - RNA, 14 nt, Human
cccaagccagaggc

SEQ ID NO: 3614574 - RNA, 15 nt, Human
cccaagccagaggcu

SEQ ID NO: 3614575 - RNA, 16 nt, Human
cccaagccagaggcug

SEQ ID NO: 3614576 - RNA, 17 nt, Human
cccaagcgcccuggccc

SEQ ID NO: 3614577 - RNA, 15 nt, Human
cccaagcucugcucc

SEQ ID NO: 3614578 - RNA, 17 nt, Human
cccaagcucuuguggua

SEQ ID NO: 3614579 - RNA, 19 nt, Human
cccaagcuggagugcagug

SEQ ID NO: 3614580 - RNA, 14 nt, Human
ccaugggcagagga

SEQ ID NO: 3614581 - RNA, 14 nt, Human
ccaugggcaggaga

SEQ ID NO: 3614582 - RNA, 14 nt, Human
ccaugggccuccug

SEQ ID NO: 3614583 - RNA, 13 nt, Human
ccaugggcuucac

SEQ ID NO: 3614584 - RNA, 19 nt, Human
ccaugggcuucacuguaua

SEQ ID NO: 3614585 - RNA, 20 nt, Human
ccaugggcuucacuguauaa

SEQ ID NO: 3614586 - RNA, 21 nt, Human
ccaugggcuucacuguauaaa

SEQ ID NO: 3614587 - RNA, 15 nt, Human
ccaugguacccccuu

SEQ ID NO: 3614588 - RNA, 16 nt, Human
ccaugguacccccuuc

SEQ ID NO: 3614589 - RNA, 19 nt, Human
ccaugguacccccuucugg

SEQ ID NO: 3614590 - RNA, 14 nt, Human
ccauggucacagag

SEQ ID NO: 3614591 - RNA, 22 nt, Human
ccauggugaauuaaucacuuuu

SEQ ID NO: 3614592 - RNA, 16 nt, Human
ccauguaaaacaaaaa

SEQ ID NO: 3614593 - RNA, 17 nt, Human
ccauguaaaacaaaaaa

SEQ ID NO: 3614594 - RNA, 17 nt, Human
ccauguaacugccuaga

SEQ ID NO: 3614595 - RNA, 20 nt, Human
ccauguaacugccuagaaac

SEQ ID NO: 3614596 - RNA, 17 nt, Human
ccauguacuaguuuuag

SEQ ID NO: 3614597 - RNA, 13 nt, Human
ccauguacuguag

SEQ ID NO: 3614598 - RNA, 14 nt, Human
ccauguacuguagu

SEQ ID NO: 3614599 - RNA, 22 nt, Human
ccauguacuguaguuuuucuuc

SEQ ID NO: 3614600 - RNA, 23 nt, Human
ccauguagcccccuggccucugu

SEQ ID NO: 3614601 - RNA, 14 nt, Human
ccauguauggccag

SEQ ID NO: 3614602 - RNA, 22 nt, Human
ccauguauuuaucucuauuuaa

SEQ ID NO: 3614603 - RNA, 23 nt, Human
ccaugucaccggauccugggugg

SEQ ID NO: 3614604 - RNA, 13 nt, Human
ccaugucacugug

SEQ ID NO: 3614605 - RNA, 21 nt, Human
ccaugucagacacagauuggc

SEQ ID NO: 3614606 - RNA, 17 nt, Human
ccaugucagcaaaaagc

SEQ ID NO: 3614607 - RNA, 13 nt, Human
ccauguccaaaga

SEQ ID NO: 3614608 - RNA, 18 nt, Human
ccauguccaaagaggcug

SEQ ID NO: 3614609 - RNA, 15 nt, Human
ccauguccuuagcac

SEQ ID NO: 3614610 - RNA, 15 nt, Human
ccaugucgccucugc

SEQ ID NO: 3614611 - RNA, 15 nt, Human
ccaugucggccucua

SEQ ID NO: 3614612 - RNA, 10 nt, Human
ccaugucgua

SEQ ID NO: 3614613 - RNA, 14 nt, Human
ccaugucucgacuc

SEQ ID NO: 3614614 - RNA, 20 nt, Human
ccaugucugcagugugcccc

SEQ ID NO: 3614615 - RNA, 13 nt, Human
ccaugucuucucc

SEQ ID NO: 3614616 - RNA, 13 nt, Human
ccaugucuuucuc

SEQ ID NO: 3614617 - RNA, 21 nt, Human
ccaugugaggguuuucagcau

SEQ ID NO: 3614618 - RNA, 22 nt, Human
ccaugugauggacacuccaggg

SEQ ID NO: 3614619 - RNA, 21 nt, Human
ccaugugccugauccagccuc

SEQ ID NO: 3614620 - RNA, 15 nt, Human
ccaugugccugcacc

SEQ ID NO: 3614621 - RNA, 13 nt, Human
cccauauuucauc

SEQ ID NO: 3614622 - RNA, 20 nt, Human
cccauauuuguacaccaaua

SEQ ID NO: 3614623 - RNA, 21 nt, Human
cccaucaaaacuccugucuuu

SEQ ID NO: 3614624 - RNA, 21 nt, Human
cccaucacaggguugggccca

SEQ ID NO: 3614625 - RNA, 12 nt, Human
cccaucagccca

SEQ ID NO: 3614626 - RNA, 18 nt, Human
cccaucagcccaaucccu

SEQ ID NO: 3614627 - RNA, 18 nt, Human
cccaucagcuccagcugc

SEQ ID NO: 3614628 - RNA, 23 nt, Human
cccaucaguguacccccgcccag

SEQ ID NO: 3614629 - RNA, 17 nt, Human
cccaucauacacuuccu

SEQ ID NO: 3614630 - RNA, 12 nt, Human
cccaucauccca

SEQ ID NO: 3614631 - RNA, 14 nt, Human
cccaucauccucug

SEQ ID NO: 3614632 - RNA, 19 nt, Human
cccaucauccucuggcuug

SEQ ID NO: 3614633 - RNA, 19 nt, Human
cccaucauguggccccacc

SEQ ID NO: 3614634 - RNA, 21 nt, Human
cccauccaccguccccuccca

SEQ ID NO: 3614635 - RNA, 20 nt, Human
cccauccagucucccaacuu

SEQ ID NO: 3614636 - RNA, 14 nt, Human
cccauccauuaggc

SEQ ID NO: 3614637 - RNA, 13 nt, Human
cccaucccauccc

SEQ ID NO: 3614638 - RNA, 14 nt, Human
cccaucccauccca

SEQ ID NO: 3614639 - RNA, 18 nt, Human
cccaucccaucccauccc

SEQ ID NO: 3614640 - RNA, 14 nt, Human
cccauccccagcga

SEQ ID NO: 3614641 - RNA, 15 nt, Human
cccauccccccucac

SEQ ID NO: 3614642 - RNA, 22 nt, Human
cccauccccccucaccaggggc

SEQ ID NO: 3614643 - RNA, 12 nt, Human
cccaucccccug

SEQ ID NO: 3614644 - RNA, 14 nt, Human
cccaucccccugcc

SEQ ID NO: 3614645 - RNA, 16 nt, Human
cccaucccccugcccu

SEQ ID NO: 3614646 - RNA, 16 nt, Human
cccauccccuguggga

SEQ ID NO: 3614647 - RNA, 15 nt, Human
cccaucccuccccag

SEQ ID NO: 3614648 - RNA, 16 nt, Human
cccaucccugucuuua

SEQ ID NO: 3614649 - RNA, 19 nt, Human
cccauccuaccaaugcaug

SEQ ID NO: 3614650 - RNA, 13 nt, Human
cccauccuacccu

SEQ ID NO: 3614651 - RNA, 18 nt, Human
cccauccuacccucgggc

SEQ ID NO: 3614652 - RNA, 22 nt, Human
cccauccuaucagccugucucu

SEQ ID NO: 3614653 - RNA, 13 nt, Human
cccauccucugua

SEQ ID NO: 3614654 - RNA, 20 nt, Human
cccauccucuguacagagcc

SEQ ID NO: 3614655 - RNA, 21 nt, Human
cccauccucuguacagagccc

SEQ ID NO: 3614656 - RNA, 19 nt, Human
cccauccucuucuuuuagc

SEQ ID NO: 3614657 - RNA, 20 nt, Human
cccauccucuucuuuuagca

SEQ ID NO: 3614658 - RNA, 15 nt, Human
cccauccugaccagc

SEQ ID NO: 3614659 - RNA, 14 nt, Human
cccauccuggccca

SEQ ID NO: 3614660 - RNA, 16 nt, Human
cccauccuggcccauc

SEQ ID NO: 3614661 - RNA, 22 nt, Human
cccauccuguguguuaagcucu

SEQ ID NO: 3614662 - RNA, 22 nt, Human
cccaucgccagcugaugacuca

SEQ ID NO: 3614663 - RNA, 20 nt, Human
cccaucguugcccccauuuc

SEQ ID NO: 3614664 - RNA, 18 nt, Human
cccaucucacacaugagc

SEQ ID NO: 3614665 - RNA, 14 nt, Human
cccaucucaugccc

SEQ ID NO: 3614666 - RNA, 15 nt, Human
cccaucucccacccu

SEQ ID NO: 3614667 - RNA, 13 nt, Human
cccaucucccugc

SEQ ID NO: 3614668 - RNA, 18 nt, Human
cccaucucccugccuggc

SEQ ID NO: 3614669 - RNA, 20 nt, Human
cccaucucccugccuggccc

SEQ ID NO: 3614670 - RNA, 22 nt, Human
cccaucucgcucccucccagga

SEQ ID NO: 3614671 - RNA, 18 nt, Human
cccaucucucccuccccu

SEQ ID NO: 3614672 - RNA, 23 nt, Human
cccaucucucccuccccugccau

SEQ ID NO: 3614673 - RNA, 21 nt, Human
cccaucugcaccccccugggc

SEQ ID NO: 3614674 - RNA, 17 nt, Human
cccaucugcagggcccc

SEQ ID NO: 3614675 - RNA, 16 nt, Human
cccaucugggaguccc

SEQ ID NO: 3614676 - RNA, 22 nt, Human
cccaucuggguccuugcacccc

SEQ ID NO: 3614677 - RNA, 12 nt, Human
cccaucugugaa

SEQ ID NO: 3614678 - RNA, 16 nt, Human
cccaucugugcauucu

SEQ ID NO: 3614679 - RNA, 15 nt, Human
cccaucuugccucca

SEQ ID NO: 3614680 - RNA, 12 nt, Human
cccaucuugcuu

SEQ ID NO: 3614681 - RNA, 22 nt, Human
cccaugaacuuaaaaugaaagu

SEQ ID NO: 3614682 - RNA, 18 nt, Human
cccaugaagacaggacag

SEQ ID NO: 3614683 - RNA, 22 nt, Human
cccaugaagacaggacagugcu

SEQ ID NO: 3614684 - RNA, 13 nt, Human
cccaugaagccuu

SEQ ID NO: 3614685 - RNA, 18 nt, Human
cccaugacaauguuguag

SEQ ID NO: 3614686 - RNA, 19 nt, Human
cccaugaccauacugaggg

SEQ ID NO: 3614687 - RNA, 13 nt, Human
cccaugacccacc

SEQ ID NO: 3614688 - RNA, 15 nt, Human
cccaugacccacccc

SEQ ID NO: 3614689 - RNA, 17 nt, Human
cccaugacccaccccug

SEQ ID NO: 3614690 - RNA, 18 nt, Human
cccaugacccaggcuggg

SEQ ID NO: 3614691 - RNA, 18 nt, Human
cccaugaccccaaagcca

SEQ ID NO: 3614692 - RNA, 16 nt, Human
cccaugaccuccagcu

SEQ ID NO: 3614693 - RNA, 22 nt, Human
cccaugacuuuauauggaugau

SEQ ID NO: 3614694 - RNA, 20 nt, Human
cccaugagagcgcagcccgc

SEQ ID NO: 3614695 - RNA, 16 nt, Human
cccaugagccucagca

SEQ ID NO: 3614696 - RNA, 20 nt, Human
cccaugagccucagcauccu

SEQ ID NO: 3614697 - RNA, 14 nt, Human
cccaugagcuccuu

SEQ ID NO: 3614698 - RNA, 15 nt, Human
cccaugagcuccuua

SEQ ID NO: 3614699 - RNA, 22 nt, Human
cccaugagcuccuuaaggcucu

SEQ ID NO: 3614700 - RNA, 15 nt, Human
cccaugaucccugug

SEQ ID NO: 3614701 - RNA, 21 nt, Human
cccaugcaagcagaggaccag

SEQ ID NO: 3614702 - RNA, 14 nt, Human
cccaugcacuguga

SEQ ID NO: 3614703 - RNA, 18 nt, Human
cccaugcacugugaagga

SEQ ID NO: 3614704 - RNA, 22 nt, Human
cccaugcacugugaaggacccu

SEQ ID NO: 3614705 - RNA, 17 nt, Human
cccaugcaggugguguc

SEQ ID NO: 3614706 - RNA, 13 nt, Human
cccaugccugucc

SEQ ID NO: 3614707 - RNA, 19 nt, Human
cccaugcugaccuguguuu

SEQ ID NO: 3614708 - RNA, 13 nt, Human
cccaugcugcccu

SEQ ID NO: 3614709 - RNA, 14 nt, Human
cccaugcugcccug

SEQ ID NO: 3614710 - RNA, 17 nt, Human
cccaugcugcccuguga

SEQ ID NO: 3614711 - RNA, 17 nt, Human
cccaugcuggagccugu

SEQ ID NO: 3614712 - RNA, 21 nt, Human
cccaugcuggagccuguguaa

SEQ ID NO: 3614713 - RNA, 14 nt, Human
cccaugcuguugau

SEQ ID NO: 3614714 - RNA, 19 nt, Human
cccaugcuguugauugcua

SEQ ID NO: 3614715 - RNA, 21 nt, Human
cccaugcuguugauugcuaaa

SEQ ID NO: 3614716 - RNA, 22 nt, Human
cccaugcuguugauugcuaaau

SEQ ID NO: 3614717 - RNA, 15 nt, Human
cccauggacacucca

SEQ ID NO: 3614718 - RNA, 16 nt, Human
cccauggacacuccag

SEQ ID NO: 3614719 - RNA, 20 nt, Human
cccauggagauugaccugga

SEQ ID NO: 3614720 - RNA, 21 nt, Human
cccauggagauugaccuggau

SEQ ID NO: 3614721 - RNA, 17 nt, Human
cccauggcccucccagu

SEQ ID NO: 3614722 - RNA, 21 nt, Human
cccauggcccugugcuaaucc

SEQ ID NO: 3614723 - RNA, 24 nt, Human
cccaugggacaaauugcacagaag

SEQ ID NO: 3614724 - RNA, 18 nt, Human
cccaugggcacugcuggg

SEQ ID NO: 3614725 - RNA, 14 nt, Human
cccacuccugcucu

SEQ ID NO: 3614726 - RNA, 17 nt, Human
cccacucucagaggccc

SEQ ID NO: 3614727 - RNA, 14 nt, Human
cccacucugcucug

SEQ ID NO: 3614728 - RNA, 19 nt, Human
cccacucugcucugaugca

SEQ ID NO: 3614729 - RNA, 15 nt, Human
cccacugagaggaca

SEQ ID NO: 3614730 - RNA, 22 nt, Human
cccacugaugcuguucucuucu

SEQ ID NO: 3614731 - RNA, 15 nt, Human
cccacugcacccccu

SEQ ID NO: 3614732 - RNA, 17 nt, Human
cccacugcacccccucc

SEQ ID NO: 3614733 - RNA, 20 nt, Human
cccacugcacccccuccugc

SEQ ID NO: 3614734 - RNA, 21 nt, Human
cccacugcacccccuccugcu

SEQ ID NO: 3614735 - RNA, 22 nt, Human
cccacugcacccccuccugcug

SEQ ID NO: 3614736 - RNA, 16 nt, Human
cccacugccagcagca

SEQ ID NO: 3614737 - RNA, 16 nt, Human
cccacugcccaccccc

SEQ ID NO: 3614738 - RNA, 18 nt, Human
cccacugccuacugcauc

SEQ ID NO: 3614739 - RNA, 15 nt, Human
cccacugccucaggu

SEQ ID NO: 3614740 - RNA, 13 nt, Human
cccacugcucccc

SEQ ID NO: 3614741 - RNA, 13 nt, Human
cccacugcugacu

SEQ ID NO: 3614742 - RNA, 16 nt, Human
cccacuggacucaccu

SEQ ID NO: 3614743 - RNA, 13 nt, Human
cccacuggccggc

SEQ ID NO: 3614744 - RNA, 12 nt, Human
cccacuggcugu

SEQ ID NO: 3614745 - RNA, 16 nt, Human
cccacuggcugugggc

SEQ ID NO: 3614746 - RNA, 21 nt, Human
cccacuggcugugggcucccu

SEQ ID NO: 3614747 - RNA, 19 nt, Human
cccacugggaccaacccug

SEQ ID NO: 3614748 - RNA, 21 nt, Human
cccacugggguccagggagca

SEQ ID NO: 3614749 - RNA, 16 nt, Human
cccacugguuagaugu

SEQ ID NO: 3614750 - RNA, 13 nt, Human
cccacuguccugg

SEQ ID NO: 3614751 - RNA, 16 nt, Human
cccacuguccugggcg

SEQ ID NO: 3614752 - RNA, 18 nt, Human
cccacuguccugggcgcc

SEQ ID NO: 3614753 - RNA, 22 nt, Human
cccacuguccugggcgcccugg

SEQ ID NO: 3614754 - RNA, 22 nt, Human
cccacugugccucagagaccag

SEQ ID NO: 3614755 - RNA, 20 nt, Human
cccacugugcguggggcucc

SEQ ID NO: 3614756 - RNA, 21 nt, Human
cccacuguuucucuugagcug

SEQ ID NO: 3614757 - RNA, 14 nt, Human
cccacuuacauuua

SEQ ID NO: 3614758 - RNA, 15 nt, Human
cccacuucagccucc

SEQ ID NO: 3614759 - RNA, 17 nt, Human
cccacuucccacccugc

SEQ ID NO: 3614760 - RNA, 14 nt, Human
cccacuuccccucc

SEQ ID NO: 3614761 - RNA, 17 nt, Human
cccacuuccccuccuac

SEQ ID NO: 3614762 - RNA, 19 nt, Human
cccacuucccugacacugc

SEQ ID NO: 3614763 - RNA, 24 nt, Human
cccacuucccugacacugcggggc

SEQ ID NO: 3614764 - RNA, 12 nt, Human
cccacuuccugu

SEQ ID NO: 3614765 - RNA, 18 nt, Human
cccacuucucucuaagga

SEQ ID NO: 3614766 - RNA, 16 nt, Human
cccacuucugcacuug

SEQ ID NO: 3614767 - RNA, 17 nt, Human
cccacuugguuagauga

SEQ ID NO: 3614768 - RNA, 15 nt, Human
cccagaaaggagacu

SEQ ID NO: 3614769 - RNA, 22 nt, Human
cccagaacacacuccaucagcu

SEQ ID NO: 3614770 - RNA, 20 nt, Human
cccagaacuggacucaggau

SEQ ID NO: 3614771 - RNA, 16 nt, Human
cccagaacuucccuga

SEQ ID NO: 3614772 - RNA, 13 nt, Human
cccagaaggcagg

SEQ ID NO: 3614773 - RNA, 22 nt, Human
cccagaaggcauaucagucucu

SEQ ID NO: 3614774 - RNA, 14 nt, Human
cccagaagugcaga

SEQ ID NO: 3614775 - RNA, 24 nt, Human
cccagaauaaacuggcagcucagc

SEQ ID NO: 3614776 - RNA, 12 nt, Human
cccagaauccca

SEQ ID NO: 3614777 - RNA, 14 nt, Human
cccagaaucccagc

SEQ ID NO: 3614778 - RNA, 20 nt, Human
cccagaaucccagccggcca

SEQ ID NO: 3614779 - RNA, 15 nt, Human
cccagacacagaaga

SEQ ID NO: 3614780 - RNA, 20 nt, Human
cccagacagacaucucugca

SEQ ID NO: 3614781 - RNA, 12 nt, Human
cccagacagcuc

SEQ ID NO: 3614782 - RNA, 13 nt, Human
cccagacagcucc

SEQ ID NO: 3614783 - RNA, 16 nt, Human
cccagacagcucccuc

SEQ ID NO: 3614784 - RNA, 20 nt, Human
cccagacagcucccucugcc

SEQ ID NO: 3614785 - RNA, 16 nt, Human
cccagacauaaaggaa

SEQ ID NO: 3614786 - RNA, 19 nt, Human
cccagacauaaaggaaaag

SEQ ID NO: 3614787 - RNA, 14 nt, Human
cccagacccagugg

SEQ ID NO: 3614788 - RNA, 18 nt, Human
cccagaccccucuggcca

SEQ ID NO: 3614789 - RNA, 20 nt, Human
cccagaccccucuggccagg

SEQ ID NO: 3614790 - RNA, 21 nt, Human
cccagaccccucuggccagga

SEQ ID NO: 3614791 - RNA, 23 nt, Human
cccagacuagauguaguauuuuu

SEQ ID NO: 3614792 - RNA, 12 nt, Human
cccagacucaga

SEQ ID NO: 3614793 - RNA, 13 nt, Human
cccagacucagac

SEQ ID NO: 3614794 - RNA, 16 nt, Human
cccagacucagacauu

SEQ ID NO: 3614795 - RNA, 23 nt, Human
cccagacuugcugaaucggaauc

SEQ ID NO: 3614796 - RNA, 17 nt, Human
cccagagaacagcgaag

SEQ ID NO: 3614797 - RNA, 12 nt, Human
cccagagaagcc

SEQ ID NO: 3614798 - RNA, 21 nt, Human
cccagagaagccccuucccca

SEQ ID NO: 3614799 - RNA, 21 nt, Human
cccagagacuuuguagauccu

SEQ ID NO: 3614800 - RNA, 18 nt, Human
cccagagagaagagcccc

SEQ ID NO: 3614801 - RNA, 21 nt, Human
cccagagagaagagccccacu

SEQ ID NO: 3614802 - RNA, 14 nt, Human
cccagagaugccuc

SEQ ID NO: 3614803 - RNA, 20 nt, Human
cccagagaugccuccaccgc

SEQ ID NO: 3614804 - RNA, 20 nt, Human
cccagagaugggacugggag

SEQ ID NO: 3614805 - RNA, 14 nt, Human
cccagagcaggaag

SEQ ID NO: 3614806 - RNA, 15 nt, Human
cccagagcagggugu

SEQ ID NO: 3614807 - RNA, 21 nt, Human
cccagagcauuacgugagcca

SEQ ID NO: 3614808 - RNA, 17 nt, Human
cccagagccacacaugg

SEQ ID NO: 3614809 - RNA, 21 nt, Human
cccagagccacacaugggcau

SEQ ID NO: 3614810 - RNA, 12 nt, Human
cccagagcccag

SEQ ID NO: 3614811 - RNA, 20 nt, Human
cccagagccuggcugcccau

SEQ ID NO: 3614812 - RNA, 23 nt, Human
cccagagcugguggacccaggga

SEQ ID NO: 3614813 - RNA, 20 nt, Human
cccagagcuguuuauggccu

SEQ ID NO: 3614814 - RNA, 21 nt, Human
cccagaggaaggggccagagg

SEQ ID NO: 3614815 - RNA, 10 nt, Human
cccagaggca

SEQ ID NO: 3614816 - RNA, 15 nt, Human
cccagaggcacagcc

SEQ ID NO: 3614817 - RNA, 22 nt, Human
cccagaggcgucccgcaccugu

SEQ ID NO: 3614818 - RNA, 12 nt, Human
cccagaggcuga

SEQ ID NO: 3614819 - RNA, 13 nt, Human
cccagagggccca

SEQ ID NO: 3614820 - RNA, 15 nt, Human
ccccuguccucacug

SEQ ID NO: 3614821 - RNA, 14 nt, Human
ccccugucuagaga

SEQ ID NO: 3614822 - RNA, 18 nt, Human
ccccugucuagagaggga

SEQ ID NO: 3614823 - RNA, 22 nt, Human
ccccugucucucagggccaggc

SEQ ID NO: 3614824 - RNA, 11 nt, Human
ccccugugcag

SEQ ID NO: 3614825 - RNA, 20 nt, Human
ccccugugcagccgcugagc

SEQ ID NO: 3614826 - RNA, 14 nt, Human
ccccugugccuugu

SEQ ID NO: 3614827 - RNA, 19 nt, Human
ccccugugcuccgugccuc

SEQ ID NO: 3614828 - RNA, 20 nt, Human
ccccuguggggaucucaggg

SEQ ID NO: 3614829 - RNA, 15 nt, Human
ccccuguucacucua

SEQ ID NO: 3614830 - RNA, 14 nt, Human
ccccuguucaugcc

SEQ ID NO: 3614831 - RNA, 16 nt, Human
ccccuguuccccucuc

SEQ ID NO: 3614832 - RNA, 19 nt, Human
ccccuguuccccucucccu

SEQ ID NO: 3614833 - RNA, 13 nt, Human
ccccuguucuaag

SEQ ID NO: 3614834 - RNA, 15 nt, Human
ccccuuauccaggac

SEQ ID NO: 3614835 - RNA, 14 nt, Human
ccccuuauccuccc

SEQ ID NO: 3614836 - RNA, 18 nt, Human
ccccuuauccucccugua

SEQ ID NO: 3614837 - RNA, 18 nt, Human
ccccuucacaccauaacu

SEQ ID NO: 3614838 - RNA, 23 nt, Human
ccccuucacuucugaccacacuu

SEQ ID NO: 3614839 - RNA, 13 nt, Human
ccccuucagugcc

SEQ ID NO: 3614840 - RNA, 20 nt, Human
ccccuuccauggacuuuguu

SEQ ID NO: 3614841 - RNA, 13 nt, Human
ccccuuccaugug

SEQ ID NO: 3614842 - RNA, 11 nt, Human
ccccuucccau

SEQ ID NO: 3614843 - RNA, 19 nt, Human
ccccuuccccacugccugc

SEQ ID NO: 3614844 - RNA, 16 nt, Human
ccccuuccccauggga

SEQ ID NO: 3614845 - RNA, 12 nt, Human
ccccuucccccu

SEQ ID NO: 3614846 - RNA, 13 nt, Human
ccccuucccugca

SEQ ID NO: 3614847 - RNA, 14 nt, Human
ccccuuccgccacu

SEQ ID NO: 3614848 - RNA, 16 nt, Human
ccccuuccgccacugg

SEQ ID NO: 3614849 - RNA, 17 nt, Human
ccccuuccgccacuggg

SEQ ID NO: 3614850 - RNA, 14 nt, Human
ccccuuccuaccac

SEQ ID NO: 3614851 - RNA, 15 nt, Human
ccccuucgcuccugu

SEQ ID NO: 3614852 - RNA, 19 nt, Human
ccccuucgcuccugugucu

SEQ ID NO: 3614853 - RNA, 20 nt, Human
ccccuucuacacucuccugg

SEQ ID NO: 3614854 - RNA, 23 nt, Human
ccccuucuacacucuccugggcc

SEQ ID NO: 3614855 - RNA, 18 nt, Human
ccccuucuauuuggggcu

SEQ ID NO: 3614856 - RNA, 12 nt, Human
ccccuucucccc

SEQ ID NO: 3614857 - RNA, 18 nt, Human
ccccuucuccccugcacu

SEQ ID NO: 3614858 - RNA, 16 nt, Human
ccccuucucucaucuc

SEQ ID NO: 3614859 - RNA, 18 nt, Human
ccccuucucugcccauuc

SEQ ID NO: 3614860 - RNA, 13 nt, Human
ccccuucugaccc

SEQ ID NO: 3614861 - RNA, 14 nt, Human
ccccuucugaccca

SEQ ID NO: 3614862 - RNA, 20 nt, Human
ccccuucugcucagcucugg

SEQ ID NO: 3614863 - RNA, 14 nt, Human
ccccuucugggcau

SEQ ID NO: 3614864 - RNA, 19 nt, Human
ccccuugaggucucagccc

SEQ ID NO: 3614865 - RNA, 22 nt, Human
ccccuugaggucucagccccuu

SEQ ID NO: 3614866 - RNA, 20 nt, Human
ccccuugccaccccacccuc

SEQ ID NO: 3614867 - RNA, 17 nt, Human
ccccuugcccagggcuc

SEQ ID NO: 3614868 - RNA, 23 nt, Human
ccccuugcccagggcucagccug

SEQ ID NO: 3614869 - RNA, 15 nt, Human
ccccuuguccuuucc

SEQ ID NO: 3614870 - RNA, 20 nt, Human
ccccuuuagaucucugaagc

SEQ ID NO: 3614871 - RNA, 20 nt, Human
cccgggaaccuccccagccu

SEQ ID NO: 3614872 - RNA, 15 nt, Human
cccgggaagcaaaug

SEQ ID NO: 3614873 - RNA, 16 nt, Human
cccgggagccuaggac

SEQ ID NO: 3614874 - RNA, 18 nt, Human
cccgggagccuaggacca

SEQ ID NO: 3614875 - RNA, 19 nt, Human
cccgggagccuaggaccac

SEQ ID NO: 3614876 - RNA, 18 nt, Human
cccgggaggggcccgcuu

SEQ ID NO: 3614877 - RNA, 14 nt, Human
cccgggcccagagg

SEQ ID NO: 3614878 - RNA, 21 nt, Human
cccgggcgcggccagccccgg

SEQ ID NO: 3614879 - RNA, 17 nt, Human
cccgggcucucugcugu

SEQ ID NO: 3614880 - RNA, 16 nt, Human
cccgggcucugccucc

SEQ ID NO: 3614881 - RNA, 17 nt, Human
cccgggcucugccuccc

SEQ ID NO: 3614882 - RNA, 17 nt, Human
cccgggcugccugggcu

SEQ ID NO: 3614883 - RNA, 18 nt, Human
cccggggacccugugaca

SEQ ID NO: 3614884 - RNA, 20 nt, Human
cccggggcagcagcagcccu

SEQ ID NO: 3614885 - RNA, 19 nt, Human
cccggggcagcugccagag

SEQ ID NO: 3614886 - RNA, 20 nt, Human
cccggguuuggcgggccaag

SEQ ID NO: 3614887 - RNA, 18 nt, Human
cccggugcccaagaauag

SEQ ID NO: 3614888 - RNA, 19 nt, Human
cccgguggcggccccagca

SEQ ID NO: 3614889 - RNA, 14 nt, Human
cccguaaugcuuag

SEQ ID NO: 3614890 - RNA, 15 nt, Human
cccgucacagccuca

SEQ ID NO: 3614891 - RNA, 17 nt, Human
cccgucaccaucucagg

SEQ ID NO: 3614892 - RNA, 17 nt, Human
cccgucagggcccaagu

SEQ ID NO: 3614893 - RNA, 19 nt, Human
cccgucccauauccugccu

SEQ ID NO: 3614894 - RNA, 15 nt, Human
cccguccugccugug

SEQ ID NO: 3614895 - RNA, 17 nt, Human
cccguccugccuguggc

SEQ ID NO: 3614896 - RNA, 20 nt, Human
cccgucgaggggcucucagc

SEQ ID NO: 3614897 - RNA, 12 nt, Human
cccgucucaggu

SEQ ID NO: 3614898 - RNA, 13 nt, Human
cccgucuccagcu

SEQ ID NO: 3614899 - RNA, 12 nt, Human
cccgucucucuc

SEQ ID NO: 3614900 - RNA, 21 nt, Human
cccgucugggguucagccccu

SEQ ID NO: 3614901 - RNA, 23 nt, Human
cccgucugggguucagccccucc

SEQ ID NO: 3614902 - RNA, 11 nt, Human
cccgucugucc

SEQ ID NO: 3614903 - RNA, 18 nt, Human
cccgucuguccaucugcc

SEQ ID NO: 3614904 - RNA, 19 nt, Human
cccgucuguccaucugccc

SEQ ID NO: 3614905 - RNA, 13 nt, Human
cccgucuucagcc

SEQ ID NO: 3614906 - RNA, 14 nt, Human
cccgucuucagccu

SEQ ID NO: 3614907 - RNA, 16 nt, Human
cccgucuucagccuag

SEQ ID NO: 3614908 - RNA, 18 nt, Human
cccgugacagacuccuga

SEQ ID NO: 3614909 - RNA, 22 nt, Human
cccgugacagacuccugaggac

SEQ ID NO: 3614910 - RNA, 21 nt, Human
cccgugaggaugucacucaga

SEQ ID NO: 3614911 - RNA, 18 nt, Human
cccgugcagacuggaggg

SEQ ID NO: 3614912 - RNA, 21 nt, Human
cccgugccaaguccagguccu

SEQ ID NO: 3614913 - RNA, 11 nt, Human
cccguggcccc

SEQ ID NO: 3614914 - RNA, 15 nt, Human
cccguggccccagcc

SEQ ID NO: 3614915 - RNA, 17 nt, Human
cccguggccccagccug

SEQ ID NO: 3614916 - RNA, 21 nt, Human
cccguggccccagccuggccc

SEQ ID NO: 3614917 - RNA, 22 nt, Human
cccguggggcagggagcugggc

SEQ ID NO: 3614918 - RNA, 14 nt, Human
cccguggggccggg

SEQ ID NO: 3614919 - RNA, 12 nt, Human
cccguggucucu

SEQ ID NO: 3614920 - RNA, 17 nt, Human
cccguguggccccuuca

SEQ ID NO: 3614921 - RNA, 18 nt, Human
cccguguggccccuucac

SEQ ID NO: 3614922 - RNA, 22 nt, Human
cccguguggccccuucacuucu

SEQ ID NO: 3614923 - RNA, 18 nt, Human
cccguuccaccccaagag

SEQ ID NO: 3614924 - RNA, 17 nt, Human
cccguugucucccuggc

SEQ ID NO: 3614925 - RNA, 12 nt, Human
cccguuuucccc

SEQ ID NO: 3614926 - RNA, 20 nt, Human
cccuaaaagaaacccugcac

SEQ ID NO: 3614927 - RNA, 20 nt, Human
cccuaaaagcacuccugcuu

SEQ ID NO: 3614928 - RNA, 18 nt, Human
cccuaaaccccuguccca

SEQ ID NO: 3614929 - RNA, 14 nt, Human
cccuaagagagcac

SEQ ID NO: 3614930 - RNA, 16 nt, Human
cccuaagcagaaagug

SEQ ID NO: 3614931 - RNA, 17 nt, Human
cccuaagccaagggccu

SEQ ID NO: 3614932 - RNA, 19 nt, Human
cccuaaggaucucucagga

SEQ ID NO: 3614933 - RNA, 13 nt, Human
cccuaagguccua

SEQ ID NO: 3614934 - RNA, 12 nt, Human
cccuaauaaagc

SEQ ID NO: 3614935 - RNA, 13 nt, Human
cccuaauaaagcu

SEQ ID NO: 3614936 - RNA, 18 nt, Human
cccuaauaaagcugugug

SEQ ID NO: 3614937 - RNA, 22 nt, Human
cccuaaucuauggucgggagac

SEQ ID NO: 3614938 - RNA, 12 nt, Human
cccuaaucuucc

SEQ ID NO: 3614939 - RNA, 21 nt, Human
cccuaaugcgcaggcuggccc

SEQ ID NO: 3614940 - RNA, 22 nt, Human
cccuaauucagccauguacaga

SEQ ID NO: 3614941 - RNA, 13 nt, Human
cccuacagcauug

SEQ ID NO: 3614942 - RNA, 21 nt, Human
cccuaccagcgcccgcugggc

SEQ ID NO: 3614943 - RNA, 19 nt, Human
cccuaccccacaccaggcc

SEQ ID NO: 3614944 - RNA, 10 nt, Human
cccuaccuca

SEQ ID NO: 3614945 - RNA, 15 nt, Human
cccuaccucaaccug

SEQ ID NO: 3614946 - RNA, 18 nt, Human
cccuaccucaaccuguaa

SEQ ID NO: 3614947 - RNA, 13 nt, Human
cccuaccucaggc

SEQ ID NO: 3614948 - RNA, 19 nt, Human
cccuaccuguucagugucc

SEQ ID NO: 3614949 - RNA, 22 nt, Human
cccuacucauugggguuccgca

SEQ ID NO: 3614950 - RNA, 17 nt, Human
cccuacugcugugaacc

SEQ ID NO: 3614951 - RNA, 17 nt, Human
cccuagaaacccaagcu

SEQ ID NO: 3614952 - RNA, 19 nt, Human
cccuagaaacccaagcucc

SEQ ID NO: 3614953 - RNA, 13 nt, Human
cccuagacuuuag

SEQ ID NO: 3614954 - RNA, 15 nt, Human
cccuagagccugccu

SEQ ID NO: 3614955 - RNA, 21 nt, Human
cccuagagccugccuggagcg

SEQ ID NO: 3614956 - RNA, 16 nt, Human
cccuagaguguuguug

SEQ ID NO: 3614957 - RNA, 15 nt, Human
cccuagccauuccug

SEQ ID NO: 3614958 - RNA, 16 nt, Human
cccuagcccaggagag

SEQ ID NO: 3614959 - RNA, 14 nt, Human
cccuagccuugcuu

SEQ ID NO: 3614960 - RNA, 20 nt, Human
cccuagcuccuccccuuccu

SEQ ID NO: 3614961 - RNA, 21 nt, Human
cccuagcuuuagacccugggu

SEQ ID NO: 3614962 - RNA, 22 nt, Human
cccuagcuuuauauauggacau

SEQ ID NO: 3614963 - RNA, 22 nt, Human
cccuaggauaaaaagccagggc

SEQ ID NO: 3614964 - RNA, 14 nt, Human
cccuaggggacacu

SEQ ID NO: 3614965 - RNA, 17 nt, Human
cccuaggggacacuucc

SEQ ID NO: 3614966 - RNA, 19 nt, Human
cccuaggggacacuucccu

SEQ ID NO: 3614967 - RNA, 15 nt, Human
cccuaguaaaaauac

SEQ ID NO: 3614968 - RNA, 23 nt, Human
cccuaguaagugccuuccauguc

SEQ ID NO: 3614969 - RNA, 17 nt, Human
cccuagucccuuccccu

SEQ ID NO: 3614970 - RNA, 22 nt, Human
cccuagucccuuccccucccug

SEQ ID NO: 3614971 - RNA, 18 nt, Human
cccuaguucccucugcuc

SEQ ID NO: 3614972 - RNA, 21 nt, Human
cccuaguucccucugcucagc

SEQ ID NO: 3614973 - RNA, 23 nt, Human
cccuaguuuucuuuccuccuuuc

SEQ ID NO: 3614974 - RNA, 16 nt, Human
cccuauccaaucaauc

SEQ ID NO: 3614975 - RNA, 18 nt, Human
cccuauccacccagccca

SEQ ID NO: 3614976 - RNA, 14 nt, Human
cccuauccuuggca

SEQ ID NO: 3614977 - RNA, 19 nt, Human
cccuauccuuggcaccaaa

SEQ ID NO: 3614978 - RNA, 15 nt, Human
cccuaucuccugaca

SEQ ID NO: 3614979 - RNA, 19 nt, Human
cccuaucuuugccacccuc

SEQ ID NO: 3614980 - RNA, 21 nt, Human
cccuaucuuugccacccucau

SEQ ID NO: 3614981 - RNA, 13 nt, Human
cccuaugcugccu

SEQ ID NO: 3614982 - RNA, 17 nt, Human
cccuauggaagcauauu

SEQ ID NO: 3614983 - RNA, 16 nt, Human
cccuauggggaugguc

SEQ ID NO: 3614984 - RNA, 18 nt, Human
cccuauggggauggucca

SEQ ID NO: 3614985 - RNA, 17 nt, Human
cccuauugguaaagaau

SEQ ID NO: 3614986 - RNA, 21 nt, Human
cccuauuuaacagggucucua

SEQ ID NO: 3614987 - RNA, 20 nt, Human
cccucaaaccuccucuucug

SEQ ID NO: 3614988 - RNA, 20 nt, Human
cccucaaaugacccaaagac

SEQ ID NO: 3614989 - RNA, 19 nt, Human
cccucaacaagggagagac

SEQ ID NO: 3614990 - RNA, 21 nt, Human
cccucaacaagggagagaccu

SEQ ID NO: 3614991 - RNA, 16 nt, Human
cccucaacucuccucc

SEQ ID NO: 3614992 - RNA, 20 nt, Human
cccucaacucuccuccagag

SEQ ID NO: 3614993 - RNA, 17 nt, Human
cccucaagaggaaguga

SEQ ID NO: 3614994 - RNA, 22 nt, Human
cccucaaggccucccacaguga

SEQ ID NO: 3614995 - RNA, 14 nt, Human
cccucacacacccu

SEQ ID NO: 3614996 - RNA, 13 nt, Human
cccucacacuggg

SEQ ID NO: 3614997 - RNA, 14 nt, Human
cccucacagccucu

SEQ ID NO: 3614998 - RNA, 15 nt, Human
cccucacagccucug

SEQ ID NO: 3614999 - RNA, 18 nt, Human
cccucacaguauugcuca

SEQ ID NO: 3615000 - RNA, 13 nt, Human
cccucacccaucc

SEQ ID NO: 3615001 - RNA, 13 nt, Human
cccucaccccugg

SEQ ID NO: 3615002 - RNA, 20 nt, Human
cccucaccccugguucucau

SEQ ID NO: 3615003 - RNA, 22 nt, Human
cccucaccccugguucucaucu

SEQ ID NO: 3615004 - RNA, 20 nt, Human
cccucacccugagccccuuc

SEQ ID NO: 3615005 - RNA, 16 nt, Human
cccucacccugccuua

SEQ ID NO: 3615006 - RNA, 21 nt, Human
cccucaccuacuuacccaggu

SEQ ID NO: 3615007 - RNA, 15 nt, Human
cccucaccugggcac

SEQ ID NO: 3615008 - RNA, 17 nt, Human
cccucaccugggcaccu

SEQ ID NO: 3615009 - RNA, 23 nt, Human
cccucaccugggcaccuggggag

SEQ ID NO: 3615010 - RNA, 16 nt, Human
cccucaccuucugagu

SEQ ID NO: 3615011 - RNA, 21 nt, Human
cccucaccuugcaacacacag

SEQ ID NO: 3615012 - RNA, 20 nt, Human
cccucaccuuggcaccagac

SEQ ID NO: 3615013 - RNA, 17 nt, Human
cccucacucgucucccc

SEQ ID NO: 3615014 - RNA, 13 nt, Human
cccucacucucag

SEQ ID NO: 3615015 - RNA, 14 nt, Human
cccucacucucagg

SEQ ID NO: 3615016 - RNA, 20 nt, Human
cagcuguaagaagagacugg

SEQ ID NO: 3615017 - RNA, 21 nt, Human
cagcuguaagaagagacuggg

SEQ ID NO: 3615018 - RNA, 17 nt, Human
cagcuguacuucgucuu

SEQ ID NO: 3615019 - RNA, 20 nt, Human
cagcuguaugauucccagcc

SEQ ID NO: 3615020 - RNA, 14 nt, Human
cagcugucccccca

SEQ ID NO: 3615021 - RNA, 21 nt, Human
cagcugucccugcccuucuuc

SEQ ID NO: 3615022 - RNA, 13 nt, Human
cagcugucccugu

SEQ ID NO: 3615023 - RNA, 16 nt, Human
cagcuguccucuucug

SEQ ID NO: 3615024 - RNA, 12 nt, Human
cagcugucucua

SEQ ID NO: 3615025 - RNA, 14 nt, Human
cagcugucuguggc

SEQ ID NO: 3615026 - RNA, 16 nt, Human
cagcugucuguggcuu

SEQ ID NO: 3615027 - RNA, 20 nt, Human
cagcugucugugucagccug

SEQ ID NO: 3615028 - RNA, 18 nt, Human
cagcugugaacauggacu

SEQ ID NO: 3615029 - RNA, 15 nt, Human
cagcugugagccuug

SEQ ID NO: 3615030 - RNA, 13 nt, Human
cagcugugccucg

SEQ ID NO: 3615031 - RNA, 19 nt, Human
cagcugugcucuggacagg

SEQ ID NO: 3615032 - RNA, 20 nt, Human
cagcugugcucuggacaggc

SEQ ID NO: 3615033 - RNA, 17 nt, Human
cagcuguggcagaguua

SEQ ID NO: 3615034 - RNA, 23 nt, Human
cagcuguggugagguugggcagc

SEQ ID NO: 3615035 - RNA, 16 nt, Human
cagcuguucagcuggu

SEQ ID NO: 3615036 - RNA, 14 nt, Human
cagcuguugacucu

SEQ ID NO: 3615037 - RNA, 21 nt, Human
cagcuguuuaaauguuuuucu

SEQ ID NO: 3615038 - RNA, 23 nt, Human
cagcuguuucuagaguuccuacc

SEQ ID NO: 3615039 - RNA, 14 nt, Human
cagcuguuugucau

SEQ ID NO: 3615040 - RNA, 12 nt, Human
cccccugucccc

SEQ ID NO: 3615041 - RNA, 21 nt, Human
cccccugugcagccgcugagc

SEQ ID NO: 3615042 - RNA, 17 nt, Human
cccccuguggaugcugc

SEQ ID NO: 3615043 - RNA, 16 nt, Human
cccccuucaagccugu

SEQ ID NO: 3615044 - RNA, 12 nt, Human
cccccuucuggg

SEQ ID NO: 3615045 - RNA, 20 nt, Human
cccccuuuagaucucugaag

SEQ ID NO: 3615046 - RNA, 13 nt, Human
cccccuuucccgg

SEQ ID NO: 3615047 - RNA, 14 nt, Human
cccccuuucccggg

SEQ ID NO: 3615048 - RNA, 20 nt, Human
cccccuuuccuggacacuca

SEQ ID NO: 3615049 - RNA, 15 nt, Human
cccccuuucuuccuc

SEQ ID NO: 3615050 - RNA, 16 nt, Human
cccccuuucuuccuca

SEQ ID NO: 3615051 - RNA, 17 nt, Human
cccccuuugggcccagg

SEQ ID NO: 3615052 - RNA, 14 nt, Human
cccccuuugugcug

SEQ ID NO: 3615053 - RNA, 16 nt, Human
cccccuuugugcugug

SEQ ID NO: 3615054 - RNA, 16 nt, Human
ccccgaagggccccca

SEQ ID NO: 3615055 - RNA, 21 nt, Human
ccccgacgccacagcccagcc

SEQ ID NO: 3615056 - RNA, 13 nt, Human
ccccgagcugggg

SEQ ID NO: 3615057 - RNA, 15 nt, Human
ccccgaggcccugca

SEQ ID NO: 3615058 - RNA, 16 nt, Human
ccccgaggcccugcau

SEQ ID NO: 3615059 - RNA, 17 nt, Human
ccccgaggcccugcaug

SEQ ID NO: 3615060 - RNA, 18 nt, Human
ccccgagggaugaugcca

SEQ ID NO: 3615061 - RNA, 14 nt, Human
ccccgagggcugag

SEQ ID NO: 3615062 - RNA, 23 nt, Human
ccccgcaccuguacaguggaacc

SEQ ID NO: 3615063 - RNA, 14 nt, Human
ccccgcacugggcu

SEQ ID NO: 3615064 - RNA, 12 nt, Human
ccccgcagaccu

SEQ ID NO: 3615065 - RNA, 14 nt, Human
ccccgcagaccucc

SEQ ID NO: 3615066 - RNA, 20 nt, Human
ccccgcagaccuccccagcc

SEQ ID NO: 3615067 - RNA, 13 nt, Human
ccccgcagcccug

SEQ ID NO: 3615068 - RNA, 18 nt, Human
ccccgcaguguuugugug

SEQ ID NO: 3615069 - RNA, 19 nt, Human
ccccgcauccccugccucc

SEQ ID NO: 3615070 - RNA, 17 nt, Human
ccccgcauuccaggcuc

SEQ ID NO: 3615071 - RNA, 15 nt, Human
ccccgcccaggcugg

SEQ ID NO: 3615072 - RNA, 17 nt, Human
ccccgccccacauuccg

SEQ ID NO: 3615073 - RNA, 16 nt, Human
ccccgcccccaguccc

SEQ ID NO: 3615074 - RNA, 21 nt, Human
ccccgcccccugcccuccccu

SEQ ID NO: 3615075 - RNA, 14 nt, Human
ccccgccuggccag

SEQ ID NO: 3615076 - RNA, 16 nt, Human
ccccgccuggccagga

SEQ ID NO: 3615077 - RNA, 22 nt, Human
ccccgcucugcaugcggcccag

SEQ ID NO: 3615078 - RNA, 13 nt, Human
ccccgcugcugug

SEQ ID NO: 3615079 - RNA, 20 nt, Human
ccccgcuguaagcuccuuug

SEQ ID NO: 3615080 - RNA, 15 nt, Human
ccccgcuuguccagc

SEQ ID NO: 3615081 - RNA, 17 nt, Human
ccccgcuuguccagcgc

SEQ ID NO: 3615082 - RNA, 18 nt, Human
ccccgcuuguccagcgcc

SEQ ID NO: 3615083 - RNA, 14 nt, Human
ccccggcacccucu

SEQ ID NO: 3615084 - RNA, 14 nt, Human
ccccggcaggcccu

SEQ ID NO: 3615085 - RNA, 12 nt, Human
ccccggccaccu

SEQ ID NO: 3615086 - RNA, 17 nt, Human
ccccggccaccucugcg

SEQ ID NO: 3615087 - RNA, 16 nt, Human
ccccggccccagccag

SEQ ID NO: 3615088 - RNA, 12 nt, Human
ccccggcccccu

SEQ ID NO: 3615089 - RNA, 13 nt, Human
ccccggcccccug

SEQ ID NO: 3615090 - RNA, 18 nt, Human
ccccggccccggccccag

SEQ ID NO: 3615091 - RNA, 16 nt, Human
ccccgggaggggcccg

SEQ ID NO: 3615092 - RNA, 16 nt, Human
ccccggggacccugug

SEQ ID NO: 3615093 - RNA, 14 nt, Human
ccccggggcccagg

SEQ ID NO: 3615094 - RNA, 20 nt, Human
ccccggucaccuagcaagcu

SEQ ID NO: 3615095 - RNA, 20 nt, Human
ccccgguggcggccccagca

SEQ ID NO: 3615096 - RNA, 18 nt, Human
ccccggugugcggugcau

SEQ ID NO: 3615097 - RNA, 14 nt, Human
ccccgucacagccu

SEQ ID NO: 3615098 - RNA, 21 nt, Human
ccccgucaccaucucaggcca

SEQ ID NO: 3615099 - RNA, 16 nt, Human
ccccgucccccucugg

SEQ ID NO: 3615100 - RNA, 20 nt, Human
ccccgucccccucuggcucc

SEQ ID NO: 3615101 - RNA, 21 nt, Human
ccccgucucugguuccucccc

SEQ ID NO: 3615102 - RNA, 15 nt, Human
ccccgugcagacugg

SEQ ID NO: 3615103 - RNA, 16 nt, Human
ccccguuacagcuccc

SEQ ID NO: 3615104 - RNA, 19 nt, Human
ccccuaaagccucaaaaca

SEQ ID NO: 3615105 - RNA, 22 nt, Human
ccccuaacccuuugugugcucu

SEQ ID NO: 3615106 - RNA, 23 nt, Human
ccccuaacccuuugugugcucuc

SEQ ID NO: 3615107 - RNA, 17 nt, Human
ccccuaagagagcaccu

SEQ ID NO: 3615108 - RNA, 18 nt, Human
ccccuaaugccugcggag

SEQ ID NO: 3615109 - RNA, 17 nt, Human
ccccuaccaauauuagg

SEQ ID NO: 3615110 - RNA, 13 nt, Human
ccccuacugcugu

SEQ ID NO: 3615111 - RNA, 13 nt, Human
ccccuagaaaccc

SEQ ID NO: 3615112 - RNA, 14 nt, Human
ccccuagccauuuu

SEQ ID NO: 3615113 - RNA, 17 nt, Human
ccccuagcccaggagag

SEQ ID NO: 3615114 - RNA, 21 nt, Human
ccccuagccgguuccuguccc

SEQ ID NO: 3615115 - RNA, 16 nt, Human
ccccuauccacccagc

SEQ ID NO: 3615116 - RNA, 19 nt, Human
ccccuauccacccagccca

SEQ ID NO: 3615117 - RNA, 20 nt, Human
ccccuauccacccagcccau

SEQ ID NO: 3615118 - RNA, 21 nt, Human
ccccuauccacccagcccauu

SEQ ID NO: 3615119 - RNA, 16 nt, Human
ccccucaacaccucug

SEQ ID NO: 3615120 - RNA, 21 nt, Human
ccccucaaccuccuguggaac

SEQ ID NO: 3615121 - RNA, 14 nt, Human
ccccucacagccuc

SEQ ID NO: 3615122 - RNA, 18 nt, Human
ccccucacagccucugac

SEQ ID NO: 3615123 - RNA, 16 nt, Human
ccccucacccugccuu

SEQ ID NO: 3615124 - RNA, 12 nt, Human
ccccucacucug

SEQ ID NO: 3615125 - RNA, 14 nt, Human
ccccucaggacccu

SEQ ID NO: 3615126 - RNA, 18 nt, Human
ccccucaggacccucgcu

SEQ ID NO: 3615127 - RNA, 22 nt, Human
ccccucaggacccucgcuggcc

SEQ ID NO: 3615128 - RNA, 15 nt, Human
ccccucaggacugca

SEQ ID NO: 3615129 - RNA, 17 nt, Human
ccccucagggucccugg

SEQ ID NO: 3615130 - RNA, 20 nt, Human
ccccucagggucccuggugg

SEQ ID NO: 3615131 - RNA, 16 nt, Human
ccccuccaaaaugugc

SEQ ID NO: 3615132 - RNA, 21 nt, Human
ccccuccaaaaugugccuauu

SEQ ID NO: 3615133 - RNA, 12 nt, Human
ccccuccacucu

SEQ ID NO: 3615134 - RNA, 12 nt, Human
ccccuccacugu

SEQ ID NO: 3615135 - RNA, 13 nt, Human
ccccuccagcuug

SEQ ID NO: 3615136 - RNA, 11 nt, Human
ccccuccagga

SEQ ID NO: 3615137 - RNA, 11 nt, Human
ccccucccacc

SEQ ID NO: 3615138 - RNA, 12 nt, Human
ccccucccagaa

SEQ ID NO: 3615139 - RNA, 13 nt, Human
ccccucccagaac

SEQ ID NO: 3615140 - RNA, 11 nt, Human
ccccucccauc

SEQ ID NO: 3615141 - RNA, 20 nt, Human
ccccuccccauuagcuuuca

SEQ ID NO: 3615142 - RNA, 17 nt, Human
ccccucccccagccacu

SEQ ID NO: 3615143 - RNA, 14 nt, Human
ccccucccuaccuc

SEQ ID NO: 3615144 - RNA, 15 nt, Human
ccccucccuaccuca

SEQ ID NO: 3615145 - RNA, 17 nt, Human
ccccucccuaccucaac

SEQ ID NO: 3615146 - RNA, 16 nt, Human
ccccucccuggccugu

SEQ ID NO: 3615147 - RNA, 14 nt, Human
ccccucccuggcuc

SEQ ID NO: 3615148 - RNA, 15 nt, Human
ccccucccuggcucc

SEQ ID NO: 3615149 - RNA, 12 nt, Human
ccccucccuggg

SEQ ID NO: 3615150 - RNA, 14 nt, Human
ccccucccuggguu

SEQ ID NO: 3615151 - RNA, 15 nt, Human
ccccucccuucaacc

SEQ ID NO: 3615152 - RNA, 17 nt, Human
ccccuccgcccugccac

SEQ ID NO: 3615153 - RNA, 13 nt, Human
ccccuccucacug

SEQ ID NO: 3615154 - RNA, 18 nt, Human
ccccuccuccacucuccc

SEQ ID NO: 3615155 - RNA, 13 nt, Human
ccccuccucccuu

SEQ ID NO: 3615156 - RNA, 22 nt, Human
ccccuccucccuuuuuccuugu

SEQ ID NO: 3615157 - RNA, 17 nt, Human
ccccuccucuagcugug

SEQ ID NO: 3615158 - RNA, 23 nt, Human
ccccuccucuccccuaccacugu

SEQ ID NO: 3615159 - RNA, 18 nt, Human
ccccuccucugaaacagc

SEQ ID NO: 3615160 - RNA, 22 nt, Human
ccccuccucugaaacagcugcc

SEQ ID NO: 3615161 - RNA, 13 nt, Human
ccccuccucugcc

SEQ ID NO: 3615162 - RNA, 14 nt, Human
ccccuccucugcca

SEQ ID NO: 3615163 - RNA, 18 nt, Human
cccuguacacaacucacu

SEQ ID NO: 3615164 - RNA, 16 nt, Human
cccuguaccucauccc

SEQ ID NO: 3615165 - RNA, 15 nt, Human
cccuguauauagccc

SEQ ID NO: 3615166 - RNA, 13 nt, Human
cccugucaccucu

SEQ ID NO: 3615167 - RNA, 14 nt, Human
cccugucaccucuu

SEQ ID NO: 3615168 - RNA, 18 nt, Human
cccugucagcaugaauuu

SEQ ID NO: 3615169 - RNA, 14 nt, Human
cccugucagugcag

SEQ ID NO: 3615170 - RNA, 17 nt, Human
cccugucagugcagccc

SEQ ID NO: 3615171 - RNA, 22 nt, Human
cccugucagugcagcccgugug

SEQ ID NO: 3615172 - RNA, 20 nt, Human
cccugucauccagcucacuc

SEQ ID NO: 3615173 - RNA, 13 nt, Human
cccugucccaugc

SEQ ID NO: 3615174 - RNA, 15 nt, Human
cccugucccaugcag

SEQ ID NO: 3615175 - RNA, 20 nt, Human
cccugucccaugcaggcccu

SEQ ID NO: 3615176 - RNA, 19 nt, Human
cccugucccccagcucugg

SEQ ID NO: 3615177 - RNA, 14 nt, Human
cccugucccuccca

SEQ ID NO: 3615178 - RNA, 17 nt, Human
cccugucccucccaccu

SEQ ID NO: 3615179 - RNA, 18 nt, Human
cccugucccucccaccuc

SEQ ID NO: 3615180 - RNA, 23 nt, Human
cccugucccucccaccucuguga

SEQ ID NO: 3615181 - RNA, 14 nt, Human
cccuguccucacug

SEQ ID NO: 3615182 - RNA, 16 nt, Human
cccuguccucacugcu

SEQ ID NO: 3615183 - RNA, 17 nt, Human
cccuguccucacugcuc

SEQ ID NO: 3615184 - RNA, 18 nt, Human
cccuguccucacugcucc

SEQ ID NO: 3615185 - RNA, 16 nt, Human
cccuguccuccucgga

SEQ ID NO: 3615186 - RNA, 14 nt, Human
cccugucuaaaaaa

SEQ ID NO: 3615187 - RNA, 12 nt, Human
cccugucuagag

SEQ ID NO: 3615188 - RNA, 23 nt, Human
cccugucuaggucaguacccacc

SEQ ID NO: 3615189 - RNA, 23 nt, Human
cccugucucaaaaaaagaaaaag

SEQ ID NO: 3615190 - RNA, 21 nt, Human
cccugucucucagggccaggc

SEQ ID NO: 3615191 - RNA, 22 nt, Human
cccugucucucagggccaggcc

SEQ ID NO: 3615192 - RNA, 16 nt, Human
cccugucugccagggc

SEQ ID NO: 3615193 - RNA, 22 nt, Human
cccugucuguagagggcccugg

SEQ ID NO: 3615194 - RNA, 13 nt, Human
cccugucuugucc

SEQ ID NO: 3615195 - RNA, 19 nt, Human
cccugucuuuacuccucac

SEQ ID NO: 3615196 - RNA, 20 nt, Human
cccugucuuuacuccucaca

SEQ ID NO: 3615197 - RNA, 22 nt, Human
cccugugacauggugccugaga

SEQ ID NO: 3615198 - RNA, 24 nt, Human
cccugugacauggugccugagagg

SEQ ID NO: 3615199 - RNA, 23 nt, Human
cccugugaguacuacaguccucc

SEQ ID NO: 3615200 - RNA, 24 nt, Human
cccugugaguacuacaguccuccc

SEQ ID NO: 3615201 - RNA, 23 nt, Human
cccugugaguuuguacagucuug

SEQ ID NO: 3615202 - RNA, 22 nt, Human
ccccucuuccucuugacccugc

SEQ ID NO: 3615203 - RNA, 12 nt, Human
ccccucuugccc

SEQ ID NO: 3615204 - RNA, 14 nt, Human
ccccucuugcccca

SEQ ID NO: 3615205 - RNA, 12 nt, Human
ccccucuuucuc

SEQ ID NO: 3615206 - RNA, 16 nt, Human
ccccucuuucucuuuc

SEQ ID NO: 3615207 - RNA, 22 nt, Human
ccccucuuucucuuucuuccuu

SEQ ID NO: 3615208 - RNA, 13 nt, Human
ccccugaauuuaa

SEQ ID NO: 3615209 - RNA, 17 nt, Human
ccccugaccacucagag

SEQ ID NO: 3615210 - RNA, 18 nt, Human
ccccugaccacucagaga

SEQ ID NO: 3615211 - RNA, 20 nt, Human
ccccugaccacucagagaca

SEQ ID NO: 3615212 - RNA, 20 nt, Human
ccccugagauccccugagcc

SEQ ID NO: 3615213 - RNA, 15 nt, Human
ccccugcacagcagg

SEQ ID NO: 3615214 - RNA, 21 nt, Human
ccccugcacagcaggcugcca

SEQ ID NO: 3615215 - RNA, 17 nt, Human
ccccugcacuguaaaau

SEQ ID NO: 3615216 - RNA, 19 nt, Human
ccccugcaggaaggagcug

SEQ ID NO: 3615217 - RNA, 20 nt, Human
ccccugcaggaaggagcugc

SEQ ID NO: 3615218 - RNA, 22 nt, Human
ccccugcaggaaggagcugccu

SEQ ID NO: 3615219 - RNA, 21 nt, Human
ccccugcauuggaacuggagg

SEQ ID NO: 3615220 - RNA, 18 nt, Human
ccccugccaccucccuga

SEQ ID NO: 3615221 - RNA, 17 nt, Human
ccccugccaccuccugc

SEQ ID NO: 3615222 - RNA, 10 nt, Human
ccccugccag

SEQ ID NO: 3615223 - RNA, 19 nt, Human
ccccugccagggcagggcc

SEQ ID NO: 3615224 - RNA, 23 nt, Human
ccccugccagggcagggccccag

SEQ ID NO: 3615225 - RNA, 14 nt, Human
ccccugccagugcc

SEQ ID NO: 3615226 - RNA, 15 nt, Human
ccccugccagugccu

SEQ ID NO: 3615227 - RNA, 18 nt, Human
ccccugcccaucugggaa

SEQ ID NO: 3615228 - RNA, 19 nt, Human
ccccugcccccaggacugg

SEQ ID NO: 3615229 - RNA, 23 nt, Human
ccccugcccccaggacugggcca

SEQ ID NO: 3615230 - RNA, 17 nt, Human
ccccugccccccagccu

SEQ ID NO: 3615231 - RNA, 18 nt, Human
ccccugcccccugcagga

SEQ ID NO: 3615232 - RNA, 19 nt, Human
ccccugcccucguggccag

SEQ ID NO: 3615233 - RNA, 12 nt, Human
ccccugcccugc

SEQ ID NO: 3615234 - RNA, 14 nt, Human
ccccugcccugugg

SEQ ID NO: 3615235 - RNA, 15 nt, Human
ccccugcccuguggg

SEQ ID NO: 3615236 - RNA, 21 nt, Human
ccccugccuccacccucugag

SEQ ID NO: 3615237 - RNA, 16 nt, Human
ccccugccuccauccu

SEQ ID NO: 3615238 - RNA, 14 nt, Human
ccccugccucucug

SEQ ID NO: 3615239 - RNA, 19 nt, Human
ccccugccucucugcaggu

SEQ ID NO: 3615240 - RNA, 16 nt, Human
ccccugccugccaugu

SEQ ID NO: 3615241 - RNA, 19 nt, Human
ccccugccugcccugguga

SEQ ID NO: 3615242 - RNA, 12 nt, Human
ccccugccuugc

SEQ ID NO: 3615243 - RNA, 22 nt, Human
ccccugcugcaggggcucugga

SEQ ID NO: 3615244 - RNA, 23 nt, Human
ccccugcugcaggggcucuggag

SEQ ID NO: 3615245 - RNA, 18 nt, Human
ccccugcugccuccccaa

SEQ ID NO: 3615246 - RNA, 21 nt, Human
ccccugcuggcucuucugccc

SEQ ID NO: 3615247 - RNA, 17 nt, Human
ccccugcuggguguggc

SEQ ID NO: 3615248 - RNA, 13 nt, Human
ccccugcugguuc

SEQ ID NO: 3615249 - RNA, 16 nt, Human
ccccugcuucaguccc

SEQ ID NO: 3615250 - RNA, 19 nt, Human
ccccugcuuccaccucacc

SEQ ID NO: 3615251 - RNA, 11 nt, Human
ccccugcuucu

SEQ ID NO: 3615252 - RNA, 19 nt, Human
ccccugcuucuccagccug

SEQ ID NO: 3615253 - RNA, 18 nt, Human
ccccuggaagagcccagu

SEQ ID NO: 3615254 - RNA, 18 nt, Human
ccccuggaagcagugccc

SEQ ID NO: 3615255 - RNA, 21 nt, Human
ccccuggaagcagugcccagg

SEQ ID NO: 3615256 - RNA, 21 nt, Human
ccccuggaggcugccucccaa

SEQ ID NO: 3615257 - RNA, 14 nt, Human
ccccuggcacuggc

SEQ ID NO: 3615258 - RNA, 21 nt, Human
ccccuggcagagaugccuccc

SEQ ID NO: 3615259 - RNA, 15 nt, Human
ccccuggcagccccu

SEQ ID NO: 3615260 - RNA, 12 nt, Human
ccccuggccucu

SEQ ID NO: 3615261 - RNA, 23 nt, Human
ccccuggcuguacugcucaggcu

SEQ ID NO: 3615262 - RNA, 18 nt, Human
ccccuggcuuuucacugc

SEQ ID NO: 3615263 - RNA, 11 nt, Human
ccccugggcuc

SEQ ID NO: 3615264 - RNA, 15 nt, Human
ccccugggcucugcc

SEQ ID NO: 3615265 - RNA, 21 nt, Human
ccccugggcucugccccagcu

SEQ ID NO: 3615266 - RNA, 16 nt, Human
ccccugggcuuggccu

SEQ ID NO: 3615267 - RNA, 14 nt, Human
ccccuggggaccca

SEQ ID NO: 3615268 - RNA, 20 nt, Human
ccccuggggcuucuccugac

SEQ ID NO: 3615269 - RNA, 20 nt, Human
ccccuggguggguggugggg

SEQ ID NO: 3615270 - RNA, 17 nt, Human
ccccuggucccucugca

SEQ ID NO: 3615271 - RNA, 15 nt, Human
ccccugguggacagu

SEQ ID NO: 3615272 - RNA, 19 nt, Human
ccccugguggacaguccug

SEQ ID NO: 3615273 - RNA, 20 nt, Human
ccccugguggacaguccugg

SEQ ID NO: 3615274 - RNA, 21 nt, Human
ccccugguggacaguccuggg

SEQ ID NO: 3615275 - RNA, 18 nt, Human
ccccugguucucaucuuu

SEQ ID NO: 3615276 - RNA, 16 nt, Human
ccccuguacacaacuc

SEQ ID NO: 3615277 - RNA, 15 nt, Human
ccccuguaggccuca

SEQ ID NO: 3615278 - RNA, 23 nt, Human
ccccugucuccuuauucggcagc

SEQ ID NO: 3615279 - RNA, 19 nt, Human
ccccugugcagccgcugag

SEQ ID NO: 3615280 - RNA, 18 nt, Human
ccccuguggggaucucag

SEQ ID NO: 3615281 - RNA, 21 nt, Human
ccccuguggggaucucagggg

SEQ ID NO: 3615282 - RNA, 24 nt, Human
ccccuguggggaucucaggggcug

SEQ ID NO: 3615283 - RNA, 20 nt, Human
ccccuguucuggcagaguug

SEQ ID NO: 3615284 - RNA, 19 nt, Human
ccccuguuuauucauaugc

SEQ ID NO: 3615285 - RNA, 16 nt, Human
ccccuuaagcccuggc

SEQ ID NO: 3615286 - RNA, 24 nt, Human
ccccuuagacagaggcccucaagu

SEQ ID NO: 3615287 - RNA, 16 nt, Human
ccccuuauccaggacu

SEQ ID NO: 3615288 - RNA, 19 nt, Human
ccccuucacuucugaccac

SEQ ID NO: 3615289 - RNA, 22 nt, Human
ccccuucacuucugaccacacu

SEQ ID NO: 3615290 - RNA, 14 nt, Human
ccccuucagugccc

SEQ ID NO: 3615291 - RNA, 16 nt, Human
ccccuucauccucuga

SEQ ID NO: 3615292 - RNA, 22 nt, Human
ccccuuccagaucacugccaca

SEQ ID NO: 3615293 - RNA, 13 nt, Human
ccccuuccccacu

SEQ ID NO: 3615294 - RNA, 21 nt, Human
ccccuuccccacugccugccc

SEQ ID NO: 3615295 - RNA, 23 nt, Human
ccccuuccccacugccugcccac

SEQ ID NO: 3615296 - RNA, 14 nt, Human
ccccuucccugcaa

SEQ ID NO: 3615297 - RNA, 13 nt, Human
ccccuucccuguc

SEQ ID NO: 3615298 - RNA, 21 nt, Human
ccccuuccuaauuccacagcu

SEQ ID NO: 3615299 - RNA, 19 nt, Human
ccccuuccucuugucugau

SEQ ID NO: 3615300 - RNA, 22 nt, Human
ccccuuccugucccaccucuuc

SEQ ID NO: 3615301 - RNA, 19 nt, Human
ccccuuccuugcucugcac

SEQ ID NO: 3615302 - RNA, 21 nt, Human
ccccuucuacacucuccuggg

SEQ ID NO: 3615303 - RNA, 22 nt, Human
ccccuucuagguggcaaggcug

SEQ ID NO: 3615304 - RNA, 14 nt, Human
ccccuucucagaau

SEQ ID NO: 3615305 - RNA, 15 nt, Human
ccccuucucaucacu

SEQ ID NO: 3615306 - RNA, 14 nt, Human
cccugcuccugcag

SEQ ID NO: 3615307 - RNA, 18 nt, Human
cccugcugagucaucugu

SEQ ID NO: 3615308 - RNA, 21 nt, Human
cccugcugagucccaggcuga

SEQ ID NO: 3615309 - RNA, 15 nt, Human
cccugcugcaggggc

SEQ ID NO: 3615310 - RNA, 16 nt, Human
cccugcugcaggggcu

SEQ ID NO: 3615311 - RNA, 13 nt, Human
cccugcugcccaa

SEQ ID NO: 3615312 - RNA, 19 nt, Human
cccugcugccgccucccag

SEQ ID NO: 3615313 - RNA, 22 nt, Human
cccugcugccgccucccagccu

SEQ ID NO: 3615314 - RNA, 23 nt, Human
cccugcugccgccucccagccug

SEQ ID NO: 3615315 - RNA, 11 nt, Human
cccugcugccu

SEQ ID NO: 3615316 - RNA, 17 nt, Human
cccugcugcugccugcc

SEQ ID NO: 3615317 - RNA, 13 nt, Human
cccugcugcuggu

SEQ ID NO: 3615318 - RNA, 16 nt, Human
cccugcugcuggugca

SEQ ID NO: 3615319 - RNA, 19 nt, Human
cccugcugcuggugcacag

SEQ ID NO: 3615320 - RNA, 19 nt, Human
cccugcugcugucaccucu

SEQ ID NO: 3615321 - RNA, 13 nt, Human
cccugcuggccgc

SEQ ID NO: 3615322 - RNA, 15 nt, Human
cccugcuggccgccu

SEQ ID NO: 3615323 - RNA, 19 nt, Human
cccugcugguucaggguug

SEQ ID NO: 3615324 - RNA, 13 nt, Human
cccugcugucccc

SEQ ID NO: 3615325 - RNA, 23 nt, Human
cccugcuguccccucuugcccca

SEQ ID NO: 3615326 - RNA, 22 nt, Human
cccugcuucagauguggagcca

SEQ ID NO: 3615327 - RNA, 14 nt, Human
cccugcuuccaccu

SEQ ID NO: 3615328 - RNA, 17 nt, Human
cccugcuuccaccucac

SEQ ID NO: 3615329 - RNA, 15 nt, Human
cccugcuuccaggaa

SEQ ID NO: 3615330 - RNA, 12 nt, Human
cccugcuucucc

SEQ ID NO: 3615331 - RNA, 14 nt, Human
cccugcuuggccca

SEQ ID NO: 3615332 - RNA, 17 nt, Human
cccugcuuugggcugcc

SEQ ID NO: 3615333 - RNA, 19 nt, Human
cccugcuuugggcugcccu

SEQ ID NO: 3615334 - RNA, 20 nt, Human
cccugcuuugggcugcccug

SEQ ID NO: 3615335 - RNA, 22 nt, Human
cccugcuuugggcugcccuggu

SEQ ID NO: 3615336 - RNA, 21 nt, Human
cccuggaaaccuuccacccag

SEQ ID NO: 3615337 - RNA, 19 nt, Human
cccuggaacauccuuugca

SEQ ID NO: 3615338 - RNA, 15 nt, Human
cccuggaacugucuc

SEQ ID NO: 3615339 - RNA, 18 nt, Human
cccuggaacugucucuca

SEQ ID NO: 3615340 - RNA, 15 nt, Human
cccuggaagagccca

SEQ ID NO: 3615341 - RNA, 16 nt, Human
cccuggaagagcccag

SEQ ID NO: 3615342 - RNA, 16 nt, Human
cccuggaagcagugcc

SEQ ID NO: 3615343 - RNA, 17 nt, Human
cccuggaagcagugccc

SEQ ID NO: 3615344 - RNA, 12 nt, Human
cccuggaagccg

SEQ ID NO: 3615345 - RNA, 18 nt, Human
cccuggaagccggcggcc

SEQ ID NO: 3615346 - RNA, 23 nt, Human
cccuggaccaguggucucacaug

SEQ ID NO: 3615347 - RNA, 16 nt, Human
cccuggacccagccag

SEQ ID NO: 3615348 - RNA, 14 nt, Human
cccuggaccccagc

SEQ ID NO: 3615349 - RNA, 18 nt, Human
cccuggaccccagccuca

SEQ ID NO: 3615350 - RNA, 13 nt, Human
cccuggagagaag

SEQ ID NO: 3615351 - RNA, 20 nt, Human
cccuggagccaacugcugcu

SEQ ID NO: 3615352 - RNA, 14 nt, Human
cccuggagccagac

SEQ ID NO: 3615353 - RNA, 18 nt, Human
cccuggagccuccacugc

SEQ ID NO: 3615354 - RNA, 15 nt, Human
cccuggaggcaccug

SEQ ID NO: 3615355 - RNA, 12 nt, Human
cccuggaggcgg

SEQ ID NO: 3615356 - RNA, 15 nt, Human
cccuggaggcugccu

SEQ ID NO: 3615357 - RNA, 16 nt, Human
cccuggaggcugccuc

SEQ ID NO: 3615358 - RNA, 17 nt, Human
cccuggaggcugccucc

SEQ ID NO: 3615359 - RNA, 19 nt, Human
cccuggaggcugccuccca

SEQ ID NO: 3615360 - RNA, 13 nt, Human
cccuggaggugcc

SEQ ID NO: 3615361 - RNA, 14 nt, Human
cccuggaggugcca

SEQ ID NO: 3615362 - RNA, 16 nt, Human
cccuggaggugccagc

SEQ ID NO: 3615363 - RNA, 17 nt, Human
cccuggaggugccagca

SEQ ID NO: 3615364 - RNA, 23 nt, Human
cccuggaggugccagcaaagccc

SEQ ID NO: 3615365 - RNA, 21 nt, Human
cccuggaguguggcugaggag

SEQ ID NO: 3615366 - RNA, 16 nt, Human
cccuggaucagcgugg

SEQ ID NO: 3615367 - RNA, 21 nt, Human
cccuggaucagcguggccuug

SEQ ID NO: 3615368 - RNA, 19 nt, Human
cccuggaucuaccuggagg

SEQ ID NO: 3615369 - RNA, 20 nt, Human
cccuggaucuaccuggaggg

SEQ ID NO: 3615370 - RNA, 13 nt, Human
cccuggaugcagc

SEQ ID NO: 3615371 - RNA, 17 nt, Human
cccuggaugcagccuca

SEQ ID NO: 3615372 - RNA, 21 nt, Human
cccuggaugcagccucacagu

SEQ ID NO: 3615373 - RNA, 16 nt, Human
cccuggaugcccagga

SEQ ID NO: 3615374 - RNA, 13 nt, Human
cccuggcacuggc

SEQ ID NO: 3615375 - RNA, 12 nt, Human
cccuggcagaga

SEQ ID NO: 3615376 - RNA, 22 nt, Human
cccuggcagagaugccucccug

SEQ ID NO: 3615377 - RNA, 12 nt, Human
cccuggcagccc

SEQ ID NO: 3615378 - RNA, 20 nt, Human
cccuggcaggaugacccugc

SEQ ID NO: 3615379 - RNA, 14 nt, Human
cccuggccagaggc

SEQ ID NO: 3615380 - RNA, 15 nt, Human
cccuggccagaggcu

SEQ ID NO: 3615381 - RNA, 21 nt, Human
cccuggcccccucccuggaug

SEQ ID NO: 3615382 - RNA, 16 nt, Human
cccuggcccccugagu

SEQ ID NO: 3615383 - RNA, 18 nt, Human
cccuggccccucucccuu

SEQ ID NO: 3615384 - RNA, 20 nt, Human
cccuggcccucaaggccucc

SEQ ID NO: 3615385 - RNA, 14 nt, Human
cccuggcccugagg

SEQ ID NO: 3615386 - RNA, 20 nt, Human
cccuggccgcgcuccgggcu

SEQ ID NO: 3615387 - RNA, 16 nt, Human
cccuggccuagaccag

SEQ ID NO: 3615388 - RNA, 11 nt, Human
cccuggccucc

SEQ ID NO: 3615389 - RNA, 13 nt, Human
cccuggccucccc

SEQ ID NO: 3615390 - RNA, 21 nt, Human
cccuggccucugugccuucuu

SEQ ID NO: 3615391 - RNA, 11 nt, Human
cccuggccuga

SEQ ID NO: 3615392 - RNA, 22 nt, Human
cccuggccugcugggcucucca

SEQ ID NO: 3615393 - RNA, 15 nt, Human
cccuggcucccauga

SEQ ID NO: 3615394 - RNA, 18 nt, Human
cccuggcucccuccucca

SEQ ID NO: 3615395 - RNA, 20 nt, Human
cccuggcuccuugugccaga

SEQ ID NO: 3615396 - RNA, 22 nt, Human
cccuggcuccuugugccagaga

SEQ ID NO: 3615397 - RNA, 15 nt, Human
cccuggcugaaggac

SEQ ID NO: 3615398 - RNA, 19 nt, Human
cccuggcugaccccaaaga

SEQ ID NO: 3615399 - RNA, 17 nt, Human
cccuggcugagggcagc

SEQ ID NO: 3615400 - RNA, 16 nt, Human
cccuggcugcccuggc

SEQ ID NO: 3615401 - RNA, 22 nt, Human
cccuggcugcugcccccacccc

SEQ ID NO: 3615402 - RNA, 15 nt, Human
cccuggcuguacugc

SEQ ID NO: 3615403 - RNA, 17 nt, Human
cccuggcuguacugcuc

SEQ ID NO: 3615404 - RNA, 21 nt, Human
cccuggcuguacugcucaggc

SEQ ID NO: 3615405 - RNA, 22 nt, Human
cccuggcuguucugugguuccu

SEQ ID NO: 3615406 - RNA, 14 nt, Human
cccuggcuuccuua

SEQ ID NO: 3615407 - RNA, 15 nt, Human
cccuggcuucugugg

SEQ ID NO: 3615408 - RNA, 17 nt, Human
cccuggcuucugugggg

SEQ ID NO: 3615409 - RNA, 22 nt, Human
cccuggcuucuguggggccccu

SEQ ID NO: 3615410 - RNA, 20 nt, Human
cccuggcuuguaacuccacc

SEQ ID NO: 3615411 - RNA, 24 nt, Human
cccuggcuuucauuuucucucagg

SEQ ID NO: 3615412 - RNA, 17 nt, Human
cccuggcuuuucacugc

SEQ ID NO: 3615413 - RNA, 17 nt, Human
ccgggcccucccuugga

SEQ ID NO: 3615414 - RNA, 15 nt, Human
ccgggcccugaguaa

SEQ ID NO: 3615415 - RNA, 15 nt, Human
ccgggcgcggccagc

SEQ ID NO: 3615416 - RNA, 21 nt, Human
ccgggcgcgguggcgggcacc

SEQ ID NO: 3615417 - RNA, 16 nt, Human
ccgggcguggugguga

SEQ ID NO: 3615418 - RNA, 22 nt, Human
ccgggcucagggaccacagcaa

SEQ ID NO: 3615419 - RNA, 22 nt, Human
ccgggcuccccuuucgcccaca

SEQ ID NO: 3615420 - RNA, 15 nt, Human
ccgggcugagggccu

SEQ ID NO: 3615421 - RNA, 18 nt, Human
ccgggcugagggccugcu

SEQ ID NO: 3615422 - RNA, 21 nt, Human
ccgggcugagggccugcugga

SEQ ID NO: 3615423 - RNA, 17 nt, Human
ccgggcugccugggcug

SEQ ID NO: 3615424 - RNA, 13 nt, Human
ccgggcugggagc

SEQ ID NO: 3615425 - RNA, 18 nt, Human
ccgggcugggagcucugc

SEQ ID NO: 3615426 - RNA, 16 nt, Human
ccggggaacuggccaa

SEQ ID NO: 3615427 - RNA, 17 nt, Human
ccggggaacuggccaag

SEQ ID NO: 3615428 - RNA, 21 nt, Human
ccggggaagagauccaaagac

SEQ ID NO: 3615429 - RNA, 23 nt, Human
ccggggcagcagcagcccugccc

SEQ ID NO: 3615430 - RNA, 20 nt, Human
ccggggcagcugccagagaa

SEQ ID NO: 3615431 - RNA, 14 nt, Human
ccggggcagggcag

SEQ ID NO: 3615432 - RNA, 16 nt, Human
ccggggcagggcagcc

SEQ ID NO: 3615433 - RNA, 17 nt, Human
ccggggccugccuagca

SEQ ID NO: 3615434 - RNA, 15 nt, Human
ccggggccugggcag

SEQ ID NO: 3615435 - RNA, 12 nt, Human
ccgggguccugu

SEQ ID NO: 3615436 - RNA, 21 nt, Human
ccgggguggagcaugggccug

SEQ ID NO: 3615437 - RNA, 18 nt, Human
ccggggugggguggcugc

SEQ ID NO: 3615438 - RNA, 22 nt, Human
ccgggucaucuguaccucugcc

SEQ ID NO: 3615439 - RNA, 13 nt, Human
ccgggucuuccua

SEQ ID NO: 3615440 - RNA, 20 nt, Human
ccgggugggcggcacagccu

SEQ ID NO: 3615441 - RNA, 20 nt, Human
ccggguuuggcgggccaagg

SEQ ID NO: 3615442 - RNA, 21 nt, Human
ccggguuuggcgggccaagga

SEQ ID NO: 3615443 - RNA, 19 nt, Human
ccgguaacuguccuguccu

SEQ ID NO: 3615444 - RNA, 18 nt, Human
ccgguagggaggcagccu

SEQ ID NO: 3615445 - RNA, 15 nt, Human
ccgguccagcuggcc

SEQ ID NO: 3615446 - RNA, 22 nt, Human
ccggucccuugagaccucagcc

SEQ ID NO: 3615447 - RNA, 16 nt, Human
ccgguggcugggcaga

SEQ ID NO: 3615448 - RNA, 21 nt, Human
ccggugugccugacugcccag

SEQ ID NO: 3615449 - RNA, 16 nt, Human
ccggugugccugcagc

SEQ ID NO: 3615450 - RNA, 14 nt, Human
ccgguguucuaaga

SEQ ID NO: 3615451 - RNA, 21 nt, Human
cccuggggcugaucucaggga

SEQ ID NO: 3615452 - RNA, 18 nt, Human
cccuggggcuucuccuga

SEQ ID NO: 3615453 - RNA, 19 nt, Human
cccugggggaagcccugga

SEQ ID NO: 3615454 - RNA, 21 nt, Human
cccuggggugcaggcgccuca

SEQ ID NO: 3615455 - RNA, 17 nt, Human
cccugggguggccacca

SEQ ID NO: 3615456 - RNA, 16 nt, Human
cccuggguggguggug

SEQ ID NO: 3615457 - RNA, 18 nt, Human
cccuggguuagacugcca

SEQ ID NO: 3615458 - RNA, 19 nt, Human
cccuggguuagacugccag

SEQ ID NO: 3615459 - RNA, 21 nt, Human
cccuggguuagacugccagcu

SEQ ID NO: 3615460 - RNA, 20 nt, Human
cccugguaagaaaaagcaaa

SEQ ID NO: 3615461 - RNA, 15 nt, Human
cccugguagggcagu

SEQ ID NO: 3615462 - RNA, 22 nt, Human
cccuggucccucugcagucucu

SEQ ID NO: 3615463 - RNA, 15 nt, Human
cccugguccugaggg

SEQ ID NO: 3615464 - RNA, 13 nt, Human
cccuggucucugg

SEQ ID NO: 3615465 - RNA, 14 nt, Human
cccuggucucuggu

SEQ ID NO: 3615466 - RNA, 14 nt, Human
cccuggugaggaag

SEQ ID NO: 3615467 - RNA, 21 nt, Human
cccuggugcacuggccccacc

SEQ ID NO: 3615468 - RNA, 16 nt, Human
cccuggugcugccaca

SEQ ID NO: 3615469 - RNA, 17 nt, Human
cccuggugcugccacac

SEQ ID NO: 3615470 - RNA, 20 nt, Human
cccugguggacaguccuggg

SEQ ID NO: 3615471 - RNA, 20 nt, Human
cccugguggagaaagcacug

SEQ ID NO: 3615472 - RNA, 23 nt, Human
cccugguggagaaagcacugacc

SEQ ID NO: 3615473 - RNA, 21 nt, Human
cccugguggcagcucaccucu

SEQ ID NO: 3615474 - RNA, 13 nt, Human
cccugguggcagu

SEQ ID NO: 3615475 - RNA, 14 nt, Human
cccugguggcagug

SEQ ID NO: 3615476 - RNA, 16 nt, Human
cccugguggcaguggg

SEQ ID NO: 3615477 - RNA, 19 nt, Human
cccugguggcagugggagc

SEQ ID NO: 3615478 - RNA, 21 nt, Human
cccugguggcagugggagcug

SEQ ID NO: 3615479 - RNA, 20 nt, Human
cccugguggcccucuccccu

SEQ ID NO: 3615480 - RNA, 21 nt, Human
cccugguggcccucuccccug

SEQ ID NO: 3615481 - RNA, 12 nt, Human
cccugguguuuc

SEQ ID NO: 3615482 - RNA, 19 nt, Human
cccugguuauauucucacg

SEQ ID NO: 3615483 - RNA, 15 nt, Human
cccugguucucaucu

SEQ ID NO: 3615484 - RNA, 20 nt, Human
cccugguuggguggcaauuc

SEQ ID NO: 3615485 - RNA, 16 nt, Human
cccugguuuccugccc

SEQ ID NO: 3615486 - RNA, 18 nt, Human
cccugguuuccugcccug

SEQ ID NO: 3615487 - RNA, 21 nt, Human
cccugguuuccugcccuggga

SEQ ID NO: 3615488 - RNA, 22 nt, Human
cccugguuuccugcccugggag

SEQ ID NO: 3615489 - RNA, 17 nt, Human
cccuguacaauauuuaa

SEQ ID NO: 3615490 - RNA, 13 nt, Human
cccuguacagugu

SEQ ID NO: 3615491 - RNA, 15 nt, Human
cccuguacaguguua

SEQ ID NO: 3615492 - RNA, 20 nt, Human
cccuguacaguguuaccauc

SEQ ID NO: 3615493 - RNA, 17 nt, Human
cccuguaccucauccca

SEQ ID NO: 3615494 - RNA, 19 nt, Human
cccuguaccuuuugaggag

SEQ ID NO: 3615495 - RNA, 18 nt, Human
cccuguacuguucugugu

SEQ ID NO: 3615496 - RNA, 21 nt, Human
cccuguagagugggagcugag

SEQ ID NO: 3615497 - RNA, 17 nt, Human
cccuguauauagcccag

SEQ ID NO: 3615498 - RNA, 14 nt, Human
cccuguauggcacu

SEQ ID NO: 3615499 - RNA, 15 nt, Human
cccugucccaccccc

SEQ ID NO: 3615500 - RNA, 22 nt, Human
cccugucccacccccuuccccc

SEQ ID NO: 3615501 - RNA, 21 nt, Human
cccugucccaugcaggcccuu

SEQ ID NO: 3615502 - RNA, 16 nt, Human
cccugucccccagcuc

SEQ ID NO: 3615503 - RNA, 18 nt, Human
cccuguccccucagcucc

SEQ ID NO: 3615504 - RNA, 19 nt, Human
cccuguccccucagcucca

SEQ ID NO: 3615505 - RNA, 20 nt, Human
cccuguccccucccccuucc

SEQ ID NO: 3615506 - RNA, 21 nt, Human
cccugucccucccaccucugu

SEQ ID NO: 3615507 - RNA, 21 nt, Human
cccuguccggaaugccaccca

SEQ ID NO: 3615508 - RNA, 22 nt, Human
cccuguccugauggucagcucc

SEQ ID NO: 3615509 - RNA, 14 nt, Human
cccuguccuggugg

SEQ ID NO: 3615510 - RNA, 23 nt, Human
cccuguccuggugguauuuucaa

SEQ ID NO: 3615511 - RNA, 23 nt, Human
cccugucgaguucggcucugggu

SEQ ID NO: 3615512 - RNA, 13 nt, Human
cccugucuaauga

SEQ ID NO: 3615513 - RNA, 16 nt, Human
cccugucuagagaggg

SEQ ID NO: 3615514 - RNA, 19 nt, Human
cccugucuccucucucugu

SEQ ID NO: 3615515 - RNA, 23 nt, Human
cccugucugaaggacacuuccug

SEQ ID NO: 3615516 - RNA, 23 nt, Human
cccugucuguagagggcccuggu

SEQ ID NO: 3615517 - RNA, 18 nt, Human
cccugugacauggugccu

SEQ ID NO: 3615518 - RNA, 20 nt, Human
cccugugacauggugccuga

SEQ ID NO: 3615519 - RNA, 21 nt, Human
cccugugacauggugccugag

SEQ ID NO: 3615520 - RNA, 22 nt, Human
cccugugauggggcccugccuc

SEQ ID NO: 3615521 - RNA, 23 nt, Human
cccugugauggggcccugccucc

SEQ ID NO: 3615522 - RNA, 22 nt, Human
cccugugcagccgcugagcgag

SEQ ID NO: 3615523 - RNA, 15 nt, Human
cccugugccuuguca

SEQ ID NO: 3615524 - RNA, 17 nt, Human
cccugugcuccgugccu

SEQ ID NO: 3615525 - RNA, 18 nt, Human
cccuguggaagggacuag

SEQ ID NO: 3615526 - RNA, 21 nt, Human
cccuguggaagggacuaggag

SEQ ID NO: 3615527 - RNA, 20 nt, Human
cccuguggaugagcccucag

SEQ ID NO: 3615528 - RNA, 21 nt, Human
cccuguggaugagcccucaga

SEQ ID NO: 3615529 - RNA, 22 nt, Human
cccuguggaugagcccucagaa

SEQ ID NO: 3615530 - RNA, 23 nt, Human
cccuguggaugagcccucagaac

SEQ ID NO: 3615531 - RNA, 18 nt, Human
cccugugggaccccaggc

SEQ ID NO: 3615532 - RNA, 20 nt, Human
cccuguggggaucucagggg

SEQ ID NO: 3615533 - RNA, 23 nt, Human
cccuguggggaucucaggggcug

SEQ ID NO: 3615534 - RNA, 22 nt, Human
cccugugguuuccaaggagcug

SEQ ID NO: 3615535 - RNA, 11 nt, Human
cccugugugca

SEQ ID NO: 3615536 - RNA, 13 nt, Human
cccugugugcagg

SEQ ID NO: 3615537 - RNA, 13 nt, Human
cccuguguuaauu

SEQ ID NO: 3615538 - RNA, 12 nt, Human
cccuguucauug

SEQ ID NO: 3615539 - RNA, 13 nt, Human
cccuguucauugu

SEQ ID NO: 3615540 - RNA, 17 nt, Human
cccuguuccugcugcug

SEQ ID NO: 3615541 - RNA, 22 nt, Human
cccuguugaauuuuguucucug

SEQ ID NO: 3615542 - RNA, 13 nt, Human
cccuguugugcca

SEQ ID NO: 3615543 - RNA, 11 nt, Human
cccuguuuaau

SEQ ID NO: 3615544 - RNA, 14 nt, Human
cccuguuuaauauu

SEQ ID NO: 3615545 - RNA, 21 nt, Human
cccuguuuaauauuuaaacag

SEQ ID NO: 3615546 - RNA, 16 nt, Human
cccuguuucagaggcu

SEQ ID NO: 3615547 - RNA, 20 nt, Human
cccuguuuuccccccaaggg

SEQ ID NO: 3615548 - RNA, 15 nt, Human
cccuguuuucugagc

SEQ ID NO: 3615549 - RNA, 14 nt, Human
cccuuaaaauagaa

SEQ ID NO: 3615550 - RNA, 14 nt, Human
cccuuaacccaagg

SEQ ID NO: 3615551 - RNA, 16 nt, Human
cccuuaacccaaggag

SEQ ID NO: 3615552 - RNA, 15 nt, Human
cccuuaagcccuggc

SEQ ID NO: 3615553 - RNA, 17 nt, Human
cccuuaagcccuggccc

SEQ ID NO: 3615554 - RNA, 20 nt, Human
cccuuaagucacccuagccc

SEQ ID NO: 3615555 - RNA, 19 nt, Human
cccuuaauuacuuaaaaaa

SEQ ID NO: 3615556 - RNA, 17 nt, Human
cccuuacagccucugac

SEQ ID NO: 3615557 - RNA, 14 nt, Human
cccuuacaguagga

SEQ ID NO: 3615558 - RNA, 21 nt, Human
cccuuaccacugcucugauga

SEQ ID NO: 3615559 - RNA, 20 nt, Human
cccuuaccaugugccugauc

SEQ ID NO: 3615560 - RNA, 23 nt, Human
cccuuaccugccaggaagccagc

SEQ ID NO: 3615561 - RNA, 17 nt, Human
cccuuacgugaguccug

SEQ ID NO: 3615562 - RNA, 20 nt, Human
cccuuagaaguuuguuguga

SEQ ID NO: 3615563 - RNA, 19 nt, Human
cccuuagcccccacccacu

SEQ ID NO: 3615564 - RNA, 21 nt, Human
cccuuagcccccacccacuuc

SEQ ID NO: 3615565 - RNA, 12 nt, Human
cccuuagucccc

SEQ ID NO: 3615566 - RNA, 18 nt, Human
cccuuagucccccaacuc

SEQ ID NO: 3615567 - RNA, 12 nt, Human
cccuuauccagg

SEQ ID NO: 3615568 - RNA, 16 nt, Human
cccuuauccaggacuc

SEQ ID NO: 3615569 - RNA, 16 nt, Human
cccuuaucugugcuca

SEQ ID NO: 3615570 - RNA, 20 nt, Human
cccuuaucugugcucaggac

SEQ ID NO: 3615571 - RNA, 12 nt, Human
cccuuauuuuca

SEQ ID NO: 3615572 - RNA, 14 nt, Human
cccuucaaccauuc

SEQ ID NO: 3615573 - RNA, 20 nt, Human
cccuucacaaagcccaaggg

SEQ ID NO: 3615574 - RNA, 18 nt, Human
cccuucacugccuuugcu

SEQ ID NO: 3615575 - RNA, 17 nt, Human
cccuucacuucugacca

SEQ ID NO: 3615576 - RNA, 17 nt, Human
cagggaagagcagaacg

SEQ ID NO: 3615577 - RNA, 14 nt, Human
cagggaagaggggu

SEQ ID NO: 3615578 - RNA, 15 nt, Human
cagggaagcuacagg

SEQ ID NO: 3615579 - RNA, 22 nt, Human
cagggaagcuacagguuacaac

SEQ ID NO: 3615580 - RNA, 13 nt, Human
cagggaagcuggc

SEQ ID NO: 3615581 - RNA, 17 nt, Human
cagggaagcuggccgag

SEQ ID NO: 3615582 - RNA, 18 nt, Human
cagggaaggaggagccug

SEQ ID NO: 3615583 - RNA, 20 nt, Human
cagggaaggaggagccuguc

SEQ ID NO: 3615584 - RNA, 19 nt, Human
cagggaaggggaggcagcc

SEQ ID NO: 3615585 - RNA, 18 nt, Human
cagggaagggggagcugg

SEQ ID NO: 3615586 - RNA, 17 nt, Human
cagggaaguccccaggc

SEQ ID NO: 3615587 - RNA, 18 nt, Human
cagggaaguccccaggcc

SEQ ID NO: 3615588 - RNA, 17 nt, Human
cagggaagugcucugau

SEQ ID NO: 3615589 - RNA, 23 nt, Human
cagggaauccaagccuccacagc

SEQ ID NO: 3615590 - RNA, 18 nt, Human
cagggaauuaggccccca

SEQ ID NO: 3615591 - RNA, 13 nt, Human
cagggacaaagag

SEQ ID NO: 3615592 - RNA, 23 nt, Human
cagggacaaagaggccuuuaacc

SEQ ID NO: 3615593 - RNA, 15 nt, Human
cagggacaccagcca

SEQ ID NO: 3615594 - RNA, 19 nt, Human
ccucuguaccccaugaccu

SEQ ID NO: 3615595 - RNA, 23 nt, Human
ccucuguauuugaaucagccuac

SEQ ID NO: 3615596 - RNA, 19 nt, Human
ccucugucacugcaggcac

SEQ ID NO: 3615597 - RNA, 16 nt, Human
ccucugucagucacag

SEQ ID NO: 3615598 - RNA, 21 nt, Human
ccucugucagucacagccacc

SEQ ID NO: 3615599 - RNA, 16 nt, Human
ccucugucauuuguug

SEQ ID NO: 3615600 - RNA, 15 nt, Human
ccucuguccaggcac

SEQ ID NO: 3615601 - RNA, 18 nt, Human
ccucuguccagggcccug

SEQ ID NO: 3615602 - RNA, 21 nt, Human
ccucuguccagggcccugagc

SEQ ID NO: 3615603 - RNA, 17 nt, Human
ccucuguccccuucucu

SEQ ID NO: 3615604 - RNA, 13 nt, Human
ccucuguccugac

SEQ ID NO: 3615605 - RNA, 14 nt, Human
ccucuguccugacu

SEQ ID NO: 3615606 - RNA, 16 nt, Human
ccucuguccugacuuc

SEQ ID NO: 3615607 - RNA, 18 nt, Human
ccucuguccugcuucuga

SEQ ID NO: 3615608 - RNA, 16 nt, Human
ccucugucuagcaugc

SEQ ID NO: 3615609 - RNA, 18 nt, Human
ccucugucucauccuccu

SEQ ID NO: 3615610 - RNA, 22 nt, Human
ccucugucucauccuccuggaa

SEQ ID NO: 3615611 - RNA, 16 nt, Human
ccucugucugcccuuc

SEQ ID NO: 3615612 - RNA, 14 nt, Human
ccucugucuggcaa

SEQ ID NO: 3615613 - RNA, 22 nt, Human
ccucugucuuggcuuucauguu

SEQ ID NO: 3615614 - RNA, 22 nt, Human
ccucugucuugugaaggcaggg

SEQ ID NO: 3615615 - RNA, 15 nt, Human
ccucugugaccucag

SEQ ID NO: 3615616 - RNA, 23 nt, Human
ccucuguggcauugaaaugagca

SEQ ID NO: 3615617 - RNA, 16 nt, Human
ccucugugucacuggc

SEQ ID NO: 3615618 - RNA, 23 nt, Human
ccucugugucacuggcugccucc

SEQ ID NO: 3615619 - RNA, 19 nt, Human
ccucugugugcuccuccuu

SEQ ID NO: 3615620 - RNA, 16 nt, Human
ccucuguucaaagcug

SEQ ID NO: 3615621 - RNA, 18 nt, Human
ccucuguucaaagcugcc

SEQ ID NO: 3615622 - RNA, 21 nt, Human
ccucuguucugcacacagcac

SEQ ID NO: 3615623 - RNA, 23 nt, Human
ccucuguuguccuccccuugggc

SEQ ID NO: 3615624 - RNA, 19 nt, Human
ccucuuaaaaaauaaaaac

SEQ ID NO: 3615625 - RNA, 19 nt, Human
ccucuuaaagaaaacccac

SEQ ID NO: 3615626 - RNA, 21 nt, Human
ccucuuaaagaaaacccaccc

SEQ ID NO: 3615627 - RNA, 19 nt, Human
ccucuuacgguaguuagga

SEQ ID NO: 3615628 - RNA, 22 nt, Human
ccucuucaccccggcaggcccu

SEQ ID NO: 3615629 - RNA, 23 nt, Human
ccucuucaccccggcaggcccug

SEQ ID NO: 3615630 - RNA, 13 nt, Human
ccucuucacuccc

SEQ ID NO: 3615631 - RNA, 14 nt, Human
ccucuucagaggcc

SEQ ID NO: 3615632 - RNA, 16 nt, Human
ccucuuccaugcugug

SEQ ID NO: 3615633 - RNA, 11 nt, Human
ccucuucccca

SEQ ID NO: 3615634 - RNA, 12 nt, Human
ccucuuccccag

SEQ ID NO: 3615635 - RNA, 13 nt, Human
ccucuuccccaga

SEQ ID NO: 3615636 - RNA, 21 nt, Human
ccucuuccccagacgccuggc

SEQ ID NO: 3615637 - RNA, 15 nt, Human
ccucuucccccaaga

SEQ ID NO: 3615638 - RNA, 15 nt, Human
ccucuuccccuugcc

SEQ ID NO: 3615639 - RNA, 17 nt, Human
ccucuuccgacucuuuc

SEQ ID NO: 3615640 - RNA, 19 nt, Human
ccucuuccggagauguagc

SEQ ID NO: 3615641 - RNA, 19 nt, Human
ccucuuccuacuggucucu

SEQ ID NO: 3615642 - RNA, 19 nt, Human
ccucuuccucccucauucc

SEQ ID NO: 3615643 - RNA, 22 nt, Human
ccucuuccucugaggcuggauc

SEQ ID NO: 3615644 - RNA, 21 nt, Human
ccucuuccugugauccaccca

SEQ ID NO: 3615645 - RNA, 15 nt, Human
ccucuuccuuuagga

SEQ ID NO: 3615646 - RNA, 15 nt, Human
ccucuucggcccuca

SEQ ID NO: 3615647 - RNA, 16 nt, Human
ccucuucucaagugcc

SEQ ID NO: 3615648 - RNA, 18 nt, Human
ccucuucucaagugccuu

SEQ ID NO: 3615649 - RNA, 15 nt, Human
ccucuucucucagac

SEQ ID NO: 3615650 - RNA, 18 nt, Human
ccucuucugacgugccuu

SEQ ID NO: 3615651 - RNA, 20 nt, Human
ccucuucugacgugccuuuu

SEQ ID NO: 3615652 - RNA, 18 nt, Human
ccucuucugggagggcag

SEQ ID NO: 3615653 - RNA, 15 nt, Human
ccucuucuucuucag

SEQ ID NO: 3615654 - RNA, 17 nt, Human
ccucuucuucuucagaa

SEQ ID NO: 3615655 - RNA, 21 nt, Human
ccucuucuuucagacuugcca

SEQ ID NO: 3615656 - RNA, 23 nt, Human
ccucuucuuucagacuugccaug

SEQ ID NO: 3615657 - RNA, 13 nt, Human
ccucuugaccagg

SEQ ID NO: 3615658 - RNA, 20 nt, Human
ccucuugaccaggcugccuc

SEQ ID NO: 3615659 - RNA, 15 nt, Human
ccucuugacccugca

SEQ ID NO: 3615660 - RNA, 16 nt, Human
ccucuugagcaguggc

SEQ ID NO: 3615661 - RNA, 24 nt, Human
ccucuugagcaguggcugguccag

SEQ ID NO: 3615662 - RNA, 14 nt, Human
ccucuugcauuuca

SEQ ID NO: 3615663 - RNA, 22 nt, Human
ccucuugccacugccucuuccu

SEQ ID NO: 3615664 - RNA, 23 nt, Human
ccucuugccccaacccccagcac

SEQ ID NO: 3615665 - RNA, 21 nt, Human
ccucuugccccccaccccagc

SEQ ID NO: 3615666 - RNA, 16 nt, Human
ccucuugccuccugga

SEQ ID NO: 3615667 - RNA, 17 nt, Human
ccucuugcggucccuuc

SEQ ID NO: 3615668 - RNA, 12 nt, Human
ccucuugcuguc

SEQ ID NO: 3615669 - RNA, 13 nt, Human
ccucuugcugucu

SEQ ID NO: 3615670 - RNA, 15 nt, Human
ccucuugcugucucu

SEQ ID NO: 3615671 - RNA, 18 nt, Human
ccucuugcugucucugcu

SEQ ID NO: 3615672 - RNA, 19 nt, Human
ccucuugcugucucugcuc

SEQ ID NO: 3615673 - RNA, 20 nt, Human
ccucuugcugucucugcucg

SEQ ID NO: 3615674 - RNA, 23 nt, Human
ccucuugcugucucugcucgccc

SEQ ID NO: 3615675 - RNA, 21 nt, Human
ccucuuggaccucugcucuga

SEQ ID NO: 3615676 - RNA, 19 nt, Human
ccucuuggagaagucucag

SEQ ID NO: 3615677 - RNA, 21 nt, Human
ccucuuggucuucccaggcug

SEQ ID NO: 3615678 - RNA, 17 nt, Human
ccucuuguaaagacugg

SEQ ID NO: 3615679 - RNA, 13 nt, Human
ccucuugucuccc

SEQ ID NO: 3615680 - RNA, 14 nt, Human
ccucuugucugauu

SEQ ID NO: 3615681 - RNA, 12 nt, Human
ccucuuguuuug

SEQ ID NO: 3615682 - RNA, 18 nt, Human
ccucuuuaaaacaaaaca

SEQ ID NO: 3615683 - RNA, 23 nt, Human
ccucuuucaagcagucgugccug

SEQ ID NO: 3615684 - RNA, 21 nt, Human
ccucuuucagaaaacagaaaa

SEQ ID NO: 3615685 - RNA, 18 nt, Human
ccucuuucagcuccugac

SEQ ID NO: 3615686 - RNA, 11 nt, Human
ccucuuucagu

SEQ ID NO: 3615687 - RNA, 21 nt, Human
ccucuuucucuuucuuccuuu

SEQ ID NO: 3615688 - RNA, 15 nt, Human
ccucuuucuuauaau

SEQ ID NO: 3615689 - RNA, 17 nt, Human
ccucuuucuucccauga

SEQ ID NO: 3615690 - RNA, 16 nt, Human
ccucuuugagugaagc

SEQ ID NO: 3615691 - RNA, 14 nt, Human
ccucuuugcugcag

SEQ ID NO: 3615692 - RNA, 13 nt, Human
ccucuuugcuuug

SEQ ID NO: 3615693 - RNA, 15 nt, Human
ccucuuugcuuugcu

SEQ ID NO: 3615694 - RNA, 20 nt, Human
ccucuuuggcuccccuguac

SEQ ID NO: 3615695 - RNA, 15 nt, Human
ccucuuuguuuuguu

SEQ ID NO: 3615696 - RNA, 19 nt, Human
ccucuuuguuuuguuuuaa

SEQ ID NO: 3615697 - RNA, 17 nt, Human
ccucuuuuccuucccaa

SEQ ID NO: 3615698 - RNA, 20 nt, Human
ccucuuuucuuacuccuccu

SEQ ID NO: 3615699 - RNA, 18 nt, Human
ccucuuuuguuguuucuu

SEQ ID NO: 3615700 - RNA, 18 nt, Human
ccugaaaacacugugcac

SEQ ID NO: 3615701 - RNA, 16 nt, Human
ccugaaaacccagaga

SEQ ID NO: 3615702 - RNA, 22 nt, Human
ccugaaaaguaacuuggcuuuc

SEQ ID NO: 3615703 - RNA, 23 nt, Human
ccugaaaauguuuuucugccagg

SEQ ID NO: 3615704 - RNA, 20 nt, Human
ccugaaaccuaguacugccc

SEQ ID NO: 3615705 - RNA, 17 nt, Human
ccugaaacgcuccuuug

SEQ ID NO: 3615706 - RNA, 21 nt, Human
ccugaaacgcuccuuugugug

SEQ ID NO: 3615707 - RNA, 22 nt, Human
ccugaaacuuauuuuuuucuga

SEQ ID NO: 3615708 - RNA, 14 nt, Human
ccugaaagcccuga

SEQ ID NO: 3615709 - RNA, 17 nt, Human
ccugaaauccugguucc

SEQ ID NO: 3615710 - RNA, 19 nt, Human
ccugaaaugugugugaugu

SEQ ID NO: 3615711 - RNA, 13 nt, Human
ccugaaauuccaa

SEQ ID NO: 3615712 - RNA, 14 nt, Human
ccugaaauuccaaa

SEQ ID NO: 3615713 - RNA, 14 nt, Human
ccugaaauuucaga

SEQ ID NO: 3615714 - RNA, 17 nt, Human
ccugaacaacgagccuu

SEQ ID NO: 3615715 - RNA, 15 nt, Human
ccugaacaagaauug

SEQ ID NO: 3615716 - RNA, 17 nt, Human
ccugaacaagaauugga

SEQ ID NO: 3615717 - RNA, 21 nt, Human
ccugaacaagaauuggaagcu

SEQ ID NO: 3615718 - RNA, 18 nt, Human
ccugaacacuuauugcuu

SEQ ID NO: 3615719 - RNA, 16 nt, Human
ccugaaccccagggcu

SEQ ID NO: 3615720 - RNA, 21 nt, Human
ccugaaccgcacagcucagga

SEQ ID NO: 3615721 - RNA, 13 nt, Human
ccugaagaaccag

SEQ ID NO: 3615722 - RNA, 21 nt, Human
ccugaagacucauucuucugu

SEQ ID NO: 3615723 - RNA, 19 nt, Human
ccugaagagaagggcaggg

SEQ ID NO: 3615724 - RNA, 17 nt, Human
ccugaagaggcgggcca

SEQ ID NO: 3615725 - RNA, 19 nt, Human
ccugaagaggcgggccagc

SEQ ID NO: 3615726 - RNA, 16 nt, Human
ccugaagccagccuuc

SEQ ID NO: 3615727 - RNA, 18 nt, Human
ccugaagccagccuucuu

SEQ ID NO: 3615728 - RNA, 14 nt, Human
ccugaagccagcug

SEQ ID NO: 3615729 - RNA, 21 nt, Human
ccugaagccaggccauggcua

SEQ ID NO: 3615730 - RNA, 19 nt, Human
cuggggacgcuccgcugcc

SEQ ID NO: 3615731 - RNA, 21 nt, Human
cuggggacgcuccgcugccgu

SEQ ID NO: 3615732 - RNA, 19 nt, Human
cuggggacggggggcccca

SEQ ID NO: 3615733 - RNA, 22 nt, Human
cuggggacggggggccccaguc

SEQ ID NO: 3615734 - RNA, 14 nt, Human
cuggggacuuggcc

SEQ ID NO: 3615735 - RNA, 15 nt, Human
cuggggacuuggccu

SEQ ID NO: 3615736 - RNA, 23 nt, Human
cuggggagaauggggcugggccc

SEQ ID NO: 3615737 - RNA, 22 nt, Human
cuguaagaagagacugggaaga

SEQ ID NO: 3615738 - RNA, 21 nt, Human
cuguaagaauaauuuauagua

SEQ ID NO: 3615739 - RNA, 16 nt, Human
cuguaagacauuagua

SEQ ID NO: 3615740 - RNA, 16 nt, Human
cuguaagacugauaau

SEQ ID NO: 3615741 - RNA, 16 nt, Human
cuguaagaugucuguu

SEQ ID NO: 3615742 - RNA, 13 nt, Human
cuguaagccugca

SEQ ID NO: 3615743 - RNA, 18 nt, Human
cuguaagccugcaagccu

SEQ ID NO: 3615744 - RNA, 13 nt, Human
cuguaagcuccuu

SEQ ID NO: 3615745 - RNA, 20 nt, Human
cuguaagcucuuugaaacaa

SEQ ID NO: 3615746 - RNA, 17 nt, Human
cuguaaggcucuagauc

SEQ ID NO: 3615747 - RNA, 22 nt, Human
cuguaaggcucuagaucauaag

SEQ ID NO: 3615748 - RNA, 21 nt, Human
cuguaaguugggcuugcuauu

SEQ ID NO: 3615749 - RNA, 24 nt, Human
cuguaaguugggcuugcuauucug

SEQ ID NO: 3615750 - RNA, 20 nt, Human
cuguaauaaagaugauugug

SEQ ID NO: 3615751 - RNA, 14 nt, Human
cuguaauaaauaug

SEQ ID NO: 3615752 - RNA, 16 nt, Human
cuguaauaaauaugag

SEQ ID NO: 3615753 - RNA, 14 nt, Human
cuguaauaauaccu

SEQ ID NO: 3615754 - RNA, 17 nt, Human
cuguaauaauaccucaa

SEQ ID NO: 3615755 - RNA, 12 nt, Human
cuguaauaauag

SEQ ID NO: 3615756 - RNA, 13 nt, Human
cuguaauauuuac

SEQ ID NO: 3615757 - RNA, 18 nt, Human
cuguaauauuuacaaugu

SEQ ID NO: 3615758 - RNA, 23 nt, Human
cuguaaucacagcuacuugggag

SEQ ID NO: 3615759 - RNA, 18 nt, Human
cuguaaucauuuguuuac

SEQ ID NO: 3615760 - RNA, 13 nt, Human
cuguaaucccagc

SEQ ID NO: 3615761 - RNA, 15 nt, Human
cuguaaucccagcac

SEQ ID NO: 3615762 - RNA, 17 nt, Human
cuguaaucccagcacuu

SEQ ID NO: 3615763 - RNA, 20 nt, Human
cuguaaucccagcaugcuga

SEQ ID NO: 3615764 - RNA, 14 nt, Human
cuguaaucccagcu

SEQ ID NO: 3615765 - RNA, 19 nt, Human
cuguaaucccagcuacucg

SEQ ID NO: 3615766 - RNA, 20 nt, Human
cuguaaucgcccuacuauuc

SEQ ID NO: 3615767 - RNA, 21 nt, Human
cuguaaugaaacaccuucucu

SEQ ID NO: 3615768 - RNA, 14 nt, Human
cuguaauguuaaua

SEQ ID NO: 3615769 - RNA, 16 nt, Human
cuguaauguuaauaau

SEQ ID NO: 3615770 - RNA, 15 nt, Human
cuguaauguuaauau

SEQ ID NO: 3615771 - RNA, 18 nt, Human
cuguaauuauaucuaaaa

SEQ ID NO: 3615772 - RNA, 13 nt, Human
cuguaauuuaguu

SEQ ID NO: 3615773 - RNA, 13 nt, Human
cuguaauuuuaua

SEQ ID NO: 3615774 - RNA, 20 nt, Human
cuguaauuuuuuucuuauau

SEQ ID NO: 3615775 - RNA, 15 nt, Human
cuguacaaaagcaau

SEQ ID NO: 3615776 - RNA, 12 nt, Human
cuguacaaaggg

SEQ ID NO: 3615777 - RNA, 16 nt, Human
cuguacaauauuuaaa

SEQ ID NO: 3615778 - RNA, 18 nt, Human
cuguacaauauuuaaaau

SEQ ID NO: 3615779 - RNA, 21 nt, Human
cuguacaauauuuaaaauuua

SEQ ID NO: 3615780 - RNA, 22 nt, Human
cuguacacaacucacuccuuuu

SEQ ID NO: 3615781 - RNA, 16 nt, Human
cuguacacacuuuauu

SEQ ID NO: 3615782 - RNA, 20 nt, Human
cuguacacacuuuauuuacu

SEQ ID NO: 3615783 - RNA, 13 nt, Human
cuguacagagccc

SEQ ID NO: 3615784 - RNA, 14 nt, Human
cuguacagagccca

SEQ ID NO: 3615785 - RNA, 15 nt, Human
cuguacagagcccac

SEQ ID NO: 3615786 - RNA, 22 nt, Human
cuguacagagcccacgccccca

SEQ ID NO: 3615787 - RNA, 20 nt, Human
cuguacagauugcugcuucu

SEQ ID NO: 3615788 - RNA, 16 nt, Human
cuguacagcuggcucu

SEQ ID NO: 3615789 - RNA, 22 nt, Human
cuguacagucugucuucuguau

SEQ ID NO: 3615790 - RNA, 15 nt, Human
cuguacagugucuuu

SEQ ID NO: 3615791 - RNA, 15 nt, Human
cuguacaguguuacc

SEQ ID NO: 3615792 - RNA, 17 nt, Human
cuguacauaaacaauga

SEQ ID NO: 3615793 - RNA, 15 nt, Human
cuguacauacuuuuu

SEQ ID NO: 3615794 - RNA, 17 nt, Human
cuguacauagccuauau

SEQ ID NO: 3615795 - RNA, 22 nt, Human
cuguacaugaaaacacauuuuu

SEQ ID NO: 3615796 - RNA, 23 nt, Human
cuguacaugaaaacacauuuuuc

SEQ ID NO: 3615797 - RNA, 15 nt, Human
cuguacaugggacua

SEQ ID NO: 3615798 - RNA, 15 nt, Human
cuguacauuguggga

SEQ ID NO: 3615799 - RNA, 19 nt, Human
cuguacauuuaaaauugcu

SEQ ID NO: 3615800 - RNA, 16 nt, Human
cuguacauuuuguugu

SEQ ID NO: 3615801 - RNA, 23 nt, Human
cuguacauuuuguuguaaaaaga

SEQ ID NO: 3615802 - RNA, 19 nt, Human
cuguaccagcccagauguu

SEQ ID NO: 3615803 - RNA, 12 nt, Human
cuguaccaguua

SEQ ID NO: 3615804 - RNA, 18 nt, Human
cuguaccaguuaauuuuu

SEQ ID NO: 3615805 - RNA, 23 nt, Human
cuguaccauauagcaaaacuuuu

SEQ ID NO: 3615806 - RNA, 13 nt, Human
cuguacccaguuu

SEQ ID NO: 3615807 - RNA, 21 nt, Human
cuguaccucuugagccuugaa

SEQ ID NO: 3615808 - RNA, 21 nt, Human
cuguaccuguuccuuagaccu

SEQ ID NO: 3615809 - RNA, 17 nt, Human
cuguacgucugacaggc

SEQ ID NO: 3615810 - RNA, 22 nt, Human
cuguacuaaaguaacgcaauaa

SEQ ID NO: 3615811 - RNA, 20 nt, Human
cuguacucaggaggcugagg

SEQ ID NO: 3615812 - RNA, 14 nt, Human
cuguacuccuccca

SEQ ID NO: 3615813 - RNA, 16 nt, Human
cuguacuccucccagg

SEQ ID NO: 3615814 - RNA, 16 nt, Human
ccuggagguuccccag

SEQ ID NO: 3615815 - RNA, 14 nt, Human
ccuggagugcaguu

SEQ ID NO: 3615816 - RNA, 19 nt, Human
ccuggaguguggcugagga

SEQ ID NO: 3615817 - RNA, 20 nt, Human
ccuggaguguggcugaggag

SEQ ID NO: 3615818 - RNA, 16 nt, Human
ccuggaguugcauuga

SEQ ID NO: 3615819 - RNA, 16 nt, Human
ccuggauagacgaguu

SEQ ID NO: 3615820 - RNA, 22 nt, Human
ccuggauauuauucuuguaguu

SEQ ID NO: 3615821 - RNA, 17 nt, Human
ccuggaucagaacagga

SEQ ID NO: 3615822 - RNA, 18 nt, Human
ccuggaucagcguggccu

SEQ ID NO: 3615823 - RNA, 19 nt, Human
ccuggaucagcguggccuu

SEQ ID NO: 3615824 - RNA, 18 nt, Human
ccuggaucuaccuggagg

SEQ ID NO: 3615825 - RNA, 22 nt, Human
ccuggaugaaguuaucuggcuu

SEQ ID NO: 3615826 - RNA, 16 nt, Human
ccuggaugacauuaaa

SEQ ID NO: 3615827 - RNA, 14 nt, Human
ccuggaugauacua

SEQ ID NO: 3615828 - RNA, 13 nt, Human
ccuggaugcagcc

SEQ ID NO: 3615829 - RNA, 17 nt, Human
ccuggaugcagccucac

SEQ ID NO: 3615830 - RNA, 13 nt, Human
ccuggaugccauc

SEQ ID NO: 3615831 - RNA, 18 nt, Human
ccuggaugccauccaagu

SEQ ID NO: 3615832 - RNA, 15 nt, Human
ccuggauggggcugc

SEQ ID NO: 3615833 - RNA, 17 nt, Human
ccuggauggggcugcac

SEQ ID NO: 3615834 - RNA, 18 nt, Human
ccuggauggggcugcacc

SEQ ID NO: 3615835 - RNA, 17 nt, Human
ccuggaugucugaacuu

SEQ ID NO: 3615836 - RNA, 20 nt, Human
ccuggauucauuuccugccc

SEQ ID NO: 3615837 - RNA, 21 nt, Human
ccuggauucauuuccugcccu

SEQ ID NO: 3615838 - RNA, 23 nt, Human
ccuggauucauuuccugcccuuc

SEQ ID NO: 3615839 - RNA, 21 nt, Human
ccuggauuucugguucugaug

SEQ ID NO: 3615840 - RNA, 16 nt, Human
ccuggauuuuuaccag

SEQ ID NO: 3615841 - RNA, 19 nt, Human
ccuggcaaagggagcagaa

SEQ ID NO: 3615842 - RNA, 21 nt, Human
ccuggcaagcuagaaccugga

SEQ ID NO: 3615843 - RNA, 12 nt, Human
ccuggcaauagu

SEQ ID NO: 3615844 - RNA, 19 nt, Human
ccuggcaauaguguguucu

SEQ ID NO: 3615845 - RNA, 21 nt, Human
ccuggcaauaguguguucuga

SEQ ID NO: 3615846 - RNA, 14 nt, Human
ccuggcacaggacu

SEQ ID NO: 3615847 - RNA, 18 nt, Human
ccuggcacaggacugauu

SEQ ID NO: 3615848 - RNA, 20 nt, Human
ccuggcacagugucugggcu

SEQ ID NO: 3615849 - RNA, 17 nt, Human
ccuggcacugcuuccag

SEQ ID NO: 3615850 - RNA, 13 nt, Human
ccuggcacuggca

SEQ ID NO: 3615851 - RNA, 22 nt, Human
ccuggcacuggcaaacagggcc

SEQ ID NO: 3615852 - RNA, 13 nt, Human
ccuggcagaacug

SEQ ID NO: 3615853 - RNA, 17 nt, Human
ccuggcagaacugagcu

SEQ ID NO: 3615854 - RNA, 18 nt, Human
ccuggcagaacugagcuc

SEQ ID NO: 3615855 - RNA, 20 nt, Human
ccuggcagaacugagcuccu

SEQ ID NO: 3615856 - RNA, 13 nt, Human
ccuggcagcccag

SEQ ID NO: 3615857 - RNA, 17 nt, Human
ccuggcagcccagagac

SEQ ID NO: 3615858 - RNA, 16 nt, Human
ccuggcagccccuguu

SEQ ID NO: 3615859 - RNA, 22 nt, Human
ccuggcagcccgcaucagcugc

SEQ ID NO: 3615860 - RNA, 12 nt, Human
ccuggcagcucu

SEQ ID NO: 3615861 - RNA, 13 nt, Human
ccuggcagcucug

SEQ ID NO: 3615862 - RNA, 15 nt, Human
ccuggcaggcagggg

SEQ ID NO: 3615863 - RNA, 23 nt, Human
ccuggcagggaggucaggcccug

SEQ ID NO: 3615864 - RNA, 22 nt, Human
ccuggcagggucauccugugcu

SEQ ID NO: 3615865 - RNA, 19 nt, Human
ccuggcagguuagaaccua

SEQ ID NO: 3615866 - RNA, 21 nt, Human
ccuggcaucgcaccauucuga

SEQ ID NO: 3615867 - RNA, 17 nt, Human
ccuggcauggcaccugu

SEQ ID NO: 3615868 - RNA, 18 nt, Human
ccuggcauggcaccuguc

SEQ ID NO: 3615869 - RNA, 13 nt, Human
ccuggcaugggaa

SEQ ID NO: 3615870 - RNA, 19 nt, Human
ccuggcauuauguccacug

SEQ ID NO: 3615871 - RNA, 18 nt, Human
ccuggcauucuuguacag

SEQ ID NO: 3615872 - RNA, 14 nt, Human
ccuggccaacaugg

SEQ ID NO: 3615873 - RNA, 15 nt, Human
ccuggccaccacccc

SEQ ID NO: 3615874 - RNA, 21 nt, Human
ccuggccaccaccccccacuc

SEQ ID NO: 3615875 - RNA, 12 nt, Human
ccuggccaccug

SEQ ID NO: 3615876 - RNA, 16 nt, Human
ccuggccaccugaggu

SEQ ID NO: 3615877 - RNA, 18 nt, Human
ccuggccaccugaggugg

SEQ ID NO: 3615878 - RNA, 19 nt, Human
ccuggccacgcagccagga

SEQ ID NO: 3615879 - RNA, 19 nt, Human
ccuggccagacacaggccc

SEQ ID NO: 3615880 - RNA, 23 nt, Human
ccuggccagacacaggcccuccc

SEQ ID NO: 3615881 - RNA, 15 nt, Human
ccugggaucugcucg

SEQ ID NO: 3615882 - RNA, 23 nt, Human
ccugggaucugguggucagcccu

SEQ ID NO: 3615883 - RNA, 20 nt, Human
ccugggauguccacagaugc

SEQ ID NO: 3615884 - RNA, 13 nt, Human
ccugggauuacag

SEQ ID NO: 3615885 - RNA, 23 nt, Human
ccugggcaaaugaauggcucacu

SEQ ID NO: 3615886 - RNA, 17 nt, Human
ccugggcaacagagcaa

SEQ ID NO: 3615887 - RNA, 17 nt, Human
ccugggcacacgcugcu

SEQ ID NO: 3615888 - RNA, 23 nt, Human
ccugggcacacgcugcucugccc

SEQ ID NO: 3615889 - RNA, 15 nt, Human
ccugggcaccugggg

SEQ ID NO: 3615890 - RNA, 20 nt, Human
ccugggcacgcacuggguug

SEQ ID NO: 3615891 - RNA, 18 nt, Human
ccugggcagccaggcugc

SEQ ID NO: 3615892 - RNA, 19 nt, Human
ccugggcagccaggcugcc

SEQ ID NO: 3615893 - RNA, 16 nt, Human
ccugggcauccuucuu

SEQ ID NO: 3615894 - RNA, 15 nt, Human
ccugggcauugcuuu

SEQ ID NO: 3615895 - RNA, 15 nt, Human
ccugggccagggucu

SEQ ID NO: 3615896 - RNA, 16 nt, Human
ccugggccagggucug

SEQ ID NO: 3615897 - RNA, 14 nt, Human
ccugggccccagcu

SEQ ID NO: 3615898 - RNA, 20 nt, Human
ccugggccccaguuguauuu

SEQ ID NO: 3615899 - RNA, 13 nt, Human
ccugggccccucc

SEQ ID NO: 3615900 - RNA, 18 nt, Human
ccugggcccucucugcuc

SEQ ID NO: 3615901 - RNA, 19 nt, Human
ccugggcccugggcuggaa

SEQ ID NO: 3615902 - RNA, 18 nt, Human
ccugggcccuggggccug

SEQ ID NO: 3615903 - RNA, 22 nt, Human
ccugggccguaucuccggcucc

SEQ ID NO: 3615904 - RNA, 17 nt, Human
ccugggccuauggagag

SEQ ID NO: 3615905 - RNA, 20 nt, Human
ccugggccuauggagagccc

SEQ ID NO: 3615906 - RNA, 15 nt, Human
ccugggccugccuca

SEQ ID NO: 3615907 - RNA, 13 nt, Human
ccugggccugcug

SEQ ID NO: 3615908 - RNA, 18 nt, Human
ccugggccugcugcugag

SEQ ID NO: 3615909 - RNA, 19 nt, Human
ccugggccugcugcugaga

SEQ ID NO: 3615910 - RNA, 15 nt, Human
ccugggccuggcucc

SEQ ID NO: 3615911 - RNA, 16 nt, Human
ccugggccuggcuccc

SEQ ID NO: 3615912 - RNA, 12 nt, Human
ccugggcgcccu

SEQ ID NO: 3615913 - RNA, 15 nt, Human
ccugggcgcccugga

SEQ ID NO: 3615914 - RNA, 16 nt, Human
ccugggcgcccuggaa

SEQ ID NO: 3615915 - RNA, 23 nt, Human
ccugggcucaagcaauccuccug

SEQ ID NO: 3615916 - RNA, 16 nt, Human
ccugggcuccuggacc

SEQ ID NO: 3615917 - RNA, 16 nt, Human
ccugggcucggaggcu

SEQ ID NO: 3615918 - RNA, 18 nt, Human
ccugggcucggaggcugc

SEQ ID NO: 3615919 - RNA, 13 nt, Human
ccugggcucuggg

SEQ ID NO: 3615920 - RNA, 14 nt, Human
ccugggcucugugg

SEQ ID NO: 3615921 - RNA, 14 nt, Human
ccugggcuggaauc

SEQ ID NO: 3615922 - RNA, 18 nt, Human
ccugggcuguuggcacuc

SEQ ID NO: 3615923 - RNA, 13 nt, Human
ccugggcuuggcc

SEQ ID NO: 3615924 - RNA, 15 nt, Human
ccugggcuuggccug

SEQ ID NO: 3615925 - RNA, 17 nt, Human
ccugggcuuggccugcu

SEQ ID NO: 3615926 - RNA, 21 nt, Human
ccugggcuuggccugcuguga

SEQ ID NO: 3615927 - RNA, 12 nt, Human
ccuggggaccca

SEQ ID NO: 3615928 - RNA, 13 nt, Human
ccuggggacccac

SEQ ID NO: 3615929 - RNA, 18 nt, Human
ccuggggagugggacaga

SEQ ID NO: 3615930 - RNA, 13 nt, Human
ccuggggcacagu

SEQ ID NO: 3615931 - RNA, 12 nt, Human
ccuggggcaucc

SEQ ID NO: 3615932 - RNA, 16 nt, Human
ccuggggccaggccgg

SEQ ID NO: 3615933 - RNA, 16 nt, Human
ccuggggcccaaaugc

SEQ ID NO: 3615934 - RNA, 14 nt, Human
ccuggggccugaga

SEQ ID NO: 3615935 - RNA, 17 nt, Human
ccuggggccugagagaa

SEQ ID NO: 3615936 - RNA, 16 nt, Human
ccuggggccuggcagg

SEQ ID NO: 3615937 - RNA, 16 nt, Human
ccuggggccuguacug

SEQ ID NO: 3615938 - RNA, 19 nt, Human
ccuggggcgcgugaggccc

SEQ ID NO: 3615939 - RNA, 19 nt, Human
ccuggggcgggccccucau

SEQ ID NO: 3615940 - RNA, 14 nt, Human
ccuggggcucccuu

SEQ ID NO: 3615941 - RNA, 15 nt, Human
ccuggggcuccuuuc

SEQ ID NO: 3615942 - RNA, 20 nt, Human
ccuggggcucuaacgccuga

SEQ ID NO: 3615943 - RNA, 22 nt, Human
ccuggggcucuaacgccugagc

SEQ ID NO: 3615944 - RNA, 18 nt, Human
ccuggggcucugugcagg

SEQ ID NO: 3615945 - RNA, 12 nt, Human
ccuggggcuggg

SEQ ID NO: 3615946 - RNA, 17 nt, Human
ccuggggcugggccccc

SEQ ID NO: 3615947 - RNA, 18 nt, Human
ccuggggcuucuccugac

SEQ ID NO: 3615948 - RNA, 18 nt, Human
ccugggggaagcccugga

SEQ ID NO: 3615949 - RNA, 15 nt, Human
ccugggggcacagga

SEQ ID NO: 3615950 - RNA, 19 nt, Human
ccugggggcagggagagga

SEQ ID NO: 3615951 - RNA, 15 nt, Human
ccugggggccugacc

SEQ ID NO: 3615952 - RNA, 19 nt, Human
ccugggggccugaccuccc

SEQ ID NO: 3615953 - RNA, 19 nt, Human
ccugggggccuggcuggcu

SEQ ID NO: 3615954 - RNA, 12 nt, Human
ccugggggcucu

SEQ ID NO: 3615955 - RNA, 13 nt, Human
ccugggggcucuc

SEQ ID NO: 3615956 - RNA, 15 nt, Human
ccugggggcuggagc

SEQ ID NO: 3615957 - RNA, 20 nt, Human
ccugggggcugggcagagga

SEQ ID NO: 3615958 - RNA, 15 nt, Human
ccugggggugccagg

SEQ ID NO: 3615959 - RNA, 18 nt, Human
ccuggggguucuuucuuc

SEQ ID NO: 3615960 - RNA, 18 nt, Human
ccuggggucucugcugca

SEQ ID NO: 3615961 - RNA, 18 nt, Human
ccuggggugacccggcac

SEQ ID NO: 3615962 - RNA, 22 nt, Human
ccuggggugcccuccacugccc

SEQ ID NO: 3615963 - RNA, 13 nt, Human
ccugggguuguca

SEQ ID NO: 3615964 - RNA, 20 nt, Human
ccuggguaaaugcagcguga

SEQ ID NO: 3615965 - RNA, 18 nt, Human
ccuggguacugaaagccu

SEQ ID NO: 3615966 - RNA, 19 nt, Human
ccugggucagucugguggg

SEQ ID NO: 3615967 - RNA, 20 nt, Human
ccuggguccaaauaaaaacu

SEQ ID NO: 3615968 - RNA, 14 nt, Human
ccugggugacauuu

SEQ ID NO: 3615969 - RNA, 14 nt, Human
ccuggguggcuacu

SEQ ID NO: 3615970 - RNA, 15 nt, Human
ccuggguggcuacuc

SEQ ID NO: 3615971 - RNA, 20 nt, Human
ccuggguggcuacucugugc

SEQ ID NO: 3615972 - RNA, 16 nt, Human
ccugggugggcucugu

SEQ ID NO: 3615973 - RNA, 22 nt, Human
ccuggguggggcugcuccucca

SEQ ID NO: 3615974 - RNA, 21 nt, Human
ccuggguggucugcaggcagg

SEQ ID NO: 3615975 - RNA, 14 nt, Human
ccuggguguccccg

SEQ ID NO: 3615976 - RNA, 20 nt, Human
ccuggguguccccgcugcug

SEQ ID NO: 3615977 - RNA, 21 nt, Human
ccuggguguccccgcugcugu

SEQ ID NO: 3615978 - RNA, 17 nt, Human
ccuggguuagacugcca

SEQ ID NO: 3615979 - RNA, 19 nt, Human
ccuggguuagacugccagc

SEQ ID NO: 3615980 - RNA, 23 nt, Human
cugucaggauugcgagagaugug

SEQ ID NO: 3615981 - RNA, 24 nt, Human
cugucaggauugcgagagaugugu

SEQ ID NO: 3615982 - RNA, 16 nt, Human
cugucaggcugaaaac

SEQ ID NO: 3615983 - RNA, 20 nt, Human
cugucagggcaguacaaugu

SEQ ID NO: 3615984 - RNA, 13 nt, Human
cugucagucacag

SEQ ID NO: 3615985 - RNA, 17 nt, Human
cugucagucacagccac

SEQ ID NO: 3615986 - RNA, 15 nt, Human
cugucagugcagccc

SEQ ID NO: 3615987 - RNA, 19 nt, Human
cugucagugcagcccgugu

SEQ ID NO: 3615988 - RNA, 18 nt, Human
cugucagugccgccgccu

SEQ ID NO: 3615989 - RNA, 14 nt, Human
cugucauagaaagu

SEQ ID NO: 3615990 - RNA, 16 nt, Human
cugucauagaaauuac

SEQ ID NO: 3615991 - RNA, 16 nt, Human
cugucauaucuucaca

SEQ ID NO: 3615992 - RNA, 18 nt, Human
cugucauaucuucacaau

SEQ ID NO: 3615993 - RNA, 16 nt, Human
cugucaucaauuaaag

SEQ ID NO: 3615994 - RNA, 20 nt, Human
cugucaucaucauggccagc

SEQ ID NO: 3615995 - RNA, 23 nt, Human
cugucauccucaaagaaagugua

SEQ ID NO: 3615996 - RNA, 15 nt, Human
cugucaucugagaau

SEQ ID NO: 3615997 - RNA, 21 nt, Human
cugucaucugugcacugccca

SEQ ID NO: 3615998 - RNA, 21 nt, Human
cugucaugaaaucagcaagag

SEQ ID NO: 3615999 - RNA, 16 nt, Human
cugucauugcuucuuc

SEQ ID NO: 3616000 - RNA, 18 nt, Human
cugucauugcuucuucug

SEQ ID NO: 3616001 - RNA, 16 nt, Human
cugucauuugagcagg

SEQ ID NO: 3616002 - RNA, 18 nt, Human
cugucauuuguugugaug

SEQ ID NO: 3616003 - RNA, 15 nt, Human
cuguccaaacugccu

SEQ ID NO: 3616004 - RNA, 19 nt, Human
cuguccaaaggaggcuggc

SEQ ID NO: 3616005 - RNA, 16 nt, Human
cuguccaaccuaaccc

SEQ ID NO: 3616006 - RNA, 14 nt, Human
cuguccacgcgugc

SEQ ID NO: 3616007 - RNA, 19 nt, Human
cuguccacgcgugccgugg

SEQ ID NO: 3616008 - RNA, 12 nt, Human
cuguccagaaag

SEQ ID NO: 3616009 - RNA, 21 nt, Human
cuguccagacagccuguaucu

SEQ ID NO: 3616010 - RNA, 18 nt, Human
cuguccagagagagaagu

SEQ ID NO: 3616011 - RNA, 19 nt, Human
cuguccagcagucacuucg

SEQ ID NO: 3616012 - RNA, 17 nt, Human
cuguccagccugggcag

SEQ ID NO: 3616013 - RNA, 12 nt, Human
cuguccagcucc

SEQ ID NO: 3616014 - RNA, 13 nt, Human
cuguccagcucca

SEQ ID NO: 3616015 - RNA, 21 nt, Human
cuguccagcuccaaccugcaa

SEQ ID NO: 3616016 - RNA, 16 nt, Human
cuguccaggcacugag

SEQ ID NO: 3616017 - RNA, 19 nt, Human
cuguccaggcacugagaua

SEQ ID NO: 3616018 - RNA, 19 nt, Human
cuguccaggcacugcugcc

SEQ ID NO: 3616019 - RNA, 21 nt, Human
cuguccaggcacugcugccca

SEQ ID NO: 3616020 - RNA, 13 nt, Human
cuguccagugccc

SEQ ID NO: 3616021 - RNA, 14 nt, Human
cuguccagugccca

SEQ ID NO: 3616022 - RNA, 18 nt, Human
cuguccagugcccauucc

SEQ ID NO: 3616023 - RNA, 14 nt, Human
cuguccagugggua

SEQ ID NO: 3616024 - RNA, 15 nt, Human
cuguccaguucccag

SEQ ID NO: 3616025 - RNA, 16 nt, Human
cuguccaucagccagg

SEQ ID NO: 3616026 - RNA, 22 nt, Human
cuguugcacguguguuuuucua

SEQ ID NO: 3616027 - RNA, 23 nt, Human
cuguugcacguguguuuuucuau

SEQ ID NO: 3616028 - RNA, 13 nt, Human
cuguugccagaga

SEQ ID NO: 3616029 - RNA, 17 nt, Human
cuguugccagagaugga

SEQ ID NO: 3616030 - RNA, 12 nt, Human
cuguugcccagg

SEQ ID NO: 3616031 - RNA, 18 nt, Human
cuguugcccaggcuggcg

SEQ ID NO: 3616032 - RNA, 12 nt, Human
cuguugcuaagc

SEQ ID NO: 3616033 - RNA, 21 nt, Human
cuguugcuaagccccagcaag

SEQ ID NO: 3616034 - RNA, 21 nt, Human
cuguugcucaaaucuauucag

SEQ ID NO: 3616035 - RNA, 22 nt, Human
cuguugcucaaaucuauucaga

SEQ ID NO: 3616036 - RNA, 14 nt, Human
cuguugcugauuuu

SEQ ID NO: 3616037 - RNA, 16 nt, Human
cuguugcugauuuuau

SEQ ID NO: 3616038 - RNA, 21 nt, Human
cuguugcugauuuuauucuug

SEQ ID NO: 3616039 - RNA, 15 nt, Human
cuguugcugccucau

SEQ ID NO: 3616040 - RNA, 20 nt, Human
cuguugcuguguuuaauuug

SEQ ID NO: 3616041 - RNA, 23 nt, Human
cuguuggaauggauuuuucuuua

SEQ ID NO: 3616042 - RNA, 15 nt, Human
cuuacccaauuuccc

SEQ ID NO: 3616043 - RNA, 23 nt, Human
cuuacccaucugcaccccccugg

SEQ ID NO: 3616044 - RNA, 17 nt, Human
cuuacccucaccuguca

SEQ ID NO: 3616045 - RNA, 19 nt, Human
cuuacccucauguucuuaa

SEQ ID NO: 3616046 - RNA, 21 nt, Human
cuuacccuuagaauccacgua

SEQ ID NO: 3616047 - RNA, 21 nt, Human
cuuacccuucugugcccagcu

SEQ ID NO: 3616048 - RNA, 22 nt, Human
cuuacccuuuccuccuuuauca

SEQ ID NO: 3616049 - RNA, 19 nt, Human
cuuaccuaagugacauuug

SEQ ID NO: 3616050 - RNA, 16 nt, Human
cuuaccuacuuucuuc

SEQ ID NO: 3616051 - RNA, 16 nt, Human
cuuaccuagugaaacu

SEQ ID NO: 3616052 - RNA, 22 nt, Human
cuuaccuagugaaacuuuucua

SEQ ID NO: 3616053 - RNA, 14 nt, Human
cuuaccucccaccu

SEQ ID NO: 3616054 - RNA, 18 nt, Human
cuuaccucccaccuuugg

SEQ ID NO: 3616055 - RNA, 15 nt, Human
cuuaccuccugccca

SEQ ID NO: 3616056 - RNA, 13 nt, Human
cuuaccucggugc

SEQ ID NO: 3616057 - RNA, 19 nt, Human
cuuaccucggugccuuccu

SEQ ID NO: 3616058 - RNA, 13 nt, Human
cuuaccucuuccg

SEQ ID NO: 3616059 - RNA, 12 nt, Human
cuuaccugacac

SEQ ID NO: 3616060 - RNA, 16 nt, Human
cuuaccugacacaaga

SEQ ID NO: 3616061 - RNA, 18 nt, Human
cuuaccugaccucuugcu

SEQ ID NO: 3616062 - RNA, 21 nt, Human
cuuaccugaccucuugcuguc

SEQ ID NO: 3616063 - RNA, 20 nt, Human
cuuaccugccaggaagccag

SEQ ID NO: 3616064 - RNA, 20 nt, Human
cuuaccuguaugucuccagu

SEQ ID NO: 3616065 - RNA, 17 nt, Human
cuuaccuucaauaaagu

SEQ ID NO: 3616066 - RNA, 18 nt, Human
cuuaccuucaauaaagua

SEQ ID NO: 3616067 - RNA, 22 nt, Human
cuuaccuucaauaaaguaucua

SEQ ID NO: 3616068 - RNA, 18 nt, Human
cuuaccuugguuggaagg

SEQ ID NO: 3616069 - RNA, 20 nt, Human
cuuaccuuuuuauuugcaug

SEQ ID NO: 3616070 - RNA, 23 nt, Human
cuuacgaauacuuuugcccuuug

SEQ ID NO: 3616071 - RNA, 16 nt, Human
cuuacgaauauuuuca

SEQ ID NO: 3616072 - RNA, 16 nt, Human
cuuacgaucaggcaca

SEQ ID NO: 3616073 - RNA, 19 nt, Human
cuuacgcccaacccuuccc

SEQ ID NO: 3616074 - RNA, 18 nt, Human
cuuacggccaucucuuug

SEQ ID NO: 3616075 - RNA, 15 nt, Human
cuuacuaaaaaguau

SEQ ID NO: 3616076 - RNA, 21 nt, Human
cuuacuaaaaaguauaaaaua

SEQ ID NO: 3616077 - RNA, 15 nt, Human
cuuacuaaaauauau

SEQ ID NO: 3616078 - RNA, 22 nt, Human
cuuacuaaacauuuuguuauug

SEQ ID NO: 3616079 - RNA, 16 nt, Human
cuuacuacacugagga

SEQ ID NO: 3616080 - RNA, 11 nt, Human
cuuacuauuuc

SEQ ID NO: 3616081 - RNA, 13 nt, Human
cuuacuauuucug

SEQ ID NO: 3616082 - RNA, 22 nt, Human
cuuacuauuucugggucuuuug

SEQ ID NO: 3616083 - RNA, 12 nt, Human
cuuacuauuuug

SEQ ID NO: 3616084 - RNA, 15 nt, Human
cuuacucccaggcac

SEQ ID NO: 3616085 - RNA, 12 nt, Human
cuuacuccuccu

SEQ ID NO: 3616086 - RNA, 13 nt, Human
cuuacuccuccuc

SEQ ID NO: 3616087 - RNA, 14 nt, Human
cuuacuccuccucu

SEQ ID NO: 3616088 - RNA, 18 nt, Human
cuuacuccuccucuuucu

SEQ ID NO: 3616089 - RNA, 23 nt, Human
cuuacuccuccucuuucucuccc

SEQ ID NO: 3616090 - RNA, 13 nt, Human
cuuacuccugugg

SEQ ID NO: 3616091 - RNA, 14 nt, Human
cuuacuccuguggg

SEQ ID NO: 3616092 - RNA, 15 nt, Human
cuuacuccuguggga

SEQ ID NO: 3616093 - RNA, 16 nt, Human
cuuacuccugugggag

SEQ ID NO: 3616094 - RNA, 13 nt, Human
cuuacucuaagau

SEQ ID NO: 3616095 - RNA, 15 nt, Human
cuuacucuucuugaa

SEQ ID NO: 3616096 - RNA, 19 nt, Human
cuuacucuucuugaaauuu

SEQ ID NO: 3616097 - RNA, 12 nt, Human
cuuacucuuucc

SEQ ID NO: 3616098 - RNA, 15 nt, Human
cuuacucuuuccuau

SEQ ID NO: 3616099 - RNA, 12 nt, Human
cuuacugauaua

SEQ ID NO: 3616100 - RNA, 22 nt, Human
cuuacugcgacuaaacuuaauu

SEQ ID NO: 3616101 - RNA, 11 nt, Human
cuuacugcuug

SEQ ID NO: 3616102 - RNA, 16 nt, Human
cuuacuguaagacauu

SEQ ID NO: 3616103 - RNA, 16 nt, Human
cuuacuguacaugaaa

SEQ ID NO: 3616104 - RNA, 15 nt, Human
cuuacuguaccuguu

SEQ ID NO: 3616105 - RNA, 18 nt, Human
cuuacuguaccuguuccu

SEQ ID NO: 3616106 - RNA, 23 nt, Human
cuuacuguaccuguuccuuagac

SEQ ID NO: 3616107 - RNA, 13 nt, Human
cuuacuguuucug

SEQ ID NO: 3616108 - RNA, 14 nt, Human
cuuacuguuucugu

SEQ ID NO: 3616109 - RNA, 16 nt, Human
cuuacuguuucuguca

SEQ ID NO: 3616110 - RNA, 18 nt, Human
cuuacuuagcaugcacaa

SEQ ID NO: 3616111 - RNA, 14 nt, Human
cuuacuucucacua

SEQ ID NO: 3616112 - RNA, 19 nt, Human
cuuacuuuaccucucuguc

SEQ ID NO: 3616113 - RNA, 22 nt, Human
cuuacuuuccuuuccccagccc

SEQ ID NO: 3616114 - RNA, 13 nt, Human
cuuacuuugcuga

SEQ ID NO: 3616115 - RNA, 21 nt, Human
cuuacuuuguaaauucugauu

SEQ ID NO: 3616116 - RNA, 14 nt, Human
cuuacuuuguauga

SEQ ID NO: 3616117 - RNA, 18 nt, Human
cuuagaaaaccagcucag

SEQ ID NO: 3616118 - RNA, 20 nt, Human
cuuagaaaaccagcucagca

SEQ ID NO: 3616119 - RNA, 19 nt, Human
cuuagaaaauucacuauug

SEQ ID NO: 3616120 - RNA, 18 nt, Human
cuuagaaauguaaacugc

SEQ ID NO: 3616121 - RNA, 15 nt, Human
cuuagaaauuuauuu

SEQ ID NO: 3616122 - RNA, 12 nt, Human
cuuagaacauuu

SEQ ID NO: 3616123 - RNA, 15 nt, Human
cuuagaaccuuucuu

SEQ ID NO: 3616124 - RNA, 17 nt, Human
cuuagaagaauauugua

SEQ ID NO: 3616125 - RNA, 20 nt, Human
cuuagaagucacacaguauu

SEQ ID NO: 3616126 - RNA, 16 nt, Human
cuuagaaguggaagua

SEQ ID NO: 3616127 - RNA, 18 nt, Human
cuuagaaguggaccagga

SEQ ID NO: 3616128 - RNA, 23 nt, Human
cuuagaaguggaccaggacagga

SEQ ID NO: 3616129 - RNA, 17 nt, Human
cuuagaauaaaauugua

SEQ ID NO: 3616130 - RNA, 12 nt, Human
cuuagaauccaa

SEQ ID NO: 3616131 - RNA, 16 nt, Human
cuuagaauccaaacuu

SEQ ID NO: 3616132 - RNA, 17 nt, Human
cuuagaauccaaacuug

SEQ ID NO: 3616133 - RNA, 18 nt, Human
cuuagaaucccuguguua

SEQ ID NO: 3616134 - RNA, 19 nt, Human
cuuagaaucccuguguuaa

SEQ ID NO: 3616135 - RNA, 20 nt, Human
cuuagaaucccuguguuaau

SEQ ID NO: 3616136 - RNA, 20 nt, Human
cuuagacagaggcccucaag

SEQ ID NO: 3616137 - RNA, 21 nt, Human
cuuagacagaggcccucaagu

SEQ ID NO: 3616138 - RNA, 15 nt, Human
cuuagacagucccug

SEQ ID NO: 3616139 - RNA, 17 nt, Human
cuuagacagucccugcc

SEQ ID NO: 3616140 - RNA, 19 nt, Human
cuuagacagucccugccaa

SEQ ID NO: 3616141 - RNA, 16 nt, Human
cuuagacauaacaaaa

SEQ ID NO: 3616142 - RNA, 18 nt, Human
cuuagacccucaugcugc

SEQ ID NO: 3616143 - RNA, 21 nt, Human
cuuagacccucaugcugccaa

SEQ ID NO: 3616144 - RNA, 22 nt, Human
cuuagacccucaugcugccaau

SEQ ID NO: 3616145 - RNA, 12 nt, Human
cuuagaccucag

SEQ ID NO: 3616146 - RNA, 17 nt, Human
cuuagaccucagccugu

SEQ ID NO: 3616147 - RNA, 18 nt, Human
cuuagaccucagccugug

SEQ ID NO: 3616148 - RNA, 18 nt, Human
cuuagacucuaguauuua

SEQ ID NO: 3616149 - RNA, 21 nt, Human
cuuagacucuaguauuuaugg

SEQ ID NO: 3616150 - RNA, 15 nt, Human
cuuagacucuuuucc

SEQ ID NO: 3616151 - RNA, 22 nt, Human
cuuagagacaguugggugagaa

SEQ ID NO: 3616152 - RNA, 22 nt, Human
cuuagagcaguuucuguccugc

SEQ ID NO: 3616153 - RNA, 19 nt, Human
cuuagagggauuucuuugc

SEQ ID NO: 3616154 - RNA, 20 nt, Human
cuuagagggauuucuuugcu

SEQ ID NO: 3616155 - RNA, 17 nt, Human
cuuagaguuucuguuug

SEQ ID NO: 3616156 - RNA, 18 nt, Human
cuuagaguuucuguuuga

SEQ ID NO: 3616157 - RNA, 20 nt, Human
cuuagauaucuuuuuauuga

SEQ ID NO: 3616158 - RNA, 13 nt, Human
cuuagaucauagu

SEQ ID NO: 3616159 - RNA, 22 nt, Human
cuuagaucauaguuuuauuuau

SEQ ID NO: 3616160 - RNA, 16 nt, Human
cuuagaucuggcaugu

SEQ ID NO: 3616161 - RNA, 13 nt, Human
cuuagauguauau

SEQ ID NO: 3616162 - RNA, 20 nt, Human
cuuagauucucugugucuaa

SEQ ID NO: 3616163 - RNA, 16 nt, Human
cuuagauucuuaauuc

SEQ ID NO: 3616164 - RNA, 19 nt, Human
cuuagauuuuacaugaagu

SEQ ID NO: 3616165 - RNA, 20 nt, Human
cuuagauuuuacaugaagua

SEQ ID NO: 3616166 - RNA, 15 nt, Human
cuuagcaaaaagugg

SEQ ID NO: 3616167 - RNA, 16 nt, Human
cuuagcagcuaucucu

SEQ ID NO: 3616168 - RNA, 16 nt, Human
cuuagcagcuuccaga

SEQ ID NO: 3616169 - RNA, 18 nt, Human
cuuagcagcuuccagauu

SEQ ID NO: 3616170 - RNA, 13 nt, Human
cuuagcaggagag

SEQ ID NO: 3616171 - RNA, 17 nt, Human
ccuugugggccugggcu

SEQ ID NO: 3616172 - RNA, 20 nt, Human
ccuugugggccugggcuccu

SEQ ID NO: 3616173 - RNA, 13 nt, Human
ccuugugguccaa

SEQ ID NO: 3616174 - RNA, 16 nt, Human
ccuuguggucccaccc

SEQ ID NO: 3616175 - RNA, 16 nt, Human
ccuuguguauauuugu

SEQ ID NO: 3616176 - RNA, 19 nt, Human
ccuuguuacuucugaggua

SEQ ID NO: 3616177 - RNA, 21 nt, Human
ccuuguuauuucucagacuuu

SEQ ID NO: 3616178 - RNA, 16 nt, Human
ccuuguuggagccugc

SEQ ID NO: 3616179 - RNA, 17 nt, Human
ccuuguuggagccugca

SEQ ID NO: 3616180 - RNA, 20 nt, Human
ccuuguuuaucagauacauc

SEQ ID NO: 3616181 - RNA, 14 nt, Human
ccuuguuucaaaca

SEQ ID NO: 3616182 - RNA, 19 nt, Human
ccuuguuuggggcaggagu

SEQ ID NO: 3616183 - RNA, 16 nt, Human
ccuuguuuuggacagu

SEQ ID NO: 3616184 - RNA, 14 nt, Human
ccuuguuuuuuucu

SEQ ID NO: 3616185 - RNA, 20 nt, Human
ccuuuaaaaaaauuuaagug

SEQ ID NO: 3616186 - RNA, 22 nt, Human
ccuuuaaaguaugaaucuaugc

SEQ ID NO: 3616187 - RNA, 23 nt, Human
ccuuuaaaguaugaaucuaugcc

SEQ ID NO: 3616188 - RNA, 17 nt, Human
ccuuuaacaacauguuu

SEQ ID NO: 3616189 - RNA, 21 nt, Human
ccuuuaacaacauguuuccag

SEQ ID NO: 3616190 - RNA, 19 nt, Human
ccuuuaaucagguccugcu

SEQ ID NO: 3616191 - RNA, 21 nt, Human
ccuuuaaucagguccugcuca

SEQ ID NO: 3616192 - RNA, 22 nt, Human
ccuuuacaaaagaaauaccuug

SEQ ID NO: 3616193 - RNA, 18 nt, Human
ccuuuacauggacagaau

SEQ ID NO: 3616194 - RNA, 19 nt, Human
ccuuuacauggacagaauu

SEQ ID NO: 3616195 - RNA, 19 nt, Human
ccuuuacccucuuugcugc

SEQ ID NO: 3616196 - RNA, 20 nt, Human
ccuuuacugacccuggggcu

SEQ ID NO: 3616197 - RNA, 17 nt, Human
ccuuuacuugucuuucu

SEQ ID NO: 3616198 - RNA, 13 nt, Human
ccuuuacuuuccc

SEQ ID NO: 3616199 - RNA, 14 nt, Human
ccuuuagaaaauau

SEQ ID NO: 3616200 - RNA, 16 nt, Human
ccuuuagaaaauauaa

SEQ ID NO: 3616201 - RNA, 18 nt, Human
ccuuuagauagcagccug

SEQ ID NO: 3616202 - RNA, 23 nt, Human
ccuuuagcacguuuaaaguucug

SEQ ID NO: 3616203 - RNA, 20 nt, Human
ccuuuagcgcccaguugggu

SEQ ID NO: 3616204 - RNA, 13 nt, Human
ccuuuagggcagc

SEQ ID NO: 3616205 - RNA, 14 nt, Human
ccuuuagggcagcu

SEQ ID NO: 3616206 - RNA, 22 nt, Human
ccuuuagggcagcuugccccgg

SEQ ID NO: 3616207 - RNA, 21 nt, Human
ccuuuaguaucaguguuuuaa

SEQ ID NO: 3616208 - RNA, 23 nt, Human
ccuuuaugugaauuuuuaagcug

SEQ ID NO: 3616209 - RNA, 13 nt, Human
ccuuuauugugau

SEQ ID NO: 3616210 - RNA, 21 nt, Human
ccuuuauuguguuugucauua

SEQ ID NO: 3616211 - RNA, 13 nt, Human
ccuuuauuuuaga

SEQ ID NO: 3616212 - RNA, 12 nt, Human
ccuuucaaagcu

SEQ ID NO: 3616213 - RNA, 16 nt, Human
ccuuucaaauuucaca

SEQ ID NO: 3616214 - RNA, 18 nt, Human
ccuuucacuucuuucccu

SEQ ID NO: 3616215 - RNA, 13 nt, Human
ccuuucagauguc

SEQ ID NO: 3616216 - RNA, 12 nt, Human
ccuuucagccca

SEQ ID NO: 3616217 - RNA, 15 nt, Human
ccuuucagcugugaa

SEQ ID NO: 3616218 - RNA, 12 nt, Human
ccuuucagggaa

SEQ ID NO: 3616219 - RNA, 22 nt, Human
ccuuucauuuacuguggcuucu

SEQ ID NO: 3616220 - RNA, 19 nt, Human
ccuuucauuugcuaucucu

SEQ ID NO: 3616221 - RNA, 19 nt, Human
ccuuuccaccacagccagc

SEQ ID NO: 3616222 - RNA, 23 nt, Human
ccuuuccaccacagccagcaccu

SEQ ID NO: 3616223 - RNA, 13 nt, Human
ccuuuccaccuuc

SEQ ID NO: 3616224 - RNA, 16 nt, Human
ccuuuccaccuucuca

SEQ ID NO: 3616225 - RNA, 17 nt, Human
ccuuuccaccuucucac

SEQ ID NO: 3616226 - RNA, 18 nt, Human
ccuuuccaccuucucaca

SEQ ID NO: 3616227 - RNA, 13 nt, Human
ccuuuccagcaug

SEQ ID NO: 3616228 - RNA, 22 nt, Human
ccuuuccauaaauccuugauga

SEQ ID NO: 3616229 - RNA, 22 nt, Human
ccuuucccaacacuucagacug

SEQ ID NO: 3616230 - RNA, 11 nt, Human
ccuuucccacc

SEQ ID NO: 3616231 - RNA, 12 nt, Human
ccuuucccaccc

SEQ ID NO: 3616232 - RNA, 11 nt, Human
ccuuucccacu

SEQ ID NO: 3616233 - RNA, 13 nt, Human
ccuuuccccagca

SEQ ID NO: 3616234 - RNA, 21 nt, Human
ccuuuccccagcaucacuccc

SEQ ID NO: 3616235 - RNA, 18 nt, Human
ccuuuccccagcccaggg

SEQ ID NO: 3616236 - RNA, 12 nt, Human
ccuuucccuaag

SEQ ID NO: 3616237 - RNA, 15 nt, Human
ccuuucccuaagcca

SEQ ID NO: 3616238 - RNA, 16 nt, Human
ccuuucccucaccccc

SEQ ID NO: 3616239 - RNA, 17 nt, Human
ccuuucccucacccccu

SEQ ID NO: 3616240 - RNA, 20 nt, Human
ccuuucccucacccccuccc

SEQ ID NO: 3616241 - RNA, 13 nt, Human
ccuuucccuuccu

SEQ ID NO: 3616242 - RNA, 15 nt, Human
ccuuucccuucuugg

SEQ ID NO: 3616243 - RNA, 19 nt, Human
ccuuuccuauaugaugauu

SEQ ID NO: 3616244 - RNA, 16 nt, Human
ccuuuccucaggcaag

SEQ ID NO: 3616245 - RNA, 17 nt, Human
ccuuuccuccuuuauca

SEQ ID NO: 3616246 - RNA, 21 nt, Human
cuuccauaaucuggacuccuc

SEQ ID NO: 3616247 - RNA, 22 nt, Human
cuuccauaaugcuacugucuca

SEQ ID NO: 3616248 - RNA, 14 nt, Human
cuuccauaauuaug

SEQ ID NO: 3616249 - RNA, 14 nt, Human
cuuccauagccuaa

SEQ ID NO: 3616250 - RNA, 15 nt, Human
cuuccauagcugcug

SEQ ID NO: 3616251 - RNA, 21 nt, Human
cuuccauagcugcugcccuag

SEQ ID NO: 3616252 - RNA, 14 nt, Human
cuuccauaugaccu

SEQ ID NO: 3616253 - RNA, 15 nt, Human
cuuccauauuuggaa

SEQ ID NO: 3616254 - RNA, 16 nt, Human
cuuccauauuuggaag

SEQ ID NO: 3616255 - RNA, 19 nt, Human
cuuccaucccaaccagugc

SEQ ID NO: 3616256 - RNA, 14 nt, Human
cuuccaucccagag

SEQ ID NO: 3616257 - RNA, 16 nt, Human
cuuccaucccuacccc

SEQ ID NO: 3616258 - RNA, 14 nt, Human
cuuccaugcugugc

SEQ ID NO: 3616259 - RNA, 15 nt, Human
cuuccaugucgccuc

SEQ ID NO: 3616260 - RNA, 16 nt, Human
cuuccaugucgccucu

SEQ ID NO: 3616261 - RNA, 17 nt, Human
cuuccaugucgccucug

SEQ ID NO: 3616262 - RNA, 18 nt, Human
cuuccaugucggccucua

SEQ ID NO: 3616263 - RNA, 12 nt, Human
cuuccaugugga

SEQ ID NO: 3616264 - RNA, 15 nt, Human
cuuccauguggagaa

SEQ ID NO: 3616265 - RNA, 22 nt, Human
cuuccauuccacacagaaugca

SEQ ID NO: 3616266 - RNA, 16 nt, Human
cuuccauuucugccuu

SEQ ID NO: 3616267 - RNA, 13 nt, Human
cuuccauuugcaa

SEQ ID NO: 3616268 - RNA, 14 nt, Human
cuuccauuuucccc

SEQ ID NO: 3616269 - RNA, 22 nt, Human
cuuccauuuucccccacuacug

SEQ ID NO: 3616270 - RNA, 17 nt, Human
cuuccauuuuccuacag

SEQ ID NO: 3616271 - RNA, 16 nt, Human
cuucccaaagcaagca

SEQ ID NO: 3616272 - RNA, 14 nt, Human
cuucccaaaggacu

SEQ ID NO: 3616273 - RNA, 19 nt, Human
cuucccaaaggacuccacc

SEQ ID NO: 3616274 - RNA, 23 nt, Human
cuucccaaaugugugcccagcuu

SEQ ID NO: 3616275 - RNA, 14 nt, Human
cuucccaacugcaa

SEQ ID NO: 3616276 - RNA, 18 nt, Human
cuucccaaggccuuaagc

SEQ ID NO: 3616277 - RNA, 21 nt, Human
cuucccaaguaagaggcugga

SEQ ID NO: 3616278 - RNA, 21 nt, Human
cuucccaaucagcacugaaaa

SEQ ID NO: 3616279 - RNA, 22 nt, Human
cuucccaaucagcacugaaaau

SEQ ID NO: 3616280 - RNA, 19 nt, Human
cuucccacccugccccuca

SEQ ID NO: 3616281 - RNA, 15 nt, Human
cuucccaccucccug

SEQ ID NO: 3616282 - RNA, 21 nt, Human
cuucccaccucucucacuccu

SEQ ID NO: 3616283 - RNA, 15 nt, Human
cuucccacucacccc

SEQ ID NO: 3616284 - RNA, 18 nt, Human
cuucccacucuagggcag

SEQ ID NO: 3616285 - RNA, 20 nt, Human
cuucccacucuagggcagug

SEQ ID NO: 3616286 - RNA, 15 nt, Human
cuucccacucuucuc

SEQ ID NO: 3616287 - RNA, 15 nt, Human
cuucccacuggaggc

SEQ ID NO: 3616288 - RNA, 15 nt, Human
cuucccacuggaggu

SEQ ID NO: 3616289 - RNA, 14 nt, Human
cuucccagcucucc

SEQ ID NO: 3616290 - RNA, 20 nt, Human
cuucccagcucucccucugg

SEQ ID NO: 3616291 - RNA, 19 nt, Human
cuucccaggaguggaggag

SEQ ID NO: 3616292 - RNA, 18 nt, Human
cuucccaggcuggggcug

SEQ ID NO: 3616293 - RNA, 14 nt, Human
cuucccaguggcug

SEQ ID NO: 3616294 - RNA, 15 nt, Human
cuucccaguggcugc

SEQ ID NO: 3616295 - RNA, 20 nt, Human
cuucccaguggcugcugccc

SEQ ID NO: 3616296 - RNA, 23 nt, Human
cuucccaguucaggagucccaag

SEQ ID NO: 3616297 - RNA, 17 nt, Human
cuucccauccccagcga

SEQ ID NO: 3616298 - RNA, 11 nt, Human
cuucccauccu

SEQ ID NO: 3616299 - RNA, 16 nt, Human
cuucccauccuacccu

SEQ ID NO: 3616300 - RNA, 20 nt, Human
cuucccaugacccaggcugg

SEQ ID NO: 3616301 - RNA, 18 nt, Human
cuucccaugcauucuggu

SEQ ID NO: 3616302 - RNA, 16 nt, Human
cuucccauuccauggc

SEQ ID NO: 3616303 - RNA, 13 nt, Human
cuucccauucucc

SEQ ID NO: 3616304 - RNA, 22 nt, Human
cuuccccaccccaguuuuuguu

SEQ ID NO: 3616305 - RNA, 15 nt, Human
cuuccccacccucag

SEQ ID NO: 3616306 - RNA, 14 nt, Human
cuuccccacugccu

SEQ ID NO: 3616307 - RNA, 13 nt, Human
cuuccccagccuc

SEQ ID NO: 3616308 - RNA, 14 nt, Human
cuuccccagccucu

SEQ ID NO: 3616309 - RNA, 14 nt, Human
cuuccccagcgucc

SEQ ID NO: 3616310 - RNA, 16 nt, Human
cuucccccaccaccaa

SEQ ID NO: 3616311 - RNA, 14 nt, Human
cuucccccagccca

SEQ ID NO: 3616312 - RNA, 15 nt, Human
cuucccccuccaauc

SEQ ID NO: 3616313 - RNA, 16 nt, Human
cuucccccuuuuuugu

SEQ ID NO: 3616314 - RNA, 18 nt, Human
cuuccccucccuggcucc

SEQ ID NO: 3616315 - RNA, 13 nt, Human
cuuccccuccuac

SEQ ID NO: 3616316 - RNA, 20 nt, Human
cuuccccucucuccuccugc

SEQ ID NO: 3616317 - RNA, 22 nt, Human
cuuccugucccaccucuucucu

SEQ ID NO: 3616318 - RNA, 14 nt, Human
cuuccuguccccau

SEQ ID NO: 3616319 - RNA, 19 nt, Human
cuuccuguccccaucuguc

SEQ ID NO: 3616320 - RNA, 15 nt, Human
cuuccuguccgcccu

SEQ ID NO: 3616321 - RNA, 14 nt, Human
cuuccuguguccug

SEQ ID NO: 3616322 - RNA, 15 nt, Human
cuuccugugugucca

SEQ ID NO: 3616323 - RNA, 22 nt, Human
cuuccuguuuaaaaaaccacau

SEQ ID NO: 3616324 - RNA, 17 nt, Human
cuuccuguuuuucacau

SEQ ID NO: 3616325 - RNA, 23 nt, Human
cuuccuguuuuucacauuuuccu

SEQ ID NO: 3616326 - RNA, 16 nt, Human
cuuccuuacccaaacu

SEQ ID NO: 3616327 - RNA, 17 nt, Human
cuuccuuaugcuucuuu

SEQ ID NO: 3616328 - RNA, 23 nt, Human
cuuccuucagagagcagugcuuu

SEQ ID NO: 3616329 - RNA, 15 nt, Human
cuuccuucugugaaa

SEQ ID NO: 3616330 - RNA, 15 nt, Human
cuuccuucuuugccc

SEQ ID NO: 3616331 - RNA, 16 nt, Human
cuuccuucuuugcccu

SEQ ID NO: 3616332 - RNA, 22 nt, Human
cuuccuugaagaacugcaggcc

SEQ ID NO: 3616333 - RNA, 22 nt, Human
cuuccuugaccagcagauccca

SEQ ID NO: 3616334 - RNA, 22 nt, Human
cuuccuugaccugcauuguaaa

SEQ ID NO: 3616335 - RNA, 23 nt, Human
cuuccuugaccugcauuguaaau

SEQ ID NO: 3616336 - RNA, 17 nt, Human
cuuccuugaccuuccuc

SEQ ID NO: 3616337 - RNA, 18 nt, Human
cuuccuugagacacggag

SEQ ID NO: 3616338 - RNA, 17 nt, Human
cuuccuugccagucuuu

SEQ ID NO: 3616339 - RNA, 17 nt, Human
cuuccuugcucugcacc

SEQ ID NO: 3616340 - RNA, 17 nt, Human
cuuccuugcuguccuag

SEQ ID NO: 3616341 - RNA, 19 nt, Human
cuuccuuggacucauuuua

SEQ ID NO: 3616342 - RNA, 20 nt, Human
cuuccuuggacucauuuuaa

SEQ ID NO: 3616343 - RNA, 17 nt, Human
cuuccuuguagccuuuu

SEQ ID NO: 3616344 - RNA, 16 nt, Human
cuuccuuuacuuuccc

SEQ ID NO: 3616345 - RNA, 20 nt, Human
cuuccuuuacuuucccuugc

SEQ ID NO: 3616346 - RNA, 19 nt, Human
cuuccuuucccaagccuuc

SEQ ID NO: 3616347 - RNA, 15 nt, Human
cuuccuuucuccagg

SEQ ID NO: 3616348 - RNA, 16 nt, Human
cuuccuuucuccagga

SEQ ID NO: 3616349 - RNA, 19 nt, Human
cuuccuuucuccaggacca

SEQ ID NO: 3616350 - RNA, 13 nt, Human
cuuccuuucuuga

SEQ ID NO: 3616351 - RNA, 14 nt, Human
cuuccuuuuaacug

SEQ ID NO: 3616352 - RNA, 12 nt, Human
cuuccuuuucac

SEQ ID NO: 3616353 - RNA, 13 nt, Human
cuuccuuuucacu

SEQ ID NO: 3616354 - RNA, 17 nt, Human
cuuccuuuucccugcuu

SEQ ID NO: 3616355 - RNA, 19 nt, Human
cuuccuuuucccugcuucc

SEQ ID NO: 3616356 - RNA, 14 nt, Human
cuucgaaaaucuag

SEQ ID NO: 3616357 - RNA, 16 nt, Human
cuucgcaggcaugucc

SEQ ID NO: 3616358 - RNA, 14 nt, Human
cuucgccaccuggg

SEQ ID NO: 3616359 - RNA, 22 nt, Human
cuucgcgcccgccccugcagca

SEQ ID NO: 3616360 - RNA, 17 nt, Human
cuucgcuucuugccucu

SEQ ID NO: 3616361 - RNA, 20 nt, Human
cuucgcuucuugccucugug

SEQ ID NO: 3616362 - RNA, 14 nt, Human
cuucggaccgcuug

SEQ ID NO: 3616363 - RNA, 16 nt, Human
cuucggccaggucaca

SEQ ID NO: 3616364 - RNA, 18 nt, Human
cuucggccuccauccuga

SEQ ID NO: 3616365 - RNA, 15 nt, Human
cuucgggaagagagg

SEQ ID NO: 3616366 - RNA, 18 nt, Human
cuucgggaagagaggagu

SEQ ID NO: 3616367 - RNA, 21 nt, Human
cuucgggaagagaggaguuca

SEQ ID NO: 3616368 - RNA, 12 nt, Human
cuucgggaccag

SEQ ID NO: 3616369 - RNA, 14 nt, Human
cuucgggaccagga

SEQ ID NO: 3616370 - RNA, 20 nt, Human
cuucgggaggucgaggcagg

SEQ ID NO: 3616371 - RNA, 16 nt, Human
cuucgggcugugcccg

SEQ ID NO: 3616372 - RNA, 18 nt, Human
cuucggggaacuccugga

SEQ ID NO: 3616373 - RNA, 16 nt, Human
cuucgguggaagagcu

SEQ ID NO: 3616374 - RNA, 23 nt, Human
cuucguaucccgagucugggaca

SEQ ID NO: 3616375 - RNA, 23 nt, Human
cuucgugaacauccccucccauc

SEQ ID NO: 3616376 - RNA, 21 nt, Human
cuucgugggaucugccccucc

SEQ ID NO: 3616377 - RNA, 17 nt, Human
cuucguucgcagagcuu

SEQ ID NO: 3616378 - RNA, 13 nt, Human
cuucguucuuuuu

SEQ ID NO: 3616379 - RNA, 15 nt, Human
cuucguucuuuuuaa

SEQ ID NO: 3616380 - RNA, 15 nt, Human
cuucguuuaaugaau

SEQ ID NO: 3616381 - RNA, 18 nt, Human
cuucguuuacuaugccug

SEQ ID NO: 3616382 - RNA, 19 nt, Human
cuucuaaaaaaaaacaaaa

SEQ ID NO: 3616383 - RNA, 19 nt, Human
cuucuaaaacuguacuuug

SEQ ID NO: 3616384 - RNA, 20 nt, Human
cuucuaaaacuguacuuuga

SEQ ID NO: 3616385 - RNA, 21 nt, Human
cuucuaaagguguugucccuu

SEQ ID NO: 3616386 - RNA, 22 nt, Human
cuucuaaagguguugucccuuc

SEQ ID NO: 3616387 - RNA, 23 nt, Human
cuucuaaagguguugucccuucu

SEQ ID NO: 3616388 - RNA, 15 nt, Human
cuucuaaaugcauau

SEQ ID NO: 3616389 - RNA, 13 nt, Human
cuucuaagacuuu

SEQ ID NO: 3616390 - RNA, 17 nt, Human
cuucuaaguaaaaccac

SEQ ID NO: 3616391 - RNA, 17 nt, Human
cuucuaaguaaauacaa

SEQ ID NO: 3616392 - RNA, 21 nt, Human
cuucuaaguaaauacaauuuu

SEQ ID NO: 3616393 - RNA, 17 nt, Human
cuucuaagucauucaua

SEQ ID NO: 3616394 - RNA, 13 nt, Human
cuucuaauaaauu

SEQ ID NO: 3616395 - RNA, 15 nt, Human
cuucuaauaaauuau

SEQ ID NO: 3616396 - RNA, 11 nt, Human
cuucuaauaua

SEQ ID NO: 3616397 - RNA, 13 nt, Human
cuucuacacucuc

SEQ ID NO: 3616398 - RNA, 18 nt, Human
cuucuaccaacuggaagc

SEQ ID NO: 3616399 - RNA, 13 nt, Human
cuucuaccugcca

SEQ ID NO: 3616400 - RNA, 14 nt, Human
cuucuaccugccac

SEQ ID NO: 3616401 - RNA, 17 nt, Human
cuucuaccugccacuca

SEQ ID NO: 3616402 - RNA, 15 nt, Human
cuucuaccugcccuc

SEQ ID NO: 3616403 - RNA, 19 nt, Human
cuucuaccugcccucaagg

SEQ ID NO: 3616404 - RNA, 17 nt, Human
cuucuaccuuaaaaugu

SEQ ID NO: 3616405 - RNA, 18 nt, Human
cuucuacucacuuuuccc

SEQ ID NO: 3616406 - RNA, 23 nt, Human
cuucuacucacuuuucccacucc

SEQ ID NO: 3616407 - RNA, 18 nt, Human
ccuuuccuccuuuaucac

SEQ ID NO: 3616408 - RNA, 15 nt, Human
ccuuuccuuccuaau

SEQ ID NO: 3616409 - RNA, 13 nt, Human
ccuuucgaggccu

SEQ ID NO: 3616410 - RNA, 15 nt, Human
ccuuucuaaacaaga

SEQ ID NO: 3616411 - RNA, 23 nt, Human
ccuuucuaaacaagauuuuaaag

SEQ ID NO: 3616412 - RNA, 19 nt, Human
ccuuucuagagcacugcca

SEQ ID NO: 3616413 - RNA, 18 nt, Human
ccuuucuaucauuuuugu

SEQ ID NO: 3616414 - RNA, 13 nt, Human
ccuuucuccagcc

SEQ ID NO: 3616415 - RNA, 17 nt, Human
ccuuucuccagccagca

SEQ ID NO: 3616416 - RNA, 15 nt, Human
ccuuucugaucuuca

SEQ ID NO: 3616417 - RNA, 12 nt, Human
ccuuucugugcc

SEQ ID NO: 3616418 - RNA, 13 nt, Human
ccuuucugugccc

SEQ ID NO: 3616419 - RNA, 20 nt, Human
ccuuucugugcccuacucau

SEQ ID NO: 3616420 - RNA, 19 nt, Human
ccuuucuuccggccccucc

SEQ ID NO: 3616421 - RNA, 23 nt, Human
ccuuucuugacaaaaccuaacuu

SEQ ID NO: 3616422 - RNA, 15 nt, Human
ccuuucuuggccagu

SEQ ID NO: 3616423 - RNA, 18 nt, Human
ccuuucuugguucauaaa

SEQ ID NO: 3616424 - RNA, 15 nt, Human
ccuuucuuuuucuuc

SEQ ID NO: 3616425 - RNA, 13 nt, Human
ccuuugaagagga

SEQ ID NO: 3616426 - RNA, 23 nt, Human
ccuuugaagaggaaaaugaauaa

SEQ ID NO: 3616427 - RNA, 14 nt, Human
ccuuugaagccuca

SEQ ID NO: 3616428 - RNA, 14 nt, Human
ccuuugaauccucu

SEQ ID NO: 3616429 - RNA, 14 nt, Human
ccuuugacauuuaa

SEQ ID NO: 3616430 - RNA, 22 nt, Human
ccuuugaccugccucccuucau

SEQ ID NO: 3616431 - RNA, 16 nt, Human
ccuuugacgccauccc

SEQ ID NO: 3616432 - RNA, 22 nt, Human
ccuuugacgccaucccagcccc

SEQ ID NO: 3616433 - RNA, 17 nt, Human
ccuuugauaaaauaaau

SEQ ID NO: 3616434 - RNA, 18 nt, Human
ccuuugcaaaucaguguu

SEQ ID NO: 3616435 - RNA, 17 nt, Human
ccuuugcacugagggcc

SEQ ID NO: 3616436 - RNA, 13 nt, Human
ccuuugcagggca

SEQ ID NO: 3616437 - RNA, 20 nt, Human
ccuuugcaucguccccuccc

SEQ ID NO: 3616438 - RNA, 15 nt, Human
ccuuugcauggagug

SEQ ID NO: 3616439 - RNA, 13 nt, Human
ccuuugccuccag

SEQ ID NO: 3616440 - RNA, 23 nt, Human
ccuuugccuccagaagcacuggg

SEQ ID NO: 3616441 - RNA, 20 nt, Human
ccuuugcuccaccccacuca

SEQ ID NO: 3616442 - RNA, 11 nt, Human
ccuuugcuguc

SEQ ID NO: 3616443 - RNA, 13 nt, Human
ccuuugcugugag

SEQ ID NO: 3616444 - RNA, 22 nt, Human
ccuuugcugugaggcuguccug

SEQ ID NO: 3616445 - RNA, 23 nt, Human
ccuuugcugugaggcuguccugu

SEQ ID NO: 3616446 - RNA, 19 nt, Human
ccuuugcuuaugaauauuu

SEQ ID NO: 3616447 - RNA, 21 nt, Human
ccuuugcuucccuuuuuuccu

SEQ ID NO: 3616448 - RNA, 16 nt, Human
ccuuuggaugaccaga

SEQ ID NO: 3616449 - RNA, 20 nt, Human
ccuuuggcaggugcagcccc

SEQ ID NO: 3616450 - RNA, 11 nt, Human
ccuuuggcuuc

SEQ ID NO: 3616451 - RNA, 14 nt, Human
ccuuugggaagggg

SEQ ID NO: 3616452 - RNA, 14 nt, Human
ccuuugggcccugc

SEQ ID NO: 3616453 - RNA, 23 nt, Human
ccuuugggccucugcuucucuca

SEQ ID NO: 3616454 - RNA, 16 nt, Human
ccuuugggugcuguuu

SEQ ID NO: 3616455 - RNA, 19 nt, Human
ccuuugggugcuguuuugc

SEQ ID NO: 3616456 - RNA, 14 nt, Human
ccuuugguucuggc

SEQ ID NO: 3616457 - RNA, 12 nt, Human
ccuuuguaacca

SEQ ID NO: 3616458 - RNA, 16 nt, Human
ccuuuguagcacucag

SEQ ID NO: 3616459 - RNA, 12 nt, Human
ccuuuguauauu

SEQ ID NO: 3616460 - RNA, 19 nt, Human
ccuuuguauauuauuucua

SEQ ID NO: 3616461 - RNA, 23 nt, Human
ccuuugucaucuuucuucuauuu

SEQ ID NO: 3616462 - RNA, 21 nt, Human
cuucuccacccugcucuccga

SEQ ID NO: 3616463 - RNA, 17 nt, Human
cuucuccacuggaugga

SEQ ID NO: 3616464 - RNA, 23 nt, Human
cuucuccagacaaaccagaagca

SEQ ID NO: 3616465 - RNA, 12 nt, Human
cuucuccagccu

SEQ ID NO: 3616466 - RNA, 15 nt, Human
cuucuccagccuaga

SEQ ID NO: 3616467 - RNA, 17 nt, Human
cuucuccaggcuguauc

SEQ ID NO: 3616468 - RNA, 20 nt, Human
cuucuccauccuuucugccu

SEQ ID NO: 3616469 - RNA, 22 nt, Human
cuucuccauccuuucugccucu

SEQ ID NO: 3616470 - RNA, 11 nt, Human
cuucuccaucu

SEQ ID NO: 3616471 - RNA, 13 nt, Human
cuucuccaucucu

SEQ ID NO: 3616472 - RNA, 19 nt, Human
cuucuccaucucucuggcc

SEQ ID NO: 3616473 - RNA, 21 nt, Human
cuucuccaucucucuggcccu

SEQ ID NO: 3616474 - RNA, 19 nt, Human
cuucuccauggcccugcca

SEQ ID NO: 3616475 - RNA, 13 nt, Human
cuucucccacacu

SEQ ID NO: 3616476 - RNA, 13 nt, Human
cuucucccagaau

SEQ ID NO: 3616477 - RNA, 15 nt, Human
cuucucccaggcaag

SEQ ID NO: 3616478 - RNA, 17 nt, Human
cuucucccaggcaaggc

SEQ ID NO: 3616479 - RNA, 18 nt, Human
cuucucccaggcaaggcu

SEQ ID NO: 3616480 - RNA, 19 nt, Human
cuucucccaggcaaggcug

SEQ ID NO: 3616481 - RNA, 14 nt, Human
cuucuccccagaau

SEQ ID NO: 3616482 - RNA, 16 nt, Human
cuucuccccagaguuc

SEQ ID NO: 3616483 - RNA, 17 nt, Human
cuucuccccagcuccca

SEQ ID NO: 3616484 - RNA, 18 nt, Human
cuucuccccagcucccag

SEQ ID NO: 3616485 - RNA, 13 nt, Human
cuucuccccugca

SEQ ID NO: 3616486 - RNA, 17 nt, Human
cuucuccccugcacugu

SEQ ID NO: 3616487 - RNA, 18 nt, Human
cuucuccccugcacugua

SEQ ID NO: 3616488 - RNA, 22 nt, Human
cuucuccccugcacuguaaaau

SEQ ID NO: 3616489 - RNA, 16 nt, Human
cuucucccuagcuccu

SEQ ID NO: 3616490 - RNA, 22 nt, Human
cuucucccugcacaagccaggg

SEQ ID NO: 3616491 - RNA, 12 nt, Human
cuucuccgccag

SEQ ID NO: 3616492 - RNA, 13 nt, Human
cuucuccgccagc

SEQ ID NO: 3616493 - RNA, 18 nt, Human
cuucuccgccagccuccu

SEQ ID NO: 3616494 - RNA, 19 nt, Human
cuucuccgccagccuccuc

SEQ ID NO: 3616495 - RNA, 21 nt, Human
cuucuccgccagccuccucug

SEQ ID NO: 3616496 - RNA, 23 nt, Human
cuucuccuacauaucccuuccag

SEQ ID NO: 3616497 - RNA, 19 nt, Human
cuucuccugacccaguccc

SEQ ID NO: 3616498 - RNA, 21 nt, Human
cuucuccuggaguugcauuga

SEQ ID NO: 3616499 - RNA, 16 nt, Human
cuucuccuugauaaca

SEQ ID NO: 3616500 - RNA, 14 nt, Human
cuucuccuuucaca

SEQ ID NO: 3616501 - RNA, 21 nt, Human
cuucucgaccacgggaagcau

SEQ ID NO: 3616502 - RNA, 16 nt, Human
cuucucgcuuuugcca

SEQ ID NO: 3616503 - RNA, 20 nt, Human
cuucucuaauucuuccuuug

SEQ ID NO: 3616504 - RNA, 11 nt, Human
cuucucuacag

SEQ ID NO: 3616505 - RNA, 20 nt, Human
cuucucuacccaucuuaaaa

SEQ ID NO: 3616506 - RNA, 17 nt, Human
cuucucuagcugguggu

SEQ ID NO: 3616507 - RNA, 13 nt, Human
cuucucuauaaaa

SEQ ID NO: 3616508 - RNA, 17 nt, Human
cuucucuauaaaaaaua

SEQ ID NO: 3616509 - RNA, 18 nt, Human
cuucucucaccuccuaaa

SEQ ID NO: 3616510 - RNA, 22 nt, Human
cuucucucagaccgucuuccuc

SEQ ID NO: 3616511 - RNA, 16 nt, Human
cuucucucaucucuua

SEQ ID NO: 3616512 - RNA, 12 nt, Human
cuucucuccagc

SEQ ID NO: 3616513 - RNA, 13 nt, Human
cuucucuccagcc

SEQ ID NO: 3616514 - RNA, 15 nt, Human
cuucucuccagcuga

SEQ ID NO: 3616515 - RNA, 17 nt, Human
cuucucuccagcugacu

SEQ ID NO: 3616516 - RNA, 15 nt, Human
cuucucucccugcca

SEQ ID NO: 3616517 - RNA, 13 nt, Human
cuucucucucccu

SEQ ID NO: 3616518 - RNA, 16 nt, Human
cuucucugaacacagg

SEQ ID NO: 3616519 - RNA, 17 nt, Human
cuucucugaacacaggc

SEQ ID NO: 3616520 - RNA, 19 nt, Human
cuucucugaacacaggcag

SEQ ID NO: 3616521 - RNA, 20 nt, Human
cuucucugaacacaggcagc

SEQ ID NO: 3616522 - RNA, 23 nt, Human
cuucucugaacacaggcagcuuu

SEQ ID NO: 3616523 - RNA, 13 nt, Human
cuucucugaaggg

SEQ ID NO: 3616524 - RNA, 14 nt, Human
cuucucugacuucu

SEQ ID NO: 3616525 - RNA, 19 nt, Human
cuucucugcccagcuuuuc

SEQ ID NO: 3616526 - RNA, 21 nt, Human
cuucucugcccauuccccagc

SEQ ID NO: 3616527 - RNA, 22 nt, Human
cuucucugcccauuccccagcc

SEQ ID NO: 3616528 - RNA, 23 nt, Human
cuucucugccuuugacauuuaau

SEQ ID NO: 3616529 - RNA, 11 nt, Human
cuucucugcuc

SEQ ID NO: 3616530 - RNA, 16 nt, Human
cuucucugcuccacca

SEQ ID NO: 3616531 - RNA, 22 nt, Human
cuucucuggagccaaguccaga

SEQ ID NO: 3616532 - RNA, 22 nt, Human
cuucucuguauuccuagaaacu

SEQ ID NO: 3616533 - RNA, 13 nt, Human
cuucucugucuca

SEQ ID NO: 3616534 - RNA, 14 nt, Human
cuucucugucucag

SEQ ID NO: 3616535 - RNA, 11 nt, Human
cuucucuguga

SEQ ID NO: 3616536 - RNA, 21 nt, Human
cuucucugugaacgauuuaga

SEQ ID NO: 3616537 - RNA, 14 nt, Human
cuucucugugagaa

SEQ ID NO: 3616538 - RNA, 18 nt, Human
cuucucugugagaagguu

SEQ ID NO: 3616539 - RNA, 21 nt, Human
cuucucuguuccauugaaucu

SEQ ID NO: 3616540 - RNA, 16 nt, Human
cuucucuuaaacuugu

SEQ ID NO: 3616541 - RNA, 19 nt, Human
cuucucuuaaacuugugaa

SEQ ID NO: 3616542 - RNA, 20 nt, Human
cuucucuuaaacuugugaau

SEQ ID NO: 3616543 - RNA, 15 nt, Human
cuucucuuaauuuaa

SEQ ID NO: 3616544 - RNA, 16 nt, Human
cuucucuuaauuuaau

SEQ ID NO: 3616545 - RNA, 14 nt, Human
cuucucuuccugua

SEQ ID NO: 3616546 - RNA, 16 nt, Human
cuucucuugcuuucua

SEQ ID NO: 3616547 - RNA, 17 nt, Human
cuucucuugcuuucuau

SEQ ID NO: 3616548 - RNA, 21 nt, Human
cuucucuuuaacucaggacuc

SEQ ID NO: 3616549 - RNA, 15 nt, Human
cuucugaaaugaaac

SEQ ID NO: 3616550 - RNA, 16 nt, Human
cuucugaauaaagcaa

SEQ ID NO: 3616551 - RNA, 15 nt, Human
cuucugaccacacuu

SEQ ID NO: 3616552 - RNA, 18 nt, Human
cuucugacccaugcugcc

SEQ ID NO: 3616553 - RNA, 20 nt, Human
cuucugacccaugcugcccu

SEQ ID NO: 3616554 - RNA, 22 nt, Human
cuucugaccuuuuggugaaagc

SEQ ID NO: 3616555 - RNA, 14 nt, Human
cuucugacggcccu

SEQ ID NO: 3616556 - RNA, 19 nt, Human
cuucugacggcccugcaau

SEQ ID NO: 3616557 - RNA, 20 nt, Human
cuucugacgugccuuuugca

SEQ ID NO: 3616558 - RNA, 13 nt, Human
cuucugacugcug

SEQ ID NO: 3616559 - RNA, 11 nt, Human
cuucugagacg

SEQ ID NO: 3616560 - RNA, 15 nt, Human
cuucugagcacuguu

SEQ ID NO: 3616561 - RNA, 22 nt, Human
cuucugagcagcgagccugcua

SEQ ID NO: 3616562 - RNA, 18 nt, Human
cuucugagcuauuucauc

SEQ ID NO: 3616563 - RNA, 12 nt, Human
cuucugagcucc

SEQ ID NO: 3616564 - RNA, 16 nt, Human
cuucugagcuccuguc

SEQ ID NO: 3616565 - RNA, 20 nt, Human
cuucugaucacugaaauaaa

SEQ ID NO: 3616566 - RNA, 20 nt, Human
cuucugaugaaauguuaaca

SEQ ID NO: 3616567 - RNA, 17 nt, Human
cuucugaugaaucuugc

SEQ ID NO: 3616568 - RNA, 18 nt, Human
cgaaagcucuagaaucug

SEQ ID NO: 3616569 - RNA, 19 nt, Human
cgaaagggacuuggaagcu

SEQ ID NO: 3616570 - RNA, 23 nt, Human
cgaaagggacuuggaagcuccgc

SEQ ID NO: 3616571 - RNA, 23 nt, Human
cgaaaggucaccucacucagcac

SEQ ID NO: 3616572 - RNA, 16 nt, Human
cgaaauaauuguuguu

SEQ ID NO: 3616573 - RNA, 17 nt, Human
cgaaauaucaaagucau

SEQ ID NO: 3616574 - RNA, 15 nt, Human
cgaaaucccugcuca

SEQ ID NO: 3616575 - RNA, 18 nt, Human
cgaaaugcugucuuucuu

SEQ ID NO: 3616576 - RNA, 14 nt, Human
cgaaauguuauuuu

SEQ ID NO: 3616577 - RNA, 11 nt, Human
cgaacaaaaca

SEQ ID NO: 3616578 - RNA, 19 nt, Human
cgaacauccaaccuuccca

SEQ ID NO: 3616579 - RNA, 14 nt, Human
cgaaccaauauuug

SEQ ID NO: 3616580 - RNA, 16 nt, Human
cgaacccaccugcuga

SEQ ID NO: 3616581 - RNA, 17 nt, Human
cgaaccuuggccugggc

SEQ ID NO: 3616582 - RNA, 18 nt, Human
cgaaccuuggccugggcc

SEQ ID NO: 3616583 - RNA, 19 nt, Human
cgaaccuuggccugggccg

SEQ ID NO: 3616584 - RNA, 12 nt, Human
cgaacuccuggg

SEQ ID NO: 3616585 - RNA, 16 nt, Human
cgaacuccugggcuca

SEQ ID NO: 3616586 - RNA, 12 nt, Human
cgaacuggcugc

SEQ ID NO: 3616587 - RNA, 19 nt, Human
cgaagaaaaaaaauaacac

SEQ ID NO: 3616588 - RNA, 18 nt, Human
cgaagacccucuugccca

SEQ ID NO: 3616589 - RNA, 21 nt, Human
cgaagaguauuuuugacagaa

SEQ ID NO: 3616590 - RNA, 16 nt, Human
cgaagcccaggggccg

SEQ ID NO: 3616591 - RNA, 11 nt, Human
cgaagcgcgcc

SEQ ID NO: 3616592 - RNA, 15 nt, Human
cgaagcguuguccuc

SEQ ID NO: 3616593 - RNA, 17 nt, Human
cgaagcguuguccucag

SEQ ID NO: 3616594 - RNA, 21 nt, Human
cgaagcguuguccucagcccc

SEQ ID NO: 3616595 - RNA, 13 nt, Human
cgaagcucagccc

SEQ ID NO: 3616596 - RNA, 14 nt, Human
cgaagcucuggcug

SEQ ID NO: 3616597 - RNA, 15 nt, Human
cgaagcucuggcuga

SEQ ID NO: 3616598 - RNA, 18 nt, Human
cgaagcuuugaaggccga

SEQ ID NO: 3616599 - RNA, 14 nt, Human
cgaagggcccccac

SEQ ID NO: 3616600 - RNA, 15 nt, Human
cgaaguagcuugcuc

SEQ ID NO: 3616601 - RNA, 18 nt, Human
cgaagucaagcucaacag

SEQ ID NO: 3616602 - RNA, 16 nt, Human
cgaagucauuaaacug

SEQ ID NO: 3616603 - RNA, 16 nt, Human
cgaaguccuauggaaa

SEQ ID NO: 3616604 - RNA, 17 nt, Human
cgaaguucaagaucaaa

SEQ ID NO: 3616605 - RNA, 18 nt, Human
cgaaguucaagaucaaaa

SEQ ID NO: 3616606 - RNA, 14 nt, Human
cgaauacaaaauug

SEQ ID NO: 3616607 - RNA, 21 nt, Human
cgaauauuaugcccaguuucu

SEQ ID NO: 3616608 - RNA, 12 nt, Human
aaaaaaaaaguu

SEQ ID NO: 3616609 - RNA, 13 nt, Human
aaaaaaaaaguuc

SEQ ID NO: 3616610 - RNA, 14 nt, Human
aaaaaaaaauguuc

SEQ ID NO: 3616611 - RNA, 11 nt, Human
aaaaaaaagag

SEQ ID NO: 3616612 - RNA, 12 nt, Human
aaaaaaaagcuu

SEQ ID NO: 3616613 - RNA, 14 nt, Human
aaaaaaaaguugca

SEQ ID NO: 3616614 - RNA, 13 nt, Human
aaaaaaacacaaa

SEQ ID NO: 3616615 - RNA, 11 nt, Human
aaaaaaaccaa

SEQ ID NO: 3616616 - RNA, 19 nt, Human
aaaaaaaccugagauuuau

SEQ ID NO: 3616617 - RNA, 10 nt, Human
aaaaaaacug

SEQ ID NO: 3616618 - RNA, 13 nt, Human
aaaaaaacuuuua

SEQ ID NO: 3616619 - RNA, 13 nt, Human
aaaaaaagaauaa

SEQ ID NO: 3616620 - RNA, 13 nt, Human
aaaaaaagacaag

SEQ ID NO: 3616621 - RNA, 10 nt, Human
aaaaaaagag

SEQ ID NO: 3616622 - RNA, 14 nt, Human
aaaaaaaguauuau

SEQ ID NO: 3616623 - RNA, 12 nt, Human
aaaaaaaguugu

SEQ ID NO: 3616624 - RNA, 12 nt, Human
aaaaaaauacaa

SEQ ID NO: 3616625 - RNA, 12 nt, Human
aaaaaaaucaca

SEQ ID NO: 3616626 - RNA, 14 nt, Human
aaaaaaaucugcag

SEQ ID NO: 3616627 - RNA, 13 nt, Human
aaaaaaaugaaug

SEQ ID NO: 3616628 - RNA, 12 nt, Human
aaaaaaaugacu

SEQ ID NO: 3616629 - RNA, 13 nt, Human
aaaaaaaugacua

SEQ ID NO: 3616630 - RNA, 13 nt, Human
aaaaaaauguugu

SEQ ID NO: 3616631 - RNA, 19 nt, Human
aaaaaaauugaaauguaag

SEQ ID NO: 3616632 - RNA, 11 nt, Human
aaaaaaauuua

SEQ ID NO: 3616633 - RNA, 10 nt, Human
aaaaaacuac

SEQ ID NO: 3616634 - RNA, 22 nt, Human
aaaaaacugcugacuguuuucu

SEQ ID NO: 3616635 - RNA, 11 nt, Human
aaaaaacuuuu

SEQ ID NO: 3616636 - RNA, 9 nt, Human
aaaaaagaa

SEQ ID NO: 3616637 - RNA, 12 nt, Human
aaaaaagagaca

SEQ ID NO: 3616638 - RNA, 21 nt, Human
aaaaaagaggaaagaaugaaa

SEQ ID NO: 3616639 - RNA, 13 nt, Human
aaaaaagauauau

SEQ ID NO: 3616640 - RNA, 19 nt, Human
aaaaaagauuguauugcug

SEQ ID NO: 3616641 - RNA, 11 nt, Human
aaaaaagcaug

SEQ ID NO: 3616642 - RNA, 21 nt, Human
aaaaaagcuggugggugaaag

SEQ ID NO: 3616643 - RNA, 18 nt, Human
aaaaaaggaugcaacaau

SEQ ID NO: 3616644 - RNA, 16 nt, Human
aaaaaaggcauuguuu

SEQ ID NO: 3616645 - RNA, 17 nt, Human
aaaaaagucucuauuua

SEQ ID NO: 3616646 - RNA, 16 nt, Human
aaaaaauaaaacauuu

SEQ ID NO: 3616647 - RNA, 16 nt, Human
aaaaaauacugccaga

SEQ ID NO: 3616648 - RNA, 13 nt, Human
aaaaaauacuugu

SEQ ID NO: 3616649 - RNA, 20 nt, Human
aaaaaauagaugucuuuuau

SEQ ID NO: 3616650 - RNA, 11 nt, Human
aaaaaauaugu

SEQ ID NO: 3616651 - RNA, 15 nt, Human
aaaaaaucugcagaa

SEQ ID NO: 3616652 - RNA, 12 nt, Human
aaaaaaugguuc

SEQ ID NO: 3616653 - RNA, 13 nt, Human
aaaaaauguuguu

SEQ ID NO: 3616654 - RNA, 18 nt, Human
aaaaaauuggggauucuu

SEQ ID NO: 3616655 - RNA, 23 nt, Human
aaaaaauuggggauucuuaaagu

SEQ ID NO: 3616656 - RNA, 22 nt, Human
aaaaaauuugagaaagccuuca

SEQ ID NO: 3616657 - RNA, 11 nt, Human
aaaaacaaaaa

SEQ ID NO: 3616658 - RNA, 12 nt, Human
aaaaacacagca

SEQ ID NO: 3616659 - RNA, 17 nt, Human
aaaaacaccuagcuuua

SEQ ID NO: 3616660 - RNA, 12 nt, Human
aaaaacacuagu

SEQ ID NO: 3616661 - RNA, 19 nt, Human
aaaaacagcauugcuuucu

SEQ ID NO: 3616662 - RNA, 19 nt, Human
aaaaacagccucacagaag

SEQ ID NO: 3616663 - RNA, 21 nt, Human
aaaaacagguauauacuuuga

SEQ ID NO: 3616664 - RNA, 18 nt, Human
aaaaacauaacauaaauu

SEQ ID NO: 3616665 - RNA, 14 nt, Human
aaaaacauauucuu

SEQ ID NO: 3616666 - RNA, 14 nt, Human
aaaaacauggccuu

SEQ ID NO: 3616667 - RNA, 16 nt, Human
aaaaaccacacaaaga

SEQ ID NO: 3616668 - RNA, 19 nt, Human
aaaaaccaccaaaaacaaa

SEQ ID NO: 3616669 - RNA, 16 nt, Human
aaaaaccaguauugua

SEQ ID NO: 3616670 - RNA, 16 nt, Human
aaaaaccgaauaaaug

SEQ ID NO: 3616671 - RNA, 17 nt, Human
aaaaaccgaauaaaugu

SEQ ID NO: 3616672 - RNA, 18 nt, Human
aaaaaccugagauuuauu

SEQ ID NO: 3616673 - RNA, 22 nt, Human
aaaaaccuuguauaucuuguuu

SEQ ID NO: 3616674 - RNA, 15 nt, Human
aaaaacgaaaacagu

SEQ ID NO: 3616675 - RNA, 14 nt, Human
aaaaacuaaauugu

SEQ ID NO: 3616676 - RNA, 12 nt, Human
aaaaacuauuaa

SEQ ID NO: 3616677 - RNA, 21 nt, Human
aaaaacuauucgaaugaaaag

SEQ ID NO: 3616678 - RNA, 11 nt, Human
aaaaacuauuu

SEQ ID NO: 3616679 - RNA, 23 nt, Human
aaaaacucaauuaaaauuuuguu

SEQ ID NO: 3616680 - RNA, 20 nt, Human
aaaaacucugggaaauaaga

SEQ ID NO: 3616681 - RNA, 13 nt, Human
aaaaacugaaaaa

SEQ ID NO: 3616682 - RNA, 13 nt, Human
aaaaacugaaguu

SEQ ID NO: 3616683 - RNA, 22 nt, Human
aaaaacuggaacggugaaggug

SEQ ID NO: 3616684 - RNA, 23 nt, Human
aaaaacuucauguaauuuuauuu

SEQ ID NO: 3616685 - RNA, 18 nt, Human
aaaaacuuucuacucauu

SEQ ID NO: 3616686 - RNA, 19 nt, Human
aaaaacuuucuacucauuu

SEQ ID NO: 3616687 - RNA, 21 nt, Human
aaaaacuuuggaaccagacuc

SEQ ID NO: 3616688 - RNA, 17 nt, Human
aaaaacuuuuauaaauu

SEQ ID NO: 3616689 - RNA, 18 nt, Human
aaaaacuuuuauaaauua

SEQ ID NO: 3616690 - RNA, 14 nt, Human
aaaaagaaacaaga

SEQ ID NO: 3616691 - RNA, 16 nt, Human
aaaaagaaacauuugg

SEQ ID NO: 3616692 - RNA, 15 nt, Human
aaaaagaaaggaggg

SEQ ID NO: 3616693 - RNA, 19 nt, Human
aaaaagaaaggcuguuaaa

SEQ ID NO: 3616694 - RNA, 23 nt, Human
ucaucccuucucuuccaggcagc

SEQ ID NO: 3616695 - RNA, 12 nt, Human
ucaucccuuucc

SEQ ID NO: 3616696 - RNA, 14 nt, Human
ucauccgaggcagg

SEQ ID NO: 3616697 - RNA, 15 nt, Human
ucauccggcagccug

SEQ ID NO: 3616698 - RNA, 19 nt, Human
ucauccggcagccuggaug

SEQ ID NO: 3616699 - RNA, 17 nt, Human
ucauccuaaagaacaaa

SEQ ID NO: 3616700 - RNA, 18 nt, Human
ucauccuauucuuucgaa

SEQ ID NO: 3616701 - RNA, 13 nt, Human
ucauccuccagua

SEQ ID NO: 3616702 - RNA, 21 nt, Human
ucauccuccaguaccuugcuu

SEQ ID NO: 3616703 - RNA, 13 nt, Human
ucauccuccugga

SEQ ID NO: 3616704 - RNA, 15 nt, Human
ucauccuccuggaac

SEQ ID NO: 3616705 - RNA, 12 nt, Human
ucauccucuggc

SEQ ID NO: 3616706 - RNA, 19 nt, Human
ucauccugacucugccccc

SEQ ID NO: 3616707 - RNA, 18 nt, Human
ucauccuuagcaacagcc

SEQ ID NO: 3616708 - RNA, 19 nt, Human
ucaucgaaaauucauuuca

SEQ ID NO: 3616709 - RNA, 21 nt, Human
ucaucgaaaauucauuucaca

SEQ ID NO: 3616710 - RNA, 18 nt, Human
ucaucgcguccuccuacc

SEQ ID NO: 3616711 - RNA, 14 nt, Human
ucaucuaccuagau

SEQ ID NO: 3616712 - RNA, 18 nt, Human
ucaucuaccuuuucucuu

SEQ ID NO: 3616713 - RNA, 18 nt, Human
ucaucuagcgcaauugaa

SEQ ID NO: 3616714 - RNA, 15 nt, Human
ucaucuauucaagca

SEQ ID NO: 3616715 - RNA, 15 nt, Human
ucaucuauuucugag

SEQ ID NO: 3616716 - RNA, 17 nt, Human
ucaucuauuucugagaa

SEQ ID NO: 3616717 - RNA, 12 nt, Human
ucaucuauuuug

SEQ ID NO: 3616718 - RNA, 14 nt, Human
ucaucuauuuugau

SEQ ID NO: 3616719 - RNA, 19 nt, Human
ucaucuauuuugaugcagc

SEQ ID NO: 3616720 - RNA, 20 nt, Human
ucaucuauuuugaugcagca

SEQ ID NO: 3616721 - RNA, 16 nt, Human
ucaucucaguccucaa

SEQ ID NO: 3616722 - RNA, 14 nt, Human
ucaucucauuuaag

SEQ ID NO: 3616723 - RNA, 16 nt, Human
ucaucucauuuaaggg

SEQ ID NO: 3616724 - RNA, 21 nt, Human
ucaucucauuuaagggaaaaa

SEQ ID NO: 3616725 - RNA, 21 nt, Human
ucaucucauuuaauccucccu

SEQ ID NO: 3616726 - RNA, 16 nt, Human
ucaucuccaucagcug

SEQ ID NO: 3616727 - RNA, 12 nt, Human
ucaucucccacc

SEQ ID NO: 3616728 - RNA, 11 nt, Human
ucaucucuccu

SEQ ID NO: 3616729 - RNA, 20 nt, Human
ucaucucuuagcuccccucc

SEQ ID NO: 3616730 - RNA, 21 nt, Human
ucaucucuuagcuccccucca

SEQ ID NO: 3616731 - RNA, 15 nt, Human
ucaucugaaauguua

SEQ ID NO: 3616732 - RNA, 23 nt, Human
ucaucugaaggggcaaauucuuu

SEQ ID NO: 3616733 - RNA, 20 nt, Human
ucaucugaauuugcccuggg

SEQ ID NO: 3616734 - RNA, 21 nt, Human
ucaucugaauuugcccuggga

SEQ ID NO: 3616735 - RNA, 13 nt, Human
ucaucugagaaug

SEQ ID NO: 3616736 - RNA, 21 nt, Human
ucaucugauuggacaggcaug

SEQ ID NO: 3616737 - RNA, 16 nt, Human
ucaucugcacccuucu

SEQ ID NO: 3616738 - RNA, 23 nt, Human
ucaucugcacccuucuuuucuca

SEQ ID NO: 3616739 - RNA, 13 nt, Human
ucaucugcugguc

SEQ ID NO: 3616740 - RNA, 23 nt, Human
ucaucuggauaggagccugcugg

SEQ ID NO: 3616741 - RNA, 13 nt, Human
ucaucugggaaag

SEQ ID NO: 3616742 - RNA, 12 nt, Human
ucaucugucccu

SEQ ID NO: 3616743 - RNA, 17 nt, Human
ucaucuguuuuucuuuu

SEQ ID NO: 3616744 - RNA, 23 nt, Human
ucaucuuagguuggcaaaaaggc

SEQ ID NO: 3616745 - RNA, 15 nt, Human
ucaucuuauucagca

SEQ ID NO: 3616746 - RNA, 13 nt, Human
ucaucuucacugc

SEQ ID NO: 3616747 - RNA, 12 nt, Human
ucaucuuccugu

SEQ ID NO: 3616748 - RNA, 15 nt, Human
ucaucuucucagcuc

SEQ ID NO: 3616749 - RNA, 18 nt, Human
ucaucuucucagcuccca

SEQ ID NO: 3616750 - RNA, 16 nt, Human
ucaucuucuucuuuaa

SEQ ID NO: 3616751 - RNA, 18 nt, Human
ucaucuugaagggcccag

SEQ ID NO: 3616752 - RNA, 19 nt, Human
ucaucuugacagagccugc

SEQ ID NO: 3616753 - RNA, 21 nt, Human
ucaucuugacagagccugccc

SEQ ID NO: 3616754 - RNA, 19 nt, Human
ucaucuugaccaagcagga

SEQ ID NO: 3616755 - RNA, 23 nt, Human
ucaucuugaccaagcaggaagcu

SEQ ID NO: 3616756 - RNA, 17 nt, Human
ucaucuugcuaccagua

SEQ ID NO: 3616757 - RNA, 18 nt, Human
ucaucuugcuaccaguau

SEQ ID NO: 3616758 - RNA, 21 nt, Human
ucaucuugcuaccaguauuua

SEQ ID NO: 3616759 - RNA, 14 nt, Human
ucaucuuucccucc

SEQ ID NO: 3616760 - RNA, 15 nt, Human
ucauguuuuggugaa

SEQ ID NO: 3616761 - RNA, 16 nt, Human
ucauguuuugugacua

SEQ ID NO: 3616762 - RNA, 17 nt, Human
ucauguuuugugacuau

SEQ ID NO: 3616763 - RNA, 21 nt, Human
ucauuaaaauaaauaaaugca

SEQ ID NO: 3616764 - RNA, 16 nt, Human
ucauuaaacuuuuuua

SEQ ID NO: 3616765 - RNA, 18 nt, Human
ucauuaaaggcuucucuc

SEQ ID NO: 3616766 - RNA, 12 nt, Human
ucauuaaaguuc

SEQ ID NO: 3616767 - RNA, 14 nt, Human
ucauuaaaguucua

SEQ ID NO: 3616768 - RNA, 12 nt, Human
ucauuaaauaaa

SEQ ID NO: 3616769 - RNA, 14 nt, Human
ucauuaaauaaauu

SEQ ID NO: 3616770 - RNA, 19 nt, Human
ucauuaaauaaauuugacu

SEQ ID NO: 3616771 - RNA, 14 nt, Human
ucauuaaauguuug

SEQ ID NO: 3616772 - RNA, 15 nt, Human
ucauuaaauguuuga

SEQ ID NO: 3616773 - RNA, 16 nt, Human
ucauuaaauguuugac

SEQ ID NO: 3616774 - RNA, 15 nt, Human
ucauuaaauuacuau

SEQ ID NO: 3616775 - RNA, 22 nt, Human
ucauuaaccuuaucauaaauuc

SEQ ID NO: 3616776 - RNA, 19 nt, Human
ucauuaagcccucuuccau

SEQ ID NO: 3616777 - RNA, 18 nt, Human
ucauuaaucugccucccu

SEQ ID NO: 3616778 - RNA, 14 nt, Human
ucauuacaaauggu

SEQ ID NO: 3616779 - RNA, 19 nt, Human
ucauuacccuucccugcac

SEQ ID NO: 3616780 - RNA, 21 nt, Human
ucauuacccuucccugcacua

SEQ ID NO: 3616781 - RNA, 17 nt, Human
ucauuacucuuaaggaa

SEQ ID NO: 3616782 - RNA, 14 nt, Human
ucauuacugggccu

SEQ ID NO: 3616783 - RNA, 21 nt, Human
ucauuacuugauuaagauuuu

SEQ ID NO: 3616784 - RNA, 18 nt, Human
ucauuacuuuaccacccc

SEQ ID NO: 3616785 - RNA, 20 nt, Human
ucauuagacuggaacuugaa

SEQ ID NO: 3616786 - RNA, 18 nt, Human
ucauuagccugaguagaa

SEQ ID NO: 3616787 - RNA, 13 nt, Human
ucauuagcuguga

SEQ ID NO: 3616788 - RNA, 18 nt, Human
ucauuaggugugacugaa

SEQ ID NO: 3616789 - RNA, 19 nt, Human
ucauuagucauguuuaucu

SEQ ID NO: 3616790 - RNA, 23 nt, Human
ucauuauaaacgugaugaucagc

SEQ ID NO: 3616791 - RNA, 22 nt, Human
ucauuauaaugucauuaaacau

SEQ ID NO: 3616792 - RNA, 13 nt, Human
ucauuaucucaaa

SEQ ID NO: 3616793 - RNA, 13 nt, Human
ucauuaugucaac

SEQ ID NO: 3616794 - RNA, 14 nt, Human
ucauuauuggaauu

SEQ ID NO: 3616795 - RNA, 14 nt, Human
ucauuauuggaggg

SEQ ID NO: 3616796 - RNA, 14 nt, Human
ucauuauuuaugua

SEQ ID NO: 3616797 - RNA, 16 nt, Human
ucauuauuuauguauu

SEQ ID NO: 3616798 - RNA, 15 nt, Human
ucauuauuuuauuau

SEQ ID NO: 3616799 - RNA, 16 nt, Human
ucauuauuuuauuaug

SEQ ID NO: 3616800 - RNA, 19 nt, Human
ucauuauuuuauuaugaaa

SEQ ID NO: 3616801 - RNA, 22 nt, Human
ucauuauuuuauuaugaaacuu

SEQ ID NO: 3616802 - RNA, 23 nt, Human
ucauuauuuuauuaugaaacuug

SEQ ID NO: 3616803 - RNA, 16 nt, Human
ucauucaaaaguugaa

SEQ ID NO: 3616804 - RNA, 13 nt, Human
ucauucaauaaau

SEQ ID NO: 3616805 - RNA, 22 nt, Human
ucauucacaucgcagauucucc

SEQ ID NO: 3616806 - RNA, 17 nt, Human
ucauucaccaguacauu

SEQ ID NO: 3616807 - RNA, 23 nt, Human
ucauucaccaguacauucucagu

SEQ ID NO: 3616808 - RNA, 24 nt, Human
ucauucaccaguacauucucaguu

SEQ ID NO: 3616809 - RNA, 17 nt, Human
ucauucacuucacugug

SEQ ID NO: 3616810 - RNA, 13 nt, Human
ucauucagaaaaa

SEQ ID NO: 3616811 - RNA, 23 nt, Human
ucauucagcagcaaauuuucagc

SEQ ID NO: 3616812 - RNA, 14 nt, Human
ucauucagcaucug

SEQ ID NO: 3616813 - RNA, 19 nt, Human
ucauucauggaccacuguu

SEQ ID NO: 3616814 - RNA, 18 nt, Human
ucauucauuagucauguu

SEQ ID NO: 3616815 - RNA, 17 nt, Human
ucauuccaacagugagu

SEQ ID NO: 3616816 - RNA, 16 nt, Human
ucauuccaugugccca

SEQ ID NO: 3616817 - RNA, 17 nt, Human
ucauuccaugugcccag

SEQ ID NO: 3616818 - RNA, 14 nt, Human
ucauuccauucugg

SEQ ID NO: 3616819 - RNA, 14 nt, Human
ucauuccauugccu

SEQ ID NO: 3616820 - RNA, 15 nt, Human
ucauuccauugccua

SEQ ID NO: 3616821 - RNA, 14 nt, Human
ucauuccccaggug

SEQ ID NO: 3616822 - RNA, 20 nt, Human
ucauucccucgucuuuccca

SEQ ID NO: 3616823 - RNA, 17 nt, Human
ucauucccucucaucuc

SEQ ID NO: 3616824 - RNA, 16 nt, Human
ucauuccguugucugu

SEQ ID NO: 3616825 - RNA, 13 nt, Human
ucauuccuccagg

SEQ ID NO: 3616826 - RNA, 21 nt, Human
ucauuccugaaagaaacaguu

SEQ ID NO: 3616827 - RNA, 18 nt, Human
ucauuccuuuuuauuuau

SEQ ID NO: 3616828 - RNA, 21 nt, Human
ucauucgcucccacauucuga

SEQ ID NO: 3616829 - RNA, 12 nt, Human
ucauucuccugc

SEQ ID NO: 3616830 - RNA, 16 nt, Human
ucauucuccugccugu

SEQ ID NO: 3616831 - RNA, 21 nt, Human
ucauucuccuuguguuacuaa

SEQ ID NO: 3616832 - RNA, 16 nt, Human
ucauucucugucucau

SEQ ID NO: 3616833 - RNA, 16 nt, Human
ucauucugcauugcua

SEQ ID NO: 3616834 - RNA, 15 nt, Human
ucauucuuacuaaaa

SEQ ID NO: 3616835 - RNA, 16 nt, Human
ucauucuuagcucuua

SEQ ID NO: 3616836 - RNA, 21 nt, Human
ucauucuuccaagcugagagu

SEQ ID NO: 3616837 - RNA, 17 nt, Human
ucauucuucucuagcug

SEQ ID NO: 3616838 - RNA, 17 nt, Human
ucauucuugaaagcugu

SEQ ID NO: 3616839 - RNA, 13 nt, Human
ucauugaaaucuu

SEQ ID NO: 3616840 - RNA, 11 nt, Human
ucauugaaaug

SEQ ID NO: 3616841 - RNA, 14 nt, Human
ucauugaaguauuu

SEQ ID NO: 3616842 - RNA, 20 nt, Human
ucauugacuaucaaacugaa

SEQ ID NO: 3616843 - RNA, 11 nt, Human
ucauugacuuu

SEQ ID NO: 3616844 - RNA, 14 nt, Human
ucauugacuuuuau

SEQ ID NO: 3616845 - RNA, 14 nt, Human
ucauugagaguuuu

SEQ ID NO: 3616846 - RNA, 13 nt, Human
ucauugauaugaa

SEQ ID NO: 3616847 - RNA, 15 nt, Human
ucauugauaugaaaa

SEQ ID NO: 3616848 - RNA, 17 nt, Human
ucauugauaugaaaaau

SEQ ID NO: 3616849 - RNA, 18 nt, Human
ucauugauaugaaaaaua

SEQ ID NO: 3616850 - RNA, 15 nt, Human
ucauugauuuccugu

SEQ ID NO: 3616851 - RNA, 18 nt, Human
ucauugauuuccuguguc

SEQ ID NO: 3616852 - RNA, 23 nt, Human
ucauugcacauaagcuuccauuu

SEQ ID NO: 3616853 - RNA, 23 nt, Human
ucauugccagugucuuucuuugg

SEQ ID NO: 3616854 - RNA, 14 nt, Human
ucauugccugugua

SEQ ID NO: 3616855 - RNA, 20 nt, Human
ucauugccuuaacuggagcc

SEQ ID NO: 3616856 - RNA, 18 nt, Human
ucauugcugaaaauggua

SEQ ID NO: 3616857 - RNA, 16 nt, Human
ucauugcugagccucu

SEQ ID NO: 3616858 - RNA, 22 nt, Human
ucauugcugagccucugcuccc

SEQ ID NO: 3616859 - RNA, 23 nt, Human
ucauugcugagccucugcucccc

SEQ ID NO: 3616860 - RNA, 22 nt, Human
uuuaguguaaaaaugagaacau

SEQ ID NO: 3616861 - RNA, 16 nt, Human
uuuaguguaauaagac

SEQ ID NO: 3616862 - RNA, 17 nt, Human
uuuaguuaaauuucugg

SEQ ID NO: 3616863 - RNA, 13 nt, Human
uuuaguuauaguu

SEQ ID NO: 3616864 - RNA, 15 nt, Human
uuuaguuauaguuuc

SEQ ID NO: 3616865 - RNA, 11 nt, Human
uuuaguugaau

SEQ ID NO: 3616866 - RNA, 19 nt, Human
uuuaguugcagaaacauuu

SEQ ID NO: 3616867 - RNA, 20 nt, Human
uuuaguuguaucucuuuuga

SEQ ID NO: 3616868 - RNA, 13 nt, Human
uuuaguuuuauuu

SEQ ID NO: 3616869 - RNA, 13 nt, Human
uuuaguuuucucu

SEQ ID NO: 3616870 - RNA, 12 nt, Human
uuuaguuuuuca

SEQ ID NO: 3616871 - RNA, 11 nt, Human
uuuaguuuuug

SEQ ID NO: 3616872 - RNA, 16 nt, Human
uuuauaaaaaaaauga

SEQ ID NO: 3616873 - RNA, 17 nt, Human
uuuauaaaaaauggugc

SEQ ID NO: 3616874 - RNA, 23 nt, Human
uuuauaaaaauaaaaaacacugg

SEQ ID NO: 3616875 - RNA, 19 nt, Human
uuuauaaaaauaaauagaa

SEQ ID NO: 3616876 - RNA, 14 nt, Human
uuuauaaaacuucu

SEQ ID NO: 3616877 - RNA, 22 nt, Human
uuuauaaaaguguucauuguuu

SEQ ID NO: 3616878 - RNA, 17 nt, Human
uuuauaaaauauaaaca

SEQ ID NO: 3616879 - RNA, 16 nt, Human
uuuauaaaauggcugu

SEQ ID NO: 3616880 - RNA, 20 nt, Human
uuuauaaaauuaaagaaaau

SEQ ID NO: 3616881 - RNA, 14 nt, Human
uuuauaaaauuaga

SEQ ID NO: 3616882 - RNA, 21 nt, Human
uuuauaaaauuggcaaaauua

SEQ ID NO: 3616883 - RNA, 17 nt, Human
uuuauaaaccucuaauu

SEQ ID NO: 3616884 - RNA, 18 nt, Human
uuuauaaacuuuaccuuu

SEQ ID NO: 3616885 - RNA, 17 nt, Human
uuuauaaauacugcaaa

SEQ ID NO: 3616886 - RNA, 20 nt, Human
uuuauaaauacugcaaauca

SEQ ID NO: 3616887 - RNA, 13 nt, Human
uuuauaaauccaa

SEQ ID NO: 3616888 - RNA, 14 nt, Human
uuuauaaauccagu

SEQ ID NO: 3616889 - RNA, 15 nt, Human
uuuauaaaugagcaa

SEQ ID NO: 3616890 - RNA, 15 nt, Human
uuuauaaaugcuauu

SEQ ID NO: 3616891 - RNA, 16 nt, Human
uuuauaaaugcuauuu

SEQ ID NO: 3616892 - RNA, 20 nt, Human
uuuauaacuauucaguugug

SEQ ID NO: 3616893 - RNA, 22 nt, Human
uuuauaacucaucauaaaauaa

SEQ ID NO: 3616894 - RNA, 16 nt, Human
uuuauaacuuuuuaua

SEQ ID NO: 3616895 - RNA, 12 nt, Human
uuuauaagaaaa

SEQ ID NO: 3616896 - RNA, 14 nt, Human
uuuauaagaaaaac

SEQ ID NO: 3616897 - RNA, 18 nt, Human
uuuauaagaaaaacuuuu

SEQ ID NO: 3616898 - RNA, 17 nt, Human
uuuauaagcaucauuau

SEQ ID NO: 3616899 - RNA, 14 nt, Human
uuuauaauucagua

SEQ ID NO: 3616900 - RNA, 21 nt, Human
uuuauaauuuuaagauuccuu

SEQ ID NO: 3616901 - RNA, 12 nt, Human
uuuauacaaaau

SEQ ID NO: 3616902 - RNA, 17 nt, Human
uuuauacaaaugucuua

SEQ ID NO: 3616903 - RNA, 13 nt, Human
ucagaauuaugau

SEQ ID NO: 3616904 - RNA, 20 nt, Human
ucagaauuauuuuuaaaaag

SEQ ID NO: 3616905 - RNA, 12 nt, Human
ucagaauucuca

SEQ ID NO: 3616906 - RNA, 18 nt, Human
ucagaauugaaacacuuu

SEQ ID NO: 3616907 - RNA, 23 nt, Human
ucagaauuuuauacuuucccuac

SEQ ID NO: 3616908 - RNA, 22 nt, Human
ucagacaaaauggauacauaaa

SEQ ID NO: 3616909 - RNA, 11 nt, Human
ucagacaagca

SEQ ID NO: 3616910 - RNA, 19 nt, Human
ucagacacaaacaaacaag

SEQ ID NO: 3616911 - RNA, 15 nt, Human
ucagacacccucaac

SEQ ID NO: 3616912 - RNA, 23 nt, Human
ucagacacccucaaccucuucug

SEQ ID NO: 3616913 - RNA, 14 nt, Human
ucagacacucuggc

SEQ ID NO: 3616914 - RNA, 18 nt, Human
ucagacacucuggcuggu

SEQ ID NO: 3616915 - RNA, 15 nt, Human
ucagacagaacuuga

SEQ ID NO: 3616916 - RNA, 23 nt, Human
ucagacagaacuugaauguguca

SEQ ID NO: 3616917 - RNA, 22 nt, Human
ucagacagagaggacuguaggg

SEQ ID NO: 3616918 - RNA, 16 nt, Human
ucagacagcugccugg

SEQ ID NO: 3616919 - RNA, 19 nt, Human
ucagacagcugccugggau

SEQ ID NO: 3616920 - RNA, 13 nt, Human
ucagacauaaagc

SEQ ID NO: 3616921 - RNA, 15 nt, Human
ucagacauaaagcca

SEQ ID NO: 3616922 - RNA, 19 nt, Human
ucagacaucugagguuuua

SEQ ID NO: 3616923 - RNA, 15 nt, Human
ucagacauguuuucc

SEQ ID NO: 3616924 - RNA, 14 nt, Human
ucagaccacaugcc

SEQ ID NO: 3616925 - RNA, 15 nt, Human
ucagaccauaauguu

SEQ ID NO: 3616926 - RNA, 12 nt, Human
ucagaccccagc

SEQ ID NO: 3616927 - RNA, 14 nt, Human
ucagacccccacuc

SEQ ID NO: 3616928 - RNA, 16 nt, Human
ucagacccuaccccac

SEQ ID NO: 3616929 - RNA, 18 nt, Human
ucagacccuaccccacca

SEQ ID NO: 3616930 - RNA, 14 nt, Human
ucagacccuggagg

SEQ ID NO: 3616931 - RNA, 14 nt, Human
ucagaccgucuucc

SEQ ID NO: 3616932 - RNA, 16 nt, Human
ucagaccgucuuccuc

SEQ ID NO: 3616933 - RNA, 20 nt, Human
uuuuuaaaguguuucuguua

SEQ ID NO: 3616934 - RNA, 16 nt, Human
uuuuuaaauaaaagca

SEQ ID NO: 3616935 - RNA, 15 nt, Human
uuuuuaaauaaacuu

SEQ ID NO: 3616936 - RNA, 16 nt, Human
uuuuuaaauaaacuuu

SEQ ID NO: 3616937 - RNA, 17 nt, Human
uuuuuaaauaaacuuuu

SEQ ID NO: 3616938 - RNA, 23 nt, Human
uuuuuaaauaaacuuuuuuucaa

SEQ ID NO: 3616939 - RNA, 20 nt, Human
uuuuuaaaugauguugaaua

SEQ ID NO: 3616940 - RNA, 20 nt, Human
uuuuuaaauguaaagauauu

SEQ ID NO: 3616941 - RNA, 15 nt, Human
uuuuuaaauguauac

SEQ ID NO: 3616942 - RNA, 16 nt, Human
uuuuuaaauuuuguaa

SEQ ID NO: 3616943 - RNA, 15 nt, Human
uccacaugggagccg

SEQ ID NO: 3616944 - RNA, 21 nt, Human
uccaggcacccuucuuuccuc

SEQ ID NO: 3616945 - RNA, 18 nt, Human
uccaggcagcacccaggu

SEQ ID NO: 3616946 - RNA, 17 nt, Human
uccaggcagcagacaca

SEQ ID NO: 3616947 - RNA, 13 nt, Human
uccaggcagccgc

SEQ ID NO: 3616948 - RNA, 14 nt, Human
uccaggcaggcuaa

SEQ ID NO: 3616949 - RNA, 19 nt, Human
uccaggcccaaggcucccg

SEQ ID NO: 3616950 - RNA, 21 nt, Human
uccaggccccaaaaccacagc

SEQ ID NO: 3616951 - RNA, 23 nt, Human
uccaggcccgucuguccaucugc

SEQ ID NO: 3616952 - RNA, 15 nt, Human
uccaggccugccucc

SEQ ID NO: 3616953 - RNA, 19 nt, Human
uccaggcuaguccggaccc

SEQ ID NO: 3616954 - RNA, 10 nt, Human
uccaggcucc

SEQ ID NO: 3616955 - RNA, 22 nt, Human
uccaggcucuuuggggucagcc

SEQ ID NO: 3616956 - RNA, 23 nt, Human
uccaggcucuuuggggucagcca

SEQ ID NO: 3616957 - RNA, 19 nt, Human
uccaggcugcauagaagga

SEQ ID NO: 3616958 - RNA, 23 nt, Human
uccaggcugggagagccuuccag

SEQ ID NO: 3616959 - RNA, 18 nt, Human
uccaggcugggugacaga

SEQ ID NO: 3616960 - RNA, 20 nt, Human
uccaggcugucuuucacuga

SEQ ID NO: 3616961 - RNA, 17 nt, Human
uccaggcuuggauguaa

SEQ ID NO: 3616962 - RNA, 20 nt, Human
uccaggcuuuguacagagug

SEQ ID NO: 3616963 - RNA, 12 nt, Human
uccagggaagcu

SEQ ID NO: 3616964 - RNA, 14 nt, Human
uccagggaagcugg

SEQ ID NO: 3616965 - RNA, 20 nt, Human
uccagggaauccaagccucc

SEQ ID NO: 3616966 - RNA, 17 nt, Human
uccagggacacacagcc

SEQ ID NO: 3616967 - RNA, 14 nt, Human
uccagggacagagg

SEQ ID NO: 3616968 - RNA, 19 nt, Human
uccagggacagaggcccca

SEQ ID NO: 3616969 - RNA, 19 nt, Human
uccagggagcauuuuccuc

SEQ ID NO: 3616970 - RNA, 22 nt, Human
uccagggaggggccggcccugu

SEQ ID NO: 3616971 - RNA, 17 nt, Human
uccagggccacgugcca

SEQ ID NO: 3616972 - RNA, 23 nt, Human
uccagggccacgugccaggcccg

SEQ ID NO: 3616973 - RNA, 16 nt, Human
uccagggcccugagcu

SEQ ID NO: 3616974 - RNA, 17 nt, Human
uccauaauuaugacagu

SEQ ID NO: 3616975 - RNA, 14 nt, Human
uccauacacacgcu

SEQ ID NO: 3616976 - RNA, 22 nt, Human
uccauacacuuuguugcaagau

SEQ ID NO: 3616977 - RNA, 12 nt, Human
uccauacauuug

SEQ ID NO: 3616978 - RNA, 15 nt, Human
uccauacauuugugu

SEQ ID NO: 3616979 - RNA, 15 nt, Human
uccauaccagcucgc

SEQ ID NO: 3616980 - RNA, 22 nt, Human
uccauaccagcucgcacccccc

SEQ ID NO: 3616981 - RNA, 16 nt, Human
uccauaguauauuaaa

SEQ ID NO: 3616982 - RNA, 15 nt, Human
uccauagugacuuuu

SEQ ID NO: 3616983 - RNA, 15 nt, Human
uccauaguuuugaug

SEQ ID NO: 3616984 - RNA, 20 nt, Human
uccauauauuagcauuuagu

SEQ ID NO: 3616985 - RNA, 15 nt, Human
uccauaucacacaca

SEQ ID NO: 3616986 - RNA, 19 nt, Human
uccauauccauagugacuu

SEQ ID NO: 3616987 - RNA, 23 nt, Human
uccauaucuuaaagaaacagcuu

SEQ ID NO: 3616988 - RNA, 21 nt, Human
uccauaucuugcgaauccaag

SEQ ID NO: 3616989 - RNA, 22 nt, Human
uccauaucuugcgaauccaagc

SEQ ID NO: 3616990 - RNA, 19 nt, Human
uccauaugaccucaugcau

SEQ ID NO: 3616991 - RNA, 16 nt, Human
uccauauggauccacu

SEQ ID NO: 3616992 - RNA, 19 nt, Human
uccauauuuauagguaccc

SEQ ID NO: 3616993 - RNA, 14 nt, Human
uccauauuuauuca

SEQ ID NO: 3616994 - RNA, 17 nt, Human
uccauauuuuauuacug

SEQ ID NO: 3616995 - RNA, 22 nt, Human
uccauauuuuuuuccuuacaua

SEQ ID NO: 3616996 - RNA, 17 nt, Human
uccaucacccucuuccu

SEQ ID NO: 3616997 - RNA, 19 nt, Human
uccaucacguuagcugucc

SEQ ID NO: 3616998 - RNA, 17 nt, Human
uccaucaguuagagcug

SEQ ID NO: 3616999 - RNA, 18 nt, Human
uccaucaguuagagcuga

SEQ ID NO: 3617000 - RNA, 14 nt, Human
uccaucaugucccc

SEQ ID NO: 3617001 - RNA, 21 nt, Human
uccauccaaggccagguucuc

SEQ ID NO: 3617002 - RNA, 15 nt, Human
uccauccacauggga

SEQ ID NO: 3617003 - RNA, 17 nt, Human
uccauccauggccagca

SEQ ID NO: 3617004 - RNA, 22 nt, Human
uccaucccaaccagugccaagg

SEQ ID NO: 3617005 - RNA, 12 nt, Human
uccaucccagag

SEQ ID NO: 3617006 - RNA, 12 nt, Human
uccaucccucua

SEQ ID NO: 3617007 - RNA, 20 nt, Human
uccaucccuggcccccuccc

SEQ ID NO: 3617008 - RNA, 16 nt, Human
uccauccuccuccuuc

SEQ ID NO: 3617009 - RNA, 17 nt, Human
uccauccuccuccuucc

SEQ ID NO: 3617010 - RNA, 20 nt, Human
uccauccuugagucaaaaaa

SEQ ID NO: 3617011 - RNA, 21 nt, Human
uccaucuccuauaaucuguca

SEQ ID NO: 3617012 - RNA, 14 nt, Human
uccaucucgccacc

SEQ ID NO: 3617013 - RNA, 23 nt, Human
uccaucucgccaccccuccuucc

SEQ ID NO: 3617014 - RNA, 14 nt, Human
uccaucucucaucc

SEQ ID NO: 3617015 - RNA, 17 nt, Human
uccaucucucuggcccu

SEQ ID NO: 3617016 - RNA, 20 nt, Human
uccaucucuugcuuguuccu

SEQ ID NO: 3617017 - RNA, 17 nt, Human
uccaucugauuccagca

SEQ ID NO: 3617018 - RNA, 18 nt, Human
uccaucugcccgccugcc

SEQ ID NO: 3617019 - RNA, 20 nt, Human
uccaucugcccgccugccca

SEQ ID NO: 3617020 - RNA, 17 nt, Human
uccaucugguuuucucu

SEQ ID NO: 3617021 - RNA, 17 nt, Human
uccaucuguacuugguc

SEQ ID NO: 3617022 - RNA, 14 nt, Human
uccaucuucagcuu

SEQ ID NO: 3617023 - RNA, 23 nt, Human
uccaucuucagcuucuucaucuu

SEQ ID NO: 3617024 - RNA, 15 nt, Human
uccaucuucuuugca

SEQ ID NO: 3617025 - RNA, 18 nt, Human
uccaucuuuccugauggc

SEQ ID NO: 3617026 - RNA, 16 nt, Human
ucccagggccugucuc

SEQ ID NO: 3617027 - RNA, 19 nt, Human
ucccagggcuacucacuca

SEQ ID NO: 3617028 - RNA, 21 nt, Human
ucccagggcuacucacucaag

SEQ ID NO: 3617029 - RNA, 14 nt, Human
ucccagggcuuacg

SEQ ID NO: 3617030 - RNA, 18 nt, Human
ucccaggggaccacaccu

SEQ ID NO: 3617031 - RNA, 21 nt, Human
ucccaggggcccaaggcggcc

SEQ ID NO: 3617032 - RNA, 22 nt, Human
ucccaggggcccaaggcggccc

SEQ ID NO: 3617033 - RNA, 18 nt, Human
ucccaggggcuggcuuca

SEQ ID NO: 3617034 - RNA, 20 nt, Human
ucccaggggucucccuggcu

SEQ ID NO: 3617035 - RNA, 22 nt, Human
ucccaggggucucccuggcucc

SEQ ID NO: 3617036 - RNA, 14 nt, Human
ucccaggguuuuaa

SEQ ID NO: 3617037 - RNA, 18 nt, Human
ucccaggguuuuaacuuu

SEQ ID NO: 3617038 - RNA, 20 nt, Human
ucccaggguuuuaacuuugu

SEQ ID NO: 3617039 - RNA, 18 nt, Human
ucccagguaagcaggagg

SEQ ID NO: 3617040 - RNA, 16 nt, Human
ucccagguuggcucug

SEQ ID NO: 3617041 - RNA, 17 nt, Human
ucccaguaccuccuguc

SEQ ID NO: 3617042 - RNA, 15 nt, Human
ucccaguagaaaaua

SEQ ID NO: 3617043 - RNA, 14 nt, Human
ucccagucauuuaa

SEQ ID NO: 3617044 - RNA, 22 nt, Human
ucccagucauuuaauaaaugug

SEQ ID NO: 3617045 - RNA, 15 nt, Human
ucccagucuacccag

SEQ ID NO: 3617046 - RNA, 16 nt, Human
ucccagucucuggcag

SEQ ID NO: 3617047 - RNA, 20 nt, Human
ucccaguggccucaacccuc

SEQ ID NO: 3617048 - RNA, 17 nt, Human
ucccaguggcugcugcc

SEQ ID NO: 3617049 - RNA, 23 nt, Human
ucccaguggcugcugcccaggcc

SEQ ID NO: 3617050 - RNA, 21 nt, Human
ucccagugggaggggcaggcu

SEQ ID NO: 3617051 - RNA, 23 nt, Human
ucccaguucaggagucccaagga

SEQ ID NO: 3617052 - RNA, 15 nt, Human
ucccauaugccuggg

SEQ ID NO: 3617053 - RNA, 21 nt, Human
ucccauauuggcauggauuuc

SEQ ID NO: 3617054 - RNA, 22 nt, Human
ucccaucauuacccuucccugc

SEQ ID NO: 3617055 - RNA, 12 nt, Human
ucccauccaggc

SEQ ID NO: 3617056 - RNA, 18 nt, Human
ucccauccagugucucac

SEQ ID NO: 3617057 - RNA, 22 nt, Human
ucccaucccagcugaaauacug

SEQ ID NO: 3617058 - RNA, 15 nt, Human
ucccauccccagcga

SEQ ID NO: 3617059 - RNA, 14 nt, Human
ucccaucccccugc

SEQ ID NO: 3617060 - RNA, 15 nt, Human
ucccaucccccugcc

SEQ ID NO: 3617061 - RNA, 15 nt, Human
ucccaucccgcucuu

SEQ ID NO: 3617062 - RNA, 12 nt, Human
ucccaucccugc

SEQ ID NO: 3617063 - RNA, 14 nt, Human
ucccaucccugcgu

SEQ ID NO: 3617064 - RNA, 16 nt, Human
ucccauccuguguguu

SEQ ID NO: 3617065 - RNA, 20 nt, Human
ucccaucgucucggccuuca

SEQ ID NO: 3617066 - RNA, 13 nt, Human
ucccaucuaggga

SEQ ID NO: 3617067 - RNA, 19 nt, Human
ucccaucugggaguccccu

SEQ ID NO: 3617068 - RNA, 23 nt, Human
ucccaucugggaguccccuuuuc

SEQ ID NO: 3617069 - RNA, 15 nt, Human
ucccaucuggucauu

SEQ ID NO: 3617070 - RNA, 20 nt, Human
ucccaucuggucauuugguu

SEQ ID NO: 3617071 - RNA, 19 nt, Human
ucccaucuuaacucuuugc

SEQ ID NO: 3617072 - RNA, 16 nt, Human
ucccaugaacacacug

SEQ ID NO: 3617073 - RNA, 19 nt, Human
ucccaugaacacacugugu

SEQ ID NO: 3617074 - RNA, 14 nt, Human
ucccaugaagccuu

SEQ ID NO: 3617075 - RNA, 15 nt, Human
ucccaugaagccuuu

SEQ ID NO: 3617076 - RNA, 17 nt, Human
ucccaugaagccuuuug

SEQ ID NO: 3617077 - RNA, 21 nt, Human
ucccaugaagccuuuugaaag

SEQ ID NO: 3617078 - RNA, 20 nt, Human
ucccaugacccaccccugug

SEQ ID NO: 3617079 - RNA, 19 nt, Human
ucccaugacccaggcuggg

SEQ ID NO: 3617080 - RNA, 20 nt, Human
ucccaugacccaggcugggc

SEQ ID NO: 3617081 - RNA, 21 nt, Human
ucccaugagacccuggugccu

SEQ ID NO: 3617082 - RNA, 22 nt, Human
ucccaugagacccuggugccug

SEQ ID NO: 3617083 - RNA, 19 nt, Human
ucccaugagccucagcauc

SEQ ID NO: 3617084 - RNA, 23 nt, Human
ucccaugagggagaugccaugag

SEQ ID NO: 3617085 - RNA, 15 nt, Human
ucccaugaucccugu

SEQ ID NO: 3617086 - RNA, 11 nt, Human
uccccagcccc

SEQ ID NO: 3617087 - RNA, 21 nt, Human
uccccagccccuagcccagga

SEQ ID NO: 3617088 - RNA, 21 nt, Human
uccccagcccuuccucugcuc

SEQ ID NO: 3617089 - RNA, 13 nt, Human
uccccagccugcg

SEQ ID NO: 3617090 - RNA, 14 nt, Human
uccccagccugcgc

SEQ ID NO: 3617091 - RNA, 15 nt, Human
uccccagccugggcc

SEQ ID NO: 3617092 - RNA, 17 nt, Human
uccccagccugggccca

SEQ ID NO: 3617093 - RNA, 23 nt, Human
uccccagcgauucccucucccag

SEQ ID NO: 3617094 - RNA, 17 nt, Human
uccccagcucaccccug

SEQ ID NO: 3617095 - RNA, 17 nt, Human
uccccagcucccaggac

SEQ ID NO: 3617096 - RNA, 15 nt, Human
uccccagcuguuuau

SEQ ID NO: 3617097 - RNA, 14 nt, Human
uccccaggaggcca

SEQ ID NO: 3617098 - RNA, 15 nt, Human
uccccaggaggccag

SEQ ID NO: 3617099 - RNA, 16 nt, Human
uccccaggaggccagc

SEQ ID NO: 3617100 - RNA, 17 nt, Human
uccccaggaggccagcc

SEQ ID NO: 3617101 - RNA, 12 nt, Human
uccccaggccag

SEQ ID NO: 3617102 - RNA, 14 nt, Human
uccccaggccaggc

SEQ ID NO: 3617103 - RNA, 13 nt, Human
uccccaggcccca

SEQ ID NO: 3617104 - RNA, 19 nt, Human
uccccagggaagcagcagc

SEQ ID NO: 3617105 - RNA, 20 nt, Human
uccccagggaagcagcagcc

SEQ ID NO: 3617106 - RNA, 18 nt, Human
uccccaggggaaaaugaa

SEQ ID NO: 3617107 - RNA, 14 nt, Human
uccccaggggagag

SEQ ID NO: 3617108 - RNA, 18 nt, Human
uccccaggggucccagcc

SEQ ID NO: 3617109 - RNA, 20 nt, Human
uccccaggggucccagccac

SEQ ID NO: 3617110 - RNA, 22 nt, Human
uccccaggggucccagccaccc

SEQ ID NO: 3617111 - RNA, 22 nt, Human
uccccagguggcugacccaguc

SEQ ID NO: 3617112 - RNA, 14 nt, Human
uccccaguaaaauu

SEQ ID NO: 3617113 - RNA, 22 nt, Human
uccccagucucucuuaaaguug

SEQ ID NO: 3617114 - RNA, 15 nt, Human
uccccagugaaaacu

SEQ ID NO: 3617115 - RNA, 17 nt, Human
uccccauaacucaaugg

SEQ ID NO: 3617116 - RNA, 19 nt, Human
uccccauacucugucuccc

SEQ ID NO: 3617117 - RNA, 17 nt, Human
uccccauccuccagcuu

SEQ ID NO: 3617118 - RNA, 19 nt, Human
uccccaucgccagcugaug

SEQ ID NO: 3617119 - RNA, 20 nt, Human
uccccaucgccagcugauga

SEQ ID NO: 3617120 - RNA, 15 nt, Human
uccccaucucccugc

SEQ ID NO: 3617121 - RNA, 16 nt, Human
uccccaucucccugcc

SEQ ID NO: 3617122 - RNA, 20 nt, Human
uccccaucucccugccuggc

SEQ ID NO: 3617123 - RNA, 11 nt, Human
uccccaugaca

SEQ ID NO: 3617124 - RNA, 16 nt, Human
uccccaugccuguggc

SEQ ID NO: 3617125 - RNA, 18 nt, Human
uccccaugcuuccuugcc

SEQ ID NO: 3617126 - RNA, 15 nt, Human
uccccauggagccag

SEQ ID NO: 3617127 - RNA, 16 nt, Human
uccccauggagccagc

SEQ ID NO: 3617128 - RNA, 17 nt, Human
uccccauggcccugagc

SEQ ID NO: 3617129 - RNA, 20 nt, Human
uccccaugugccugcaccag

SEQ ID NO: 3617130 - RNA, 18 nt, Human
uccccauuucccaucugc

SEQ ID NO: 3617131 - RNA, 20 nt, Human
uccccauuucccaucugcac

SEQ ID NO: 3617132 - RNA, 12 nt, Human
ucccccaaaguu

SEQ ID NO: 3617133 - RNA, 17 nt, Human
ucccccaaaguucacaa

SEQ ID NO: 3617134 - RNA, 19 nt, Human
uccgacucuuucugagugc

SEQ ID NO: 3617135 - RNA, 22 nt, Human
uccgacuugaauuuucccacug

SEQ ID NO: 3617136 - RNA, 19 nt, Human
uccgagccggggaguuucu

SEQ ID NO: 3617137 - RNA, 23 nt, Human
uccgaggggcgggacccaggcac

SEQ ID NO: 3617138 - RNA, 13 nt, Human
uccgaguguguuu

SEQ ID NO: 3617139 - RNA, 23 nt, Human
uccgaguguguuucauccuuccc

SEQ ID NO: 3617140 - RNA, 14 nt, Human
uccgauccuuccuc

SEQ ID NO: 3617141 - RNA, 15 nt, Human
uccgcagaagcccug

SEQ ID NO: 3617142 - RNA, 15 nt, Human
uccgcaggugcuggu

SEQ ID NO: 3617143 - RNA, 16 nt, Human
uccgcaggugcugguc

SEQ ID NO: 3617144 - RNA, 14 nt, Human
uccgcagugagaga

SEQ ID NO: 3617145 - RNA, 19 nt, Human
uccgcaguguggccaggcu

SEQ ID NO: 3617146 - RNA, 21 nt, Human
uccgcaucccuaccgacccag

SEQ ID NO: 3617147 - RNA, 18 nt, Human
uccgccaaugcacggccu

SEQ ID NO: 3617148 - RNA, 12 nt, Human
uccgccagccuc

SEQ ID NO: 3617149 - RNA, 18 nt, Human
uccgccagggcccacacc

SEQ ID NO: 3617150 - RNA, 19 nt, Human
uccgccagggcccacaccc

SEQ ID NO: 3617151 - RNA, 14 nt, Human
uccgcccccagccu

SEQ ID NO: 3617152 - RNA, 14 nt, Human
uccgcccccaggua

SEQ ID NO: 3617153 - RNA, 15 nt, Human
uccgcccccagguag

SEQ ID NO: 3617154 - RNA, 16 nt, Human
uccgccccugagccca

SEQ ID NO: 3617155 - RNA, 17 nt, Human
uccgccccugagcccac

SEQ ID NO: 3617156 - RNA, 19 nt, Human
uccgccccugagcccacug

SEQ ID NO: 3617157 - RNA, 17 nt, Human
uccgccccuucccuucc

SEQ ID NO: 3617158 - RNA, 15 nt, Human
uccgcccugccacuc

SEQ ID NO: 3617159 - RNA, 16 nt, Human
uccgcccugccacuca

SEQ ID NO: 3617160 - RNA, 12 nt, Human
uccgcccugcuc

SEQ ID NO: 3617161 - RNA, 20 nt, Human
uccgcucauacaggaaugaa

SEQ ID NO: 3617162 - RNA, 18 nt, Human
uccgcucucuuccugccc

SEQ ID NO: 3617163 - RNA, 14 nt, Human
uccgcugccagccu

SEQ ID NO: 3617164 - RNA, 14 nt, Human
uccgcugccgugcc

SEQ ID NO: 3617165 - RNA, 14 nt, Human
uccgcuggaggugg

SEQ ID NO: 3617166 - RNA, 22 nt, Human
uccgcuuggagcuauuuuccag

SEQ ID NO: 3617167 - RNA, 15 nt, Human
uccggaauccugucc

SEQ ID NO: 3617168 - RNA, 16 nt, Human
uccggauccuaagcau

SEQ ID NO: 3617169 - RNA, 16 nt, Human
uccggcaccaguagca

SEQ ID NO: 3617170 - RNA, 18 nt, Human
uccggcaccaguagcagg

SEQ ID NO: 3617171 - RNA, 18 nt, Human
uccggcaguucugggugc

SEQ ID NO: 3617172 - RNA, 11 nt, Human
uccggccaggu

SEQ ID NO: 3617173 - RNA, 20 nt, Human
uccggccaggugccuccuga

SEQ ID NO: 3617174 - RNA, 14 nt, Human
uccggcccccagag

SEQ ID NO: 3617175 - RNA, 18 nt, Human
uccggcccccagagcgcc

SEQ ID NO: 3617176 - RNA, 15 nt, Human
uccggccucuccagc

SEQ ID NO: 3617177 - RNA, 19 nt, Human
uccggccucuccagccuca

SEQ ID NO: 3617178 - RNA, 14 nt, Human
uccggccucugccu

SEQ ID NO: 3617179 - RNA, 19 nt, Human
uccggccucugccuuugca

SEQ ID NO: 3617180 - RNA, 21 nt, Human
uccggccugaugacagagcga

SEQ ID NO: 3617181 - RNA, 15 nt, Human
uccggcgucagccuc

SEQ ID NO: 3617182 - RNA, 16 nt, Human
uccggcgucagccucc

SEQ ID NO: 3617183 - RNA, 19 nt, Human
uccggcgucagccuccagc

SEQ ID NO: 3617184 - RNA, 22 nt, Human
uccggcgucagccuccagccuc

SEQ ID NO: 3617185 - RNA, 15 nt, Human
uccggcucccagccu

SEQ ID NO: 3617186 - RNA, 16 nt, Human
uccggcucccagccuc

SEQ ID NO: 3617187 - RNA, 17 nt, Human
uccggcucccagccuca

SEQ ID NO: 3617188 - RNA, 15 nt, Human
uccggcugugcuggg

SEQ ID NO: 3617189 - RNA, 16 nt, Human
uccggcugugcuggga

SEQ ID NO: 3617190 - RNA, 16 nt, Human
uccgggacccccagga

SEQ ID NO: 3617191 - RNA, 18 nt, Human
uccgggacccccaggaca

SEQ ID NO: 3617192 - RNA, 23 nt, Human
uccgggagggugcggcugugcag

SEQ ID NO: 3617193 - RNA, 18 nt, Human
uccgggcaaaugccaggg

SEQ ID NO: 3617194 - RNA, 16 nt, Human
uccggggccagcuccg

SEQ ID NO: 3617195 - RNA, 20 nt, Human
uccgggggggcccaucucuu

SEQ ID NO: 3617196 - RNA, 17 nt, Human
uccgguagggaggcagc

SEQ ID NO: 3617197 - RNA, 18 nt, Human
uccgguagggaggcagcc

SEQ ID NO: 3617198 - RNA, 18 nt, Human
uccggucgugucucuggu

SEQ ID NO: 3617199 - RNA, 15 nt, Human
uccggugugccugca

SEQ ID NO: 3617200 - RNA, 14 nt, Human
uccgguguucuaag

SEQ ID NO: 3617201 - RNA, 16 nt, Human
uccgguguucuaagau

SEQ ID NO: 3617202 - RNA, 18 nt, Human
uccgguguuuaagacauu

SEQ ID NO: 3617203 - RNA, 14 nt, Human
uccgguugcauacu

SEQ ID NO: 3617204 - RNA, 18 nt, Human
uccgguugcauacuggac

SEQ ID NO: 3617205 - RNA, 16 nt, Human
uccguaacccaacucu

SEQ ID NO: 3617206 - RNA, 16 nt, Human
uccgucacuaccuggc

SEQ ID NO: 3617207 - RNA, 14 nt, Human
uccguccccugccc

SEQ ID NO: 3617208 - RNA, 16 nt, Human
uccguccucgauggga

SEQ ID NO: 3617209 - RNA, 20 nt, Human
uccgucuaagucaugagcug

SEQ ID NO: 3617210 - RNA, 20 nt, Human
uccgugagugaaccaucauu

SEQ ID NO: 3617211 - RNA, 16 nt, Human
uccgugccuccaccac

SEQ ID NO: 3617212 - RNA, 17 nt, Human
uccgugccuccaccacc

SEQ ID NO: 3617213 - RNA, 17 nt, Human
uccgugcugacagcugc

SEQ ID NO: 3617214 - RNA, 16 nt, Human
uccgugcuuccucagu

SEQ ID NO: 3617215 - RNA, 12 nt, Human
uccguggaggag

SEQ ID NO: 3617216 - RNA, 16 nt, Human
uccgugggacggugcc

SEQ ID NO: 3617217 - RNA, 16 nt, Human
uccguggguugcuaac

SEQ ID NO: 3617218 - RNA, 16 nt, Human
uccguuagcuccugug

SEQ ID NO: 3617219 - RNA, 13 nt, Human
uccuaaaacaaca

SEQ ID NO: 3617220 - RNA, 20 nt, Human
uccuaaaacaacagauguac

SEQ ID NO: 3617221 - RNA, 22 nt, Human
uccuaaaagcaaaauaaaaacu

SEQ ID NO: 3617222 - RNA, 18 nt, Human
uccuaaaaggcccagaga

SEQ ID NO: 3617223 - RNA, 21 nt, Human
uccuaaaaggcccagagagaa

SEQ ID NO: 3617224 - RNA, 22 nt, Human
uccuaaaauaagggcagaguca

SEQ ID NO: 3617225 - RNA, 21 nt, Human
uccuaaacaucauucauuuuu

SEQ ID NO: 3617226 - RNA, 23 nt, Human
uccuaaagaaaaauaucuuggcc

SEQ ID NO: 3617227 - RNA, 12 nt, Human
uccuaaauguau

SEQ ID NO: 3617228 - RNA, 20 nt, Human
uccuaaauuuuccuguccuc

SEQ ID NO: 3617229 - RNA, 20 nt, Human
uccuaacaaaagaugaaagc

SEQ ID NO: 3617230 - RNA, 16 nt, Human
uccuaacacagcaugu

SEQ ID NO: 3617231 - RNA, 13 nt, Human
uccuaacccuggc

SEQ ID NO: 3617232 - RNA, 23 nt, Human
uccuaagaaauaugugagauuuu

SEQ ID NO: 3617233 - RNA, 22 nt, Human
uccuaagaagcuucuaauaaau

SEQ ID NO: 3617234 - RNA, 13 nt, Human
uccuaagacacaa

SEQ ID NO: 3617235 - RNA, 15 nt, Human
uccuaagaccugggg

SEQ ID NO: 3617236 - RNA, 19 nt, Human
uccuaagagugcugggcau

SEQ ID NO: 3617237 - RNA, 23 nt, Human
uccuaagauguguucuuauuuuu

SEQ ID NO: 3617238 - RNA, 16 nt, Human
uccuaagcaucuaagu

SEQ ID NO: 3617239 - RNA, 17 nt, Human
uccuaagcaucuaaguu

SEQ ID NO: 3617240 - RNA, 13 nt, Human
uccuaagccugug

SEQ ID NO: 3617241 - RNA, 21 nt, Human
uccuaagcuauucaguaauaa

SEQ ID NO: 3617242 - RNA, 12 nt, Human
uccuaaggacac

SEQ ID NO: 3617243 - RNA, 16 nt, Human
uccuaaggacacacua

SEQ ID NO: 3617244 - RNA, 17 nt, Human
uccuaaggacacacuaa

SEQ ID NO: 3617245 - RNA, 21 nt, Human
uccuaagggucgaaagcucua

SEQ ID NO: 3617246 - RNA, 12 nt, Human
uccuaauaaaaa

SEQ ID NO: 3617247 - RNA, 13 nt, Human
uccuaauaaaaag

SEQ ID NO: 3617248 - RNA, 19 nt, Human
uccuaauaauaucccacug

SEQ ID NO: 3617249 - RNA, 14 nt, Human
uccuaauacuguca

SEQ ID NO: 3617250 - RNA, 15 nt, Human
uccuaauacugucau

SEQ ID NO: 3617251 - RNA, 16 nt, Human
uccuaaucuucugaac

SEQ ID NO: 3617252 - RNA, 24 nt, Human
uccuaauggugaugcagucuuaga

SEQ ID NO: 3617253 - RNA, 18 nt, Human
uccuaauucuucuguccu

SEQ ID NO: 3617254 - RNA, 19 nt, Human
uccuaauuucuccucccuu

SEQ ID NO: 3617255 - RNA, 14 nt, Human
uccuacaaagaugu

SEQ ID NO: 3617256 - RNA, 12 nt, Human
uccuacacagga

SEQ ID NO: 3617257 - RNA, 17 nt, Human
uccuacacccuuggacu

SEQ ID NO: 3617258 - RNA, 16 nt, Human
uccuacaccuaacuca

SEQ ID NO: 3617259 - RNA, 20 nt, Human
uccuacagcacuacugggug

SEQ ID NO: 3617260 - RNA, 17 nt, Human
uccuacagccccuuuuu

SEQ ID NO: 3617261 - RNA, 19 nt, Human
uccuacaggcagucucucu

SEQ ID NO: 3617262 - RNA, 18 nt, Human
uccuacauaucccuucca

SEQ ID NO: 3617263 - RNA, 13 nt, Human
uccuaccaaugca

SEQ ID NO: 3617264 - RNA, 21 nt, Human
uccuaccaaugcaugcagcca

SEQ ID NO: 3617265 - RNA, 15 nt, Human
uccuacccaaccacu

SEQ ID NO: 3617266 - RNA, 14 nt, Human
uccuacccaucccc

SEQ ID NO: 3617267 - RNA, 15 nt, Human
uccuacccauccccg

SEQ ID NO: 3617268 - RNA, 16 nt, Human
uccuaccccaauuccu

SEQ ID NO: 3617269 - RNA, 16 nt, Human
uccuacccccugugcc

SEQ ID NO: 3617270 - RNA, 17 nt, Human
uccuacccccugugccu

SEQ ID NO: 3617271 - RNA, 13 nt, Human
uccuaccccuccc

SEQ ID NO: 3617272 - RNA, 15 nt, Human
uccuaccccucccag

SEQ ID NO: 3617273 - RNA, 21 nt, Human
uccuacccucgggcccaccug

SEQ ID NO: 3617274 - RNA, 13 nt, Human
uccuacccuuuuc

SEQ ID NO: 3617275 - RNA, 13 nt, Human
uccuaccucagcc

SEQ ID NO: 3617276 - RNA, 17 nt, Human
uccuaccucagccuaga

SEQ ID NO: 3617277 - RNA, 13 nt, Human
uccuaccucccug

SEQ ID NO: 3617278 - RNA, 15 nt, Human
uccuaccugcccugg

SEQ ID NO: 3617279 - RNA, 15 nt, Human
ucucugcagccagcc

SEQ ID NO: 3617280 - RNA, 17 nt, Human
ucucugcagccagccca

SEQ ID NO: 3617281 - RNA, 13 nt, Human
ucucugcagcugc

SEQ ID NO: 3617282 - RNA, 16 nt, Human
ucucugcaggucccua

SEQ ID NO: 3617283 - RNA, 19 nt, Human
ucucugcaggucccuaaua

SEQ ID NO: 3617284 - RNA, 22 nt, Human
ucucugcaggucccuaauaaag

SEQ ID NO: 3617285 - RNA, 13 nt, Human
ucucugcaucuga

SEQ ID NO: 3617286 - RNA, 10 nt, Human
ucucugccau

SEQ ID NO: 3617287 - RNA, 22 nt, Human
ucucugcccuaaugcgcaggcu

SEQ ID NO: 3617288 - RNA, 11 nt, Human
ucucugcccuc

SEQ ID NO: 3617289 - RNA, 15 nt, Human
ucucugccggcucuu

SEQ ID NO: 3617290 - RNA, 19 nt, Human
ucucugccggcucuuuccu

SEQ ID NO: 3617291 - RNA, 21 nt, Human
ucucugccucccucacccuga

SEQ ID NO: 3617292 - RNA, 16 nt, Human
ucucugccuugccuuu

SEQ ID NO: 3617293 - RNA, 21 nt, Human
ucucugcgugcagggacaaag

SEQ ID NO: 3617294 - RNA, 17 nt, Human
ucucugcuccaccacau

SEQ ID NO: 3617295 - RNA, 17 nt, Human
ucucugcucgcccuccu

SEQ ID NO: 3617296 - RNA, 22 nt, Human
ucucugcucugcgugucaccug

SEQ ID NO: 3617297 - RNA, 11 nt, Human
ucucugcugcc

SEQ ID NO: 3617298 - RNA, 16 nt, Human
ucucugcuggcccagc

SEQ ID NO: 3617299 - RNA, 11 nt, Human
ucucugcuuca

SEQ ID NO: 3617300 - RNA, 19 nt, Human
ucucugcuugagucagguu

SEQ ID NO: 3617301 - RNA, 14 nt, Human
ucucugcuuuaaag

SEQ ID NO: 3617302 - RNA, 19 nt, Human
ucucuggaagccccugggc

SEQ ID NO: 3617303 - RNA, 19 nt, Human
ucucuggcccuucuugccu

SEQ ID NO: 3617304 - RNA, 19 nt, Human
ucucuggccucccacccga

SEQ ID NO: 3617305 - RNA, 12 nt, Human
ucucuggccuuc

SEQ ID NO: 3617306 - RNA, 16 nt, Human
ucucuggccuucggcc

SEQ ID NO: 3617307 - RNA, 17 nt, Human
ucucuggccuucggccu

SEQ ID NO: 3617308 - RNA, 17 nt, Human
ucucuggcgacaguuuu

SEQ ID NO: 3617309 - RNA, 22 nt, Human
ucucuggcgacaguuuuccuuc

SEQ ID NO: 3617310 - RNA, 13 nt, Human
ucucuggcugggg

SEQ ID NO: 3617311 - RNA, 14 nt, Human
ucucuggcugggga

SEQ ID NO: 3617312 - RNA, 22 nt, Human
ucucuggcuguaaggcucuaga

SEQ ID NO: 3617313 - RNA, 23 nt, Human
ucucuggcuguaaggcucuagau

SEQ ID NO: 3617314 - RNA, 19 nt, Human
ucucugggagaaaaucauc

SEQ ID NO: 3617315 - RNA, 12 nt, Human
ucucugggcugg

SEQ ID NO: 3617316 - RNA, 20 nt, Human
ucucugggcuggaugagcuc

SEQ ID NO: 3617317 - RNA, 22 nt, Human
ucucugggcuggaugagcuccc

SEQ ID NO: 3617318 - RNA, 12 nt, Human
ucucuguaaagc

SEQ ID NO: 3617319 - RNA, 14 nt, Human
ucucuguaaagcua

SEQ ID NO: 3617320 - RNA, 16 nt, Human
ucucuguacuuuucau

SEQ ID NO: 3617321 - RNA, 19 nt, Human
ucucugucacccuuguccu

SEQ ID NO: 3617322 - RNA, 16 nt, Human
ucucugucccuugcug

SEQ ID NO: 3617323 - RNA, 19 nt, Human
ucucugucccuugcuguau

SEQ ID NO: 3617324 - RNA, 12 nt, Human
ucucugucucau

SEQ ID NO: 3617325 - RNA, 21 nt, Human
ucucugucucauccaucauca

SEQ ID NO: 3617326 - RNA, 13 nt, Human
ucucugugaccca

SEQ ID NO: 3617327 - RNA, 22 nt, Human
ucucugugagacucgagaacuu

SEQ ID NO: 3617328 - RNA, 15 nt, Human
ucucugugcugugga

SEQ ID NO: 3617329 - RNA, 11 nt, Human
ucucugugcuu

SEQ ID NO: 3617330 - RNA, 20 nt, Human
ucucugugucuaagauucua

SEQ ID NO: 3617331 - RNA, 10 nt, Human
ucucuguguu

SEQ ID NO: 3617332 - RNA, 16 nt, Human
ucucuguucauuuccu

SEQ ID NO: 3617333 - RNA, 22 nt, Human
ucucuguuccaugucuccuuua

SEQ ID NO: 3617334 - RNA, 18 nt, Human
ucucuguugacuggcugu

SEQ ID NO: 3617335 - RNA, 18 nt, Human
ucucuuaaacuugugaau

SEQ ID NO: 3617336 - RNA, 22 nt, Human
ucucuuaagacagcauguguua

SEQ ID NO: 3617337 - RNA, 22 nt, Human
ucucuuacgcccaacccuuccc

SEQ ID NO: 3617338 - RNA, 18 nt, Human
ucucuuagcuccccucca

SEQ ID NO: 3617339 - RNA, 21 nt, Human
ucucuuauagaauauuuauua

SEQ ID NO: 3617340 - RNA, 16 nt, Human
ucucuuauggaugucc

SEQ ID NO: 3617341 - RNA, 19 nt, Human
ucucuucagacucucagcc

SEQ ID NO: 3617342 - RNA, 14 nt, Human
ucucuucagguucu

SEQ ID NO: 3617343 - RNA, 23 nt, Human
ucucuucagguucuuagugucac

SEQ ID NO: 3617344 - RNA, 23 nt, Human
ucucuuccaaccauuuaucuuga

SEQ ID NO: 3617345 - RNA, 16 nt, Human
ucucuuccacauguua

SEQ ID NO: 3617346 - RNA, 16 nt, Human
ucucuuccaggcagcc

SEQ ID NO: 3617347 - RNA, 23 nt, Human
ucucuucccuuuccccagcauca

SEQ ID NO: 3617348 - RNA, 13 nt, Human
ucucuuccugccc

SEQ ID NO: 3617349 - RNA, 18 nt, Human
ucucuuccugccccucuu

SEQ ID NO: 3617350 - RNA, 22 nt, Human
ucucuuccugccccucuuucuc

SEQ ID NO: 3617351 - RNA, 21 nt, Human
ucucuuccuugaccugcauug

SEQ ID NO: 3617352 - RNA, 14 nt, Human
ucucuucuccacug

SEQ ID NO: 3617353 - RNA, 15 nt, Human
ucucuucuccacugg

SEQ ID NO: 3617354 - RNA, 14 nt, Human
ucucuucucccaga

SEQ ID NO: 3617355 - RNA, 21 nt, Human
ucucuucuccccuuccauuuc

SEQ ID NO: 3617356 - RNA, 11 nt, Human
ucucuucuccu

SEQ ID NO: 3617357 - RNA, 12 nt, Human
ucucuucuccuu

SEQ ID NO: 3617358 - RNA, 14 nt, Human
ucucuucucuccag

SEQ ID NO: 3617359 - RNA, 13 nt, Human
ucucuucucuguu

SEQ ID NO: 3617360 - RNA, 19 nt, Human
ucucuucugaauaaagcaa

SEQ ID NO: 3617361 - RNA, 22 nt, Human
ucucuucugagcuauuucaucu

SEQ ID NO: 3617362 - RNA, 14 nt, Human
ucucuucugcucca

SEQ ID NO: 3617363 - RNA, 19 nt, Human
ucucuucugcuccacccuu

SEQ ID NO: 3617364 - RNA, 19 nt, Human
ucucuucuggguuccuucc

SEQ ID NO: 3617365 - RNA, 20 nt, Human
ucucuucuggguuccuuccu

SEQ ID NO: 3617366 - RNA, 13 nt, Human
ucucuucuugaac

SEQ ID NO: 3617367 - RNA, 14 nt, Human
ucucuugagagggu

SEQ ID NO: 3617368 - RNA, 14 nt, Human
ucucuugagccugg

SEQ ID NO: 3617369 - RNA, 17 nt, Human
ucucuugagccugggag

SEQ ID NO: 3617370 - RNA, 18 nt, Human
ucucuugagccugggagg

SEQ ID NO: 3617371 - RNA, 16 nt, Human
ucucuugagcuggccu

SEQ ID NO: 3617372 - RNA, 16 nt, Human
ucucuugauucauaau

SEQ ID NO: 3617373 - RNA, 15 nt, Human
ucucuugcacccgcc

SEQ ID NO: 3617374 - RNA, 22 nt, Human
ucucuugccgaggagccaggca

SEQ ID NO: 3617375 - RNA, 22 nt, Human
ucucuugccuaaguauuccuuu

SEQ ID NO: 3617376 - RNA, 21 nt, Human
ucucuugccucaaccucccaa

SEQ ID NO: 3617377 - RNA, 13 nt, Human
ucucuugccucag

SEQ ID NO: 3617378 - RNA, 16 nt, Human
ucucuugccucagccu

SEQ ID NO: 3617379 - RNA, 22 nt, Human
ucucuugccucagcuuccccag

SEQ ID NO: 3617380 - RNA, 18 nt, Human
ucucuugguccugcugca

SEQ ID NO: 3617381 - RNA, 20 nt, Human
ucucuugguguuaaaacacu

SEQ ID NO: 3617382 - RNA, 20 nt, Human
ucuuagcuaucauugcuucc

SEQ ID NO: 3617383 - RNA, 15 nt, Human
ucuuagcucaaugag

SEQ ID NO: 3617384 - RNA, 16 nt, Human
ucuuagcucaaugagc

SEQ ID NO: 3617385 - RNA, 22 nt, Human
ucuuagcucaaugagcauguuu

SEQ ID NO: 3617386 - RNA, 17 nt, Human
ucuuagcuccccuccaa

SEQ ID NO: 3617387 - RNA, 15 nt, Human
ucuuagcugucugcu

SEQ ID NO: 3617388 - RNA, 14 nt, Human
ucuuagcuuuuuaa

SEQ ID NO: 3617389 - RNA, 21 nt, Human
ucuuagcuuuuuaauuguugu

SEQ ID NO: 3617390 - RNA, 19 nt, Human
ucuuaggaagagaaaccag

SEQ ID NO: 3617391 - RNA, 14 nt, Human
ucuuaggagcagag

SEQ ID NO: 3617392 - RNA, 17 nt, Human
ucuuaggccaggcgugg

SEQ ID NO: 3617393 - RNA, 22 nt, Human
ucuuaggguuaugauuaaguaa

SEQ ID NO: 3617394 - RNA, 20 nt, Human
ucuuagguuggcaaaaaggc

SEQ ID NO: 3617395 - RNA, 15 nt, Human
ucuuaguucucacug

SEQ ID NO: 3617396 - RNA, 21 nt, Human
ucuuaguuuggauucuuaugu

SEQ ID NO: 3617397 - RNA, 12 nt, Human
ucuuauaaauau

SEQ ID NO: 3617398 - RNA, 17 nt, Human
ucuuauaauacucuguu

SEQ ID NO: 3617399 - RNA, 14 nt, Human
ucuuauacuguaca

SEQ ID NO: 3617400 - RNA, 21 nt, Human
ucuuauacuguacaauaaaaa

SEQ ID NO: 3617401 - RNA, 16 nt, Human
ucuuauagcacuuuga

SEQ ID NO: 3617402 - RNA, 19 nt, Human
ucuuauagcacuuugaaau

SEQ ID NO: 3617403 - RNA, 16 nt, Human
ucuuauaguucuaggc

SEQ ID NO: 3617404 - RNA, 12 nt, Human
ucuuauauagca

SEQ ID NO: 3617405 - RNA, 18 nt, Human
ucuuauauaugugaacau

SEQ ID NO: 3617406 - RNA, 21 nt, Human
ucuuauauuuacaacacuuua

SEQ ID NO: 3617407 - RNA, 16 nt, Human
ucuuauccuccaccgu

SEQ ID NO: 3617408 - RNA, 16 nt, Human
ucuuaucucagauauu

SEQ ID NO: 3617409 - RNA, 12 nt, Human
ucuuaucucagu

SEQ ID NO: 3617410 - RNA, 14 nt, Human
ucuuaucuuacgaa

SEQ ID NO: 3617411 - RNA, 15 nt, Human
ucuuaucuucugcaa

SEQ ID NO: 3617412 - RNA, 17 nt, Human
ucuuaugcaaaauggaa

SEQ ID NO: 3617413 - RNA, 14 nt, Human
ucuuaugccauuug

SEQ ID NO: 3617414 - RNA, 20 nt, Human
ucuuaugccauuuguuuauu

SEQ ID NO: 3617415 - RNA, 18 nt, Human
ucuuaugcuguacccagu

SEQ ID NO: 3617416 - RNA, 13 nt, Human
ucuuaugcuucca

SEQ ID NO: 3617417 - RNA, 19 nt, Human
ucuuauggauguccccagc

SEQ ID NO: 3617418 - RNA, 15 nt, Human
ucuuauggauucauu

SEQ ID NO: 3617419 - RNA, 17 nt, Human
ucuuauggauucauuua

SEQ ID NO: 3617420 - RNA, 13 nt, Human
ucuuaugggcugg

SEQ ID NO: 3617421 - RNA, 16 nt, Human
ucuuaugggcuggguu

SEQ ID NO: 3617422 - RNA, 17 nt, Human
ucuuauguaccucuuuu

SEQ ID NO: 3617423 - RNA, 21 nt, Human
ucuuaugugacauuaacaaau

SEQ ID NO: 3617424 - RNA, 12 nt, Human
ucuuauuaaagu

SEQ ID NO: 3617425 - RNA, 22 nt, Human
ucuuauuaaaguuucaaaaauc

SEQ ID NO: 3617426 - RNA, 22 nt, Human
ucuuauuagaacaggcaaguga

SEQ ID NO: 3617427 - RNA, 12 nt, Human
ucuuauucauca

SEQ ID NO: 3617428 - RNA, 16 nt, Human
ucuuauucauuuucuc

SEQ ID NO: 3617429 - RNA, 19 nt, Human
ucuuauuccauauuagaaa

SEQ ID NO: 3617430 - RNA, 15 nt, Human
ucuuauucucacucc

SEQ ID NO: 3617431 - RNA, 22 nt, Human
ucuuauugcaaaauagcauuug

SEQ ID NO: 3617432 - RNA, 18 nt, Human
ucuuauugcccacgcugg

SEQ ID NO: 3617433 - RNA, 13 nt, Human
ucuuauuuauuau

SEQ ID NO: 3617434 - RNA, 18 nt, Human
ucuuauuucaugaaaauu

SEQ ID NO: 3617435 - RNA, 11 nt, Human
ucuuauuugcu

SEQ ID NO: 3617436 - RNA, 12 nt, Human
ucuuauuuuucu

SEQ ID NO: 3617437 - RNA, 18 nt, Human
ucuuauuuuucuaaacgu

SEQ ID NO: 3617438 - RNA, 16 nt, Human
ucuucaaaaacuguuu

SEQ ID NO: 3617439 - RNA, 21 nt, Human
ucuucaaaaguaaugccucug

SEQ ID NO: 3617440 - RNA, 22 nt, Human
ucuucaaaauauaaaaugccaa

SEQ ID NO: 3617441 - RNA, 19 nt, Human
ucuucaaaauguauauauu

SEQ ID NO: 3617442 - RNA, 13 nt, Human
ucuucaaauccuu

SEQ ID NO: 3617443 - RNA, 22 nt, Human
ucuucaaauccuuccaaaaauu

SEQ ID NO: 3617444 - RNA, 19 nt, Human
ucuucaaauuagaagacau

SEQ ID NO: 3617445 - RNA, 12 nt, Human
ucuucaacaaau

SEQ ID NO: 3617446 - RNA, 19 nt, Human
ucuucaacaucaauguuca

SEQ ID NO: 3617447 - RNA, 23 nt, Human
ucuucaacaucaauguucauugu

SEQ ID NO: 3617448 - RNA, 20 nt, Human
ucuucaacaugucacacugg

SEQ ID NO: 3617449 - RNA, 16 nt, Human
ucuucaacugaccagc

SEQ ID NO: 3617450 - RNA, 15 nt, Human
ucuucaaggcuucag

SEQ ID NO: 3617451 - RNA, 17 nt, Human
ucuucaaggcuucaguc

SEQ ID NO: 3617452 - RNA, 13 nt, Human
ucuucaagggcug

SEQ ID NO: 3617453 - RNA, 22 nt, Human
ucuucacaauggugcucauuuc

SEQ ID NO: 3617454 - RNA, 19 nt, Human
ucuucacccagcuaaucug

SEQ ID NO: 3617455 - RNA, 11 nt, Human
ucuucaccccg

SEQ ID NO: 3617456 - RNA, 21 nt, Human
ucuucaccccggcaggcccug

SEQ ID NO: 3617457 - RNA, 23 nt, Human
ucuucaccccggcaggcccugca

SEQ ID NO: 3617458 - RNA, 23 nt, Human
ucuucaccuaagucucugugaau

SEQ ID NO: 3617459 - RNA, 14 nt, Human
ucuucacggcagga

SEQ ID NO: 3617460 - RNA, 13 nt, Human
ucuucacucacag

SEQ ID NO: 3617461 - RNA, 14 nt, Human
ucuucacucgcccc

SEQ ID NO: 3617462 - RNA, 18 nt, Human
ucuucacucucugaagau

SEQ ID NO: 3617463 - RNA, 14 nt, Human
ucuucacucuuagg

SEQ ID NO: 3617464 - RNA, 15 nt, Human
ucuucacuuuugcaa

SEQ ID NO: 3617465 - RNA, 13 nt, Human
ucuucagaagaca

SEQ ID NO: 3617466 - RNA, 20 nt, Human
ucuucagacucucagcccag

SEQ ID NO: 3617467 - RNA, 14 nt, Human
ucuucagagaaauc

SEQ ID NO: 3617468 - RNA, 12 nt, Human
ucuucagagacu

SEQ ID NO: 3617469 - RNA, 19 nt, Human
ucuucagagacuccugcag

SEQ ID NO: 3617470 - RNA, 20 nt, Human
ucuucagagacuccugcagg

SEQ ID NO: 3617471 - RNA, 15 nt, Human
ucuucagaggcccuc

SEQ ID NO: 3617472 - RNA, 19 nt, Human
ucuucagauacaaacugca

SEQ ID NO: 3617473 - RNA, 23 nt, Human
ucuucagaucucuaacuucacca

SEQ ID NO: 3617474 - RNA, 14 nt, Human
ucuucagaugccac

SEQ ID NO: 3617475 - RNA, 13 nt, Human
ucuucagccauca

SEQ ID NO: 3617476 - RNA, 11 nt, Human
ucuucagccua

SEQ ID NO: 3617477 - RNA, 21 nt, Human
ucuucagccuagccgaccuca

SEQ ID NO: 3617478 - RNA, 23 nt, Human
ucuucagccuagccgaccucagc

SEQ ID NO: 3617479 - RNA, 19 nt, Human
ucuucagcguaaaauggug

SEQ ID NO: 3617480 - RNA, 16 nt, Human
ucuucagcuucuucau

SEQ ID NO: 3617481 - RNA, 17 nt, Human
ucuucaggcuuccugca

SEQ ID NO: 3617482 - RNA, 15 nt, Human
ucuucagggccuggu

SEQ ID NO: 3617483 - RNA, 23 nt, Human
ucuucagggccugguugaagaag

SEQ ID NO: 3617484 - RNA, 16 nt, Human
ucuuccccaccaaccc

SEQ ID NO: 3617485 - RNA, 14 nt, Human
ucuuccccacuccc

SEQ ID NO: 3617486 - RNA, 19 nt, Human
ucuuccccacuccccaccu

SEQ ID NO: 3617487 - RNA, 20 nt, Human
ucuuccccagaaaggagacu

SEQ ID NO: 3617488 - RNA, 19 nt, Human
ucuuccccagacgccuggc

SEQ ID NO: 3617489 - RNA, 18 nt, Human
ucuucccccacuccucuu

SEQ ID NO: 3617490 - RNA, 14 nt, Human
ucuucccccucucc

SEQ ID NO: 3617491 - RNA, 16 nt, Human
ucuucccccucuccca

SEQ ID NO: 3617492 - RNA, 24 nt, Human
ucuuccccucuaaugcucacgcuc

SEQ ID NO: 3617493 - RNA, 22 nt, Human
ucuuccccuugcccuugcccug

SEQ ID NO: 3617494 - RNA, 18 nt, Human
ucuucccgaaccccaagg

SEQ ID NO: 3617495 - RNA, 21 nt, Human
ucuucccuaccucaggcagga

SEQ ID NO: 3617496 - RNA, 15 nt, Human
ucuuccgacucuuuc

SEQ ID NO: 3617497 - RNA, 21 nt, Human
ucuuccgccccugccugccau

SEQ ID NO: 3617498 - RNA, 18 nt, Human
ucuuccggagauguagca

SEQ ID NO: 3617499 - RNA, 21 nt, Human
ucuuccggagauguagcaaaa

SEQ ID NO: 3617500 - RNA, 20 nt, Human
ucuuccggccccuccccucc

SEQ ID NO: 3617501 - RNA, 23 nt, Human
ucuuccggccccuccccuccaaa

SEQ ID NO: 3617502 - RNA, 14 nt, Human
ucuuccgucucccc

SEQ ID NO: 3617503 - RNA, 20 nt, Human
ucuuccgucucccccguguu

SEQ ID NO: 3617504 - RNA, 21 nt, Human
ucuuccuacccugccucccuu

SEQ ID NO: 3617505 - RNA, 16 nt, Human
ucuuccuaucccaucc

SEQ ID NO: 3617506 - RNA, 22 nt, Human
ucuuccuaucccucuccuaacu

SEQ ID NO: 3617507 - RNA, 16 nt, Human
ucuuccuauuucagaa

SEQ ID NO: 3617508 - RNA, 17 nt, Human
ucuuccuauuucagaag

SEQ ID NO: 3617509 - RNA, 23 nt, Human
ucuuccucaaaauaaagaaguau

SEQ ID NO: 3617510 - RNA, 21 nt, Human
ucuuccucacagucccacugu

SEQ ID NO: 3617511 - RNA, 15 nt, Human
ucuuccucccucccu

SEQ ID NO: 3617512 - RNA, 18 nt, Human
ucuuccuccgaggccagu

SEQ ID NO: 3617513 - RNA, 14 nt, Human
ucuuccucugaggc

SEQ ID NO: 3617514 - RNA, 16 nt, Human
ucuuccucugaggcug

SEQ ID NO: 3617515 - RNA, 11 nt, Human
ucuuccucugc

SEQ ID NO: 3617516 - RNA, 21 nt, Human
ucuuccucugcuaaauugaug

SEQ ID NO: 3617517 - RNA, 16 nt, Human
ucuuccugacacuuua

SEQ ID NO: 3617518 - RNA, 14 nt, Human
ucuuccugccccuc

SEQ ID NO: 3617519 - RNA, 15 nt, Human
ucuuccugccccucu

SEQ ID NO: 3617520 - RNA, 19 nt, Human
ucuuccugccccucuuucu

SEQ ID NO: 3617521 - RNA, 13 nt, Human
ucuuccuggcuuu

SEQ ID NO: 3617522 - RNA, 21 nt, Human
ucuuccuggucgaaaguuagu

SEQ ID NO: 3617523 - RNA, 22 nt, Human
ucuuccuguaacacaagccaca

SEQ ID NO: 3617524 - RNA, 17 nt, Human
ucuuccuguuaauguau

SEQ ID NO: 3617525 - RNA, 23 nt, Human
ucuuccuuacuuuuuauauauau

SEQ ID NO: 3617526 - RNA, 13 nt, Human
ucuuccuucugcc

SEQ ID NO: 3617527 - RNA, 21 nt, Human
ucuuccuugaagaacugcagg

SEQ ID NO: 3617528 - RNA, 18 nt, Human
ucuuccuuggagggggga

SEQ ID NO: 3617529 - RNA, 17 nt, Human
ucuuccuuuacuuuccc

SEQ ID NO: 3617530 - RNA, 20 nt, Human
ucuuccuuuacuuucccuug

SEQ ID NO: 3617531 - RNA, 13 nt, Human
ucuuccuuuguaa

SEQ ID NO: 3617532 - RNA, 16 nt, Human
ucuuccuuuguaaaaa

SEQ ID NO: 3617533 - RNA, 10 nt, Human
ucuuccuuuu

SEQ ID NO: 3617534 - RNA, 15 nt, Human
ucuucgacuguuguu

SEQ ID NO: 3617535 - RNA, 17 nt, Human
ucuucgacuguuguuau

SEQ ID NO: 3617536 - RNA, 13 nt, Human
ucuucgaggugga

SEQ ID NO: 3617537 - RNA, 14 nt, Human
ucuucggaaaccuu

SEQ ID NO: 3617538 - RNA, 13 nt, Human
ucuucgggaagag

SEQ ID NO: 3617539 - RNA, 19 nt, Human
ucuucggggaacuccugga

SEQ ID NO: 3617540 - RNA, 12 nt, Human
ucuucuaaaugg

SEQ ID NO: 3617541 - RNA, 20 nt, Human
ucuucuaauuucaaaaauau

SEQ ID NO: 3617542 - RNA, 14 nt, Human
ucuucuaccaccca

SEQ ID NO: 3617543 - RNA, 22 nt, Human
ucuucuacucacuuuucccacu

SEQ ID NO: 3617544 - RNA, 13 nt, Human
ucuucuauauaau

SEQ ID NO: 3617545 - RNA, 11 nt, Human
ucuucucaagu

SEQ ID NO: 3617546 - RNA, 15 nt, Human
ucuucucaagugccu

SEQ ID NO: 3617547 - RNA, 15 nt, Human
ucuucucaaguucua

SEQ ID NO: 3617548 - RNA, 18 nt, Human
ucuucucaaguucuaaga

SEQ ID NO: 3617549 - RNA, 17 nt, Human
ucuucucacucccuucu

SEQ ID NO: 3617550 - RNA, 21 nt, Human
ucuucucaggcucugcccugc

SEQ ID NO: 3617551 - RNA, 16 nt, Human
ucuucucauagcauua

SEQ ID NO: 3617552 - RNA, 18 nt, Human
ucuucucauagcauuaac

SEQ ID NO: 3617553 - RNA, 18 nt, Human
ucuucucauuucaccccu

SEQ ID NO: 3617554 - RNA, 19 nt, Human
ucuucucauuucaccccuc

SEQ ID NO: 3617555 - RNA, 15 nt, Human
ucuucuccagauuuu

SEQ ID NO: 3617556 - RNA, 13 nt, Human
ucuucuccaggcu

SEQ ID NO: 3617557 - RNA, 19 nt, Human
ucuucuccauccuaccaca

SEQ ID NO: 3617558 - RNA, 12 nt, Human
ucuucuccaucu

SEQ ID NO: 3617559 - RNA, 13 nt, Human
ucuucucccagaa

SEQ ID NO: 3617560 - RNA, 12 nt, Human
ucuucuccccag

SEQ ID NO: 3617561 - RNA, 12 nt, Human
ucuucuccccca

SEQ ID NO: 3617562 - RNA, 21 nt, Human
ucuucuccccuuccauuucug

SEQ ID NO: 3617563 - RNA, 16 nt, Human
ucuucuccuaugugua

SEQ ID NO: 3617564 - RNA, 21 nt, Human
ucuucuccuggaguugcauug

SEQ ID NO: 3617565 - RNA, 13 nt, Human
ucuucuccuuuca

SEQ ID NO: 3617566 - RNA, 23 nt, Human
ucuucucguccucguuuguguuc

SEQ ID NO: 3617567 - RNA, 13 nt, Human
ucuucucuagcug

SEQ ID NO: 3617568 - RNA, 15 nt, Human
ucuucucuagcuggu

SEQ ID NO: 3617569 - RNA, 17 nt, Human
ucuucucucugcucuga

SEQ ID NO: 3617570 - RNA, 21 nt, Human
ucuucucuggcgacaguuuuc

SEQ ID NO: 3617571 - RNA, 12 nt, Human
ucuucucugucu

SEQ ID NO: 3617572 - RNA, 13 nt, Human
ucuucucuuccug

SEQ ID NO: 3617573 - RNA, 19 nt, Human
ucuucucuuccuuuuauca

SEQ ID NO: 3617574 - RNA, 16 nt, Human
ucuucugacaaacugu

SEQ ID NO: 3617575 - RNA, 17 nt, Human
ucuucugacaaacugug

SEQ ID NO: 3617576 - RNA, 14 nt, Human
ucuucugacgugcc

SEQ ID NO: 3617577 - RNA, 15 nt, Human
ucuucugacgugccu

SEQ ID NO: 3617578 - RNA, 16 nt, Human
ucuucugagcacuguu

SEQ ID NO: 3617579 - RNA, 22 nt, Human
ucuucugagcuuacguaguucu

SEQ ID NO: 3617580 - RNA, 20 nt, Human
ucuucugaguggcuaaaacu

SEQ ID NO: 3617581 - RNA, 19 nt, Human
ucuucugccggcccugggg

SEQ ID NO: 3617582 - RNA, 16 nt, Human
ucuucugccuguuaua

SEQ ID NO: 3617583 - RNA, 22 nt, Human
ucuucugcuaugugacuugcau

SEQ ID NO: 3617584 - RNA, 15 nt, Human
ucuucugcuccaccc

SEQ ID NO: 3617585 - RNA, 18 nt, Human
ucuucugcucuuucuucu

SEQ ID NO: 3617586 - RNA, 22 nt, Human
ucuucugcucuuucuucuucca

SEQ ID NO: 3617587 - RNA, 22 nt, Human
ucuucugcuucagccucccgag

SEQ ID NO: 3617588 - RNA, 12 nt, Human
ucuucuggaaug

SEQ ID NO: 3617589 - RNA, 18 nt, Human
ucuucuggacugguuuuc

SEQ ID NO: 3617590 - RNA, 13 nt, Human
ucuucuggcucaa

SEQ ID NO: 3617591 - RNA, 17 nt, Human
ucuucugggagggcagc

SEQ ID NO: 3617592 - RNA, 22 nt, Human
ucuucugggagggcagcagggc

SEQ ID NO: 3617593 - RNA, 23 nt, Human
ucuucugggagggcagcagggcu

SEQ ID NO: 3617594 - RNA, 18 nt, Human
ucuucuggguuccuuccu

SEQ ID NO: 3617595 - RNA, 16 nt, Human
ugaaguuaguggaaau

SEQ ID NO: 3617596 - RNA, 19 nt, Human
ugaaguuauguguauguga

SEQ ID NO: 3617597 - RNA, 14 nt, Human
ugaaguucuccuga

SEQ ID NO: 3617598 - RNA, 21 nt, Human
ugaaguucugccucugaugua

SEQ ID NO: 3617599 - RNA, 22 nt, Human
ugaaguucugccucugauguau

SEQ ID NO: 3617600 - RNA, 14 nt, Human
ugaaguuggacagc

SEQ ID NO: 3617601 - RNA, 16 nt, Human
ugaaguuguagguaau

SEQ ID NO: 3617602 - RNA, 22 nt, Human
ugaaguuguuacuaacuaaacu

SEQ ID NO: 3617603 - RNA, 14 nt, Human
ugaaguuuaaaaca

SEQ ID NO: 3617604 - RNA, 14 nt, Human
ugaaguuuacauuu

SEQ ID NO: 3617605 - RNA, 16 nt, Human
ugaaguuuacauuuuu

SEQ ID NO: 3617606 - RNA, 17 nt, Human
ugaaguuuacauuuuua

SEQ ID NO: 3617607 - RNA, 14 nt, Human
ugaaguuuauacag

SEQ ID NO: 3617608 - RNA, 16 nt, Human
ugaaguuuauacagua

SEQ ID NO: 3617609 - RNA, 14 nt, Human
ugaaguuucacucc

SEQ ID NO: 3617610 - RNA, 14 nt, Human
ugaaguuugaaugu

SEQ ID NO: 3617611 - RNA, 15 nt, Human
ugaaguuugaauguu

SEQ ID NO: 3617612 - RNA, 15 nt, Human
ugaaguuuuacauug

SEQ ID NO: 3617613 - RNA, 16 nt, Human
ugaaguuuuacauugu

SEQ ID NO: 3617614 - RNA, 19 nt, Human
ugaauaaaaauauguacaa

SEQ ID NO: 3617615 - RNA, 14 nt, Human
ugaauaaaaaugca

SEQ ID NO: 3617616 - RNA, 15 nt, Human
ugaauaaaaaugcac

SEQ ID NO: 3617617 - RNA, 16 nt, Human
ugaauaaaagugcaca

SEQ ID NO: 3617618 - RNA, 15 nt, Human
ugaauaaagacaccu

SEQ ID NO: 3617619 - RNA, 13 nt, Human
ugaauaaagagcc

SEQ ID NO: 3617620 - RNA, 13 nt, Human
ugaauaaauaccu

SEQ ID NO: 3617621 - RNA, 23 nt, Human
ugaauaaauaccucuuagcugag

SEQ ID NO: 3617622 - RNA, 12 nt, Human
ugaauaaauguc

SEQ ID NO: 3617623 - RNA, 15 nt, Human
ugaauaaaugucacu

SEQ ID NO: 3617624 - RNA, 19 nt, Human
ugaauaaaugucacuuuuu

SEQ ID NO: 3617625 - RNA, 20 nt, Human
ugaauaaaugucacuuuuug

SEQ ID NO: 3617626 - RNA, 23 nt, Human
ugaauaaccacuuaaaaaauguc

SEQ ID NO: 3617627 - RNA, 13 nt, Human
ugaauaagcacuu

SEQ ID NO: 3617628 - RNA, 16 nt, Human
ugaauaauaagcagga

SEQ ID NO: 3617629 - RNA, 17 nt, Human
ugaauaaugccuuugua

SEQ ID NO: 3617630 - RNA, 16 nt, Human
ugaauaauggaaaaug

SEQ ID NO: 3617631 - RNA, 15 nt, Human
ugaauaauuucccaa

SEQ ID NO: 3617632 - RNA, 19 nt, Human
ugaauacagggcaugcauu

SEQ ID NO: 3617633 - RNA, 18 nt, Human
ugaauaccacucuguaau

SEQ ID NO: 3617634 - RNA, 20 nt, Human
ugaauaccacucuguaauug

SEQ ID NO: 3617635 - RNA, 22 nt, Human
ugaauaccccaagacucccaug

SEQ ID NO: 3617636 - RNA, 14 nt, Human
ugaauaccugcuca

SEQ ID NO: 3617637 - RNA, 21 nt, Human
ugaauaccuuagugcaguuau

SEQ ID NO: 3617638 - RNA, 20 nt, Human
ugaauacucugcccucuaga

SEQ ID NO: 3617639 - RNA, 13 nt, Human
ugaauacugcuug

SEQ ID NO: 3617640 - RNA, 16 nt, Human
ugaauacugcuugaau

SEQ ID NO: 3617641 - RNA, 15 nt, Human
ugaauacuuugaaug

SEQ ID NO: 3617642 - RNA, 17 nt, Human
ugaauacuuugaaugug

SEQ ID NO: 3617643 - RNA, 20 nt, Human
ugaauacuuugaauguguuu

SEQ ID NO: 3617644 - RNA, 21 nt, Human
ugaauagauaugaaagcugau

SEQ ID NO: 3617645 - RNA, 16 nt, Human
ugaauagccauauuug

SEQ ID NO: 3617646 - RNA, 18 nt, Human
ugaauagccauauuugua

SEQ ID NO: 3617647 - RNA, 17 nt, Human
ugaauaggcgaucacaa

SEQ ID NO: 3617648 - RNA, 18 nt, Human
ugaauaggcgaucacaac

SEQ ID NO: 3617649 - RNA, 14 nt, Human
ugaauauaaaugug

SEQ ID NO: 3617650 - RNA, 18 nt, Human
ugaauauaaaugugugua

SEQ ID NO: 3617651 - RNA, 12 nt, Human
ugaauauaugau

SEQ ID NO: 3617652 - RNA, 14 nt, Human
ugaauauauggcau

SEQ ID NO: 3617653 - RNA, 14 nt, Human
ugaauauccccucc

SEQ ID NO: 3617654 - RNA, 16 nt, Human
ugaauauccccuccca

SEQ ID NO: 3617655 - RNA, 18 nt, Human
ugaauaucuauuaauaua

SEQ ID NO: 3617656 - RNA, 21 nt, Human
ugaauaucuauuaauauaugu

SEQ ID NO: 3617657 - RNA, 15 nt, Human
ugaauaugauuaaaa

SEQ ID NO: 3617658 - RNA, 14 nt, Human
ugaauaugccugua

SEQ ID NO: 3617659 - RNA, 16 nt, Human
ugaauaugccuguaau

SEQ ID NO: 3617660 - RNA, 23 nt, Human
ugaauaugccuguaauucagugu

SEQ ID NO: 3617661 - RNA, 22 nt, Human
ugaauauggacaagagguacag

SEQ ID NO: 3617662 - RNA, 23 nt, Human
ugaauauguaguaucuauaugac

SEQ ID NO: 3617663 - RNA, 22 nt, Human
ugaauaugucaucacucuaggu

SEQ ID NO: 3617664 - RNA, 21 nt, Human
ugacauugaaaucuaggaaaa

SEQ ID NO: 3617665 - RNA, 18 nt, Human
ugacauugccaaaaagga

SEQ ID NO: 3617666 - RNA, 16 nt, Human
ugacauugcuaagaug

SEQ ID NO: 3617667 - RNA, 22 nt, Human
ugacauuguagagcuucuggca

SEQ ID NO: 3617668 - RNA, 12 nt, Human
ugacauugucuc

SEQ ID NO: 3617669 - RNA, 21 nt, Human
ugacauuguuggccaaagcca

SEQ ID NO: 3617670 - RNA, 18 nt, Human
ugacauuuaauuuaguga

SEQ ID NO: 3617671 - RNA, 19 nt, Human
ugacauuuagucccucaag

SEQ ID NO: 3617672 - RNA, 19 nt, Human
ugacauuuauauauugaau

SEQ ID NO: 3617673 - RNA, 18 nt, Human
ugacauuuauuuuucauu

SEQ ID NO: 3617674 - RNA, 22 nt, Human
ugacauuuauuuuucucaugaa

SEQ ID NO: 3617675 - RNA, 12 nt, Human
ugacauuucuuu

SEQ ID NO: 3617676 - RNA, 14 nt, Human
ugacauuucuuugu

SEQ ID NO: 3617677 - RNA, 15 nt, Human
ugacauuuggagagg

SEQ ID NO: 3617678 - RNA, 22 nt, Human
ugacauuugggagacaugugac

SEQ ID NO: 3617679 - RNA, 24 nt, Human
ugacauuugggagacaugugacau

SEQ ID NO: 3617680 - RNA, 17 nt, Human
ugacauuuguaguugag

SEQ ID NO: 3617681 - RNA, 13 nt, Human
ugacauuugucau

SEQ ID NO: 3617682 - RNA, 15 nt, Human
ugacauuugucauuu

SEQ ID NO: 3617683 - RNA, 15 nt, Human
ugacauuuguuuggu

SEQ ID NO: 3617684 - RNA, 16 nt, Human
ugaccaaaauccccuu

SEQ ID NO: 3617685 - RNA, 22 nt, Human
ugaccaaauaucaccaggacug

SEQ ID NO: 3617686 - RNA, 20 nt, Human
ugaccaacauggagaaaccc

SEQ ID NO: 3617687 - RNA, 15 nt, Human
ugaccaacuagacau

SEQ ID NO: 3617688 - RNA, 16 nt, Human
ugaccaacuagacauu

SEQ ID NO: 3617689 - RNA, 17 nt, Human
ugauaauuuuccuuuaa

SEQ ID NO: 3617690 - RNA, 19 nt, Human
ugauaauuuuccuuuaaua

SEQ ID NO: 3617691 - RNA, 17 nt, Human
ugauacaagauuagaag

SEQ ID NO: 3617692 - RNA, 18 nt, Human
ugauacaaugcugugccc

SEQ ID NO: 3617693 - RNA, 20 nt, Human
ugauacaaugcugugcccua

SEQ ID NO: 3617694 - RNA, 21 nt, Human
ugauacaaugcugugcccuaa

SEQ ID NO: 3617695 - RNA, 23 nt, Human
ugauacacuaugaagauguuuca

SEQ ID NO: 3617696 - RNA, 12 nt, Human
ugauacagaaaa

SEQ ID NO: 3617697 - RNA, 14 nt, Human
ugauacagaacucu

SEQ ID NO: 3617698 - RNA, 15 nt, Human
ugauacagaacucuu

SEQ ID NO: 3617699 - RNA, 15 nt, Human
ugauacauaacuaaa

SEQ ID NO: 3617700 - RNA, 22 nt, Human
ugauacauccaaagcagacagc

SEQ ID NO: 3617701 - RNA, 20 nt, Human
ugauacauucaaauuugucu

SEQ ID NO: 3617702 - RNA, 14 nt, Human
ugauacauuuuugu

SEQ ID NO: 3617703 - RNA, 18 nt, Human
ugauacccauagcuucca

SEQ ID NO: 3617704 - RNA, 21 nt, Human
ugauacccauagcuuccauga

SEQ ID NO: 3617705 - RNA, 22 nt, Human
ugauaccccuggggaacauuuc

SEQ ID NO: 3617706 - RNA, 15 nt, Human
ugauacgaugcuuca

SEQ ID NO: 3617707 - RNA, 14 nt, Human
ugauacuaagcauu

SEQ ID NO: 3617708 - RNA, 16 nt, Human
ugauacuaagcauuga

SEQ ID NO: 3617709 - RNA, 18 nt, Human
ugauacuauccaguuacu

SEQ ID NO: 3617710 - RNA, 20 nt, Human
ugauacucuuucuaaugcug

SEQ ID NO: 3617711 - RNA, 18 nt, Human
ugauacuggaggaacacu

SEQ ID NO: 3617712 - RNA, 19 nt, Human
ugauacuguugcacgugug

SEQ ID NO: 3617713 - RNA, 20 nt, Human
ugauacuguugcacgugugu

SEQ ID NO: 3617714 - RNA, 22 nt, Human
ugauacuuauauuuucguauga

SEQ ID NO: 3617715 - RNA, 18 nt, Human
ugauacuucgacacuguu

SEQ ID NO: 3617716 - RNA, 20 nt, Human
ugauacuucgacacuguucu

SEQ ID NO: 3617717 - RNA, 16 nt, Human
ugauacuuuuuugaaa

SEQ ID NO: 3617718 - RNA, 17 nt, Human
ugauagacaauugaggu

SEQ ID NO: 3617719 - RNA, 19 nt, Human
ugauagacacauaugaggg

SEQ ID NO: 3617720 - RNA, 14 nt, Human
ugauagauuuucug

SEQ ID NO: 3617721 - RNA, 16 nt, Human
ugauagcaaaaucaag

SEQ ID NO: 3617722 - RNA, 18 nt, Human
ugauagcaaauggccuca

SEQ ID NO: 3617723 - RNA, 13 nt, Human
ugauagcacuuuc

SEQ ID NO: 3617724 - RNA, 21 nt, Human
ugauagcacuuucuacaaugu

SEQ ID NO: 3617725 - RNA, 13 nt, Human
ugauagcauugcu

SEQ ID NO: 3617726 - RNA, 11 nt, Human
ugauagcuuua

SEQ ID NO: 3617727 - RNA, 23 nt, Human
ugauagcuuuauuuuuuaaguau

SEQ ID NO: 3617728 - RNA, 16 nt, Human
ugauaggaauucaucu

SEQ ID NO: 3617729 - RNA, 15 nt, Human
ugauagggaacuggg

SEQ ID NO: 3617730 - RNA, 20 nt, Human
ugauagggauacaugcucuu

SEQ ID NO: 3617731 - RNA, 17 nt, Human
ugauagucuuuugcuuu

SEQ ID NO: 3617732 - RNA, 14 nt, Human
ugauaguuacuguu

SEQ ID NO: 3617733 - RNA, 16 nt, Human
ugauaguuacuguugu

SEQ ID NO: 3617734 - RNA, 20 nt, Human
ugauaguuacuguugugacc

SEQ ID NO: 3617735 - RNA, 18 nt, Human
ugauaguugauuuucaaa

SEQ ID NO: 3617736 - RNA, 16 nt, Human
ugauauaaaugcaaua

SEQ ID NO: 3617737 - RNA, 13 nt, Human
ugauauaaauucu

SEQ ID NO: 3617738 - RNA, 14 nt, Human
ugauauaaauucug

SEQ ID NO: 3617739 - RNA, 16 nt, Human
ugauauaaauucugug

SEQ ID NO: 3617740 - RNA, 17 nt, Human
ugauauaaguguguguu

SEQ ID NO: 3617741 - RNA, 20 nt, Human
ugauauaccaaauuaaaaaa

SEQ ID NO: 3617742 - RNA, 21 nt, Human
ugauauagaaguauaaagaau

SEQ ID NO: 3617743 - RNA, 18 nt, Human
ugauauagaauuagcuuu

SEQ ID NO: 3617744 - RNA, 19 nt, Human
ugauauauaaguguacaua

SEQ ID NO: 3617745 - RNA, 16 nt, Human
ugauauauauuauaaa

SEQ ID NO: 3617746 - RNA, 15 nt, Human
ugauauaucucaaau

SEQ ID NO: 3617747 - RNA, 16 nt, Human
ugauauauggauaaug

SEQ ID NO: 3617748 - RNA, 13 nt, Human
ugauauauguguu

SEQ ID NO: 3617749 - RNA, 21 nt, Human
ugauauauguguuuuucacau

SEQ ID NO: 3617750 - RNA, 17 nt, Human
ugauauauuuaaaaaca

SEQ ID NO: 3617751 - RNA, 17 nt, Human
ugauaucacagucuaau

SEQ ID NO: 3617752 - RNA, 19 nt, Human
ugauauccauucuuucuga

SEQ ID NO: 3617753 - RNA, 16 nt, Human
ugauaucccccagccu

SEQ ID NO: 3617754 - RNA, 12 nt, Human
ugauaucccuga

SEQ ID NO: 3617755 - RNA, 18 nt, Human
ugauaucuauaguagaca

SEQ ID NO: 3617756 - RNA, 12 nt, Human
ugauaugaaaaa

SEQ ID NO: 3617757 - RNA, 19 nt, Human
ugauaugaaaaauaugaua

SEQ ID NO: 3617758 - RNA, 19 nt, Human
ugauaugaguauacaauau

SEQ ID NO: 3617759 - RNA, 23 nt, Human
ugauaugcacaauguagauaagu

SEQ ID NO: 3617760 - RNA, 19 nt, Human
ugauaugcaguuuuccuua

SEQ ID NO: 3617761 - RNA, 17 nt, Human
ugauauggagcccugua

SEQ ID NO: 3617762 - RNA, 18 nt, Human
ugauauggcagaagacac

SEQ ID NO: 3617763 - RNA, 22 nt, Human
ugauauggguuuauaauuuucu

SEQ ID NO: 3617764 - RNA, 17 nt, Human
ugauauguuuuauuuca

SEQ ID NO: 3617765 - RNA, 23 nt, Human
ugauauguuuuauuucauugguu

SEQ ID NO: 3617766 - RNA, 22 nt, Human
ugauauuacauuuauuuaucca

SEQ ID NO: 3617767 - RNA, 14 nt, Human
ugauauucagaauu

SEQ ID NO: 3617768 - RNA, 15 nt, Human
ugauauuccauagua

SEQ ID NO: 3617769 - RNA, 12 nt, Human
ugauauucuaag

SEQ ID NO: 3617770 - RNA, 22 nt, Human
ugauauucuaagaaauaucugu

SEQ ID NO: 3617771 - RNA, 15 nt, Human
ugauauucuuuguua

SEQ ID NO: 3617772 - RNA, 18 nt, Human
ugauauucuuuguuaauu

SEQ ID NO: 3617773 - RNA, 16 nt, Human
ugauauugcugaagaa

SEQ ID NO: 3617774 - RNA, 17 nt, Human
ugauauuguuauauaca

SEQ ID NO: 3617775 - RNA, 19 nt, Human
ugauauuuccccaugguuu

SEQ ID NO: 3617776 - RNA, 23 nt, Human
ugauauuucccuccccuggggac

SEQ ID NO: 3617777 - RNA, 18 nt, Human
ugauauuucucuaguagu

SEQ ID NO: 3617778 - RNA, 18 nt, Human
ugauauuuguauuuauuc

SEQ ID NO: 3617779 - RNA, 19 nt, Human
ugauauuuguauuuauucu

SEQ ID NO: 3617780 - RNA, 19 nt, Human
ugauauuuucaacgcagcc

SEQ ID NO: 3617781 - RNA, 22 nt, Human
ugauauuuucaacgcagcccug

SEQ ID NO: 3617782 - RNA, 17 nt, Human
ugauauuuucugugccu

SEQ ID NO: 3617783 - RNA, 20 nt, Human
ugauauuuucugugccugaa

SEQ ID NO: 3617784 - RNA, 16 nt, Human
ugauauuuuguacuuu

SEQ ID NO: 3617785 - RNA, 18 nt, Human
ugauauuuuguuuuuccc

SEQ ID NO: 3617786 - RNA, 16 nt, Human
ugauauuuuuucucuc

SEQ ID NO: 3617787 - RNA, 16 nt, Human
ugauauuuuuuuaagu

SEQ ID NO: 3617788 - RNA, 16 nt, Human
ugaucaaaaauaaugc

SEQ ID NO: 3617789 - RNA, 17 nt, Human
ugaucaaacaugucucu

SEQ ID NO: 3617790 - RNA, 14 nt, Human
ugaucaaauguuua

SEQ ID NO: 3617791 - RNA, 17 nt, Human
ugaucaaauucauuuuu

SEQ ID NO: 3617792 - RNA, 17 nt, Human
ugaucaacaucuuuucu

SEQ ID NO: 3617793 - RNA, 21 nt, Human
ugaucaacaucuuuucuugcc

SEQ ID NO: 3617794 - RNA, 17 nt, Human
ugaucaagggaauguaa

SEQ ID NO: 3617795 - RNA, 19 nt, Human
ugaucaauaaaaugugauu

SEQ ID NO: 3617796 - RNA, 14 nt, Human
ugcacucaaccuua

SEQ ID NO: 3617797 - RNA, 14 nt, Human
ugcacucagacugu

SEQ ID NO: 3617798 - RNA, 15 nt, Human
ugcacucagacugua

SEQ ID NO: 3617799 - RNA, 16 nt, Human
ugcacucagacuguau

SEQ ID NO: 3617800 - RNA, 12 nt, Human
ugcacuccagcc

SEQ ID NO: 3617801 - RNA, 15 nt, Human
ugcacuccagccuga

SEQ ID NO: 3617802 - RNA, 17 nt, Human
ugcacuccagccugagc

SEQ ID NO: 3617803 - RNA, 17 nt, Human
ugcacuccagccugggc

SEQ ID NO: 3617804 - RNA, 18 nt, Human
ugcacuccagccugggca

SEQ ID NO: 3617805 - RNA, 19 nt, Human
ugcacucccaccugacaca

SEQ ID NO: 3617806 - RNA, 21 nt, Human
ugcacucuaaaagguucaggg

SEQ ID NO: 3617807 - RNA, 12 nt, Human
ugcacucugugc

SEQ ID NO: 3617808 - RNA, 16 nt, Human
ugcacucugugcccau

SEQ ID NO: 3617809 - RNA, 21 nt, Human
ugcacucugugcccaugggca

SEQ ID NO: 3617810 - RNA, 17 nt, Human
ugcacucuuuaagggag

SEQ ID NO: 3617811 - RNA, 16 nt, Human
ugcacugaaguuugau

SEQ ID NO: 3617812 - RNA, 18 nt, Human
ugcacugacauuguuggc

SEQ ID NO: 3617813 - RNA, 21 nt, Human
ugcacugacauuguuggccaa

SEQ ID NO: 3617814 - RNA, 16 nt, Human
ugcacugacccuucca

SEQ ID NO: 3617815 - RNA, 14 nt, Human
ugcacugaugcugc

SEQ ID NO: 3617816 - RNA, 16 nt, Human
ugcacugaugcugccc

SEQ ID NO: 3617817 - RNA, 21 nt, Human
ugcacugcccauggacaggcu

SEQ ID NO: 3617818 - RNA, 16 nt, Human
ugcacuggccuucuga

SEQ ID NO: 3617819 - RNA, 21 nt, Human
ugcacuggccuucugaugaaa

SEQ ID NO: 3617820 - RNA, 16 nt, Human
ugcacugucaagauga

SEQ ID NO: 3617821 - RNA, 21 nt, Human
ugcacugucacuuugcucugg

SEQ ID NO: 3617822 - RNA, 12 nt, Human
ugcacuguccug

SEQ ID NO: 3617823 - RNA, 17 nt, Human
ugcacuguccugcucca

SEQ ID NO: 3617824 - RNA, 22 nt, Human
ugcacuguccugcuccacagug

SEQ ID NO: 3617825 - RNA, 20 nt, Human
ugcacuguucccccugugca

SEQ ID NO: 3617826 - RNA, 23 nt, Human
ugcacuguucccccugugcagcc

SEQ ID NO: 3617827 - RNA, 14 nt, Human
ugcacuuaaagaag

SEQ ID NO: 3617828 - RNA, 16 nt, Human
ugcacuuaaauaucaa

SEQ ID NO: 3617829 - RNA, 19 nt, Human
ugcacuuaugauuucaugu

SEQ ID NO: 3617830 - RNA, 19 nt, Human
ugcacuuauugaccauuuu

SEQ ID NO: 3617831 - RNA, 14 nt, Human
ugcacuucuuacaa

SEQ ID NO: 3617832 - RNA, 21 nt, Human
ugcacuugcagacucuacaga

SEQ ID NO: 3617833 - RNA, 17 nt, Human
ugcacuuggccucugga

SEQ ID NO: 3617834 - RNA, 17 nt, Human
ugcacuuggggcacagg

SEQ ID NO: 3617835 - RNA, 21 nt, Human
ugcacuuggggcacagggaga

SEQ ID NO: 3617836 - RNA, 21 nt, Human
ugcacuuucagacucucucug

SEQ ID NO: 3617837 - RNA, 20 nt, Human
ugcacuuucuauccucugua

SEQ ID NO: 3617838 - RNA, 12 nt, Human
ugcacuuugcuu

SEQ ID NO: 3617839 - RNA, 17 nt, Human
ugcacuuugcuuuaaua

SEQ ID NO: 3617840 - RNA, 20 nt, Human
ugcacuuugcuuuaauauaa

SEQ ID NO: 3617841 - RNA, 21 nt, Human
ugcacuuugcuuuaauauaaa

SEQ ID NO: 3617842 - RNA, 22 nt, Human
ugcacuuugcuuuaauauaaau

SEQ ID NO: 3617843 - RNA, 13 nt, Human
ugcacuuuguaaa

SEQ ID NO: 3617844 - RNA, 14 nt, Human
ugcacuuuguaaau

SEQ ID NO: 3617845 - RNA, 16 nt, Human
ugcacuuuguaaauuc

SEQ ID NO: 3617846 - RNA, 13 nt, Human
ugcacuuuguagu

SEQ ID NO: 3617847 - RNA, 18 nt, Human
ugcacuuuguaguguuug

SEQ ID NO: 3617848 - RNA, 19 nt, Human
ugcacuuuguucuggcucu

SEQ ID NO: 3617849 - RNA, 13 nt, Human
ugcagaaaacauu

SEQ ID NO: 3617850 - RNA, 18 nt, Human
ugcagaaaagcaccugcc

SEQ ID NO: 3617851 - RNA, 21 nt, Human
ugcagaaaagcaccugccgac

SEQ ID NO: 3617852 - RNA, 17 nt, Human
ugcagaaaauucugugc

SEQ ID NO: 3617853 - RNA, 15 nt, Human
ugcagaaacuacuga

SEQ ID NO: 3617854 - RNA, 17 nt, Human
ugcagaaauagacaaaa

SEQ ID NO: 3617855 - RNA, 22 nt, Human
ugcagaacuugaagccugcucc

SEQ ID NO: 3617856 - RNA, 23 nt, Human
ugcagaacuugaagccugcuccu

SEQ ID NO: 3617857 - RNA, 17 nt, Human
ugcagaagaaggcaucg

SEQ ID NO: 3617858 - RNA, 15 nt, Human
ugcagaagacaguau

SEQ ID NO: 3617859 - RNA, 22 nt, Human
ugcagaagacaguauggcagcu

SEQ ID NO: 3617860 - RNA, 20 nt, Human
ugcagaaggaaaaaugugua

SEQ ID NO: 3617861 - RNA, 21 nt, Human
ugcagaaggaaaaauguguaa

SEQ ID NO: 3617862 - RNA, 22 nt, Human
ugcagaaggaaaaauguguaau

SEQ ID NO: 3617863 - RNA, 23 nt, Human
ugcagaaggaagggcauccuucu

SEQ ID NO: 3617864 - RNA, 13 nt, Human
ugcagaaggccaa

SEQ ID NO: 3617865 - RNA, 15 nt, Human
ugcagaaggccaaga

SEQ ID NO: 3617866 - RNA, 21 nt, Human
ugcagaauacaguaagcugcu

SEQ ID NO: 3617867 - RNA, 17 nt, Human
ugcagaauggcauuugc

SEQ ID NO: 3617868 - RNA, 12 nt, Human
ugcagaauguaa

SEQ ID NO: 3617869 - RNA, 19 nt, Human
ugcagaauguaagugggcc

SEQ ID NO: 3617870 - RNA, 17 nt, Human
ugcagacaaucuucugu

SEQ ID NO: 3617871 - RNA, 19 nt, Human
ugcagacagaagucuccuc

SEQ ID NO: 3617872 - RNA, 22 nt, Human
ugcagacaggcaagcaccuccu

SEQ ID NO: 3617873 - RNA, 14 nt, Human
ugcagacccucaga

SEQ ID NO: 3617874 - RNA, 15 nt, Human
ugcagacccugcccu

SEQ ID NO: 3617875 - RNA, 18 nt, Human
ugcagaccuguccuccug

SEQ ID NO: 3617876 - RNA, 21 nt, Human
ugcagaccuguccuccuggug

SEQ ID NO: 3617877 - RNA, 22 nt, Human
ugcagacuagaauucuagugcu

SEQ ID NO: 3617878 - RNA, 23 nt, Human
ugcagacuagaauucuagugcug

SEQ ID NO: 3617879 - RNA, 20 nt, Human
ugcagacucaguuugucaga

SEQ ID NO: 3617880 - RNA, 16 nt, Human
ugcagacucuacagag

SEQ ID NO: 3617881 - RNA, 22 nt, Human
ugcagacugcuaguguucuguc

SEQ ID NO: 3617882 - RNA, 14 nt, Human
ugcagacuggaggg

SEQ ID NO: 3617883 - RNA, 16 nt, Human
ugcagacuggagggga

SEQ ID NO: 3617884 - RNA, 15 nt, Human
ugcagacuucccagc

SEQ ID NO: 3617885 - RNA, 19 nt, Human
ugcagagaaacuuaagcaa

SEQ ID NO: 3617886 - RNA, 20 nt, Human
ugcagagaaacuuaagcaaa

SEQ ID NO: 3617887 - RNA, 17 nt, Human
ugcagagacaggaccug

SEQ ID NO: 3617888 - RNA, 13 nt, Human
ugcagagagaagc

SEQ ID NO: 3617889 - RNA, 16 nt, Human
ugcagagagccauuuu

SEQ ID NO: 3617890 - RNA, 18 nt, Human
ugcagagcaguaagggaa

SEQ ID NO: 3617891 - RNA, 13 nt, Human
ugcagaggcugug

SEQ ID NO: 3617892 - RNA, 13 nt, Human
ugcagaggggcag

SEQ ID NO: 3617893 - RNA, 15 nt, Human
ugcagaggggcaggc

SEQ ID NO: 3617894 - RNA, 20 nt, Human
ugcagaggggcaggcccugc

SEQ ID NO: 3617895 - RNA, 21 nt, Human
ugcagaggggcaggcccugca

SEQ ID NO: 3617896 - RNA, 20 nt, Human
ugcagaggggcuuucuggag

SEQ ID NO: 3617897 - RNA, 22 nt, Human
ugcagaggggcuuucuggagag

SEQ ID NO: 3617898 - RNA, 15 nt, Human
ugcagagguacccug

SEQ ID NO: 3617899 - RNA, 17 nt, Human
ugcagagguacccuggg

SEQ ID NO: 3617900 - RNA, 15 nt, Human
ugcagaggucagacu

SEQ ID NO: 3617901 - RNA, 15 nt, Human
ugcagaggucugugc

SEQ ID NO: 3617902 - RNA, 17 nt, Human
ugcagaggucugugcug

SEQ ID NO: 3617903 - RNA, 14 nt, Human
ugcagaguauuucu

SEQ ID NO: 3617904 - RNA, 19 nt, Human
ugcagaguucagggaagau

SEQ ID NO: 3617905 - RNA, 19 nt, Human
ugcagauaaacaguaguga

SEQ ID NO: 3617906 - RNA, 17 nt, Human
ugcagauaacuuugacu

SEQ ID NO: 3617907 - RNA, 19 nt, Human
ugcagauacuacugaccag

SEQ ID NO: 3617908 - RNA, 14 nt, Human
ugcagaugacaaaa

SEQ ID NO: 3617909 - RNA, 17 nt, Human
ugcagaugcaauuguuu

SEQ ID NO: 3617910 - RNA, 20 nt, Human
ugcagaugccacccuagcca

SEQ ID NO: 3617911 - RNA, 22 nt, Human
ugcagauggggcucccgcccgu

SEQ ID NO: 3617912 - RNA, 17 nt, Human
ugcagauguuagauauu

SEQ ID NO: 3617913 - RNA, 23 nt, Human
ugcagauugagaccuacaggcug

SEQ ID NO: 3617914 - RNA, 17 nt, Human
ugcagcaaccagagcac

SEQ ID NO: 3617915 - RNA, 18 nt, Human
ugcagcaaccagagcacu

SEQ ID NO: 3617916 - RNA, 20 nt, Human
ugcagcaaccagagcacugu

SEQ ID NO: 3617917 - RNA, 18 nt, Human
ugcagcaaggcccugcug

SEQ ID NO: 3617918 - RNA, 20 nt, Human
ugcagcaaggcccugcugcc

SEQ ID NO: 3617919 - RNA, 20 nt, Human
ugcagcaauaaagcagcguu

SEQ ID NO: 3617920 - RNA, 12 nt, Human
ugcagcaccucc

SEQ ID NO: 3617921 - RNA, 14 nt, Human
ugcagcaccuccag

SEQ ID NO: 3617922 - RNA, 20 nt, Human
ugcagcaccuccaggccugu

SEQ ID NO: 3617923 - RNA, 20 nt, Human
ugcagcacucacacaggacc

SEQ ID NO: 3617924 - RNA, 13 nt, Human
ugcagcagaggca

SEQ ID NO: 3617925 - RNA, 14 nt, Human
ugcagcagaggcac

SEQ ID NO: 3617926 - RNA, 16 nt, Human
ugcagcagaggcacug

SEQ ID NO: 3617927 - RNA, 20 nt, Human
ugcagcagcgguggccucuu

SEQ ID NO: 3617928 - RNA, 20 nt, Human
ugcagcagcuugcugcaccc

SEQ ID NO: 3617929 - RNA, 13 nt, Human
ugcagcaggagug

SEQ ID NO: 3617930 - RNA, 14 nt, Human
ugcagcaggagugg

SEQ ID NO: 3617931 - RNA, 20 nt, Human
ugcagcaggaguggugcaga

SEQ ID NO: 3617932 - RNA, 17 nt, Human
ugcagcauaugaggaug

SEQ ID NO: 3617933 - RNA, 17 nt, Human
ugcagcaugaccuguga

SEQ ID NO: 3617934 - RNA, 18 nt, Human
ugcagcauggucccugcc

SEQ ID NO: 3617935 - RNA, 19 nt, Human
ugcagcauggucccugccu

SEQ ID NO: 3617936 - RNA, 17 nt, Human
ugcagcauguugcugag

SEQ ID NO: 3617937 - RNA, 21 nt, Human
ugcagcauguugcugaggagu

SEQ ID NO: 3617938 - RNA, 17 nt, Human
ugcagccacuuaggaca

SEQ ID NO: 3617939 - RNA, 21 nt, Human
ugcagccagaccuauuccucc

SEQ ID NO: 3617940 - RNA, 19 nt, Human
ugcagccagcccagcccag

SEQ ID NO: 3617941 - RNA, 14 nt, Human
ugcagcccauuucu

SEQ ID NO: 3617942 - RNA, 15 nt, Human
ugcagcccauuucuc

SEQ ID NO: 3617943 - RNA, 18 nt, Human
ugcagcccauuucuccag

SEQ ID NO: 3617944 - RNA, 22 nt, Human
ugcagcccauuucuccagaacc

SEQ ID NO: 3617945 - RNA, 16 nt, Human
ugcauuaaaagaaaau

SEQ ID NO: 3617946 - RNA, 13 nt, Human
ugcauuaaaccug

SEQ ID NO: 3617947 - RNA, 14 nt, Human
ugcauuaaaccugu

SEQ ID NO: 3617948 - RNA, 16 nt, Human
ugcauuaaaccugucu

SEQ ID NO: 3617949 - RNA, 13 nt, Human
ugcauuaaauuca

SEQ ID NO: 3617950 - RNA, 11 nt, Human
ugcauuacaga

SEQ ID NO: 3617951 - RNA, 14 nt, Human
ugcauuacauuccu

SEQ ID NO: 3617952 - RNA, 15 nt, Human
ugcauuacugcaugc

SEQ ID NO: 3617953 - RNA, 17 nt, Human
ugcauuacugcaugcac

SEQ ID NO: 3617954 - RNA, 13 nt, Human
ugcauuagaaauu

SEQ ID NO: 3617955 - RNA, 14 nt, Human
ugcauuagcacaga

SEQ ID NO: 3617956 - RNA, 19 nt, Human
ugcauuagcacagauuuua

SEQ ID NO: 3617957 - RNA, 17 nt, Human
ugcauuaucuagauacu

SEQ ID NO: 3617958 - RNA, 18 nt, Human
ugcauuaucuagauacug

SEQ ID NO: 3617959 - RNA, 18 nt, Human
ugcauuaugcaauuuuua

SEQ ID NO: 3617960 - RNA, 15 nt, Human
ugcauuauuaaauug

SEQ ID NO: 3617961 - RNA, 18 nt, Human
ugcauuauuaaauuguaa

SEQ ID NO: 3617962 - RNA, 23 nt, Human
ugcauuauuugagaagcugcuca

SEQ ID NO: 3617963 - RNA, 23 nt, Human
ugcauucacauuuagaaaaguga

SEQ ID NO: 3617964 - RNA, 14 nt, Human
ugcauucauuuuua

SEQ ID NO: 3617965 - RNA, 15 nt, Human
ugcauucauuuuuau

SEQ ID NO: 3617966 - RNA, 18 nt, Human
ugcauucguuguguuuuu

SEQ ID NO: 3617967 - RNA, 15 nt, Human
ugcauucuauugccu

SEQ ID NO: 3617968 - RNA, 16 nt, Human
ugcauucuucugagca

SEQ ID NO: 3617969 - RNA, 21 nt, Human
ugcauucuuuuaaaagacaag

SEQ ID NO: 3617970 - RNA, 17 nt, Human
ugcauugaaaagagcug

SEQ ID NO: 3617971 - RNA, 20 nt, Human
ugcauugaaaagagcugaag

SEQ ID NO: 3617972 - RNA, 21 nt, Human
ugcauugaacacaaacuguaa

SEQ ID NO: 3617973 - RNA, 22 nt, Human
ugcauugaacacaaacuguaaa

SEQ ID NO: 3617974 - RNA, 17 nt, Human
ugcauugacuuucccca

SEQ ID NO: 3617975 - RNA, 22 nt, Human
ugcauugacuuuccccaccaga

SEQ ID NO: 3617976 - RNA, 15 nt, Human
ugcauugagaacugc

SEQ ID NO: 3617977 - RNA, 17 nt, Human
ugcauugauauugugaa

SEQ ID NO: 3617978 - RNA, 22 nt, Human
ugcauugauauugugaacauuu

SEQ ID NO: 3617979 - RNA, 17 nt, Human
ugcauugauucaguauu

SEQ ID NO: 3617980 - RNA, 23 nt, Human
ugcauugccugcggucaaggcca

SEQ ID NO: 3617981 - RNA, 16 nt, Human
ugcauugcuagauaaa

SEQ ID NO: 3617982 - RNA, 17 nt, Human
ugcauugcuagauaaaa

SEQ ID NO: 3617983 - RNA, 18 nt, Human
ugcauuggauaacaccac

SEQ ID NO: 3617984 - RNA, 22 nt, Human
ugcauuggauaacaccaccauu

SEQ ID NO: 3617985 - RNA, 17 nt, Human
ugcauugggugaucauu

SEQ ID NO: 3617986 - RNA, 18 nt, Human
ugcauuguaucgauguua

SEQ ID NO: 3617987 - RNA, 12 nt, Human
ugcauugucugu

SEQ ID NO: 3617988 - RNA, 13 nt, Human
ugcauugugcuuc

SEQ ID NO: 3617989 - RNA, 14 nt, Human
ugcauuguuucugu

SEQ ID NO: 3617990 - RNA, 15 nt, Human
ugcauuuaaaacaga

SEQ ID NO: 3617991 - RNA, 18 nt, Human
ugcauuuaccggcagugc

SEQ ID NO: 3617992 - RNA, 14 nt, Human
ugcauuuagcacaa

SEQ ID NO: 3617993 - RNA, 14 nt, Human
ugcauuuauaugua

SEQ ID NO: 3617994 - RNA, 16 nt, Human
ugcauuuauauguacc

SEQ ID NO: 3617995 - RNA, 19 nt, Human
ugcauuuaugagcucuuca

SEQ ID NO: 3617996 - RNA, 14 nt, Human
ugcauuuccugaca

SEQ ID NO: 3617997 - RNA, 13 nt, Human
ugcauuuggaaca

SEQ ID NO: 3617998 - RNA, 17 nt, Human
ugcauuuggguccagga

SEQ ID NO: 3617999 - RNA, 20 nt, Human
ugcauuuggguccaggagga

SEQ ID NO: 3618000 - RNA, 18 nt, Human
ugcauuuguaaaugcugu

SEQ ID NO: 3618001 - RNA, 16 nt, Human
ugcauuugucuauucu

SEQ ID NO: 3618002 - RNA, 20 nt, Human
ugcauuugucuauucuccag

SEQ ID NO: 3618003 - RNA, 20 nt, Human
ugcauuuguuuauguaauuu

SEQ ID NO: 3618004 - RNA, 21 nt, Human
ugcauuuguuuauguaauuuc

SEQ ID NO: 3618005 - RNA, 22 nt, Human
ugcauuuguuuauguaauuuca

SEQ ID NO: 3618006 - RNA, 22 nt, Human
ugcauuuucugaaacuaaugaa

SEQ ID NO: 3618007 - RNA, 23 nt, Human
ugcauuuuggagaguuuccugaa

SEQ ID NO: 3618008 - RNA, 22 nt, Human
ugcauuuuguuugguauuguau

SEQ ID NO: 3618009 - RNA, 23 nt, Human
ugcauuuuguuugguauuguauu

SEQ ID NO: 3618010 - RNA, 15 nt, Human
ugcauuuuucugcag

SEQ ID NO: 3618011 - RNA, 11 nt, Human
ugcauuuuugu

SEQ ID NO: 3618012 - RNA, 15 nt, Human
ugcauuuuuguaaau

SEQ ID NO: 3618013 - RNA, 22 nt, Human
ugcauuuuuguaaauguguaca

SEQ ID NO: 3618014 - RNA, 19 nt, Human
ugcauuuuuuaaaacaaga

SEQ ID NO: 3618015 - RNA, 16 nt, Human
ugccaaaaaaaaauac

SEQ ID NO: 3618016 - RNA, 16 nt, Human
ugccaaaaagugaaau

SEQ ID NO: 3618017 - RNA, 17 nt, Human
ugccaaaaagugaaaua

SEQ ID NO: 3618018 - RNA, 18 nt, Human
ugccaaaaagugaaauaa

SEQ ID NO: 3618019 - RNA, 19 nt, Human
ugccaaaaagugaaauaau

SEQ ID NO: 3618020 - RNA, 13 nt, Human
ugccaaaauaaug

SEQ ID NO: 3618021 - RNA, 14 nt, Human
ugccaaaauaaugu

SEQ ID NO: 3618022 - RNA, 22 nt, Human
ugccaaaauaaugucuuguuaa

SEQ ID NO: 3618023 - RNA, 17 nt, Human
ugccaaaaugcucuagu

SEQ ID NO: 3618024 - RNA, 18 nt, Human
ugccaaaaugcucuagug

SEQ ID NO: 3618025 - RNA, 17 nt, Human
ugccaaacaaaaagguu

SEQ ID NO: 3618026 - RNA, 23 nt, Human
ugccaaacaaaaagguucucagg

SEQ ID NO: 3618027 - RNA, 12 nt, Human
ugccaaacauua

SEQ ID NO: 3618028 - RNA, 19 nt, Human
ugccaaacauuaauguuga

SEQ ID NO: 3618029 - RNA, 21 nt, Human
ugccaaagaucacuuguuguu

SEQ ID NO: 3618030 - RNA, 20 nt, Human
ugccaaagcuaggguggccc

SEQ ID NO: 3618031 - RNA, 16 nt, Human
ugccaaauauguccug

SEQ ID NO: 3618032 - RNA, 14 nt, Human
ugccaaaucuggcu

SEQ ID NO: 3618033 - RNA, 18 nt, Human
ugccaaauuguaguucuu

SEQ ID NO: 3618034 - RNA, 21 nt, Human
ugccaacaauccuagugcuuu

SEQ ID NO: 3618035 - RNA, 18 nt, Human
ugccaacaccacagaaau

SEQ ID NO: 3618036 - RNA, 21 nt, Human
ugccaacacucaagaagcagg

SEQ ID NO: 3618037 - RNA, 22 nt, Human
ugccaacacucaagaagcaggc

SEQ ID NO: 3618038 - RNA, 21 nt, Human
ugccaacaguguuaggccugg

SEQ ID NO: 3618039 - RNA, 22 nt, Human
ugccaacauugccuauuucagu

SEQ ID NO: 3618040 - RNA, 22 nt, Human
ugccaaccauaccuuccuuccc

SEQ ID NO: 3618041 - RNA, 12 nt, Human
ugccaaccuaaa

SEQ ID NO: 3618042 - RNA, 18 nt, Human
ugccaaccuaaaacucuu

SEQ ID NO: 3618043 - RNA, 21 nt, Human
ugccaaccuguaauaaauaug

SEQ ID NO: 3618044 - RNA, 23 nt, Human
ugccaaccuguaauaaauaugag

SEQ ID NO: 3618045 - RNA, 15 nt, Human
ugccaacuguggcug

SEQ ID NO: 3618046 - RNA, 22 nt, Human
ugccaacuguucagcuguccuc

SEQ ID NO: 3618047 - RNA, 21 nt, Human
ugccaacuucuucagagcuga

SEQ ID NO: 3618048 - RNA, 13 nt, Human
ugccaagacaaau

SEQ ID NO: 3618049 - RNA, 16 nt, Human
ugccaagacaaaucaa

SEQ ID NO: 3618050 - RNA, 22 nt, Human
ugccaagacaaaucaacagaag

SEQ ID NO: 3618051 - RNA, 23 nt, Human
ugccaagacugcuguggccagga

SEQ ID NO: 3618052 - RNA, 23 nt, Human
ugccaagagcccgucugcuccug

SEQ ID NO: 3618053 - RNA, 17 nt, Human
ugccaagagugaaggga

SEQ ID NO: 3618054 - RNA, 15 nt, Human
ugccaagcacagugc

SEQ ID NO: 3618055 - RNA, 17 nt, Human
ugccaagcacugugcuc

SEQ ID NO: 3618056 - RNA, 22 nt, Human
ugccaagcauuuaauguagcca

SEQ ID NO: 3618057 - RNA, 15 nt, Human
ugccaagcucaggac

SEQ ID NO: 3618058 - RNA, 18 nt, Human
ugccaagcucaggaccag

SEQ ID NO: 3618059 - RNA, 23 nt, Human
ugccaagcuccaagccccaucuu

SEQ ID NO: 3618060 - RNA, 16 nt, Human
ugccaaggcagaggcc

SEQ ID NO: 3618061 - RNA, 20 nt, Human
ugccaaggccagaguggccu

SEQ ID NO: 3618062 - RNA, 21 nt, Human
ugccaagggcauaaauuauug

SEQ ID NO: 3618063 - RNA, 15 nt, Human
ugccaaguuguuuga

SEQ ID NO: 3618064 - RNA, 13 nt, Human
ugccaaguuuguu

SEQ ID NO: 3618065 - RNA, 21 nt, Human
ugccaauaauaauaccucccu

SEQ ID NO: 3618066 - RNA, 18 nt, Human
ugccaauacuagucaccc

SEQ ID NO: 3618067 - RNA, 16 nt, Human
ugccaauauccuaaua

SEQ ID NO: 3618068 - RNA, 18 nt, Human
ugccaauauccuaauaaa

SEQ ID NO: 3618069 - RNA, 19 nt, Human
ugccaauauguauuguaaa

SEQ ID NO: 3618070 - RNA, 19 nt, Human
ugccaauauuaaaucugcu

SEQ ID NO: 3618071 - RNA, 14 nt, Human
ugccaaucaauagc

SEQ ID NO: 3618072 - RNA, 13 nt, Human
ugccaauuucaag

SEQ ID NO: 3618073 - RNA, 17 nt, Human
ugccaauuugcacauua

SEQ ID NO: 3618074 - RNA, 17 nt, Human
ugccaauuuuugccuuc

SEQ ID NO: 3618075 - RNA, 19 nt, Human
ugccacaacgccuggcuaa

SEQ ID NO: 3618076 - RNA, 18 nt, Human
ugccacaaggaagaaauu

SEQ ID NO: 3618077 - RNA, 22 nt, Human
ugccacacaaggauagaugcug

SEQ ID NO: 3618078 - RNA, 20 nt, Human
ugccacacagaguggucuuu

SEQ ID NO: 3618079 - RNA, 21 nt, Human
ugccacaccaagcugugccac

SEQ ID NO: 3618080 - RNA, 23 nt, Human
ugccacaccaagcugugccaccc

SEQ ID NO: 3618081 - RNA, 19 nt, Human
ugccacacgagaaccugaa

SEQ ID NO: 3618082 - RNA, 12 nt, Human
ugccacagcccu

SEQ ID NO: 3618083 - RNA, 14 nt, Human
ugccacagcccugu

SEQ ID NO: 3618084 - RNA, 16 nt, Human
ugccacagcccuguca

SEQ ID NO: 3618085 - RNA, 21 nt, Human
ugccacagcccugucagcaug

SEQ ID NO: 3618086 - RNA, 11 nt, Human
ugccacagcuu

SEQ ID NO: 3618087 - RNA, 16 nt, Human
ugccacagcuuuugca

SEQ ID NO: 3618088 - RNA, 14 nt, Human
ugccacaggacaca

SEQ ID NO: 3618089 - RNA, 18 nt, Human
ugccacaggacacaguca

SEQ ID NO: 3618090 - RNA, 20 nt, Human
ugccacaggacacagucaga

SEQ ID NO: 3618091 - RNA, 11 nt, Human
ugccacaggcc

SEQ ID NO: 3618092 - RNA, 15 nt, Human
ugccacaggccuccc

SEQ ID NO: 3618093 - RNA, 18 nt, Human
ugccacaggccucccugu

SEQ ID NO: 3618094 - RNA, 13 nt, Human
ugcugcugucccu

SEQ ID NO: 3618095 - RNA, 14 nt, Human
ugcugcuucaauuu

SEQ ID NO: 3618096 - RNA, 15 nt, Human
ugcugcuucauguuu

SEQ ID NO: 3618097 - RNA, 18 nt, Human
ugcugcuucucccaggca

SEQ ID NO: 3618098 - RNA, 12 nt, Human
ugcugcuugagg

SEQ ID NO: 3618099 - RNA, 19 nt, Human
ugcugcuugaggcaacuca

SEQ ID NO: 3618100 - RNA, 15 nt, Human
ugcugcuuuccccug

SEQ ID NO: 3618101 - RNA, 20 nt, Human
ugcugcuuuuugagguggca

SEQ ID NO: 3618102 - RNA, 18 nt, Human
ugcuggaaaauaauacug

SEQ ID NO: 3618103 - RNA, 22 nt, Human
ugcuggaagacgcaagggccug

SEQ ID NO: 3618104 - RNA, 17 nt, Human
ugcuggaauaaguucaa

SEQ ID NO: 3618105 - RNA, 16 nt, Human
ugcuggacaggucugg

SEQ ID NO: 3618106 - RNA, 16 nt, Human
ugcuggacaguaucac

SEQ ID NO: 3618107 - RNA, 21 nt, Human
ugcuggacuggaggccccugg

SEQ ID NO: 3618108 - RNA, 15 nt, Human
ugcuggacugucaua

SEQ ID NO: 3618109 - RNA, 13 nt, Human
ugcuggagacucc

SEQ ID NO: 3618110 - RNA, 13 nt, Human
ugcuggagagguu

SEQ ID NO: 3618111 - RNA, 14 nt, Human
ugcuggagauguuu

SEQ ID NO: 3618112 - RNA, 18 nt, Human
ugcuggagcacugggcuc

SEQ ID NO: 3618113 - RNA, 10 nt, Human
ugcuggagcc

SEQ ID NO: 3618114 - RNA, 18 nt, Human
ugcuggagccacuaacua

SEQ ID NO: 3618115 - RNA, 15 nt, Human
ugcuggagccugugu

SEQ ID NO: 3618116 - RNA, 16 nt, Human
ugcuggagccugugua

SEQ ID NO: 3618117 - RNA, 17 nt, Human
ugcuggagccuguguaa

SEQ ID NO: 3618118 - RNA, 22 nt, Human
ugcuggagccuguguaacagcu

SEQ ID NO: 3618119 - RNA, 13 nt, Human
ugcuggagcggcu

SEQ ID NO: 3618120 - RNA, 14 nt, Human
ugcuggagcucugc

SEQ ID NO: 3618121 - RNA, 21 nt, Human
ugcuggaggugacaucucuua

SEQ ID NO: 3618122 - RNA, 17 nt, Human
ugcuggauaaaaugagg

SEQ ID NO: 3618123 - RNA, 22 nt, Human
ugcuggaucacagcugcuuucu

SEQ ID NO: 3618124 - RNA, 23 nt, Human
ugcuggaucacagcugcuuucug

SEQ ID NO: 3618125 - RNA, 17 nt, Human
ugcuggauggagcccag

SEQ ID NO: 3618126 - RNA, 22 nt, Human
ugcuggaugucugccaauuuuu

SEQ ID NO: 3618127 - RNA, 18 nt, Human
ugcuggcaucaagaggug

SEQ ID NO: 3618128 - RNA, 16 nt, Human
ugcuggccagccuggg

SEQ ID NO: 3618129 - RNA, 17 nt, Human
ugcuggccagccugggg

SEQ ID NO: 3618130 - RNA, 21 nt, Human
ugcuggccagccuggggccug

SEQ ID NO: 3618131 - RNA, 12 nt, Human
ugcuggcccagg

SEQ ID NO: 3618132 - RNA, 13 nt, Human
ugcuggcccaggg

SEQ ID NO: 3618133 - RNA, 16 nt, Human
ugcuggcccagggccc

SEQ ID NO: 3618134 - RNA, 23 nt, Human
ugcuggcccagggcccagagccc

SEQ ID NO: 3618135 - RNA, 18 nt, Human
ugcuggccccagcccugc

SEQ ID NO: 3618136 - RNA, 22 nt, Human
ugcuggccccagcccugcuggg

SEQ ID NO: 3618137 - RNA, 24 nt, Human
ugcuggccccucaccugggcaccu

SEQ ID NO: 3618138 - RNA, 16 nt, Human
ugcuggccggacaccc

SEQ ID NO: 3618139 - RNA, 17 nt, Human
ugcuggccgggcacagc

SEQ ID NO: 3618140 - RNA, 15 nt, Human
ugcuggccuggaucu

SEQ ID NO: 3618141 - RNA, 13 nt, Human
ugcuggccuggcc

SEQ ID NO: 3618142 - RNA, 23 nt, Human
ugcuggcgagugaaugccagugu

SEQ ID NO: 3618143 - RNA, 13 nt, Human
ugcuggcugccuu

SEQ ID NO: 3618144 - RNA, 21 nt, Human
ugcuggcugccuuagaaccuu

SEQ ID NO: 3618145 - RNA, 16 nt, Human
ugcuggcuggaaggga

SEQ ID NO: 3618146 - RNA, 16 nt, Human
ugcuggcugguuagag

SEQ ID NO: 3618147 - RNA, 16 nt, Human
ugcugggacucagccu

SEQ ID NO: 3618148 - RNA, 17 nt, Human
ugcugggacugagccag

SEQ ID NO: 3618149 - RNA, 16 nt, Human
ugcugggagaggcagc

SEQ ID NO: 3618150 - RNA, 15 nt, Human
ugcugggagcuccac

SEQ ID NO: 3618151 - RNA, 22 nt, Human
ugcugggagcuccacucugcuu

SEQ ID NO: 3618152 - RNA, 14 nt, Human
ugcugggagcugaa

SEQ ID NO: 3618153 - RNA, 23 nt, Human
ugcugggauggugggcuucaggg

SEQ ID NO: 3618154 - RNA, 21 nt, Human
ugcugggauuacaagcgugag

SEQ ID NO: 3618155 - RNA, 16 nt, Human
ugcugggauuacagac

SEQ ID NO: 3618156 - RNA, 17 nt, Human
ugcugggauuacaggug

SEQ ID NO: 3618157 - RNA, 14 nt, Human
ugcugggauuucca

SEQ ID NO: 3618158 - RNA, 12 nt, Human
ugcugggcagcc

SEQ ID NO: 3618159 - RNA, 15 nt, Human
ugcugggcagcccgc

SEQ ID NO: 3618160 - RNA, 19 nt, Human
ugcugggccccugccucuc

SEQ ID NO: 3618161 - RNA, 18 nt, Human
ugcugggcggcugugcuu

SEQ ID NO: 3618162 - RNA, 12 nt, Human
ugcugggcucag

SEQ ID NO: 3618163 - RNA, 14 nt, Human
ugcugggcucucca

SEQ ID NO: 3618164 - RNA, 15 nt, Human
ugcugggcucuccac

SEQ ID NO: 3618165 - RNA, 20 nt, Human
ugcugggcucuccaccucag

SEQ ID NO: 3618166 - RNA, 19 nt, Human
ugcugggcugacggugcag

SEQ ID NO: 3618167 - RNA, 13 nt, Human
ugcugggcugggg

SEQ ID NO: 3618168 - RNA, 14 nt, Human
ugcugggcugggug

SEQ ID NO: 3618169 - RNA, 15 nt, Human
ugcugggcugggugc

SEQ ID NO: 3618170 - RNA, 17 nt, Human
ugcugggcuugucugua

SEQ ID NO: 3618171 - RNA, 23 nt, Human
ugcuggggacggggggccccagu

SEQ ID NO: 3618172 - RNA, 18 nt, Human
ugcuggggcaagucccug

SEQ ID NO: 3618173 - RNA, 18 nt, Human
ugcuggggccucagacga

SEQ ID NO: 3618174 - RNA, 17 nt, Human
ugcuggggccugggaca

SEQ ID NO: 3618175 - RNA, 23 nt, Human
ugcuggggccugggacaacugcu

SEQ ID NO: 3618176 - RNA, 15 nt, Human
ugcugggggaaugag

SEQ ID NO: 3618177 - RNA, 23 nt, Human
ugcugggggaaugagcccagaga

SEQ ID NO: 3618178 - RNA, 15 nt, Human
ugcugggggcaacug

SEQ ID NO: 3618179 - RNA, 16 nt, Human
ugcuggguuggugcac

SEQ ID NO: 3618180 - RNA, 18 nt, Human
ugcuggguuggugcacag

SEQ ID NO: 3618181 - RNA, 14 nt, Human
ugcugguaaaauga

SEQ ID NO: 3618182 - RNA, 19 nt, Human
ugcugguaaaaugaagaau

SEQ ID NO: 3618183 - RNA, 19 nt, Human
ugcuggucacagccuccuc

SEQ ID NO: 3618184 - RNA, 22 nt, Human
ugcuggugggcuugucauagcc

SEQ ID NO: 3618185 - RNA, 22 nt, Human
ugcugguguaugugugaaguga

SEQ ID NO: 3618186 - RNA, 17 nt, Human
ugcugguguccugacca

SEQ ID NO: 3618187 - RNA, 16 nt, Human
ugcugguuuuaacaac

SEQ ID NO: 3618188 - RNA, 20 nt, Human
ugcugguuuuaucugaguga

SEQ ID NO: 3618189 - RNA, 15 nt, Human
ugcugguuuuccuaa

SEQ ID NO: 3618190 - RNA, 20 nt, Human
ugcuguaaauaaaugcuuua

SEQ ID NO: 3618191 - RNA, 22 nt, Human
ugcuguaagaugucuguuugcu

SEQ ID NO: 3618192 - RNA, 22 nt, Human
ugcuguacauacuuuuuggguu

SEQ ID NO: 3618193 - RNA, 16 nt, Human
ugcuguacaucuauuu

SEQ ID NO: 3618194 - RNA, 16 nt, Human
ugcuguagaugacaac

SEQ ID NO: 3618195 - RNA, 14 nt, Human
ugcuguauaaaauc

SEQ ID NO: 3618196 - RNA, 16 nt, Human
ugcuguauaaaaucag

SEQ ID NO: 3618197 - RNA, 22 nt, Human
ugcuguauauggaauucuuuua

SEQ ID NO: 3618198 - RNA, 23 nt, Human
ugcuguauccauccauggggcug

SEQ ID NO: 3618199 - RNA, 13 nt, Human
ugcuguauuuuaa

SEQ ID NO: 3618200 - RNA, 22 nt, Human
ugcuguauuuuaaaagaaugau

SEQ ID NO: 3618201 - RNA, 20 nt, Human
ugcugucaaguuccuuuggg

SEQ ID NO: 3618202 - RNA, 18 nt, Human
ugcugucagucuugaccu

SEQ ID NO: 3618203 - RNA, 14 nt, Human
ugcugucauugcuu

SEQ ID NO: 3618204 - RNA, 20 nt, Human
ugcugucauugcuucuucug

SEQ ID NO: 3618205 - RNA, 21 nt, Human
ugcugucauugcuucuucuga

SEQ ID NO: 3618206 - RNA, 13 nt, Human
ugcuguccccucu

SEQ ID NO: 3618207 - RNA, 15 nt, Human
ugcuguccccucuug

SEQ ID NO: 3618208 - RNA, 17 nt, Human
ugcugucccuuacguga

SEQ ID NO: 3618209 - RNA, 17 nt, Human
ugcugucccuuuuccuu

SEQ ID NO: 3618210 - RNA, 14 nt, Human
ugcuguccucaggu

SEQ ID NO: 3618211 - RNA, 14 nt, Human
ugcuguccugaucu

SEQ ID NO: 3618212 - RNA, 14 nt, Human
ugcuguccuugaau

SEQ ID NO: 3618213 - RNA, 18 nt, Human
ugcugucuaaccugugac

SEQ ID NO: 3618214 - RNA, 19 nt, Human
ugcugucucugcucgcccu

SEQ ID NO: 3618215 - RNA, 19 nt, Human
ugcugucugaucugugcuu

SEQ ID NO: 3618216 - RNA, 13 nt, Human
ugcugucugcagc

SEQ ID NO: 3618217 - RNA, 15 nt, Human
ugcugucuggcacag

SEQ ID NO: 3618218 - RNA, 19 nt, Human
ugcugucuggcacagccug

SEQ ID NO: 3618219 - RNA, 18 nt, Human
ugcugucuggguggcuca

SEQ ID NO: 3618220 - RNA, 14 nt, Human
ugcugucuuuucuu

SEQ ID NO: 3618221 - RNA, 22 nt, Human
ugcugucuuuucuuugccaucu

SEQ ID NO: 3618222 - RNA, 13 nt, Human
ugcugugaaaaaa

SEQ ID NO: 3618223 - RNA, 18 nt, Human
ugcugugaacaagugaac

SEQ ID NO: 3618224 - RNA, 18 nt, Human
ugcugugaauuagcucac

SEQ ID NO: 3618225 - RNA, 19 nt, Human
ugcugugaauuagcucacu

SEQ ID NO: 3618226 - RNA, 16 nt, Human
ugcugugaggcugucc

SEQ ID NO: 3618227 - RNA, 20 nt, Human
ugcugugauacgaugcuuca

SEQ ID NO: 3618228 - RNA, 22 nt, Human
ugcugugauacgaugcuucaag

SEQ ID NO: 3618229 - RNA, 13 nt, Human
ugcugugcaaaug

SEQ ID NO: 3618230 - RNA, 15 nt, Human
ugcugugccccuggc

SEQ ID NO: 3618231 - RNA, 17 nt, Human
ugcugugcgcccagggc

SEQ ID NO: 3618232 - RNA, 15 nt, Human
ugcugugcugugcua

SEQ ID NO: 3618233 - RNA, 18 nt, Human
ugcugugcugugcuaugg

SEQ ID NO: 3618234 - RNA, 13 nt, Human
ugcuguggaagca

SEQ ID NO: 3618235 - RNA, 14 nt, Human
ugcuguggccagga

SEQ ID NO: 3618236 - RNA, 16 nt, Human
ugcuguggccaggagg

SEQ ID NO: 3618237 - RNA, 12 nt, Human
ugcuguggccug

SEQ ID NO: 3618238 - RNA, 14 nt, Human
ugcuguggccuggg

SEQ ID NO: 3618239 - RNA, 14 nt, Human
ugcugugggaacga

SEQ ID NO: 3618240 - RNA, 16 nt, Human
ugcuguggggcuggua

SEQ ID NO: 3618241 - RNA, 18 nt, Human
ugcuguggggcugguagc

SEQ ID NO: 3618242 - RNA, 23 nt, Human
ugcuguggggcugguagcucagg

SEQ ID NO: 3618243 - RNA, 21 nt, Human
ugcugugggugauauggacag

SEQ ID NO: 3618244 - RNA, 16 nt, Human
ugcugugguguguccc

SEQ ID NO: 3618245 - RNA, 23 nt, Human
ugcuguggugugucccccucugu

SEQ ID NO: 3618246 - RNA, 17 nt, Human
ugcugugguuccugggg

SEQ ID NO: 3618247 - RNA, 12 nt, Human
ugcuguguaaaa

SEQ ID NO: 3618248 - RNA, 17 nt, Human
ugcuguguaaaguuagu

SEQ ID NO: 3618249 - RNA, 16 nt, Human
ugcuguguaacacugu

SEQ ID NO: 3618250 - RNA, 18 nt, Human
ugcuguguccaacuccag

SEQ ID NO: 3618251 - RNA, 13 nt, Human
ugcugugugccuu

SEQ ID NO: 3618252 - RNA, 21 nt, Human
ugcugugugcuuuuuuugugu

SEQ ID NO: 3618253 - RNA, 11 nt, Human
ugcuguguggu

SEQ ID NO: 3618254 - RNA, 21 nt, Human
ugcugugugucccaggcaggg

SEQ ID NO: 3618255 - RNA, 21 nt, Human
ugcuguguguugccugggaca

SEQ ID NO: 3618256 - RNA, 16 nt, Human
ugcuguguuuaauuug

SEQ ID NO: 3618257 - RNA, 17 nt, Human
ugcuguuacaguuuucu

SEQ ID NO: 3618258 - RNA, 14 nt, Human
ugcuguuacuguua

SEQ ID NO: 3618259 - RNA, 20 nt, Human
ugcuguuacuguuaaccauu

SEQ ID NO: 3618260 - RNA, 20 nt, Human
ugcuguuaugucuguuuaag

SEQ ID NO: 3618261 - RNA, 15 nt, Human
ugcuguuccuuacuu

SEQ ID NO: 3618262 - RNA, 18 nt, Human
ugcuguugacauauuuaa

SEQ ID NO: 3618263 - RNA, 21 nt, Human
ugcuguugacauauuuaaugu

SEQ ID NO: 3618264 - RNA, 17 nt, Human
ugcuguugauguuuugu

SEQ ID NO: 3618265 - RNA, 16 nt, Human
ugcuguugauugcuaa

SEQ ID NO: 3618266 - RNA, 22 nt, Human
ugcuguugauugcuaaauguaa

SEQ ID NO: 3618267 - RNA, 13 nt, Human
ugcuguugcuuga

SEQ ID NO: 3618268 - RNA, 18 nt, Human
ugcuguugcuugaauagc

SEQ ID NO: 3618269 - RNA, 14 nt, Human
ugcuguuggucaug

SEQ ID NO: 3618270 - RNA, 18 nt, Human
ugcuguuguccaacuauu

SEQ ID NO: 3618271 - RNA, 19 nt, Human
ugcuguuguuaugaugugc

SEQ ID NO: 3618272 - RNA, 22 nt, Human
ugcuguuguuaugaugugcuua

SEQ ID NO: 3618273 - RNA, 13 nt, Human
ugcuguuguuucu

SEQ ID NO: 3618274 - RNA, 14 nt, Human
ugcuguuuauuaau

SEQ ID NO: 3618275 - RNA, 17 nt, Human
ugcuguuuauuaaucuu

SEQ ID NO: 3618276 - RNA, 16 nt, Human
ugcuguuucaaaguuc

SEQ ID NO: 3618277 - RNA, 13 nt, Human
ugcuguuucacaa

SEQ ID NO: 3618278 - RNA, 23 nt, Human
ugcuguuucccggggaggaaaca

SEQ ID NO: 3618279 - RNA, 17 nt, Human
ugcuguuugacaccucu

SEQ ID NO: 3618280 - RNA, 15 nt, Human
ugcuguuuuccuccc

SEQ ID NO: 3618281 - RNA, 21 nt, Human
ugcuguuuuccucccuucugc

SEQ ID NO: 3618282 - RNA, 22 nt, Human
ugcuguuuugccagcccauuug

SEQ ID NO: 3618283 - RNA, 16 nt, Human
ugcuguuuuguuauau

SEQ ID NO: 3618284 - RNA, 16 nt, Human
ugcuguuuuguucugu

SEQ ID NO: 3618285 - RNA, 20 nt, Human
ugcuuaaagaauucaaauuu

SEQ ID NO: 3618286 - RNA, 12 nt, Human
ugcuuaaaugug

SEQ ID NO: 3618287 - RNA, 13 nt, Human
ugcuuaaauguga

SEQ ID NO: 3618288 - RNA, 17 nt, Human
ugcuuaaaugugaauua

SEQ ID NO: 3618289 - RNA, 15 nt, Human
ugcuuaaauuucuua

SEQ ID NO: 3618290 - RNA, 13 nt, Human
ugcuuaaauuuua

SEQ ID NO: 3618291 - RNA, 20 nt, Human
ugcuuaaccuuuuuauuuca

SEQ ID NO: 3618292 - RNA, 18 nt, Human
ugcuuaacuucacauauu

SEQ ID NO: 3618293 - RNA, 16 nt, Human
ugcuuaagcagaagca

SEQ ID NO: 3618294 - RNA, 18 nt, Human
ugcuuaagggaguuuaau

SEQ ID NO: 3618295 - RNA, 16 nt, Human
ugcuuaaguuccagca

SEQ ID NO: 3618296 - RNA, 14 nt, Human
ugcuuaaucuucaa

SEQ ID NO: 3618297 - RNA, 15 nt, Human
ugcuuaaucuucaaa

SEQ ID NO: 3618298 - RNA, 20 nt, Human
ugcuuaaucuucaaagccuu

SEQ ID NO: 3618299 - RNA, 20 nt, Human
ugcuuaauuacaauauuucu

SEQ ID NO: 3618300 - RNA, 17 nt, Human
ugcuuaauucaaauaau

SEQ ID NO: 3618301 - RNA, 15 nt, Human
ugcuuaauuucuaaa

SEQ ID NO: 3618302 - RNA, 19 nt, Human
ugcuuaauuucuaaagaua

SEQ ID NO: 3618303 - RNA, 18 nt, Human
ugcuuacaauucccugcu

SEQ ID NO: 3618304 - RNA, 21 nt, Human
ugcuuacaauucccugcuguc

SEQ ID NO: 3618305 - RNA, 13 nt, Human
ugcuuacaauuuu

SEQ ID NO: 3618306 - RNA, 17 nt, Human
ugcuuacacaucucaga

SEQ ID NO: 3618307 - RNA, 14 nt, Human
ugcuuacauuuuua

SEQ ID NO: 3618308 - RNA, 19 nt, Human
ugcuuaccuugacuguuga

SEQ ID NO: 3618309 - RNA, 14 nt, Human
ugcuuacuuuggaa

SEQ ID NO: 3618310 - RNA, 22 nt, Human
ugcuuagagggauuucuuugcu

SEQ ID NO: 3618311 - RNA, 23 nt, Human
ugcuuagagggauuucuuugcug

SEQ ID NO: 3618312 - RNA, 19 nt, Human
ugcuuagccuccugaccug

SEQ ID NO: 3618313 - RNA, 23 nt, Human
ugcuuaggauguuuuucaugaaa

SEQ ID NO: 3618314 - RNA, 13 nt, Human
ugcuuaguaaaau

SEQ ID NO: 3618315 - RNA, 14 nt, Human
ugcuuaguaaaauu

SEQ ID NO: 3618316 - RNA, 16 nt, Human
ugcuuaguaaaauuua

SEQ ID NO: 3618317 - RNA, 13 nt, Human
ugcuuaguaaugc

SEQ ID NO: 3618318 - RNA, 18 nt, Human
ugcuuaguaaugcuacgu

SEQ ID NO: 3618319 - RNA, 14 nt, Human
ugcuuagucacugc

SEQ ID NO: 3618320 - RNA, 19 nt, Human
ugcuuagucacugccugca

SEQ ID NO: 3618321 - RNA, 21 nt, Human
ugcuuagucacuuauuucaua

SEQ ID NO: 3618322 - RNA, 23 nt, Human
ugcuuauaaccuaguuaaagaaa

SEQ ID NO: 3618323 - RNA, 13 nt, Human
ugcuuauacacuu

SEQ ID NO: 3618324 - RNA, 17 nt, Human
ugcuuauagguggccuc

SEQ ID NO: 3618325 - RNA, 21 nt, Human
ugcuuauuccaugacugcuug

SEQ ID NO: 3618326 - RNA, 17 nt, Human
ugcuuauugcuuaguaa

SEQ ID NO: 3618327 - RNA, 21 nt, Human
ugcuuauugcuuaguaaaauu

SEQ ID NO: 3618328 - RNA, 15 nt, Human
ugcuuauuguuccaa

SEQ ID NO: 3618329 - RNA, 18 nt, Human
ugcuuauuuauuguauuc

SEQ ID NO: 3618330 - RNA, 21 nt, Human
ugcuuauuuauuguauucugg

SEQ ID NO: 3618331 - RNA, 23 nt, Human
ugcuuauuugacaacguuucagc

SEQ ID NO: 3618332 - RNA, 17 nt, Human
ugcuuauuuuaaaauuu

SEQ ID NO: 3618333 - RNA, 21 nt, Human
ugcuucaaaaacauucuuaca

SEQ ID NO: 3618334 - RNA, 21 nt, Human
ugcuucaaacucaaacacaga

SEQ ID NO: 3618335 - RNA, 17 nt, Human
ugcuucaaauccaucca

SEQ ID NO: 3618336 - RNA, 23 nt, Human
ugcuucaagagaaaaugcgguua

SEQ ID NO: 3618337 - RNA, 21 nt, Human
ugcuucaaggauccugagcca

SEQ ID NO: 3618338 - RNA, 21 nt, Human
ugcuucaauaguucaaggaac

SEQ ID NO: 3618339 - RNA, 16 nt, Human
ugcuucacaguagagc

SEQ ID NO: 3618340 - RNA, 13 nt, Human
ugcuucagccucc

SEQ ID NO: 3618341 - RNA, 14 nt, Human
ugcuucauacaggg

SEQ ID NO: 3618342 - RNA, 16 nt, Human
ugcuucauacagggau

SEQ ID NO: 3618343 - RNA, 17 nt, Human
ugcuucaugcucagccc

SEQ ID NO: 3618344 - RNA, 17 nt, Human
ugcuucaugugucccag

SEQ ID NO: 3618345 - RNA, 21 nt, Human
ugcuucaugugucccagaaga

SEQ ID NO: 3618346 - RNA, 19 nt, Human
ugcuucauucaauauugac

SEQ ID NO: 3618347 - RNA, 18 nt, Human
ugcuucauucuuugcagg

SEQ ID NO: 3618348 - RNA, 20 nt, Human
ugcuucauuuguaugucaaa

SEQ ID NO: 3618349 - RNA, 17 nt, Human
ugcuuccaccucacccc

SEQ ID NO: 3618350 - RNA, 16 nt, Human
ugcuuccagugaggcu

SEQ ID NO: 3618351 - RNA, 18 nt, Human
ugcuuccagugaggcucu

SEQ ID NO: 3618352 - RNA, 20 nt, Human
ugcuuccagugaggcucugc

SEQ ID NO: 3618353 - RNA, 21 nt, Human
ugcuuccagugaggcucugcc

SEQ ID NO: 3618354 - RNA, 23 nt, Human
ugcuuccauggccguguagaagc

SEQ ID NO: 3618355 - RNA, 14 nt, Human
ugcuucccaccucc

SEQ ID NO: 3618356 - RNA, 19 nt, Human
ugcuucccaccucccugcc

SEQ ID NO: 3618357 - RNA, 16 nt, Human
ugcuucccauccuacc

SEQ ID NO: 3618358 - RNA, 18 nt, Human
ugcuucccauccuacccu

SEQ ID NO: 3618359 - RNA, 17 nt, Human
ugcuucccauuguggcu

SEQ ID NO: 3618360 - RNA, 21 nt, Human
ugcuucccucugccugucccu

SEQ ID NO: 3618361 - RNA, 20 nt, Human
ugcuucccuuuuuuccuuuc

SEQ ID NO: 3618362 - RNA, 23 nt, Human
ugcuucccuuuuuuccuuuccac

SEQ ID NO: 3618363 - RNA, 22 nt, Human
ugcuuccgguagggaggcagcc

SEQ ID NO: 3618364 - RNA, 12 nt, Human
ugcuuccuagaa

SEQ ID NO: 3618365 - RNA, 20 nt, Human
ugcuuccuagaaguuacuga

SEQ ID NO: 3618366 - RNA, 18 nt, Human
ugcuuccuauaauuuuga

SEQ ID NO: 3618367 - RNA, 23 nt, Human
ugcuuccucccaacaagcagcug

SEQ ID NO: 3618368 - RNA, 12 nt, Human
ugcuuccuccug

SEQ ID NO: 3618369 - RNA, 15 nt, Human
ugcuucgggcccuuc

SEQ ID NO: 3618370 - RNA, 18 nt, Human
ugcuucuaaguaaauaca

SEQ ID NO: 3618371 - RNA, 20 nt, Human
ugcuucuaaguaaauacaau

SEQ ID NO: 3618372 - RNA, 18 nt, Human
ugcuucuaccaacuggaa

SEQ ID NO: 3618373 - RNA, 23 nt, Human
ugcuucuaccaacuggaagcaca

SEQ ID NO: 3618374 - RNA, 19 nt, Human
ugcuucuaguucugccagg

SEQ ID NO: 3618375 - RNA, 20 nt, Human
ugcuucuaguucugccagga

SEQ ID NO: 3618376 - RNA, 22 nt, Human
ugcuucucagauuucugaggaa

SEQ ID NO: 3618377 - RNA, 15 nt, Human
ugcuucuccagccug

SEQ ID NO: 3618378 - RNA, 17 nt, Human
ugcuucuccaugagaca

SEQ ID NO: 3618379 - RNA, 21 nt, Human
ugcuucucccaggcaaggcug

SEQ ID NO: 3618380 - RNA, 16 nt, Human
ugcuucucuacagacu

SEQ ID NO: 3618381 - RNA, 12 nt, Human
ugcuucucugac

SEQ ID NO: 3618382 - RNA, 13 nt, Human
ugcuucucugacu

SEQ ID NO: 3618383 - RNA, 18 nt, Human
ugcuucucugcccagcuu

SEQ ID NO: 3618384 - RNA, 14 nt, Human
ugcuucugggaagg

SEQ ID NO: 3618385 - RNA, 20 nt, Human
ugcuucuguaguacuccuua

SEQ ID NO: 3618386 - RNA, 14 nt, Human
ugcuucuguuuuau

SEQ ID NO: 3618387 - RNA, 17 nt, Human
ugcuucuuaaccccagu

SEQ ID NO: 3618388 - RNA, 13 nt, Human
ugcuucuucagag

SEQ ID NO: 3618389 - RNA, 16 nt, Human
ugcuucuucucaggca

SEQ ID NO: 3618390 - RNA, 14 nt, Human
ugcuucuuggaguc

SEQ ID NO: 3618391 - RNA, 12 nt, Human
ugcuucuuguga

SEQ ID NO: 3618392 - RNA, 20 nt, Human
ugcuucuugugaaggccaug

SEQ ID NO: 3618393 - RNA, 19 nt, Human
ucccuggcucucagaaggu

SEQ ID NO: 3618394 - RNA, 17 nt, Human
ucccuggcuucuguggg

SEQ ID NO: 3618395 - RNA, 14 nt, Human
ucccugggaggccc

SEQ ID NO: 3618396 - RNA, 23 nt, Human
ucccugggagggacaugcuuagc

SEQ ID NO: 3618397 - RNA, 17 nt, Human
ucccugggcauugcuuu

SEQ ID NO: 3618398 - RNA, 17 nt, Human
ucccugggccagggucu

SEQ ID NO: 3618399 - RNA, 18 nt, Human
ucccugggccagggucug

SEQ ID NO: 3618400 - RNA, 14 nt, Human
uggggcgaggcagg

SEQ ID NO: 3618401 - RNA, 17 nt, Human
uggggcgcgugaggccc

SEQ ID NO: 3618402 - RNA, 17 nt, Human
uggggcgggaaagccag

SEQ ID NO: 3618403 - RNA, 14 nt, Human
uggggcguggggag

SEQ ID NO: 3618404 - RNA, 20 nt, Human
uggggcuaaagacugaucuc

SEQ ID NO: 3618405 - RNA, 17 nt, Human
aagcuuauuaaugcuaa

SEQ ID NO: 3618406 - RNA, 16 nt, Human
aagcuucaguugcuug

SEQ ID NO: 3618407 - RNA, 20 nt, Human
aagcuucaugcacuuaaaga

SEQ ID NO: 3618408 - RNA, 21 nt, Human
aagcuucaugcacuuaaagaa

SEQ ID NO: 3618409 - RNA, 21 nt, Human
aagcuuccaggaaaaaggaca

SEQ ID NO: 3618410 - RNA, 20 nt, Human
aagcuuccauagcugcugcc

SEQ ID NO: 3618411 - RNA, 15 nt, Human
aagcuuccaugauuc

SEQ ID NO: 3618412 - RNA, 16 nt, Human
aagcuuccaugauucu

SEQ ID NO: 3618413 - RNA, 17 nt, Human
aagcuucccucccugcu

SEQ ID NO: 3618414 - RNA, 11 nt, Human
aagcuucuaau

SEQ ID NO: 3618415 - RNA, 19 nt, Human
aagcuucuaauaaauuaua

SEQ ID NO: 3618416 - RNA, 19 nt, Human
aagcuucuuaauuaauuug

SEQ ID NO: 3618417 - RNA, 21 nt, Human
aagcuucuuaauuaauuugau

SEQ ID NO: 3618418 - RNA, 17 nt, Human
aagcuugacucccaagu

SEQ ID NO: 3618419 - RNA, 18 nt, Human
aagcuugacucccaaguu

SEQ ID NO: 3618420 - RNA, 18 nt, Human
aagcuuggauuaaauaca

SEQ ID NO: 3618421 - RNA, 14 nt, Human
aagcuuggcagccg

SEQ ID NO: 3618422 - RNA, 21 nt, Human
aagcuuggcuguagaaggaga

SEQ ID NO: 3618423 - RNA, 17 nt, Human
aagcuugguucugugaa

SEQ ID NO: 3618424 - RNA, 23 nt, Human
aagcuuguauuccuuuuucucuc

SEQ ID NO: 3618425 - RNA, 21 nt, Human
aagcuuucagaauaugucagu

SEQ ID NO: 3618426 - RNA, 21 nt, Human
aagcuuucaguauuagugaug

SEQ ID NO: 3618427 - RNA, 12 nt, Human
aagcuuuccugc

SEQ ID NO: 3618428 - RNA, 16 nt, Human
aagcuuuccugcccca

SEQ ID NO: 3618429 - RNA, 17 nt, Human
aagcuuuccuguugaau

SEQ ID NO: 3618430 - RNA, 19 nt, Human
aagcuuugaauacuaaauu

SEQ ID NO: 3618431 - RNA, 14 nt, Human
aagcuuugacacug

SEQ ID NO: 3618432 - RNA, 16 nt, Human
aagcuuugauuuagau

SEQ ID NO: 3618433 - RNA, 17 nt, Human
aagcuuugccagcugcu

SEQ ID NO: 3618434 - RNA, 15 nt, Human
aagcuuuguccccug

SEQ ID NO: 3618435 - RNA, 18 nt, Human
aagcuuuguccccugcuu

SEQ ID NO: 3618436 - RNA, 16 nt, Human
aagcuuuguuuguucu

SEQ ID NO: 3618437 - RNA, 13 nt, Human
aagcuuuucuauu

SEQ ID NO: 3618438 - RNA, 17 nt, Human
aagcuuuucuauuuuaa

SEQ ID NO: 3618439 - RNA, 15 nt, Human
aagcuuuugcauauu

SEQ ID NO: 3618440 - RNA, 22 nt, Human
aagcuuuugcauauugcauacu

SEQ ID NO: 3618441 - RNA, 19 nt, Human
aagcuuuugucuacacacc

SEQ ID NO: 3618442 - RNA, 16 nt, Human
aagcuuuuuccuccug

SEQ ID NO: 3618443 - RNA, 17 nt, Human
aagcuuuuuuauuuuuu

SEQ ID NO: 3618444 - RNA, 22 nt, Human
aagcuuuuuuauuuuuuauaca

SEQ ID NO: 3618445 - RNA, 19 nt, Human
aaggaaaaaauaacaauga

SEQ ID NO: 3618446 - RNA, 15 nt, Human
aaggaaaaaauguug

SEQ ID NO: 3618447 - RNA, 20 nt, Human
aaggaaaaacacaagcaaaa

SEQ ID NO: 3618448 - RNA, 10 nt, Human
aaggaaaaag

SEQ ID NO: 3618449 - RNA, 15 nt, Human
aaggaaaaagcucca

SEQ ID NO: 3618450 - RNA, 23 nt, Human
aaggaaaaagcuccaugugccuc

SEQ ID NO: 3618451 - RNA, 17 nt, Human
aaggaaaaauaaauauu

SEQ ID NO: 3618452 - RNA, 21 nt, Human
aaggaaaaauguguaauuuug

SEQ ID NO: 3618453 - RNA, 16 nt, Human
aaggaaaacuaccugu

SEQ ID NO: 3618454 - RNA, 16 nt, Human
aaggaaaacugcaugg

SEQ ID NO: 3618455 - RNA, 15 nt, Human
aaggaaaagaaaaaa

SEQ ID NO: 3618456 - RNA, 17 nt, Human
aaggaaaauaguaaugu

SEQ ID NO: 3618457 - RNA, 15 nt, Human
aaggaaacccagcuc

SEQ ID NO: 3618458 - RNA, 16 nt, Human
aaggaaacucuuaucu

SEQ ID NO: 3618459 - RNA, 15 nt, Human
aaggaaagagggagg

SEQ ID NO: 3618460 - RNA, 20 nt, Human
aaggaaagcaauaaaugaau

SEQ ID NO: 3618461 - RNA, 18 nt, Human
aaggaaagcuguguuuau

SEQ ID NO: 3618462 - RNA, 22 nt, Human
aaggaaauaaaaaagucucuau

SEQ ID NO: 3618463 - RNA, 16 nt, Human
aaggaaaucucacccc

SEQ ID NO: 3618464 - RNA, 22 nt, Human
aaggaaccaaagcgaauuuuaa

SEQ ID NO: 3618465 - RNA, 13 nt, Human
aaggaaccaacaa

SEQ ID NO: 3618466 - RNA, 17 nt, Human
aaggaaccaacaaucuu

SEQ ID NO: 3618467 - RNA, 13 nt, Human
aaggaaccuuccu

SEQ ID NO: 3618468 - RNA, 17 nt, Human
aaggaacuugaaaaaua

SEQ ID NO: 3618469 - RNA, 13 nt, Human
aaggaagaaaaau

SEQ ID NO: 3618470 - RNA, 15 nt, Human
aaggaagaaaaauca

SEQ ID NO: 3618471 - RNA, 13 nt, Human
aaggaagacuaga

SEQ ID NO: 3618472 - RNA, 22 nt, Human
aaggaagcauuguaaaauaauu

SEQ ID NO: 3618473 - RNA, 16 nt, Human
aaggaagccaaauuua

SEQ ID NO: 3618474 - RNA, 16 nt, Human
aaggaagcuccacugu

SEQ ID NO: 3618475 - RNA, 19 nt, Human
aaggaagcuuucucugcuu

SEQ ID NO: 3618476 - RNA, 12 nt, Human
aaggaaggaaag

SEQ ID NO: 3618477 - RNA, 20 nt, Human
aaggaaggagacucaccucu

SEQ ID NO: 3618478 - RNA, 22 nt, Human
aaggaaggagacucaccucugc

SEQ ID NO: 3618479 - RNA, 16 nt, Human
aaggaagguaaaaagu

SEQ ID NO: 3618480 - RNA, 12 nt, Human
aaggaaggugga

SEQ ID NO: 3618481 - RNA, 16 nt, Human
aaggaagguucuggug

SEQ ID NO: 3618482 - RNA, 17 nt, Human
aaggaagguuuucucca

SEQ ID NO: 3618483 - RNA, 21 nt, Human
aaggaagucaaagcaaggaaa

SEQ ID NO: 3618484 - RNA, 21 nt, Human
aaggaauaaauugcuccuuga

SEQ ID NO: 3618485 - RNA, 17 nt, Human
aaggaauagaagcaaau

SEQ ID NO: 3618486 - RNA, 16 nt, Human
aaggaauauauggcag

SEQ ID NO: 3618487 - RNA, 21 nt, Human
aaggaauccacucccaggcag

SEQ ID NO: 3618488 - RNA, 16 nt, Human
aaggaauuaucaauua

SEQ ID NO: 3618489 - RNA, 15 nt, Human
aaggaauucuaggca

SEQ ID NO: 3618490 - RNA, 20 nt, Human
aaggaauucuaggcauccca

SEQ ID NO: 3618491 - RNA, 19 nt, Human
aaggaauuuugcuaaguaa

SEQ ID NO: 3618492 - RNA, 17 nt, Human
aaggacaaagucuccag

SEQ ID NO: 3618493 - RNA, 16 nt, Human
aaggacaaagugccaa

SEQ ID NO: 3618494 - RNA, 20 nt, Human
aaggacaaagugccaaagaa

SEQ ID NO: 3618495 - RNA, 18 nt, Human
aaggacacagaugaaaca

SEQ ID NO: 3618496 - RNA, 22 nt, Human
aaggacacagaugaaacacaaa

SEQ ID NO: 3618497 - RNA, 13 nt, Human
aaggacacuagaa

SEQ ID NO: 3618498 - RNA, 17 nt, Human
aaggacacuuccugccu

SEQ ID NO: 3618499 - RNA, 19 nt, Human
aaggacagccccuccucca

SEQ ID NO: 3618500 - RNA, 15 nt, Human
aaggacaggcagaaa

SEQ ID NO: 3618501 - RNA, 21 nt, Human
aaggacaguccuauuuagaca

SEQ ID NO: 3618502 - RNA, 15 nt, Human
aaggacaucagcaaa

SEQ ID NO: 3618503 - RNA, 17 nt, Human
aaggacaucagcaaaca

SEQ ID NO: 3618504 - RNA, 15 nt, Human
aaggacauucuugua

SEQ ID NO: 3618505 - RNA, 18 nt, Human
aaggacauugcggacagc

SEQ ID NO: 3618506 - RNA, 12 nt, Human
aaggaccaggac

SEQ ID NO: 3618507 - RNA, 13 nt, Human
aaggaccaggacu

SEQ ID NO: 3618508 - RNA, 18 nt, Human
aaggacccggaggggccu

SEQ ID NO: 3618509 - RNA, 20 nt, Human
aaggacccuucagagguggc

SEQ ID NO: 3618510 - RNA, 19 nt, Human
aaggaccguggcccugccc

SEQ ID NO: 3618511 - RNA, 12 nt, Human
aaggaccuaaaa

SEQ ID NO: 3618512 - RNA, 15 nt, Human
aaggaccuaaaaauu

SEQ ID NO: 3618513 - RNA, 12 nt, Human
aaggaccuuaag

SEQ ID NO: 3618514 - RNA, 22 nt, Human
aaggaccuucacucuaagaugu

SEQ ID NO: 3618515 - RNA, 21 nt, Human
aaggacugugacaggcagcag

SEQ ID NO: 3618516 - RNA, 23 nt, Human
aaggacuguuuuuuccugagcuu

SEQ ID NO: 3618517 - RNA, 21 nt, Human
aaggacuuguuagaucuaguu

SEQ ID NO: 3618518 - RNA, 19 nt, Human
aaggagaaacagagacagg

SEQ ID NO: 3618519 - RNA, 18 nt, Human
aaggagaaucauguuucu

SEQ ID NO: 3618520 - RNA, 14 nt, Human
aaggagaaugaauc

SEQ ID NO: 3618521 - RNA, 14 nt, Human
aaggagacacagau

SEQ ID NO: 3618522 - RNA, 15 nt, Human
aaggagacacagaug

SEQ ID NO: 3618523 - RNA, 17 nt, Human
aaggagacucaccucug

SEQ ID NO: 3618524 - RNA, 14 nt, Human
aaggagacuguguu

SEQ ID NO: 3618525 - RNA, 11 nt, Human
aaggagagaaa

SEQ ID NO: 3618526 - RNA, 16 nt, Human
aaggagagaaaguggg

SEQ ID NO: 3618527 - RNA, 20 nt, Human
aaggagagacucccaugaag

SEQ ID NO: 3618528 - RNA, 21 nt, Human
aaggagagacucccaugaagc

SEQ ID NO: 3618529 - RNA, 13 nt, Human
aaggagagccugc

SEQ ID NO: 3618530 - RNA, 17 nt, Human
aaggagauagggaaaag

SEQ ID NO: 3618531 - RNA, 18 nt, Human
aaggagauguaagagcuu

SEQ ID NO: 3618532 - RNA, 18 nt, Human
aaggagauuuuccuuccu

SEQ ID NO: 3618533 - RNA, 23 nt, Human
aaggagcagagcugauggagaag

SEQ ID NO: 3618534 - RNA, 15 nt, Human
aaggagccaguuugc

SEQ ID NO: 3618535 - RNA, 17 nt, Human
aaggagccccauuccug

SEQ ID NO: 3618536 - RNA, 16 nt, Human
aaggagcugagaauag

SEQ ID NO: 3618537 - RNA, 13 nt, Human
aaggagcugccug

SEQ ID NO: 3618538 - RNA, 14 nt, Human
aaggagcugcuaua

SEQ ID NO: 3618539 - RNA, 18 nt, Human
aaggagcugcuauagccu

SEQ ID NO: 3618540 - RNA, 14 nt, Human
ugggagagcccagc

SEQ ID NO: 3618541 - RNA, 16 nt, Human
ugggagagccuuccag

SEQ ID NO: 3618542 - RNA, 16 nt, Human
ugggagaggcagagug

SEQ ID NO: 3618543 - RNA, 22 nt, Human
ugggagaggcagcccaggaagu

SEQ ID NO: 3618544 - RNA, 13 nt, Human
ugggagagggcgc

SEQ ID NO: 3618545 - RNA, 20 nt, Human
ugggagagggcgcaggccgu

SEQ ID NO: 3618546 - RNA, 21 nt, Human
ugggagagugucaaccagaca

SEQ ID NO: 3618547 - RNA, 20 nt, Human
ugggagcaaacugcaugccc

SEQ ID NO: 3618548 - RNA, 22 nt, Human
ugggagcaaacugcaugcccag

SEQ ID NO: 3618549 - RNA, 13 nt, Human
ugggagcacugga

SEQ ID NO: 3618550 - RNA, 23 nt, Human
ugggagcagcccgcugaguggac

SEQ ID NO: 3618551 - RNA, 11 nt, Human
ugggagcagga

SEQ ID NO: 3618552 - RNA, 22 nt, Human
ugggagcaggagauugagaagg

SEQ ID NO: 3618553 - RNA, 15 nt, Human
ugggagcaggauuuu

SEQ ID NO: 3618554 - RNA, 13 nt, Human
ugggagccccagg

SEQ ID NO: 3618555 - RNA, 22 nt, Human
ugggagccccagggucuucccu

SEQ ID NO: 3618556 - RNA, 23 nt, Human
ugggagccccagggucuucccua

SEQ ID NO: 3618557 - RNA, 15 nt, Human
ugggagcccccagcc

SEQ ID NO: 3618558 - RNA, 17 nt, Human
ugggagcccccagccug

SEQ ID NO: 3618559 - RNA, 18 nt, Human
ugggagcccccagccugu

SEQ ID NO: 3618560 - RNA, 13 nt, Human
ugggagccgggca

SEQ ID NO: 3618561 - RNA, 23 nt, Human
ugggagccgggucugccucuucu

SEQ ID NO: 3618562 - RNA, 22 nt, Human
ugggagccugcaaacucacugc

SEQ ID NO: 3618563 - RNA, 20 nt, Human
ugggagcgugggaggcggga

SEQ ID NO: 3618564 - RNA, 15 nt, Human
ugggagcuccucucc

SEQ ID NO: 3618565 - RNA, 19 nt, Human
ugggagcuccucuccugga

SEQ ID NO: 3618566 - RNA, 22 nt, Human
ugggagcuccucuccuggagga

SEQ ID NO: 3618567 - RNA, 22 nt, Human
ugggagcugccuguucagcucc

SEQ ID NO: 3618568 - RNA, 24 nt, Human
ugggagcugccuguucagcuccag

SEQ ID NO: 3618569 - RNA, 18 nt, Human
ugggagcuggaguccacu

SEQ ID NO: 3618570 - RNA, 18 nt, Human
ugggaggaaagagagcag

SEQ ID NO: 3618571 - RNA, 12 nt, Human
ugggaggaagca

SEQ ID NO: 3618572 - RNA, 13 nt, Human
ugggaggaagcag

SEQ ID NO: 3618573 - RNA, 14 nt, Human
ugggaggaagcaga

SEQ ID NO: 3618574 - RNA, 16 nt, Human
ugggaggaagcagaau

SEQ ID NO: 3618575 - RNA, 13 nt, Human
ugggaggaaggac

SEQ ID NO: 3618576 - RNA, 19 nt, Human
ugggaggacggugcaaccc

SEQ ID NO: 3618577 - RNA, 13 nt, Human
ugggaggagcaga

SEQ ID NO: 3618578 - RNA, 20 nt, Human
ugggaggauucuaugaggca

SEQ ID NO: 3618579 - RNA, 22 nt, Human
ugggaggauugcuugagcucag

SEQ ID NO: 3618580 - RNA, 18 nt, Human
ugggaggcaagaggggug

SEQ ID NO: 3618581 - RNA, 14 nt, Human
ugggaggcacagca

SEQ ID NO: 3618582 - RNA, 20 nt, Human
ugggaggccccacuggggaa

SEQ ID NO: 3618583 - RNA, 20 nt, Human
ugggaggccuuucccuaagc

SEQ ID NO: 3618584 - RNA, 22 nt, Human
ugggaggcggagaguacaguga

SEQ ID NO: 3618585 - RNA, 22 nt, Human
ugggaggcucacccccuucucc

SEQ ID NO: 3618586 - RNA, 22 nt, Human
ugggaggcuccuguuagcuccu

SEQ ID NO: 3618587 - RNA, 14 nt, Human
ugggaggcucugga

SEQ ID NO: 3618588 - RNA, 11 nt, Human
ugggaggcuga

SEQ ID NO: 3618589 - RNA, 13 nt, Human
ugggaggcugagg

SEQ ID NO: 3618590 - RNA, 14 nt, Human
ugggaggcugaggc

SEQ ID NO: 3618591 - RNA, 15 nt, Human
ugggaggcugaggca

SEQ ID NO: 3618592 - RNA, 14 nt, Human
ugggaggcugaggu

SEQ ID NO: 3618593 - RNA, 12 nt, Human
ugggagggagcu

SEQ ID NO: 3618594 - RNA, 21 nt, Human
ugggagggauggcccuuccuc

SEQ ID NO: 3618595 - RNA, 19 nt, Human
ugggagggcagcagggcua

SEQ ID NO: 3618596 - RNA, 14 nt, Human
ugggaggggcaggc

SEQ ID NO: 3618597 - RNA, 17 nt, Human
ugggaggggcaggcuga

SEQ ID NO: 3618598 - RNA, 23 nt, Human
ugggagggggcuugaagccaaag

SEQ ID NO: 3618599 - RNA, 23 nt, Human
ugggaggucaaggcugcagugag

SEQ ID NO: 3618600 - RNA, 14 nt, Human
ugggaggucuugcu

SEQ ID NO: 3618601 - RNA, 20 nt, Human
ugggagguguuggcugcacg

SEQ ID NO: 3618602 - RNA, 20 nt, Human
ugggaguacucucaucacua

SEQ ID NO: 3618603 - RNA, 12 nt, Human
ugggaguccagg

SEQ ID NO: 3618604 - RNA, 21 nt, Human
ugggagugaggaugucugggc

SEQ ID NO: 3618605 - RNA, 22 nt, Human
ugggagugaggaugucugggcc

SEQ ID NO: 3618606 - RNA, 14 nt, Human
ugggagugggccca

SEQ ID NO: 3618607 - RNA, 17 nt, Human
ugggaguucagcugcuu

SEQ ID NO: 3618608 - RNA, 16 nt, Human
ugggaguugucauuaa

SEQ ID NO: 3618609 - RNA, 20 nt, Human
ugggaguuuuuaugagaaac

SEQ ID NO: 3618610 - RNA, 13 nt, Human
ugggauaggaaaa

SEQ ID NO: 3618611 - RNA, 21 nt, Human
ugggauaggaaaaaugaguaa

SEQ ID NO: 3618612 - RNA, 19 nt, Human
ugggaucagggguaggaau

SEQ ID NO: 3618613 - RNA, 18 nt, Human
ugggaucaugaaaguaga

SEQ ID NO: 3618614 - RNA, 15 nt, Human
ugggauccaggcccc

SEQ ID NO: 3618615 - RNA, 20 nt, Human
ugggauccaggccccucccu

SEQ ID NO: 3618616 - RNA, 19 nt, Human
ugggaucccugucuuuccu

SEQ ID NO: 3618617 - RNA, 13 nt, Human
ugggauccuccag

SEQ ID NO: 3618618 - RNA, 18 nt, Human
ugggauccuccaggugca

SEQ ID NO: 3618619 - RNA, 14 nt, Human
ugggaucugacugc

SEQ ID NO: 3618620 - RNA, 13 nt, Human
ugggaucugcccc

SEQ ID NO: 3618621 - RNA, 17 nt, Human
ugggaugauugaagaaa

SEQ ID NO: 3618622 - RNA, 17 nt, Human
ugggaugguggagggcc

SEQ ID NO: 3618623 - RNA, 23 nt, Human
ugggauguaugaauacagcagca

SEQ ID NO: 3618624 - RNA, 20 nt, Human
ugggauguucagcacugucc

SEQ ID NO: 3618625 - RNA, 22 nt, Human
ugggauguucagcacugucccu

SEQ ID NO: 3618626 - RNA, 21 nt, Human
ugggauuacaggcaugugcca

SEQ ID NO: 3618627 - RNA, 21 nt, Human
ugggauuacaggcgugagcca

SEQ ID NO: 3618628 - RNA, 24 nt, Human
ugggauuacaggcuccugccacca

SEQ ID NO: 3618629 - RNA, 16 nt, Human
ugggauuacaggugug

SEQ ID NO: 3618630 - RNA, 17 nt, Human
ugggauuacagguguga

SEQ ID NO: 3618631 - RNA, 15 nt, Human
ugggauuauggguca

SEQ ID NO: 3618632 - RNA, 17 nt, Human
ugggauucaggaaugug

SEQ ID NO: 3618633 - RNA, 15 nt, Human
aagcgcccuggcccc

SEQ ID NO: 3618634 - RNA, 14 nt, Human
aagcgccuccaacc

SEQ ID NO: 3618635 - RNA, 22 nt, Human
aagcgcuagaggaagcagccaa

SEQ ID NO: 3618636 - RNA, 23 nt, Human
aagcgcuuuuccuuggcauuccg

SEQ ID NO: 3618637 - RNA, 21 nt, Human
aagcggagguugcagggagcc

SEQ ID NO: 3618638 - RNA, 17 nt, Human
aagcgugagccacugca

SEQ ID NO: 3618639 - RNA, 20 nt, Human
aagcgugagccacugcaccg

SEQ ID NO: 3618640 - RNA, 22 nt, Human
aagcgugagcuuaaaauacaag

SEQ ID NO: 3618641 - RNA, 21 nt, Human
aagcgugcacaaggauugaaa

SEQ ID NO: 3618642 - RNA, 23 nt, Human
aagcgugcacaaggauugaaaau

SEQ ID NO: 3618643 - RNA, 21 nt, Human
aagcuaaauccuuuacuguua

SEQ ID NO: 3618644 - RNA, 21 nt, Human
aagcuaacagggaaggcaggc

SEQ ID NO: 3618645 - RNA, 23 nt, Human
aagcuaacagggaaggcaggcag

SEQ ID NO: 3618646 - RNA, 21 nt, Human
aagcuaauaaaauaucauuca

SEQ ID NO: 3618647 - RNA, 23 nt, Human
aagcuaaugacgaggaaccgaaa

SEQ ID NO: 3618648 - RNA, 20 nt, Human
aagcuaauugggaguccagg

SEQ ID NO: 3618649 - RNA, 22 nt, Human
aagcuaauuugcauuaaauuca

SEQ ID NO: 3618650 - RNA, 20 nt, Human
aagcuacagguuacaacaga

SEQ ID NO: 3618651 - RNA, 22 nt, Human
aagcuacuagcaaaauaaaaca

SEQ ID NO: 3618652 - RNA, 17 nt, Human
aagcuacugccauccug

SEQ ID NO: 3618653 - RNA, 19 nt, Human
aagcuacugugugugugaa

SEQ ID NO: 3618654 - RNA, 23 nt, Human
aagcuacugugugugugaaugaa

SEQ ID NO: 3618655 - RNA, 13 nt, Human
aagcuagaaauga

SEQ ID NO: 3618656 - RNA, 17 nt, Human
aagcuagaaccuggagg

SEQ ID NO: 3618657 - RNA, 15 nt, Human
aagcuagacagaucc

SEQ ID NO: 3618658 - RNA, 16 nt, Human
aagcuagcaaauagua

SEQ ID NO: 3618659 - RNA, 12 nt, Human
aagcuagcuccc

SEQ ID NO: 3618660 - RNA, 13 nt, Human
aagcuagcucccc

SEQ ID NO: 3618661 - RNA, 19 nt, Human
aagcuagcuccccuccucu

SEQ ID NO: 3618662 - RNA, 19 nt, Human
aagcuaggaaaagaaaucu

SEQ ID NO: 3618663 - RNA, 20 nt, Human
aagcuaggaaaagaaaucua

SEQ ID NO: 3618664 - RNA, 14 nt, Human
aagcuaggaaugaa

SEQ ID NO: 3618665 - RNA, 12 nt, Human
aagcuaggccug

SEQ ID NO: 3618666 - RNA, 16 nt, Human
aagcuaggccuggcca

SEQ ID NO: 3618667 - RNA, 17 nt, Human
aagcuaggccuggccag

SEQ ID NO: 3618668 - RNA, 19 nt, Human
aagcuaggccuggccagau

SEQ ID NO: 3618669 - RNA, 15 nt, Human
aagcuaggguggccc

SEQ ID NO: 3618670 - RNA, 19 nt, Human
aagcuaggguggcccuugc

SEQ ID NO: 3618671 - RNA, 23 nt, Human
aagcuaggugcuauuugucaucu

SEQ ID NO: 3618672 - RNA, 15 nt, Human
aagcuagucaacagu

SEQ ID NO: 3618673 - RNA, 16 nt, Human
aagcuagucuuuugcu

SEQ ID NO: 3618674 - RNA, 17 nt, Human
aagcuagucuuuugcuu

SEQ ID NO: 3618675 - RNA, 21 nt, Human
aagcuagucuuuugcuuuugc

SEQ ID NO: 3618676 - RNA, 18 nt, Human
aagcuaguggcuucaaaa

SEQ ID NO: 3618677 - RNA, 13 nt, Human
aagcuauaaagca

SEQ ID NO: 3618678 - RNA, 22 nt, Human
aagcuauaucaaucucucuuag

SEQ ID NO: 3618679 - RNA, 18 nt, Human
aagcuauggugagaugca

SEQ ID NO: 3618680 - RNA, 22 nt, Human
aagcuauggugagaugcagcug

SEQ ID NO: 3618681 - RNA, 21 nt, Human
aagcuauuagccaggaucaug

SEQ ID NO: 3618682 - RNA, 22 nt, Human
aagcuauucaguaauaacucua

SEQ ID NO: 3618683 - RNA, 17 nt, Human
ugcuaaagccuuccuau

SEQ ID NO: 3618684 - RNA, 23 nt, Human
ugcuaaauaaaauuuguugcaua

SEQ ID NO: 3618685 - RNA, 21 nt, Human
ugcuaaauggucgcccaggag

SEQ ID NO: 3618686 - RNA, 22 nt, Human
ugcuaaauggucgcccaggaga

SEQ ID NO: 3618687 - RNA, 17 nt, Human
ugcuaaauguaacaguc

SEQ ID NO: 3618688 - RNA, 15 nt, Human
ugcuaaauugauguu

SEQ ID NO: 3618689 - RNA, 15 nt, Human
ugcuaaauuuucagu

SEQ ID NO: 3618690 - RNA, 13 nt, Human
ugcuaacaaagac

SEQ ID NO: 3618691 - RNA, 13 nt, Human
ugcuaacaucuaa

SEQ ID NO: 3618692 - RNA, 19 nt, Human
ugcuaacaugaagaccuuu

SEQ ID NO: 3618693 - RNA, 20 nt, Human
ugcuaacuagcuuggaaacu

SEQ ID NO: 3618694 - RNA, 15 nt, Human
ugcuaacugaacuuu

SEQ ID NO: 3618695 - RNA, 14 nt, Human
ugcuaagaaaccag

SEQ ID NO: 3618696 - RNA, 22 nt, Human
ugcuaagaauauuugaauguau

SEQ ID NO: 3618697 - RNA, 16 nt, Human
ugcuaagaauuuuuua

SEQ ID NO: 3618698 - RNA, 19 nt, Human
ugcuaagagaaaaaaaaga

SEQ ID NO: 3618699 - RNA, 15 nt, Human
ugcuaagccccagca

SEQ ID NO: 3618700 - RNA, 12 nt, Human
ugcuaaggacuu

SEQ ID NO: 3618701 - RNA, 13 nt, Human
ugcuaaggacuug

SEQ ID NO: 3618702 - RNA, 22 nt, Human
ugcuaaggacuuguuagaucua

SEQ ID NO: 3618703 - RNA, 23 nt, Human
ugcuaaggucuuggaacuugccu

SEQ ID NO: 3618704 - RNA, 15 nt, Human
ugcuaagguucuaag

SEQ ID NO: 3618705 - RNA, 16 nt, Human
ugcuaagguucuaagg

SEQ ID NO: 3618706 - RNA, 18 nt, Human
ugcuaagguucuaaggcc

SEQ ID NO: 3618707 - RNA, 21 nt, Human
ugcuaaguaaaucucuucugu

SEQ ID NO: 3618708 - RNA, 17 nt, Human
ugcuaaguauuucccag

SEQ ID NO: 3618709 - RNA, 18 nt, Human
ugcuaaguauuucccagc

SEQ ID NO: 3618710 - RNA, 23 nt, Human
ugcuaagugcuuauuacauuuua

SEQ ID NO: 3618711 - RNA, 15 nt, Human
ugcuaaguguaggau

SEQ ID NO: 3618712 - RNA, 16 nt, Human
ugcuaagugugaacug

SEQ ID NO: 3618713 - RNA, 16 nt, Human
ugcuaauauuaaaagu

SEQ ID NO: 3618714 - RNA, 18 nt, Human
ugcuaauauuuuccuccu

SEQ ID NO: 3618715 - RNA, 17 nt, Human
ugcuaaucaaagccagg

SEQ ID NO: 3618716 - RNA, 21 nt, Human
ugcuaaucaaagccagggucu

SEQ ID NO: 3618717 - RNA, 13 nt, Human
ugcuaaucuucuu

SEQ ID NO: 3618718 - RNA, 16 nt, Human
ugcugcaugcccucuc

SEQ ID NO: 3618719 - RNA, 16 nt, Human
ugcugcauggcagggg

SEQ ID NO: 3618720 - RNA, 23 nt, Human
ugcugcauggcagggggcugcug

SEQ ID NO: 3618721 - RNA, 14 nt, Human
ugcugcauuuaaaa

SEQ ID NO: 3618722 - RNA, 19 nt, Human
ugcugcauuugugucaucu

SEQ ID NO: 3618723 - RNA, 23 nt, Human
ugcugcauuuuaauuuuaaccaa

SEQ ID NO: 3618724 - RNA, 23 nt, Human
ugcugccaauauccuaauaaaaa

SEQ ID NO: 3618725 - RNA, 15 nt, Human
ugcugccacacuuca

SEQ ID NO: 3618726 - RNA, 16 nt, Human
ugcugccacacuucag

SEQ ID NO: 3618727 - RNA, 11 nt, Human
ugcugccaucc

SEQ ID NO: 3618728 - RNA, 22 nt, Human
ugcugccauccagguucagcuu

SEQ ID NO: 3618729 - RNA, 21 nt, Human
ugcugccauuugauuuuucua

SEQ ID NO: 3618730 - RNA, 16 nt, Human
ugcugcccaggcccag

SEQ ID NO: 3618731 - RNA, 14 nt, Human
ugcugcccaugcca

SEQ ID NO: 3618732 - RNA, 21 nt, Human
ugcugcccaugccaccgcuuc

SEQ ID NO: 3618733 - RNA, 16 nt, Human
ugcugcccauguuuca

SEQ ID NO: 3618734 - RNA, 21 nt, Human
ugcugccccaucagugcuccc

SEQ ID NO: 3618735 - RNA, 24 nt, Human
ugcugccccaugaagccacagccc

SEQ ID NO: 3618736 - RNA, 15 nt, Human
ugcugcccccacccc

SEQ ID NO: 3618737 - RNA, 22 nt, Human
ugcugcccccaccccggggacc

SEQ ID NO: 3618738 - RNA, 21 nt, Human
ugcugccccugcacagcaggc

SEQ ID NO: 3618739 - RNA, 22 nt, Human
ugcugccccugcacagcaggcu

SEQ ID NO: 3618740 - RNA, 20 nt, Human
ugcugcccgucuucagccua

SEQ ID NO: 3618741 - RNA, 23 nt, Human
ugcugcccucccccuccucucca

SEQ ID NO: 3618742 - RNA, 10 nt, Human
ugcugcccug

SEQ ID NO: 3618743 - RNA, 15 nt, Human
ugcugcccugaagaa

SEQ ID NO: 3618744 - RNA, 21 nt, Human
ugcugcccugcccaccuggcc

SEQ ID NO: 3618745 - RNA, 14 nt, Human
ugcugcccugcccc

SEQ ID NO: 3618746 - RNA, 11 nt, Human
ugcugcccugu

SEQ ID NO: 3618747 - RNA, 13 nt, Human
ugcugcccuguga

SEQ ID NO: 3618748 - RNA, 21 nt, Human
ugcugccgccccacccagaug

SEQ ID NO: 3618749 - RNA, 19 nt, Human
ugcugccgccucccagccu

SEQ ID NO: 3618750 - RNA, 15 nt, Human
ugcugccucaggaau

SEQ ID NO: 3618751 - RNA, 13 nt, Human
ugcugccucaugc

SEQ ID NO: 3618752 - RNA, 13 nt, Human
ugcugccucccca

SEQ ID NO: 3618753 - RNA, 17 nt, Human
ugcugccuccccaaccc

SEQ ID NO: 3618754 - RNA, 20 nt, Human
ugcugccucggauccccuuc

SEQ ID NO: 3618755 - RNA, 19 nt, Human
ugcugccucuuucccuagg

SEQ ID NO: 3618756 - RNA, 14 nt, Human
ugcugccugaguca

SEQ ID NO: 3618757 - RNA, 15 nt, Human
ugcugccugccuguc

SEQ ID NO: 3618758 - RNA, 14 nt, Human
ugcugccuggccac

SEQ ID NO: 3618759 - RNA, 13 nt, Human
ugcugccuguccc

SEQ ID NO: 3618760 - RNA, 19 nt, Human
ugcugccuuauucagggaa

SEQ ID NO: 3618761 - RNA, 20 nt, Human
ugcugccuuauucagggaag

SEQ ID NO: 3618762 - RNA, 22 nt, Human
ugcugccuucugacggcccugc

SEQ ID NO: 3618763 - RNA, 17 nt, Human
ugcugccuucuggauuc

SEQ ID NO: 3618764 - RNA, 21 nt, Human
ugcugccuuuucuuuaacuuu

SEQ ID NO: 3618765 - RNA, 15 nt, Human
ugcugcgcccuuccc

SEQ ID NO: 3618766 - RNA, 15 nt, Human
ugcugcggagcaaga

SEQ ID NO: 3618767 - RNA, 17 nt, Human
ugcugcuaaucuucagg

SEQ ID NO: 3618768 - RNA, 14 nt, Human
ugcugcuacccucc

SEQ ID NO: 3618769 - RNA, 18 nt, Human
ugcugcuacccucccugc

SEQ ID NO: 3618770 - RNA, 14 nt, Human
ugcugcuagaacuu

SEQ ID NO: 3618771 - RNA, 15 nt, Human
ugcugcucccucaga

SEQ ID NO: 3618772 - RNA, 18 nt, Human
ugcugcuccuuagcugcc

SEQ ID NO: 3618773 - RNA, 17 nt, Human
ugcugcucuuggcugga

SEQ ID NO: 3618774 - RNA, 13 nt, Human
ugcugcugagaac

SEQ ID NO: 3618775 - RNA, 18 nt, Human
ugcugcugagaaccuggc

SEQ ID NO: 3618776 - RNA, 19 nt, Human
ugcugcugagaaccuggcc

SEQ ID NO: 3618777 - RNA, 22 nt, Human
ugcugcugagaaccuggccuuc

SEQ ID NO: 3618778 - RNA, 19 nt, Human
ugcugcugccccugcacag

SEQ ID NO: 3618779 - RNA, 17 nt, Human
ugcugcugccucuuucc

SEQ ID NO: 3618780 - RNA, 13 nt, Human
ugcugcugccugg

SEQ ID NO: 3618781 - RNA, 12 nt, Human
ugcugcugcugc

SEQ ID NO: 3618782 - RNA, 13 nt, Human
ugcugcugggcuc

SEQ ID NO: 3618783 - RNA, 19 nt, Human
ugcugcuggggaagacagu

SEQ ID NO: 3618784 - RNA, 20 nt, Human
ugcugcuggggaagacagug

SEQ ID NO: 3618785 - RNA, 22 nt, Human
ugcugcuggggaagacaguggc

SEQ ID NO: 3618786 - RNA, 24 nt, Human
ugcugcuggggaagacaguggccc

SEQ ID NO: 3618787 - RNA, 18 nt, Human
uggcgcgaucucagcuca

SEQ ID NO: 3618788 - RNA, 16 nt, Human
uggcgcugccccuggc

SEQ ID NO: 3618789 - RNA, 23 nt, Human
uggcggcagcagccaucauagga

SEQ ID NO: 3618790 - RNA, 15 nt, Human
uggcggcuacucagc

SEQ ID NO: 3618791 - RNA, 17 nt, Human
uggcggcuacucagcag

SEQ ID NO: 3618792 - RNA, 21 nt, Human
uggcggcuacucagcagcccu

SEQ ID NO: 3618793 - RNA, 23 nt, Human
uggcggcuacucagcagcccucc

SEQ ID NO: 3618794 - RNA, 16 nt, Human
uggcgggaugggccac

SEQ ID NO: 3618795 - RNA, 13 nt, Human
uggcgggccaagg

SEQ ID NO: 3618796 - RNA, 15 nt, Human
uggcgggguggggug

SEQ ID NO: 3618797 - RNA, 21 nt, Human
uggcguaaguacagagaagcc

SEQ ID NO: 3618798 - RNA, 22 nt, Human
uggcguaaguacagagaagcca

SEQ ID NO: 3618799 - RNA, 23 nt, Human
uggcguaaguacagagaagccau

SEQ ID NO: 3618800 - RNA, 22 nt, Human
uggcguagcagaguuaaaucuc

SEQ ID NO: 3618801 - RNA, 16 nt, Human
uggcguaggcuacaga

SEQ ID NO: 3618802 - RNA, 17 nt, Human
uggcguaggcuacagag

SEQ ID NO: 3618803 - RNA, 21 nt, Human
uggcguaggcuacagagaagc

SEQ ID NO: 3618804 - RNA, 15 nt, Human
uggcgucugucuuca

SEQ ID NO: 3618805 - RNA, 17 nt, Human
uggcgucugucuucaag

SEQ ID NO: 3618806 - RNA, 13 nt, Human
uggcguggauuaa

SEQ ID NO: 3618807 - RNA, 18 nt, Human
uggcuaaagauaauugcu

SEQ ID NO: 3618808 - RNA, 22 nt, Human
uggcuaaagauaauugcuauuu

SEQ ID NO: 3618809 - RNA, 14 nt, Human
uggcuaaccaagag

SEQ ID NO: 3618810 - RNA, 20 nt, Human
uggcuaacuuacaaagauuc

SEQ ID NO: 3618811 - RNA, 16 nt, Human
uggcuaacuuggguua

SEQ ID NO: 3618812 - RNA, 18 nt, Human
uggcuaagcaaaauguga

SEQ ID NO: 3618813 - RNA, 17 nt, Human
uggcuaagcuuaaaaaa

SEQ ID NO: 3618814 - RNA, 17 nt, Human
uggcuaauguacugcau

SEQ ID NO: 3618815 - RNA, 15 nt, Human
uggcuaauucccaga

SEQ ID NO: 3618816 - RNA, 18 nt, Human
uggcuacgccucuucugu

SEQ ID NO: 3618817 - RNA, 15 nt, Human
uggcuacucugugcc

SEQ ID NO: 3618818 - RNA, 16 nt, Human
uggcuacucugugcca

SEQ ID NO: 3618819 - RNA, 17 nt, Human
uggcuacucugugccag

SEQ ID NO: 3618820 - RNA, 18 nt, Human
uggcuacucugugccaga

SEQ ID NO: 3618821 - RNA, 21 nt, Human
uggcuacucugugccagagcc

SEQ ID NO: 3618822 - RNA, 21 nt, Human
uggcuagaggccagccccacc

SEQ ID NO: 3618823 - RNA, 23 nt, Human
uggcuagaggccagccccaccca

SEQ ID NO: 3618824 - RNA, 22 nt, Human
uggcuagagguucaaagauauu

SEQ ID NO: 3618825 - RNA, 16 nt, Human
uggcuagaguccucac

SEQ ID NO: 3618826 - RNA, 17 nt, Human
uggcuaggggagcaggg

SEQ ID NO: 3618827 - RNA, 22 nt, Human
uggcuagucaagcuccuccucc

SEQ ID NO: 3618828 - RNA, 16 nt, Human
uggcuagucagagaga

SEQ ID NO: 3618829 - RNA, 13 nt, Human
uggcuauaaauau

SEQ ID NO: 3618830 - RNA, 15 nt, Human
uggcuauaggugcua

SEQ ID NO: 3618831 - RNA, 19 nt, Human
uggcuauaggugcuacaaa

SEQ ID NO: 3618832 - RNA, 21 nt, Human
uggcuauauggcaagaaagcu

SEQ ID NO: 3618833 - RNA, 13 nt, Human
uggcuauccugau

SEQ ID NO: 3618834 - RNA, 14 nt, Human
uggcuauccugauu

SEQ ID NO: 3618835 - RNA, 15 nt, Human
uggcuaugcauuuga

SEQ ID NO: 3618836 - RNA, 17 nt, Human
uggcuauguuuuuaaug

SEQ ID NO: 3618837 - RNA, 22 nt, Human
uggcuauuagagaucaaccccu

SEQ ID NO: 3618838 - RNA, 19 nt, Human
uggcucacaccuguaaucc

SEQ ID NO: 3618839 - RNA, 22 nt, Human
uggcucacaccuguaaucccag

SEQ ID NO: 3618840 - RNA, 21 nt, Human
uggcucacacucgacaugaaa

SEQ ID NO: 3618841 - RNA, 12 nt, Human
uggcucacacug

SEQ ID NO: 3618842 - RNA, 17 nt, Human
uggcucacagacuggag

SEQ ID NO: 3618843 - RNA, 22 nt, Human
uggcucacaguacagcaugugc

SEQ ID NO: 3618844 - RNA, 24 nt, Human
uggcucacaguacagcaugugccu

SEQ ID NO: 3618845 - RNA, 16 nt, Human
uggcucacccaguccu

SEQ ID NO: 3618846 - RNA, 13 nt, Human
uggcucacgccug

SEQ ID NO: 3618847 - RNA, 20 nt, Human
uggcucacuaugaaucuauu

SEQ ID NO: 3618848 - RNA, 21 nt, Human
uggcucacuauggugccaaug

SEQ ID NO: 3618849 - RNA, 17 nt, Human
uggcucacucagcacuu

SEQ ID NO: 3618850 - RNA, 22 nt, Human
uggcucacucagcacuuggccc

SEQ ID NO: 3618851 - RNA, 21 nt, Human
uggcucacugcaacuucugcc

SEQ ID NO: 3618852 - RNA, 16 nt, Human
uggcucacugcagccu

SEQ ID NO: 3618853 - RNA, 18 nt, Human
uggcucacugcagccucg

SEQ ID NO: 3618854 - RNA, 22 nt, Human
uggcucagagggggacugcugc

SEQ ID NO: 3618855 - RNA, 13 nt, Human
uggcucagccagc

SEQ ID NO: 3618856 - RNA, 24 nt, Human
uggcucagcucggggagccuuagc

SEQ ID NO: 3618857 - RNA, 14 nt, Human
uggcucaggguggu

SEQ ID NO: 3618858 - RNA, 19 nt, Human
uggcucauauuccugcagc

SEQ ID NO: 3618859 - RNA, 21 nt, Human
uggcucauauuccugcagccu

SEQ ID NO: 3618860 - RNA, 20 nt, Human
uggcuccagaaaugucuaaa

SEQ ID NO: 3618861 - RNA, 15 nt, Human
uggcuccagucugcu

SEQ ID NO: 3618862 - RNA, 20 nt, Human
uggcuccagucugcugcccu

SEQ ID NO: 3618863 - RNA, 20 nt, Human
uggcuccauugguguugaca

SEQ ID NO: 3618864 - RNA, 19 nt, Human
uggcucccacaggcagcuu

SEQ ID NO: 3618865 - RNA, 14 nt, Human
uggcucccaggggc

SEQ ID NO: 3618866 - RNA, 14 nt, Human
uggcucccaugacc

SEQ ID NO: 3618867 - RNA, 20 nt, Human
uggcucccaugaccauacug

SEQ ID NO: 3618868 - RNA, 18 nt, Human
uggcucccauucacucuu

SEQ ID NO: 3618869 - RNA, 14 nt, Human
uggcuccccaaagg

SEQ ID NO: 3618870 - RNA, 24 nt, Human
uggcuccccugcagcccuggccca

SEQ ID NO: 3618871 - RNA, 15 nt, Human
uggcuccccuggggu

SEQ ID NO: 3618872 - RNA, 17 nt, Human
uggugacugugggcucc

SEQ ID NO: 3618873 - RNA, 22 nt, Human
uggugagaaauuucugugaaac

SEQ ID NO: 3618874 - RNA, 12 nt, Human
uggugagcauua

SEQ ID NO: 3618875 - RNA, 18 nt, Human
uggugagcauuacaggca

SEQ ID NO: 3618876 - RNA, 16 nt, Human
uggugaggaagcucca

SEQ ID NO: 3618877 - RNA, 13 nt, Human
uggugaggagcac

SEQ ID NO: 3618878 - RNA, 17 nt, Human
uggugagguugggcagc

SEQ ID NO: 3618879 - RNA, 20 nt, Human
uggugagucuuggcggcagc

SEQ ID NO: 3618880 - RNA, 15 nt, Human
uggugaguuaggaac

SEQ ID NO: 3618881 - RNA, 19 nt, Human
uggugaucaauuaaaugua

SEQ ID NO: 3618882 - RNA, 20 nt, Human
uggugauuugaaaaauauaa

SEQ ID NO: 3618883 - RNA, 21 nt, Human
uggugauuugaaaaauauaaa

SEQ ID NO: 3618884 - RNA, 18 nt, Human
uggugauuuuaaaugugu

SEQ ID NO: 3618885 - RNA, 23 nt, Human
uggugcaaguugaggacuucuug

SEQ ID NO: 3618886 - RNA, 14 nt, Human
uggugcaaugaccu

SEQ ID NO: 3618887 - RNA, 22 nt, Human
uggugcaauguguguauaugga

SEQ ID NO: 3618888 - RNA, 17 nt, Human
uggugcacuuuguaaau

SEQ ID NO: 3618889 - RNA, 21 nt, Human
uggugcagguagaccugucuc

SEQ ID NO: 3618890 - RNA, 15 nt, Human
uggugcagugugaaa

SEQ ID NO: 3618891 - RNA, 17 nt, Human
uggugccaauggaaccu

SEQ ID NO: 3618892 - RNA, 22 nt, Human
uggugccaauggaaccuccuuu

SEQ ID NO: 3618893 - RNA, 15 nt, Human
uggugccaauuucaa

SEQ ID NO: 3618894 - RNA, 20 nt, Human
uggugccacaaauaaaaugg

SEQ ID NO: 3618895 - RNA, 14 nt, Human
uggugccagccuuc

SEQ ID NO: 3618896 - RNA, 21 nt, Human
uggugccagccuuccucugca

SEQ ID NO: 3618897 - RNA, 21 nt, Human
uggugccauccccagggggca

SEQ ID NO: 3618898 - RNA, 13 nt, Human
uguagauuugauu

SEQ ID NO: 3618899 - RNA, 16 nt, Human
uguagauuugauuuuu

SEQ ID NO: 3618900 - RNA, 18 nt, Human
uguagcaaacccugucaa

SEQ ID NO: 3618901 - RNA, 20 nt, Human
uguagcaacuacagucuaaa

SEQ ID NO: 3618902 - RNA, 22 nt, Human
uguagcacugacagauuuccau

SEQ ID NO: 3618903 - RNA, 12 nt, Human
uguagcagaaag

SEQ ID NO: 3618904 - RNA, 16 nt, Human
uguagcauccuggaau

SEQ ID NO: 3618905 - RNA, 18 nt, Human
uguagcauccuggaauau

SEQ ID NO: 3618906 - RNA, 13 nt, Human
uguagccacacca

SEQ ID NO: 3618907 - RNA, 12 nt, Human
uguagccagccg

SEQ ID NO: 3618908 - RNA, 20 nt, Human
uguagccaggucccccugca

SEQ ID NO: 3618909 - RNA, 16 nt, Human
uguagcccacacuuga

SEQ ID NO: 3618910 - RNA, 16 nt, Human
uguagcccaggcugga

SEQ ID NO: 3618911 - RNA, 21 nt, Human
uguagccccagugacagcuag

SEQ ID NO: 3618912 - RNA, 18 nt, Human
uguagccccucuccugga

SEQ ID NO: 3618913 - RNA, 21 nt, Human
uguagcccucccacuuugcug

SEQ ID NO: 3618914 - RNA, 23 nt, Human
uguagccucaaucgagugagaca

SEQ ID NO: 3618915 - RNA, 22 nt, Human
uguagccucgccgucugugaau

SEQ ID NO: 3618916 - RNA, 16 nt, Human
uguagccugugcaugu

SEQ ID NO: 3618917 - RNA, 15 nt, Human
uguagccuucacaca

SEQ ID NO: 3618918 - RNA, 16 nt, Human
uguagccuugcccgga

SEQ ID NO: 3618919 - RNA, 18 nt, Human
uguagccuuuugacuuuc

SEQ ID NO: 3618920 - RNA, 13 nt, Human
uguagccuuuuug

SEQ ID NO: 3618921 - RNA, 15 nt, Human
uguagcgucuuucuu

SEQ ID NO: 3618922 - RNA, 17 nt, Human
uguagcguguuuacaug

SEQ ID NO: 3618923 - RNA, 21 nt, Human
uguagcguguuuacaugugua

SEQ ID NO: 3618924 - RNA, 21 nt, Human
uguagcuacagagaaaccagc

SEQ ID NO: 3618925 - RNA, 20 nt, Human
uguagcuauaaugagcaugu

SEQ ID NO: 3618926 - RNA, 17 nt, Human
uguagcuccuccccugg

SEQ ID NO: 3618927 - RNA, 16 nt, Human
uguagcugugaccugc

SEQ ID NO: 3618928 - RNA, 20 nt, Human
uguagcugugaccugcugag

SEQ ID NO: 3618929 - RNA, 16 nt, Human
uguagcuucagucauu

SEQ ID NO: 3618930 - RNA, 12 nt, Human
uguagcuuugcu

SEQ ID NO: 3618931 - RNA, 15 nt, Human
uguagcuuuucaccu

SEQ ID NO: 3618932 - RNA, 21 nt, Human
uguaggaagaguagcauuuca

SEQ ID NO: 3618933 - RNA, 23 nt, Human
uguaggaagaguagcauuucauu

SEQ ID NO: 3618934 - RNA, 16 nt, Human
uguaggaagguacugu

SEQ ID NO: 3618935 - RNA, 20 nt, Human
uguaggaauucuuuugggga

SEQ ID NO: 3618936 - RNA, 11 nt, Human
uguaggagaau

SEQ ID NO: 3618937 - RNA, 13 nt, Human
uguaggagacuug

SEQ ID NO: 3618938 - RNA, 22 nt, Human
uguaggagacuugccagagccg

SEQ ID NO: 3618939 - RNA, 12 nt, Human
uguaggcagaca

SEQ ID NO: 3618940 - RNA, 15 nt, Human
uguaggcagacacag

SEQ ID NO: 3618941 - RNA, 17 nt, Human
uguaggcauaaagucag

SEQ ID NO: 3618942 - RNA, 17 nt, Human
uguaggcaucaugcaug

SEQ ID NO: 3618943 - RNA, 17 nt, Human
uguaggcuuaguuugug

SEQ ID NO: 3618944 - RNA, 17 nt, Human
uguaggcuuuacuuagc

SEQ ID NO: 3618945 - RNA, 20 nt, Human
uguaggcuuuacuuagcuua

SEQ ID NO: 3618946 - RNA, 12 nt, Human
uguagggaacuc

SEQ ID NO: 3618947 - RNA, 12 nt, Human
uguagggcugga

SEQ ID NO: 3618948 - RNA, 18 nt, Human
uguaggguaaggugccuu

SEQ ID NO: 3618949 - RNA, 20 nt, Human
uguaggguccaaccagaccu

SEQ ID NO: 3618950 - RNA, 16 nt, Human
uguaggguuacagaga

SEQ ID NO: 3618951 - RNA, 13 nt, Human
uguaggguuucua

SEQ ID NO: 3618952 - RNA, 13 nt, Human
uguagguaaaaug

SEQ ID NO: 3618953 - RNA, 14 nt, Human
uguagguaagacug

SEQ ID NO: 3618954 - RNA, 20 nt, Human
uguaggugcaagauggaaag

SEQ ID NO: 3618955 - RNA, 14 nt, Human
uguagguugcacac

SEQ ID NO: 3618956 - RNA, 18 nt, Human
uguagguugcacacuuug

SEQ ID NO: 3618957 - RNA, 19 nt, Human
uguaguaaagccguuguuu

SEQ ID NO: 3618958 - RNA, 22 nt, Human
uguaguaaagccguuguuuacu

SEQ ID NO: 3618959 - RNA, 14 nt, Human
uguaguaacacuaa

SEQ ID NO: 3618960 - RNA, 15 nt, Human
uguaguaacacuaau

SEQ ID NO: 3618961 - RNA, 20 nt, Human
uguaguaacacuaauauauu

SEQ ID NO: 3618962 - RNA, 19 nt, Human
uguaguaauugacaugugc

SEQ ID NO: 3618963 - RNA, 14 nt, Human
uguaguagucucau

SEQ ID NO: 3618964 - RNA, 15 nt, Human
uguagucauuuacua

SEQ ID NO: 3618965 - RNA, 19 nt, Human
uguagucauuuacuaaaca

SEQ ID NO: 3618966 - RNA, 17 nt, Human
uguagucccagcuacuc

SEQ ID NO: 3618967 - RNA, 23 nt, Human
uguagucccagcuacuugggagg

SEQ ID NO: 3618968 - RNA, 14 nt, Human
uguagucucaggac

SEQ ID NO: 3618969 - RNA, 17 nt, Human
uguagugagauagcauu

SEQ ID NO: 3618970 - RNA, 20 nt, Human
uguagugauuuuuaugccac

SEQ ID NO: 3618971 - RNA, 21 nt, Human
uguagugccucuuucauccac

SEQ ID NO: 3618972 - RNA, 15 nt, Human
uguagugcuacaggg

SEQ ID NO: 3618973 - RNA, 15 nt, Human
uguagugcuuugaga

SEQ ID NO: 3618974 - RNA, 22 nt, Human
uguagugcuuugagagagaaag

SEQ ID NO: 3618975 - RNA, 20 nt, Human
uguaguguccauuuugugaa

SEQ ID NO: 3618976 - RNA, 18 nt, Human
uguaguguucagaaaaaa

SEQ ID NO: 3618977 - RNA, 14 nt, Human
uguaguguuggaga

SEQ ID NO: 3618978 - RNA, 17 nt, Human
uguccaagaagcccagg

SEQ ID NO: 3618979 - RNA, 18 nt, Human
uguccaagaagcccagga

SEQ ID NO: 3618980 - RNA, 22 nt, Human
uguccaagaagcccaggaaagg

SEQ ID NO: 3618981 - RNA, 23 nt, Human
uguccaagaagcccaggaaaggc

SEQ ID NO: 3618982 - RNA, 14 nt, Human
uguccaaggaaacu

SEQ ID NO: 3618983 - RNA, 15 nt, Human
uguccacacccagcu

SEQ ID NO: 3618984 - RNA, 19 nt, Human
uguccacagaugccuccac

SEQ ID NO: 3618985 - RNA, 20 nt, Human
uguccacagaugccuccacc

SEQ ID NO: 3618986 - RNA, 16 nt, Human
uguccacaggcuucug

SEQ ID NO: 3618987 - RNA, 12 nt, Human
uguccaccccca

SEQ ID NO: 3618988 - RNA, 15 nt, Human
uguccaccuggcccc

SEQ ID NO: 3618989 - RNA, 16 nt, Human
uguccacgacugucuc

SEQ ID NO: 3618990 - RNA, 19 nt, Human
uguccacgacugucuccau

SEQ ID NO: 3618991 - RNA, 23 nt, Human
uguccacgcgugccguggcacca

SEQ ID NO: 3618992 - RNA, 16 nt, Human
uguccagaagaauauu

SEQ ID NO: 3618993 - RNA, 21 nt, Human
uguccagaagaauauucagga

SEQ ID NO: 3618994 - RNA, 22 nt, Human
uguccagacagagcccugugag

SEQ ID NO: 3618995 - RNA, 13 nt, Human
uguccagacagcc

SEQ ID NO: 3618996 - RNA, 15 nt, Human
uguccagacagccug

SEQ ID NO: 3618997 - RNA, 11 nt, Human
uguccagagag

SEQ ID NO: 3618998 - RNA, 23 nt, Human
uguccagagagagaagugccccu

SEQ ID NO: 3618999 - RNA, 12 nt, Human
uguccagcaccu

SEQ ID NO: 3619000 - RNA, 17 nt, Human
uguccagcauugcugga

SEQ ID NO: 3619001 - RNA, 19 nt, Human
uguccagcauugcuggacu

SEQ ID NO: 3619002 - RNA, 20 nt, Human
uguccagccccguagacgug

SEQ ID NO: 3619003 - RNA, 12 nt, Human
uguccagccugg

SEQ ID NO: 3619004 - RNA, 12 nt, Human
uguccagcucca

SEQ ID NO: 3619005 - RNA, 23 nt, Human
uguccagcuccaaccugcaaaga

SEQ ID NO: 3619006 - RNA, 17 nt, Human
uguccagcugagcgcca

SEQ ID NO: 3619007 - RNA, 17 nt, Human
uguccagggcccugagc

SEQ ID NO: 3619008 - RNA, 19 nt, Human
uguccaguaagaucacugu

SEQ ID NO: 3619009 - RNA, 21 nt, Human
uguccaguaagaucacuguuu

SEQ ID NO: 3619010 - RNA, 23 nt, Human
uguccaguggguagguuggacug

SEQ ID NO: 3619011 - RNA, 19 nt, Human
uguccugagccccagggag

SEQ ID NO: 3619012 - RNA, 12 nt, Human
uguccugagcuc

SEQ ID NO: 3619013 - RNA, 21 nt, Human
uguccugauggucagcucccu

SEQ ID NO: 3619014 - RNA, 22 nt, Human
uguccugccuaaggcugaacuu

SEQ ID NO: 3619015 - RNA, 15 nt, Human
uguccugccugucug

SEQ ID NO: 3619016 - RNA, 21 nt, Human
uguccugccugucugccccag

SEQ ID NO: 3619017 - RNA, 15 nt, Human
uguccugcuccacag

SEQ ID NO: 3619018 - RNA, 12 nt, Human
uguccugggagu

SEQ ID NO: 3619019 - RNA, 20 nt, Human
uguccugggagugagcuggu

SEQ ID NO: 3619020 - RNA, 11 nt, Human
uguccugggcg

SEQ ID NO: 3619021 - RNA, 20 nt, Human
uguccuggugcucucugcca

SEQ ID NO: 3619022 - RNA, 16 nt, Human
uguccuggugucacuu

SEQ ID NO: 3619023 - RNA, 17 nt, Human
uguccugguuagcagag

SEQ ID NO: 3619024 - RNA, 22 nt, Human
uguccuguaaacacucagcugu

SEQ ID NO: 3619025 - RNA, 16 nt, Human
uguccuguaacuguua

SEQ ID NO: 3619026 - RNA, 18 nt, Human
uguccuguaacuguuaca

SEQ ID NO: 3619027 - RNA, 19 nt, Human
uguccugucaucaucaugg

SEQ ID NO: 3619028 - RNA, 14 nt, Human
uguccuguccugcu

SEQ ID NO: 3619029 - RNA, 18 nt, Human
uguccugugagaugugua

SEQ ID NO: 3619030 - RNA, 20 nt, Human
uguccugugagauguguauc

SEQ ID NO: 3619031 - RNA, 13 nt, Human
uguccugugaggu

SEQ ID NO: 3619032 - RNA, 20 nt, Human
uguccugugagguuucccaa

SEQ ID NO: 3619033 - RNA, 13 nt, Human
ugugcugcccugc

SEQ ID NO: 3619034 - RNA, 20 nt, Human
ugugcugcccugcccaccug

SEQ ID NO: 3619035 - RNA, 21 nt, Human
ugugcugcccugcccaccugg

SEQ ID NO: 3619036 - RNA, 17 nt, Human
ugugcugcuguaagaaa

SEQ ID NO: 3619037 - RNA, 13 nt, Human
ugugcuggagaug

SEQ ID NO: 3619038 - RNA, 18 nt, Human
ugugcuggagauguuuua

SEQ ID NO: 3619039 - RNA, 13 nt, Human
ugugcuggagcca

SEQ ID NO: 3619040 - RNA, 19 nt, Human
ugugcuggagccacuaacu

SEQ ID NO: 3619041 - RNA, 11 nt, Human
ugugcuggggg

SEQ ID NO: 3619042 - RNA, 19 nt, Human
ugugcugggguuaucugaa

SEQ ID NO: 3619043 - RNA, 19 nt, Human
ugugcugugcuauggugcu

SEQ ID NO: 3619044 - RNA, 16 nt, Human
ugugcuguggaagcaa

SEQ ID NO: 3619045 - RNA, 13 nt, Human
ugugcuguguaaa

SEQ ID NO: 3619046 - RNA, 15 nt, Human
ugugcuguguaaagu

SEQ ID NO: 3619047 - RNA, 23 nt, Human
ugugcuguguaaaguuagucuac

SEQ ID NO: 3619048 - RNA, 20 nt, Human
ugugcuguguuugcuccccu

SEQ ID NO: 3619049 - RNA, 14 nt, Human
ugugcuguuguuau

SEQ ID NO: 3619050 - RNA, 16 nt, Human
ugugcuguuguuauga

SEQ ID NO: 3619051 - RNA, 20 nt, Human
ugugcuguuguuaugaugug

SEQ ID NO: 3619052 - RNA, 23 nt, Human
ugugcuguuguuaugaugugcuu

SEQ ID NO: 3619053 - RNA, 15 nt, Human
ugugcuguuucaaag

SEQ ID NO: 3619054 - RNA, 18 nt, Human
ugugcuguuucaaaguuc

SEQ ID NO: 3619055 - RNA, 12 nt, Human
ugugcuucuccc

SEQ ID NO: 3619056 - RNA, 16 nt, Human
ugugcuucuccccaga

SEQ ID NO: 3619057 - RNA, 18 nt, Human
ugugcuucuccccagaau

SEQ ID NO: 3619058 - RNA, 15 nt, Human
ugugcuucugccacc

SEQ ID NO: 3619059 - RNA, 14 nt, Human
ugugcuucuuucuu

SEQ ID NO: 3619060 - RNA, 21 nt, Human
ugugcuucuuucuuugggaau

SEQ ID NO: 3619061 - RNA, 14 nt, Human
ugugcuuguuaacu

SEQ ID NO: 3619062 - RNA, 14 nt, Human
ugugcuuguuuaca

SEQ ID NO: 3619063 - RNA, 18 nt, Human
ugugcuuuccagcucacc

SEQ ID NO: 3619064 - RNA, 22 nt, Human
ugugcuuucccugaacugggac

SEQ ID NO: 3619065 - RNA, 17 nt, Human
ugugcuuucuauuguac

SEQ ID NO: 3619066 - RNA, 20 nt, Human
ugugcuuugacucaccuguu

SEQ ID NO: 3619067 - RNA, 17 nt, Human
ugugcuuugcucuuguc

SEQ ID NO: 3619068 - RNA, 14 nt, Human
ugugcuuuuccuau

SEQ ID NO: 3619069 - RNA, 21 nt, Human
ugugcuuuuccugauaaagca

SEQ ID NO: 3619070 - RNA, 17 nt, Human
ugugcuuuuuuugugug

SEQ ID NO: 3619071 - RNA, 13 nt, Human
uguggaaaacaga

SEQ ID NO: 3619072 - RNA, 16 nt, Human
uguggaaaagauggca

SEQ ID NO: 3619073 - RNA, 21 nt, Human
uguggaaagucacaggucaca

SEQ ID NO: 3619074 - RNA, 14 nt, Human
uguggaaaguguaa

SEQ ID NO: 3619075 - RNA, 17 nt, Human
uguggaaaguguaaagc

SEQ ID NO: 3619076 - RNA, 19 nt, Human
uguggaacauaaaaaggac

SEQ ID NO: 3619077 - RNA, 15 nt, Human
uguggaacccagcag

SEQ ID NO: 3619078 - RNA, 15 nt, Human
uguggaacugcugcc

SEQ ID NO: 3619079 - RNA, 22 nt, Human
uguggaacugcugccacugagg

SEQ ID NO: 3619080 - RNA, 22 nt, Human
uguggaagaaaaugguuuauuu

SEQ ID NO: 3619081 - RNA, 22 nt, Human
uguggaaggcaagccaggcuca

SEQ ID NO: 3619082 - RNA, 18 nt, Human
uguggaaugagugugcau

SEQ ID NO: 3619083 - RNA, 15 nt, Human
uguggacacagcucu

SEQ ID NO: 3619084 - RNA, 16 nt, Human
uguggacacagcucuu

SEQ ID NO: 3619085 - RNA, 14 nt, Human
uguggacaggacua

SEQ ID NO: 3619086 - RNA, 22 nt, Human
uguggaccauggaguggcagcc

SEQ ID NO: 3619087 - RNA, 16 nt, Human
uguggacuaaaagaua

SEQ ID NO: 3619088 - RNA, 19 nt, Human
uguggacuaaaagauauaa

SEQ ID NO: 3619089 - RNA, 21 nt, Human
uguggacuaaaagauauaagu

SEQ ID NO: 3619090 - RNA, 22 nt, Human
uguggacucuggugccuccaga

SEQ ID NO: 3619091 - RNA, 23 nt, Human
uguggacucuggugccuccagag

SEQ ID NO: 3619092 - RNA, 23 nt, Human
uguggacuguggcacuugccugg

SEQ ID NO: 3619093 - RNA, 13 nt, Human
uguggagaaagga

SEQ ID NO: 3619094 - RNA, 15 nt, Human
uguggagacugcucc

SEQ ID NO: 3619095 - RNA, 23 nt, Human
uguggagacugcuccugagcccc

SEQ ID NO: 3619096 - RNA, 13 nt, Human
uguggagacuggg

SEQ ID NO: 3619097 - RNA, 20 nt, Human
uguggagcacaaaagccucu

SEQ ID NO: 3619098 - RNA, 11 nt, Human
uguggagccag

SEQ ID NO: 3619099 - RNA, 16 nt, Human
uguggagcucagcccc

SEQ ID NO: 3619100 - RNA, 14 nt, Human
uguggaggaaggau

SEQ ID NO: 3619101 - RNA, 15 nt, Human
uguggaggaaggauu

SEQ ID NO: 3619102 - RNA, 17 nt, Human
uguggaggaaggauugu

SEQ ID NO: 3619103 - RNA, 16 nt, Human
uguggagucauucuca

SEQ ID NO: 3619104 - RNA, 17 nt, Human
uguggagucauuucuga

SEQ ID NO: 3619105 - RNA, 18 nt, Human
uguggaguggggcaguag

SEQ ID NO: 3619106 - RNA, 21 nt, Human
uguggaguucaucuugaauug

SEQ ID NO: 3619107 - RNA, 19 nt, Human
uguggauaacaaagauauc

SEQ ID NO: 3619108 - RNA, 21 nt, Human
uguggaucaaauccagccugc

SEQ ID NO: 3619109 - RNA, 20 nt, Human
uguggaucaaccaucgcuuu

SEQ ID NO: 3619110 - RNA, 17 nt, Human
uguggaucagagaugca

SEQ ID NO: 3619111 - RNA, 17 nt, Human
uguggauccaauguuag

SEQ ID NO: 3619112 - RNA, 19 nt, Human
uguggaucuuuucauucuc

SEQ ID NO: 3619113 - RNA, 19 nt, Human
uguggaugagcccucagaa

SEQ ID NO: 3619114 - RNA, 14 nt, Human
uguggaugauaaaa

SEQ ID NO: 3619115 - RNA, 15 nt, Human
uguggaugucuuccu

SEQ ID NO: 3619116 - RNA, 22 nt, Human
uguggauguuuuaauuccauga

SEQ ID NO: 3619117 - RNA, 17 nt, Human
uguggauucugaggccc

SEQ ID NO: 3619118 - RNA, 14 nt, Human
uguggauucuuuaa

SEQ ID NO: 3619119 - RNA, 22 nt, Human
uguggauuuaacagaaauguac

SEQ ID NO: 3619120 - RNA, 15 nt, Human
uguggauuucaguuu

SEQ ID NO: 3619121 - RNA, 21 nt, Human
uguggauuuuugugguaguga

SEQ ID NO: 3619122 - RNA, 18 nt, Human
uguggcaagccccugccc

SEQ ID NO: 3619123 - RNA, 17 nt, Human
uguggcaaggaaaaaca

SEQ ID NO: 3619124 - RNA, 14 nt, Human
uguggcaagugaau

SEQ ID NO: 3619125 - RNA, 14 nt, Human
uguggcacauuuuu

SEQ ID NO: 3619126 - RNA, 15 nt, Human
uguggcacuugccug

SEQ ID NO: 3619127 - RNA, 15 nt, Human
uguggcagaguuaca

SEQ ID NO: 3619128 - RNA, 21 nt, Human
uguggcagaguuacaguucug

SEQ ID NO: 3619129 - RNA, 16 nt, Human
uguggcagcugucuca

SEQ ID NO: 3619130 - RNA, 19 nt, Human
uguggcaguaaagagaaac

SEQ ID NO: 3619131 - RNA, 17 nt, Human
uguggcaucuuugccuu

SEQ ID NO: 3619132 - RNA, 19 nt, Human
uguggccaaggagcugcua

SEQ ID NO: 3619133 - RNA, 18 nt, Human
uguggccaaguucuuagu

SEQ ID NO: 3619134 - RNA, 12 nt, Human
uguggccaggag

SEQ ID NO: 3619135 - RNA, 14 nt, Human
uguggccaggaggu

SEQ ID NO: 3619136 - RNA, 19 nt, Human
uguggccagggugagagcu

SEQ ID NO: 3619137 - RNA, 20 nt, Human
uguggccagggugagagcug

SEQ ID NO: 3619138 - RNA, 23 nt, Human
uguggccccacccugggcccugg

SEQ ID NO: 3619139 - RNA, 17 nt, Human
uguggccccugaacaag

SEQ ID NO: 3619140 - RNA, 13 nt, Human
uguggcccugcca

SEQ ID NO: 3619141 - RNA, 20 nt, Human
uguggcccuggccugcuggg

SEQ ID NO: 3619142 - RNA, 18 nt, Human
uguggccguuaucuggaa

SEQ ID NO: 3619143 - RNA, 23 nt, Human
uguggccucagcucccacaagcc

SEQ ID NO: 3619144 - RNA, 11 nt, Human
uguggccugca

SEQ ID NO: 3619145 - RNA, 14 nt, Human
uguggccugccagu

SEQ ID NO: 3619146 - RNA, 20 nt, Human
uguggccuuccauuuauaug

SEQ ID NO: 3619147 - RNA, 23 nt, Human
uguggcgcagcauauucaggaag

SEQ ID NO: 3619148 - RNA, 13 nt, Human
uguggcggugccu

SEQ ID NO: 3619149 - RNA, 10 nt, Human
uguggcucac

SEQ ID NO: 3619150 - RNA, 22 nt, Human
uguggcucacgugagagugucu

SEQ ID NO: 3619151 - RNA, 17 nt, Human
uguggcuccaggccaaa

SEQ ID NO: 3619152 - RNA, 23 nt, Human
uguggcuccccucuauuuagcau

SEQ ID NO: 3619153 - RNA, 20 nt, Human
uguggcuccuaucuguguuu

SEQ ID NO: 3619154 - RNA, 21 nt, Human
uguggcuccuggggguucuuu

SEQ ID NO: 3619155 - RNA, 22 nt, Human
uguggcugaggaggccuccauc

SEQ ID NO: 3619156 - RNA, 14 nt, Human
uguggcugcuagca

SEQ ID NO: 3619157 - RNA, 19 nt, Human
uguggcuuucagccucugg

SEQ ID NO: 3619158 - RNA, 15 nt, Human
ugugggaaggccagc

SEQ ID NO: 3619159 - RNA, 14 nt, Human
uguuauguacugua

SEQ ID NO: 3619160 - RNA, 20 nt, Human
uguuauguagugugcuuuuu

SEQ ID NO: 3619161 - RNA, 12 nt, Human
uguuauguauuu

SEQ ID NO: 3619162 - RNA, 17 nt, Human
uguuauguuuaauaagc

SEQ ID NO: 3619163 - RNA, 21 nt, Human
uguuauguuuucgaaaaucaa

SEQ ID NO: 3619164 - RNA, 13 nt, Human
uguuauuaaaugu

SEQ ID NO: 3619165 - RNA, 17 nt, Human
uguuauuacauccuugu

SEQ ID NO: 3619166 - RNA, 23 nt, Human
uguuauuagagauuaccuccuga

SEQ ID NO: 3619167 - RNA, 14 nt, Human
uguuauuagauguu

SEQ ID NO: 3619168 - RNA, 21 nt, Human
uguuauuauagagcagaaauu

SEQ ID NO: 3619169 - RNA, 22 nt, Human
uguuauuauagagcagaaauuc

SEQ ID NO: 3619170 - RNA, 12 nt, Human
uguuauuauaua

SEQ ID NO: 3619171 - RNA, 23 nt, Human
uguuauuaucugggcuuauaucu

SEQ ID NO: 3619172 - RNA, 16 nt, Human
uguuauucuuugcacu

SEQ ID NO: 3619173 - RNA, 16 nt, Human
uguuauugaaaaaaau

SEQ ID NO: 3619174 - RNA, 21 nt, Human
uguuauugggcaagugauuga

SEQ ID NO: 3619175 - RNA, 13 nt, Human
uguuauugugaau

SEQ ID NO: 3619176 - RNA, 14 nt, Human
uguuauuuaaagaa

SEQ ID NO: 3619177 - RNA, 18 nt, Human
uguuauuuaacagcugaa

SEQ ID NO: 3619178 - RNA, 15 nt, Human
uguuauuuauugaaa

SEQ ID NO: 3619179 - RNA, 17 nt, Human
uguuauuuauugaaaug

SEQ ID NO: 3619180 - RNA, 20 nt, Human
uguuauuucccuacauuaaa

SEQ ID NO: 3619181 - RNA, 23 nt, Human
uguuauuucccuacauuaaacau

SEQ ID NO: 3619182 - RNA, 22 nt, Human
uguuauuucuauuuuuguagaa

SEQ ID NO: 3619183 - RNA, 17 nt, Human
uguuauuucucagacuu

SEQ ID NO: 3619184 - RNA, 13 nt, Human
uguuauuucugca

SEQ ID NO: 3619185 - RNA, 22 nt, Human
uguuauuuucagcaugaaaaug

SEQ ID NO: 3619186 - RNA, 18 nt, Human
uguuauuuucaguauuuu

SEQ ID NO: 3619187 - RNA, 22 nt, Human
uguuauuuuuauaucagccuga

SEQ ID NO: 3619188 - RNA, 18 nt, Human
uguuauuuuucaaggaag

SEQ ID NO: 3619189 - RNA, 16 nt, Human
uguuauuuuuguuucu

SEQ ID NO: 3619190 - RNA, 13 nt, Human
uguucaaacaaua

SEQ ID NO: 3619191 - RNA, 21 nt, Human
uguucaaaggagcaagaacuu

SEQ ID NO: 3619192 - RNA, 21 nt, Human
uguucaagcgauucuccugcc

SEQ ID NO: 3619193 - RNA, 14 nt, Human
uguucacaaccugg

SEQ ID NO: 3619194 - RNA, 16 nt, Human
uguucacaccagagaa

SEQ ID NO: 3619195 - RNA, 15 nt, Human
uguucacacucucac

SEQ ID NO: 3619196 - RNA, 19 nt, Human
uguucacacucucacaugu

SEQ ID NO: 3619197 - RNA, 15 nt, Human
uguucaccauuauaa

SEQ ID NO: 3619198 - RNA, 17 nt, Human
uguucacgcaacuugaa

SEQ ID NO: 3619199 - RNA, 15 nt, Human
uguucacuaaacucu

SEQ ID NO: 3619200 - RNA, 17 nt, Human
uguucacuuuugacaaa

SEQ ID NO: 3619201 - RNA, 15 nt, Human
uguucagaaaaaagg

SEQ ID NO: 3619202 - RNA, 18 nt, Human
uguucagauugcuuugau

SEQ ID NO: 3619203 - RNA, 14 nt, Human
uguucagcauucuu

SEQ ID NO: 3619204 - RNA, 21 nt, Human
uguucuggcccucaccccugc

SEQ ID NO: 3619205 - RNA, 12 nt, Human
uguucuggcucu

SEQ ID NO: 3619206 - RNA, 16 nt, Human
uguucuggcucuucca

SEQ ID NO: 3619207 - RNA, 16 nt, Human
uguucugggacacagu

SEQ ID NO: 3619208 - RNA, 21 nt, Human
uguucuggggggacccagugc

SEQ ID NO: 3619209 - RNA, 15 nt, Human
uguucuguuacaaaa

SEQ ID NO: 3619210 - RNA, 16 nt, Human
uguucuguuacaaaau

SEQ ID NO: 3619211 - RNA, 19 nt, Human
uguucuguuuaauacucau

SEQ ID NO: 3619212 - RNA, 14 nt, Human
uguucuguuucaag

SEQ ID NO: 3619213 - RNA, 15 nt, Human
uguucuguuuguuaa

SEQ ID NO: 3619214 - RNA, 20 nt, Human
uguucuguuuguuaaaacug

SEQ ID NO: 3619215 - RNA, 13 nt, Human
uguucuguuuugu

SEQ ID NO: 3619216 - RNA, 14 nt, Human
uguucuuaauucuu

SEQ ID NO: 3619217 - RNA, 16 nt, Human
uguucuuaauugcacu

SEQ ID NO: 3619218 - RNA, 17 nt, Human
uguucuuaauugcacuc

SEQ ID NO: 3619219 - RNA, 13 nt, Human
uguucuuacacau

SEQ ID NO: 3619220 - RNA, 22 nt, Human
uguucuuagcucaaugagcaug

SEQ ID NO: 3619221 - RNA, 18 nt, Human
uguucuuaguuugcaguu

SEQ ID NO: 3619222 - RNA, 11 nt, Human
uguucuuccaa

SEQ ID NO: 3619223 - RNA, 17 nt, Human
uguucuuccaaagcaga

SEQ ID NO: 3619224 - RNA, 16 nt, Human
uguucuuccucagcca

SEQ ID NO: 3619225 - RNA, 20 nt, Human
uguucuuccucagccagccu

SEQ ID NO: 3619226 - RNA, 13 nt, Human
uguucuuccuggc

SEQ ID NO: 3619227 - RNA, 20 nt, Human
uguucuugaagcaguagccu

SEQ ID NO: 3619228 - RNA, 19 nt, Human
uguucuugccacugcacuc

SEQ ID NO: 3619229 - RNA, 15 nt, Human
uguucuugcugcuag

SEQ ID NO: 3619230 - RNA, 18 nt, Human
uguucuugcugcuagaac

SEQ ID NO: 3619231 - RNA, 19 nt, Human
uguucuugcugcuagaacu

SEQ ID NO: 3619232 - RNA, 20 nt, Human
uguucuugcugcuagaacuu

SEQ ID NO: 3619233 - RNA, 23 nt, Human
uguucuugcugcuagaacuuuuu

SEQ ID NO: 3619234 - RNA, 22 nt, Human
uguucuuggcaauaaauuuuga

SEQ ID NO: 3619235 - RNA, 18 nt, Human
uguucuugguuuguaaau

SEQ ID NO: 3619236 - RNA, 13 nt, Human
uguucuuguauuu

SEQ ID NO: 3619237 - RNA, 14 nt, Human
uguucuuguuuuua

SEQ ID NO: 3619238 - RNA, 16 nt, Human
uguucuuucuggaguc

SEQ ID NO: 3619239 - RNA, 22 nt, Human
uguucuuucuggcuaugcauuu

SEQ ID NO: 3619240 - RNA, 18 nt, Human
uguucuuuggaaaguaca

SEQ ID NO: 3619241 - RNA, 17 nt, Human
uguucuuuuuauugaau

SEQ ID NO: 3619242 - RNA, 21 nt, Human
uguugaaaaaauuuaaaagua

SEQ ID NO: 3619243 - RNA, 19 nt, Human
uguugaaaagccauguuua

SEQ ID NO: 3619244 - RNA, 20 nt, Human
uguugaaaagccauguuuaa

SEQ ID NO: 3619245 - RNA, 23 nt, Human
uguugaaaagccauguuuaagau

SEQ ID NO: 3619246 - RNA, 21 nt, Human
uguugaaaauuauuuuaaaca

SEQ ID NO: 3619247 - RNA, 22 nt, Human
uguugaaacggaugauuucuau

SEQ ID NO: 3619248 - RNA, 18 nt, Human
uguugaaagcaaaaaugc

SEQ ID NO: 3619249 - RNA, 19 nt, Human
uguugaaagcaaaaaugcu

SEQ ID NO: 3619250 - RNA, 23 nt, Human
uguugaaagguuuuuuuucaguu

SEQ ID NO: 3619251 - RNA, 14 nt, Human
uguugaaauuaugu

SEQ ID NO: 3619252 - RNA, 15 nt, Human
uguugaaauuaugua

SEQ ID NO: 3619253 - RNA, 21 nt, Human
uguugaaauuauguauguuua

SEQ ID NO: 3619254 - RNA, 16 nt, Human
uguugaaauuuugcaa

SEQ ID NO: 3619255 - RNA, 23 nt, Human
uguugaaauuuugcaaauauaaa

SEQ ID NO: 3619256 - RNA, 15 nt, Human
uuaacuucuguuuua

SEQ ID NO: 3619257 - RNA, 17 nt, Human
uuaacuucuugcuucuu

SEQ ID NO: 3619258 - RNA, 11 nt, Human
uuaacuuuguu

SEQ ID NO: 3619259 - RNA, 15 nt, Human
uuaacuuuuauaaac

SEQ ID NO: 3619260 - RNA, 22 nt, Human
uuaacuuuuauaaacuuuaccu

SEQ ID NO: 3619261 - RNA, 15 nt, Human
uuaagaaaaaaauaa

SEQ ID NO: 3619262 - RNA, 16 nt, Human
uuaagaaaaaaauaau

SEQ ID NO: 3619263 - RNA, 16 nt, Human
uuaagaaaaguauuuu

SEQ ID NO: 3619264 - RNA, 17 nt, Human
uuaagaaaaguauuuug

SEQ ID NO: 3619265 - RNA, 18 nt, Human
uuaagaaaaguauuuuga

SEQ ID NO: 3619266 - RNA, 22 nt, Human
uuaagaaaaucauauugcuucu

SEQ ID NO: 3619267 - RNA, 14 nt, Human
uuaagaaauguagu

SEQ ID NO: 3619268 - RNA, 18 nt, Human
uuaagaaauuuugccuuu

SEQ ID NO: 3619269 - RNA, 16 nt, Human
uuaagaacacaaagcg

SEQ ID NO: 3619270 - RNA, 16 nt, Human
uuaagaacuaaaaugu

SEQ ID NO: 3619271 - RNA, 13 nt, Human
uuaagaagaaaau

SEQ ID NO: 3619272 - RNA, 20 nt, Human
uuaagaagacugcauuauau

SEQ ID NO: 3619273 - RNA, 20 nt, Human
uuaagaagcuguuguacauu

SEQ ID NO: 3619274 - RNA, 20 nt, Human
uuaagaauauguuuccuugu

SEQ ID NO: 3619275 - RNA, 22 nt, Human
uuaagaaugaaauacuguuuga

SEQ ID NO: 3619276 - RNA, 21 nt, Human
uuaagaauugaccaucugcuu

SEQ ID NO: 3619277 - RNA, 19 nt, Human
uuaagaauugaguaauggu

SEQ ID NO: 3619278 - RNA, 16 nt, Human
uuaagacaugauuucc

SEQ ID NO: 3619279 - RNA, 18 nt, Human
uuaagacauuuuuggaag

SEQ ID NO: 3619280 - RNA, 19 nt, Human
uuaagaccaccucaaauuu

SEQ ID NO: 3619281 - RNA, 21 nt, Human
uuaagaccuacuguucuaaag

SEQ ID NO: 3619282 - RNA, 14 nt, Human
uuaagaccuggcag

SEQ ID NO: 3619283 - RNA, 23 nt, Human
uuaagacuuaaugagacuuuaaa

SEQ ID NO: 3619284 - RNA, 14 nt, Human
uuaagagaaacuuu

SEQ ID NO: 3619285 - RNA, 15 nt, Human
uuaagagaaacuuua

SEQ ID NO: 3619286 - RNA, 16 nt, Human
uuaagagaaacuuuau

SEQ ID NO: 3619287 - RNA, 20 nt, Human
uuaagagaaacuuuauacau

SEQ ID NO: 3619288 - RNA, 12 nt, Human
uuaagagaaaug

SEQ ID NO: 3619289 - RNA, 13 nt, Human
uuaagagagaaau

SEQ ID NO: 3619290 - RNA, 23 nt, Human
uuaagagccauauaaguuugaag

SEQ ID NO: 3619291 - RNA, 20 nt, Human
uuaagaggcagaaaauugca

SEQ ID NO: 3619292 - RNA, 12 nt, Human
uuacauguuuuc

SEQ ID NO: 3619293 - RNA, 18 nt, Human
uguuuugcuuuuucugac

SEQ ID NO: 3619294 - RNA, 19 nt, Human
uguuuuggacaguuuacca

SEQ ID NO: 3619295 - RNA, 19 nt, Human
uguuuuggacuuuguuaca

SEQ ID NO: 3619296 - RNA, 16 nt, Human
uguuuugguagauuaa

SEQ ID NO: 3619297 - RNA, 13 nt, Human
uguuuuguaaaca

SEQ ID NO: 3619298 - RNA, 16 nt, Human
uguuuuguaaacauuu

SEQ ID NO: 3619299 - RNA, 13 nt, Human
uguuuuguaaacu

SEQ ID NO: 3619300 - RNA, 16 nt, Human
uguuuuguacagaugu

SEQ ID NO: 3619301 - RNA, 22 nt, Human
uguuuuguauacaaauauauug

SEQ ID NO: 3619302 - RNA, 16 nt, Human
uguuuuguucuguggu

SEQ ID NO: 3619303 - RNA, 17 nt, Human
uguuuuguucuuuaaag

SEQ ID NO: 3619304 - RNA, 18 nt, Human
uguuuuguugcacugaag

SEQ ID NO: 3619305 - RNA, 20 nt, Human
uguuuuguugcacugaaguu

SEQ ID NO: 3619306 - RNA, 13 nt, Human
uguuuuguuuuaa

SEQ ID NO: 3619307 - RNA, 15 nt, Human
uguuuuguuuuuaca

SEQ ID NO: 3619308 - RNA, 10 nt, Human
uguuuuuaaa

SEQ ID NO: 3619309 - RNA, 17 nt, Human
uguuuuuaaaaaucaua

SEQ ID NO: 3619310 - RNA, 16 nt, Human
uguuuuuaaaaucuua

SEQ ID NO: 3619311 - RNA, 17 nt, Human
uguuuuuaaaaucuuau

SEQ ID NO: 3619312 - RNA, 16 nt, Human
uguuuuuaaacuguac

SEQ ID NO: 3619313 - RNA, 22 nt, Human
uguuuuuaagcuguuuccauag

SEQ ID NO: 3619314 - RNA, 19 nt, Human
uguuuuuaaugcuauuuga

SEQ ID NO: 3619315 - RNA, 22 nt, Human
uguuuuuacccauauccccucu

SEQ ID NO: 3619316 - RNA, 21 nt, Human
uguuuuuauacaaaauaagaa

SEQ ID NO: 3619317 - RNA, 20 nt, Human
uguuuuuaugaagaaaaaau

SEQ ID NO: 3619318 - RNA, 18 nt, Human
uguuuuuauuaauuuaua

SEQ ID NO: 3619319 - RNA, 13 nt, Human
uguuuuucacauu

SEQ ID NO: 3619320 - RNA, 12 nt, Human
uguuuuucaguu

SEQ ID NO: 3619321 - RNA, 14 nt, Human
uguuuuucuauuaa

SEQ ID NO: 3619322 - RNA, 14 nt, Human
uguuuuucuccagu

SEQ ID NO: 3619323 - RNA, 15 nt, Human
uguuuuucugcuuua

SEQ ID NO: 3619324 - RNA, 19 nt, Human
uguuuuucugcuuuagacu

SEQ ID NO: 3619325 - RNA, 16 nt, Human
uguuuuucuuucuaca

SEQ ID NO: 3619326 - RNA, 20 nt, Human
uguuuuugaaggcagaaagc

SEQ ID NO: 3619327 - RNA, 14 nt, Human
uguuuuugggaugu

SEQ ID NO: 3619328 - RNA, 16 nt, Human
uguuuuuggucuuuua

SEQ ID NO: 3619329 - RNA, 12 nt, Human
uguuuuuguaaa

SEQ ID NO: 3619330 - RNA, 21 nt, Human
uguuuuuguauauugguuuua

SEQ ID NO: 3619331 - RNA, 12 nt, Human
uguuuuugugaa

SEQ ID NO: 3619332 - RNA, 14 nt, Human
uguuuuuguugugu

SEQ ID NO: 3619333 - RNA, 14 nt, Human
uguuuuuuaagaua

SEQ ID NO: 3619334 - RNA, 21 nt, Human
uguuuuuuaagauaguguaac

SEQ ID NO: 3619335 - RNA, 19 nt, Human
uguuuuuuaagauggcaau

SEQ ID NO: 3619336 - RNA, 13 nt, Human
uguuuuuucaaaa

SEQ ID NO: 3619337 - RNA, 13 nt, Human
uguuuuuucaugu

SEQ ID NO: 3619338 - RNA, 22 nt, Human
uguuuuuucuuuuuuuuuaagu

SEQ ID NO: 3619339 - RNA, 16 nt, Human
uguuuuuugaaaacau

SEQ ID NO: 3619340 - RNA, 19 nt, Human
uguuuuuugccacagcuuu

SEQ ID NO: 3619341 - RNA, 15 nt, Human
uguuuuuuucuaaua

SEQ ID NO: 3619342 - RNA, 18 nt, Human
uguuuuuuuguuauuaaa

SEQ ID NO: 3619343 - RNA, 18 nt, Human
uguuuuuuuuuaaagacu

SEQ ID NO: 3619344 - RNA, 18 nt, Human
uguuuuuuuuuuccacuu

SEQ ID NO: 3619345 - RNA, 22 nt, Human
uuaaaaaaaaaaaaaagcuuua

SEQ ID NO: 3619346 - RNA, 23 nt, Human
uuaaaaaaaaaaaaaagcuuuau

SEQ ID NO: 3619347 - RNA, 16 nt, Human
uuaaaaaaaaaaguca

SEQ ID NO: 3619348 - RNA, 21 nt, Human
uuaaaaaaaaaagucaccaaa

SEQ ID NO: 3619349 - RNA, 15 nt, Human
uuaaaaaaaaaauug

SEQ ID NO: 3619350 - RNA, 13 nt, Human
uuaaaaaaaaaga

SEQ ID NO: 3619351 - RNA, 20 nt, Human
uuaaaaaaaaagucagagac

SEQ ID NO: 3619352 - RNA, 12 nt, Human
uuaaaaaaaaga

SEQ ID NO: 3619353 - RNA, 13 nt, Human
uuaaaaaaaagaa

SEQ ID NO: 3619354 - RNA, 18 nt, Human
uuaaaaaaaauaauaaau

SEQ ID NO: 3619355 - RNA, 13 nt, Human
uuaaaaaaaaucc

SEQ ID NO: 3619356 - RNA, 18 nt, Human
uuacuaugccugugucuu

SEQ ID NO: 3619357 - RNA, 14 nt, Human
uuacuauuaagcag

SEQ ID NO: 3619358 - RNA, 18 nt, Human
uuacuauucgguguguuu

SEQ ID NO: 3619359 - RNA, 15 nt, Human
uuacucacagccagc

SEQ ID NO: 3619360 - RNA, 12 nt, Human
uuacucagcccu

SEQ ID NO: 3619361 - RNA, 14 nt, Human
uuacucagcccugg

SEQ ID NO: 3619362 - RNA, 13 nt, Human
uuacucagggcuc

SEQ ID NO: 3619363 - RNA, 18 nt, Human
uuacucagggcuccuccc

SEQ ID NO: 3619364 - RNA, 15 nt, Human
uuacucaguuuaugu

SEQ ID NO: 3619365 - RNA, 20 nt, Human
uuacucauuaaaaauaauag

SEQ ID NO: 3619366 - RNA, 13 nt, Human
uuacucauugaaa

SEQ ID NO: 3619367 - RNA, 18 nt, Human
uuacucauugaaauguca

SEQ ID NO: 3619368 - RNA, 19 nt, Human
uuacucauugaaaugucac

SEQ ID NO: 3619369 - RNA, 24 nt, Human
uuacuccaaaacuucguuuaauga

SEQ ID NO: 3619370 - RNA, 11 nt, Human
uuacuccccuu

SEQ ID NO: 3619371 - RNA, 20 nt, Human
uuagaggaaauaagaaaaau

SEQ ID NO: 3619372 - RNA, 15 nt, Human
uuagaguaagaaauu

SEQ ID NO: 3619373 - RNA, 16 nt, Human
uuagagugucuuucca

SEQ ID NO: 3619374 - RNA, 17 nt, Human
uuagagugucuuuccac

SEQ ID NO: 3619375 - RNA, 24 nt, Human
uuagauaacgcuuaaaggaaguca

SEQ ID NO: 3619376 - RNA, 16 nt, Human
uuagauagcccugucc

SEQ ID NO: 3619377 - RNA, 18 nt, Human
uuagauagcccuguccug

SEQ ID NO: 3619378 - RNA, 13 nt, Human
uuagaucaaauac

SEQ ID NO: 3619379 - RNA, 16 nt, Human
uuagaucauaguuuua

SEQ ID NO: 3619380 - RNA, 15 nt, Human
uuagauccauuaauu

SEQ ID NO: 3619381 - RNA, 23 nt, Human
uuagauccauuaauuuaaaugau

SEQ ID NO: 3619382 - RNA, 15 nt, Human
uuagaucuggcaugu

SEQ ID NO: 3619383 - RNA, 20 nt, Human
uuagaugcaguucugaagaa

SEQ ID NO: 3619384 - RNA, 23 nt, Human
uuagaugcaguucugaagaagau

SEQ ID NO: 3619385 - RNA, 16 nt, Human
uuagaugguuacacug

SEQ ID NO: 3619386 - RNA, 15 nt, Human
uuagauguucucuau

SEQ ID NO: 3619387 - RNA, 23 nt, Human
uuagauguucucuaucauuuaau

SEQ ID NO: 3619388 - RNA, 16 nt, Human
uuagauguugccaugu

SEQ ID NO: 3619389 - RNA, 17 nt, Human
uuagauuagcucuggac

SEQ ID NO: 3619390 - RNA, 22 nt, Human
uuagauuauauugagacaaaaa

SEQ ID NO: 3619391 - RNA, 19 nt, Human
uuagauucucugugucuaa

SEQ ID NO: 3619392 - RNA, 23 nt, Human
uuagauugaaaacuuuucucaga

SEQ ID NO: 3619393 - RNA, 18 nt, Human
uuagauuucauaguucag

SEQ ID NO: 3619394 - RNA, 20 nt, Human
uuagauuucauaguucagaa

SEQ ID NO: 3619395 - RNA, 12 nt, Human
uuagauuuuaca

SEQ ID NO: 3619396 - RNA, 15 nt, Human
uuagauuuuacauga

SEQ ID NO: 3619397 - RNA, 19 nt, Human
uuagauuuuacaugaagua

SEQ ID NO: 3619398 - RNA, 21 nt, Human
uuagauuuuacaugaaguauu

SEQ ID NO: 3619399 - RNA, 18 nt, Human
uuagauuuucugguucua

SEQ ID NO: 3619400 - RNA, 19 nt, Human
uuagauuuucugguucuaa

SEQ ID NO: 3619401 - RNA, 21 nt, Human
uuagauuuucugguucuaaca

SEQ ID NO: 3619402 - RNA, 22 nt, Human
uuagauuuuguguuuauucuug

SEQ ID NO: 3619403 - RNA, 23 nt, Human
uuagauuuuguguuuauucuuga

SEQ ID NO: 3619404 - RNA, 22 nt, Human
uuagcaaagauaucucaucucu

SEQ ID NO: 3619405 - RNA, 21 nt, Human
uuagcaaggucauuucuucag

SEQ ID NO: 3619406 - RNA, 19 nt, Human
uuagcacagauuuuaauug

SEQ ID NO: 3619407 - RNA, 21 nt, Human
uuagcacagauuuuaauuguc

SEQ ID NO: 3619408 - RNA, 12 nt, Human
uuagcacuguug

SEQ ID NO: 3619409 - RNA, 14 nt, Human
uuagcacuguugau

SEQ ID NO: 3619410 - RNA, 15 nt, Human
uuagcagcuuccaga

SEQ ID NO: 3619411 - RNA, 18 nt, Human
uuagcaggaagcugugag

SEQ ID NO: 3619412 - RNA, 22 nt, Human
uuagcaggagaggagagccaga

SEQ ID NO: 3619413 - RNA, 14 nt, Human
uuagcaguaaaaua

SEQ ID NO: 3619414 - RNA, 19 nt, Human
uuagcaguaaaauagcuga

SEQ ID NO: 3619415 - RNA, 18 nt, Human
uuagcaguucugcaaaua

SEQ ID NO: 3619416 - RNA, 15 nt, Human
uuagcaguuugcuuu

SEQ ID NO: 3619417 - RNA, 15 nt, Human
uuagcauccuaagaa

SEQ ID NO: 3619418 - RNA, 19 nt, Human
uuagcauccuaagaaauau

SEQ ID NO: 3619419 - RNA, 22 nt, Human
uuagcaugacaagccccaggca

SEQ ID NO: 3619420 - RNA, 17 nt, Human
uuagcauguguugaaaa

SEQ ID NO: 3619421 - RNA, 22 nt, Human
uuagcauuguagugcuuugaga

SEQ ID NO: 3619422 - RNA, 22 nt, Human
uuagcauuuaguccaaugucuu

SEQ ID NO: 3619423 - RNA, 21 nt, Human
uuagccaguaauccuguagga

SEQ ID NO: 3619424 - RNA, 18 nt, Human
uuagccauuuuucaaagc

SEQ ID NO: 3619425 - RNA, 12 nt, Human
uuagcccccacc

SEQ ID NO: 3619426 - RNA, 15 nt, Human
uuagccccugaaagc

SEQ ID NO: 3619427 - RNA, 16 nt, Human
uuagcccugaacauuu

SEQ ID NO: 3619428 - RNA, 17 nt, Human
uuagccgcccaugcacu

SEQ ID NO: 3619429 - RNA, 19 nt, Human
uuagccuaagauauacuug

SEQ ID NO: 3619430 - RNA, 10 nt, Human
uuagccugga

SEQ ID NO: 3619431 - RNA, 17 nt, Human
uuagccuggaccucuga

SEQ ID NO: 3619432 - RNA, 18 nt, Human
uuagccuggaccucugac

SEQ ID NO: 3619433 - RNA, 12 nt, Human
uuagccuguccu

SEQ ID NO: 3619434 - RNA, 20 nt, Human
uuagccuguggcaguaaaga

SEQ ID NO: 3619435 - RNA, 16 nt, Human
uuagccuuugucccag

SEQ ID NO: 3619436 - RNA, 20 nt, Human
uuagccuuuuuuccccagac

SEQ ID NO: 3619437 - RNA, 15 nt, Human
uuagcgacaacagau

SEQ ID NO: 3619438 - RNA, 23 nt, Human
uuagcgacaacagauuggauuuu

SEQ ID NO: 3619439 - RNA, 16 nt, Human
uuagcuacuauauaug

SEQ ID NO: 3619440 - RNA, 13 nt, Human
uuagcucaaugag

SEQ ID NO: 3619441 - RNA, 14 nt, Human
uuagcucaaugagc

SEQ ID NO: 3619442 - RNA, 17 nt, Human
uuagcucaaugagcaug

SEQ ID NO: 3619443 - RNA, 19 nt, Human
uuagcucagccccagccca

SEQ ID NO: 3619444 - RNA, 18 nt, Human
uuagcuccccuccaaccu

SEQ ID NO: 3619445 - RNA, 14 nt, Human
uuagcuccuguggc

SEQ ID NO: 3619446 - RNA, 15 nt, Human
uuagcucuauugaua

SEQ ID NO: 3619447 - RNA, 11 nt, Human
uuagcucugag

SEQ ID NO: 3619448 - RNA, 12 nt, Human
uuagcugacaaa

SEQ ID NO: 3619449 - RNA, 18 nt, Human
uuagcugccugaaaauca

SEQ ID NO: 3619450 - RNA, 12 nt, Human
uuagcugggaga

SEQ ID NO: 3619451 - RNA, 15 nt, Human
uuagcugugugaaau

SEQ ID NO: 3619452 - RNA, 18 nt, Human
uuagcuguguuauuauag

SEQ ID NO: 3619453 - RNA, 17 nt, Human
uuagcuguuauuucuau

SEQ ID NO: 3619454 - RNA, 17 nt, Human
uuagcuuauguuaacug

SEQ ID NO: 3619455 - RNA, 12 nt, Human
uuagcuucagga

SEQ ID NO: 3619456 - RNA, 12 nt, Human
uuagcuuccuua

SEQ ID NO: 3619457 - RNA, 13 nt, Human
uuagcuuccuuaa

SEQ ID NO: 3619458 - RNA, 17 nt, Human
uuagcuugcaccuuguc

SEQ ID NO: 3619459 - RNA, 15 nt, Human
uuagcuuuacuguuu

SEQ ID NO: 3619460 - RNA, 16 nt, Human
uuagcuuuacuguuug

SEQ ID NO: 3619461 - RNA, 17 nt, Human
uuagcuuuacuguuugu

SEQ ID NO: 3619462 - RNA, 20 nt, Human
uuagcuuucugagcaagagg

SEQ ID NO: 3619463 - RNA, 15 nt, Human
uuagcuuugcucugc

SEQ ID NO: 3619464 - RNA, 12 nt, Human
uuagcuuuguca

SEQ ID NO: 3619465 - RNA, 13 nt, Human
uuagcuuuguguu

SEQ ID NO: 3619466 - RNA, 20 nt, Human
uuagcuuuguguuugguuua

SEQ ID NO: 3619467 - RNA, 22 nt, Human
uuagcuuuguguuugguuuaca

SEQ ID NO: 3619468 - RNA, 18 nt, Human
uuagcuuuuuaaaacauu

SEQ ID NO: 3619469 - RNA, 21 nt, Human
uuaggaaaaucacuuugucua

SEQ ID NO: 3619470 - RNA, 11 nt, Human
uuaggaaauaa

SEQ ID NO: 3619471 - RNA, 18 nt, Human
uuaggaaauaaaaccuuu

SEQ ID NO: 3619472 - RNA, 20 nt, Human
uuaggaaauaaaaccuuuca

SEQ ID NO: 3619473 - RNA, 17 nt, Human
uuaggaaaugaaugugu

SEQ ID NO: 3619474 - RNA, 19 nt, Human
uuaggaaaugaaugugugu

SEQ ID NO: 3619475 - RNA, 23 nt, Human
uuaggaaauguuuuuaauaaaag

SEQ ID NO: 3619476 - RNA, 23 nt, Human
uuaggaaguugacuuauaguaca

SEQ ID NO: 3619477 - RNA, 19 nt, Human
uuaggaauuaaguuaucuu

SEQ ID NO: 3619478 - RNA, 23 nt, Human
uuaggagauuuuagguguugauu

SEQ ID NO: 3619479 - RNA, 22 nt, Human
uuauguuaagggaagaauucca

SEQ ID NO: 3619480 - RNA, 13 nt, Human
uuauguuaauauu

SEQ ID NO: 3619481 - RNA, 15 nt, Human
uuauguugaaaaaau

SEQ ID NO: 3619482 - RNA, 18 nt, Human
uuauguugaaaaaauuua

SEQ ID NO: 3619483 - RNA, 16 nt, Human
uuauguugacauuugu

SEQ ID NO: 3619484 - RNA, 17 nt, Human
uuauguugacauuuguu

SEQ ID NO: 3619485 - RNA, 17 nt, Human
uuauguuguauagauua

SEQ ID NO: 3619486 - RNA, 23 nt, Human
uuauguuguuguuguuuuuggau

SEQ ID NO: 3619487 - RNA, 18 nt, Human
uuauguuguuuuguacag

SEQ ID NO: 3619488 - RNA, 14 nt, Human
uuauguuuaauaag

SEQ ID NO: 3619489 - RNA, 19 nt, Human
uuauguuuauauaaaugcu

SEQ ID NO: 3619490 - RNA, 14 nt, Human
uuauguuugaauau

SEQ ID NO: 3619491 - RNA, 15 nt, Human
uuauguuugaauaug

SEQ ID NO: 3619492 - RNA, 16 nt, Human
uuauuaaaaucuuaaa

SEQ ID NO: 3619493 - RNA, 20 nt, Human
uuauuaaaaugauuguaaaa

SEQ ID NO: 3619494 - RNA, 21 nt, Human
uuauuaaacagauuuuuacaa

SEQ ID NO: 3619495 - RNA, 14 nt, Human
uuauuaaaccccuu

SEQ ID NO: 3619496 - RNA, 20 nt, Human
uuauuaaacguaugcaugug

SEQ ID NO: 3619497 - RNA, 22 nt, Human
uuauuaaacguaugcaugugaa

SEQ ID NO: 3619498 - RNA, 13 nt, Human
uuauuaaagaaaa

SEQ ID NO: 3619499 - RNA, 20 nt, Human
uuauuaaagaaaaaaaugua

SEQ ID NO: 3619500 - RNA, 22 nt, Human
uuauuaaagaaaaaaauguauu

SEQ ID NO: 3619501 - RNA, 14 nt, Human
uuauuaaaguuuca

SEQ ID NO: 3619502 - RNA, 15 nt, Human
uuauuaaaguuucaa

SEQ ID NO: 3619503 - RNA, 17 nt, Human
uuauuaaaguuucaaaa

SEQ ID NO: 3619504 - RNA, 11 nt, Human
uuauuaaauag

SEQ ID NO: 3619505 - RNA, 17 nt, Human
uuauuaaaugcuucauu

SEQ ID NO: 3619506 - RNA, 24 nt, Human
uuauuaaauguagcuucagucauu

SEQ ID NO: 3619507 - RNA, 21 nt, Human
uuauuaaauuuuuuuguauga

SEQ ID NO: 3619508 - RNA, 19 nt, Human
uuauuaacaauuaggcaga

SEQ ID NO: 3619509 - RNA, 21 nt, Human
uuauuaacgauguccaacccg

SEQ ID NO: 3619510 - RNA, 16 nt, Human
uuauuaacuacauuua

SEQ ID NO: 3619511 - RNA, 17 nt, Human
uuauuaagauggauucu

SEQ ID NO: 3619512 - RNA, 20 nt, Human
uuauuaagauggauucucag

SEQ ID NO: 3619513 - RNA, 18 nt, Human
uuauuaagguuacagauu

SEQ ID NO: 3619514 - RNA, 14 nt, Human
uuauuaauaaacau

SEQ ID NO: 3619515 - RNA, 13 nt, Human
uuauuaaucacua

SEQ ID NO: 3619516 - RNA, 16 nt, Human
uuauuaaucacugugu

SEQ ID NO: 3619517 - RNA, 17 nt, Human
uuauuaaucuuagugua

SEQ ID NO: 3619518 - RNA, 17 nt, Human
uuauuaaugcacuuucu

SEQ ID NO: 3619519 - RNA, 13 nt, Human
uuauuaaugcuaa

SEQ ID NO: 3619520 - RNA, 14 nt, Human
uuauuaaugcuaag

SEQ ID NO: 3619521 - RNA, 14 nt, Human
uuauuaaugcuuug

SEQ ID NO: 3619522 - RNA, 12 nt, Human
uuauuaauguuu

SEQ ID NO: 3619523 - RNA, 12 nt, Human
uuauuacagugu

SEQ ID NO: 3619524 - RNA, 19 nt, Human
uuauuacaguguuuauccu

SEQ ID NO: 3619525 - RNA, 15 nt, Human
uuauuacauguaauu

SEQ ID NO: 3619526 - RNA, 20 nt, Human
uuauuacccccuccuucaga

SEQ ID NO: 3619527 - RNA, 22 nt, Human
uuauuacccccuccuucagaca

SEQ ID NO: 3619528 - RNA, 18 nt, Human
uuauuacccuucuuucca

SEQ ID NO: 3619529 - RNA, 12 nt, Human
uuauuaccucug

SEQ ID NO: 3619530 - RNA, 19 nt, Human
uuauuacugcuaaguauuu

SEQ ID NO: 3619531 - RNA, 16 nt, Human
uuauuacuguaagaaa

SEQ ID NO: 3619532 - RNA, 14 nt, Human
uuauuacuuauuug

SEQ ID NO: 3619533 - RNA, 15 nt, Human
uuauuacuuccauga

SEQ ID NO: 3619534 - RNA, 15 nt, Human
uuauuacuuguaaau

SEQ ID NO: 3619535 - RNA, 20 nt, Human
uuauuagaaucaaacauuuu

SEQ ID NO: 3619536 - RNA, 21 nt, Human
uuauuagagauuaccuccuga

SEQ ID NO: 3619537 - RNA, 17 nt, Human
uuauuagagugucuuuc

SEQ ID NO: 3619538 - RNA, 23 nt, Human
uuauaaauguaccagagagaguu

SEQ ID NO: 3619539 - RNA, 11 nt, Human
uuauaaauuaa

SEQ ID NO: 3619540 - RNA, 13 nt, Human
uuauaaauuaaau

SEQ ID NO: 3619541 - RNA, 13 nt, Human
uuauaaauuaugu

SEQ ID NO: 3619542 - RNA, 17 nt, Human
uuauaaauuucuauuuu

SEQ ID NO: 3619543 - RNA, 21 nt, Human
uuauaaccuuaauuuauuauu

SEQ ID NO: 3619544 - RNA, 16 nt, Human
uuauaacucaucauaa

SEQ ID NO: 3619545 - RNA, 19 nt, Human
uuauaacucaucauaaaau

SEQ ID NO: 3619546 - RNA, 19 nt, Human
uuauaacucugcacuacuc

SEQ ID NO: 3619547 - RNA, 18 nt, Human
uuauaacuguaaagaugu

SEQ ID NO: 3619548 - RNA, 13 nt, Human
uuauaacuuaaaa

SEQ ID NO: 3619549 - RNA, 15 nt, Human
uuauaacuuaaaaaa

SEQ ID NO: 3619550 - RNA, 12 nt, Human
uuauaagacucu

SEQ ID NO: 3619551 - RNA, 14 nt, Human
uuauaagcagauuu

SEQ ID NO: 3619552 - RNA, 22 nt, Human
uuauaagcaucauuauuuaugu

SEQ ID NO: 3619553 - RNA, 15 nt, Human
uuauaagcauugaaa

SEQ ID NO: 3619554 - RNA, 18 nt, Human
uuauaagcauugaaauua

SEQ ID NO: 3619555 - RNA, 17 nt, Human
uuauaaggaaauuuuac

SEQ ID NO: 3619556 - RNA, 11 nt, Human
uuauaaggacu

SEQ ID NO: 3619557 - RNA, 17 nt, Human
uuauaaggacugcaugg

SEQ ID NO: 3619558 - RNA, 22 nt, Human
uuauaaggacugcaugguaauu

SEQ ID NO: 3619559 - RNA, 14 nt, Human
uuauaagguguuuu

SEQ ID NO: 3619560 - RNA, 20 nt, Human
uuauaagguguuuucugugu

SEQ ID NO: 3619561 - RNA, 21 nt, Human
uuauaagguguuuucugugua

SEQ ID NO: 3619562 - RNA, 21 nt, Human
uuauaauaaaaggaaaagcaa

SEQ ID NO: 3619563 - RNA, 20 nt, Human
uuauaauaaauauauacauu

SEQ ID NO: 3619564 - RNA, 18 nt, Human
uuauaauaauguuaacau

SEQ ID NO: 3619565 - RNA, 24 nt, Human
uuauaauccuuaaaucuuaauguu

SEQ ID NO: 3619566 - RNA, 15 nt, Human
uuauaaugaaugaaa

SEQ ID NO: 3619567 - RNA, 14 nt, Human
uuauaaugaaugac

SEQ ID NO: 3619568 - RNA, 22 nt, Human
uuauaauucaguauguuuuaca

SEQ ID NO: 3619569 - RNA, 23 nt, Human
uuauaauucuuucaauacagaua

SEQ ID NO: 3619570 - RNA, 21 nt, Human
uuauaauuuuaaauguuuuuu

SEQ ID NO: 3619571 - RNA, 15 nt, Human
uuauaauuuuaagau

SEQ ID NO: 3619572 - RNA, 21 nt, Human
uuauaauuuuaagauuccuuu

SEQ ID NO: 3619573 - RNA, 15 nt, Human
uuauaauuuugugaa

SEQ ID NO: 3619574 - RNA, 17 nt, Human
uuauacaacagugcuaa

SEQ ID NO: 3619575 - RNA, 21 nt, Human
uuauacaacagugcuaaaaau

SEQ ID NO: 3619576 - RNA, 14 nt, Human
uuauacacauaauu

SEQ ID NO: 3619577 - RNA, 21 nt, Human
uuauacacauaauuaaagugu

SEQ ID NO: 3619578 - RNA, 23 nt, Human
uuauacagaauugugucugcagg

SEQ ID NO: 3619579 - RNA, 15 nt, Human
uuauacagcuguauu

SEQ ID NO: 3619580 - RNA, 21 nt, Human
uuauacaguagugagaagaau

SEQ ID NO: 3619581 - RNA, 21 nt, Human
uuauacaguuauaaaauuaaa

SEQ ID NO: 3619582 - RNA, 18 nt, Human
uuauacaguuuuaaagaa

SEQ ID NO: 3619583 - RNA, 19 nt, Human
uuauacaguuuuaaagaau

SEQ ID NO: 3619584 - RNA, 11 nt, Human
uuauacauaaa

SEQ ID NO: 3619585 - RNA, 16 nt, Human
uuauacaugacacuga

SEQ ID NO: 3619586 - RNA, 22 nt, Human
uuauacaugacacugaaaugcc

SEQ ID NO: 3619587 - RNA, 21 nt, Human
uuauaccuguguauuuuuuaa

SEQ ID NO: 3619588 - RNA, 21 nt, Human
uuauacgcuggcaacacagag

SEQ ID NO: 3619589 - RNA, 19 nt, Human
uuauacucuuccuauuuuu

SEQ ID NO: 3619590 - RNA, 13 nt, Human
uuauacuguacaa

SEQ ID NO: 3619591 - RNA, 17 nt, Human
uuauacuguacaauaaa

SEQ ID NO: 3619592 - RNA, 22 nt, Human
uuauacuguacuuaauaaauuc

SEQ ID NO: 3619593 - RNA, 18 nt, Human
uuauacuuucccuacccu

SEQ ID NO: 3619594 - RNA, 18 nt, Human
uuauagaacuucauggau

SEQ ID NO: 3619595 - RNA, 19 nt, Human
uuauagaagaaugcaugcu

SEQ ID NO: 3619596 - RNA, 16 nt, Human
uucuauaauuuuacaa

SEQ ID NO: 3619597 - RNA, 19 nt, Human
uucuauagcaucacuuaaa

SEQ ID NO: 3619598 - RNA, 22 nt, Human
uucuauagcaucacuuaaaaca

SEQ ID NO: 3619599 - RNA, 21 nt, Human
uucuauagccaaaaauagcua

SEQ ID NO: 3619600 - RNA, 14 nt, Human
uucuauagcuuuuc

SEQ ID NO: 3619601 - RNA, 20 nt, Human
uucuauaugaauuuaaauau

SEQ ID NO: 3619602 - RNA, 23 nt, Human
uucuauaugaauuuaaauauaau

SEQ ID NO: 3619603 - RNA, 11 nt, Human
uucuauauuuu

SEQ ID NO: 3619604 - RNA, 16 nt, Human
uucuauauuuucauuc

SEQ ID NO: 3619605 - RNA, 13 nt, Human
uucuaucauuuuu

SEQ ID NO: 3619606 - RNA, 19 nt, Human
uucuaucauuuuuguacag

SEQ ID NO: 3619607 - RNA, 17 nt, Human
uucuaucuacugauuug

SEQ ID NO: 3619608 - RNA, 20 nt, Human
uucuaucuuguuccaaggcc

SEQ ID NO: 3619609 - RNA, 13 nt, Human
uucuaucuuuugu

SEQ ID NO: 3619610 - RNA, 16 nt, Human
uucuaugaaagacuca

SEQ ID NO: 3619611 - RNA, 19 nt, Human
uucuaugaguggaaaaagc

SEQ ID NO: 3619612 - RNA, 21 nt, Human
uucuauguacuaguacugugu

SEQ ID NO: 3619613 - RNA, 24 nt, Human
uucuauguacuaguacuguguacu

SEQ ID NO: 3619614 - RNA, 15 nt, Human
uucuauguaguuuau

SEQ ID NO: 3619615 - RNA, 22 nt, Human
uucuaugugacaauuuuguaca

SEQ ID NO: 3619616 - RNA, 13 nt, Human
uucuauguuuacu

SEQ ID NO: 3619617 - RNA, 16 nt, Human
uucuauuaaaagacuc

SEQ ID NO: 3619618 - RNA, 15 nt, Human
uucuauuaaagugcu

SEQ ID NO: 3619619 - RNA, 17 nt, Human
uucuauuaacuuuaauu

SEQ ID NO: 3619620 - RNA, 15 nt, Human
uucuauuauggaaaa

SEQ ID NO: 3619621 - RNA, 19 nt, Human
uucuauuauggaaaacugu

SEQ ID NO: 3619622 - RNA, 14 nt, Human
uucuauuccuucug

SEQ ID NO: 3619623 - RNA, 17 nt, Human
uucuauucucuccucag

SEQ ID NO: 3619624 - RNA, 20 nt, Human
uucuauucucuccucagacu

SEQ ID NO: 3619625 - RNA, 17 nt, Human
uucuauugacuucaaug

SEQ ID NO: 3619626 - RNA, 14 nt, Human
uucuauugccucug

SEQ ID NO: 3619627 - RNA, 17 nt, Human
uucuauugccucugaga

SEQ ID NO: 3619628 - RNA, 21 nt, Human
uucuauugccuucuuugaaga

SEQ ID NO: 3619629 - RNA, 23 nt, Human
uucuauugccuucuuugaagaag

SEQ ID NO: 3619630 - RNA, 14 nt, Human
uucuauuguacaga

SEQ ID NO: 3619631 - RNA, 19 nt, Human
uucuauuguuacucugguu

SEQ ID NO: 3619632 - RNA, 22 nt, Human
uucuauuguuacucugguucuu

SEQ ID NO: 3619633 - RNA, 17 nt, Human
uucuauuguuuauucuu

SEQ ID NO: 3619634 - RNA, 13 nt, Human
uucuauuuaagug

SEQ ID NO: 3619635 - RNA, 19 nt, Human
uucuauuuauauguacaug

SEQ ID NO: 3619636 - RNA, 17 nt, Human
uucuauuuauuaugcuu

SEQ ID NO: 3619637 - RNA, 15 nt, Human
uucuauuuauuuacu

SEQ ID NO: 3619638 - RNA, 16 nt, Human
uucuauuugcugggcu

SEQ ID NO: 3619639 - RNA, 14 nt, Human
uucuauuuggggcu

SEQ ID NO: 3619640 - RNA, 22 nt, Human
uucuauuuuaagacugauuuua

SEQ ID NO: 3619641 - RNA, 21 nt, Human
uucuauuuucauuuucugcaa

SEQ ID NO: 3619642 - RNA, 13 nt, Human
uucuauuuuguaa

SEQ ID NO: 3619643 - RNA, 13 nt, Human
uucucaaagaaau

SEQ ID NO: 3619644 - RNA, 15 nt, Human
uucucaaagaaauuu

SEQ ID NO: 3619645 - RNA, 12 nt, Human
uucucaaagcag

SEQ ID NO: 3619646 - RNA, 19 nt, Human
uucucaaaggguacuucca

SEQ ID NO: 3619647 - RNA, 18 nt, Human
uucucaaaguuuugaaaa

SEQ ID NO: 3619648 - RNA, 14 nt, Human
uucucaacuccaaa

SEQ ID NO: 3619649 - RNA, 18 nt, Human
uucucaacuccaaacuga

SEQ ID NO: 3619650 - RNA, 14 nt, Human
uucucaagcccugc

SEQ ID NO: 3619651 - RNA, 20 nt, Human
uucucaaguucuaagauucu

SEQ ID NO: 3619652 - RNA, 23 nt, Human
uucucaaguucuaagauucuaau

SEQ ID NO: 3619653 - RNA, 13 nt, Human
uucucaaugaaaa

SEQ ID NO: 3619654 - RNA, 13 nt, Human
uucucaauuccaa

SEQ ID NO: 3619655 - RNA, 18 nt, Human
uucucaauuccaacaguu

SEQ ID NO: 3619656 - RNA, 20 nt, Human
uucucacacucuaacuguau

SEQ ID NO: 3619657 - RNA, 22 nt, Human
uucucacacucuaacuguauau

SEQ ID NO: 3619658 - RNA, 12 nt, Human
uucucacagcac

SEQ ID NO: 3619659 - RNA, 21 nt, Human
uucucacagcacaugcuggcc

SEQ ID NO: 3619660 - RNA, 22 nt, Human
uucucacagcacaugcuggcca

SEQ ID NO: 3619661 - RNA, 20 nt, Human
uucucacagcuccaagaauu

SEQ ID NO: 3619662 - RNA, 18 nt, Human
uucucacaggucccaaau

SEQ ID NO: 3619663 - RNA, 19 nt, Human
uucucacagugggagccag

SEQ ID NO: 3619664 - RNA, 13 nt, Human
uucucaccagcug

SEQ ID NO: 3619665 - RNA, 22 nt, Human
uucucaccagcugcaaaguguu

SEQ ID NO: 3619666 - RNA, 23 nt, Human
uucucaccagcugcaaaguguuu

SEQ ID NO: 3619667 - RNA, 13 nt, Human
uucucaccaggaa

SEQ ID NO: 3619668 - RNA, 16 nt, Human
uucucacuccuaccug

SEQ ID NO: 3619669 - RNA, 18 nt, Human
uucucagaaggcaaauga

SEQ ID NO: 3619670 - RNA, 22 nt, Human
uucucagaaggcaaaugacuuu

SEQ ID NO: 3619671 - RNA, 19 nt, Human
uucucagaaucucaaauaa

SEQ ID NO: 3619672 - RNA, 23 nt, Human
uucucagaaucucaaauaacuaa

SEQ ID NO: 3619673 - RNA, 16 nt, Human
uucucagauuucugag

SEQ ID NO: 3619674 - RNA, 14 nt, Human
uucucagcucccau

SEQ ID NO: 3619675 - RNA, 16 nt, Human
uucucagcucccccug

SEQ ID NO: 3619676 - RNA, 14 nt, Human
uucucagcucuucu

SEQ ID NO: 3619677 - RNA, 18 nt, Human
uucucaggacacaggccu

SEQ ID NO: 3619678 - RNA, 19 nt, Human
uucucaggacacaggccug

SEQ ID NO: 3619679 - RNA, 20 nt, Human
uucucaggacacaggccugu

SEQ ID NO: 3619680 - RNA, 22 nt, Human
uucucaggacacaggccugugu

SEQ ID NO: 3619681 - RNA, 23 nt, Human
uucucaggacacaggccugugua

SEQ ID NO: 3619682 - RNA, 17 nt, Human
uucucaggcaugaacau

SEQ ID NO: 3619683 - RNA, 20 nt, Human
uucucaggcucugcccugcc

SEQ ID NO: 3619684 - RNA, 13 nt, Human
uucucagggucuc

SEQ ID NO: 3619685 - RNA, 18 nt, Human
uucucagggucucugcug

SEQ ID NO: 3619686 - RNA, 19 nt, Human
uucucagguguugccaaau

SEQ ID NO: 3619687 - RNA, 22 nt, Human
uucucagugccaacuguggcug

SEQ ID NO: 3619688 - RNA, 15 nt, Human
uucucaguuuguaua

SEQ ID NO: 3619689 - RNA, 15 nt, Human
uucucaguuuucaua

SEQ ID NO: 3619690 - RNA, 17 nt, Human
uucucauaauuccuaca

SEQ ID NO: 3619691 - RNA, 19 nt, Human
uucucauaauuccuacagc

SEQ ID NO: 3619692 - RNA, 24 nt, Human
uucucauaggaaaaguacauuuaa

SEQ ID NO: 3619693 - RNA, 13 nt, Human
uucucaucaguag

SEQ ID NO: 3619694 - RNA, 15 nt, Human
uucucauccugcagg

SEQ ID NO: 3619695 - RNA, 19 nt, Human
uucucaucugcacccuucu

SEQ ID NO: 3619696 - RNA, 23 nt, Human
uucucaucuugacagagccugcc

SEQ ID NO: 3619697 - RNA, 15 nt, Human
uucucaucuugugaa

SEQ ID NO: 3619698 - RNA, 18 nt, Human
uucucaucuuucuugauc

SEQ ID NO: 3619699 - RNA, 14 nt, Human
uucucaugauccaa

SEQ ID NO: 3619700 - RNA, 20 nt, Human
uucucaugauuuacagagaa

SEQ ID NO: 3619701 - RNA, 14 nt, Human
uucucaugccucag

SEQ ID NO: 3619702 - RNA, 15 nt, Human
uucucauuacuuguu

SEQ ID NO: 3619703 - RNA, 13 nt, Human
uucucauuuucuu

SEQ ID NO: 3619704 - RNA, 18 nt, Human
uucuccaaaaaucugccu

SEQ ID NO: 3619705 - RNA, 21 nt, Human
uucuccaaaaaucugccuggg

SEQ ID NO: 3619706 - RNA, 14 nt, Human
uucuccaaaugaga

SEQ ID NO: 3619707 - RNA, 15 nt, Human
uucuccaaggaaacc

SEQ ID NO: 3619708 - RNA, 21 nt, Human
uucuccaccucccacaaagga

SEQ ID NO: 3619709 - RNA, 12 nt, Human
uucuccaccugc

SEQ ID NO: 3619710 - RNA, 14 nt, Human
uucuccaccugcca

SEQ ID NO: 3619711 - RNA, 18 nt, Human
uucuccaccugccaggga

SEQ ID NO: 3619712 - RNA, 12 nt, Human
uucuccacugga

SEQ ID NO: 3619713 - RNA, 14 nt, Human
uucuccacugugca

SEQ ID NO: 3619714 - RNA, 22 nt, Human
uucuccagccuggacccccagc

SEQ ID NO: 3619715 - RNA, 23 nt, Human
uucuccagccuggacccccagcu

SEQ ID NO: 3619716 - RNA, 13 nt, Human
uucuccagcucag

SEQ ID NO: 3619717 - RNA, 14 nt, Human
uucuccagcugggc

SEQ ID NO: 3619718 - RNA, 15 nt, Human
uucuccagcugggcu

SEQ ID NO: 3619719 - RNA, 20 nt, Human
uucuccaggucucacgggca

SEQ ID NO: 3619720 - RNA, 12 nt, Human
uucuccaucccu

SEQ ID NO: 3619721 - RNA, 18 nt, Human
uucuccaucuggcagggu

SEQ ID NO: 3619722 - RNA, 23 nt, Human
uucuccaugagacacaucuccuc

SEQ ID NO: 3619723 - RNA, 23 nt, Human
uucucccaauucauccucacuca

SEQ ID NO: 3619724 - RNA, 13 nt, Human
uucucccacacug

SEQ ID NO: 3619725 - RNA, 11 nt, Human
uucucccacuc

SEQ ID NO: 3619726 - RNA, 17 nt, Human
uucucccagaaucccag

SEQ ID NO: 3619727 - RNA, 20 nt, Human
uucucccagaaucccagccg

SEQ ID NO: 3619728 - RNA, 19 nt, Human
uucucccaggcaaggcugu

SEQ ID NO: 3619729 - RNA, 15 nt, Human
uucuuaucuucugca

SEQ ID NO: 3619730 - RNA, 14 nt, Human
uucuuaugaggagg

SEQ ID NO: 3619731 - RNA, 17 nt, Human
uucuuaugcaaaaugga

SEQ ID NO: 3619732 - RNA, 18 nt, Human
uucuuaugcaaaauggaa

SEQ ID NO: 3619733 - RNA, 18 nt, Human
uucuuaugccauauaauu

SEQ ID NO: 3619734 - RNA, 18 nt, Human
uucuuauggaauugauuu

SEQ ID NO: 3619735 - RNA, 21 nt, Human
uucuuaugugacauuaacaaa

SEQ ID NO: 3619736 - RNA, 19 nt, Human
uucuuauuuaaugaaagac

SEQ ID NO: 3619737 - RNA, 14 nt, Human
uucuuauuucauga

SEQ ID NO: 3619738 - RNA, 15 nt, Human
uucuuauuucauuuc

SEQ ID NO: 3619739 - RNA, 16 nt, Human
uucuucaaaccuuugu

SEQ ID NO: 3619740 - RNA, 17 nt, Human
uucuucaacaucaaugu

SEQ ID NO: 3619741 - RNA, 21 nt, Human
uucuucaacaucaauguucau

SEQ ID NO: 3619742 - RNA, 12 nt, Human
uucuucaagauc

SEQ ID NO: 3619743 - RNA, 17 nt, Human
uucuucaagaucccauu

SEQ ID NO: 3619744 - RNA, 13 nt, Human
uucuucacugcaa

SEQ ID NO: 3619745 - RNA, 14 nt, Human
uucuucacuuuugc

SEQ ID NO: 3619746 - RNA, 18 nt, Human
uucuucacuuuugcaagg

SEQ ID NO: 3619747 - RNA, 18 nt, Human
uucuucagauauacugga

SEQ ID NO: 3619748 - RNA, 20 nt, Human
uucuucagcguaaaauggug

SEQ ID NO: 3619749 - RNA, 18 nt, Human
uucuucauaacaauuuua

SEQ ID NO: 3619750 - RNA, 21 nt, Human
uucuucauaacaauuuuagga

SEQ ID NO: 3619751 - RNA, 15 nt, Human
uucuucauauucuaa

SEQ ID NO: 3619752 - RNA, 20 nt, Human
uucuucauauucuaaaacca

SEQ ID NO: 3619753 - RNA, 18 nt, Human
uucuucaucugugacucc

SEQ ID NO: 3619754 - RNA, 15 nt, Human
uucuucaugcaauga

SEQ ID NO: 3619755 - RNA, 17 nt, Human
uucuuccaaaaagauuu

SEQ ID NO: 3619756 - RNA, 14 nt, Human
uucuuccaaagcag

SEQ ID NO: 3619757 - RNA, 13 nt, Human
uucuuccauccca

SEQ ID NO: 3619758 - RNA, 20 nt, Human
uucuucccuuuuacauacug

SEQ ID NO: 3619759 - RNA, 15 nt, Human
uucuuccggccccuc

SEQ ID NO: 3619760 - RNA, 18 nt, Human
uucuuccuaccaagucaa

SEQ ID NO: 3619761 - RNA, 20 nt, Human
uucuuccucagccagccucg

SEQ ID NO: 3619762 - RNA, 15 nt, Human
uucuuccucauuccc

SEQ ID NO: 3619763 - RNA, 16 nt, Human
uucuuccuccagcugc

SEQ ID NO: 3619764 - RNA, 11 nt, Human
uucuuccucug

SEQ ID NO: 3619765 - RNA, 12 nt, Human
uucuuccucugc

SEQ ID NO: 3619766 - RNA, 13 nt, Human
uucuuccuggccg

SEQ ID NO: 3619767 - RNA, 18 nt, Human
uucuuccuguuaauguau

SEQ ID NO: 3619768 - RNA, 9 nt, Human
uucuuccuu

SEQ ID NO: 3619769 - RNA, 22 nt, Human
uucuuccuuaauucacucccac

SEQ ID NO: 3619770 - RNA, 14 nt, Human
uucuucgaaaaucu

SEQ ID NO: 3619771 - RNA, 17 nt, Human
uucuucgaaaaucuaga

SEQ ID NO: 3619772 - RNA, 19 nt, Human
uucuucgacuguuguuauc

SEQ ID NO: 3619773 - RNA, 23 nt, Human
uucuucgagguggaucacagagg

SEQ ID NO: 3619774 - RNA, 11 nt, Human
uucuucuagag

SEQ ID NO: 3619775 - RNA, 14 nt, Human
uucuucuagaguuc

SEQ ID NO: 3619776 - RNA, 18 nt, Human
uucuucuagguucuaaaa

SEQ ID NO: 3619777 - RNA, 21 nt, Human
uucuucuagguucuaaaaauu

SEQ ID NO: 3619778 - RNA, 17 nt, Human
uucuucucccccauccu

SEQ ID NO: 3619779 - RNA, 11 nt, Human
uucuucucccu

SEQ ID NO: 3619780 - RNA, 14 nt, Human
uucuucucccucag

SEQ ID NO: 3619781 - RNA, 14 nt, Human
uucuucucuagcug

SEQ ID NO: 3619782 - RNA, 14 nt, Human
uucuucucugcugc

SEQ ID NO: 3619783 - RNA, 15 nt, Human
uucuucucugugaga

SEQ ID NO: 3619784 - RNA, 19 nt, Human
uucuucucuuagauucuua

SEQ ID NO: 3619785 - RNA, 19 nt, Human
uucuucugaucacugaaau

SEQ ID NO: 3619786 - RNA, 20 nt, Human
uucuucugaucacugaaaua

SEQ ID NO: 3619787 - RNA, 23 nt, Human
uucuucuguaauauuuacaaugu

SEQ ID NO: 3619788 - RNA, 22 nt, Human
uucuucuuccaacguggcccag

SEQ ID NO: 3619789 - RNA, 14 nt, Human
uucuucuuccugaa

SEQ ID NO: 3619790 - RNA, 14 nt, Human
uucuucuucucguc

SEQ ID NO: 3619791 - RNA, 20 nt, Human
uucuugaacacucaugcuga

SEQ ID NO: 3619792 - RNA, 21 nt, Human
uucuugaacacucaugcugaa

SEQ ID NO: 3619793 - RNA, 17 nt, Human
uucuugaauauaaaaaa

SEQ ID NO: 3619794 - RNA, 23 nt, Human
uucuugaauggcaauguuuugcu

SEQ ID NO: 3619795 - RNA, 23 nt, Human
uucuugaggggaagcuagucuuu

SEQ ID NO: 3619796 - RNA, 20 nt, Human
uucuugauaauuuuccuuua

SEQ ID NO: 3619797 - RNA, 15 nt, Human
uucuugauguaaaau

SEQ ID NO: 3619798 - RNA, 16 nt, Human
uucuugcauugacauu

SEQ ID NO: 3619799 - RNA, 18 nt, Human
uucuugccucuguccccu

SEQ ID NO: 3619800 - RNA, 20 nt, Human
uucuugccucuguccccuuc

SEQ ID NO: 3619801 - RNA, 22 nt, Human
uucuugccucugugcugugugu

SEQ ID NO: 3619802 - RNA, 22 nt, Human
uucuugcucccuucagccccca

SEQ ID NO: 3619803 - RNA, 20 nt, Human
uucuugcucuaucucucaaa

SEQ ID NO: 3619804 - RNA, 19 nt, Human
uucuugcugcuagaacuuu

SEQ ID NO: 3619805 - RNA, 21 nt, Human
uucuugcugcuagaacuuuuu

SEQ ID NO: 3619806 - RNA, 17 nt, Human
uucuugcuucuuucuag

SEQ ID NO: 3619807 - RNA, 19 nt, Human
uucuugcuucuuucuagaa

SEQ ID NO: 3619808 - RNA, 19 nt, Human
uucuuggacacuuaauucu

SEQ ID NO: 3619809 - RNA, 22 nt, Human
uucuuggacacuuaauucuguu

SEQ ID NO: 3619810 - RNA, 18 nt, Human
uucuuggagucuuccaaa

SEQ ID NO: 3619811 - RNA, 23 nt, Human
uucuuggcaaaagccuuguguau

SEQ ID NO: 3619812 - RNA, 17 nt, Human
uucuuggccaugggagg

SEQ ID NO: 3619813 - RNA, 15 nt, Human
uucuuggcccaggau

SEQ ID NO: 3619814 - RNA, 14 nt, Human
uucuugggcccucc

SEQ ID NO: 3619815 - RNA, 18 nt, Human
uucuuggggcccuacacc

SEQ ID NO: 3619816 - RNA, 14 nt, Human
uucuugguaaaguc

SEQ ID NO: 3619817 - RNA, 22 nt, Human
uucuugguauuuggauaucugu

SEQ ID NO: 3619818 - RNA, 17 nt, Human
uucuugguucauaaaug

SEQ ID NO: 3619819 - RNA, 18 nt, Human
uucuugguucauaaauga

SEQ ID NO: 3619820 - RNA, 19 nt, Human
uucuugguucauaaaugaa

SEQ ID NO: 3619821 - RNA, 22 nt, Human
uucuugguugaggaaacaaaca

SEQ ID NO: 3619822 - RNA, 13 nt, Human
uucuugguuugua

SEQ ID NO: 3619823 - RNA, 17 nt, Human
uucuugguuuguaaauu

SEQ ID NO: 3619824 - RNA, 15 nt, Human
uucuuguaaaugugu

SEQ ID NO: 3619825 - RNA, 21 nt, Human
uucuuguaauuuaaacaggcc

SEQ ID NO: 3619826 - RNA, 13 nt, Human
uucuuguaguagu

SEQ ID NO: 3619827 - RNA, 22 nt, Human
uucuuguaucuggauucaaauu

SEQ ID NO: 3619828 - RNA, 13 nt, Human
uucuuguauuaag

SEQ ID NO: 3619829 - RNA, 19 nt, Human
uucuuguauuaagaaugaa

SEQ ID NO: 3619830 - RNA, 12 nt, Human
uucuuguauuua

SEQ ID NO: 3619831 - RNA, 17 nt, Human
uucuugucagacauaaa

SEQ ID NO: 3619832 - RNA, 14 nt, Human
uucuugucuauaaa

SEQ ID NO: 3619833 - RNA, 16 nt, Human
uucuugucuauaaagc

SEQ ID NO: 3619834 - RNA, 22 nt, Human
uucuugucuauaaagcauuuaa

SEQ ID NO: 3619835 - RNA, 15 nt, Human
uucuugucuauaguu

SEQ ID NO: 3619836 - RNA, 17 nt, Human
uucuugugaaggccaug

SEQ ID NO: 3619837 - RNA, 22 nt, Human
uucuuguguguaugcacaugaa

SEQ ID NO: 3619838 - RNA, 16 nt, Human
uucuuguucuguuuug

SEQ ID NO: 3619839 - RNA, 12 nt, Human
uucuuguugcuu

SEQ ID NO: 3619840 - RNA, 13 nt, Human
uucuuguuuauca

SEQ ID NO: 3619841 - RNA, 15 nt, Human
uucuuguuuccuugu

SEQ ID NO: 3619842 - RNA, 13 nt, Human
uucuuguuucucc

SEQ ID NO: 3619843 - RNA, 13 nt, Human
uucuuguuuugcu

SEQ ID NO: 3619844 - RNA, 23 nt, Human
uucuuuaaaaaacaacuauggau

SEQ ID NO: 3619845 - RNA, 14 nt, Human
uucuuuaaauguuu

SEQ ID NO: 3619846 - RNA, 12 nt, Human
uucuuuaacugc

SEQ ID NO: 3619847 - RNA, 22 nt, Human
uucuuuacaaaacaaacucauu

SEQ ID NO: 3619848 - RNA, 17 nt, Human
uucuuuagagaacugaa

SEQ ID NO: 3619849 - RNA, 18 nt, Human
uucuuuagagaacugaaa

SEQ ID NO: 3619850 - RNA, 20 nt, Human
uucuuuagagaacugaaaag

SEQ ID NO: 3619851 - RNA, 21 nt, Human
uucuuuagagaacugaaaaga

SEQ ID NO: 3619852 - RNA, 18 nt, Human
uucuuuagagcauugcca

SEQ ID NO: 3619853 - RNA, 14 nt, Human
uucuuuaggagauu

SEQ ID NO: 3619854 - RNA, 22 nt, Human
uucuuuaggagauuuuaggugu

SEQ ID NO: 3619855 - RNA, 20 nt, Human
uucuuuaguagcaacuaaaa

SEQ ID NO: 3619856 - RNA, 14 nt, Human
uucuuuauaagaaa

SEQ ID NO: 3619857 - RNA, 22 nt, Human
uucuuuauaagaaagccugagu

SEQ ID NO: 3619858 - RNA, 16 nt, Human
uucuuuauacaacagu

SEQ ID NO: 3619859 - RNA, 20 nt, Human
uucuuuauauuuauccacua

SEQ ID NO: 3619860 - RNA, 10 nt, Human
uucuuucaag

SEQ ID NO: 3619861 - RNA, 15 nt, Human
uucuuucaauacaga

SEQ ID NO: 3619862 - RNA, 19 nt, Human
uucuuucacaaaaaagaag

SEQ ID NO: 3619863 - RNA, 12 nt, Human
uucuuucagcca

SEQ ID NO: 3619864 - RNA, 18 nt, Human
uucuuucagcuaucagua

SEQ ID NO: 3619865 - RNA, 19 nt, Human
uucuuucaguucuuuggau

SEQ ID NO: 3619866 - RNA, 21 nt, Human
uucuuucuaguggucuuugua

SEQ ID NO: 3619867 - RNA, 20 nt, Human
uucuuucuuagaaauuuauu

SEQ ID NO: 3619868 - RNA, 19 nt, Human
uucuuugaaaaaaaauaaa

SEQ ID NO: 3619869 - RNA, 23 nt, Human
uucuuugaaaauaguuauucagu

SEQ ID NO: 3619870 - RNA, 12 nt, Human
uucuuugaagaa

SEQ ID NO: 3619871 - RNA, 20 nt, Human
uugauauuugugcauuuucu

SEQ ID NO: 3619872 - RNA, 22 nt, Human
uugauauuuucaacgcagcccu

SEQ ID NO: 3619873 - RNA, 18 nt, Human
uugaucaacaucuuuucu

SEQ ID NO: 3619874 - RNA, 22 nt, Human
uugaucaacaucuuuucuugcc

SEQ ID NO: 3619875 - RNA, 18 nt, Human
uugaucaguuaagaaauu

SEQ ID NO: 3619876 - RNA, 17 nt, Human
uugaucauguacuuuuu

SEQ ID NO: 3619877 - RNA, 14 nt, Human
uugaucauuucuug

SEQ ID NO: 3619878 - RNA, 17 nt, Human
uugaucauuucuuguga

SEQ ID NO: 3619879 - RNA, 19 nt, Human
uugaucauuuuccccccac

SEQ ID NO: 3619880 - RNA, 22 nt, Human
uugaucauuuuccccccacucu

SEQ ID NO: 3619881 - RNA, 16 nt, Human
uugauccauuucuaau

SEQ ID NO: 3619882 - RNA, 12 nt, Human
uugaucucccca

SEQ ID NO: 3619883 - RNA, 16 nt, Human
uugaucuccguggcuu

SEQ ID NO: 3619884 - RNA, 19 nt, Human
uugaucugcucagcccugg

SEQ ID NO: 3619885 - RNA, 16 nt, Human
uugaucuggaacccag

SEQ ID NO: 3619886 - RNA, 17 nt, Human
uugaucuggaacccaga

SEQ ID NO: 3619887 - RNA, 19 nt, Human
uugaucuggaacccagacu

SEQ ID NO: 3619888 - RNA, 11 nt, Human
uugaucuucaa

SEQ ID NO: 3619889 - RNA, 15 nt, Human
uugaucuucaacaaa

SEQ ID NO: 3619890 - RNA, 11 nt, Human
uugaugaaaag

SEQ ID NO: 3619891 - RNA, 19 nt, Human
uugaugaaaagauuuaagc

SEQ ID NO: 3619892 - RNA, 14 nt, Human
uugaugaaaagcuu

SEQ ID NO: 3619893 - RNA, 15 nt, Human
uugaugaaagcugau

SEQ ID NO: 3619894 - RNA, 16 nt, Human
uugaugaaagcugauu

SEQ ID NO: 3619895 - RNA, 12 nt, Human
uugaugaagaag

SEQ ID NO: 3619896 - RNA, 13 nt, Human
uugaugaagaagu

SEQ ID NO: 3619897 - RNA, 14 nt, Human
uugaugaagaaguu

SEQ ID NO: 3619898 - RNA, 16 nt, Human
uugaugaagcaaggaa

SEQ ID NO: 3619899 - RNA, 21 nt, Human
uugaugaagcaaggaagauau

SEQ ID NO: 3619900 - RNA, 13 nt, Human
uugaugacuggaa

SEQ ID NO: 3619901 - RNA, 20 nt, Human
uugaugacuggaauuuuuau

SEQ ID NO: 3619902 - RNA, 14 nt, Human
uugaugaggccucu

SEQ ID NO: 3619903 - RNA, 19 nt, Human
uugaugaguguaacaagaa

SEQ ID NO: 3619904 - RNA, 12 nt, Human
uugaugcacaga

SEQ ID NO: 3619905 - RNA, 18 nt, Human
uugaugcacagagaagcu

SEQ ID NO: 3619906 - RNA, 21 nt, Human
uugaugcacagagaagcuggg

SEQ ID NO: 3619907 - RNA, 14 nt, Human
uugaugcagcauuu

SEQ ID NO: 3619908 - RNA, 18 nt, Human
uugaugcagcauuugaua

SEQ ID NO: 3619909 - RNA, 18 nt, Human
uugaugcaggcacuuauu

SEQ ID NO: 3619910 - RNA, 11 nt, Human
uugaugcaugu

SEQ ID NO: 3619911 - RNA, 19 nt, Human
uugaugcauuaaaagaaaa

SEQ ID NO: 3619912 - RNA, 14 nt, Human
uugaugccaaaaaa

SEQ ID NO: 3619913 - RNA, 22 nt, Human
uugaugccaaaaaaaaauacau

SEQ ID NO: 3619914 - RNA, 17 nt, Human
uugaugcugacagucau

SEQ ID NO: 3619915 - RNA, 20 nt, Human
uugauggcuaacuuacaaag

SEQ ID NO: 3619916 - RNA, 15 nt, Human
uugaugggauuuggu

SEQ ID NO: 3619917 - RNA, 18 nt, Human
uugauggugguauguuuu

SEQ ID NO: 3619918 - RNA, 12 nt, Human
uugaugguuuau

SEQ ID NO: 3619919 - RNA, 15 nt, Human
uugauguaaaaucuu

SEQ ID NO: 3619920 - RNA, 16 nt, Human
uugauguaaaaucuug

SEQ ID NO: 3619921 - RNA, 21 nt, Human
uugauguaaaaucuugucaug

SEQ ID NO: 3619922 - RNA, 22 nt, Human
uugauguacugauugagaaguu

SEQ ID NO: 3619923 - RNA, 14 nt, Human
uugaugugacaaua

SEQ ID NO: 3619924 - RNA, 13 nt, Human
uugauguggcccu

SEQ ID NO: 3619925 - RNA, 14 nt, Human
uugauguguuaucu

SEQ ID NO: 3619926 - RNA, 13 nt, Human
uugauguguuguu

SEQ ID NO: 3619927 - RNA, 23 nt, Human
uugauguucuuucacccuuuucu

SEQ ID NO: 3619928 - RNA, 13 nt, Human
uugauguuggcug

SEQ ID NO: 3619929 - RNA, 13 nt, Human
uugauuaaauucu

SEQ ID NO: 3619930 - RNA, 14 nt, Human
uugauuaaauucuu

SEQ ID NO: 3619931 - RNA, 16 nt, Human
uugauuaaauucuugc

SEQ ID NO: 3619932 - RNA, 22 nt, Human
uugauuaagaucucagugguua

SEQ ID NO: 3619933 - RNA, 16 nt, Human
uugauuaagauuuuac

SEQ ID NO: 3619934 - RNA, 13 nt, Human
uugauuaugcaua

SEQ ID NO: 3619935 - RNA, 16 nt, Human
uugauuauuagccagg

SEQ ID NO: 3619936 - RNA, 15 nt, Human
uugauuauucagugu

SEQ ID NO: 3619937 - RNA, 12 nt, Human
uugauuauucug

SEQ ID NO: 3619938 - RNA, 20 nt, Human
uugauuauucugauuccacu

SEQ ID NO: 3619939 - RNA, 12 nt, Human
uugauuauuugc

SEQ ID NO: 3619940 - RNA, 23 nt, Human
uugauuauuugcauguuauguuu

SEQ ID NO: 3619941 - RNA, 23 nt, Human
uugauuauuuuuuuuuucuucuu

SEQ ID NO: 3619942 - RNA, 12 nt, Human
uugauucaaaau

SEQ ID NO: 3619943 - RNA, 15 nt, Human
uugauucaaaauauu

SEQ ID NO: 3619944 - RNA, 18 nt, Human
uugauucaaaauauuuaa

SEQ ID NO: 3619945 - RNA, 13 nt, Human
uugauucacaugu

SEQ ID NO: 3619946 - RNA, 14 nt, Human
uugccuuugaagag

SEQ ID NO: 3619947 - RNA, 17 nt, Human
uugccuuugaagaguga

SEQ ID NO: 3619948 - RNA, 17 nt, Human
uugccuuuguuuugaug

SEQ ID NO: 3619949 - RNA, 13 nt, Human
uugccuuuugcaa

SEQ ID NO: 3619950 - RNA, 14 nt, Human
uugccuuuuucauu

SEQ ID NO: 3619951 - RNA, 17 nt, Human
uugcgaaugguuccauu

SEQ ID NO: 3619952 - RNA, 19 nt, Human
uugcgacggagagaaaaaa

SEQ ID NO: 3619953 - RNA, 20 nt, Human
uugcgacggagagaaaaaag

SEQ ID NO: 3619954 - RNA, 12 nt, Human
uugcgagagaug

SEQ ID NO: 3619955 - RNA, 14 nt, Human
uugcgagagaugug

SEQ ID NO: 3619956 - RNA, 16 nt, Human
uugcgagagaugugug

SEQ ID NO: 3619957 - RNA, 17 nt, Human
uugcgagagaugugugu

SEQ ID NO: 3619958 - RNA, 15 nt, Human
uugcgcuccuggccc

SEQ ID NO: 3619959 - RNA, 20 nt, Human
uugcgcuccuggcccagccu

SEQ ID NO: 3619960 - RNA, 17 nt, Human
uugcggcaaaaggaaag

SEQ ID NO: 3619961 - RNA, 23 nt, Human
uugcggcgucagucuuuuucugu

SEQ ID NO: 3619962 - RNA, 14 nt, Human
uugcggcuccucag

SEQ ID NO: 3619963 - RNA, 14 nt, Human
uugcgggacagagu

SEQ ID NO: 3619964 - RNA, 17 nt, Human
uugcguaacuggcugug

SEQ ID NO: 3619965 - RNA, 14 nt, Human
uugcgugacacucu

SEQ ID NO: 3619966 - RNA, 20 nt, Human
uugcgugacacucuccuugc

SEQ ID NO: 3619967 - RNA, 18 nt, Human
uugcgugcccggggcagc

SEQ ID NO: 3619968 - RNA, 13 nt, Human
uugcuaaacacug

SEQ ID NO: 3619969 - RNA, 14 nt, Human
uugcuaaacacugc

SEQ ID NO: 3619970 - RNA, 22 nt, Human
uugcuaaaggaaaaaaccaucc

SEQ ID NO: 3619971 - RNA, 20 nt, Human
uugcuaacagcaacacaaag

SEQ ID NO: 3619972 - RNA, 16 nt, Human
uugcuaagcauuccaa

SEQ ID NO: 3619973 - RNA, 21 nt, Human
uugcuaagccccagcaagcaa

SEQ ID NO: 3619974 - RNA, 22 nt, Human
uugcuaaguaaaucucuucugu

SEQ ID NO: 3619975 - RNA, 20 nt, Human
uugcuaagugaggaugaaaa

SEQ ID NO: 3619976 - RNA, 15 nt, Human
uugcuaaucaguguc

SEQ ID NO: 3619977 - RNA, 23 nt, Human
uugcuaauuuucucaaaagcauu

SEQ ID NO: 3619978 - RNA, 17 nt, Human
uugcuaauuuuuauuaa

SEQ ID NO: 3619979 - RNA, 13 nt, Human
uugcuacauaauu

SEQ ID NO: 3619980 - RNA, 12 nt, Human
uugcuaccagua

SEQ ID NO: 3619981 - RNA, 16 nt, Human
uugcuaccaguauuua

SEQ ID NO: 3619982 - RNA, 20 nt, Human
uugcuaccaguauuuagaag

SEQ ID NO: 3619983 - RNA, 19 nt, Human
uugcuacuguuguaagaau

SEQ ID NO: 3619984 - RNA, 19 nt, Human
uugcuagaaugggaagggu

SEQ ID NO: 3619985 - RNA, 16 nt, Human
uugcuagagcuccucc

SEQ ID NO: 3619986 - RNA, 16 nt, Human
uugcuagcuaugugac

SEQ ID NO: 3619987 - RNA, 19 nt, Human
uugcuagcuaugugaccuu

SEQ ID NO: 3619988 - RNA, 21 nt, Human
uugcuaucaaaauaaauugaa

SEQ ID NO: 3619989 - RNA, 15 nt, Human
uugcuaucuuaauuu

SEQ ID NO: 3619990 - RNA, 18 nt, Human
uugcuaucuuaauuuugg

SEQ ID NO: 3619991 - RNA, 18 nt, Human
uugcuauguuacuauuuu

SEQ ID NO: 3619992 - RNA, 21 nt, Human
uugcuauguuacuauuuucua

SEQ ID NO: 3619993 - RNA, 17 nt, Human
uugcuauuagagcauug

SEQ ID NO: 3619994 - RNA, 12 nt, Human
uugcuauucugu

SEQ ID NO: 3619995 - RNA, 15 nt, Human
uugcuauucuguccc

SEQ ID NO: 3619996 - RNA, 18 nt, Human
uugcuauugaauugagau

SEQ ID NO: 3619997 - RNA, 19 nt, Human
uugcucaaaucuauucaga

SEQ ID NO: 3619998 - RNA, 21 nt, Human
uugcucaaguucauugaugac

SEQ ID NO: 3619999 - RNA, 22 nt, Human
uugcucaaguucauugaugacc

SEQ ID NO: 3620000 - RNA, 15 nt, Human
uugcucacagcugua

SEQ ID NO: 3620001 - RNA, 19 nt, Human
uugcucacccagugcccuc

SEQ ID NO: 3620002 - RNA, 13 nt, Human
uugcucagucucc

SEQ ID NO: 3620003 - RNA, 23 nt, Human
uugcucauuuuuuaaaaaaugga

SEQ ID NO: 3620004 - RNA, 16 nt, Human
uugcuccccuuccccu

SEQ ID NO: 3620005 - RNA, 17 nt, Human
uugcuccccuuccccuu

SEQ ID NO: 3620006 - RNA, 20 nt, Human
uugcuccccuuccccuuccu

SEQ ID NO: 3620007 - RNA, 19 nt, Human
uugcucccuucagccccca

SEQ ID NO: 3620008 - RNA, 12 nt, Human
uugcuccuugac

SEQ ID NO: 3620009 - RNA, 18 nt, Human
uugcucuaaaauauuuau

SEQ ID NO: 3620010 - RNA, 14 nt, Human
uugcucuacaauga

SEQ ID NO: 3620011 - RNA, 14 nt, Human
uugcucuaggaaga

SEQ ID NO: 3620012 - RNA, 20 nt, Human
uugcucucccgguucuucca

SEQ ID NO: 3620013 - RNA, 23 nt, Human
uugcucucccgguucuuccagug

SEQ ID NO: 3620014 - RNA, 18 nt, Human
uugcucucccucuucuca

SEQ ID NO: 3620015 - RNA, 23 nt, Human
uugcucuguaaucucguuucaaa

SEQ ID NO: 3620016 - RNA, 20 nt, Human
uugcucuguuugugggguga

SEQ ID NO: 3620017 - RNA, 17 nt, Human
uugcucuucagaugcca

SEQ ID NO: 3620018 - RNA, 17 nt, Human
uugcucuugaugccugg

SEQ ID NO: 3620019 - RNA, 15 nt, Human
uugcucuuguagccc

SEQ ID NO: 3620020 - RNA, 19 nt, Human
uugcucuugucccacgugu

SEQ ID NO: 3620021 - RNA, 16 nt, Human
uugcucuuucuacucu

SEQ ID NO: 3620022 - RNA, 13 nt, Human
uugcugaaaaaug

SEQ ID NO: 3620023 - RNA, 17 nt, Human
uugcugaacauuggaga

SEQ ID NO: 3620024 - RNA, 23 nt, Human
uugcugaauacagaggcaacugc

SEQ ID NO: 3620025 - RNA, 11 nt, Human
uugcugaauag

SEQ ID NO: 3620026 - RNA, 21 nt, Human
uugcugacuguagcuuuggaa

SEQ ID NO: 3620027 - RNA, 14 nt, Human
uugcugacuuagaa

SEQ ID NO: 3620028 - RNA, 11 nt, Human
uugcugagacu

SEQ ID NO: 3620029 - RNA, 14 nt, Human
uugcugagccucug

SEQ ID NO: 3620030 - RNA, 17 nt, Human
uugcugauggugcaaug

SEQ ID NO: 3620031 - RNA, 19 nt, Human
uugcugauggugcaaugac

SEQ ID NO: 3620032 - RNA, 19 nt, Human
uugcugauuuuaauggauu

SEQ ID NO: 3620033 - RNA, 20 nt, Human
uugcugauuuuauucuugau

SEQ ID NO: 3620034 - RNA, 20 nt, Human
uugcugcaagcacagcccuu

SEQ ID NO: 3620035 - RNA, 12 nt, Human
uugcugcagaga

SEQ ID NO: 3620036 - RNA, 18 nt, Human
uugcugcaguaugaaaau

SEQ ID NO: 3620037 - RNA, 20 nt, Human
uugcugccacuuuuuaacua

SEQ ID NO: 3620038 - RNA, 19 nt, Human
uugcugccccaucagugcu

SEQ ID NO: 3620039 - RNA, 12 nt, Human
uugcugccucau

SEQ ID NO: 3620040 - RNA, 23 nt, Human
uugcugccucggauccccuuccu

SEQ ID NO: 3620041 - RNA, 21 nt, Human
uugcugccugaagaacaguaa

SEQ ID NO: 3620042 - RNA, 13 nt, Human
uugggauuaauau

SEQ ID NO: 3620043 - RNA, 21 nt, Human
uugggauugggggcuggugcc

SEQ ID NO: 3620044 - RNA, 22 nt, Human
uugggauugggggcuggugcca

SEQ ID NO: 3620045 - RNA, 21 nt, Human
uugggcaauauucucuguaca

SEQ ID NO: 3620046 - RNA, 22 nt, Human
uugggcaauauucucuguacau

SEQ ID NO: 3620047 - RNA, 19 nt, Human
uugggcacccccagccugg

SEQ ID NO: 3620048 - RNA, 19 nt, Human
uugggcagaagggagaagg

SEQ ID NO: 3620049 - RNA, 22 nt, Human
uugggcagagcuggcucugagc

SEQ ID NO: 3620050 - RNA, 19 nt, Human
uugggcagcaauuuaaaug

SEQ ID NO: 3620051 - RNA, 19 nt, Human
uugggcagcgcccuuccuc

SEQ ID NO: 3620052 - RNA, 22 nt, Human
uugggccaaauccgcucucuuc

SEQ ID NO: 3620053 - RNA, 16 nt, Human
uugggccauacuggcc

SEQ ID NO: 3620054 - RNA, 23 nt, Human
uugggccauacuggccucgccug

SEQ ID NO: 3620055 - RNA, 20 nt, Human
uugggcccacaccuccuucc

SEQ ID NO: 3620056 - RNA, 22 nt, Human
uugggcccacaccuccuucccu

SEQ ID NO: 3620057 - RNA, 18 nt, Human
uugggcccagcugggcuc

SEQ ID NO: 3620058 - RNA, 11 nt, Human
uugggcccagg

SEQ ID NO: 3620059 - RNA, 12 nt, Human
uugggcccuccu

SEQ ID NO: 3620060 - RNA, 19 nt, Human
uugggccugcuccagaccu

SEQ ID NO: 3620061 - RNA, 20 nt, Human
uugggccugcuccagaccug

SEQ ID NO: 3620062 - RNA, 16 nt, Human
uugggcggcugagagc

SEQ ID NO: 3620063 - RNA, 21 nt, Human
uugggcggcugagagccccag

SEQ ID NO: 3620064 - RNA, 15 nt, Human
uugggcuccuuuuuc

SEQ ID NO: 3620065 - RNA, 16 nt, Human
uugggcuccuuuuucu

SEQ ID NO: 3620066 - RNA, 13 nt, Human
uugggcugagacu

SEQ ID NO: 3620067 - RNA, 15 nt, Human
uugggcugagacugg

SEQ ID NO: 3620068 - RNA, 19 nt, Human
uugggcuggaacagauuca

SEQ ID NO: 3620069 - RNA, 17 nt, Human
uugggcuugcuauucug

SEQ ID NO: 3620070 - RNA, 20 nt, Human
uuggggaaaccuagagaaga

SEQ ID NO: 3620071 - RNA, 19 nt, Human
uuggggaagaacgaagcca

SEQ ID NO: 3620072 - RNA, 22 nt, Human
uuggggaagagagccugcagga

SEQ ID NO: 3620073 - RNA, 18 nt, Human
uuggggaagggccugccc

SEQ ID NO: 3620074 - RNA, 15 nt, Human
uuggggaauuuccuc

SEQ ID NO: 3620075 - RNA, 23 nt, Human
uuggggacaggggcaggaggaag

SEQ ID NO: 3620076 - RNA, 16 nt, Human
uuggggagauuugcca

SEQ ID NO: 3620077 - RNA, 13 nt, Human
uuggggaggggcg

SEQ ID NO: 3620078 - RNA, 17 nt, Human
uuggggaguuaagaccu

SEQ ID NO: 3620079 - RNA, 13 nt, Human
uuggggauucuua

SEQ ID NO: 3620080 - RNA, 20 nt, Human
uuggggcaggaguagcugag

SEQ ID NO: 3620081 - RNA, 17 nt, Human
uuggggcgaggcagagg

SEQ ID NO: 3620082 - RNA, 15 nt, Human
uuggggcucccagcc

SEQ ID NO: 3620083 - RNA, 15 nt, Human
uuggggcuuauuuuu

SEQ ID NO: 3620084 - RNA, 14 nt, Human
uuggggcuucuugg

SEQ ID NO: 3620085 - RNA, 16 nt, Human
uuggggcuugacuuuu

SEQ ID NO: 3620086 - RNA, 23 nt, Human
uugggggacagggcuggcccagc

SEQ ID NO: 3620087 - RNA, 12 nt, Human
uugggggcuggu

SEQ ID NO: 3620088 - RNA, 19 nt, Human
uuggggggaaggggacccu

SEQ ID NO: 3620089 - RNA, 21 nt, Human
uugggggggccaaaaggaaaa

SEQ ID NO: 3620090 - RNA, 13 nt, Human
uuggggggguggc

SEQ ID NO: 3620091 - RNA, 19 nt, Human
uugggggucagugcugccu

SEQ ID NO: 3620092 - RNA, 13 nt, Human
uuggggucagcca

SEQ ID NO: 3620093 - RNA, 16 nt, Human
uuggggucagccaggg

SEQ ID NO: 3620094 - RNA, 13 nt, Human
uuggggucucuuu

SEQ ID NO: 3620095 - RNA, 22 nt, Human
uuggggucucuuuuguaaauua

SEQ ID NO: 3620096 - RNA, 21 nt, Human
uuggggugucuuuuuuuggug

SEQ ID NO: 3620097 - RNA, 16 nt, Human
uugggguuuuuuaaua

SEQ ID NO: 3620098 - RNA, 14 nt, Human
uuggguccaggagg

SEQ ID NO: 3620099 - RNA, 14 nt, Human
uuggguccuggguc

SEQ ID NO: 3620100 - RNA, 17 nt, Human
uugggucuauuccagcu

SEQ ID NO: 3620101 - RNA, 19 nt, Human
uugggugcugcuaauucuu

SEQ ID NO: 3620102 - RNA, 17 nt, Human
uuggguggagaagccau

SEQ ID NO: 3620103 - RNA, 19 nt, Human
uuggguggagaagccauug

SEQ ID NO: 3620104 - RNA, 20 nt, Human
uuggguguaacaggucuccu

SEQ ID NO: 3620105 - RNA, 21 nt, Human
uuggguguaacaggucuccuc

SEQ ID NO: 3620106 - RNA, 13 nt, Human
uuggguguauugu

SEQ ID NO: 3620107 - RNA, 21 nt, Human
uuggguuaaaaaaaaaaaaag

SEQ ID NO: 3620108 - RNA, 15 nt, Human
uuggguuagaccuac

SEQ ID NO: 3620109 - RNA, 17 nt, Human
uuggguuuauuuggaaa

SEQ ID NO: 3620110 - RNA, 12 nt, Human
uugguaaaccuu

SEQ ID NO: 3620111 - RNA, 15 nt, Human
uugguaaaguccuuu

SEQ ID NO: 3620112 - RNA, 16 nt, Human
uugguaacauccuuuc

SEQ ID NO: 3620113 - RNA, 14 nt, Human
uugguaagagacag

SEQ ID NO: 3620114 - RNA, 20 nt, Human
uugguaauccccuaaaauaa

SEQ ID NO: 3620115 - RNA, 14 nt, Human
uugguacacaacua

SEQ ID NO: 3620116 - RNA, 14 nt, Human
uugguaccuugcac

SEQ ID NO: 3620117 - RNA, 13 nt, Human
uugguagagauuc

SEQ ID NO: 3620118 - RNA, 15 nt, Human
uugguagagauucau

SEQ ID NO: 3620119 - RNA, 18 nt, Human
uugguagauuaaauauag

SEQ ID NO: 3620120 - RNA, 16 nt, Human
uugguaucaagaaagu

SEQ ID NO: 3620121 - RNA, 16 nt, Human
uugguauuaauaaaaa

SEQ ID NO: 3620122 - RNA, 19 nt, Human
uuggucaugugggucuucc

SEQ ID NO: 3620123 - RNA, 13 nt, Human
uuggucccugggg

SEQ ID NO: 3620124 - RNA, 21 nt, Human
uugguccuaagucccugcccc

SEQ ID NO: 3620125 - RNA, 14 nt, Human
uugguccugucccc

SEQ ID NO: 3620126 - RNA, 18 nt, Human
uuggucucuauuucauuu

SEQ ID NO: 3620127 - RNA, 20 nt, Human
uuggucugacccacugcuuu

SEQ ID NO: 3620128 - RNA, 13 nt, Human
uuggucuggacug

SEQ ID NO: 3620129 - RNA, 17 nt, Human
uuggucuggacugacag

SEQ ID NO: 3620130 - RNA, 13 nt, Human
uuggucuguguga

SEQ ID NO: 3620131 - RNA, 16 nt, Human
uuggugagaaaccugu

SEQ ID NO: 3620132 - RNA, 18 nt, Human
uuggugagaaaccuguau

SEQ ID NO: 3620133 - RNA, 21 nt, Human
uuggugagaaaccuguaucuu

SEQ ID NO: 3620134 - RNA, 15 nt, Human
uuggugauucaaaug

SEQ ID NO: 3620135 - RNA, 18 nt, Human
uuggugcacagugauuuu

SEQ ID NO: 3620136 - RNA, 12 nt, Human
uuggugccuggc

SEQ ID NO: 3620137 - RNA, 13 nt, Human
uuggugccuggcc

SEQ ID NO: 3620138 - RNA, 17 nt, Human
uuggugccuuuccuguu

SEQ ID NO: 3620139 - RNA, 16 nt, Human
uugguggagauaaaga

SEQ ID NO: 3620140 - RNA, 18 nt, Human
uuggugguuucagaaaug

SEQ ID NO: 3620141 - RNA, 17 nt, Human
uugguguaauuugaaga

SEQ ID NO: 3620142 - RNA, 14 nt, Human
uugguguacagacu

SEQ ID NO: 3620143 - RNA, 17 nt, Human
uuggugucgggcaugac

SEQ ID NO: 3620144 - RNA, 18 nt, Human
uuggugucgggcaugaca

SEQ ID NO: 3620145 - RNA, 19 nt, Human
uugguguguuggacagaga

SEQ ID NO: 3620146 - RNA, 23 nt, Human
uugguguguuuuugggaugucuu

SEQ ID NO: 3620147 - RNA, 15 nt, Human
uugguguugucauug

SEQ ID NO: 3620148 - RNA, 16 nt, Human
uugguuauacaugaca

SEQ ID NO: 3620149 - RNA, 20 nt, Human
uugguuauagugcaauauau

SEQ ID NO: 3620150 - RNA, 13 nt, Human
uugguucaaaugu

SEQ ID NO: 3620151 - RNA, 18 nt, Human
uugguucauuuucagauu

SEQ ID NO: 3620152 - RNA, 22 nt, Human
uugguuccaagucuuugcuauu

SEQ ID NO: 3620153 - RNA, 14 nt, Human
uugguucccuugug

SEQ ID NO: 3620154 - RNA, 14 nt, Human
uugguuccucucug

SEQ ID NO: 3620155 - RNA, 13 nt, Human
uugguuccugggg

SEQ ID NO: 3620156 - RNA, 18 nt, Human
uugguucuaaggaccuga

SEQ ID NO: 3620157 - RNA, 18 nt, Human
uugguucuagcgcaguuu

SEQ ID NO: 3620158 - RNA, 19 nt, Human
uugguucugcuucaauaaa

SEQ ID NO: 3620159 - RNA, 14 nt, Human
uugguucuggggcc

SEQ ID NO: 3620160 - RNA, 14 nt, Human
uugguucugugaac

SEQ ID NO: 3620161 - RNA, 22 nt, Human
uugguucuugaggggaccagga

SEQ ID NO: 3620162 - RNA, 22 nt, Human
uugguucuugguagagauucau

SEQ ID NO: 3620163 - RNA, 16 nt, Human
uugguugcuuuaauau

SEQ ID NO: 3620164 - RNA, 15 nt, Human
uugguuggcuggccu

SEQ ID NO: 3620165 - RNA, 17 nt, Human
uugguugggaugacuug

SEQ ID NO: 3620166 - RNA, 13 nt, Human
uugguuguauucu

SEQ ID NO: 3620167 - RNA, 18 nt, Human
uugguuguuuuuuccuuu

SEQ ID NO: 3620168 - RNA, 18 nt, Human
uugguuuaaagaaagugu

SEQ ID NO: 3620169 - RNA, 16 nt, Human
uugguuuacuuucaaa

SEQ ID NO: 3620170 - RNA, 22 nt, Human
uugguuuagcccaaguggagcc

SEQ ID NO: 3620171 - RNA, 13 nt, Human
uugguuuccccaa

SEQ ID NO: 3620172 - RNA, 20 nt, Human
uugguuuggccaucucugga

SEQ ID NO: 3620173 - RNA, 14 nt, Human
uugguuuguaaauu

SEQ ID NO: 3620174 - RNA, 20 nt, Human
uugguuuuaauugaaggaaa

SEQ ID NO: 3620175 - RNA, 13 nt, Human
uugguuuuauggu

SEQ ID NO: 3620176 - RNA, 20 nt, Human
uugguuuucacauuggaaac

SEQ ID NO: 3620177 - RNA, 13 nt, Human
uugguuuucuucu

SEQ ID NO: 3620178 - RNA, 13 nt, Human
uugguuuugacug

SEQ ID NO: 3620179 - RNA, 15 nt, Human
uugguuuugacugga

SEQ ID NO: 3620180 - RNA, 17 nt, Human
uugguuuuguuccccuc

SEQ ID NO: 3620181 - RNA, 19 nt, Human
uugguuuuuauuucuccuu

SEQ ID NO: 3620182 - RNA, 17 nt, Human
uuguaaaaaaaaaugcc

SEQ ID NO: 3620183 - RNA, 19 nt, Human
uuguaaaaaaaaaugccuu

SEQ ID NO: 3620184 - RNA, 23 nt, Human
uuguaaaaaaaaaugccuuugag

SEQ ID NO: 3620185 - RNA, 13 nt, Human
uuguaaaaagaaa

SEQ ID NO: 3620186 - RNA, 18 nt, Human
uuguaaaaagaaaaacca

SEQ ID NO: 3620187 - RNA, 22 nt, Human
uuguaaaaaucuuuugaagcau

SEQ ID NO: 3620188 - RNA, 13 nt, Human
uuguaaaaaugua

SEQ ID NO: 3620189 - RNA, 22 nt, Human
uuguaaaaauuaaaaguuaugg

SEQ ID NO: 3620190 - RNA, 21 nt, Human
uuguaaaaccugucaaugaua

SEQ ID NO: 3620191 - RNA, 14 nt, Human
uuguaaaacuacac

SEQ ID NO: 3620192 - RNA, 20 nt, Human
uuguaaaagaacaguaaaca

SEQ ID NO: 3620193 - RNA, 23 nt, Human
uuguaaaagaacaguaaacauug

SEQ ID NO: 3620194 - RNA, 15 nt, Human
uuguaaaauagcuug

SEQ ID NO: 3620195 - RNA, 13 nt, Human
uuguaaaauauag

SEQ ID NO: 3620196 - RNA, 14 nt, Human
uuguaaaauauagc

SEQ ID NO: 3620197 - RNA, 13 nt, Human
uuguaaaaugaca

SEQ ID NO: 3620198 - RNA, 12 nt, Human
uuguaaaauggu

SEQ ID NO: 3620199 - RNA, 20 nt, Human
uuguaaaauggugugaccac

SEQ ID NO: 3620200 - RNA, 19 nt, Human
uuguaaaauguucucuuau

SEQ ID NO: 3620201 - RNA, 23 nt, Human
uuguaaacaaacuguguaacugc

SEQ ID NO: 3620202 - RNA, 14 nt, Human
uuguaaacaugugu

SEQ ID NO: 3620203 - RNA, 14 nt, Human
uuguaaacauuuau

SEQ ID NO: 3620204 - RNA, 22 nt, Human
uuguaaacucaaaauauuugua

SEQ ID NO: 3620205 - RNA, 15 nt, Human
uuguaaacuguacua

SEQ ID NO: 3620206 - RNA, 12 nt, Human
uuguaaacuuug

SEQ ID NO: 3620207 - RNA, 13 nt, Human
uuguaaacuuuga

SEQ ID NO: 3620208 - RNA, 18 nt, Human
uuguaaacuuugaaauau

SEQ ID NO: 3620209 - RNA, 12 nt, Human
uuguaaagacug

SEQ ID NO: 3620210 - RNA, 13 nt, Human
uuguaaagaguug

SEQ ID NO: 3620211 - RNA, 17 nt, Human
uuguaaagauuucuguu

SEQ ID NO: 3620212 - RNA, 18 nt, Human
uuguaaagauuucuguuc

SEQ ID NO: 3620213 - RNA, 23 nt, Human
uuguaaaguguggucccaacagg

SEQ ID NO: 3620214 - RNA, 14 nt, Human
uuguaaauaagaga

SEQ ID NO: 3620215 - RNA, 11 nt, Human
uuguaaauaca

SEQ ID NO: 3620216 - RNA, 12 nt, Human
uuguaaauacac

SEQ ID NO: 3620217 - RNA, 12 nt, Human
uuguaaauauau

SEQ ID NO: 3620218 - RNA, 23 nt, Human
uuguaaauauuaaaccauaagau

SEQ ID NO: 3620219 - RNA, 12 nt, Human
uuguaaauauuu

SEQ ID NO: 3620220 - RNA, 16 nt, Human
uuguaaauauuuaugu

SEQ ID NO: 3620221 - RNA, 18 nt, Human
uuguaaaugugcuuuuaa

SEQ ID NO: 3620222 - RNA, 13 nt, Human
uuguaaauguuau

SEQ ID NO: 3620223 - RNA, 18 nt, Human
uuguaaauguuauuucug

SEQ ID NO: 3620224 - RNA, 12 nt, Human
uuguaaauuaua

SEQ ID NO: 3620225 - RNA, 15 nt, Human
uuguaaauuauauuu

SEQ ID NO: 3620226 - RNA, 16 nt, Human
uuguaaauuauuaauu

SEQ ID NO: 3620227 - RNA, 23 nt, Human
uuguaaauuauuaauuuaugcag

SEQ ID NO: 3620228 - RNA, 12 nt, Human
uuguaaauucug

SEQ ID NO: 3620229 - RNA, 13 nt, Human
uuguaaauucuga

SEQ ID NO: 3620230 - RNA, 14 nt, Human
uuguaaauucugau

SEQ ID NO: 3620231 - RNA, 14 nt, Human
uuguaaauuggcau

SEQ ID NO: 3620232 - RNA, 14 nt, Human
uuguaaccucagcu

SEQ ID NO: 3620233 - RNA, 16 nt, Human
uuguaaccucagcucu

SEQ ID NO: 3620234 - RNA, 19 nt, Human
uuguaacguugcuguggga

SEQ ID NO: 3620235 - RNA, 22 nt, Human
uuguaacuguuuagaugaaugu

SEQ ID NO: 3620236 - RNA, 18 nt, Human
uuguaacuuauauugaag

SEQ ID NO: 3620237 - RNA, 17 nt, Human
uuguaacuuauguagau

SEQ ID NO: 3620238 - RNA, 18 nt, Human
uuguaacuuauguagaua

SEQ ID NO: 3620239 - RNA, 20 nt, Human
uuguaagaaaccaaucaaga

SEQ ID NO: 3620240 - RNA, 23 nt, Human
uuguaagaaaccaaucaagauaa

SEQ ID NO: 3620241 - RNA, 19 nt, Human
uuguaagaaggcaauauua

SEQ ID NO: 3620242 - RNA, 20 nt, Human
uuguaagaaggcaauauuaa

SEQ ID NO: 3620243 - RNA, 18 nt, Human
uuguaagagcuauacagu

SEQ ID NO: 3620244 - RNA, 15 nt, Human
uuguaagaguguaga

SEQ ID NO: 3620245 - RNA, 18 nt, Human
uuguaagcguauggcuuu

SEQ ID NO: 3620246 - RNA, 14 nt, Human
uuguaaggaaugau

SEQ ID NO: 3620247 - RNA, 14 nt, Human
uuguaaggcuuuga

SEQ ID NO: 3620248 - RNA, 15 nt, Human
uuguaagucaguguu

SEQ ID NO: 3620249 - RNA, 19 nt, Human
uuguaagucaguguugaga

SEQ ID NO: 3620250 - RNA, 18 nt, Human
uuguaagugagugugcug

SEQ ID NO: 3620251 - RNA, 12 nt, Human
uuguaaguuuau

SEQ ID NO: 3620252 - RNA, 16 nt, Human
uuguaaguuucaggug

SEQ ID NO: 3620253 - RNA, 14 nt, Human
uuguaauaaaaugu

SEQ ID NO: 3620254 - RNA, 20 nt, Human
uuguaauaaaguauauaauu

SEQ ID NO: 3620255 - RNA, 13 nt, Human
uuguaauauuuug

SEQ ID NO: 3620256 - RNA, 15 nt, Human
uuguaauauuuugua

SEQ ID NO: 3620257 - RNA, 14 nt, Human
uuguaaucacuguu

SEQ ID NO: 3620258 - RNA, 12 nt, Human
uuguaaugaaaa

SEQ ID NO: 3620259 - RNA, 16 nt, Human
uuguaaugcugcacuu

SEQ ID NO: 3620260 - RNA, 21 nt, Human
uuguaaugcugcacuuccugu

SEQ ID NO: 3620261 - RNA, 13 nt, Human
uuguaauguaacu

SEQ ID NO: 3620262 - RNA, 20 nt, Human
uuguaaugucuugagcucua

SEQ ID NO: 3620263 - RNA, 17 nt, Human
uuguaaugugugaaaaa

SEQ ID NO: 3620264 - RNA, 12 nt, Human
uuguaauguugu

SEQ ID NO: 3620265 - RNA, 19 nt, Human
uuguaauguugugaauaau

SEQ ID NO: 3620266 - RNA, 17 nt, Human
uuguaauuaaaagcaaa

SEQ ID NO: 3620267 - RNA, 11 nt, Human
uuguaauuaug

SEQ ID NO: 3620268 - RNA, 12 nt, Human
uuguaauuauug

SEQ ID NO: 3620269 - RNA, 14 nt, Human
uuguaauucuaaau

SEQ ID NO: 3620270 - RNA, 23 nt, Human
uuguaauucuaaaugaauguuua

SEQ ID NO: 3620271 - RNA, 16 nt, Human
uuguaauucuucaguu

SEQ ID NO: 3620272 - RNA, 23 nt, Human
uuguaauuuaaacaggcccagca

SEQ ID NO: 3620273 - RNA, 20 nt, Human
uuguaauuuaaggucuguuu

SEQ ID NO: 3620274 - RNA, 15 nt, Human
uuguaauuuuacacg

SEQ ID NO: 3620275 - RNA, 13 nt, Human
uuguaauuuucuu

SEQ ID NO: 3620276 - RNA, 16 nt, Human
uuguaauuuucuugau

SEQ ID NO: 3620277 - RNA, 12 nt, Human
uuguacaaaaua

SEQ ID NO: 3620278 - RNA, 14 nt, Human
uuguacaaaauaaa

SEQ ID NO: 3620279 - RNA, 23 nt, Human
uuguacaaaauaaacaaauaaca

SEQ ID NO: 3620280 - RNA, 17 nt, Human
uuguacaaaguauuaag

SEQ ID NO: 3620281 - RNA, 19 nt, Human
uuguacacaccuuauauuu

SEQ ID NO: 3620282 - RNA, 20 nt, Human
uuguacacucauucauuacu

SEQ ID NO: 3620283 - RNA, 22 nt, Human
uuguacagaauauuucuauuga

SEQ ID NO: 3620284 - RNA, 12 nt, Human
uuguacagacaa

SEQ ID NO: 3620285 - RNA, 19 nt, Human
uuguacagacguaugcuua

SEQ ID NO: 3620286 - RNA, 21 nt, Human
uuguacagacguaugcuuauu

SEQ ID NO: 3620287 - RNA, 18 nt, Human
uuguacagauucuuuauu

SEQ ID NO: 3620288 - RNA, 20 nt, Human
uuguacaguuuguuuacaca

SEQ ID NO: 3620289 - RNA, 16 nt, Human
uuguacaguuuuuauu

SEQ ID NO: 3620290 - RNA, 14 nt, Human
uuguacauaaugcg

SEQ ID NO: 3620291 - RNA, 15 nt, Human
uuguacauauuugug

SEQ ID NO: 3620292 - RNA, 12 nt, Human
uuguacaugaaa

SEQ ID NO: 3620293 - RNA, 22 nt, Human
uuguacaugaaauuuuuguaaa

SEQ ID NO: 3620294 - RNA, 20 nt, Human
uuguacauguaacauuaaag

SEQ ID NO: 3620295 - RNA, 18 nt, Human
uuguaccaaaauuuuaaa

SEQ ID NO: 3620296 - RNA, 23 nt, Human
uuguaccagugaauuuuugcaau

SEQ ID NO: 3620297 - RNA, 11 nt, Human
uuguaccucuc

SEQ ID NO: 3620298 - RNA, 14 nt, Human
uuguaccucuggcu

SEQ ID NO: 3620299 - RNA, 19 nt, Human
uuguacgaagaguauuuuu

SEQ ID NO: 3620300 - RNA, 21 nt, Human
uuguacgaagaguauuuuuga

SEQ ID NO: 3620301 - RNA, 18 nt, Human
uuguacgacgucagaugu

SEQ ID NO: 3620302 - RNA, 15 nt, Human
uuguacguuuaaagu

SEQ ID NO: 3620303 - RNA, 16 nt, Human
uuguacguuuaaagug

SEQ ID NO: 3620304 - RNA, 18 nt, Human
uuguacuacaguucuuuu

SEQ ID NO: 3620305 - RNA, 15 nt, Human
uuguacucaauuuua

SEQ ID NO: 3620306 - RNA, 21 nt, Human
uuguacugaauuuuuuuguaa

SEQ ID NO: 3620307 - RNA, 14 nt, Human
uuguacuguaaaga

SEQ ID NO: 3620308 - RNA, 15 nt, Human
uuguacuguaaagag

SEQ ID NO: 3620309 - RNA, 18 nt, Human
uuguacuuuagggaagua

SEQ ID NO: 3620310 - RNA, 15 nt, Human
uuguacuuuaucaug

SEQ ID NO: 3620311 - RNA, 13 nt, Human
uuguacuuucugu

SEQ ID NO: 3620312 - RNA, 15 nt, Human
uuguacuuucuguua

SEQ ID NO: 3620313 - RNA, 22 nt, Human
uuguacuuucuguuaaaaugca

SEQ ID NO: 3620314 - RNA, 19 nt, Human
uuguagaacucacucuggg

SEQ ID NO: 3620315 - RNA, 22 nt, Human
uuguagaaguaggaagugaaaa

SEQ ID NO: 3620316 - RNA, 19 nt, Human
uuguagaauguauuguacc

SEQ ID NO: 3620317 - RNA, 22 nt, Human
uuguagaauguauuguaccuuu

SEQ ID NO: 3620318 - RNA, 18 nt, Human
uuguagaguguagacugu

SEQ ID NO: 3620319 - RNA, 22 nt, Human
uuguagauacaaucagcugcuu

SEQ ID NO: 3620320 - RNA, 12 nt, Human
uuguagaugaaa

SEQ ID NO: 3620321 - RNA, 14 nt, Human
uuguagauuugauu

SEQ ID NO: 3620322 - RNA, 15 nt, Human
uuguagauuugauuu

SEQ ID NO: 3620323 - RNA, 14 nt, Human
uuguagcacugaca

SEQ ID NO: 3620324 - RNA, 18 nt, Human
uuguagcauccuggaaua

SEQ ID NO: 3620325 - RNA, 16 nt, Human
uuguagccuuccucca

SEQ ID NO: 3620326 - RNA, 22 nt, Human
uuguagccuuccuccacauccu

SEQ ID NO: 3620327 - RNA, 17 nt, Human
uuuaaagaaucauuauu

SEQ ID NO: 3620328 - RNA, 13 nt, Human
uuuaaagaauugu

SEQ ID NO: 3620329 - RNA, 16 nt, Human
uuuaaagagucuagau

SEQ ID NO: 3620330 - RNA, 21 nt, Human
uuuaaagagucuagauucaaa

SEQ ID NO: 3620331 - RNA, 20 nt, Human
uuuaaagcaacugucuauuu

SEQ ID NO: 3620332 - RNA, 23 nt, Human
uuuaaagcaacugucuauuucug

SEQ ID NO: 3620333 - RNA, 16 nt, Human
uuuaaagcagguucuu

SEQ ID NO: 3620334 - RNA, 15 nt, Human
uuuaaagcauugcug

SEQ ID NO: 3620335 - RNA, 16 nt, Human
uuuaaagcuuacucug

SEQ ID NO: 3620336 - RNA, 18 nt, Human
uuuaaaggcuuuuuggug

SEQ ID NO: 3620337 - RNA, 16 nt, Human
uuuaaaggggcagaaa

SEQ ID NO: 3620338 - RNA, 23 nt, Human
uuuaaagguggauuuuguuuaaa

SEQ ID NO: 3620339 - RNA, 21 nt, Human
uuuaaagguuucuauuuucuc

SEQ ID NO: 3620340 - RNA, 15 nt, Human
uuuaaaguaugcauu

SEQ ID NO: 3620341 - RNA, 21 nt, Human
uuuaaaguaugcauuauuaaa

SEQ ID NO: 3620342 - RNA, 18 nt, Human
uuuaaaguguaauaauau

SEQ ID NO: 3620343 - RNA, 20 nt, Human
uuuaaaguguuucuguuauu

SEQ ID NO: 3620344 - RNA, 15 nt, Human
uuuaaaguucaaacu

SEQ ID NO: 3620345 - RNA, 15 nt, Human
uuuaaaguucugugu

SEQ ID NO: 3620346 - RNA, 17 nt, Human
uuuaaaguuguuugugc

SEQ ID NO: 3620347 - RNA, 15 nt, Human
uuuaaauaaacuuuu

SEQ ID NO: 3620348 - RNA, 21 nt, Human
uuuaaauaaaguaucaugcau

SEQ ID NO: 3620349 - RNA, 23 nt, Human
uuuaaauaaaguaucaugcauuc

SEQ ID NO: 3620350 - RNA, 16 nt, Human
uuuaaauaauuuaacu

SEQ ID NO: 3620351 - RNA, 15 nt, Human
uuuaaauagaugaca

SEQ ID NO: 3620352 - RNA, 16 nt, Human
uuuaaauauaauucug

SEQ ID NO: 3620353 - RNA, 21 nt, Human
uuuaaauauaauucuguaaau

SEQ ID NO: 3620354 - RNA, 21 nt, Human
uuuaaauauaugcuaagucuu

SEQ ID NO: 3620355 - RNA, 16 nt, Human
uuuaaauauauuuuca

SEQ ID NO: 3620356 - RNA, 13 nt, Human
uuuaaauauuuuc

SEQ ID NO: 3620357 - RNA, 19 nt, Human
uuuaaaucaaguauuuugu

SEQ ID NO: 3620358 - RNA, 13 nt, Human
uuuaaaugaaagu

SEQ ID NO: 3620359 - RNA, 21 nt, Human
uuuaaaugaacaagagaagca

SEQ ID NO: 3620360 - RNA, 14 nt, Human
uuuaaauggacaga

SEQ ID NO: 3620361 - RNA, 16 nt, Human
uuuaaauguaaaacau

SEQ ID NO: 3620362 - RNA, 18 nt, Human
uuuaaauguaaagauauu

SEQ ID NO: 3620363 - RNA, 13 nt, Human
uuuaaauguauac

SEQ ID NO: 3620364 - RNA, 13 nt, Human
uuuaaaugucaaa

SEQ ID NO: 3620365 - RNA, 15 nt, Human
uuuaaaugucuaaug

SEQ ID NO: 3620366 - RNA, 16 nt, Human
uuuaaaugucuaaugu

SEQ ID NO: 3620367 - RNA, 17 nt, Human
uuuaaauguguacaaug

SEQ ID NO: 3620368 - RNA, 18 nt, Human
uuuaaauguguacaaugu

SEQ ID NO: 3620369 - RNA, 19 nt, Human
uuuaaauguguacaaugua

SEQ ID NO: 3620370 - RNA, 18 nt, Human
uuuacuguuauccuauuu

SEQ ID NO: 3620371 - RNA, 22 nt, Human
uuuacuguuuugaaaucaaugc

SEQ ID NO: 3620372 - RNA, 14 nt, Human
uuuacuuaaagauu

SEQ ID NO: 3620373 - RNA, 22 nt, Human
uuuacuuaaagauuuaucaaau

SEQ ID NO: 3620374 - RNA, 23 nt, Human
uuuacuuaaagauuuaucaaauc

SEQ ID NO: 3620375 - RNA, 12 nt, Human
uuuacuuaagac

SEQ ID NO: 3620376 - RNA, 17 nt, Human
uuuacuuaucuuaugcc

SEQ ID NO: 3620377 - RNA, 14 nt, Human
uuuacuuuaaacua

SEQ ID NO: 3620378 - RNA, 11 nt, Human
uuuacuuucaa

SEQ ID NO: 3620379 - RNA, 15 nt, Human
uuuacuuuguguuca

SEQ ID NO: 3620380 - RNA, 16 nt, Human
uuuacuuuuaaacugu

SEQ ID NO: 3620381 - RNA, 21 nt, Human
uuuacuuuuuuuuuauuuuau

SEQ ID NO: 3620382 - RNA, 22 nt, Human
uuuacuuuuuuuuuauuuuauu

SEQ ID NO: 3620383 - RNA, 23 nt, Human
uuuagaaaaaauggaugcccaga

SEQ ID NO: 3620384 - RNA, 19 nt, Human
uuuagaaaaagaacaugca

SEQ ID NO: 3620385 - RNA, 12 nt, Human
uuuagaaaacuu

SEQ ID NO: 3620386 - RNA, 14 nt, Human
uuuagaaaacuuua

SEQ ID NO: 3620387 - RNA, 22 nt, Human
uuuagaaaagggaguuuaaaaa

SEQ ID NO: 3620388 - RNA, 20 nt, Human
uuuagaaacacaacuauauu

SEQ ID NO: 3620389 - RNA, 22 nt, Human
uuuagaaacuuaucuuacaaag

SEQ ID NO: 3620390 - RNA, 13 nt, Human
uuuagaaagcauu

SEQ ID NO: 3620391 - RNA, 16 nt, Human
uuuagaaagcugacau

SEQ ID NO: 3620392 - RNA, 17 nt, Human
uuuagaaauaaaccuua

SEQ ID NO: 3620393 - RNA, 19 nt, Human
uuuagaaauacugcaagaa

SEQ ID NO: 3620394 - RNA, 22 nt, Human
uuuagaacagaaaacaacaaaa

SEQ ID NO: 3620395 - RNA, 16 nt, Human
uuuagaacagcauugu

SEQ ID NO: 3620396 - RNA, 15 nt, Human
uuuagaacagguuuu

SEQ ID NO: 3620397 - RNA, 22 nt, Human
uuuagaagccaacuaugauuau

SEQ ID NO: 3620398 - RNA, 14 nt, Human
uuuagaaguagaau

SEQ ID NO: 3620399 - RNA, 15 nt, Human
uuuagaagugucaug

SEQ ID NO: 3620400 - RNA, 20 nt, Human
uuuagaauaagaauuugcau

SEQ ID NO: 3620401 - RNA, 17 nt, Human
uuuagaauaugccuugu

SEQ ID NO: 3620402 - RNA, 19 nt, Human
uuuagaaucccagcccccu

SEQ ID NO: 3620403 - RNA, 22 nt, Human
uuuagaaugaugcacauuucau

SEQ ID NO: 3620404 - RNA, 20 nt, Human
uuuagaauggugauuuuaaa

SEQ ID NO: 3620405 - RNA, 21 nt, Human
uuuagaauggugauuuuaaau

SEQ ID NO: 3620406 - RNA, 13 nt, Human
uuuagaauugaag

SEQ ID NO: 3620407 - RNA, 15 nt, Human
uuuagaauugaaggu

SEQ ID NO: 3620408 - RNA, 18 nt, Human
uuuagaauugaagguuuu

SEQ ID NO: 3620409 - RNA, 21 nt, Human
uuuagaauugaagguuuuuga

SEQ ID NO: 3620410 - RNA, 22 nt, Human
uuuagacaaauacucaugugua

SEQ ID NO: 3620411 - RNA, 16 nt, Human
uuuagacaaaucuaag

SEQ ID NO: 3620412 - RNA, 21 nt, Human
uuuagacaaaucuaagggaaa

SEQ ID NO: 3620413 - RNA, 22 nt, Human
uuuagacaagagaugggaauga

SEQ ID NO: 3620414 - RNA, 12 nt, Human
uuuagacagagu

SEQ ID NO: 3620415 - RNA, 21 nt, Human
uuuagacauguaauuugugua

SEQ ID NO: 3620416 - RNA, 11 nt, Human
uuuagaccaag

SEQ ID NO: 3620417 - RNA, 15 nt, Human
uuuagaccaaggaac

SEQ ID NO: 3620418 - RNA, 15 nt, Human
uuuagaccauuuauc

SEQ ID NO: 3620419 - RNA, 22 nt, Human
uuuagacucaucaaucaaauaa

SEQ ID NO: 3620420 - RNA, 15 nt, Human
uuuagacuguagccu

SEQ ID NO: 3620421 - RNA, 20 nt, Human
uuuagacuuaauagaaacau

SEQ ID NO: 3620422 - RNA, 13 nt, Human
uuuagacuugaaa

SEQ ID NO: 3620423 - RNA, 20 nt, Human
uuuagacuugaaaagagaca

SEQ ID NO: 3620424 - RNA, 21 nt, Human
uuuagacuugaaaagagacag

SEQ ID NO: 3620425 - RNA, 18 nt, Human
uuuagagaacugaaaaga

SEQ ID NO: 3620426 - RNA, 20 nt, Human
uuuagagaacugaaaagaga

SEQ ID NO: 3620427 - RNA, 22 nt, Human
uuuagagauaagaguuggcugg

SEQ ID NO: 3620428 - RNA, 22 nt, Human
uuuagaguaagaaauuucaggu

SEQ ID NO: 3620429 - RNA, 15 nt, Human
uuuagauaauacacc

SEQ ID NO: 3620430 - RNA, 23 nt, Human
uuuagauagcccuguccuggugg

SEQ ID NO: 3620431 - RNA, 17 nt, Human
uuuagaugaaugucagu

SEQ ID NO: 3620432 - RNA, 17 nt, Human
uuuagaugaggaaauga

SEQ ID NO: 3620433 - RNA, 21 nt, Human
uuuagaugauaaagagacagu

SEQ ID NO: 3620434 - RNA, 11 nt, Human
uuuagaugcug

SEQ ID NO: 3620435 - RNA, 17 nt, Human
uuuagauguaauuuugu

SEQ ID NO: 3620436 - RNA, 19 nt, Human
uuuagaugugcugcuuuga

SEQ ID NO: 3620437 - RNA, 14 nt, Human
uuuagauugaguaa

SEQ ID NO: 3620438 - RNA, 20 nt, Human
uuuagauuucaagaaaaaau

SEQ ID NO: 3620439 - RNA, 19 nt, Human
uuuagauuuucugguucua

SEQ ID NO: 3620440 - RNA, 21 nt, Human
uuuagcacguuuaaaguucug

SEQ ID NO: 3620441 - RNA, 12 nt, Human
uuuagcaugugu

SEQ ID NO: 3620442 - RNA, 15 nt, Human
uuucaauucucaaaa

SEQ ID NO: 3620443 - RNA, 16 nt, Human
uuucaauucuguaggu

SEQ ID NO: 3620444 - RNA, 13 nt, Human
uuucacaaaauuu

SEQ ID NO: 3620445 - RNA, 22 nt, Human
uuucacaaacagaaaacaugua

SEQ ID NO: 3620446 - RNA, 14 nt, Human
uuucacaaauuugu

SEQ ID NO: 3620447 - RNA, 23 nt, Human
uuucacaacagccugacaacauu

SEQ ID NO: 3620448 - RNA, 14 nt, Human
uuucacagaaaaua

SEQ ID NO: 3620449 - RNA, 17 nt, Human
uuucacagcuaugaaga

SEQ ID NO: 3620450 - RNA, 16 nt, Human
uuucacagugugauuu

SEQ ID NO: 3620451 - RNA, 22 nt, Human
uuucacaguguguggucaacau

SEQ ID NO: 3620452 - RNA, 16 nt, Human
uuucacaguuugaaau

SEQ ID NO: 3620453 - RNA, 17 nt, Human
uuucacaguuugaaaua

SEQ ID NO: 3620454 - RNA, 13 nt, Human
uuucacaguuuuu

SEQ ID NO: 3620455 - RNA, 13 nt, Human
uuucacauaaaug

SEQ ID NO: 3620456 - RNA, 22 nt, Human
uuucacauaucuaguaugaaau

SEQ ID NO: 3620457 - RNA, 15 nt, Human
uuucacauuaauauu

SEQ ID NO: 3620458 - RNA, 16 nt, Human
uuucacauuaauauuu

SEQ ID NO: 3620459 - RNA, 17 nt, Human
uuucacauuagaagaca

SEQ ID NO: 3620460 - RNA, 19 nt, Human
uuucacauuagaagacaau

SEQ ID NO: 3620461 - RNA, 22 nt, Human
uuucaccauuugauuauguagc

SEQ ID NO: 3620462 - RNA, 18 nt, Human
uuucacccacagaaagag

SEQ ID NO: 3620463 - RNA, 20 nt, Human
uuucacccacagaaagagag

SEQ ID NO: 3620464 - RNA, 22 nt, Human
uuucaccccacccuuccccucc

SEQ ID NO: 3620465 - RNA, 21 nt, Human
uuucaccccaucccuccuuaa

SEQ ID NO: 3620466 - RNA, 13 nt, Human
uuucaccccuccc

SEQ ID NO: 3620467 - RNA, 20 nt, Human
uuucaccccucccuuucucc

SEQ ID NO: 3620468 - RNA, 15 nt, Human
uuucacccuucuacu

SEQ ID NO: 3620469 - RNA, 17 nt, Human
uuucaccuacuuuguaa

SEQ ID NO: 3620470 - RNA, 16 nt, Human
uuucaccuagauuuuu

SEQ ID NO: 3620471 - RNA, 13 nt, Human
uuucaccuguaaa

SEQ ID NO: 3620472 - RNA, 18 nt, Human
uuucacggaaacucccga

SEQ ID NO: 3620473 - RNA, 19 nt, Human
uuucacggaaguuuucaau

SEQ ID NO: 3620474 - RNA, 15 nt, Human
uuucacgggagauuu

SEQ ID NO: 3620475 - RNA, 15 nt, Human
uuucacuauuuccuu

SEQ ID NO: 3620476 - RNA, 17 nt, Human
uuucacucccuccauca

SEQ ID NO: 3620477 - RNA, 15 nt, Human
uuucacucuaaguca

SEQ ID NO: 3620478 - RNA, 22 nt, Human
uuucacucuaagucauguaugu

SEQ ID NO: 3620479 - RNA, 20 nt, Human
uuucacucuccuaugccuuu

SEQ ID NO: 3620480 - RNA, 14 nt, Human
uuucacucuccuug

SEQ ID NO: 3620481 - RNA, 20 nt, Human
uuucacugcuggcugccuua

SEQ ID NO: 3620482 - RNA, 22 nt, Human
uuucacugcuggcugccuuaga

SEQ ID NO: 3620483 - RNA, 17 nt, Human
uuucacuggaguuacau

SEQ ID NO: 3620484 - RNA, 23 nt, Human
uuucacuggccacaguuguuuga

SEQ ID NO: 3620485 - RNA, 17 nt, Human
uuucacuguagcucuaa

SEQ ID NO: 3620486 - RNA, 16 nt, Human
uuucacuucuuucccu

SEQ ID NO: 3620487 - RNA, 23 nt, Human
uuucacuucuuucccuuccucca

SEQ ID NO: 3620488 - RNA, 17 nt, Human
uuucacuuugugauuau

SEQ ID NO: 3620489 - RNA, 16 nt, Human
uuucagaaaaagaaau

SEQ ID NO: 3620490 - RNA, 12 nt, Human
uuucagaaaaca

SEQ ID NO: 3620491 - RNA, 22 nt, Human
uuucagaaagcuagaaagugua

SEQ ID NO: 3620492 - RNA, 13 nt, Human
uuucagaaauaca

SEQ ID NO: 3620493 - RNA, 16 nt, Human
uuucagaaauaugugg

SEQ ID NO: 3620494 - RNA, 20 nt, Human
uuucagaaauaugugguuuc

SEQ ID NO: 3620495 - RNA, 18 nt, Human
uuucagaaccucuucccc

SEQ ID NO: 3620496 - RNA, 19 nt, Human
uuucagaaccucuucccca

SEQ ID NO: 3620497 - RNA, 23 nt, Human
uuucagaaccucuuccccagaaa

SEQ ID NO: 3620498 - RNA, 16 nt, Human
uuucagaagaaauaaa

SEQ ID NO: 3620499 - RNA, 21 nt, Human
uuucagaagaaauaaauauac

SEQ ID NO: 3620500 - RNA, 22 nt, Human
uuucagaagugagcuuugcugc

SEQ ID NO: 3620501 - RNA, 16 nt, Human
uuucagaaguuaguuu

SEQ ID NO: 3620502 - RNA, 14 nt, Human
uuucagaaucugaa

SEQ ID NO: 3620503 - RNA, 19 nt, Human
uuucagaaucugaauguaa

SEQ ID NO: 3620504 - RNA, 23 nt, Human
uuucagaaucugaauguaauuug

SEQ ID NO: 3620505 - RNA, 14 nt, Human
uuucagaccccagc

SEQ ID NO: 3620506 - RNA, 23 nt, Human
uuucagagacagcugauacuuca

SEQ ID NO: 3620507 - RNA, 22 nt, Human
uuucagagugacuacacacagu

SEQ ID NO: 3620508 - RNA, 21 nt, Human
uuucagauaaucacaauacau

SEQ ID NO: 3620509 - RNA, 16 nt, Human
uuucagaugcuucugg

SEQ ID NO: 3620510 - RNA, 20 nt, Human
uuucagaugcuucugggaga

SEQ ID NO: 3620511 - RNA, 15 nt, Human
uuucagaugcuuuag

SEQ ID NO: 3620512 - RNA, 19 nt, Human
uuucagaugucuucugccu

SEQ ID NO: 3620513 - RNA, 21 nt, Human
uuucagaugucuucugccugu

SEQ ID NO: 3620514 - RNA, 20 nt, Human
uuucagauucccagagcaaa

SEQ ID NO: 3620515 - RNA, 16 nt, Human
uuucagauuguggaau

SEQ ID NO: 3620516 - RNA, 21 nt, Human
uuucagauuguggaauguugg

SEQ ID NO: 3620517 - RNA, 18 nt, Human
uuucagcaagauaaacau

SEQ ID NO: 3620518 - RNA, 23 nt, Human
uuucagcaccuacaguguacagu

SEQ ID NO: 3620519 - RNA, 20 nt, Human
uuucagcacuagccaaaccu

SEQ ID NO: 3620520 - RNA, 14 nt, Human
uuucagcagacuga

SEQ ID NO: 3620521 - RNA, 14 nt, Human
uuucagcaggcagc

SEQ ID NO: 3620522 - RNA, 15 nt, Human
uuucagcauugauau

SEQ ID NO: 3620523 - RNA, 20 nt, Human
uuucagcauugauauuugug

SEQ ID NO: 3620524 - RNA, 22 nt, Human
uuucagcuaagggaagacauuu

SEQ ID NO: 3620525 - RNA, 19 nt, Human
uuucagcuaggaacaaauc

SEQ ID NO: 3620526 - RNA, 21 nt, Human
uuucagcuaggaacaaaucuu

SEQ ID NO: 3620527 - RNA, 12 nt, Human
uuucagcuccug

SEQ ID NO: 3620528 - RNA, 20 nt, Human
uuucagcuccugaccaguug

SEQ ID NO: 3620529 - RNA, 21 nt, Human
uuucagcuccugaccaguugc

SEQ ID NO: 3620530 - RNA, 12 nt, Human
uuucagcucucu

SEQ ID NO: 3620531 - RNA, 16 nt, Human
uuucaggaccuuuuga

SEQ ID NO: 3620532 - RNA, 22 nt, Human
uuucaggagagaguugaaccua

SEQ ID NO: 3620533 - RNA, 19 nt, Human
uuucaggaggaauacugaa

SEQ ID NO: 3620534 - RNA, 22 nt, Human
uuucaggaggcuggaggaaggg

SEQ ID NO: 3620535 - RNA, 13 nt, Human
uuucaggauacuc

SEQ ID NO: 3620536 - RNA, 20 nt, Human
uuucaggauacucugucaga

SEQ ID NO: 3620537 - RNA, 21 nt, Human
uuucaggauacucugucagau

SEQ ID NO: 3620538 - RNA, 14 nt, Human
uuucaggaucuauu

SEQ ID NO: 3620539 - RNA, 19 nt, Human
uuucagggagguggcuggg

SEQ ID NO: 3620540 - RNA, 22 nt, Human
uuucagggagguggcuggguuu

SEQ ID NO: 3620541 - RNA, 22 nt, Human
uuucagggcuaacgaccacagg

SEQ ID NO: 3620542 - RNA, 22 nt, Human
uuucagguagaggugcaugccu

SEQ ID NO: 3620543 - RNA, 13 nt, Human
uuucaggugacau

SEQ ID NO: 3620544 - RNA, 15 nt, Human
uuucaggugacaugu

SEQ ID NO: 3620545 - RNA, 22 nt, Human
uuucaggugacaugugaaaccu

SEQ ID NO: 3620546 - RNA, 19 nt, Human
uuucagguuuuguaaagau

SEQ ID NO: 3620547 - RNA, 16 nt, Human
uuucaguacuuuuuua

SEQ ID NO: 3620548 - RNA, 16 nt, Human
uuucaguauuauaugu

SEQ ID NO: 3620549 - RNA, 13 nt, Human
uuucaguguacau

SEQ ID NO: 3620550 - RNA, 19 nt, Human
uuucaguguaguuaauuua

SEQ ID NO: 3620551 - RNA, 17 nt, Human
uuucaguguuaccugug

SEQ ID NO: 3620552 - RNA, 14 nt, Human
uuucaguucaaagu

SEQ ID NO: 3620553 - RNA, 22 nt, Human
uuucaguucuuuggauucuaaa

SEQ ID NO: 3620554 - RNA, 14 nt, Human
uuucauaaacaagu

SEQ ID NO: 3620555 - RNA, 19 nt, Human
uuucauaaauuauuugauu

SEQ ID NO: 3620556 - RNA, 21 nt, Human
uuucaucaaucauuguacagu

SEQ ID NO: 3620557 - RNA, 24 nt, Human
uuucaucagaacagcuguugacuc

SEQ ID NO: 3620558 - RNA, 16 nt, Human
uuucaucauauuauac

SEQ ID NO: 3620559 - RNA, 14 nt, Human
uuucaucaugagga

SEQ ID NO: 3620560 - RNA, 21 nt, Human
uuucaucauucacuucacugu

SEQ ID NO: 3620561 - RNA, 24 nt, Human
uuucaucauucacuucacugugcu

SEQ ID NO: 3620562 - RNA, 21 nt, Human
uuucauccacuagugcaaauc

SEQ ID NO: 3620563 - RNA, 16 nt, Human
uuucauccauaacuga

SEQ ID NO: 3620564 - RNA, 19 nt, Human
uuucauccauaacugaaca

SEQ ID NO: 3620565 - RNA, 14 nt, Human
uuucauccaugucc

SEQ ID NO: 3620566 - RNA, 19 nt, Human
uuucauccccuuacccuua

SEQ ID NO: 3620567 - RNA, 12 nt, Human
uuucaucucauu

SEQ ID NO: 3620568 - RNA, 16 nt, Human
uuucaucucuuguaua

SEQ ID NO: 3620569 - RNA, 20 nt, Human
uuucaucugcucuccuuccu

SEQ ID NO: 3620570 - RNA, 14 nt, Human
uuucaucugggaaa

SEQ ID NO: 3620571 - RNA, 17 nt, Human
uuucaucuucaguuguc

SEQ ID NO: 3620572 - RNA, 19 nt, Human
uuucaugaaaauaccauuu

SEQ ID NO: 3620573 - RNA, 16 nt, Human
uuucaugauuagaaau

SEQ ID NO: 3620574 - RNA, 13 nt, Human
uuucaugcaaacu

SEQ ID NO: 3620575 - RNA, 18 nt, Human
uuucaugcaaacucuuug

SEQ ID NO: 3620576 - RNA, 16 nt, Human
uuucaugcuaucucug

SEQ ID NO: 3620577 - RNA, 19 nt, Human
uuucaugcuaucucugugu

SEQ ID NO: 3620578 - RNA, 22 nt, Human
uuucauggugaaaauguacuga

SEQ ID NO: 3620579 - RNA, 12 nt, Human
uuucauguacug

SEQ ID NO: 3620580 - RNA, 20 nt, Human
uuucauguacugcauuauuu

SEQ ID NO: 3620581 - RNA, 15 nt, Human
uuucauguccauaaa

SEQ ID NO: 3620582 - RNA, 21 nt, Human
uuucauguccugugucaguuu

SEQ ID NO: 3620583 - RNA, 23 nt, Human
uuucaugugcggggaucaucugc

SEQ ID NO: 3620584 - RNA, 17 nt, Human
uuucauguggcuguaga

SEQ ID NO: 3620585 - RNA, 19 nt, Human
uuucauguuaguuaccuua

SEQ ID NO: 3620586 - RNA, 16 nt, Human
uuucauuaaaggcuuc

SEQ ID NO: 3620587 - RNA, 15 nt, Human
uuucauuaaauaaau

SEQ ID NO: 3620588 - RNA, 18 nt, Human
uuucauuaaauaaauuug

SEQ ID NO: 3620589 - RNA, 19 nt, Human
uuucauuaaauaaauuuga

SEQ ID NO: 3620590 - RNA, 22 nt, Human
uuucauuaaauaaauuugacuu

SEQ ID NO: 3620591 - RNA, 16 nt, Human
uuucauuagcaaaaaa

SEQ ID NO: 3620592 - RNA, 21 nt, Human
uuucauuagcaaaaaaaguug

SEQ ID NO: 3620593 - RNA, 13 nt, Human
uuucauuauuagu

SEQ ID NO: 3620594 - RNA, 15 nt, Human
uuucauucaucccau

SEQ ID NO: 3620595 - RNA, 13 nt, Human
uuucauucucauu

SEQ ID NO: 3620596 - RNA, 15 nt, Human
uuucauucuccugcc

SEQ ID NO: 3620597 - RNA, 13 nt, Human
uuucauugccagu

SEQ ID NO: 3620598 - RNA, 18 nt, Human
uuucauugccagugucuu

SEQ ID NO: 3620599 - RNA, 23 nt, Human
uuucauugccuguguauggaaaa

SEQ ID NO: 3620600 - RNA, 18 nt, Human
uuucauugcugugacagu

SEQ ID NO: 3620601 - RNA, 17 nt, Human
uuucauugguuaauuuu

SEQ ID NO: 3620602 - RNA, 17 nt, Human
uuucauuguaugaugug

SEQ ID NO: 3620603 - RNA, 23 nt, Human
uuucauuguaugauguguuguga

SEQ ID NO: 3620604 - RNA, 14 nt, Human
uuucauuuacugug

SEQ ID NO: 3620605 - RNA, 14 nt, Human
uuucauuuagguga

SEQ ID NO: 3620606 - RNA, 18 nt, Human
uuucauuuaggugaggaa

SEQ ID NO: 3620607 - RNA, 23 nt, Human
uuucauuucuucuacaacucaua

SEQ ID NO: 3620608 - RNA, 22 nt, Human
uuucauuugccuauucccacac

SEQ ID NO: 3620609 - RNA, 21 nt, Human
uuucauuuguuuguuuuccuu

SEQ ID NO: 3620610 - RNA, 17 nt, Human
uuucauuuucucucagg

SEQ ID NO: 3620611 - RNA, 20 nt, Human
uuucauuuugcuuuaauuuu

SEQ ID NO: 3620612 - RNA, 17 nt, Human
uuucauuuuuaaaugug

SEQ ID NO: 3620613 - RNA, 17 nt, Human
uuuccaaaaaaauacug

SEQ ID NO: 3620614 - RNA, 24 nt, Human
uuuccaaaaguggccucuuugucu

SEQ ID NO: 3620615 - RNA, 14 nt, Human
uuuccaaaauaauu

SEQ ID NO: 3620616 - RNA, 18 nt, Human
uuuccaaaauaauuuuaa

SEQ ID NO: 3620617 - RNA, 18 nt, Human
uuuccaaaauuuuucaac

SEQ ID NO: 3620618 - RNA, 15 nt, Human
uuuccaacaccacag

SEQ ID NO: 3620619 - RNA, 20 nt, Human
uuuccaacaccacagacaca

SEQ ID NO: 3620620 - RNA, 23 nt, Human
uuuccaacaccacagacacacac

SEQ ID NO: 3620621 - RNA, 18 nt, Human
uuuccaacuacuaauaga

SEQ ID NO: 3620622 - RNA, 19 nt, Human
uuuccaacuacuaauagaa

SEQ ID NO: 3620623 - RNA, 20 nt, Human
uuuccaagcaaauguuacau

SEQ ID NO: 3620624 - RNA, 22 nt, Human
uuuccaagcaaauguuacauag

SEQ ID NO: 3620625 - RNA, 19 nt, Human
uuuccaaggagcugagaau

SEQ ID NO: 3620626 - RNA, 15 nt, Human
uuuccaauucuccuu

SEQ ID NO: 3620627 - RNA, 22 nt, Human
uuuccacaagauucccagagac

SEQ ID NO: 3620628 - RNA, 22 nt, Human
uuuccacccccucccuggccug

SEQ ID NO: 3620629 - RNA, 16 nt, Human
uuuccacuaaaaauau

SEQ ID NO: 3620630 - RNA, 16 nt, Human
uuuccacuccauuguc

SEQ ID NO: 3620631 - RNA, 15 nt, Human
uuuccacuucuucau

SEQ ID NO: 3620632 - RNA, 15 nt, Human
uuuccacuucuuccu

SEQ ID NO: 3620633 - RNA, 18 nt, Human
uuuccagacuuccuugag

SEQ ID NO: 3620634 - RNA, 19 nt, Human
uuuccagagcauuccaguc

SEQ ID NO: 3620635 - RNA, 20 nt, Human
uuuccagcauucccagguag

SEQ ID NO: 3620636 - RNA, 19 nt, Human
uuuccaggaaaaagaacuu

SEQ ID NO: 3620637 - RNA, 23 nt, Human
uuuccaggcuauguauaaaauac

SEQ ID NO: 3620638 - RNA, 16 nt, Human
uuuccaggcuucugcu

SEQ ID NO: 3620639 - RNA, 11 nt, Human
uuuccagggag

SEQ ID NO: 3620640 - RNA, 17 nt, Human
uuuccaguauuuuagug

SEQ ID NO: 3620641 - RNA, 21 nt, Human
uuuccagucuccaccaggaac

SEQ ID NO: 3620642 - RNA, 18 nt, Human
uuuccagucucuuguaca

SEQ ID NO: 3620643 - RNA, 19 nt, Human
uuuccauaaagaagauguu

SEQ ID NO: 3620644 - RNA, 19 nt, Human
uuuccauagcaacaggaaa

SEQ ID NO: 3620645 - RNA, 12 nt, Human
uuuccauauguu

SEQ ID NO: 3620646 - RNA, 17 nt, Human
uuuccaugaaaaugcaa

SEQ ID NO: 3620647 - RNA, 19 nt, Human
uuuccaugacugcauuuua

SEQ ID NO: 3620648 - RNA, 17 nt, Human
uuuccaugaguccccug

SEQ ID NO: 3620649 - RNA, 23 nt, Human
uuuccaugcacccucauacacag

SEQ ID NO: 3620650 - RNA, 19 nt, Human
uuuccaugcguguuucuga

SEQ ID NO: 3620651 - RNA, 20 nt, Human
uuuccauggcaggaaggcuu

SEQ ID NO: 3620652 - RNA, 19 nt, Human
uuuccaugggaccacaacu

SEQ ID NO: 3620653 - RNA, 14 nt, Human
uuuccauguaugca

SEQ ID NO: 3620654 - RNA, 15 nt, Human
uuuccauuacaagua

SEQ ID NO: 3620655 - RNA, 14 nt, Human
uuuccauuccagaa

SEQ ID NO: 3620656 - RNA, 22 nt, Human
uuuccauucgugaaaacacauu

SEQ ID NO: 3620657 - RNA, 12 nt, Human
uuucccaauuca

SEQ ID NO: 3620658 - RNA, 15 nt, Human
uuucccaauucacau

SEQ ID NO: 3620659 - RNA, 23 nt, Human
uuucccacaccguguaaaccaaa

SEQ ID NO: 3620660 - RNA, 23 nt, Human
uuucccacucauucugaauuaau

SEQ ID NO: 3620661 - RNA, 18 nt, Human
uuucccacugcacccccu

SEQ ID NO: 3620662 - RNA, 18 nt, Human
uuucccaggacccugaag

SEQ ID NO: 3620663 - RNA, 17 nt, Human
uuucccaggcaaauaaa

SEQ ID NO: 3620664 - RNA, 13 nt, Human
uuucccaucugca

SEQ ID NO: 3620665 - RNA, 21 nt, Human
uuucccaugauuucauguacu

SEQ ID NO: 3620666 - RNA, 16 nt, Human
uuucccauggggaggg

SEQ ID NO: 3620667 - RNA, 14 nt, Human
uuucccauuuagaa

SEQ ID NO: 3620668 - RNA, 14 nt, Human
uuuccccaaagucu

SEQ ID NO: 3620669 - RNA, 13 nt, Human
uuuccccagccca

SEQ ID NO: 3620670 - RNA, 14 nt, Human
uuuccccagggcac

SEQ ID NO: 3620671 - RNA, 23 nt, Human
uuuccccccacucuccccacacu

SEQ ID NO: 3620672 - RNA, 19 nt, Human
uuuccccccuuuuuuuccu

SEQ ID NO: 3620673 - RNA, 16 nt, Human
uuucccccuucuacau

SEQ ID NO: 3620674 - RNA, 17 nt, Human
uuucccccuuucuuccu

SEQ ID NO: 3620675 - RNA, 21 nt, Human
uuucccccuuucuuccucauu

SEQ ID NO: 3620676 - RNA, 21 nt, Human
uuuccccuguggggaucucag

SEQ ID NO: 3620677 - RNA, 22 nt, Human
uuucccgagcaaagucuaaagu

SEQ ID NO: 3620678 - RNA, 13 nt, Human
uuucccgccaagc

SEQ ID NO: 3620679 - RNA, 15 nt, Human
uuucccguggcccca

SEQ ID NO: 3620680 - RNA, 21 nt, Human
uuucccguggccccagccugg

SEQ ID NO: 3620681 - RNA, 11 nt, Human
uuucccuaagc

SEQ ID NO: 3620682 - RNA, 20 nt, Human
uuucccuaagccagcugccc

SEQ ID NO: 3620683 - RNA, 22 nt, Human
uuucccuaagccagcugccccc

SEQ ID NO: 3620684 - RNA, 17 nt, Human
uuuguuuuuccuuccaa

SEQ ID NO: 3620685 - RNA, 13 nt, Human
uuuguuuuugcuu

SEQ ID NO: 3620686 - RNA, 16 nt, Human
uuuguuuuugcuuguu

SEQ ID NO: 3620687 - RNA, 23 nt, Human
uuuguuuuuuaaagucuugcugu

SEQ ID NO: 3620688 - RNA, 16 nt, Human
uuuguuuuuugaagug

SEQ ID NO: 3620689 - RNA, 18 nt, Human
uuuguuuuuuguuuuucu

SEQ ID NO: 3620690 - RNA, 16 nt, Human
uuuguuuuuuuccaac

SEQ ID NO: 3620691 - RNA, 22 nt, Human
uuuguuuuuuuccaacuguguu

SEQ ID NO: 3620692 - RNA, 15 nt, Human
uuuuaaaaaaagaaa

SEQ ID NO: 3620693 - RNA, 19 nt, Human
uuuuaaaaaaauaaaacau

SEQ ID NO: 3620694 - RNA, 14 nt, Human
uuuuaaaaaagcuu

SEQ ID NO: 3620695 - RNA, 15 nt, Human
uuuuaaaaaagcuua

SEQ ID NO: 3620696 - RNA, 22 nt, Human
uuuuaaaaaagcuuaaaacuuu

SEQ ID NO: 3620697 - RNA, 13 nt, Human
uuuuaaaaaauga

SEQ ID NO: 3620698 - RNA, 14 nt, Human
uuuuaaaaaaugaa

SEQ ID NO: 3620699 - RNA, 22 nt, Human
uuuuaaaaaaugaaaauaagug

SEQ ID NO: 3620700 - RNA, 16 nt, Human
uuuuaaaaacaacuua

SEQ ID NO: 3620701 - RNA, 21 nt, Human
uuuuaaaaaggaacugcagca

SEQ ID NO: 3620702 - RNA, 14 nt, Human
uuuuaaaaaguauu

SEQ ID NO: 3620703 - RNA, 21 nt, Human
uuuuaaaaaguauugccaaac

SEQ ID NO: 3620704 - RNA, 17 nt, Human
uuuuaaaaauagacacu

SEQ ID NO: 3620705 - RNA, 22 nt, Human
uuuuaaaaaucuaccuucugua

SEQ ID NO: 3620706 - RNA, 14 nt, Human
uuuuaaaaaugcaa

SEQ ID NO: 3620707 - RNA, 12 nt, Human
uuuuaaaaaugg

SEQ ID NO: 3620708 - RNA, 13 nt, Human
uuuuaaaaauggu

SEQ ID NO: 3620709 - RNA, 11 nt, Human
uuuuaaaacac

SEQ ID NO: 3620710 - RNA, 13 nt, Human
uuuuaaaacacau

SEQ ID NO: 3620711 - RNA, 16 nt, Human
uuuuaaaacacuucca

SEQ ID NO: 3620712 - RNA, 17 nt, Human
uuuuaaaacuggaccug

SEQ ID NO: 3620713 - RNA, 13 nt, Human
uuuuaaaagaaau

SEQ ID NO: 3620714 - RNA, 15 nt, Human
uuuuaaaagaaugau

SEQ ID NO: 3620715 - RNA, 14 nt, Human
uuuuaaaagacaag

SEQ ID NO: 3620716 - RNA, 13 nt, Human
uuuuaaaagccuu

SEQ ID NO: 3620717 - RNA, 18 nt, Human
uuuuaaaagccuuggccu

SEQ ID NO: 3620718 - RNA, 22 nt, Human
uuuuaaaaguuacuccuuuuag

SEQ ID NO: 3620719 - RNA, 14 nt, Human
uuuuaaaauagaaa

SEQ ID NO: 3620720 - RNA, 16 nt, Human
uuuuaaaauagaaauu

SEQ ID NO: 3620721 - RNA, 18 nt, Human
uuuuaaaauagaaauuuu

SEQ ID NO: 3620722 - RNA, 14 nt, Human
uuuuaaaauaucuu

SEQ ID NO: 3620723 - RNA, 20 nt, Human
uuuuaaaauaucuuuugacc

SEQ ID NO: 3620724 - RNA, 16 nt, Human
uuuuaaaaucaacuua

SEQ ID NO: 3620725 - RNA, 19 nt, Human
uuuuaaaaucacuaacauu

SEQ ID NO: 3620726 - RNA, 14 nt, Human
uuuuaaaaucagcu

SEQ ID NO: 3620727 - RNA, 23 nt, Human
uuuuaaaauccacuuuaucuuga

SEQ ID NO: 3620728 - RNA, 14 nt, Human
uuuuaaaaucuuau

SEQ ID NO: 3620729 - RNA, 15 nt, Human
uuuuaaaaugagaaa

SEQ ID NO: 3620730 - RNA, 19 nt, Human
uuuuaaaaugagagucacu

SEQ ID NO: 3620731 - RNA, 16 nt, Human
uuuuaaaaugcaaugu

SEQ ID NO: 3620732 - RNA, 13 nt, Human
uuuuaaaauguac

SEQ ID NO: 3620733 - RNA, 15 nt, Human
uuuuaaaauuucaua

SEQ ID NO: 3620734 - RNA, 20 nt, Human
uuuuaaaauuuguucuugua

SEQ ID NO: 3620735 - RNA, 13 nt, Human
uuuuaaaauuuua

SEQ ID NO: 3620736 - RNA, 16 nt, Human
uuuuaaacaaaauaga

SEQ ID NO: 3620737 - RNA, 20 nt, Human
uuuuaaacaaaauagaagcu

SEQ ID NO: 3620738 - RNA, 23 nt, Human
uuuuaaacaaaauagaagcugua

SEQ ID NO: 3620739 - RNA, 13 nt, Human
uuuuaaacacauu

SEQ ID NO: 3620740 - RNA, 19 nt, Human
uuuuaaacagugagccuga

SEQ ID NO: 3620741 - RNA, 23 nt, Human
uuuuaaacauuaauagcagccuu

SEQ ID NO: 3620742 - RNA, 18 nt, Human
uuuuaaagaaaagaugaa

SEQ ID NO: 3620743 - RNA, 15 nt, Human
uuuuaaagaaaaguu

SEQ ID NO: 3620744 - RNA, 11 nt, Human
uuuuaaagaau

SEQ ID NO: 3620745 - RNA, 23 nt, Human
uuuuaaagacccuccuauucuau

SEQ ID NO: 3620746 - RNA, 15 nt, Human
uuuuaaagacuugca

SEQ ID NO: 3620747 - RNA, 15 nt, Human
uuuuaaagaucugua

SEQ ID NO: 3620748 - RNA, 16 nt, Human
uuuuaaaggcuuuuug

SEQ ID NO: 3620749 - RNA, 18 nt, Human
uuuuaaagguggauuuug

SEQ ID NO: 3620750 - RNA, 21 nt, Human
uuuuaaagucuugcugugguc

SEQ ID NO: 3620751 - RNA, 17 nt, Human
uuuuaaauaaaagugau

SEQ ID NO: 3620752 - RNA, 15 nt, Human
uuuuaaauaaacuuu

SEQ ID NO: 3620753 - RNA, 13 nt, Human
uuuuaaauauauu

SEQ ID NO: 3620754 - RNA, 15 nt, Human
uuuuaaauauuuucu

SEQ ID NO: 3620755 - RNA, 16 nt, Human
uuuuaaauuauaagga

SEQ ID NO: 3620756 - RNA, 19 nt, Human
uuuuaaauuauguuuuacu

SEQ ID NO: 3620757 - RNA, 17 nt, Human
uuuuaaauuuucuucag

SEQ ID NO: 3620758 - RNA, 16 nt, Human
uuuuaaauuuuguaau

SEQ ID NO: 3620759 - RNA, 17 nt, Human
uuuuaaauuuuguaaug

SEQ ID NO: 3620760 - RNA, 13 nt, Human
uuuuaacaagaag

SEQ ID NO: 3620761 - RNA, 16 nt, Human
uuuuaacaagaagaug

SEQ ID NO: 3620762 - RNA, 17 nt, Human
uuuuaacaagaagauga

SEQ ID NO: 3620763 - RNA, 16 nt, Human
uuuuaacaagaagcaa

SEQ ID NO: 3620764 - RNA, 21 nt, Human
uuuuaacaauaacuacugugu

SEQ ID NO: 3620765 - RNA, 13 nt, Human
uuuuaacauuccu

SEQ ID NO: 3620766 - RNA, 14 nt, Human
uuuuaacauuccuc

SEQ ID NO: 3620767 - RNA, 14 nt, Human
uuuuaaccaaaggu

SEQ ID NO: 3620768 - RNA, 16 nt, Human
uuuuaaccaaagguga

SEQ ID NO: 3620769 - RNA, 16 nt, Human
uuuuaaccccgucaac

SEQ ID NO: 3620770 - RNA, 22 nt, Human
uuuuaaccgguaagaguuucag

SEQ ID NO: 3620771 - RNA, 18 nt, Human
uuuuaaccucuuuaagua

SEQ ID NO: 3620772 - RNA, 14 nt, Human
uuuuaacucugucu

SEQ ID NO: 3620773 - RNA, 14 nt, Human
uuuuaacugugcaa

SEQ ID NO: 3620774 - RNA, 14 nt, Human
uuuuaacuguggau

SEQ ID NO: 3620775 - RNA, 15 nt, Human
uuuuaacuucuuucu

SEQ ID NO: 3620776 - RNA, 13 nt, Human
uuuuaacuuuguu

SEQ ID NO: 3620777 - RNA, 14 nt, Human
uuuuaagaaagaaa

SEQ ID NO: 3620778 - RNA, 14 nt, Human
uuuuaagaaaugua

SEQ ID NO: 3620779 - RNA, 20 nt, Human
uuuuaagaaauuuugccuuu

SEQ ID NO: 3620780 - RNA, 15 nt, Human
uuuuaagaggcaggg

SEQ ID NO: 3620781 - RNA, 22 nt, Human
uuuuaagauaaauuauaaguua

SEQ ID NO: 3620782 - RNA, 21 nt, Human
uuuuaagauaauaauauaugu

SEQ ID NO: 3620783 - RNA, 14 nt, Human
uuuuaagauagugu

SEQ ID NO: 3620784 - RNA, 23 nt, Human
uuuuaagauaguguaacuugcuu

SEQ ID NO: 3620785 - RNA, 12 nt, Human
uuuuaagcauua

SEQ ID NO: 3620786 - RNA, 23 nt, Human
uuuuaagcauuacucuuguaaga

SEQ ID NO: 3620787 - RNA, 18 nt, Human
uuuuaagcauugugagua

SEQ ID NO: 3620788 - RNA, 23 nt, Human
uuuuaagcccaucaauuauagaa

SEQ ID NO: 3620789 - RNA, 15 nt, Human
uuuuaaggaaaacua

SEQ ID NO: 3620790 - RNA, 12 nt, Human
uuuuaaggaaac

SEQ ID NO: 3620791 - RNA, 19 nt, Human
uuuuaaggacugacugagg

SEQ ID NO: 3620792 - RNA, 14 nt, Human
uuuuaaggcuucaa

SEQ ID NO: 3620793 - RNA, 20 nt, Human
uuuuaaggguuuguggaaaa

SEQ ID NO: 3620794 - RNA, 13 nt, Human
uuuuaaggucuuu

SEQ ID NO: 3620795 - RNA, 18 nt, Human
uuuuaaggucuuucagua

SEQ ID NO: 3620796 - RNA, 16 nt, Human
uuuuaagugcugcauu

SEQ ID NO: 3620797 - RNA, 17 nt, Human
uuuuaagugcugcauuu

SEQ ID NO: 3620798 - RNA, 12 nt, Human
uuuuaaguucuu

SEQ ID NO: 3620799 - RNA, 13 nt, Human
uuuuaaguucuua

SEQ ID NO: 3620800 - RNA, 18 nt, Human
uuuuaaguuguuugcaug

SEQ ID NO: 3620801 - RNA, 19 nt, Human
uuuuaauaaaaauaauuuu

SEQ ID NO: 3620802 - RNA, 13 nt, Human
uuuuaauaaacua

SEQ ID NO: 3620803 - RNA, 14 nt, Human
uuuuaauaaacuuu

SEQ ID NO: 3620804 - RNA, 15 nt, Human
uuuuaauaaacuuuu

SEQ ID NO: 3620805 - RNA, 14 nt, Human
uuuuaauaaauuuc

SEQ ID NO: 3620806 - RNA, 12 nt, Human
uuuuaauaaugu

SEQ ID NO: 3620807 - RNA, 14 nt, Human
uuuuaauaauguuu

SEQ ID NO: 3620808 - RNA, 16 nt, Human
uuuuaauaauguuuca

SEQ ID NO: 3620809 - RNA, 22 nt, Human
uuuuaauaugcuuaaaauaagc

SEQ ID NO: 3620810 - RNA, 19 nt, Human
uuuuaauauggaucuguau

SEQ ID NO: 3620811 - RNA, 16 nt, Human
uuuuaaucaugaaauu

SEQ ID NO: 3620812 - RNA, 18 nt, Human
uuuuaaucuacugcauuu

SEQ ID NO: 3620813 - RNA, 21 nt, Human
uuuuaaucucuaacaguggac

SEQ ID NO: 3620814 - RNA, 17 nt, Human
uuuuaaugaugacaaaa

SEQ ID NO: 3620815 - RNA, 17 nt, Human
uuuuaauggauuguuaa

SEQ ID NO: 3620816 - RNA, 17 nt, Human
uuuuaauggcagcagaa

SEQ ID NO: 3620817 - RNA, 22 nt, Human
uuuuaauggcagcagaaaacuu

SEQ ID NO: 3620818 - RNA, 21 nt, Human
uuuuaaugugcuguguaaagu

SEQ ID NO: 3620819 - RNA, 11 nt, Human
uuuuaauuauu

SEQ ID NO: 3620820 - RNA, 13 nt, Human
uuuuaauuauugu

SEQ ID NO: 3620821 - RNA, 14 nt, Human
uuuuaauuauuguu

SEQ ID NO: 3620822 - RNA, 20 nt, Human
uuuuaauucaccaaaguauu

SEQ ID NO: 3620823 - RNA, 12 nt, Human
uuuuaauucauu

SEQ ID NO: 3620824 - RNA, 11 nt, Human
uuuuaauucca

SEQ ID NO: 3620825 - RNA, 18 nt, Human
uuuuaauuccaauaugau

SEQ ID NO: 3620826 - RNA, 18 nt, Human
uuuuaauuccaugaaucg

SEQ ID NO: 3620827 - RNA, 15 nt, Human
uuuuaauugauuauu

SEQ ID NO: 3620828 - RNA, 14 nt, Human
uuuuaauuguauuu

SEQ ID NO: 3620829 - RNA, 23 nt, Human
uuuuaauugucaugguuacaaac

SEQ ID NO: 3620830 - RNA, 12 nt, Human
uuuuaauuuaac

SEQ ID NO: 3620831 - RNA, 12 nt, Human
uuuuaauuuagu

SEQ ID NO: 3620832 - RNA, 20 nt, Human
uuuuaauuuaguaaauguua

SEQ ID NO: 3620833 - RNA, 19 nt, Human
uuuuaauuucaagcuuauu

SEQ ID NO: 3620834 - RNA, 19 nt, Human
uuuuaauuugaugaaagcu

SEQ ID NO: 3620835 - RNA, 13 nt, Human
uuuuaauuuuguc

SEQ ID NO: 3620836 - RNA, 18 nt, Human
uuuuacaaguaacaaaaa

SEQ ID NO: 3620837 - RNA, 16 nt, Human
uuuuacaauguaauua

SEQ ID NO: 3620838 - RNA, 16 nt, Human
uuuuacaauugaaaug

SEQ ID NO: 3620839 - RNA, 15 nt, Human
uuuuacacagaaaca

SEQ ID NO: 3620840 - RNA, 21 nt, Human
uuuuacacagaaacacugccu

SEQ ID NO: 3620841 - RNA, 22 nt, Human
uuuuacacagaaacacugccuu

SEQ ID NO: 3620842 - RNA, 16 nt, Human
uuuuacagcugccugc

SEQ ID NO: 3620843 - RNA, 22 nt, Human
uuuuacauaaauuuaguauuuu

SEQ ID NO: 3620844 - RNA, 15 nt, Human
uuuuacaucuaaacu

SEQ ID NO: 3620845 - RNA, 16 nt, Human
uuuuacaucuaaacua

SEQ ID NO: 3620846 - RNA, 18 nt, Human
uuuuacauguuuauaaau

SEQ ID NO: 3620847 - RNA, 15 nt, Human
uuuuacauucugaau

SEQ ID NO: 3620848 - RNA, 13 nt, Human
uuuuaccaaguuu

SEQ ID NO: 3620849 - RNA, 15 nt, Human
uuuuaccagcuuuua

SEQ ID NO: 3620850 - RNA, 23 nt, Human
uuuuaccaucacacauguucaga

SEQ ID NO: 3620851 - RNA, 20 nt, Human
uuuuacccauuuguucauau

SEQ ID NO: 3620852 - RNA, 19 nt, Human
uuuuaccuaccacaguguc

SEQ ID NO: 3620853 - RNA, 14 nt, Human
uuuuaccuuucaua

SEQ ID NO: 3620854 - RNA, 22 nt, Human
uuuuacuccagguuauugcaau

SEQ ID NO: 3620855 - RNA, 14 nt, Human
uuuuacucugccua

SEQ ID NO: 3620856 - RNA, 22 nt, Human
uuuuacucugccuacagaacuu

SEQ ID NO: 3620857 - RNA, 11 nt, Human
uuuuacugaac

SEQ ID NO: 3620858 - RNA, 13 nt, Human
uuuuacugaacaa

SEQ ID NO: 3620859 - RNA, 16 nt, Human
uuuuacugcucugaga

SEQ ID NO: 3620860 - RNA, 15 nt, Human
uuuuacugcuuuuaa

SEQ ID NO: 3620861 - RNA, 17 nt, Human
uuuuacugguugcaugg

SEQ ID NO: 3620862 - RNA, 13 nt, Human
uuuuacuuggaaa

SEQ ID NO: 3620863 - RNA, 18 nt, Human
uuuuacuuuuaaacugug

SEQ ID NO: 3620864 - RNA, 15 nt, Human
uuuuacuuuuaaaug

SEQ ID NO: 3620865 - RNA, 22 nt, Human
uuuuacuuuuuuuuuauuuuau

SEQ ID NO: 3620866 - RNA, 12 nt, Human
uuuuagaaacuu

SEQ ID NO: 3620867 - RNA, 14 nt, Human
uuuuagaaagcauu

SEQ ID NO: 3620868 - RNA, 18 nt, Human
uuuuagaaagcauuugaa

SEQ ID NO: 3620869 - RNA, 16 nt, Human
uuuuagaauaagaauu

SEQ ID NO: 3620870 - RNA, 17 nt, Human
uuuuagaucaaauacuu

SEQ ID NO: 3620871 - RNA, 19 nt, Human
uuuuagaucaaauacuuua

SEQ ID NO: 3620872 - RNA, 20 nt, Human
uuuuagaugagauuguuuua

SEQ ID NO: 3620873 - RNA, 17 nt, Human
uuuuagaugguuucuug

SEQ ID NO: 3620874 - RNA, 23 nt, Human
uuuuagcaaagcggguuauaaug

SEQ ID NO: 3620875 - RNA, 16 nt, Human
uuuuagccuucucugu

SEQ ID NO: 3620876 - RNA, 23 nt, Human
uuuuagccuucucuguucauuuc

SEQ ID NO: 3620877 - RNA, 20 nt, Human
uuuuagcugaugaacuuauu

SEQ ID NO: 3620878 - RNA, 20 nt, Human
uuuuaggaaaaucacuuugu

SEQ ID NO: 3620879 - RNA, 15 nt, Human
uuuuaggaaaugaau

SEQ ID NO: 3620880 - RNA, 17 nt, Human
uuuuaggcacucuuaaa

SEQ ID NO: 3620881 - RNA, 17 nt, Human
uuuuagggagcuggucu

SEQ ID NO: 3620882 - RNA, 19 nt, Human
uuuuagguguugauuuucu

SEQ ID NO: 3620883 - RNA, 13 nt, Human
uuuuagguucuaa

SEQ ID NO: 3620884 - RNA, 23 nt, Human
uuuuagguucuaaaguucuaaga

SEQ ID NO: 3620885 - RNA, 18 nt, Human
uuuuaguaaguuaaugua

SEQ ID NO: 3620886 - RNA, 15 nt, Human
uuuuaguaaucugua

SEQ ID NO: 3620887 - RNA, 19 nt, Human
uuuuaguauuuauuuaugu

SEQ ID NO: 3620888 - RNA, 14 nt, Human
uuuuagucacuuuu

SEQ ID NO: 3620889 - RNA, 20 nt, Human
uuuuaguggacccugaaaug

SEQ ID NO: 3620890 - RNA, 20 nt, Human
uuuuaguuccugugcacagc

SEQ ID NO: 3620891 - RNA, 19 nt, Human
uuuuaguuucuguucugug

SEQ ID NO: 3620892 - RNA, 20 nt, Human
uuuuaguuucuguucugugg

SEQ ID NO: 3620893 - RNA, 21 nt, Human
uuuuaguuucuguucugugga

SEQ ID NO: 3620894 - RNA, 13 nt, Human
uuuuaguuuugcu

SEQ ID NO: 3620895 - RNA, 16 nt, Human
uuuuaguuuuucauua

SEQ ID NO: 3620896 - RNA, 20 nt, Human
uuuuauaaaaaaaaugaaau

SEQ ID NO: 3620897 - RNA, 16 nt, Human
uuuuauaaaaaauggu

SEQ ID NO: 3620898 - RNA, 16 nt, Human
uuuuauaaaaauaaau

SEQ ID NO: 3620899 - RNA, 20 nt, Human
uuuuauaaaauuaaagaaaa

SEQ ID NO: 3620900 - RNA, 21 nt, Human
uuuuauaaaauuaaagaaaau

SEQ ID NO: 3620901 - RNA, 13 nt, Human
aaaaaaaaagaaa

SEQ ID NO: 3620902 - RNA, 12 nt, Human
aaaaaaaacaaa

SEQ ID NO: 3620903 - RNA, 12 nt, Human
aaaaaaaacagu

SEQ ID NO: 3620904 - RNA, 13 nt, Human
aaaaaaaagcuuc

SEQ ID NO: 3620905 - RNA, 12 nt, Human
aaaaaaaaguca

SEQ ID NO: 3620906 - RNA, 13 nt, Human
aaaaaaaagucag

SEQ ID NO: 3620907 - RNA, 11 nt, Human
aaaaaaaaguu

SEQ ID NO: 3620908 - RNA, 12 nt, Human
aaaaaaaaguua

SEQ ID NO: 3620909 - RNA, 13 nt, Human
aaaaaaaaugcca

SEQ ID NO: 3620910 - RNA, 11 nt, Human
aaaaaaaaugg

SEQ ID NO: 3620911 - RNA, 13 nt, Human
aaaaaaaauugua

SEQ ID NO: 3620912 - RNA, 18 nt, Human
aaaaaaacaguggaucac

SEQ ID NO: 3620913 - RNA, 11 nt, Human
aaaaaaagaaa

SEQ ID NO: 3620914 - RNA, 10 nt, Human
aaaaaaagac

SEQ ID NO: 3620915 - RNA, 14 nt, Human
aaaaaaagaucugu

SEQ ID NO: 3620916 - RNA, 12 nt, Human
aaaaaaagcaua

SEQ ID NO: 3620917 - RNA, 12 nt, Human
aaaaaaagcuuu

SEQ ID NO: 3620918 - RNA, 11 nt, Human
aaaaaaaguua

SEQ ID NO: 3620919 - RNA, 11 nt, Human
aaaaaaauaag

SEQ ID NO: 3620920 - RNA, 12 nt, Human
aaaaaaauaaua

SEQ ID NO: 3620921 - RNA, 14 nt, Human
aaaaaaaugccaua

SEQ ID NO: 3620922 - RNA, 12 nt, Human
aaaaaaauuggc

SEQ ID NO: 3620923 - RNA, 11 nt, Human
aaaaaaauuug

SEQ ID NO: 3620924 - RNA, 19 nt, Human
aaaaaacucgaggacugua

SEQ ID NO: 3620925 - RNA, 11 nt, Human
aaaaaacucuu

SEQ ID NO: 3620926 - RNA, 12 nt, Human
aaaaaagaaaau

SEQ ID NO: 3620927 - RNA, 12 nt, Human
aaaaaagaaaga

SEQ ID NO: 3620928 - RNA, 10 nt, Human
aaaaaagcuc

SEQ ID NO: 3620929 - RNA, 11 nt, Human
aaaaaagcuca

SEQ ID NO: 3620930 - RNA, 12 nt, Human
aaaaaagcucau

SEQ ID NO: 3620931 - RNA, 11 nt, Human
aaaaaagcuuu

SEQ ID NO: 3620932 - RNA, 12 nt, Human
aaaaaagucaga

SEQ ID NO: 3620933 - RNA, 12 nt, Human
aaaaaaguuaua

SEQ ID NO: 3620934 - RNA, 13 nt, Human
aaaaaaguugaag

SEQ ID NO: 3620935 - RNA, 12 nt, Human
aaaaaaguuuua

SEQ ID NO: 3620936 - RNA, 12 nt, Human
aaaaaauaacac

SEQ ID NO: 3620937 - RNA, 20 nt, Human
aaaaaauaaucuauuucuau

SEQ ID NO: 3620938 - RNA, 12 nt, Human
aaaaaauaauua

SEQ ID NO: 3620939 - RNA, 11 nt, Human
aaaaaauacug

SEQ ID NO: 3620940 - RNA, 14 nt, Human
aaaaaauacugcca

SEQ ID NO: 3620941 - RNA, 19 nt, Human
aaaaaauauagccuuuaca

SEQ ID NO: 3620942 - RNA, 17 nt, Human
aaaaaaucaucuauuuu

SEQ ID NO: 3620943 - RNA, 13 nt, Human
aaaaaaucugcag

SEQ ID NO: 3620944 - RNA, 12 nt, Human
aaaauauacugu

SEQ ID NO: 3620945 - RNA, 13 nt, Human
aaaauauacugua

SEQ ID NO: 3620946 - RNA, 14 nt, Human
aaaauugaaaugua

SEQ ID NO: 3620947 - RNA, 16 nt, Human
aaaauugaaauguaag

SEQ ID NO: 3620948 - RNA, 18 nt, Human
aaaauugaaauguaaggc

SEQ ID NO: 3620949 - RNA, 14 nt, Human
aaaauugaaugcaa

SEQ ID NO: 3620950 - RNA, 21 nt, Human
aaaauugaaugcaaaccauag

SEQ ID NO: 3620951 - RNA, 12 nt, Human
aaaauugaauuu

SEQ ID NO: 3620952 - RNA, 14 nt, Human
aaaauugaauuuaa

SEQ ID NO: 3620953 - RNA, 17 nt, Human
aaaauugaauuuaacaa

SEQ ID NO: 3620954 - RNA, 22 nt, Human
aaaauugaguucuuccuguaau

SEQ ID NO: 3620955 - RNA, 20 nt, Human
aaaauugaguugcacuuauu

SEQ ID NO: 3620956 - RNA, 23 nt, Human
aaaauugauauacuuuuuucuua

SEQ ID NO: 3620957 - RNA, 21 nt, Human
aaaauugccauauugcacaug

SEQ ID NO: 3620958 - RNA, 15 nt, Human
aaaauugcugugccu

SEQ ID NO: 3620959 - RNA, 21 nt, Human
aaaauugcugugccucccaaa

SEQ ID NO: 3620960 - RNA, 20 nt, Human
aaaauuggcuaguugaaucu

SEQ ID NO: 3620961 - RNA, 18 nt, Human
aaaauuggggauucuuaa

SEQ ID NO: 3620962 - RNA, 20 nt, Human
aaaauuggggauucuuaaag

SEQ ID NO: 3620963 - RNA, 16 nt, Human
aaaauugguuggagaa

SEQ ID NO: 3620964 - RNA, 13 nt, Human
aaaauuguauaga

SEQ ID NO: 3620965 - RNA, 16 nt, Human
aaaauuguauagagau

SEQ ID NO: 3620966 - RNA, 21 nt, Human
aaaauuguauagagauaugca

SEQ ID NO: 3620967 - RNA, 16 nt, Human
aaaauuguuuagugau

SEQ ID NO: 3620968 - RNA, 18 nt, Human
aaaauuuaaaaagcccaa

SEQ ID NO: 3620969 - RNA, 19 nt, Human
aaaauuuaaaaagcccaac

SEQ ID NO: 3620970 - RNA, 21 nt, Human
aaaauuuaagcauuguuugcu

SEQ ID NO: 3620971 - RNA, 18 nt, Human
aaaauuuaagugcgugug

SEQ ID NO: 3620972 - RNA, 14 nt, Human
aaaauuuauuucau

SEQ ID NO: 3620973 - RNA, 20 nt, Human
aaaauuucacauuaauauuu

SEQ ID NO: 3620974 - RNA, 12 nt, Human
aaaauuugaaac

SEQ ID NO: 3620975 - RNA, 13 nt, Human
aaaauuugaaaca

SEQ ID NO: 3620976 - RNA, 14 nt, Human
aaaauuugaaacau

SEQ ID NO: 3620977 - RNA, 16 nt, Human
aaaauuugaaacauug

SEQ ID NO: 3620978 - RNA, 17 nt, Human
aaaauuugaaacauugc

SEQ ID NO: 3620979 - RNA, 16 nt, Human
aaaauuugaacacugg

SEQ ID NO: 3620980 - RNA, 19 nt, Human
aaaauuugaaccaaaacau

SEQ ID NO: 3620981 - RNA, 19 nt, Human
aaaauuugacuaauuuuac

SEQ ID NO: 3620982 - RNA, 19 nt, Human
aaaauuuguuugaaaucuu

SEQ ID NO: 3620983 - RNA, 13 nt, Human
aaaauuuuauucc

SEQ ID NO: 3620984 - RNA, 20 nt, Human
aaaauuuugauguuuuaagg

SEQ ID NO: 3620985 - RNA, 17 nt, Human
aaaauuuugcuuuuaau

SEQ ID NO: 3620986 - RNA, 14 nt, Human
aaaauuuuuggauu

SEQ ID NO: 3620987 - RNA, 22 nt, Human
aaaauuuuuucucuaggaaaua

SEQ ID NO: 3620988 - RNA, 21 nt, Human
aaacaaaaauuagguauuuug

SEQ ID NO: 3620989 - RNA, 13 nt, Human
aaacaaaacaaaa

SEQ ID NO: 3620990 - RNA, 17 nt, Human
aaacaaaacaaaacuau

SEQ ID NO: 3620991 - RNA, 13 nt, Human
aaacaaaaccaaa

SEQ ID NO: 3620992 - RNA, 18 nt, Human
aaacaaaauggcuucagu

SEQ ID NO: 3620993 - RNA, 20 nt, Human
aaacaaaauuuguuugaaau

SEQ ID NO: 3620994 - RNA, 15 nt, Human
aaacaaacaagcuag

SEQ ID NO: 3620995 - RNA, 18 nt, Human
aaacaaacaccuucuuau

SEQ ID NO: 3620996 - RNA, 16 nt, Human
aaacaaagcaauucuu

SEQ ID NO: 3620997 - RNA, 12 nt, Human
aaacaaagccag

SEQ ID NO: 3620998 - RNA, 13 nt, Human
aaacaaagccaga

SEQ ID NO: 3620999 - RNA, 17 nt, Human
aaacaaagcuuagcagg

SEQ ID NO: 3621000 - RNA, 22 nt, Human
aaacaaagcuuagcaggagagg

SEQ ID NO: 3621001 - RNA, 13 nt, Human
aaacaaagucuuu

SEQ ID NO: 3621002 - RNA, 17 nt, Human
aaacaaaguggaaggaa

SEQ ID NO: 3621003 - RNA, 17 nt, Human
aaacaaaguuacuaggu

SEQ ID NO: 3621004 - RNA, 23 nt, Human
aaacaaaguuucagaguauauug

SEQ ID NO: 3621005 - RNA, 13 nt, Human
aaacaaauaaaaa

SEQ ID NO: 3621006 - RNA, 21 nt, Human
aaacaaauucauauucugucu

SEQ ID NO: 3621007 - RNA, 12 nt, Human
aaacaacaaaaa

SEQ ID NO: 3621008 - RNA, 16 nt, Human
aaacaacaacacaaua

SEQ ID NO: 3621009 - RNA, 19 nt, Human
aaacaacagucuucauuuu

SEQ ID NO: 3621010 - RNA, 19 nt, Human
aaacaacauuuugagaaca

SEQ ID NO: 3621011 - RNA, 15 nt, Human
aaacaaccaugucau

SEQ ID NO: 3621012 - RNA, 17 nt, Human
aaacaaccaugucauuu

SEQ ID NO: 3621013 - RNA, 13 nt, Human
aaacaagaaaaau

SEQ ID NO: 3621014 - RNA, 17 nt, Human
aaacaagaaaaauaaag

SEQ ID NO: 3621015 - RNA, 23 nt, Human
aaacaagaaugaagguuuuugua

SEQ ID NO: 3621016 - RNA, 12 nt, Human
aaacaagaaugu

SEQ ID NO: 3621017 - RNA, 20 nt, Human
aaacaagaccacguuucuaa

SEQ ID NO: 3621018 - RNA, 20 nt, Human
aaacaagcacuaaacaaaga

SEQ ID NO: 3621019 - RNA, 12 nt, Human
aaacaagcauau

SEQ ID NO: 3621020 - RNA, 20 nt, Human
aaacaagcauauaaaauggc

SEQ ID NO: 3621021 - RNA, 23 nt, Human
aaacaagccaagaaagauguaua

SEQ ID NO: 3621022 - RNA, 19 nt, Human
aaacaaggggcuguuacau

SEQ ID NO: 3621023 - RNA, 22 nt, Human
aaacaaguauuuguuaauuuag

SEQ ID NO: 3621024 - RNA, 14 nt, Human
aaacaauaaagaga

SEQ ID NO: 3621025 - RNA, 15 nt, Human
aaacaauaaagagau

SEQ ID NO: 3621026 - RNA, 15 nt, Human
aaacaauaaagcaau

SEQ ID NO: 3621027 - RNA, 15 nt, Human
aaacaauaaaugugc

SEQ ID NO: 3621028 - RNA, 14 nt, Human
aaacaauauagucu

SEQ ID NO: 3621029 - RNA, 18 nt, Human
aaacaauauuuauuguau

SEQ ID NO: 3621030 - RNA, 22 nt, Human
aaacaauauuuauuguauuuua

SEQ ID NO: 3621031 - RNA, 15 nt, Human
aaacaaucucuuaaa

SEQ ID NO: 3621032 - RNA, 17 nt, Human
aaacaaugcaaaaccuu

SEQ ID NO: 3621033 - RNA, 22 nt, Human
aaacaauguuaacauuuuuggu

SEQ ID NO: 3621034 - RNA, 14 nt, Human
aaacaauguuuaaa

SEQ ID NO: 3621035 - RNA, 17 nt, Human
aaacaauuuauuuuauu

SEQ ID NO: 3621036 - RNA, 18 nt, Human
aaacacaaaacaaauccu

SEQ ID NO: 3621037 - RNA, 19 nt, Human
aaacacaaaugcagggauu

SEQ ID NO: 3621038 - RNA, 18 nt, Human
aaacacaccaggcugugg

SEQ ID NO: 3621039 - RNA, 12 nt, Human
aaacacagagag

SEQ ID NO: 3621040 - RNA, 19 nt, Human
aaacacagucaaaauaauu

SEQ ID NO: 3621041 - RNA, 13 nt, Human
aaacacaguuaca

SEQ ID NO: 3621042 - RNA, 16 nt, Human
aaacacaguuacacuu

SEQ ID NO: 3621043 - RNA, 18 nt, Human
aaacacaucuuuccuguc

SEQ ID NO: 3621044 - RNA, 15 nt, Human
aaacacauuaaaggu

SEQ ID NO: 3621045 - RNA, 11 nt, Human
aaacacauuuu

SEQ ID NO: 3621046 - RNA, 12 nt, Human
aaacaccccuca

SEQ ID NO: 3621047 - RNA, 14 nt, Human
aaacaccuagcuuu

SEQ ID NO: 3621048 - RNA, 21 nt, Human
aaacaccucacaccucacucu

SEQ ID NO: 3621049 - RNA, 23 nt, Human
aaacaccugacagccccucccuc

SEQ ID NO: 3621050 - RNA, 14 nt, Human
aaacaccuucuaua

SEQ ID NO: 3621051 - RNA, 22 nt, Human
aaacacguuuuaaggacugacu

SEQ ID NO: 3621052 - RNA, 20 nt, Human
aaacacuaaauguuaaagau

SEQ ID NO: 3621053 - RNA, 15 nt, Human
aaacacuccuugcau

SEQ ID NO: 3621054 - RNA, 17 nt, Human
aaacacucuugaaaaau

SEQ ID NO: 3621055 - RNA, 23 nt, Human
aaacacugccaucuuaguuugga

SEQ ID NO: 3621056 - RNA, 17 nt, Human
aaacacugccuuuuuau

SEQ ID NO: 3621057 - RNA, 21 nt, Human
aaacacugcgcuuuauuuucu

SEQ ID NO: 3621058 - RNA, 19 nt, Human
aaacacuggggcuggcaca

SEQ ID NO: 3621059 - RNA, 23 nt, Human
aaacacuguggaacuaauaaaua

SEQ ID NO: 3621060 - RNA, 22 nt, Human
aaacacuguucucugcccucca

SEQ ID NO: 3621061 - RNA, 15 nt, Human
aaacacuucaauaau

SEQ ID NO: 3621062 - RNA, 18 nt, Human
aaacacuucguucgcaga

SEQ ID NO: 3621063 - RNA, 21 nt, Human
aaacacuucguucgcagagcu

SEQ ID NO: 3621064 - RNA, 15 nt, Human
aaacacuugcaaccu

SEQ ID NO: 3621065 - RNA, 12 nt, Human
aaacacuuguaa

SEQ ID NO: 3621066 - RNA, 13 nt, Human
aaacacuuucaaa

SEQ ID NO: 3621067 - RNA, 17 nt, Human
aaacacuuugccuccug

SEQ ID NO: 3621068 - RNA, 17 nt, Human
aaacagaaaaaaaacac

SEQ ID NO: 3621069 - RNA, 14 nt, Human
aaacagaaaaaaag

SEQ ID NO: 3621070 - RNA, 14 nt, Human
aaacagaacacuua

SEQ ID NO: 3621071 - RNA, 12 nt, Human
aaacagaacagg

SEQ ID NO: 3621072 - RNA, 15 nt, Human
aaacagaacaggguc

SEQ ID NO: 3621073 - RNA, 12 nt, Human
aaacagaagccu

SEQ ID NO: 3621074 - RNA, 14 nt, Human
aaacagacaauaug

SEQ ID NO: 3621075 - RNA, 16 nt, Human
aaacagacaauaugug

SEQ ID NO: 3621076 - RNA, 20 nt, Human
aaacagacucgauucauauu

SEQ ID NO: 3621077 - RNA, 18 nt, Human
aaacagaguaaucuuguu

SEQ ID NO: 3621078 - RNA, 14 nt, Human
aaacagauaccaua

SEQ ID NO: 3621079 - RNA, 17 nt, Human
aaacagaugaaaagccu

SEQ ID NO: 3621080 - RNA, 16 nt, Human
aaacagauuguuugca

SEQ ID NO: 3621081 - RNA, 22 nt, Human
aaacagauuuggugaauuugaa

SEQ ID NO: 3621082 - RNA, 23 nt, Human
aaacagauuuggugaauuugaau

SEQ ID NO: 3621083 - RNA, 13 nt, Human
aaacagcaaacca

SEQ ID NO: 3621084 - RNA, 24 nt, Human
aaacagcaaaccaagagauugcua

SEQ ID NO: 3621085 - RNA, 22 nt, Human
aaacagccgucagccaaaugua

SEQ ID NO: 3621086 - RNA, 21 nt, Human
aaacagcgcuggguccacccc

SEQ ID NO: 3621087 - RNA, 15 nt, Human
aaacagcguuuaaga

SEQ ID NO: 3621088 - RNA, 14 nt, Human
aaacagcucaggcu

SEQ ID NO: 3621089 - RNA, 23 nt, Human
aaagauauggagaauugcugaag

SEQ ID NO: 3621090 - RNA, 22 nt, Human
aaagauauuauucaccauguaa

SEQ ID NO: 3621091 - RNA, 20 nt, Human
aaagauauuuugcuuuguga

SEQ ID NO: 3621092 - RNA, 15 nt, Human
aaagaucaaaauaaa

SEQ ID NO: 3621093 - RNA, 17 nt, Human
aaagaucaaaauaaaaa

SEQ ID NO: 3621094 - RNA, 15 nt, Human
aaagaucuacaugaa

SEQ ID NO: 3621095 - RNA, 19 nt, Human
aaagaucuguccucagccu

SEQ ID NO: 3621096 - RNA, 13 nt, Human
aaagaucuguuuu

SEQ ID NO: 3621097 - RNA, 17 nt, Human
aaagaugaaaauauuug

SEQ ID NO: 3621098 - RNA, 18 nt, Human
aaagaugaaggucuguuu

SEQ ID NO: 3621099 - RNA, 15 nt, Human
aaagaugagugagca

SEQ ID NO: 3621100 - RNA, 12 nt, Human
aaagaugcacuu

SEQ ID NO: 3621101 - RNA, 21 nt, Human
aaagaugcacuuugcuuuaau

SEQ ID NO: 3621102 - RNA, 23 nt, Human
aaagaugcucagguacagagaag

SEQ ID NO: 3621103 - RNA, 24 nt, Human
aaagaugcucagguacagagaagg

SEQ ID NO: 3621104 - RNA, 14 nt, Human
aaagaugcuucuca

SEQ ID NO: 3621105 - RNA, 13 nt, Human
aaagaugcuuuua

SEQ ID NO: 3621106 - RNA, 16 nt, Human
aaagauggaguuucua

SEQ ID NO: 3621107 - RNA, 22 nt, Human
aaagauggcugugccucugccu

SEQ ID NO: 3621108 - RNA, 21 nt, Human
aaagauggggucuguaaaauc

SEQ ID NO: 3621109 - RNA, 17 nt, Human
aaagaugguuaaacauu

SEQ ID NO: 3621110 - RNA, 20 nt, Human
aaagaugguuaaacauuuuc

SEQ ID NO: 3621111 - RNA, 14 nt, Human
aaagauguagcaaa

SEQ ID NO: 3621112 - RNA, 23 nt, Human
aaagaugucucugcaaaccaaca

SEQ ID NO: 3621113 - RNA, 13 nt, Human
aaagaugugggga

SEQ ID NO: 3621114 - RNA, 16 nt, Human
aaagauguucuggaua

SEQ ID NO: 3621115 - RNA, 21 nt, Human
aaagauguuugucagauauga

SEQ ID NO: 3621116 - RNA, 22 nt, Human
aaagauuacuuuuucuuuaugu

SEQ ID NO: 3621117 - RNA, 22 nt, Human
aaagauuagcaaggucauuucu

SEQ ID NO: 3621118 - RNA, 22 nt, Human
aaagauucaccuaagagauucu

SEQ ID NO: 3621119 - RNA, 14 nt, Human
aaagauucaccuga

SEQ ID NO: 3621120 - RNA, 21 nt, Human
aaagauuuaagcacaaacuuu

SEQ ID NO: 3621121 - RNA, 14 nt, Human
aaagauuucuguuc

SEQ ID NO: 3621122 - RNA, 13 nt, Human
aaagauuuucaga

SEQ ID NO: 3621123 - RNA, 14 nt, Human
aaagauuuuuuaau

SEQ ID NO: 3621124 - RNA, 20 nt, Human
aaagauuuuuuaauaauuua

SEQ ID NO: 3621125 - RNA, 14 nt, Human
aaagcaaaaaagaa

SEQ ID NO: 3621126 - RNA, 15 nt, Human
aaagcaaaaaugcua

SEQ ID NO: 3621127 - RNA, 22 nt, Human
aaagcaaaagaucccuuuuucu

SEQ ID NO: 3621128 - RNA, 17 nt, Human
aaagcaaaauaaaaacu

SEQ ID NO: 3621129 - RNA, 15 nt, Human
aaagcaaaccuguaa

SEQ ID NO: 3621130 - RNA, 13 nt, Human
aaagcaaaugucu

SEQ ID NO: 3621131 - RNA, 16 nt, Human
aaagcaaaugugaccu

SEQ ID NO: 3621132 - RNA, 13 nt, Human
aaagcaacaucag

SEQ ID NO: 3621133 - RNA, 21 nt, Human
aaagcaacugucuauuucugc

SEQ ID NO: 3621134 - RNA, 18 nt, Human
aaagcaagaaucagagaa

SEQ ID NO: 3621135 - RNA, 14 nt, Human
aaagcaaggaaacu

SEQ ID NO: 3621136 - RNA, 22 nt, Human
aaagcaagugauugggacagag

SEQ ID NO: 3621137 - RNA, 15 nt, Human
aaagcaauaaaugaa

SEQ ID NO: 3621138 - RNA, 17 nt, Human
aaagcaauaaaugaaug

SEQ ID NO: 3621139 - RNA, 12 nt, Human
aaagcaauagaa

SEQ ID NO: 3621140 - RNA, 15 nt, Human
aaagcaauagaaaca

SEQ ID NO: 3621141 - RNA, 14 nt, Human
aaagcaauaugcau

SEQ ID NO: 3621142 - RNA, 18 nt, Human
aaagcaauauuuuggagu

SEQ ID NO: 3621143 - RNA, 14 nt, Human
aaagcaauuuuccu

SEQ ID NO: 3621144 - RNA, 16 nt, Human
aaagcaauuuuccuug

SEQ ID NO: 3621145 - RNA, 18 nt, Human
aaagcaauuuuccuugaa

SEQ ID NO: 3621146 - RNA, 19 nt, Human
aaagcaauuuuccuugaag

SEQ ID NO: 3621147 - RNA, 21 nt, Human
aaagcaauuuuccuugaagcc

SEQ ID NO: 3621148 - RNA, 13 nt, Human
aaagcacaaagga

SEQ ID NO: 3621149 - RNA, 17 nt, Human
aaagauaccuuaaaauu

SEQ ID NO: 3621150 - RNA, 18 nt, Human
aaagauaccuuaaaauuu

SEQ ID NO: 3621151 - RNA, 20 nt, Human
aaagauaccuuaaaauuuga

SEQ ID NO: 3621152 - RNA, 16 nt, Human
aaagauacgacuuuau

SEQ ID NO: 3621153 - RNA, 20 nt, Human
aaagauacgacuuuauuuuc

SEQ ID NO: 3621154 - RNA, 22 nt, Human
aaagauacgacuuuauuuucug

SEQ ID NO: 3621155 - RNA, 16 nt, Human
aaagauauaagugcug

SEQ ID NO: 3621156 - RNA, 18 nt, Human
aaagauauaagugcugua

SEQ ID NO: 3621157 - RNA, 20 nt, Human
aaagauauaugaauaugaca

SEQ ID NO: 3621158 - RNA, 20 nt, Human
aaagauaucucaucucuucu

SEQ ID NO: 3621159 - RNA, 15 nt, Human
aaagauaucuuuucu

SEQ ID NO: 3621160 - RNA, 14 nt, Human
aaagauauggagaa

SEQ ID NO: 3621161 - RNA, 15 nt, Human
aaagauauuguucaa

SEQ ID NO: 3621162 - RNA, 12 nt, Human
aaagauauuuug

SEQ ID NO: 3621163 - RNA, 20 nt, Human
aaagaucaaaauaaaaagug

SEQ ID NO: 3621164 - RNA, 22 nt, Human
aaagaucacuuguuguuuuacu

SEQ ID NO: 3621165 - RNA, 20 nt, Human
aaagaucuguccucagccuu

SEQ ID NO: 3621166 - RNA, 16 nt, Human
aaagaucuguuuugaa

SEQ ID NO: 3621167 - RNA, 15 nt, Human
aaagaugaaaggcag

SEQ ID NO: 3621168 - RNA, 23 nt, Human
aaagaugaacucugaacuuugga

SEQ ID NO: 3621169 - RNA, 19 nt, Human
aaagaugaaggucuguuuu

SEQ ID NO: 3621170 - RNA, 20 nt, Human
aaagaugagcuuugucuacu

SEQ ID NO: 3621171 - RNA, 14 nt, Human
aaagaugcaaugua

SEQ ID NO: 3621172 - RNA, 17 nt, Human
aaagaugcacuuugcuu

SEQ ID NO: 3621173 - RNA, 22 nt, Human
aaagaugcacuuugcuuuaaua

SEQ ID NO: 3621174 - RNA, 14 nt, Human
aaagaugccacauu

SEQ ID NO: 3621175 - RNA, 12 nt, Human
aaagaugcuuuu

SEQ ID NO: 3621176 - RNA, 13 nt, Human
aaagauggaaaaa

SEQ ID NO: 3621177 - RNA, 15 nt, Human
aaagauggaguuucu

SEQ ID NO: 3621178 - RNA, 18 nt, Human
aaagauggcucagagggg

SEQ ID NO: 3621179 - RNA, 23 nt, Human
aaagauggcugugccucugccug

SEQ ID NO: 3621180 - RNA, 19 nt, Human
aaagauggggucuguaaaa

SEQ ID NO: 3621181 - RNA, 19 nt, Human
aaagaugggugaaggcugg

SEQ ID NO: 3621182 - RNA, 22 nt, Human
aaagauguaaugucccuuucag

SEQ ID NO: 3621183 - RNA, 15 nt, Human
aaagauguagcaaac

SEQ ID NO: 3621184 - RNA, 13 nt, Human
aaagauguauaua

SEQ ID NO: 3621185 - RNA, 13 nt, Human
aaagauuaaacag

SEQ ID NO: 3621186 - RNA, 19 nt, Human
aaagauuacuuagaggaaa

SEQ ID NO: 3621187 - RNA, 13 nt, Human
aaagauuagcaag

SEQ ID NO: 3621188 - RNA, 18 nt, Human
aaagauuagcaaggucau

SEQ ID NO: 3621189 - RNA, 19 nt, Human
aaagauucagguauguugc

SEQ ID NO: 3621190 - RNA, 15 nt, Human
aaagauucaugauuu

SEQ ID NO: 3621191 - RNA, 13 nt, Human
aaagauucauuuu

SEQ ID NO: 3621192 - RNA, 19 nt, Human
aaagauucauuuuuaauca

SEQ ID NO: 3621193 - RNA, 19 nt, Human
aaagauucuauaguucuag

SEQ ID NO: 3621194 - RNA, 21 nt, Human
aaagauucuauaguucuagac

SEQ ID NO: 3621195 - RNA, 15 nt, Human
aaagauugagagaau

SEQ ID NO: 3621196 - RNA, 21 nt, Human
aaagauugcugaaauuuuaua

SEQ ID NO: 3621197 - RNA, 20 nt, Human
aaagauuuaagcacaaacuu

SEQ ID NO: 3621198 - RNA, 13 nt, Human
aaagauuuaucaa

SEQ ID NO: 3621199 - RNA, 13 nt, Human
aaagauuucuguu

SEQ ID NO: 3621200 - RNA, 14 nt, Human
aaagauuucuugag

SEQ ID NO: 3621201 - RNA, 14 nt, Human
aaagauuuuaauca

SEQ ID NO: 3621202 - RNA, 14 nt, Human
aaagauuuucagaa

SEQ ID NO: 3621203 - RNA, 12 nt, Human
aaagcaaaaaug

SEQ ID NO: 3621204 - RNA, 16 nt, Human
aaagcaaaaaugcuaa

SEQ ID NO: 3621205 - RNA, 17 nt, Human
aaagcaaaaaugcuaau

SEQ ID NO: 3621206 - RNA, 14 nt, Human
aaagcaaaagugcu

SEQ ID NO: 3621207 - RNA, 21 nt, Human
aaagcaaacuuaagaaacacu

SEQ ID NO: 3621208 - RNA, 11 nt, Human
aaagcaaagca

SEQ ID NO: 3621209 - RNA, 14 nt, Human
aaagcaaaucauuu

SEQ ID NO: 3621210 - RNA, 14 nt, Human
aaagcaacacuuuu

SEQ ID NO: 3621211 - RNA, 14 nt, Human
aaagcaagacuguu

SEQ ID NO: 3621212 - RNA, 19 nt, Human
aaagcaagcugauuaaaug

SEQ ID NO: 3621213 - RNA, 13 nt, Human
aaagcaauaaaau

SEQ ID NO: 3621214 - RNA, 14 nt, Human
aaagcaauaauggu

SEQ ID NO: 3621215 - RNA, 14 nt, Human
aaagcaauauugua

SEQ ID NO: 3621216 - RNA, 14 nt, Human
aaagcaaugcauuu

SEQ ID NO: 3621217 - RNA, 20 nt, Human
aaagcaauuuuccuugaagc

SEQ ID NO: 3621218 - RNA, 22 nt, Human
aaagcaauuuuccuugaagccg

SEQ ID NO: 3621219 - RNA, 23 nt, Human
aaagcaauuuuccuugaagccga

SEQ ID NO: 3621220 - RNA, 13 nt, Human
aaagcacaagaag

SEQ ID NO: 3621221 - RNA, 20 nt, Human
aaagcacaguguuaaaugaa

SEQ ID NO: 3621222 - RNA, 12 nt, Human
aaagcacaucca

SEQ ID NO: 3621223 - RNA, 20 nt, Human
aaagcaccaaaauaagaaaa

SEQ ID NO: 3621224 - RNA, 21 nt, Human
aaagcaccaaaauaagaaaag

SEQ ID NO: 3621225 - RNA, 22 nt, Human
aaagcaccagcuucuccaggcu

SEQ ID NO: 3621226 - RNA, 13 nt, Human
aaagcaccugccg

SEQ ID NO: 3621227 - RNA, 18 nt, Human
aaagcacuagagaaugca

SEQ ID NO: 3621228 - RNA, 21 nt, Human
aaagcacuccucccugaugua

SEQ ID NO: 3621229 - RNA, 22 nt, Human
aaagcacugaccugucaugccc

SEQ ID NO: 3621230 - RNA, 17 nt, Human
aaagcacugacuucuaa

SEQ ID NO: 3621231 - RNA, 21 nt, Human
aaagcacugacuucuaaguaa

SEQ ID NO: 3621232 - RNA, 12 nt, Human
aaagcagaaaau

SEQ ID NO: 3621233 - RNA, 16 nt, Human
aaagcagaacagugau

SEQ ID NO: 3621234 - RNA, 20 nt, Human
aaaccgccuaguuuacuguu

SEQ ID NO: 3621235 - RNA, 21 nt, Human
aaaccgcuaaaagaaacuuuc

SEQ ID NO: 3621236 - RNA, 18 nt, Human
aaaccgcuuuggccugag

SEQ ID NO: 3621237 - RNA, 15 nt, Human
aaaccguccucuuuu

SEQ ID NO: 3621238 - RNA, 15 nt, Human
aaaccuaaaaaagau

SEQ ID NO: 3621239 - RNA, 19 nt, Human
aaaccuaaguccuuuaugu

SEQ ID NO: 3621240 - RNA, 16 nt, Human
aaaccuacauauucca

SEQ ID NO: 3621241 - RNA, 11 nt, Human
aaaccuagguc

SEQ ID NO: 3621242 - RNA, 17 nt, Human
aaaccuauccucacugc

SEQ ID NO: 3621243 - RNA, 22 nt, Human
aaaccucacccgaggcugccca

SEQ ID NO: 3621244 - RNA, 19 nt, Human
aaaccucuaacccaggucu

SEQ ID NO: 3621245 - RNA, 20 nt, Human
aaaccucuaauuuauuuugu

SEQ ID NO: 3621246 - RNA, 24 nt, Human
aaaccucuaauuuauuuugucgaa

SEQ ID NO: 3621247 - RNA, 17 nt, Human
aaaccucuacauauuua

SEQ ID NO: 3621248 - RNA, 22 nt, Human
aaaccucuccucauguucugcu

SEQ ID NO: 3621249 - RNA, 16 nt, Human
aaaccucuguucagug

SEQ ID NO: 3621250 - RNA, 16 nt, Human
aaaccugaaaaaaagu

SEQ ID NO: 3621251 - RNA, 18 nt, Human
aaaccugaccccugcuca

SEQ ID NO: 3621252 - RNA, 14 nt, Human
aaaccugcccugcc

SEQ ID NO: 3621253 - RNA, 11 nt, Human
aaaccuggaga

SEQ ID NO: 3621254 - RNA, 19 nt, Human
aaaccuggagaugguggau

SEQ ID NO: 3621255 - RNA, 15 nt, Human
aaaccuggaugucac

SEQ ID NO: 3621256 - RNA, 18 nt, Human
aaaccugggauucaggaa

SEQ ID NO: 3621257 - RNA, 18 nt, Human
aaaccugggcucugguuu

SEQ ID NO: 3621258 - RNA, 18 nt, Human
aaaccugucaaugauaca

SEQ ID NO: 3621259 - RNA, 18 nt, Human
aaaccugucuccacugug

SEQ ID NO: 3621260 - RNA, 12 nt, Human
aaaccugucuga

SEQ ID NO: 3621261 - RNA, 12 nt, Human
aaaccugugaag

SEQ ID NO: 3621262 - RNA, 21 nt, Human
aaaccuguuuaaauauuucaa

SEQ ID NO: 3621263 - RNA, 13 nt, Human
aaaccuuaauauu

SEQ ID NO: 3621264 - RNA, 15 nt, Human
aaaccuuaauauuuc

SEQ ID NO: 3621265 - RNA, 20 nt, Human
aaaccuuauuuuuucccaaa

SEQ ID NO: 3621266 - RNA, 11 nt, Human
aaaccuucaca

SEQ ID NO: 3621267 - RNA, 19 nt, Human
aaaccuuucaaauuucaca

SEQ ID NO: 3621268 - RNA, 13 nt, Human
aaaccuuugcccc

SEQ ID NO: 3621269 - RNA, 22 nt, Human
aaaccuuuuacugguugcaugg

SEQ ID NO: 3621270 - RNA, 18 nt, Human
aaaccuuuuauauuuagu

SEQ ID NO: 3621271 - RNA, 16 nt, Human
aaacgaaacugcucua

SEQ ID NO: 3621272 - RNA, 13 nt, Human
aaacgaaagcugg

SEQ ID NO: 3621273 - RNA, 21 nt, Human
aaacgacacucucuggaagcc

SEQ ID NO: 3621274 - RNA, 16 nt, Human
aaacgauuuaauucuc

SEQ ID NO: 3621275 - RNA, 18 nt, Human
aaacgauuuaauucucuu

SEQ ID NO: 3621276 - RNA, 18 nt, Human
aaacgcgcagaugugcag

SEQ ID NO: 3621277 - RNA, 21 nt, Human
aaacgcgcagaugugcagcag

SEQ ID NO: 3621278 - RNA, 24 nt, Human
aaacgcgcagaugugcagcagauu

SEQ ID NO: 3621279 - RNA, 12 nt, Human
aaacgcuaccuc

SEQ ID NO: 3621280 - RNA, 16 nt, Human
aaacgcuccuuugugu

SEQ ID NO: 3621281 - RNA, 16 nt, Human
aaacgcugccugccca

SEQ ID NO: 3621282 - RNA, 16 nt, Human
aaacgcuucaguuguu

SEQ ID NO: 3621283 - RNA, 14 nt, Human
aaacggauuauuuu

SEQ ID NO: 3621284 - RNA, 21 nt, Human
aaacggauuauuuuuucagac

SEQ ID NO: 3621285 - RNA, 13 nt, Human
aaacggcccucuu

SEQ ID NO: 3621286 - RNA, 23 nt, Human
aaacggccucacuaggcuucugg

SEQ ID NO: 3621287 - RNA, 17 nt, Human
aaacgguuaaaacuguc

SEQ ID NO: 3621288 - RNA, 19 nt, Human
aaacgguucaguuucuucu

SEQ ID NO: 3621289 - RNA, 18 nt, Human
aaacguauaauauguaca

SEQ ID NO: 3621290 - RNA, 17 nt, Human
aaacguaugcaugugaa

SEQ ID NO: 3621291 - RNA, 23 nt, Human
aaacguccucuuuaguuuuuggu

SEQ ID NO: 3621292 - RNA, 14 nt, Human
aaacgucuuaaaua

SEQ ID NO: 3621293 - RNA, 17 nt, Human
aaacguggcugcuucaa

SEQ ID NO: 3621294 - RNA, 20 nt, Human
aaacguggcugcuucaagga

SEQ ID NO: 3621295 - RNA, 16 nt, Human
aaacgugguuacauua

SEQ ID NO: 3621296 - RNA, 16 nt, Human
aaacguguauguuuuu

SEQ ID NO: 3621297 - RNA, 18 nt, Human
aaacguguauguuuuuca

SEQ ID NO: 3621298 - RNA, 20 nt, Human
aaacguguauguuuuucagu

SEQ ID NO: 3621299 - RNA, 17 nt, Human
aaacguguugccuugaa

SEQ ID NO: 3621300 - RNA, 17 nt, Human
aaacuaaagcaauagaa

SEQ ID NO: 3621301 - RNA, 18 nt, Human
aaacuaaaucucuaauau

SEQ ID NO: 3621302 - RNA, 15 nt, Human
aaacuaauaauugca

SEQ ID NO: 3621303 - RNA, 16 nt, Human
aaacuaauauuuuaug

SEQ ID NO: 3621304 - RNA, 11 nt, Human
aaacuaaucca

SEQ ID NO: 3621305 - RNA, 20 nt, Human
aaacuaaugguccacaccca

SEQ ID NO: 3621306 - RNA, 21 nt, Human
aaacuacaaccaauggaaugu

SEQ ID NO: 3621307 - RNA, 13 nt, Human
aaacuacauuuua

SEQ ID NO: 3621308 - RNA, 15 nt, Human
aaacuacauuuuaac

SEQ ID NO: 3621309 - RNA, 16 nt, Human
aaacuacauuuuaaca

SEQ ID NO: 3621310 - RNA, 22 nt, Human
aaaggauaaagaaggaugaugu

SEQ ID NO: 3621311 - RNA, 17 nt, Human
aaaggauacuuauuuaa

SEQ ID NO: 3621312 - RNA, 21 nt, Human
aaaggauaguauuuuuaucca

SEQ ID NO: 3621313 - RNA, 13 nt, Human
aaaggauauuuaa

SEQ ID NO: 3621314 - RNA, 21 nt, Human
aaaggauauuuaagaaaauac

SEQ ID NO: 3621315 - RNA, 15 nt, Human
aaaggauauuuucuu

SEQ ID NO: 3621316 - RNA, 21 nt, Human
aaaggauguaaacagugccug

SEQ ID NO: 3621317 - RNA, 12 nt, Human
aaaggaugugau

SEQ ID NO: 3621318 - RNA, 17 nt, Human
aaaggaugugauauaua

SEQ ID NO: 3621319 - RNA, 19 nt, Human
aaaggaugugauauauaag

SEQ ID NO: 3621320 - RNA, 14 nt, Human
aaaggauuucuaga

SEQ ID NO: 3621321 - RNA, 13 nt, Human
aaaggcaaggucc

SEQ ID NO: 3621322 - RNA, 20 nt, Human
aaaggcacauggaauauauu

SEQ ID NO: 3621323 - RNA, 21 nt, Human
aaaggcacauggaauauauuu

SEQ ID NO: 3621324 - RNA, 17 nt, Human
aaaggcagcuguugucu

SEQ ID NO: 3621325 - RNA, 16 nt, Human
aaaggcaguuuucuaa

SEQ ID NO: 3621326 - RNA, 21 nt, Human
aaaggcauaagacccuaagcc

SEQ ID NO: 3621327 - RNA, 15 nt, Human
aaaggcauauugcuu

SEQ ID NO: 3621328 - RNA, 15 nt, Human
aaaggcauuagaguc

SEQ ID NO: 3621329 - RNA, 13 nt, Human
aaaggccaaacug

SEQ ID NO: 3621330 - RNA, 20 nt, Human
aaaggccagaccugcagacg

SEQ ID NO: 3621331 - RNA, 14 nt, Human
aaaggccagcuggc

SEQ ID NO: 3621332 - RNA, 12 nt, Human
aaaggcccagag

SEQ ID NO: 3621333 - RNA, 14 nt, Human
aaaggcccagcccc

SEQ ID NO: 3621334 - RNA, 17 nt, Human
aaaggcccagccccuag

SEQ ID NO: 3621335 - RNA, 13 nt, Human
aaaggccucuugu

SEQ ID NO: 3621336 - RNA, 15 nt, Human
aaaggcuccaggagc

SEQ ID NO: 3621337 - RNA, 21 nt, Human
aaaggcuccaggagcagccac

SEQ ID NO: 3621338 - RNA, 19 nt, Human
aaaggcucgauuuuguauc

SEQ ID NO: 3621339 - RNA, 13 nt, Human
aaaggcuguauuc

SEQ ID NO: 3621340 - RNA, 14 nt, Human
aaaggcuguauuca

SEQ ID NO: 3621341 - RNA, 17 nt, Human
aaaggcuuauaaaacag

SEQ ID NO: 3621342 - RNA, 13 nt, Human
aaagggaaauuga

SEQ ID NO: 3621343 - RNA, 16 nt, Human
aaagggaacugaacau

SEQ ID NO: 3621344 - RNA, 14 nt, Human
aaagggaagaaacu

SEQ ID NO: 3621345 - RNA, 20 nt, Human
aaagggacugagaaauuuau

SEQ ID NO: 3621346 - RNA, 15 nt, Human
aaagggaguuuaaaa

SEQ ID NO: 3621347 - RNA, 14 nt, Human
aaagggaguuuuug

SEQ ID NO: 3621348 - RNA, 13 nt, Human
aaagggccaggag

SEQ ID NO: 3621349 - RNA, 20 nt, Human
aaagggcccagagagggugg

SEQ ID NO: 3621350 - RNA, 16 nt, Human
aaagggcucuuuagcc

SEQ ID NO: 3621351 - RNA, 22 nt, Human
aaagggcuguuauaaucuuuca

SEQ ID NO: 3621352 - RNA, 16 nt, Human
aaaggggagagccugc

SEQ ID NO: 3621353 - RNA, 13 nt, Human
aaaggggggaggg

SEQ ID NO: 3621354 - RNA, 14 nt, Human
aaaggggggagggg

SEQ ID NO: 3621355 - RNA, 20 nt, Human
aaagggggucccagugggag

SEQ ID NO: 3621356 - RNA, 21 nt, Human
aaagggggucccagugggagg

SEQ ID NO: 3621357 - RNA, 17 nt, Human
aaaggggguccguggaa

SEQ ID NO: 3621358 - RNA, 22 nt, Human
aaagggguuggggugacaguca

SEQ ID NO: 3621359 - RNA, 18 nt, Human
aaagggugcugcuucccu

SEQ ID NO: 3621360 - RNA, 14 nt, Human
aaaggguguacuua

SEQ ID NO: 3621361 - RNA, 21 nt, Human
aaagguagcuuaccugacaca

SEQ ID NO: 3621362 - RNA, 14 nt, Human
aaagguauaauuuu

SEQ ID NO: 3621363 - RNA, 12 nt, Human
aaagguauuugg

SEQ ID NO: 3621364 - RNA, 21 nt, Human
aaagguauuuuaaucaccaag

SEQ ID NO: 3621365 - RNA, 19 nt, Human
aaaggucaccucacucagc

SEQ ID NO: 3621366 - RNA, 20 nt, Human
aaagguccacaggucuagac

SEQ ID NO: 3621367 - RNA, 18 nt, Human
aaaggucccaaggcaagg

SEQ ID NO: 3621368 - RNA, 21 nt, Human
aaaggugaguuugagcugccu

SEQ ID NO: 3621369 - RNA, 13 nt, Human
aaaggugauaaaa

SEQ ID NO: 3621370 - RNA, 14 nt, Human
aaaggugauaaaau

SEQ ID NO: 3621371 - RNA, 13 nt, Human
aaagguggccaca

SEQ ID NO: 3621372 - RNA, 21 nt, Human
aaaggugguauguguguguau

SEQ ID NO: 3621373 - RNA, 13 nt, Human
aaaggugugcugu

SEQ ID NO: 3621374 - RNA, 18 nt, Human
aaagguguugucccuucu

SEQ ID NO: 3621375 - RNA, 17 nt, Human
aaagguucacuaaagca

SEQ ID NO: 3621376 - RNA, 13 nt, Human
aaagguucuaggu

SEQ ID NO: 3621377 - RNA, 21 nt, Human
aaagguucuagguuucaaaga

SEQ ID NO: 3621378 - RNA, 19 nt, Human
aaagguugcuguuucacaa

SEQ ID NO: 3621379 - RNA, 18 nt, Human
aaagguuuaaaugaacaa

SEQ ID NO: 3621380 - RNA, 13 nt, Human
aaauaugccucuc

SEQ ID NO: 3621381 - RNA, 23 nt, Human
aaauaugccucuccuuuguauau

SEQ ID NO: 3621382 - RNA, 16 nt, Human
aaauaugccuuuuuga

SEQ ID NO: 3621383 - RNA, 19 nt, Human
aaauaugcuaauuugggga

SEQ ID NO: 3621384 - RNA, 18 nt, Human
aaauauggaacuuacauu

SEQ ID NO: 3621385 - RNA, 17 nt, Human
aaauauggaacuucuaa

SEQ ID NO: 3621386 - RNA, 18 nt, Human
aaauauggaacuucuaau

SEQ ID NO: 3621387 - RNA, 20 nt, Human
aaauauggaacuucuaauau

SEQ ID NO: 3621388 - RNA, 21 nt, Human
aaauaugguacucauuaaaaa

SEQ ID NO: 3621389 - RNA, 18 nt, Human
aaauaugucccagaaaug

SEQ ID NO: 3621390 - RNA, 12 nt, Human
aaauaugugaag

SEQ ID NO: 3621391 - RNA, 15 nt, Human
aaauaugugaaggac

SEQ ID NO: 3621392 - RNA, 20 nt, Human
aaauaugugaaggaccuuca

SEQ ID NO: 3621393 - RNA, 19 nt, Human
aaauauguugaugaaaaau

SEQ ID NO: 3621394 - RNA, 20 nt, Human
aaauauguugaugaaaaaua

SEQ ID NO: 3621395 - RNA, 21 nt, Human
aaauauguuuuuuagaucaaa

SEQ ID NO: 3621396 - RNA, 23 nt, Human
aaauauguuuuuuagaucaaaua

SEQ ID NO: 3621397 - RNA, 13 nt, Human
aaauauuaaaaga

SEQ ID NO: 3621398 - RNA, 18 nt, Human
aaauauuaaaagaaaggg

SEQ ID NO: 3621399 - RNA, 13 nt, Human
aaauauuagaugu

SEQ ID NO: 3621400 - RNA, 21 nt, Human
aaauauuagaugugauuuaau

SEQ ID NO: 3621401 - RNA, 14 nt, Human
aaauauuagcaaag

SEQ ID NO: 3621402 - RNA, 18 nt, Human
aaauauuaucuuuguaau

SEQ ID NO: 3621403 - RNA, 19 nt, Human
aaauauuaugcaaauuccc

SEQ ID NO: 3621404 - RNA, 22 nt, Human
aaauauuaugcaaauucccaga

SEQ ID NO: 3621405 - RNA, 14 nt, Human
aaauauuauguguu

SEQ ID NO: 3621406 - RNA, 13 nt, Human
aaauauuauugaa

SEQ ID NO: 3621407 - RNA, 23 nt, Human
aaauauuauuguggaaaugaaua

SEQ ID NO: 3621408 - RNA, 12 nt, Human
aaauauucagaa

SEQ ID NO: 3621409 - RNA, 13 nt, Human
aaauauucagaau

SEQ ID NO: 3621410 - RNA, 16 nt, Human
aaauauucaugcuucu

SEQ ID NO: 3621411 - RNA, 18 nt, Human
aaauauucccuagaaacu

SEQ ID NO: 3621412 - RNA, 19 nt, Human
aaauauucccuagaaacuu

SEQ ID NO: 3621413 - RNA, 16 nt, Human
aaauauuccuuugcau

SEQ ID NO: 3621414 - RNA, 20 nt, Human
aaauauucuauaugaauuua

SEQ ID NO: 3621415 - RNA, 22 nt, Human
aaauauucuauuuucauuuucu

SEQ ID NO: 3621416 - RNA, 21 nt, Human
aaauauugaggcuuuguguug

SEQ ID NO: 3621417 - RNA, 20 nt, Human
aaauauugguguugucagua

SEQ ID NO: 3621418 - RNA, 17 nt, Human
aaauauuguugacaacu

SEQ ID NO: 3621419 - RNA, 21 nt, Human
aaauauuguugacaacuguga

SEQ ID NO: 3621420 - RNA, 16 nt, Human
aaauauuguuucugca

SEQ ID NO: 3621421 - RNA, 21 nt, Human
aaauauuguuucugcauucau

SEQ ID NO: 3621422 - RNA, 22 nt, Human
aaauauuuaugaagaaaauacu

SEQ ID NO: 3621423 - RNA, 15 nt, Human
aaauauuuauucauu

SEQ ID NO: 3621424 - RNA, 23 nt, Human
aaauauuuauucauuauuuguca

SEQ ID NO: 3621425 - RNA, 15 nt, Human
aaauauuuauuuauu

SEQ ID NO: 3621426 - RNA, 13 nt, Human
aaauauuuauuuu

SEQ ID NO: 3621427 - RNA, 20 nt, Human
aaauauuuauuuuaauaaug

SEQ ID NO: 3621428 - RNA, 14 nt, Human
aaauauuucaagac

SEQ ID NO: 3621429 - RNA, 14 nt, Human
aaauauuuccuuaa

SEQ ID NO: 3621430 - RNA, 20 nt, Human
aaauauuugacuugcaugaa

SEQ ID NO: 3621431 - RNA, 16 nt, Human
aaauauuuggaaaaua

SEQ ID NO: 3621432 - RNA, 12 nt, Human
aaauauuuggag

SEQ ID NO: 3621433 - RNA, 17 nt, Human
aaauauuuggucucuau

SEQ ID NO: 3621434 - RNA, 14 nt, Human
aaauauuuguacau

SEQ ID NO: 3621435 - RNA, 15 nt, Human
aaauauuuucuauuu

SEQ ID NO: 3621436 - RNA, 16 nt, Human
aaauauuuucuggguu

SEQ ID NO: 3621437 - RNA, 21 nt, Human
aaauauuuugauaauaaauug

SEQ ID NO: 3621438 - RNA, 16 nt, Human
aaauauuuugcuaguu

SEQ ID NO: 3621439 - RNA, 12 nt, Human
aaauauuuuugg

SEQ ID NO: 3621440 - RNA, 15 nt, Human
aaauauuuuuuacag

SEQ ID NO: 3621441 - RNA, 22 nt, Human
aaauauuuuuuauauauacagu

SEQ ID NO: 3621442 - RNA, 21 nt, Human
aaauauuuuuucuuuucuauu

SEQ ID NO: 3621443 - RNA, 17 nt, Human
aaauauuuuuuuguaga

SEQ ID NO: 3621444 - RNA, 15 nt, Human
aaaucaaaaucucuc

SEQ ID NO: 3621445 - RNA, 22 nt, Human
aaaucaaauaauaccuuagaag

SEQ ID NO: 3621446 - RNA, 18 nt, Human
aaaucaaauaugcaaagc

SEQ ID NO: 3621447 - RNA, 13 nt, Human
aaaucaaaugaau

SEQ ID NO: 3621448 - RNA, 22 nt, Human
aaaucaacuuuuuauugccuuc

SEQ ID NO: 3621449 - RNA, 13 nt, Human
aaaucaauaagaa

SEQ ID NO: 3621450 - RNA, 22 nt, Human
aaaucaauacacuaguuguuuc

SEQ ID NO: 3621451 - RNA, 16 nt, Human
aaaucaauaugcagaa

SEQ ID NO: 3621452 - RNA, 20 nt, Human
aaaucaaucuguaaaacuaa

SEQ ID NO: 3621453 - RNA, 23 nt, Human
aaaucaauuacugguccaaaaga

SEQ ID NO: 3621454 - RNA, 16 nt, Human
aaaucacuuccauagu

SEQ ID NO: 3621455 - RNA, 12 nt, Human
aaaucagaaguc

SEQ ID NO: 3621456 - RNA, 18 nt, Human
aaaucagaagucaucuug

SEQ ID NO: 3621457 - RNA, 14 nt, Human
aaaucagacuauga

SEQ ID NO: 3621458 - RNA, 16 nt, Human
aaaucagagacaaaau

SEQ ID NO: 3621459 - RNA, 20 nt, Human
aaaucagccaauuauguuaa

SEQ ID NO: 3621460 - RNA, 12 nt, Human
aaaucagccugc

SEQ ID NO: 3621461 - RNA, 17 nt, Human
aaaucagguauuaaucu

SEQ ID NO: 3621462 - RNA, 19 nt, Human
aaaucagguuuucuuuuaa

SEQ ID NO: 3621463 - RNA, 19 nt, Human
aaaucaguaagagguguua

SEQ ID NO: 3621464 - RNA, 14 nt, Human
aaaucagucaagcu

SEQ ID NO: 3621465 - RNA, 21 nt, Human
aaaucaguuacuaagaagaaa

SEQ ID NO: 3621466 - RNA, 23 nt, Human
aaaucauaaacugugugcagacu

SEQ ID NO: 3621467 - RNA, 11 nt, Human
aaaucaucaag

SEQ ID NO: 3621468 - RNA, 14 nt, Human
aaaucaucaagaag

SEQ ID NO: 3621469 - RNA, 19 nt, Human
aaaucaucaagaagggcug

SEQ ID NO: 3621470 - RNA, 16 nt, Human
aaaucaucuauuuuga

SEQ ID NO: 3621471 - RNA, 16 nt, Human
aaaucauguacauuuc

SEQ ID NO: 3621472 - RNA, 23 nt, Human
aaaucauguugaucauguacuuu

SEQ ID NO: 3621473 - RNA, 12 nt, Human
aaaucauguuug

SEQ ID NO: 3621474 - RNA, 21 nt, Human
aaaucauugcuuugaagcagu

SEQ ID NO: 3621475 - RNA, 12 nt, Human
aaaucauuucug

SEQ ID NO: 3621476 - RNA, 23 nt, Human
aaaucauuucugcaucagcugcu

SEQ ID NO: 3621477 - RNA, 16 nt, Human
aaaucauuuuaggaaa

SEQ ID NO: 3621478 - RNA, 20 nt, Human
aaaucauuuuauaugucaaa

SEQ ID NO: 3621479 - RNA, 17 nt, Human
aaauccacccauauguu

SEQ ID NO: 3621480 - RNA, 19 nt, Human
aaauccacccauauguuaa

SEQ ID NO: 3621481 - RNA, 23 nt, Human
aaauccagaaacuuguucuucca

SEQ ID NO: 3621482 - RNA, 15 nt, Human
aaauccagaaagaaa

SEQ ID NO: 3621483 - RNA, 21 nt, Human
aaauccaggacccugccaggc

SEQ ID NO: 3621484 - RNA, 23 nt, Human
aaauccauaucuuaaagaaacag

SEQ ID NO: 3621485 - RNA, 23 nt, Human
aaauccauuuggaaaucuuuaaa

SEQ ID NO: 3621486 - RNA, 17 nt, Human
aaaucccauuauucaaa

SEQ ID NO: 3621487 - RNA, 21 nt, Human
aaaucccauuauucaaaguug

SEQ ID NO: 3621488 - RNA, 21 nt, Human
aaaucccauucauaacuuuca

SEQ ID NO: 3621489 - RNA, 13 nt, Human
aaauccccuucuc

SEQ ID NO: 3621490 - RNA, 15 nt, Human
aaauccgaaccuccu

SEQ ID NO: 3621491 - RNA, 19 nt, Human
aaauccgaaccuccucugu

SEQ ID NO: 3621492 - RNA, 19 nt, Human
aaauccgcucucuuccugc

SEQ ID NO: 3621493 - RNA, 17 nt, Human
aaauccuaccaaccucu

SEQ ID NO: 3621494 - RNA, 21 nt, Human
aaauccuaguuuccucuccuu

SEQ ID NO: 3621495 - RNA, 14 nt, Human
aaauccucuuccuc

SEQ ID NO: 3621496 - RNA, 21 nt, Human
aaauccucuuccucugaggcu

SEQ ID NO: 3621497 - RNA, 22 nt, Human
aaauccugcaaugaaagguacu

SEQ ID NO: 3621498 - RNA, 20 nt, Human
aaauccuguugaaaagccau

SEQ ID NO: 3621499 - RNA, 19 nt, Human
aaauccuuagaucuggcau

SEQ ID NO: 3621500 - RNA, 13 nt, Human
aaauccuuccaaa

SEQ ID NO: 3621501 - RNA, 19 nt, Human
aaauccuuuuucuuuauaa

SEQ ID NO: 3621502 - RNA, 13 nt, Human
aaaucgaugcagu

SEQ ID NO: 3621503 - RNA, 23 nt, Human
aaaucggaucuggggcucuggga

SEQ ID NO: 3621504 - RNA, 15 nt, Human
aaaucuaaaucuauu

SEQ ID NO: 3621505 - RNA, 16 nt, Human
aaaucuaaaucuauuu

SEQ ID NO: 3621506 - RNA, 14 nt, Human
aaaucuaagggaaa

SEQ ID NO: 3621507 - RNA, 17 nt, Human
aaaucuaauauuaaaaa

SEQ ID NO: 3621508 - RNA, 18 nt, Human
aaaucuaauauuaaaaau

SEQ ID NO: 3621509 - RNA, 19 nt, Human
aaaucuacacuccagugag

SEQ ID NO: 3621510 - RNA, 13 nt, Human
aaaucuaccacug

SEQ ID NO: 3621511 - RNA, 16 nt, Human
aaaucuaccuucugua

SEQ ID NO: 3621512 - RNA, 18 nt, Human
aaaucuaggaaaauauuu

SEQ ID NO: 3621513 - RNA, 17 nt, Human
aaaucuaggaaaauuau

SEQ ID NO: 3621514 - RNA, 13 nt, Human
aaaucuauagaaa

SEQ ID NO: 3621515 - RNA, 21 nt, Human
aaauauuuuuuuuucuuucag

SEQ ID NO: 3621516 - RNA, 16 nt, Human
aaaucaaaacaaguga

SEQ ID NO: 3621517 - RNA, 22 nt, Human
aaaucaaaagggccaaagaacc

SEQ ID NO: 3621518 - RNA, 13 nt, Human
aaaucaaaaucuc

SEQ ID NO: 3621519 - RNA, 17 nt, Human
aaaucaaaaucucucca

SEQ ID NO: 3621520 - RNA, 15 nt, Human
aaaucaaauaugcaa

SEQ ID NO: 3621521 - RNA, 20 nt, Human
aaaucaaaugguaucuuuug

SEQ ID NO: 3621522 - RNA, 22 nt, Human
aaaucaaauguaaaguuuaauu

SEQ ID NO: 3621523 - RNA, 18 nt, Human
aaaucaacagaagcauuu

SEQ ID NO: 3621524 - RNA, 19 nt, Human
aaaugcuaaugucaaacuu

SEQ ID NO: 3621525 - RNA, 21 nt, Human
aaaugcuaaugucaaacuuga

SEQ ID NO: 3621526 - RNA, 15 nt, Human
aaaugcuagaaaaau

SEQ ID NO: 3621527 - RNA, 15 nt, Human
aaaugcuagguucua

SEQ ID NO: 3621528 - RNA, 16 nt, Human
aaaugcuaugucauuu

SEQ ID NO: 3621529 - RNA, 19 nt, Human
aaaugcuaugucauuucau

SEQ ID NO: 3621530 - RNA, 13 nt, Human
aaaugcuccccac

SEQ ID NO: 3621531 - RNA, 13 nt, Human
aaaugaaauuuaa

SEQ ID NO: 3621532 - RNA, 17 nt, Human
aaaugaaauuuaaacau

SEQ ID NO: 3621533 - RNA, 18 nt, Human
aaaugaaauuuuaccaag

SEQ ID NO: 3621534 - RNA, 18 nt, Human
aaaugaacacaaauuaug

SEQ ID NO: 3621535 - RNA, 14 nt, Human
aaaugaacaucuau

SEQ ID NO: 3621536 - RNA, 16 nt, Human
aaaugaagaauuuaaa

SEQ ID NO: 3621537 - RNA, 19 nt, Human
aaaugaagagcuguugaug

SEQ ID NO: 3621538 - RNA, 23 nt, Human
aaaugaagauuauuuuuuaugag

SEQ ID NO: 3621539 - RNA, 14 nt, Human
aaaugaaggucuuu

SEQ ID NO: 3621540 - RNA, 22 nt, Human
aaaugaagguuaggauuuaaca

SEQ ID NO: 3621541 - RNA, 21 nt, Human
aaaugaaguaacuugucuuaa

SEQ ID NO: 3621542 - RNA, 11 nt, Human
aaaugaagugc

SEQ ID NO: 3621543 - RNA, 15 nt, Human
aaaugaauaauuucc

SEQ ID NO: 3621544 - RNA, 17 nt, Human
aaaugaauaauuuccca

SEQ ID NO: 3621545 - RNA, 16 nt, Human
aaaugaauaucuauua

SEQ ID NO: 3621546 - RNA, 19 nt, Human
aaaugaauaucuauuaaua

SEQ ID NO: 3621547 - RNA, 18 nt, Human
aaaugaauauuuugauaa

SEQ ID NO: 3621548 - RNA, 19 nt, Human
aaaugaauauuuugauaau

SEQ ID NO: 3621549 - RNA, 14 nt, Human
aaaugaaugucacu

SEQ ID NO: 3621550 - RNA, 19 nt, Human
aaaugaaugucuaaaauug

SEQ ID NO: 3621551 - RNA, 15 nt, Human
aaaugaaugugugug

SEQ ID NO: 3621552 - RNA, 17 nt, Human
aaaugaauguguguggu

SEQ ID NO: 3621553 - RNA, 22 nt, Human
aaaugaaugugugugguuuuuu

SEQ ID NO: 3621554 - RNA, 11 nt, Human
aaaugaauuuu

SEQ ID NO: 3621555 - RNA, 19 nt, Human
aaaugacaaucaugugugu

SEQ ID NO: 3621556 - RNA, 23 nt, Human
aaaugacacucauauaauuauau

SEQ ID NO: 3621557 - RNA, 15 nt, Human
aaaugacagacugaa

SEQ ID NO: 3621558 - RNA, 14 nt, Human
aaaugacaucuuuu

SEQ ID NO: 3621559 - RNA, 17 nt, Human
aaaugacaugcacugac

SEQ ID NO: 3621560 - RNA, 19 nt, Human
aaaugacaugcacugaccc

SEQ ID NO: 3621561 - RNA, 19 nt, Human
aaaugacuaaaaaacaaag

SEQ ID NO: 3621562 - RNA, 20 nt, Human
aaaugacuaaaaauauuaua

SEQ ID NO: 3621563 - RNA, 21 nt, Human
aaaugacuacuuagcauccua

SEQ ID NO: 3621564 - RNA, 16 nt, Human
aaaugagaaaucuaaa

SEQ ID NO: 3621565 - RNA, 15 nt, Human
aaaugagaacauguu

SEQ ID NO: 3621566 - RNA, 18 nt, Human
aaaugagaacauguuggu

SEQ ID NO: 3621567 - RNA, 23 nt, Human
aaaugagaacauguugguauuua

SEQ ID NO: 3621568 - RNA, 21 nt, Human
aaaugagaaggcagccaccag

SEQ ID NO: 3621569 - RNA, 20 nt, Human
aaaugagacccucguggccu

SEQ ID NO: 3621570 - RNA, 20 nt, Human
aaaugagagggcaguguuuc

SEQ ID NO: 3621571 - RNA, 13 nt, Human
aaaugagccauga

SEQ ID NO: 3621572 - RNA, 17 nt, Human
aaaugaggaauguauau

SEQ ID NO: 3621573 - RNA, 16 nt, Human
aaaugaggacauguuu

SEQ ID NO: 3621574 - RNA, 20 nt, Human
aaaugaggccauggacucug

SEQ ID NO: 3621575 - RNA, 9 nt, Human
aaaugaggg

SEQ ID NO: 3621576 - RNA, 17 nt, Human
aaaugaggucagagccu

SEQ ID NO: 3621577 - RNA, 15 nt, Human
aaaugaggucuguuu

SEQ ID NO: 3621578 - RNA, 15 nt, Human
aaaugaguaacauuu

SEQ ID NO: 3621579 - RNA, 12 nt, Human
aaaugagugugu

SEQ ID NO: 3621580 - RNA, 15 nt, Human
aaaugauagauuuga

SEQ ID NO: 3621581 - RNA, 21 nt, Human
aaaugauagauuugaccuccu

SEQ ID NO: 3621582 - RNA, 21 nt, Human
aaaugauaguugauuuucaaa

SEQ ID NO: 3621583 - RNA, 18 nt, Human
aaaugauauuaaaaauug

SEQ ID NO: 3621584 - RNA, 19 nt, Human
aaaugaucugagucccagg

SEQ ID NO: 3621585 - RNA, 16 nt, Human
aaaugaucuuuucaag

SEQ ID NO: 3621586 - RNA, 19 nt, Human
aaaugaugauguggaagaa

SEQ ID NO: 3621587 - RNA, 17 nt, Human
aaaugauuacuaaggaa

SEQ ID NO: 3621588 - RNA, 15 nt, Human
aaaugauucuuagug

SEQ ID NO: 3621589 - RNA, 16 nt, Human
aaaugauugcuuuuaa

SEQ ID NO: 3621590 - RNA, 20 nt, Human
aaaugauugcuuuuaaaauu

SEQ ID NO: 3621591 - RNA, 23 nt, Human
aaaugauugcuuuuaaaauuuua

SEQ ID NO: 3621592 - RNA, 22 nt, Human
aaaugauuguaaaauagcuugu

SEQ ID NO: 3621593 - RNA, 15 nt, Human
aaaugauuucacagu

SEQ ID NO: 3621594 - RNA, 21 nt, Human
aaaugauuuuaucugugaauu

SEQ ID NO: 3621595 - RNA, 17 nt, Human
aaaugcaaaguucugug

SEQ ID NO: 3621596 - RNA, 13 nt, Human
aaaugcaaauccu

SEQ ID NO: 3621597 - RNA, 11 nt, Human
aaaugcaauau

SEQ ID NO: 3621598 - RNA, 15 nt, Human
aaaugcaauauguau

SEQ ID NO: 3621599 - RNA, 17 nt, Human
aaaugcaauauuaaugc

SEQ ID NO: 3621600 - RNA, 15 nt, Human
aaaugcaauauuugu

SEQ ID NO: 3621601 - RNA, 15 nt, Human
aaaugcacaaugucu

SEQ ID NO: 3621602 - RNA, 16 nt, Human
aaaugcacaaugucuu

SEQ ID NO: 3621603 - RNA, 17 nt, Human
aaaugcacaaugucuug

SEQ ID NO: 3621604 - RNA, 22 nt, Human
aaaugcagggauugcugccacu

SEQ ID NO: 3621605 - RNA, 19 nt, Human
aaaugcaucuuugaugugu

SEQ ID NO: 3621606 - RNA, 21 nt, Human
aaaugcaucuuugauguguug

SEQ ID NO: 3621607 - RNA, 20 nt, Human
aaaugcauuauaggaucauu

SEQ ID NO: 3621608 - RNA, 20 nt, Human
aaaugcauuguaucgauguu

SEQ ID NO: 3621609 - RNA, 14 nt, Human
aaaugcauuucuaa

SEQ ID NO: 3621610 - RNA, 17 nt, Human
aaaugccaaauuaaaaa

SEQ ID NO: 3621611 - RNA, 18 nt, Human
aaaugccaaauuaaaaaa

SEQ ID NO: 3621612 - RNA, 18 nt, Human
aaaugcccagccccuucu

SEQ ID NO: 3621613 - RNA, 13 nt, Human
aaaugcccagcuu

SEQ ID NO: 3621614 - RNA, 22 nt, Human
aaaugcccucuucucgugccuc

SEQ ID NO: 3621615 - RNA, 16 nt, Human
aaaugccucaguguau

SEQ ID NO: 3621616 - RNA, 17 nt, Human
aaaugccucaguguauu

SEQ ID NO: 3621617 - RNA, 19 nt, Human
aaaugccucaguguauuug

SEQ ID NO: 3621618 - RNA, 21 nt, Human
aaaugccucaguguauuugua

SEQ ID NO: 3621619 - RNA, 18 nt, Human
aaaugccuuacuuuguau

SEQ ID NO: 3621620 - RNA, 22 nt, Human
aaaugccuuacuuuguaugaua

SEQ ID NO: 3621621 - RNA, 17 nt, Human
aaaugccuuugagacag

SEQ ID NO: 3621622 - RNA, 18 nt, Human
aaaugccuuugagacagu

SEQ ID NO: 3621623 - RNA, 21 nt, Human
aaaugccuuuucccaaaaugu

SEQ ID NO: 3621624 - RNA, 15 nt, Human
aaaugcgguuauaaa

SEQ ID NO: 3621625 - RNA, 22 nt, Human
aaaugcgguuauaaaaaauggu

SEQ ID NO: 3621626 - RNA, 15 nt, Human
aaaugcuaauauuaa

SEQ ID NO: 3621627 - RNA, 21 nt, Human
aaaugcuaauauuaaaaguca

SEQ ID NO: 3621628 - RNA, 18 nt, Human
aaaugcuagguucuaccu

SEQ ID NO: 3621629 - RNA, 17 nt, Human
aaaugcuaugucauuuc

SEQ ID NO: 3621630 - RNA, 20 nt, Human
aaaugcuaugucauuucaug

SEQ ID NO: 3621631 - RNA, 22 nt, Human
aaaugcucucucaaauugucag

SEQ ID NO: 3621632 - RNA, 16 nt, Human
aaaugcugaaaauugc

SEQ ID NO: 3621633 - RNA, 15 nt, Human
aaaugcugaacauug

SEQ ID NO: 3621634 - RNA, 14 nt, Human
aaaugcugauuuaa

SEQ ID NO: 3621635 - RNA, 14 nt, Human
aaaugcugccugcc

SEQ ID NO: 3621636 - RNA, 17 nt, Human
aaaugcugcgcccuucc

SEQ ID NO: 3621637 - RNA, 23 nt, Human
aaaugcugcuuuuucucaaaaug

SEQ ID NO: 3621638 - RNA, 23 nt, Human
aaaugcuggcuauagaugucuuu

SEQ ID NO: 3621639 - RNA, 19 nt, Human
aaaugcuuagaaauucagc

SEQ ID NO: 3621640 - RNA, 18 nt, Human
aaaugcuucacuguacgu

SEQ ID NO: 3621641 - RNA, 14 nt, Human
aaauggaaacagag

SEQ ID NO: 3621642 - RNA, 17 nt, Human
aaauggacguguuauga

SEQ ID NO: 3621643 - RNA, 22 nt, Human
aaauggacguguuaugacucca

SEQ ID NO: 3621644 - RNA, 21 nt, Human
aaauggacuguggugacuuug

SEQ ID NO: 3621645 - RNA, 23 nt, Human
aaauggacuguggugacuuugga

SEQ ID NO: 3621646 - RNA, 17 nt, Human
aaauggagaagcugcag

SEQ ID NO: 3621647 - RNA, 23 nt, Human
aaauggaguuggaguucauucau

SEQ ID NO: 3621648 - RNA, 19 nt, Human
aaauggauauuauuagaaa

SEQ ID NO: 3621649 - RNA, 17 nt, Human
aaauggaugcaaaguac

SEQ ID NO: 3621650 - RNA, 18 nt, Human
aaauggcaacaaacugca

SEQ ID NO: 3621651 - RNA, 20 nt, Human
aaauggcaacaaacugcaca

SEQ ID NO: 3621652 - RNA, 17 nt, Human
aaauggcaaguuuucca

SEQ ID NO: 3621653 - RNA, 16 nt, Human
aaauggcagugaugaa

SEQ ID NO: 3621654 - RNA, 16 nt, Human
aaauggccauuugcuu

SEQ ID NO: 3621655 - RNA, 23 nt, Human
aaauggccauuugcuuuuucacc

SEQ ID NO: 3621656 - RNA, 15 nt, Human
aaauggccucaugug

SEQ ID NO: 3621657 - RNA, 21 nt, Human
aaauggccucauguggcugga

SEQ ID NO: 3621658 - RNA, 23 nt, Human
aaauggcuggagugauucugaau

SEQ ID NO: 3621659 - RNA, 19 nt, Human
aaauggcuuccuggcaaua

SEQ ID NO: 3621660 - RNA, 13 nt, Human
aaaugggaacauu

SEQ ID NO: 3621661 - RNA, 16 nt, Human
aaaugggacuuaacuc

SEQ ID NO: 3621662 - RNA, 13 nt, Human
aaauggggccaga

SEQ ID NO: 3621663 - RNA, 22 nt, Human
aaauggggccagauccagccug

SEQ ID NO: 3621664 - RNA, 15 nt, Human
aaaugggggugcauu

SEQ ID NO: 3621665 - RNA, 16 nt, Human
aaaugggggugcauuu

SEQ ID NO: 3621666 - RNA, 15 nt, Human
aaauggguuuuacug

SEQ ID NO: 3621667 - RNA, 18 nt, Human
aaaugguagcauuuuaaa

SEQ ID NO: 3621668 - RNA, 16 nt, Human
aacaaacaccuucuua

SEQ ID NO: 3621669 - RNA, 15 nt, Human
aacaaacauuguguu

SEQ ID NO: 3621670 - RNA, 16 nt, Human
aacaaaccagaauccc

SEQ ID NO: 3621671 - RNA, 11 nt, Human
aacaaaccauc

SEQ ID NO: 3621672 - RNA, 21 nt, Human
aacaaacccucguuucugauu

SEQ ID NO: 3621673 - RNA, 15 nt, Human
aacaaacuauuucuu

SEQ ID NO: 3621674 - RNA, 16 nt, Human
aacaaacucguuuuuu

SEQ ID NO: 3621675 - RNA, 20 nt, Human
aacaaacucguuuuuuacaa

SEQ ID NO: 3621676 - RNA, 21 nt, Human
aacaaacugcacaugauuuca

SEQ ID NO: 3621677 - RNA, 17 nt, Human
aacaaacuguguaacug

SEQ ID NO: 3621678 - RNA, 11 nt, Human
aacaaagaaac

SEQ ID NO: 3621679 - RNA, 13 nt, Human
aacaaagaaauau

SEQ ID NO: 3621680 - RNA, 13 nt, Human
aacaaagaagguu

SEQ ID NO: 3621681 - RNA, 12 nt, Human
aacaaagacaau

SEQ ID NO: 3621682 - RNA, 14 nt, Human
aacaaagaccaauu

SEQ ID NO: 3621683 - RNA, 16 nt, Human
aacaaagaccaauuuu

SEQ ID NO: 3621684 - RNA, 19 nt, Human
aacaaagaguucaagaaau

SEQ ID NO: 3621685 - RNA, 17 nt, Human
aacaaagcacaguguua

SEQ ID NO: 3621686 - RNA, 15 nt, Human
aacaaagcagccacg

SEQ ID NO: 3621687 - RNA, 22 nt, Human
aacaaagcauuugacuuucugu

SEQ ID NO: 3621688 - RNA, 18 nt, Human
aacaaagcuguuaaacug

SEQ ID NO: 3621689 - RNA, 15 nt, Human
aacaaagcuguugau

SEQ ID NO: 3621690 - RNA, 16 nt, Human
aacaaagcuuagcagg

SEQ ID NO: 3621691 - RNA, 17 nt, Human
aacaaagcuuagcagga

SEQ ID NO: 3621692 - RNA, 19 nt, Human
aacaaaggauacuuauuua

SEQ ID NO: 3621693 - RNA, 12 nt, Human
aacaaagucuuu

SEQ ID NO: 3621694 - RNA, 18 nt, Human
aacaaagugcuaaaggaa

SEQ ID NO: 3621695 - RNA, 18 nt, Human
aacaaauaauuuuuuagu

SEQ ID NO: 3621696 - RNA, 16 nt, Human
aacaaauagucuauca

SEQ ID NO: 3621697 - RNA, 13 nt, Human
aacaaauaugcaa

SEQ ID NO: 3621698 - RNA, 18 nt, Human
aacaaauccugcauuuag

SEQ ID NO: 3621699 - RNA, 14 nt, Human
aacaaaugaagaca

SEQ ID NO: 3621700 - RNA, 17 nt, Human
aacaaaugccaaauuaa

SEQ ID NO: 3621701 - RNA, 23 nt, Human
aacaaaugccaaauuaaaaaaga

SEQ ID NO: 3621702 - RNA, 19 nt, Human
aacaaauuagguuuuguac

SEQ ID NO: 3621703 - RNA, 20 nt, Human
aacaaauuauguuacaucug

SEQ ID NO: 3621704 - RNA, 18 nt, Human
aacaaauuuacagagaca

SEQ ID NO: 3621705 - RNA, 14 nt, Human
aacaacaauuggua

SEQ ID NO: 3621706 - RNA, 20 nt, Human
aacaacagucuucauuuuuu

SEQ ID NO: 3621707 - RNA, 13 nt, Human
aacaacauguaua

SEQ ID NO: 3621708 - RNA, 20 nt, Human
aacaacauguuuccagcauu

SEQ ID NO: 3621709 - RNA, 12 nt, Human
aacaacauuuug

SEQ ID NO: 3621710 - RNA, 15 nt, Human
aacaaccacaggaau

SEQ ID NO: 3621711 - RNA, 14 nt, Human
aacaaccucaacug

SEQ ID NO: 3621712 - RNA, 18 nt, Human
aacaaccucaacugccua

SEQ ID NO: 3621713 - RNA, 14 nt, Human
aacaacuacuacuu

SEQ ID NO: 3621714 - RNA, 16 nt, Human
aacaacuaggcuucag

SEQ ID NO: 3621715 - RNA, 11 nt, Human
aacaagaaaaa

SEQ ID NO: 3621716 - RNA, 18 nt, Human
aacaagaaaaauaaagaa

SEQ ID NO: 3621717 - RNA, 19 nt, Human
aacaagaaaaauaaagaaa

SEQ ID NO: 3621718 - RNA, 13 nt, Human
aacaagaagauga

SEQ ID NO: 3621719 - RNA, 19 nt, Human
aacaagaagggacugagag

SEQ ID NO: 3621720 - RNA, 15 nt, Human
aacaagaaugcauug

SEQ ID NO: 3621721 - RNA, 17 nt, Human
aacaagaaugcauugau

SEQ ID NO: 3621722 - RNA, 12 nt, Human
aacaagaauugg

SEQ ID NO: 3621723 - RNA, 19 nt, Human
aacaagagcgaaacuccgu

SEQ ID NO: 3621724 - RNA, 19 nt, Human
aacaagaucuuucaggaaa

SEQ ID NO: 3621725 - RNA, 18 nt, Human
aacaagccaagaaagaug

SEQ ID NO: 3621726 - RNA, 14 nt, Human
aacaagcccaaagc

SEQ ID NO: 3621727 - RNA, 14 nt, Human
aacaagcuaggugc

SEQ ID NO: 3621728 - RNA, 14 nt, Human
aacaaggaagucaa

SEQ ID NO: 3621729 - RNA, 20 nt, Human
aacaagggagagaccucauc

SEQ ID NO: 3621730 - RNA, 14 nt, Human
aacaagggcagugg

SEQ ID NO: 3621731 - RNA, 19 nt, Human
aacaaggggcuguuacaua

SEQ ID NO: 3621732 - RNA, 13 nt, Human
aacaccagccccu

SEQ ID NO: 3621733 - RNA, 22 nt, Human
aacaccagccccugccccagcc

SEQ ID NO: 3621734 - RNA, 19 nt, Human
aacaccauugaaggcuuaa

SEQ ID NO: 3621735 - RNA, 21 nt, Human
aacacccauuuuuccuuuugc

SEQ ID NO: 3621736 - RNA, 14 nt, Human
aacacccuuccuuc

SEQ ID NO: 3621737 - RNA, 17 nt, Human
aacaccugauguguaca

SEQ ID NO: 3621738 - RNA, 15 nt, Human
aacaccuuaauaugc

SEQ ID NO: 3621739 - RNA, 15 nt, Human
aacacgaaacuuguu

SEQ ID NO: 3621740 - RNA, 19 nt, Human
aacacgaaacuuguuauug

SEQ ID NO: 3621741 - RNA, 13 nt, Human
aacacggccacau

SEQ ID NO: 3621742 - RNA, 14 nt, Human
aacacuaaaaauaa

SEQ ID NO: 3621743 - RNA, 13 nt, Human
aacacuaaaauuu

SEQ ID NO: 3621744 - RNA, 18 nt, Human
aacacuaaauguuaaaga

SEQ ID NO: 3621745 - RNA, 19 nt, Human
aacacuaaauguuaaagau

SEQ ID NO: 3621746 - RNA, 21 nt, Human
aacacuaaauguuaaagaugu

SEQ ID NO: 3621747 - RNA, 14 nt, Human
aacacuauauggca

SEQ ID NO: 3621748 - RNA, 18 nt, Human
aacacuauauggcagugu

SEQ ID NO: 3621749 - RNA, 20 nt, Human
aacacuauauggcagugucu

SEQ ID NO: 3621750 - RNA, 16 nt, Human
aacacuauguuuauuu

SEQ ID NO: 3621751 - RNA, 16 nt, Human
aacacuauuuuaugca

SEQ ID NO: 3621752 - RNA, 19 nt, Human
aacacuauuuucagaaucu

SEQ ID NO: 3621753 - RNA, 12 nt, Human
aacacucaccau

SEQ ID NO: 3621754 - RNA, 16 nt, Human
aacacucagaagccug

SEQ ID NO: 3621755 - RNA, 12 nt, Human
aacacucagcug

SEQ ID NO: 3621756 - RNA, 11 nt, Human
aacacucugag

SEQ ID NO: 3621757 - RNA, 12 nt, Human
aacacucugaga

SEQ ID NO: 3621758 - RNA, 22 nt, Human
aacacugauuuccccuuuugca

SEQ ID NO: 3621759 - RNA, 23 nt, Human
aacacugauuuccccuuuugcau

SEQ ID NO: 3621760 - RNA, 22 nt, Human
aacacugccagcauuucccuuc

SEQ ID NO: 3621761 - RNA, 21 nt, Human
aacacugcccucgcacggccc

SEQ ID NO: 3621762 - RNA, 12 nt, Human
aacacuggcccc

SEQ ID NO: 3621763 - RNA, 15 nt, Human
aacacuggccccuag

SEQ ID NO: 3621764 - RNA, 14 nt, Human
aacacuggggcugg

SEQ ID NO: 3621765 - RNA, 17 nt, Human
aacacuggugugaccug

SEQ ID NO: 3621766 - RNA, 20 nt, Human
aacacuggugugaccugagg

SEQ ID NO: 3621767 - RNA, 16 nt, Human
aacacugguuuuaaau

SEQ ID NO: 3621768 - RNA, 22 nt, Human
aacacugugcacaucugugucu

SEQ ID NO: 3621769 - RNA, 13 nt, Human
aacacugugcccu

SEQ ID NO: 3621770 - RNA, 18 nt, Human
aacacugugcccuggugg

SEQ ID NO: 3621771 - RNA, 21 nt, Human
aacacuguguauuguuguaaa

SEQ ID NO: 3621772 - RNA, 17 nt, Human
aacacuguucucugccc

SEQ ID NO: 3621773 - RNA, 19 nt, Human
aacacuguucucugcccuc

SEQ ID NO: 3621774 - RNA, 20 nt, Human
aacacuguucucugcccucc

SEQ ID NO: 3621775 - RNA, 22 nt, Human
aacacuuaaggguuuuagaaaa

SEQ ID NO: 3621776 - RNA, 15 nt, Human
aacacuucaauaauu

SEQ ID NO: 3621777 - RNA, 11 nt, Human
aacacuuccag

SEQ ID NO: 3621778 - RNA, 17 nt, Human
aacacuucuguccugug

SEQ ID NO: 3621779 - RNA, 13 nt, Human
aacacuugaaccu

SEQ ID NO: 3621780 - RNA, 22 nt, Human
aacacuugcccaugcuauuugu

SEQ ID NO: 3621781 - RNA, 12 nt, Human
aacacuuguaau

SEQ ID NO: 3621782 - RNA, 13 nt, Human
aacacuuuuuugg

SEQ ID NO: 3621783 - RNA, 17 nt, Human
aacagaaaaaaaacaca

SEQ ID NO: 3621784 - RNA, 10 nt, Human
aacagaaaug

SEQ ID NO: 3621785 - RNA, 12 nt, Human
aacagaaaugua

SEQ ID NO: 3621786 - RNA, 15 nt, Human
aacagaaauguacag

SEQ ID NO: 3621787 - RNA, 13 nt, Human
aacagaaauuggu

SEQ ID NO: 3621788 - RNA, 18 nt, Human
aacagaaauuguauauug

SEQ ID NO: 3621789 - RNA, 12 nt, Human
aacagaacacuu

SEQ ID NO: 3621790 - RNA, 13 nt, Human
aacagaacuaaau

SEQ ID NO: 3621791 - RNA, 15 nt, Human
aacagaacuaaaugu

SEQ ID NO: 3621792 - RNA, 16 nt, Human
aacagaacuaaauguu

SEQ ID NO: 3621793 - RNA, 18 nt, Human
aacagaacuaaauguucu

SEQ ID NO: 3621794 - RNA, 13 nt, Human
aacagaagaaaau

SEQ ID NO: 3621795 - RNA, 17 nt, Human
aacagaagcauuuguau

SEQ ID NO: 3621796 - RNA, 11 nt, Human
aacagacagga

SEQ ID NO: 3621797 - RNA, 14 nt, Human
aacagacaggagaa

SEQ ID NO: 3621798 - RNA, 11 nt, Human
aacagacauug

SEQ ID NO: 3621799 - RNA, 12 nt, Human
aacagacauugu

SEQ ID NO: 3621800 - RNA, 22 nt, Human
aacagacauuguuuugccaaca

SEQ ID NO: 3621801 - RNA, 18 nt, Human
aacagaccuaaugcuccu

SEQ ID NO: 3621802 - RNA, 18 nt, Human
aacagacuggccugagga

SEQ ID NO: 3621803 - RNA, 16 nt, Human
aacagagaaggcagga

SEQ ID NO: 3621804 - RNA, 20 nt, Human
aacagaggaagaauuuguua

SEQ ID NO: 3621805 - RNA, 12 nt, Human
aacagaggauau

SEQ ID NO: 3621806 - RNA, 16 nt, Human
aacagaguaaucuugu

SEQ ID NO: 3621807 - RNA, 20 nt, Human
aacagauaguuguguuuuua

SEQ ID NO: 3621808 - RNA, 16 nt, Human
aacagaucaauuugua

SEQ ID NO: 3621809 - RNA, 20 nt, Human
aacagaugaaaagccucugu

SEQ ID NO: 3621810 - RNA, 16 nt, Human
aacagaugaauaaacu

SEQ ID NO: 3621811 - RNA, 19 nt, Human
aacagaugaccccugccca

SEQ ID NO: 3621812 - RNA, 14 nt, Human
aacagaugcucuga

SEQ ID NO: 3621813 - RNA, 16 nt, Human
aacagauucacacugu

SEQ ID NO: 3621814 - RNA, 17 nt, Human
aacagauucuuuuaugu

SEQ ID NO: 3621815 - RNA, 17 nt, Human
aacagauuggauuuuau

SEQ ID NO: 3621816 - RNA, 14 nt, Human
aacauaacaaauaa

SEQ ID NO: 3621817 - RNA, 20 nt, Human
aacauaacccacuugucacu

SEQ ID NO: 3621818 - RNA, 13 nt, Human
aacauaagcuauu

SEQ ID NO: 3621819 - RNA, 15 nt, Human
aacauaagcuauuuu

SEQ ID NO: 3621820 - RNA, 12 nt, Human
aacauaaugaaa

SEQ ID NO: 3621821 - RNA, 12 nt, Human
aacauaauuaaa

SEQ ID NO: 3621822 - RNA, 15 nt, Human
aacauaauucuuauu

SEQ ID NO: 3621823 - RNA, 18 nt, Human
aacauaauucuuguauau

SEQ ID NO: 3621824 - RNA, 15 nt, Human
aacauacaaaugcau

SEQ ID NO: 3621825 - RNA, 21 nt, Human
aacauacaaaugcaucuuuga

SEQ ID NO: 3621826 - RNA, 16 nt, Human
aacauacauuuuguac

SEQ ID NO: 3621827 - RNA, 21 nt, Human
aacauaccccuuacaaaugaa

SEQ ID NO: 3621828 - RNA, 14 nt, Human
aacauacucccauc

SEQ ID NO: 3621829 - RNA, 23 nt, Human
aacauagaaauggaaauuuugcu

SEQ ID NO: 3621830 - RNA, 22 nt, Human
aacauagaauugcaaucuauaa

SEQ ID NO: 3621831 - RNA, 15 nt, Human
aacauagacagaaga

SEQ ID NO: 3621832 - RNA, 16 nt, Human
aacauagacagaagaa

SEQ ID NO: 3621833 - RNA, 21 nt, Human
aacauagacagaagaaacaag

SEQ ID NO: 3621834 - RNA, 17 nt, Human
aacauagccaaaaugug

SEQ ID NO: 3621835 - RNA, 17 nt, Human
aacauauaaaauaaugc

SEQ ID NO: 3621836 - RNA, 13 nt, Human
aacauauaauguu

SEQ ID NO: 3621837 - RNA, 21 nt, Human
aacauauaauguuguuauuua

SEQ ID NO: 3621838 - RNA, 12 nt, Human
aacauauauaac

SEQ ID NO: 3621839 - RNA, 12 nt, Human
aacauauaugga

SEQ ID NO: 3621840 - RNA, 17 nt, Human
aacauaugaaaauacaa

SEQ ID NO: 3621841 - RNA, 14 nt, Human
aacauaugauuuca

SEQ ID NO: 3621842 - RNA, 21 nt, Human
aacauaugauuucacuagaaa

SEQ ID NO: 3621843 - RNA, 21 nt, Human
aacauauguacauaaauugca

SEQ ID NO: 3621844 - RNA, 22 nt, Human
aacauauuuguuaaauauuuac

SEQ ID NO: 3621845 - RNA, 13 nt, Human
aacaucaauguuc

SEQ ID NO: 3621846 - RNA, 14 nt, Human
aacaucaauguuca

SEQ ID NO: 3621847 - RNA, 18 nt, Human
aacaucacaccugcccua

SEQ ID NO: 3621848 - RNA, 21 nt, Human
aacaucagguuaggcaguaua

SEQ ID NO: 3621849 - RNA, 18 nt, Human
aacaucaguuacucugaa

SEQ ID NO: 3621850 - RNA, 21 nt, Human
aacaucaucaaggcacugccu

SEQ ID NO: 3621851 - RNA, 14 nt, Human
aacaucauuccuuu

SEQ ID NO: 3621852 - RNA, 21 nt, Human
aacaucauuccuuuuuauuua

SEQ ID NO: 3621853 - RNA, 17 nt, Human
aacaucauuuuguuuuc

SEQ ID NO: 3621854 - RNA, 17 nt, Human
aacauccaaccuuccca

SEQ ID NO: 3621855 - RNA, 15 nt, Human
aacauccaauaggaa

SEQ ID NO: 3621856 - RNA, 15 nt, Human
aacauccaauauuuu

SEQ ID NO: 3621857 - RNA, 18 nt, Human
aacaucccauugcccugg

SEQ ID NO: 3621858 - RNA, 17 nt, Human
aacaucccuuuuucaau

SEQ ID NO: 3621859 - RNA, 15 nt, Human
aacauccuuccuucc

SEQ ID NO: 3621860 - RNA, 18 nt, Human
aacaucuacaaaacauua

SEQ ID NO: 3621861 - RNA, 14 nt, Human
aacaucuauucucu

SEQ ID NO: 3621862 - RNA, 21 nt, Human
aacaucugagaaaagcuuuga

SEQ ID NO: 3621863 - RNA, 15 nt, Human
aacaucuucaacaug

SEQ ID NO: 3621864 - RNA, 21 nt, Human
aacaucuugaauacucugccc

SEQ ID NO: 3621865 - RNA, 18 nt, Human
aacaucuuuccaguccuu

SEQ ID NO: 3621866 - RNA, 22 nt, Human
aacaucuuugaaauuauguaaa

SEQ ID NO: 3621867 - RNA, 12 nt, Human
aacaugaaauga

SEQ ID NO: 3621868 - RNA, 14 nt, Human
aacaugaagaccuu

SEQ ID NO: 3621869 - RNA, 18 nt, Human
aacaugaagaccuuuuuc

SEQ ID NO: 3621870 - RNA, 21 nt, Human
aacaugaagucguugugaggg

SEQ ID NO: 3621871 - RNA, 23 nt, Human
aacaugaaguguguuuccuucag

SEQ ID NO: 3621872 - RNA, 20 nt, Human
aacaugacccuaaaucuuga

SEQ ID NO: 3621873 - RNA, 20 nt, Human
aacaugacuccauagaccuu

SEQ ID NO: 3621874 - RNA, 17 nt, Human
aacaugagguucucucu

SEQ ID NO: 3621875 - RNA, 13 nt, Human
aacaugauuuggg

SEQ ID NO: 3621876 - RNA, 14 nt, Human
aacaugcacugaug

SEQ ID NO: 3621877 - RNA, 20 nt, Human
aacaugcagaacaaaugaag

SEQ ID NO: 3621878 - RNA, 15 nt, Human
aacaugcaguuugaa

SEQ ID NO: 3621879 - RNA, 22 nt, Human
aacaugcaguuugaaauucuga

SEQ ID NO: 3621880 - RNA, 22 nt, Human
aacaugcccccugcagacacgu

SEQ ID NO: 3621881 - RNA, 22 nt, Human
aacaugcuacacacugcauguu

SEQ ID NO: 3621882 - RNA, 19 nt, Human
aacaugcuguacauacuuu

SEQ ID NO: 3621883 - RNA, 20 nt, Human
aacaugcuguacauacuuuu

SEQ ID NO: 3621884 - RNA, 19 nt, Human
aacaugcuguuauuuaggu

SEQ ID NO: 3621885 - RNA, 19 nt, Human
aacauggacuuguauauuu

SEQ ID NO: 3621886 - RNA, 23 nt, Human
aacauggacuuguauauuuguac

SEQ ID NO: 3621887 - RNA, 20 nt, Human
aacauggagaaacccugucu

SEQ ID NO: 3621888 - RNA, 22 nt, Human
aacauggccuuugcuugaaaga

SEQ ID NO: 3621889 - RNA, 21 nt, Human
aacaugggcucuucacuagug

SEQ ID NO: 3621890 - RNA, 23 nt, Human
aacaugggguuggcugggcccag

SEQ ID NO: 3621891 - RNA, 22 nt, Human
aacaugguaaacgcugucccua

SEQ ID NO: 3621892 - RNA, 23 nt, Human
aacaugguuaccaugucuuucuc

SEQ ID NO: 3621893 - RNA, 20 nt, Human
aacaugguuuugaaaugcuu

SEQ ID NO: 3621894 - RNA, 19 nt, Human
aacauguaauauaaagaug

SEQ ID NO: 3621895 - RNA, 12 nt, Human
aacauguauuua

SEQ ID NO: 3621896 - RNA, 20 nt, Human
aacauguccugccuauuauc

SEQ ID NO: 3621897 - RNA, 13 nt, Human
aacaugucuccua

SEQ ID NO: 3621898 - RNA, 16 nt, Human
aacauguggcuccucc

SEQ ID NO: 3621899 - RNA, 19 nt, Human
aacagaaauuguauauugu

SEQ ID NO: 3621900 - RNA, 21 nt, Human
aacagaaauuguauauuguaa

SEQ ID NO: 3621901 - RNA, 13 nt, Human
aacagaacacuua

SEQ ID NO: 3621902 - RNA, 14 nt, Human
aacagaacagcuuc

SEQ ID NO: 3621903 - RNA, 14 nt, Human
aacagaacuaaaug

SEQ ID NO: 3621904 - RNA, 17 nt, Human
aacagaacuaaauguuc

SEQ ID NO: 3621905 - RNA, 23 nt, Human
aacagaacucgguguccccacca

SEQ ID NO: 3621906 - RNA, 15 nt, Human
aacagaacuuuuccu

SEQ ID NO: 3621907 - RNA, 20 nt, Human
aacagaagaaaauagaauug

SEQ ID NO: 3621908 - RNA, 21 nt, Human
aacagaagcauuuguauuuug

SEQ ID NO: 3621909 - RNA, 16 nt, Human
aacagaagcuuccauu

SEQ ID NO: 3621910 - RNA, 17 nt, Human
aacagaaugaaaaauga

SEQ ID NO: 3621911 - RNA, 14 nt, Human
aacagaauguuuua

SEQ ID NO: 3621912 - RNA, 18 nt, Human
aacagacaaaaacagccu

SEQ ID NO: 3621913 - RNA, 17 nt, Human
aacagacaagugacugu

SEQ ID NO: 3621914 - RNA, 19 nt, Human
aacagacaccaucuuuugu

SEQ ID NO: 3621915 - RNA, 15 nt, Human
aacagacaggagaaa

SEQ ID NO: 3621916 - RNA, 13 nt, Human
aacagacucaggu

SEQ ID NO: 3621917 - RNA, 19 nt, Human
aacagacucgauucauauu

SEQ ID NO: 3621918 - RNA, 23 nt, Human
aacagacuggccugaggagcagc

SEQ ID NO: 3621919 - RNA, 15 nt, Human
aacagagaaggcagg

SEQ ID NO: 3621920 - RNA, 19 nt, Human
aacagagacugaauagaua

SEQ ID NO: 3621921 - RNA, 13 nt, Human
aacagaggaccag

SEQ ID NO: 3621922 - RNA, 21 nt, Human
aacagaggccauggcagaaua

SEQ ID NO: 3621923 - RNA, 13 nt, Human
aacagauaaucag

SEQ ID NO: 3621924 - RNA, 21 nt, Human
aacagaucuggaaccucagcc

SEQ ID NO: 3621925 - RNA, 14 nt, Human
aacagaucuuuuac

SEQ ID NO: 3621926 - RNA, 17 nt, Human
aacagaugcucugagag

SEQ ID NO: 3621927 - RNA, 14 nt, Human
aacagaugcuuuuc

SEQ ID NO: 3621928 - RNA, 24 nt, Human
aacagauguuucuuuuguauguaa

SEQ ID NO: 3621929 - RNA, 17 nt, Human
aacagauuauuuuggaa

SEQ ID NO: 3621930 - RNA, 20 nt, Human
aacagauuauuuuggaaagu

SEQ ID NO: 3621931 - RNA, 15 nt, Human
aacagauucacacug

SEQ ID NO: 3621932 - RNA, 18 nt, Human
aacagauucacacugucu

SEQ ID NO: 3621933 - RNA, 16 nt, Human
aacagauuguuugcaa

SEQ ID NO: 3621934 - RNA, 13 nt, Human
aacagauuuggaa

SEQ ID NO: 3621935 - RNA, 18 nt, Human
aacagauuuggugaauuu

SEQ ID NO: 3621936 - RNA, 22 nt, Human
aacagauuuggugaauuugaau

SEQ ID NO: 3621937 - RNA, 15 nt, Human
aacagcaaaccaaga

SEQ ID NO: 3621938 - RNA, 20 nt, Human
aacagcaaaugcaaaaacuc

SEQ ID NO: 3621939 - RNA, 17 nt, Human
aacagcaacacaaagcu

SEQ ID NO: 3621940 - RNA, 22 nt, Human
aacagcaacacaaagcuuuugc

SEQ ID NO: 3621941 - RNA, 20 nt, Human
aacagcaccaaaucaaaauc

SEQ ID NO: 3621942 - RNA, 21 nt, Human
aacagcacuggcucucuccag

SEQ ID NO: 3621943 - RNA, 19 nt, Human
aacagcagacucagcucug

SEQ ID NO: 3621944 - RNA, 17 nt, Human
aacagcaggcccaccua

SEQ ID NO: 3621945 - RNA, 21 nt, Human
aacagcaggguagucugguuu

SEQ ID NO: 3621946 - RNA, 11 nt, Human
aacagcagugu

SEQ ID NO: 3621947 - RNA, 18 nt, Human
aacagcaguuucagguag

SEQ ID NO: 3621948 - RNA, 22 nt, Human
aacagcauguacggauuuucag

SEQ ID NO: 3621949 - RNA, 16 nt, Human
aacagccaacaggugg

SEQ ID NO: 3621950 - RNA, 15 nt, Human
aacagccacuccccu

SEQ ID NO: 3621951 - RNA, 18 nt, Human
aacagccacuccccucca

SEQ ID NO: 3621952 - RNA, 12 nt, Human
aacagccagcaa

SEQ ID NO: 3621953 - RNA, 17 nt, Human
aacagcccuccucugca

SEQ ID NO: 3621954 - RNA, 20 nt, Human
aacagccgcuccugucugcc

SEQ ID NO: 3621955 - RNA, 13 nt, Human
aacagccucacuu

SEQ ID NO: 3621956 - RNA, 20 nt, Human
aacagcggcuggacuuggag

SEQ ID NO: 3621957 - RNA, 23 nt, Human
aacagcguuccuagagaagacag

SEQ ID NO: 3621958 - RNA, 13 nt, Human
aacagcuacaaca

SEQ ID NO: 3621959 - RNA, 19 nt, Human
aacagcuacaacagccuca

SEQ ID NO: 3621960 - RNA, 22 nt, Human
aacauuuauuugaguggaguua

SEQ ID NO: 3621961 - RNA, 23 nt, Human
aacauuuauuuuuuuuaaagaaa

SEQ ID NO: 3621962 - RNA, 22 nt, Human
aacauuucuaacucugauguaa

SEQ ID NO: 3621963 - RNA, 15 nt, Human
aacauuucuguaaau

SEQ ID NO: 3621964 - RNA, 13 nt, Human
aacauuugccuug

SEQ ID NO: 3621965 - RNA, 17 nt, Human
aacauuugccuugcaga

SEQ ID NO: 3621966 - RNA, 18 nt, Human
aacauuugccuugcagaa

SEQ ID NO: 3621967 - RNA, 20 nt, Human
aacauuugccuugcagaacu

SEQ ID NO: 3621968 - RNA, 16 nt, Human
aacauuugcugucagc

SEQ ID NO: 3621969 - RNA, 19 nt, Human
aacauuuggguuacuauuu

SEQ ID NO: 3621970 - RNA, 12 nt, Human
aacauuugugau

SEQ ID NO: 3621971 - RNA, 22 nt, Human
aacauuuguucuauagcuuuuc

SEQ ID NO: 3621972 - RNA, 20 nt, Human
aacauuuuaaauaaaagaaa

SEQ ID NO: 3621973 - RNA, 18 nt, Human
aacauuuuaaauggacag

SEQ ID NO: 3621974 - RNA, 23 nt, Human
aacauuuuagcucuauugauacu

SEQ ID NO: 3621975 - RNA, 12 nt, Human
aacauuuucugg

SEQ ID NO: 3621976 - RNA, 18 nt, Human
aacauuuuguucuuacac

SEQ ID NO: 3621977 - RNA, 20 nt, Human
aacauuuuguucuuacacau

SEQ ID NO: 3621978 - RNA, 15 nt, Human
aacauuuuucaacaa

SEQ ID NO: 3621979 - RNA, 22 nt, Human
aacauuuuucaacaaauaucuu

SEQ ID NO: 3621980 - RNA, 19 nt, Human
aacauuuuuuuuuuaaauc

SEQ ID NO: 3621981 - RNA, 22 nt, Human
aaccaaaaguuauuaaaauugu

SEQ ID NO: 3621982 - RNA, 11 nt, Human
aaccaaaauga

SEQ ID NO: 3621983 - RNA, 17 nt, Human
aaccaaaaugacaucuu

SEQ ID NO: 3621984 - RNA, 22 nt, Human
aaccaaaaugacaucuuuuuaa

SEQ ID NO: 3621985 - RNA, 13 nt, Human
aaccaaagaagaa

SEQ ID NO: 3621986 - RNA, 16 nt, Human
aaccaaagaagaaagu

SEQ ID NO: 3621987 - RNA, 23 nt, Human
aaccaaagagacuggagcaucug

SEQ ID NO: 3621988 - RNA, 19 nt, Human
aaccaaagcgaauuuuaaa

SEQ ID NO: 3621989 - RNA, 16 nt, Human
aaccaaaggaaaaugu

SEQ ID NO: 3621990 - RNA, 23 nt, Human
aaccaaaguaaccuuuugcaccu

SEQ ID NO: 3621991 - RNA, 18 nt, Human
aaccaaaugcaaugugaa

SEQ ID NO: 3621992 - RNA, 15 nt, Human
aaccaaaugcaucaa

SEQ ID NO: 3621993 - RNA, 17 nt, Human
aaccaaaugcaucaauc

SEQ ID NO: 3621994 - RNA, 18 nt, Human
aaccaaaugcaucaaucc

SEQ ID NO: 3621995 - RNA, 23 nt, Human
aaccaaaugcaucaauccugugu

SEQ ID NO: 3621996 - RNA, 15 nt, Human
aaccaaauguuuauu

SEQ ID NO: 3621997 - RNA, 21 nt, Human
aaccaaauguuuauuuucuac

SEQ ID NO: 3621998 - RNA, 17 nt, Human
aaccaacaccaucacag

SEQ ID NO: 3621999 - RNA, 22 nt, Human
aaccaacaccaucacagcuugu

SEQ ID NO: 3622000 - RNA, 21 nt, Human
aaccaacuugguucugcuuca

SEQ ID NO: 3622001 - RNA, 16 nt, Human
aaccaagagauugcua

SEQ ID NO: 3622002 - RNA, 22 nt, Human
aaccaagagauugcuaauugcu

SEQ ID NO: 3622003 - RNA, 17 nt, Human
aaccaagaggcugguuu

SEQ ID NO: 3622004 - RNA, 21 nt, Human
aaccaagucggaacagcagau

SEQ ID NO: 3622005 - RNA, 15 nt, Human
aaccaaucaagauaa

SEQ ID NO: 3622006 - RNA, 19 nt, Human
aaccaaucaagauaaagga

SEQ ID NO: 3622007 - RNA, 19 nt, Human
aaccaauccuaugcauggu

SEQ ID NO: 3622008 - RNA, 20 nt, Human
aaccaauccuaugcaugguu

SEQ ID NO: 3622009 - RNA, 15 nt, Human
aaccaaugaacgaag

SEQ ID NO: 3622010 - RNA, 14 nt, Human
aaccaauuauuuuc

SEQ ID NO: 3622011 - RNA, 16 nt, Human
aaccaauuccucaucc

SEQ ID NO: 3622012 - RNA, 17 nt, Human
aaccaauuccucauccu

SEQ ID NO: 3622013 - RNA, 22 nt, Human
aaccaauuccucauccucagau

SEQ ID NO: 3622014 - RNA, 18 nt, Human
aaccaauuuucaaaguuc

SEQ ID NO: 3622015 - RNA, 20 nt, Human
aaccaauuuuuuguucuuca

SEQ ID NO: 3622016 - RNA, 11 nt, Human
aaccacaaagg

SEQ ID NO: 3622017 - RNA, 16 nt, Human
aaccacaacugacaca

SEQ ID NO: 3622018 - RNA, 15 nt, Human
aaccacacaaagaca

SEQ ID NO: 3622019 - RNA, 15 nt, Human
aaccacacaccucac

SEQ ID NO: 3622020 - RNA, 18 nt, Human
aaccacagcuccuuuucc

SEQ ID NO: 3622021 - RNA, 18 nt, Human
aaccacaguguaccauua

SEQ ID NO: 3622022 - RNA, 23 nt, Human
aaccacaguguaccauuaaaaua

SEQ ID NO: 3622023 - RNA, 18 nt, Human
aaccacaucuugcucugc

SEQ ID NO: 3622024 - RNA, 14 nt, Human
aaccacauugaaga

SEQ ID NO: 3622025 - RNA, 16 nt, Human
aaccacauugaagaau

SEQ ID NO: 3622026 - RNA, 22 nt, Human
aaccacauugaagaauguuaga

SEQ ID NO: 3622027 - RNA, 17 nt, Human
aaccaccagaagcccag

SEQ ID NO: 3622028 - RNA, 19 nt, Human
aaccaccagaagcccagaa

SEQ ID NO: 3622029 - RNA, 16 nt, Human
aaccaccccaucugca

SEQ ID NO: 3622030 - RNA, 15 nt, Human
aaccaccgcucccca

SEQ ID NO: 3622031 - RNA, 16 nt, Human
aaccaccgcuccccag

SEQ ID NO: 3622032 - RNA, 18 nt, Human
aaccaccgcuccccagcc

SEQ ID NO: 3622033 - RNA, 15 nt, Human
aaccacugaaaaaau

SEQ ID NO: 3622034 - RNA, 20 nt, Human
aaccacugaaaaaauauaug

SEQ ID NO: 3622035 - RNA, 14 nt, Human
aaccacugcaacgg

SEQ ID NO: 3622036 - RNA, 16 nt, Human
aaccacugcaaguccu

SEQ ID NO: 3622037 - RNA, 23 nt, Human
aaccacugcaaguccuuuuguaa

SEQ ID NO: 3622038 - RNA, 19 nt, Human
aaccacugcaauaucuucg

SEQ ID NO: 3622039 - RNA, 13 nt, Human
aaccacugcuucc

SEQ ID NO: 3622040 - RNA, 20 nt, Human
aaccacugcuuccauuuaau

SEQ ID NO: 3622041 - RNA, 22 nt, Human
aaccacuggaaaguuuaugguu

SEQ ID NO: 3622042 - RNA, 15 nt, Human
aaccacuguaaaaug

SEQ ID NO: 3622043 - RNA, 15 nt, Human
aaccacuucagcuga

SEQ ID NO: 3622044 - RNA, 14 nt, Human
aaccacuucauucu

SEQ ID NO: 3622045 - RNA, 21 nt, Human
aaccacuucccucaucucucc

SEQ ID NO: 3622046 - RNA, 20 nt, Human
aaccacuuguagauuugauu

SEQ ID NO: 3622047 - RNA, 13 nt, Human
aaccacuuuccuu

SEQ ID NO: 3622048 - RNA, 21 nt, Human
aaccacuuucuuauuuuuuuc

SEQ ID NO: 3622049 - RNA, 22 nt, Human
aaccacuuucuuauuuuuuucu

SEQ ID NO: 3622050 - RNA, 16 nt, Human
aaccagaaucccucua

SEQ ID NO: 3622051 - RNA, 12 nt, Human
aaccagacacaa

SEQ ID NO: 3622052 - RNA, 19 nt, Human
aaccagagcaagcuuuuuu

SEQ ID NO: 3622053 - RNA, 18 nt, Human
aaccagagcacuguauac

SEQ ID NO: 3622054 - RNA, 15 nt, Human
aaccagagugcugaa

SEQ ID NO: 3622055 - RNA, 12 nt, Human
aaccagaucauu

SEQ ID NO: 3622056 - RNA, 20 nt, Human
aaccagcuggucugggugua

SEQ ID NO: 3622057 - RNA, 16 nt, Human
aaccagcuuccuucag

SEQ ID NO: 3622058 - RNA, 19 nt, Human
aaccagcuuccuucagaga

SEQ ID NO: 3622059 - RNA, 18 nt, Human
aacauaaauaaaaugacc

SEQ ID NO: 3622060 - RNA, 21 nt, Human
aacauaaccauuacagggagc

SEQ ID NO: 3622061 - RNA, 17 nt, Human
aacauaacccacuuguc

SEQ ID NO: 3622062 - RNA, 22 nt, Human
aacauaagcuauuuuucuaacu

SEQ ID NO: 3622063 - RNA, 20 nt, Human
aacauaaucuucugccuucu

SEQ ID NO: 3622064 - RNA, 22 nt, Human
aacauaaucuucugccuucuca

SEQ ID NO: 3622065 - RNA, 20 nt, Human
aacauacaaaugcaucuuug

SEQ ID NO: 3622066 - RNA, 15 nt, Human
aacauaccaacaugu

SEQ ID NO: 3622067 - RNA, 17 nt, Human
aacauaccuaagaagua

SEQ ID NO: 3622068 - RNA, 16 nt, Human
aacauacucccaucug

SEQ ID NO: 3622069 - RNA, 18 nt, Human
aacauacucccaucugug

SEQ ID NO: 3622070 - RNA, 17 nt, Human
aacauacuggcugguga

SEQ ID NO: 3622071 - RNA, 15 nt, Human
aacauacuuauaugu

SEQ ID NO: 3622072 - RNA, 13 nt, Human
aacauagaaaaau

SEQ ID NO: 3622073 - RNA, 22 nt, Human
aacauagaaauugccugacgaa

SEQ ID NO: 3622074 - RNA, 21 nt, Human
aacauagaauugcaaucuaua

SEQ ID NO: 3622075 - RNA, 15 nt, Human
aacauagcugugauu

SEQ ID NO: 3622076 - RNA, 15 nt, Human
aacauauaaagcacu

SEQ ID NO: 3622077 - RNA, 14 nt, Human
aacauauaauauau

SEQ ID NO: 3622078 - RNA, 21 nt, Human
aacauauaauauauguuuuaa

SEQ ID NO: 3622079 - RNA, 15 nt, Human
aacauauauauacua

SEQ ID NO: 3622080 - RNA, 23 nt, Human
aacauauucuguaugaacuuuau

SEQ ID NO: 3622081 - RNA, 13 nt, Human
aacauauuuguua

SEQ ID NO: 3622082 - RNA, 18 nt, Human
aacaucaauguucauugu

SEQ ID NO: 3622083 - RNA, 19 nt, Human
aacaucaauguucauugua

SEQ ID NO: 3622084 - RNA, 18 nt, Human
aacaucacuauccaugca

SEQ ID NO: 3622085 - RNA, 22 nt, Human
aacaucagguuaggcaguauaa

SEQ ID NO: 3622086 - RNA, 19 nt, Human
aacaucaguuacucugaag

SEQ ID NO: 3622087 - RNA, 14 nt, Human
aacaucaucaaggc

SEQ ID NO: 3622088 - RNA, 22 nt, Human
aacaucaucaaggcacugccug

SEQ ID NO: 3622089 - RNA, 22 nt, Human
aacaucaugaauuuauugcaca

SEQ ID NO: 3622090 - RNA, 18 nt, Human
aacaucauuuuguuuucc

SEQ ID NO: 3622091 - RNA, 19 nt, Human
aacauccaaggagaaacag

SEQ ID NO: 3622092 - RNA, 13 nt, Human
aacauccacucuc

SEQ ID NO: 3622093 - RNA, 16 nt, Human
aacauccacucucucu

SEQ ID NO: 3622094 - RNA, 22 nt, Human
aacaucccaagauuuuuucauu

SEQ ID NO: 3622095 - RNA, 19 nt, Human
aacaucccauugcccuggu

SEQ ID NO: 3622096 - RNA, 15 nt, Human
aacauccuacaagac

SEQ ID NO: 3622097 - RNA, 22 nt, Human
aacauccuaucaacaacaaggu

SEQ ID NO: 3622098 - RNA, 22 nt, Human
aacauccuuugcagggcagccc

SEQ ID NO: 3622099 - RNA, 23 nt, Human
aacaucucaauaaagugcuuuaa

SEQ ID NO: 3622100 - RNA, 18 nt, Human
aacaucucaucaugucua

SEQ ID NO: 3622101 - RNA, 18 nt, Human
aacaucuuuaaggggagg

SEQ ID NO: 3622102 - RNA, 18 nt, Human
aacaucuuuauugaaauu

SEQ ID NO: 3622103 - RNA, 18 nt, Human
aacugagcuccucugggc

SEQ ID NO: 3622104 - RNA, 18 nt, Human
aacugaggaauuucaccu

SEQ ID NO: 3622105 - RNA, 16 nt, Human
aacugauaguuacugu

SEQ ID NO: 3622106 - RNA, 14 nt, Human
aacugaucauguuu

SEQ ID NO: 3622107 - RNA, 23 nt, Human
aacugaucauguuuaugagaaac

SEQ ID NO: 3622108 - RNA, 15 nt, Human
aacugaugugaaacu

SEQ ID NO: 3622109 - RNA, 17 nt, Human
aacugauucacaucuca

SEQ ID NO: 3622110 - RNA, 13 nt, Human
aacugauucauaa

SEQ ID NO: 3622111 - RNA, 19 nt, Human
aacugauuuuuuuuuccuu

SEQ ID NO: 3622112 - RNA, 21 nt, Human
aacugauuuuuuuuuccuuca

SEQ ID NO: 3622113 - RNA, 13 nt, Human
aacuaucuugugu

SEQ ID NO: 3622114 - RNA, 15 nt, Human
aacuaugaaaccuuu

SEQ ID NO: 3622115 - RNA, 21 nt, Human
aacuaugauuuggaaaauaaa

SEQ ID NO: 3622116 - RNA, 23 nt, Human
aacuaugcauggugccccaggac

SEQ ID NO: 3622117 - RNA, 18 nt, Human
aacuauggaucagaauag

SEQ ID NO: 3622118 - RNA, 12 nt, Human
aacuauguacaa

SEQ ID NO: 3622119 - RNA, 15 nt, Human
aacuauguacaauau

SEQ ID NO: 3622120 - RNA, 22 nt, Human
aacuauguacaauauuuuaagc

SEQ ID NO: 3622121 - RNA, 19 nt, Human
aacuauguguuuuucucau

SEQ ID NO: 3622122 - RNA, 21 nt, Human
aacuauuaaggauguagcuuu

SEQ ID NO: 3622123 - RNA, 23 nt, Human
aacuauucaggagaguagaacag

SEQ ID NO: 3622124 - RNA, 12 nt, Human
aacuauucaguu

SEQ ID NO: 3622125 - RNA, 17 nt, Human
aacuauucaguuguguu

SEQ ID NO: 3622126 - RNA, 17 nt, Human
aacuauuuaaagaaaua

SEQ ID NO: 3622127 - RNA, 13 nt, Human
aacuauuuaucug

SEQ ID NO: 3622128 - RNA, 20 nt, Human
aacuauuuaucuguguuuuu

SEQ ID NO: 3622129 - RNA, 18 nt, Human
aacuauuucuuauauaug

SEQ ID NO: 3622130 - RNA, 19 nt, Human
aacuauuugucuuucagga

SEQ ID NO: 3622131 - RNA, 17 nt, Human
aacuauuuucaaagacu

SEQ ID NO: 3622132 - RNA, 16 nt, Human
aacucaaacacagaga

SEQ ID NO: 3622133 - RNA, 23 nt, Human
aacucaaacuucuggcucccucu

SEQ ID NO: 3622134 - RNA, 23 nt, Human
aacucaaccaaaugguacaaaac

SEQ ID NO: 3622135 - RNA, 16 nt, Human
aacucaagacaaugca

SEQ ID NO: 3622136 - RNA, 22 nt, Human
aacucaaggauaccuucuuauu

SEQ ID NO: 3622137 - RNA, 20 nt, Human
aacucaauauuuuccaugaa

SEQ ID NO: 3622138 - RNA, 13 nt, Human
aacucaaugcuuu

SEQ ID NO: 3622139 - RNA, 21 nt, Human
aacucaaugcuuuauuuguaa

SEQ ID NO: 3622140 - RNA, 20 nt, Human
aacucaccagccccacugcc

SEQ ID NO: 3622141 - RNA, 16 nt, Human
aacucaccauguaaaa

SEQ ID NO: 3622142 - RNA, 17 nt, Human
aacucaccccagcccca

SEQ ID NO: 3622143 - RNA, 22 nt, Human
aacucacccccaaggggcaguc

SEQ ID NO: 3622144 - RNA, 21 nt, Human
aacucaccuaauguuuaugag

SEQ ID NO: 3622145 - RNA, 20 nt, Human
aacucaccugcuggccccuc

SEQ ID NO: 3622146 - RNA, 20 nt, Human
aacucaccuggcaucuuaca

SEQ ID NO: 3622147 - RNA, 17 nt, Human
aacucacuccuuuuaaa

SEQ ID NO: 3622148 - RNA, 16 nt, Human
aacucacucugggcug

SEQ ID NO: 3622149 - RNA, 17 nt, Human
aacucacucugggcugu

SEQ ID NO: 3622150 - RNA, 14 nt, Human
aacucacugcucaa

SEQ ID NO: 3622151 - RNA, 22 nt, Human
aacucacugcucaagaagacau

SEQ ID NO: 3622152 - RNA, 15 nt, Human
aacucacugugauca

SEQ ID NO: 3622153 - RNA, 21 nt, Human
aacucagaaacaucaguuacu

SEQ ID NO: 3622154 - RNA, 21 nt, Human
aacucagaauuauuuuuaaaa

SEQ ID NO: 3622155 - RNA, 23 nt, Human
aacucagagaaaaaugcucccca

SEQ ID NO: 3622156 - RNA, 20 nt, Human
aacucagaucacuacugcag

SEQ ID NO: 3622157 - RNA, 17 nt, Human
aacucagaucugucuga

SEQ ID NO: 3622158 - RNA, 22 nt, Human
aacucagccucaauaagccuug

SEQ ID NO: 3622159 - RNA, 17 nt, Human
aacucaggcaaagaaaa

SEQ ID NO: 3622160 - RNA, 18 nt, Human
aacucaggcaaagaaaau

SEQ ID NO: 3622161 - RNA, 16 nt, Human
aacucagggacagagc

SEQ ID NO: 3622162 - RNA, 18 nt, Human
aacucauauuuucaugcu

SEQ ID NO: 3622163 - RNA, 22 nt, Human
aacucaucuagguaaauuacag

SEQ ID NO: 3622164 - RNA, 17 nt, Human
aacucaucugaaauguu

SEQ ID NO: 3622165 - RNA, 18 nt, Human
aacucaucugaaauguua

SEQ ID NO: 3622166 - RNA, 19 nt, Human
aacucaucugaaauguuac

SEQ ID NO: 3622167 - RNA, 20 nt, Human
aacucaucugaaauguuaca

SEQ ID NO: 3622168 - RNA, 15 nt, Human
aacucauuagacugg

SEQ ID NO: 3622169 - RNA, 24 nt, Human
aacucauuuuuguuuucauuaucu

SEQ ID NO: 3622170 - RNA, 18 nt, Human
aacuccaagguucccuug

SEQ ID NO: 3622171 - RNA, 17 nt, Human
aacuccacaucugccuu

SEQ ID NO: 3622172 - RNA, 15 nt, Human
aacuccaccaaccca

SEQ ID NO: 3622173 - RNA, 16 nt, Human
aacuccaggcccuccu

SEQ ID NO: 3622174 - RNA, 19 nt, Human
aacuccaguacuggagcuu

SEQ ID NO: 3622175 - RNA, 13 nt, Human
aacucccaagaac

SEQ ID NO: 3622176 - RNA, 22 nt, Human
aacucccagcaacacaagcugg

SEQ ID NO: 3622177 - RNA, 21 nt, Human
aacucccauuaccauguaaug

SEQ ID NO: 3622178 - RNA, 16 nt, Human
aacuccccuguuucaa

SEQ ID NO: 3622179 - RNA, 19 nt, Human
aacuccccuguuucaauca

SEQ ID NO: 3622180 - RNA, 22 nt, Human
aacuccccuguuucaaucacug

SEQ ID NO: 3622181 - RNA, 19 nt, Human
aacuccccuuccucacugc

SEQ ID NO: 3622182 - RNA, 23 nt, Human
aacuccccuuccucacugcccaa

SEQ ID NO: 3622183 - RNA, 13 nt, Human
aacucccuuucaa

SEQ ID NO: 3622184 - RNA, 14 nt, Human
aacuccgcccccag

SEQ ID NO: 3622185 - RNA, 19 nt, Human
aacuccgcccccagccuau

SEQ ID NO: 3622186 - RNA, 16 nt, Human
aacuccucauuguaaa

SEQ ID NO: 3622187 - RNA, 11 nt, Human
aacuccuccca

SEQ ID NO: 3622188 - RNA, 23 nt, Human
aacuccucgacaucacuguucau

SEQ ID NO: 3622189 - RNA, 12 nt, Human
aacuccugaccu

SEQ ID NO: 3622190 - RNA, 18 nt, Human
aacuccugaccucaggca

SEQ ID NO: 3622191 - RNA, 15 nt, Human
aacuccugggcucaa

SEQ ID NO: 3622192 - RNA, 21 nt, Human
aacuccuuuagcagguggucc

SEQ ID NO: 3622193 - RNA, 14 nt, Human
aacucgaggacugu

SEQ ID NO: 3622194 - RNA, 20 nt, Human
aacucgaggacuguauuugu

SEQ ID NO: 3622195 - RNA, 16 nt, Human
aacucgcgcucaguaa

SEQ ID NO: 3622196 - RNA, 17 nt, Human
aacucgggcucccgggu

SEQ ID NO: 3622197 - RNA, 19 nt, Human
aacucgguguccccaccau

SEQ ID NO: 3622198 - RNA, 24 nt, Human
aacucgguguccccaccaucugcu

SEQ ID NO: 3622199 - RNA, 19 nt, Human
aacucgugucuggcacagc

SEQ ID NO: 3622200 - RNA, 20 nt, Human
aacucuaaguguuugcugca

SEQ ID NO: 3622201 - RNA, 15 nt, Human
aacucuacuguguaa

SEQ ID NO: 3622202 - RNA, 12 nt, Human
aacucuagcugg

SEQ ID NO: 3622203 - RNA, 23 nt, Human
aacucuagcugggggugggccag

SEQ ID NO: 3622204 - RNA, 18 nt, Human
aacucuaucugggccugg

SEQ ID NO: 3622205 - RNA, 19 nt, Human
aacucuaucugggccuggg

SEQ ID NO: 3622206 - RNA, 24 nt, Human
aacucuauggucuuauauuuacaa

SEQ ID NO: 3622207 - RNA, 19 nt, Human
aacucuccucugcugcugg

SEQ ID NO: 3622208 - RNA, 21 nt, Human
aacucuccucugcugcuggcu

SEQ ID NO: 3622209 - RNA, 19 nt, Human
aacucucuuauugccucac

SEQ ID NO: 3622210 - RNA, 21 nt, Human
aacucucuuauugccucacuu

SEQ ID NO: 3622211 - RNA, 17 nt, Human
aacucugaacuuuggag

SEQ ID NO: 3622212 - RNA, 19 nt, Human
aacucugaauuuaucuuug

SEQ ID NO: 3622213 - RNA, 21 nt, Human
aacucugaauuuaucuuugau

SEQ ID NO: 3622214 - RNA, 22 nt, Human
aacucugaauuuaucuuugaua

SEQ ID NO: 3622215 - RNA, 13 nt, Human
aacucugagccca

SEQ ID NO: 3622216 - RNA, 16 nt, Human
aacucugcauucuagu

SEQ ID NO: 3622217 - RNA, 17 nt, Human
aacucuggcuuccaggu

SEQ ID NO: 3622218 - RNA, 18 nt, Human
aacucuggcuuccaggua

SEQ ID NO: 3622219 - RNA, 12 nt, Human
aacucugggcuc

SEQ ID NO: 3622220 - RNA, 21 nt, Human
aacucugggcugcuacccaga

SEQ ID NO: 3622221 - RNA, 12 nt, Human
aacucugguggc

SEQ ID NO: 3622222 - RNA, 18 nt, Human
aacucugguggcacagga

SEQ ID NO: 3622223 - RNA, 17 nt, Human
aacucugucuucaccug

SEQ ID NO: 3622224 - RNA, 23 nt, Human
aacucuguuacacuuuuuggaag

SEQ ID NO: 3622225 - RNA, 22 nt, Human
aacucuguugcaagugcaauaa

SEQ ID NO: 3622226 - RNA, 13 nt, Human
aacucuuaaaaau

SEQ ID NO: 3622227 - RNA, 13 nt, Human
aacucuuaucuca

SEQ ID NO: 3622228 - RNA, 19 nt, Human
aacucuucaaggucugcuu

SEQ ID NO: 3622229 - RNA, 15 nt, Human
aacucuucacucuuc

SEQ ID NO: 3622230 - RNA, 12 nt, Human
aacucuuccucc

SEQ ID NO: 3622231 - RNA, 13 nt, Human
aacucuucucauu

SEQ ID NO: 3622232 - RNA, 11 nt, Human
aacucuugauu

SEQ ID NO: 3622233 - RNA, 13 nt, Human
aacucuuucaaaa

SEQ ID NO: 3622234 - RNA, 19 nt, Human
aacucuuugaaugacaaag

SEQ ID NO: 3622235 - RNA, 11 nt, Human
aacucuuugcc

SEQ ID NO: 3622236 - RNA, 13 nt, Human
aacucuuuuaaca

SEQ ID NO: 3622237 - RNA, 11 nt, Human
aacugaaaaca

SEQ ID NO: 3622238 - RNA, 20 nt, Human
aacugaaaagacucaguguu

SEQ ID NO: 3622239 - RNA, 12 nt, Human
aacugaaaauua

SEQ ID NO: 3622240 - RNA, 17 nt, Human
aacugaaaauuauuuaa

SEQ ID NO: 3622241 - RNA, 18 nt, Human
aacugaaauuaaaacuau

SEQ ID NO: 3622242 - RNA, 21 nt, Human
aacugaacaccauugaaggcu

SEQ ID NO: 3622243 - RNA, 19 nt, Human
aacugaacucugacaacag

SEQ ID NO: 3622244 - RNA, 16 nt, Human
aacugaacuuugaaga

SEQ ID NO: 3622245 - RNA, 14 nt, Human
aacugaagagacag

SEQ ID NO: 3622246 - RNA, 18 nt, Human
aacugaagaguaaucaau

SEQ ID NO: 3622247 - RNA, 17 nt, Human
aacuguguucauuagaa

SEQ ID NO: 3622248 - RNA, 12 nt, Human
aacuguguugua

SEQ ID NO: 3622249 - RNA, 15 nt, Human
aacuguuaacuuauu

SEQ ID NO: 3622250 - RNA, 15 nt, Human
aacuguuacaguaau

SEQ ID NO: 3622251 - RNA, 15 nt, Human
aacuguuaccuaaag

SEQ ID NO: 3622252 - RNA, 16 nt, Human
aacuguuagaauguaa

SEQ ID NO: 3622253 - RNA, 20 nt, Human
aacuguuagcacuguugaug

SEQ ID NO: 3622254 - RNA, 20 nt, Human
aacuguuauuuauaaucacu

SEQ ID NO: 3622255 - RNA, 22 nt, Human
aacuguuauuuauaaucacuuu

SEQ ID NO: 3622256 - RNA, 18 nt, Human
aacuguucccaccugcug

SEQ ID NO: 3622257 - RNA, 21 nt, Human
aacuguucucuauuagacuuu

SEQ ID NO: 3622258 - RNA, 14 nt, Human
aacuguugauugca

SEQ ID NO: 3622259 - RNA, 15 nt, Human
aacuguugccagaga

SEQ ID NO: 3622260 - RNA, 17 nt, Human
aacuguugccagagaug

SEQ ID NO: 3622261 - RNA, 19 nt, Human
aacuguuggaauggauuuu

SEQ ID NO: 3622262 - RNA, 13 nt, Human
aacuguuguauaa

SEQ ID NO: 3622263 - RNA, 22 nt, Human
aacuguuugaaaacuucagaag

SEQ ID NO: 3622264 - RNA, 15 nt, Human
aacuguuuuuuaagu

SEQ ID NO: 3622265 - RNA, 17 nt, Human
aacuuaaaaauguaaau

SEQ ID NO: 3622266 - RNA, 21 nt, Human
aacuuaaaaauguaaauauuc

SEQ ID NO: 3622267 - RNA, 13 nt, Human
aacuuaaaauauu

SEQ ID NO: 3622268 - RNA, 14 nt, Human
aacuuaacauauuu

SEQ ID NO: 3622269 - RNA, 13 nt, Human
aacuuaacaugaa

SEQ ID NO: 3622270 - RNA, 18 nt, Human
aacuuaaccgcaucagaa

SEQ ID NO: 3622271 - RNA, 22 nt, Human
aacuuaaccgcaucagaagccu

SEQ ID NO: 3622272 - RNA, 21 nt, Human
aacuuaagcaaaggggacagc

SEQ ID NO: 3622273 - RNA, 22 nt, Human
aacuuaagccaauuucaaucuu

SEQ ID NO: 3622274 - RNA, 13 nt, Human
aacuuaauaauca

SEQ ID NO: 3622275 - RNA, 20 nt, Human
aacuuaauguucugaauaau

SEQ ID NO: 3622276 - RNA, 12 nt, Human
aacuuacaaaaa

SEQ ID NO: 3622277 - RNA, 17 nt, Human
aacuuauugcugauuuu

SEQ ID NO: 3622278 - RNA, 21 nt, Human
aacuuauugcugauuuuaaug

SEQ ID NO: 3622279 - RNA, 22 nt, Human
aacuuauugcugauuuuaaugg

SEQ ID NO: 3622280 - RNA, 19 nt, Human
aacuuauuugagugauuau

SEQ ID NO: 3622281 - RNA, 17 nt, Human
aacuuauuuuuuucuga

SEQ ID NO: 3622282 - RNA, 19 nt, Human
aacuuauuuuuuucugauu

SEQ ID NO: 3622283 - RNA, 20 nt, Human
aacuuauuuuuuucugauug

SEQ ID NO: 3622284 - RNA, 13 nt, Human
aacuucacucugg

SEQ ID NO: 3622285 - RNA, 14 nt, Human
aacuucagaaagac

SEQ ID NO: 3622286 - RNA, 15 nt, Human
aacuucagacacaaa

SEQ ID NO: 3622287 - RNA, 13 nt, Human
aacuucagacaua

SEQ ID NO: 3622288 - RNA, 14 nt, Human
aacuucagaguucu

SEQ ID NO: 3622289 - RNA, 13 nt, Human
aacuucagcacca

SEQ ID NO: 3622290 - RNA, 11 nt, Human
aacuucagcag

SEQ ID NO: 3622291 - RNA, 21 nt, Human
aacuucagcgguuuauauaag

SEQ ID NO: 3622292 - RNA, 13 nt, Human
aacuucaguccug

SEQ ID NO: 3622293 - RNA, 14 nt, Human
aacuucauguaauu

SEQ ID NO: 3622294 - RNA, 15 nt, Human
aacuuccaaagaaag

SEQ ID NO: 3622295 - RNA, 16 nt, Human
aacuuccaaagaaagu

SEQ ID NO: 3622296 - RNA, 18 nt, Human
aacuuccccaucuucuaa

SEQ ID NO: 3622297 - RNA, 11 nt, Human
aacuucccuga

SEQ ID NO: 3622298 - RNA, 17 nt, Human
aacuucgcaucaaaaga

SEQ ID NO: 3622299 - RNA, 16 nt, Human
aacuucuaaaacugua

SEQ ID NO: 3622300 - RNA, 14 nt, Human
aacuucuaauauau

SEQ ID NO: 3622301 - RNA, 16 nt, Human
aacuucuaauauauuu

SEQ ID NO: 3622302 - RNA, 20 nt, Human
aacuucugcaacaagcaugc

SEQ ID NO: 3622303 - RNA, 13 nt, Human
aacuucuguuuua

SEQ ID NO: 3622304 - RNA, 13 nt, Human
aacuucuuaaaua

SEQ ID NO: 3622305 - RNA, 15 nt, Human
aacuucuuaaauauc

SEQ ID NO: 3622306 - RNA, 20 nt, Human
aacuucuugcuucuuucuag

SEQ ID NO: 3622307 - RNA, 17 nt, Human
aacuucuugucagacau

SEQ ID NO: 3622308 - RNA, 15 nt, Human
aacuucuuugaauuu

SEQ ID NO: 3622309 - RNA, 15 nt, Human
aacuugaaaaauacu

SEQ ID NO: 3622310 - RNA, 21 nt, Human
aacuugaaauauccugcuuga

SEQ ID NO: 3622311 - RNA, 18 nt, Human
aacuugaaauuugaauuu

SEQ ID NO: 3622312 - RNA, 19 nt, Human
aacuugaaauuugaauuuu

SEQ ID NO: 3622313 - RNA, 14 nt, Human
aacuugaacugauu

SEQ ID NO: 3622314 - RNA, 13 nt, Human
aacuugaauaaua

SEQ ID NO: 3622315 - RNA, 15 nt, Human
aacuugacccugagc

SEQ ID NO: 3622316 - RNA, 18 nt, Human
aacuugacccugagcuga

SEQ ID NO: 3622317 - RNA, 19 nt, Human
aacuugacccugagcugac

SEQ ID NO: 3622318 - RNA, 16 nt, Human
aacuugacuccauuuc

SEQ ID NO: 3622319 - RNA, 15 nt, Human
aacuugagauguaug

SEQ ID NO: 3622320 - RNA, 22 nt, Human
aacuugagauguaugaaggcuu

SEQ ID NO: 3622321 - RNA, 15 nt, Human
aacuugagcgugaau

SEQ ID NO: 3622322 - RNA, 19 nt, Human
aacuugagcgugaaucugu

SEQ ID NO: 3622323 - RNA, 22 nt, Human
aacuugagcuuuaaaaaucauu

SEQ ID NO: 3622324 - RNA, 20 nt, Human
aacuugagggcccagagcag

SEQ ID NO: 3622325 - RNA, 22 nt, Human
aacuugagggcccagagcagga

SEQ ID NO: 3622326 - RNA, 22 nt, Human
aacuugaggguaauaaacuuag

SEQ ID NO: 3622327 - RNA, 19 nt, Human
aacuugagguggccuccuu

SEQ ID NO: 3622328 - RNA, 11 nt, Human
aacuugaugca

SEQ ID NO: 3622329 - RNA, 12 nt, Human
aacuugaugcau

SEQ ID NO: 3622330 - RNA, 21 nt, Human
aacuugcauccaacuccagga

SEQ ID NO: 3622331 - RNA, 13 nt, Human
aacuugccucuuu

SEQ ID NO: 3622332 - RNA, 22 nt, Human
aacuugccucuuuuaccugcug

SEQ ID NO: 3622333 - RNA, 23 nt, Human
aacuugccucuuuuaccugcugc

SEQ ID NO: 3622334 - RNA, 13 nt, Human
aacuugccugccu

SEQ ID NO: 3622335 - RNA, 19 nt, Human
aacuugcuuaaaugugaau

SEQ ID NO: 3622336 - RNA, 23 nt, Human
aacuuggaaaaauccagaaagaa

SEQ ID NO: 3622337 - RNA, 23 nt, Human
aacuuggaauuuguaaccucagc

SEQ ID NO: 3622338 - RNA, 17 nt, Human
aacuuggauacuuggau

SEQ ID NO: 3622339 - RNA, 13 nt, Human
aacuuggauucuc

SEQ ID NO: 3622340 - RNA, 15 nt, Human
aacuuggauuuuuga

SEQ ID NO: 3622341 - RNA, 23 nt, Human
aacuuggcucgaaucucugugcc

SEQ ID NO: 3622342 - RNA, 19 nt, Human
aacuuggcugcaggaaucu

SEQ ID NO: 3622343 - RNA, 12 nt, Human
aacuugggaacu

SEQ ID NO: 3622344 - RNA, 19 nt, Human
aacuuggggaacaagggug

SEQ ID NO: 3622345 - RNA, 20 nt, Human
aacuuggugcuuauugauau

SEQ ID NO: 3622346 - RNA, 18 nt, Human
aacuuguaaaugcuguca

SEQ ID NO: 3622347 - RNA, 16 nt, Human
aacuuguagcuguaaa

SEQ ID NO: 3622348 - RNA, 17 nt, Human
aacuuguauuaaagaca

SEQ ID NO: 3622349 - RNA, 11 nt, Human
aacuugucacu

SEQ ID NO: 3622350 - RNA, 12 nt, Human
aacuugucuuaa

SEQ ID NO: 3622351 - RNA, 22 nt, Human
aacuugucuuuggacccugagg

SEQ ID NO: 3622352 - RNA, 20 nt, Human
aacuugucuuuuucuggacu

SEQ ID NO: 3622353 - RNA, 15 nt, Human
aacuuguguaaauac

SEQ ID NO: 3622354 - RNA, 20 nt, Human
aacuuguguaaauacaauuu

SEQ ID NO: 3622355 - RNA, 13 nt, Human
aacuuuaaaccug

SEQ ID NO: 3622356 - RNA, 13 nt, Human
aacuuuaacuucu

SEQ ID NO: 3622357 - RNA, 21 nt, Human
aacuuuaaguuucaggauaca

SEQ ID NO: 3622358 - RNA, 12 nt, Human
aacuuuaauaug

SEQ ID NO: 3622359 - RNA, 14 nt, Human
aacuuuaauaugua

SEQ ID NO: 3622360 - RNA, 19 nt, Human
aacuuuaauguuuuuugcc

SEQ ID NO: 3622361 - RNA, 21 nt, Human
aacuuuaauucucuuucaaag

SEQ ID NO: 3622362 - RNA, 21 nt, Human
aacuuuaccuuuuuuauacau

SEQ ID NO: 3622363 - RNA, 23 nt, Human
aacuuuaccuuuuuuauacauaa

SEQ ID NO: 3622364 - RNA, 20 nt, Human
aacuuuacuaagaugacauu

SEQ ID NO: 3622365 - RNA, 21 nt, Human
aacuuuagcagaaucaaaaug

SEQ ID NO: 3622366 - RNA, 20 nt, Human
aacuuuaugcuaagugaaau

SEQ ID NO: 3622367 - RNA, 23 nt, Human
aacuuuauuaaauacaaaacuuc

SEQ ID NO: 3622368 - RNA, 21 nt, Human
aacuuucaagaacuuguuuaa

SEQ ID NO: 3622369 - RNA, 15 nt, Human
aacuuucaauuguca

SEQ ID NO: 3622370 - RNA, 15 nt, Human
aacuuuccuggaugu

SEQ ID NO: 3622371 - RNA, 18 nt, Human
aacuuuccuggaugucug

SEQ ID NO: 3622372 - RNA, 14 nt, Human
aacuuucucuugua

SEQ ID NO: 3622373 - RNA, 23 nt, Human
aacuuucugaguuuuucagaugu

SEQ ID NO: 3622374 - RNA, 15 nt, Human
aacuuucuguaaacu

SEQ ID NO: 3622375 - RNA, 11 nt, Human
aacuuugaaau

SEQ ID NO: 3622376 - RNA, 13 nt, Human
aacuuugaaauau

SEQ ID NO: 3622377 - RNA, 16 nt, Human
aacuuugaaauauaug

SEQ ID NO: 3622378 - RNA, 15 nt, Human
aacuuugaaguuagc

SEQ ID NO: 3622379 - RNA, 15 nt, Human
aacuuugaauaaaga

SEQ ID NO: 3622380 - RNA, 16 nt, Human
aacuuugagaucuaaa

SEQ ID NO: 3622381 - RNA, 12 nt, Human
aacuuugcuugc

SEQ ID NO: 3622382 - RNA, 21 nt, Human
aacuuugcuugcaguagauuu

SEQ ID NO: 3622383 - RNA, 19 nt, Human
aacuuuggaaccagacucu

SEQ ID NO: 3622384 - RNA, 22 nt, Human
aacuuuggagagugagcuacag

SEQ ID NO: 3622385 - RNA, 16 nt, Human
aacuuugggaaaacau

SEQ ID NO: 3622386 - RNA, 14 nt, Human
aacuuuguaaaaau

SEQ ID NO: 3622387 - RNA, 15 nt, Human
aacuuuguauaguua

SEQ ID NO: 3622388 - RNA, 22 nt, Human
aacuuuguauaguuauguaaau

SEQ ID NO: 3622389 - RNA, 20 nt, Human
aacuuuguggaugucuuccu

SEQ ID NO: 3622390 - RNA, 12 nt, Human
aacuuuguuuua

SEQ ID NO: 3622391 - RNA, 17 nt, Human
aacuuuuaguaaaguca

SEQ ID NO: 3622392 - RNA, 16 nt, Human
aagagacucuggccuc

SEQ ID NO: 3622393 - RNA, 12 nt, Human
aagagagaaaaa

SEQ ID NO: 3622394 - RNA, 18 nt, Human
aagagagaaaacuuauuu

SEQ ID NO: 3622395 - RNA, 14 nt, Human
aagagagaaaauaa

SEQ ID NO: 3622396 - RNA, 21 nt, Human
aagagagaaaauaaaaaguua

SEQ ID NO: 3622397 - RNA, 23 nt, Human
aagagagaaccuaacuguaucuu

SEQ ID NO: 3622398 - RNA, 13 nt, Human
aagagagaaugua

SEQ ID NO: 3622399 - RNA, 21 nt, Human
aagagagagaaacaaacuuuu

SEQ ID NO: 3622400 - RNA, 14 nt, Human
aagagagagcugag

SEQ ID NO: 3622401 - RNA, 22 nt, Human
aagagagcuuaaugauaauauu

SEQ ID NO: 3622402 - RNA, 14 nt, Human
aagagaggaguuca

SEQ ID NO: 3622403 - RNA, 15 nt, Human
aagagaggaguucaa

SEQ ID NO: 3622404 - RNA, 17 nt, Human
aagagaggaguucaaug

SEQ ID NO: 3622405 - RNA, 18 nt, Human
aagagaggaguucaauga

SEQ ID NO: 3622406 - RNA, 20 nt, Human
aagagaggaugugcaagcga

SEQ ID NO: 3622407 - RNA, 22 nt, Human
aagagaguauuuuuauacaaac

SEQ ID NO: 3622408 - RNA, 19 nt, Human
aagagaguuaaucaacuga

SEQ ID NO: 3622409 - RNA, 22 nt, Human
aagagaguuaaucaacugaaag

SEQ ID NO: 3622410 - RNA, 15 nt, Human
aagagauaagucuuu

SEQ ID NO: 3622411 - RNA, 12 nt, Human
aagagauauuuu

SEQ ID NO: 3622412 - RNA, 20 nt, Human
aagagauauuuuaaaaugag

SEQ ID NO: 3622413 - RNA, 22 nt, Human
aagagaucaggaagagaaggag

SEQ ID NO: 3622414 - RNA, 14 nt, Human
aagagauccaaaga

SEQ ID NO: 3622415 - RNA, 15 nt, Human
aagagauccaaagac

SEQ ID NO: 3622416 - RNA, 13 nt, Human
aagagaugaagag

SEQ ID NO: 3622417 - RNA, 14 nt, Human
aagagauugcuaau

SEQ ID NO: 3622418 - RNA, 14 nt, Human
aagagauuuaauua

SEQ ID NO: 3622419 - RNA, 15 nt, Human
aagagauuucaagag

SEQ ID NO: 3622420 - RNA, 14 nt, Human
aagagauuuuucau

SEQ ID NO: 3622421 - RNA, 13 nt, Human
aagagcaaaaaua

SEQ ID NO: 3622422 - RNA, 14 nt, Human
aagagcaaaaauau

SEQ ID NO: 3622423 - RNA, 15 nt, Human
aagagcaagucugga

SEQ ID NO: 3622424 - RNA, 16 nt, Human
aagagcacaaacauuu

SEQ ID NO: 3622425 - RNA, 13 nt, Human
aagagcacacuug

SEQ ID NO: 3622426 - RNA, 15 nt, Human
aagagcacagcccuc

SEQ ID NO: 3622427 - RNA, 19 nt, Human
aagagcacagcccucccgc

SEQ ID NO: 3622428 - RNA, 16 nt, Human
aagagcacuuaagaga

SEQ ID NO: 3622429 - RNA, 19 nt, Human
aagagcagccuguggcauc

SEQ ID NO: 3622430 - RNA, 22 nt, Human
aagagcaggacuccaggcccaa

SEQ ID NO: 3622431 - RNA, 23 nt, Human
aagagcaggcacauggaggagcu

SEQ ID NO: 3622432 - RNA, 18 nt, Human
aagagcagugguaagaau

SEQ ID NO: 3622433 - RNA, 17 nt, Human
aagagcaucaugccucu

SEQ ID NO: 3622434 - RNA, 23 nt, Human
aagagcaucaugccucugaggcc

SEQ ID NO: 3622435 - RNA, 24 nt, Human
aagagcaucaugccucugaggcca

SEQ ID NO: 3622436 - RNA, 15 nt, Human
aagagccacaggucu

SEQ ID NO: 3622437 - RNA, 22 nt, Human
aagagccacaggucuuuauguu

SEQ ID NO: 3622438 - RNA, 16 nt, Human
aagagcccaggccucc

SEQ ID NO: 3622439 - RNA, 18 nt, Human
aagagcccagucuguuga

SEQ ID NO: 3622440 - RNA, 17 nt, Human
aagagccccacucucag

SEQ ID NO: 3622441 - RNA, 18 nt, Human
aagagcccuaaguuugua

SEQ ID NO: 3622442 - RNA, 16 nt, Human
aagagcccuugccucc

SEQ ID NO: 3622443 - RNA, 14 nt, Human
aagagccggagccu

SEQ ID NO: 3622444 - RNA, 20 nt, Human
aagagccugcaggugcugcu

SEQ ID NO: 3622445 - RNA, 22 nt, Human
aagagccugcaggugcugcugc

SEQ ID NO: 3622446 - RNA, 13 nt, Human
aagagccuuaaaa

SEQ ID NO: 3622447 - RNA, 16 nt, Human
aagagccuuccaccca

SEQ ID NO: 3622448 - RNA, 21 nt, Human
aagagcgagagaucaaagaug

SEQ ID NO: 3622449 - RNA, 18 nt, Human
aagagcuacguauuuaau

SEQ ID NO: 3622450 - RNA, 15 nt, Human
aagagcuagagaaau

SEQ ID NO: 3622451 - RNA, 19 nt, Human
aagagcuagcgcugccgca

SEQ ID NO: 3622452 - RNA, 14 nt, Human
aagagcuauacagu

SEQ ID NO: 3622453 - RNA, 13 nt, Human
aagagcucuggug

SEQ ID NO: 3622454 - RNA, 19 nt, Human
aagagcuguucacagccag

SEQ ID NO: 3622455 - RNA, 14 nt, Human
aagagcuuaagaac

SEQ ID NO: 3622456 - RNA, 19 nt, Human
aagagcuuagaaacuggaa

SEQ ID NO: 3622457 - RNA, 14 nt, Human
aagagcuugcuuug

SEQ ID NO: 3622458 - RNA, 17 nt, Human
aagagcuuuacaaaaag

SEQ ID NO: 3622459 - RNA, 10 nt, Human
aagaggaaaa

SEQ ID NO: 3622460 - RNA, 19 nt, Human
aagaggaaaauauugacaa

SEQ ID NO: 3622461 - RNA, 22 nt, Human
aagaggaacagcacuggggagu

SEQ ID NO: 3622462 - RNA, 16 nt, Human
aagaggaaguucagau

SEQ ID NO: 3622463 - RNA, 17 nt, Human
aagaggaaguucagauc

SEQ ID NO: 3622464 - RNA, 20 nt, Human
aagaggaaugaaaaaagcuu

SEQ ID NO: 3622465 - RNA, 19 nt, Human
aagaggaauuacgugcucu

SEQ ID NO: 3622466 - RNA, 19 nt, Human
aagaggacucgcuuguaaa

SEQ ID NO: 3622467 - RNA, 23 nt, Human
aagaggacucgcuuguaaauacc

SEQ ID NO: 3622468 - RNA, 21 nt, Human
aagaggagcacuuccaaaauu

SEQ ID NO: 3622469 - RNA, 13 nt, Human
aagaggaggagga

SEQ ID NO: 3622470 - RNA, 17 nt, Human
aagaggaggggaagagg

SEQ ID NO: 3622471 - RNA, 21 nt, Human
aagaggaggggaagaggccug

SEQ ID NO: 3622472 - RNA, 22 nt, Human
aagaggaggggaagaggccugu

SEQ ID NO: 3622473 - RNA, 16 nt, Human
aagaggaucggaggcu

SEQ ID NO: 3622474 - RNA, 17 nt, Human
aagaggaugcugugaaa

SEQ ID NO: 3622475 - RNA, 19 nt, Human
aagaggcaagcugaaauuu

SEQ ID NO: 3622476 - RNA, 15 nt, Human
aagaggcaccugucc

SEQ ID NO: 3622477 - RNA, 16 nt, Human
aagaggcagaaaauug

SEQ ID NO: 3622478 - RNA, 11 nt, Human
aagaggcaggg

SEQ ID NO: 3622479 - RNA, 23 nt, Human
aagaggcccugucuguaccuaac

SEQ ID NO: 3622480 - RNA, 19 nt, Human
aagagguagaaaagauugg

SEQ ID NO: 3622481 - RNA, 21 nt, Human
aagagguauuuaucuuuacuu

SEQ ID NO: 3622482 - RNA, 16 nt, Human
aagaggugaccccagg

SEQ ID NO: 3622483 - RNA, 16 nt, Human
aagaggugacugggcc

SEQ ID NO: 3622484 - RNA, 17 nt, Human
aagaggugggagggccc

SEQ ID NO: 3622485 - RNA, 19 nt, Human
aagagguucucgacuggag

SEQ ID NO: 3622486 - RNA, 13 nt, Human
aagaguagaaacu

SEQ ID NO: 3622487 - RNA, 14 nt, Human
aagaguagcauuuc

SEQ ID NO: 3622488 - RNA, 14 nt, Human
aagaguaggaagac

SEQ ID NO: 3622489 - RNA, 19 nt, Human
aagaguaggaagacuuugg

SEQ ID NO: 3622490 - RNA, 16 nt, Human
aagaguaguaauagag

SEQ ID NO: 3622491 - RNA, 23 nt, Human
aagaguaguugauguugcauuuu

SEQ ID NO: 3622492 - RNA, 21 nt, Human
aagaguccauuguuuaaaaau

SEQ ID NO: 3622493 - RNA, 15 nt, Human
aagaguccucugaau

SEQ ID NO: 3622494 - RNA, 22 nt, Human
aagagucgcugugccacaggcu

SEQ ID NO: 3622495 - RNA, 14 nt, Human
aagagucuaaagau

SEQ ID NO: 3622496 - RNA, 21 nt, Human
aagagucuacccgacauaagu

SEQ ID NO: 3622497 - RNA, 20 nt, Human
aagagucuagauucaaaggu

SEQ ID NO: 3622498 - RNA, 14 nt, Human
aagagucuucaaca

SEQ ID NO: 3622499 - RNA, 22 nt, Human
aagagugaaauaccauuauuau

SEQ ID NO: 3622500 - RNA, 18 nt, Human
aagagugaauucccucac

SEQ ID NO: 3622501 - RNA, 18 nt, Human
aagagugacuaguacaaa

SEQ ID NO: 3622502 - RNA, 17 nt, Human
aagagugauugcagcuu

SEQ ID NO: 3622503 - RNA, 18 nt, Human
aagagugcaaaacauuga

SEQ ID NO: 3622504 - RNA, 22 nt, Human
aagaguggcagcuauaggaaau

SEQ ID NO: 3622505 - RNA, 15 nt, Human
aagaguggccccacc

SEQ ID NO: 3622506 - RNA, 14 nt, Human
aagaguguacuggg

SEQ ID NO: 3622507 - RNA, 15 nt, Human
aagaguguacugggg

SEQ ID NO: 3622508 - RNA, 13 nt, Human
aagaguguagaag

SEQ ID NO: 3622509 - RNA, 12 nt, Human
aagagugugugu

SEQ ID NO: 3622510 - RNA, 16 nt, Human
aagaguucccuugaaa

SEQ ID NO: 3622511 - RNA, 20 nt, Human
aagaguucccuugaaacuuu

SEQ ID NO: 3622512 - RNA, 23 nt, Human
aagaguucuuaaggauugugaua

SEQ ID NO: 3622513 - RNA, 19 nt, Human
aagaguuguguuguucuuu

SEQ ID NO: 3622514 - RNA, 15 nt, Human
aagaguuuaaaauca

SEQ ID NO: 3622515 - RNA, 18 nt, Human
aagaguuucaguuuguug

SEQ ID NO: 3622516 - RNA, 21 nt, Human
aagaguuucaguuuguuggaa

SEQ ID NO: 3622517 - RNA, 18 nt, Human
aagauaaaaaaacagcuu

SEQ ID NO: 3622518 - RNA, 17 nt, Human
aagauaaacacaagauu

SEQ ID NO: 3622519 - RNA, 13 nt, Human
aagauaaacauua

SEQ ID NO: 3622520 - RNA, 17 nt, Human
aagauaaagccagaagc

SEQ ID NO: 3622521 - RNA, 13 nt, Human
aagauaaaugugc

SEQ ID NO: 3622522 - RNA, 21 nt, Human
aagauaacaagaucuuucagg

SEQ ID NO: 3622523 - RNA, 15 nt, Human
aagauaacuugagca

SEQ ID NO: 3622524 - RNA, 19 nt, Human
aagauaaguuggaaacacu

SEQ ID NO: 3622525 - RNA, 15 nt, Human
aagauaauaauauau

SEQ ID NO: 3622526 - RNA, 22 nt, Human
aagauaaucucagugcuuuccu

SEQ ID NO: 3622527 - RNA, 13 nt, Human
aagauaauugcua

SEQ ID NO: 3622528 - RNA, 14 nt, Human
aagauacauuugua

SEQ ID NO: 3622529 - RNA, 18 nt, Human
aagauaccaucagcaaag

SEQ ID NO: 3622530 - RNA, 15 nt, Human
aagauaccuuaaaau

SEQ ID NO: 3622531 - RNA, 18 nt, Human
aagauaccuuaaaauuug

SEQ ID NO: 3622532 - RNA, 18 nt, Human
aagauaccuuuuuuuuuc

SEQ ID NO: 3622533 - RNA, 20 nt, Human
aagauaccuuuuuuuuucuu

SEQ ID NO: 3622534 - RNA, 14 nt, Human
aagauacgacuuua

SEQ ID NO: 3622535 - RNA, 14 nt, Human
aagauacugaaaua

SEQ ID NO: 3622536 - RNA, 20 nt, Human
aagauacugaaauaaacguc

SEQ ID NO: 3622537 - RNA, 23 nt, Human
aagagugauagucuuuugcuuuu

SEQ ID NO: 3622538 - RNA, 14 nt, Human
aagagugauugcag

SEQ ID NO: 3622539 - RNA, 20 nt, Human
aagagugauugcagcuuuau

SEQ ID NO: 3622540 - RNA, 17 nt, Human
aagagugcaaaacauug

SEQ ID NO: 3622541 - RNA, 14 nt, Human
aagagugcauuuuc

SEQ ID NO: 3622542 - RNA, 20 nt, Human
aagagugcgccgagucuguc

SEQ ID NO: 3622543 - RNA, 19 nt, Human
aagaguggccccaccuggc

SEQ ID NO: 3622544 - RNA, 20 nt, Human
aagagugggggagagcaggc

SEQ ID NO: 3622545 - RNA, 17 nt, Human
aagaguguaaaauauuu

SEQ ID NO: 3622546 - RNA, 12 nt, Human
aagaguguagaa

SEQ ID NO: 3622547 - RNA, 16 nt, Human
aagaguguagaagcau

SEQ ID NO: 3622548 - RNA, 18 nt, Human
aagaguguagaagcauuc

SEQ ID NO: 3622549 - RNA, 23 nt, Human
aagaguguccuaggaguauccuc

SEQ ID NO: 3622550 - RNA, 22 nt, Human
aagaguguggagucauucucau

SEQ ID NO: 3622551 - RNA, 13 nt, Human
aagagugugugug

SEQ ID NO: 3622552 - RNA, 15 nt, Human
aagaguuaagaaugu

SEQ ID NO: 3622553 - RNA, 19 nt, Human
aagaguugagugauagagc

SEQ ID NO: 3622554 - RNA, 14 nt, Human
aagaguuggcuggu

SEQ ID NO: 3622555 - RNA, 19 nt, Human
aagaguuggggacagaacu

SEQ ID NO: 3622556 - RNA, 18 nt, Human
aagaguuguguuguucuu

SEQ ID NO: 3622557 - RNA, 22 nt, Human
aagaguuguguuguucuuuucc

SEQ ID NO: 3622558 - RNA, 20 nt, Human
aagaguuugaugaggcccuc

SEQ ID NO: 3622559 - RNA, 22 nt, Human
aagaguuugaugaggcccucca

SEQ ID NO: 3622560 - RNA, 23 nt, Human
aagaguuuugggaguuguaguua

SEQ ID NO: 3622561 - RNA, 22 nt, Human
aagauaaacacaagauuggugu

SEQ ID NO: 3622562 - RNA, 18 nt, Human
aagauaaagaccagaaau

SEQ ID NO: 3622563 - RNA, 14 nt, Human
aagauaaagaugau

SEQ ID NO: 3622564 - RNA, 11 nt, Human
aagauaaagga

SEQ ID NO: 3622565 - RNA, 14 nt, Human
aagauaaaggacag

SEQ ID NO: 3622566 - RNA, 12 nt, Human
aagauaaaugug

SEQ ID NO: 3622567 - RNA, 14 nt, Human
aagauaaaugugcu

SEQ ID NO: 3622568 - RNA, 22 nt, Human
aagauaacaagaucuuucagga

SEQ ID NO: 3622569 - RNA, 13 nt, Human
aagauaaguugga

SEQ ID NO: 3622570 - RNA, 15 nt, Human
aagauaaguuggaaa

SEQ ID NO: 3622571 - RNA, 17 nt, Human
aagauaaguuggaaaca

SEQ ID NO: 3622572 - RNA, 18 nt, Human
aagauaauauuuuacaua

SEQ ID NO: 3622573 - RNA, 23 nt, Human
aagauaaucucagugcuuuccuc

SEQ ID NO: 3622574 - RNA, 21 nt, Human
aagauaaucuuagcugccaag

SEQ ID NO: 3622575 - RNA, 23 nt, Human
aagauacaguuacucagaauucu

SEQ ID NO: 3622576 - RNA, 19 nt, Human
aagauacauaaaagugcuu

SEQ ID NO: 3622577 - RNA, 15 nt, Human
aagauacaucacagu

SEQ ID NO: 3622578 - RNA, 17 nt, Human
aagauaccaucagcaaa

SEQ ID NO: 3622579 - RNA, 19 nt, Human
aagauaccuuaaaauuuga

SEQ ID NO: 3622580 - RNA, 21 nt, Human
aagauacgacuuuauuuucug

SEQ ID NO: 3622581 - RNA, 12 nt, Human
aagauacuguuu

SEQ ID NO: 3622582 - RNA, 17 nt, Human
aagauacuuaagugcug

SEQ ID NO: 3622583 - RNA, 12 nt, Human
aagauagaagaa

SEQ ID NO: 3622584 - RNA, 19 nt, Human
aagauagaguaaaaagaaa

SEQ ID NO: 3622585 - RNA, 14 nt, Human
aagauagcugugac

SEQ ID NO: 3622586 - RNA, 16 nt, Human
aagauaggcucugcac

SEQ ID NO: 3622587 - RNA, 17 nt, Human
aagauaggcucugcaca

SEQ ID NO: 3622588 - RNA, 20 nt, Human
aagauagucuuggaagcugu

SEQ ID NO: 3622589 - RNA, 14 nt, Human
aagauaguguaacu

SEQ ID NO: 3622590 - RNA, 15 nt, Human
aagauaguguaacuu

SEQ ID NO: 3622591 - RNA, 15 nt, Human
aagauauaagugcug

SEQ ID NO: 3622592 - RNA, 16 nt, Human
aagauauaagugcugu

SEQ ID NO: 3622593 - RNA, 21 nt, Human
aagauauauacacaggauccu

SEQ ID NO: 3622594 - RNA, 11 nt, Human
aagauauauua

SEQ ID NO: 3622595 - RNA, 14 nt, Human
aagauauauuaaaa

SEQ ID NO: 3622596 - RNA, 20 nt, Human
aagauauauuaaaaauauaa

SEQ ID NO: 3622597 - RNA, 19 nt, Human
aagauaugggacauuuuug

SEQ ID NO: 3622598 - RNA, 13 nt, Human
aagauauuguaca

SEQ ID NO: 3622599 - RNA, 14 nt, Human
aagauauuguucaa

SEQ ID NO: 3622600 - RNA, 13 nt, Human
aagauauuuauau

SEQ ID NO: 3622601 - RNA, 15 nt, Human
aagauauuuauauau

SEQ ID NO: 3622602 - RNA, 20 nt, Human
aagauauuugcaguuuuuca

SEQ ID NO: 3622603 - RNA, 19 nt, Human
aagauauuuuaaaaucugu

SEQ ID NO: 3622604 - RNA, 15 nt, Human
aagauauuuugcuuu

SEQ ID NO: 3622605 - RNA, 17 nt, Human
aagauauuuuuaucuuu

SEQ ID NO: 3622606 - RNA, 20 nt, Human
aagaucacugccagagauaa

SEQ ID NO: 3622607 - RNA, 23 nt, Human
aagaucacuuucucaguuuucau

SEQ ID NO: 3622608 - RNA, 15 nt, Human
aagaucacuuugcuc

SEQ ID NO: 3622609 - RNA, 18 nt, Human
aagaucacuuugcucuga

SEQ ID NO: 3622610 - RNA, 15 nt, Human
aagauccccucagga

SEQ ID NO: 3622611 - RNA, 16 nt, Human
aagauccccucaggac

SEQ ID NO: 3622612 - RNA, 22 nt, Human
aagauccuagauccuaaggguc

SEQ ID NO: 3622613 - RNA, 16 nt, Human
aagaucgcccccaccu

SEQ ID NO: 3622614 - RNA, 20 nt, Human
aagaucgcgccacugcacuc

SEQ ID NO: 3622615 - RNA, 18 nt, Human
aagaucgguuaacaaaua

SEQ ID NO: 3622616 - RNA, 19 nt, Human
aagaucgguuaacaaauaa

SEQ ID NO: 3622617 - RNA, 19 nt, Human
aagaucguucucugccuca

SEQ ID NO: 3622618 - RNA, 13 nt, Human
aagaucuacauga

SEQ ID NO: 3622619 - RNA, 23 nt, Human
aagaucugcagggggugugucug

SEQ ID NO: 3622620 - RNA, 19 nt, Human
aagaucugugcagccccgc

SEQ ID NO: 3622621 - RNA, 22 nt, Human
aagaucuguuuugaaggcaaaa

SEQ ID NO: 3622622 - RNA, 17 nt, Human
aagaucuuaaauuuugu

SEQ ID NO: 3622623 - RNA, 17 nt, Human
aagaucuuuuauuuugc

SEQ ID NO: 3622624 - RNA, 17 nt, Human
aagaugaaaauggaagu

SEQ ID NO: 3622625 - RNA, 16 nt, Human
aagaugaaagagcagu

SEQ ID NO: 3622626 - RNA, 17 nt, Human
aagaugacauugcuaag

SEQ ID NO: 3622627 - RNA, 15 nt, Human
aagaugacugagggu

SEQ ID NO: 3622628 - RNA, 20 nt, Human
aagaugagaacagauaaaga

SEQ ID NO: 3622629 - RNA, 18 nt, Human
aagaugagagaacuggag

SEQ ID NO: 3622630 - RNA, 22 nt, Human
aagaugagauuggcauggcuuu

SEQ ID NO: 3622631 - RNA, 18 nt, Human
aagaugaucuacucagaa

SEQ ID NO: 3622632 - RNA, 15 nt, Human
aagaugauuugcaau

SEQ ID NO: 3622633 - RNA, 16 nt, Human
aagaugauuugcaaug

SEQ ID NO: 3622634 - RNA, 17 nt, Human
aagaugcauuguaguuu

SEQ ID NO: 3622635 - RNA, 22 nt, Human
aagaugcauuguaguuuaacca

SEQ ID NO: 3622636 - RNA, 16 nt, Human
aagaugccacauucaa

SEQ ID NO: 3622637 - RNA, 24 nt, Human
aagaugcccacugaggaaugauga

SEQ ID NO: 3622638 - RNA, 22 nt, Human
aagaugcucagguacagagaag

SEQ ID NO: 3622639 - RNA, 22 nt, Human
aagaugcucuaucuugcucugu

SEQ ID NO: 3622640 - RNA, 17 nt, Human
aagauguguucuuauuu

SEQ ID NO: 3622641 - RNA, 14 nt, Human
aagauguuauauuu

SEQ ID NO: 3622642 - RNA, 15 nt, Human
aagauguucuggaua

SEQ ID NO: 3622643 - RNA, 20 nt, Human
aagauguucuggauaccauu

SEQ ID NO: 3622644 - RNA, 15 nt, Human
aagauguugaagaau

SEQ ID NO: 3622645 - RNA, 11 nt, Human
aagauguuugc

SEQ ID NO: 3622646 - RNA, 16 nt, Human
aagauguuugucagau

SEQ ID NO: 3622647 - RNA, 20 nt, Human
aagauuacuuagaggaaaua

SEQ ID NO: 3622648 - RNA, 11 nt, Human
aagauuagaag

SEQ ID NO: 3622649 - RNA, 13 nt, Human
aagauuagaagcu

SEQ ID NO: 3622650 - RNA, 18 nt, Human
aagauuagaagcugaaaa

SEQ ID NO: 3622651 - RNA, 21 nt, Human
aagauuagcaaggucauuucu

SEQ ID NO: 3622652 - RNA, 19 nt, Human
aagauuauaauuguugcau

SEQ ID NO: 3622653 - RNA, 20 nt, Human
aagauuauaauuguugcaua

SEQ ID NO: 3622654 - RNA, 15 nt, Human
aagauuauagauucu

SEQ ID NO: 3622655 - RNA, 17 nt, Human
aagauuauagauucuaa

SEQ ID NO: 3622656 - RNA, 17 nt, Human
aagauuauuuuauuaug

SEQ ID NO: 3622657 - RNA, 17 nt, Human
aagauucaaucccagga

SEQ ID NO: 3622658 - RNA, 23 nt, Human
aagauucacaccugacucugaaa

SEQ ID NO: 3622659 - RNA, 21 nt, Human
aagauucaccuaagagauucu

SEQ ID NO: 3622660 - RNA, 14 nt, Human
aagauucagcuagu

SEQ ID NO: 3622661 - RNA, 15 nt, Human
aagauucagguaugu

SEQ ID NO: 3622662 - RNA, 19 nt, Human
aagauucauuuuuaaucau

SEQ ID NO: 3622663 - RNA, 12 nt, Human
aagauuccaaaa

SEQ ID NO: 3622664 - RNA, 17 nt, Human
aagauuccaaaaagcac

SEQ ID NO: 3622665 - RNA, 12 nt, Human
aagauucccaga

SEQ ID NO: 3622666 - RNA, 13 nt, Human
aagauucccagag

SEQ ID NO: 3622667 - RNA, 14 nt, Human
aagauucccagaga

SEQ ID NO: 3622668 - RNA, 16 nt, Human
aagauucccaggaguu

SEQ ID NO: 3622669 - RNA, 17 nt, Human
aagauucccaggaguuc

SEQ ID NO: 3622670 - RNA, 19 nt, Human
aagauucccaggaguucug

SEQ ID NO: 3622671 - RNA, 21 nt, Human
aagauucccaggaguucugcu

SEQ ID NO: 3622672 - RNA, 21 nt, Human
aagauuccggauccuaagcau

SEQ ID NO: 3622673 - RNA, 11 nt, Human
aagauucuaaa

SEQ ID NO: 3622674 - RNA, 14 nt, Human
aagauucuaaugau

SEQ ID NO: 3622675 - RNA, 11 nt, Human
aagauucuaga

SEQ ID NO: 3622676 - RNA, 20 nt, Human
aagauucuagaucagaugcu

SEQ ID NO: 3622677 - RNA, 14 nt, Human
aagauucuagauga

SEQ ID NO: 3622678 - RNA, 11 nt, Human
aagauucuaug

SEQ ID NO: 3622679 - RNA, 17 nt, Human
aagauucuccugugcua

SEQ ID NO: 3622680 - RNA, 17 nt, Human
aagauucuugguauuug

SEQ ID NO: 3622681 - RNA, 19 nt, Human
aagauugagaaguuacuuu

SEQ ID NO: 3622682 - RNA, 21 nt, Human
aagcuaacagcaguuucaggu

SEQ ID NO: 3622683 - RNA, 20 nt, Human
aagcuaacagggaaggcagg

SEQ ID NO: 3622684 - RNA, 15 nt, Human
aagcuaauaaaauau

SEQ ID NO: 3622685 - RNA, 20 nt, Human
aagcuaauaaaauaucauuc

SEQ ID NO: 3622686 - RNA, 18 nt, Human
aagcuaauaauucuucac

SEQ ID NO: 3622687 - RNA, 23 nt, Human
aagcuaauuugcauuaaauucac

SEQ ID NO: 3622688 - RNA, 20 nt, Human
aagcuacagaagaaacuggg

SEQ ID NO: 3622689 - RNA, 14 nt, Human
aagcuacagguuac

SEQ ID NO: 3622690 - RNA, 15 nt, Human
aagcuacagguuaca

SEQ ID NO: 3622691 - RNA, 19 nt, Human
aagcuacagguuacaacag

SEQ ID NO: 3622692 - RNA, 18 nt, Human
aagcuuauuaaugcuaag

SEQ ID NO: 3622693 - RNA, 20 nt, Human
aagcuuauuaaugcuaaggg

SEQ ID NO: 3622694 - RNA, 16 nt, Human
aagcuuauuuuggaga

SEQ ID NO: 3622695 - RNA, 14 nt, Human
aagcuucaaauuaa

SEQ ID NO: 3622696 - RNA, 18 nt, Human
aagcuucaaauuaaaaca

SEQ ID NO: 3622697 - RNA, 22 nt, Human
aagcuucaugcacuuaaagaag

SEQ ID NO: 3622698 - RNA, 21 nt, Human
aagcuucauucuccuuguugu

SEQ ID NO: 3622699 - RNA, 16 nt, Human
aagcuuccaggaaaaa

SEQ ID NO: 3622700 - RNA, 18 nt, Human
aagcuuccauagcugcug

SEQ ID NO: 3622701 - RNA, 20 nt, Human
aagcuuccaugauucuauuu

SEQ ID NO: 3622702 - RNA, 21 nt, Human
aagcuuccaugauucuauuua

SEQ ID NO: 3622703 - RNA, 16 nt, Human
aagcuuccauuccaca

SEQ ID NO: 3622704 - RNA, 23 nt, Human
aagcuucccacggccuuucuagc

SEQ ID NO: 3622705 - RNA, 13 nt, Human
aagcuuccuuggc

SEQ ID NO: 3622706 - RNA, 14 nt, Human
aagcuucuaauaaa

SEQ ID NO: 3622707 - RNA, 16 nt, Human
aagcuucuaauaaauu

SEQ ID NO: 3622708 - RNA, 22 nt, Human
aagcuucuuaaaugagaaggaa

SEQ ID NO: 3622709 - RNA, 21 nt, Human
aagcuuggcagccgagcucgu

SEQ ID NO: 3622710 - RNA, 12 nt, Human
aagcuuguguau

SEQ ID NO: 3622711 - RNA, 13 nt, Human
aagcuuguguauc

SEQ ID NO: 3622712 - RNA, 22 nt, Human
aagcuuguguauccauuaucau

SEQ ID NO: 3622713 - RNA, 14 nt, Human
aagcuuuaaauuau

SEQ ID NO: 3622714 - RNA, 15 nt, Human
aagcuuuaccagcug

SEQ ID NO: 3622715 - RNA, 22 nt, Human
aagcuuuauacguguagcuaua

SEQ ID NO: 3622716 - RNA, 14 nt, Human
aagcuuuaucuauu

SEQ ID NO: 3622717 - RNA, 21 nt, Human
aagcuuuauuaccaguggcgu

SEQ ID NO: 3622718 - RNA, 20 nt, Human
aagcuuuauuucuagcuuuu

SEQ ID NO: 3622719 - RNA, 16 nt, Human
aagcuuucagaauaug

SEQ ID NO: 3622720 - RNA, 18 nt, Human
aagcuuuccugccccagg

SEQ ID NO: 3622721 - RNA, 21 nt, Human
aagcuuuccugccccaggccu

SEQ ID NO: 3622722 - RNA, 23 nt, Human
aagcuuucucugcuucagcuugc

SEQ ID NO: 3622723 - RNA, 19 nt, Human
aagcuuuggugagaaccug

SEQ ID NO: 3622724 - RNA, 22 nt, Human
aagcuuuggugagaaccugggu

SEQ ID NO: 3622725 - RNA, 18 nt, Human
aagcuuuuagaaauacug

SEQ ID NO: 3622726 - RNA, 12 nt, Human
aagcuuuuauga

SEQ ID NO: 3622727 - RNA, 13 nt, Human
aagcuuuuaugag

SEQ ID NO: 3622728 - RNA, 13 nt, Human
aagcuuuugcaua

SEQ ID NO: 3622729 - RNA, 19 nt, Human
aagcuuuugcauauugcau

SEQ ID NO: 3622730 - RNA, 13 nt, Human
aagcuuuuuggaa

SEQ ID NO: 3622731 - RNA, 15 nt, Human
aaggaaaaaaagacu

SEQ ID NO: 3622732 - RNA, 21 nt, Human
aaggaaaaaaagacucuuuuu

SEQ ID NO: 3622733 - RNA, 19 nt, Human
aaggaaaaaagagaaguau

SEQ ID NO: 3622734 - RNA, 18 nt, Human
aaggaaaaagaaaauaaa

SEQ ID NO: 3622735 - RNA, 21 nt, Human
aaggaaaaagcacaagaagcg

SEQ ID NO: 3622736 - RNA, 13 nt, Human
aaggaaaaagcuc

SEQ ID NO: 3622737 - RNA, 14 nt, Human
aaggaaaaagcucc

SEQ ID NO: 3622738 - RNA, 17 nt, Human
aaggaaaaauguguaau

SEQ ID NO: 3622739 - RNA, 13 nt, Human
aaggaaaaauuca

SEQ ID NO: 3622740 - RNA, 18 nt, Human
aaggaaaaccugaagacu

SEQ ID NO: 3622741 - RNA, 14 nt, Human
aaggaaaacugcau

SEQ ID NO: 3622742 - RNA, 17 nt, Human
aaggaaaacugcaugga

SEQ ID NO: 3622743 - RNA, 16 nt, Human
aaggaaaagaaaaaaa

SEQ ID NO: 3622744 - RNA, 20 nt, Human
aaggaaaagaaaacaaaaaa

SEQ ID NO: 3622745 - RNA, 14 nt, Human
aaggaaaaugaucu

SEQ ID NO: 3622746 - RNA, 16 nt, Human
aaggaaaccacagcug

SEQ ID NO: 3622747 - RNA, 20 nt, Human
aaggaaaccacagcugcugg

SEQ ID NO: 3622748 - RNA, 12 nt, Human
aaggaaaccuuu

SEQ ID NO: 3622749 - RNA, 18 nt, Human
aaggaaaccuuuucuugu

SEQ ID NO: 3622750 - RNA, 15 nt, Human
aaggaaagaaaacau

SEQ ID NO: 3622751 - RNA, 13 nt, Human
aaggaaagcaaua

SEQ ID NO: 3622752 - RNA, 12 nt, Human
aaggaaagcugu

SEQ ID NO: 3622753 - RNA, 14 nt, Human
aaggaaaggccuga

SEQ ID NO: 3622754 - RNA, 20 nt, Human
aaggaaauaaaaaagucucu

SEQ ID NO: 3622755 - RNA, 23 nt, Human
aaggaacaaaaaaaccacaaagg

SEQ ID NO: 3622756 - RNA, 17 nt, Human
aaggaacagcaauggug

SEQ ID NO: 3622757 - RNA, 13 nt, Human
aaggaacuugucu

SEQ ID NO: 3622758 - RNA, 17 nt, Human
aaggaagaaauuaacuu

SEQ ID NO: 3622759 - RNA, 16 nt, Human
aaggaagacaguucua

SEQ ID NO: 3622760 - RNA, 15 nt, Human
aaggaagacuucauc

SEQ ID NO: 3622761 - RNA, 22 nt, Human
aaggaagaucacuuugcucuga

SEQ ID NO: 3622762 - RNA, 13 nt, Human
aaggaagcacaug

SEQ ID NO: 3622763 - RNA, 18 nt, Human
aaggaagcauuguaaaau

SEQ ID NO: 3622764 - RNA, 23 nt, Human
aaggaagcauuguaaaauaauuc

SEQ ID NO: 3622765 - RNA, 22 nt, Human
aaggaagccacagcugguggua

SEQ ID NO: 3622766 - RNA, 15 nt, Human
aaggaagcugugcgu

SEQ ID NO: 3622767 - RNA, 22 nt, Human
aaggaagcuuucucugcuucag

SEQ ID NO: 3622768 - RNA, 11 nt, Human
aaggaaggaaa

SEQ ID NO: 3622769 - RNA, 13 nt, Human
aaggaaggaaaga

SEQ ID NO: 3622770 - RNA, 16 nt, Human
aaggaaggaaagaaag

SEQ ID NO: 3622771 - RNA, 21 nt, Human
aaggaaggcucuucuccccag

SEQ ID NO: 3622772 - RNA, 22 nt, Human
aaggaagggcauccuucugccu

SEQ ID NO: 3622773 - RNA, 18 nt, Human
aaggaagguaaaaaguua

SEQ ID NO: 3622774 - RNA, 17 nt, Human
aaggaagguggauggcc

SEQ ID NO: 3622775 - RNA, 18 nt, Human
aaggaagguggauggccc

SEQ ID NO: 3622776 - RNA, 15 nt, Human
aaggaagguucaugu

SEQ ID NO: 3622777 - RNA, 16 nt, Human
aaggaagugcccccuc

SEQ ID NO: 3622778 - RNA, 22 nt, Human
aaggaaguuacuguuauagagg

SEQ ID NO: 3622779 - RNA, 20 nt, Human
aaggaauagaucuaugauug

SEQ ID NO: 3622780 - RNA, 13 nt, Human
aaggaauauaaug

SEQ ID NO: 3622781 - RNA, 15 nt, Human
aaggaauauauggca

SEQ ID NO: 3622782 - RNA, 17 nt, Human
aaggaauauauggcaga

SEQ ID NO: 3622783 - RNA, 22 nt, Human
aaggaauauauggcagaguugu

SEQ ID NO: 3622784 - RNA, 23 nt, Human
aaggaauauauggcagaguugua

SEQ ID NO: 3622785 - RNA, 19 nt, Human
aaggaaucacguuagagga

SEQ ID NO: 3622786 - RNA, 23 nt, Human
aaggaauccacucccaggcagcc

SEQ ID NO: 3622787 - RNA, 21 nt, Human
aaggaaucuccaguuuucagu

SEQ ID NO: 3622788 - RNA, 16 nt, Human
aaggaaugcaaagaug

SEQ ID NO: 3622789 - RNA, 17 nt, Human
aaggaaugcuuggaaua

SEQ ID NO: 3622790 - RNA, 16 nt, Human
aaggaauggaggcucu

SEQ ID NO: 3622791 - RNA, 21 nt, Human
aaggaauguagcugguuuccu

SEQ ID NO: 3622792 - RNA, 18 nt, Human
aaggaauuauucccauga

SEQ ID NO: 3622793 - RNA, 23 nt, Human
aaggaauuucuuaacuucuugcu

SEQ ID NO: 3622794 - RNA, 16 nt, Human
aaggacaaagucucca

SEQ ID NO: 3622795 - RNA, 14 nt, Human
aaggacaaagugcc

SEQ ID NO: 3622796 - RNA, 19 nt, Human
aaggacaaagugccaaaga

SEQ ID NO: 3622797 - RNA, 14 nt, Human
aaggacacacuaau

SEQ ID NO: 3622798 - RNA, 14 nt, Human
aaggacacuuccug

SEQ ID NO: 3622799 - RNA, 13 nt, Human
aaggacagccccu

SEQ ID NO: 3622800 - RNA, 18 nt, Human
aaggacaggcagaaagag

SEQ ID NO: 3622801 - RNA, 20 nt, Human
aaggacaggcagaaagaguu

SEQ ID NO: 3622802 - RNA, 14 nt, Human
aaggacaucagcaa

SEQ ID NO: 3622803 - RNA, 16 nt, Human
aaggacauuaugugug

SEQ ID NO: 3622804 - RNA, 16 nt, Human
aaggaccacauuuuau

SEQ ID NO: 3622805 - RNA, 19 nt, Human
aaggaccacauuuuauauu

SEQ ID NO: 3622806 - RNA, 20 nt, Human
aaggaccacauuuuauauuu

SEQ ID NO: 3622807 - RNA, 20 nt, Human
aaggaccagcccuugaggga

SEQ ID NO: 3622808 - RNA, 17 nt, Human
aaggaccuauguuugcu

SEQ ID NO: 3622809 - RNA, 19 nt, Human
aaggaccugaaauuccaaa

SEQ ID NO: 3622810 - RNA, 18 nt, Human
aaggaccuuaagacagag

SEQ ID NO: 3622811 - RNA, 21 nt, Human
aaggaccuucacucuaagaug

SEQ ID NO: 3622812 - RNA, 15 nt, Human
aaggacuaggguccu

SEQ ID NO: 3622813 - RNA, 18 nt, Human
aaggacuaggguccuggg

SEQ ID NO: 3622814 - RNA, 16 nt, Human
aaggacuauaagaaua

SEQ ID NO: 3622815 - RNA, 13 nt, Human
aaggacuccaccc

SEQ ID NO: 3622816 - RNA, 19 nt, Human
aaggacugacugaggcagu

SEQ ID NO: 3622817 - RNA, 20 nt, Human
aaggacugagcacccucugg

SEQ ID NO: 3622818 - RNA, 15 nt, Human
aaggacugcauggua

SEQ ID NO: 3622819 - RNA, 21 nt, Human
aaggacugcaugguaauuuau

SEQ ID NO: 3622820 - RNA, 20 nt, Human
aaggacugugacaggcagca

SEQ ID NO: 3622821 - RNA, 14 nt, Human
aaggacugugcuuu

SEQ ID NO: 3622822 - RNA, 17 nt, Human
aaggacuuccuguccag

SEQ ID NO: 3622823 - RNA, 21 nt, Human
aaggacuucuuuaauuuugga

SEQ ID NO: 3622824 - RNA, 17 nt, Human
aaggacuugacuugcaa

SEQ ID NO: 3622825 - RNA, 17 nt, Human
aaggacuuuguacauuu

SEQ ID NO: 3622826 - RNA, 22 nt, Human
aagcuuagcaggagaggagagc

SEQ ID NO: 3622827 - RNA, 15 nt, Human
aagcuuauuaaugcu

SEQ ID NO: 3622828 - RNA, 14 nt, Human
aagcuuauuuaauu

SEQ ID NO: 3622829 - RNA, 19 nt, Human
aagcuucagugcugccgau

SEQ ID NO: 3622830 - RNA, 15 nt, Human
aagcuucaguuuccu

SEQ ID NO: 3622831 - RNA, 11 nt, Human
aagcuucccuc

SEQ ID NO: 3622832 - RNA, 20 nt, Human
aagcuucuuaaaugagaagg

SEQ ID NO: 3622833 - RNA, 12 nt, Human
aagcuugacucc

SEQ ID NO: 3622834 - RNA, 16 nt, Human
aagcuugguucuguga

SEQ ID NO: 3622835 - RNA, 21 nt, Human
aagcuugguucugugaacaag

SEQ ID NO: 3622836 - RNA, 16 nt, Human
aagcuuguguauccau

SEQ ID NO: 3622837 - RNA, 21 nt, Human
aagcuuguguauccauuauca

SEQ ID NO: 3622838 - RNA, 15 nt, Human
aagcuuguuuuccag

SEQ ID NO: 3622839 - RNA, 20 nt, Human
aagcuuuauacguguagcua

SEQ ID NO: 3622840 - RNA, 21 nt, Human
aagcuuuaugauuuucauaac

SEQ ID NO: 3622841 - RNA, 16 nt, Human
aagcuuuauuaccagu

SEQ ID NO: 3622842 - RNA, 13 nt, Human
aagcuuuauuucu

SEQ ID NO: 3622843 - RNA, 13 nt, Human
aagcuuuccugga

SEQ ID NO: 3622844 - RNA, 19 nt, Human
aagcuuucucugcuucagc

SEQ ID NO: 3622845 - RNA, 19 nt, Human
aagcuuuguccccugcuuc

SEQ ID NO: 3622846 - RNA, 22 nt, Human
aagcuuuguccccugcuucaga

SEQ ID NO: 3622847 - RNA, 16 nt, Human
aagcuuuuaugugaaa

SEQ ID NO: 3622848 - RNA, 19 nt, Human
aagcuuuuaugugaaacau

SEQ ID NO: 3622849 - RNA, 21 nt, Human
aagcuuuuaugugaaacaugu

SEQ ID NO: 3622850 - RNA, 13 nt, Human
aagcuuuuugaaa

SEQ ID NO: 3622851 - RNA, 17 nt, Human
aacucuugauuauccau

SEQ ID NO: 3622852 - RNA, 17 nt, Human
aacucuugguuucuuca

SEQ ID NO: 3622853 - RNA, 13 nt, Human
aacucuuucggua

SEQ ID NO: 3622854 - RNA, 19 nt, Human
aacucuuuguuauuugaaa

SEQ ID NO: 3622855 - RNA, 14 nt, Human
aacucuuuuaacag

SEQ ID NO: 3622856 - RNA, 23 nt, Human
aacucuuuuaucuccugaaaaaa

SEQ ID NO: 3622857 - RNA, 17 nt, Human
aacucuuuuugggcucc

SEQ ID NO: 3622858 - RNA, 23 nt, Human
aacucuuuuugggcuccuuuuuc

SEQ ID NO: 3622859 - RNA, 15 nt, Human
aacugaaaacauaaa

SEQ ID NO: 3622860 - RNA, 21 nt, Human
aacugaaaacucccauuuacg

SEQ ID NO: 3622861 - RNA, 15 nt, Human
aacugaaaagagagc

SEQ ID NO: 3622862 - RNA, 21 nt, Human
aacugaaaagagagcagagaa

SEQ ID NO: 3622863 - RNA, 12 nt, Human
aacugaaaaugu

SEQ ID NO: 3622864 - RNA, 13 nt, Human
aacugaaagugaa

SEQ ID NO: 3622865 - RNA, 14 nt, Human
aacugaaaguguuu

SEQ ID NO: 3622866 - RNA, 12 nt, Human
aacugaaaucau

SEQ ID NO: 3622867 - RNA, 14 nt, Human
aacugaacucugac

SEQ ID NO: 3622868 - RNA, 16 nt, Human
aacugaacucugacaa

SEQ ID NO: 3622869 - RNA, 23 nt, Human
aacugaacucugacaacagacuu

SEQ ID NO: 3622870 - RNA, 13 nt, Human
aacugaaggagaa

SEQ ID NO: 3622871 - RNA, 15 nt, Human
aacugaaggagaagg

SEQ ID NO: 3622872 - RNA, 20 nt, Human
aacugaauagcaaguggcau

SEQ ID NO: 3622873 - RNA, 18 nt, Human
aacugaaugaaaccccca

SEQ ID NO: 3622874 - RNA, 23 nt, Human
aacugaaugaaacccccacacac

SEQ ID NO: 3622875 - RNA, 20 nt, Human
aacugaauguuuauuccuug

SEQ ID NO: 3622876 - RNA, 19 nt, Human
aacugacaaaucaaguuuc

SEQ ID NO: 3622877 - RNA, 17 nt, Human
aacugacaagccaucuu

SEQ ID NO: 3622878 - RNA, 11 nt, Human
aacugacacag

SEQ ID NO: 3622879 - RNA, 21 nt, Human
aacugacaggcagccuggaca

SEQ ID NO: 3622880 - RNA, 12 nt, Human
aacugacaugau

SEQ ID NO: 3622881 - RNA, 18 nt, Human
aacugacaugcccucccu

SEQ ID NO: 3622882 - RNA, 22 nt, Human
aacugacuauucuugauguaaa

SEQ ID NO: 3622883 - RNA, 23 nt, Human
aacugacuauucuugauguaaaa

SEQ ID NO: 3622884 - RNA, 18 nt, Human
aacugacucuuaagaaga

SEQ ID NO: 3622885 - RNA, 18 nt, Human
aacugacuuuauccucag

SEQ ID NO: 3622886 - RNA, 23 nt, Human
aacugagaugugaacacaucagc

SEQ ID NO: 3622887 - RNA, 13 nt, Human
aacugaggaauuu

SEQ ID NO: 3622888 - RNA, 18 nt, Human
aacugaggaauuuucuuu

SEQ ID NO: 3622889 - RNA, 12 nt, Human
aacugaggcaga

SEQ ID NO: 3622890 - RNA, 19 nt, Human
aacugaggcuuagagauag

SEQ ID NO: 3622891 - RNA, 17 nt, Human
aacugauaguuacuguu

SEQ ID NO: 3622892 - RNA, 19 nt, Human
aacugauaguuacuguugu

SEQ ID NO: 3622893 - RNA, 18 nt, Human
aacugaucauguuuauga

SEQ ID NO: 3622894 - RNA, 13 nt, Human
aacugaucuguua

SEQ ID NO: 3622895 - RNA, 18 nt, Human
aacugauuaguaagucuu

SEQ ID NO: 3622896 - RNA, 17 nt, Human
aacugauuuuuuuuucc

SEQ ID NO: 3622897 - RNA, 20 nt, Human
aacugauuuuuuuuuccuuc

SEQ ID NO: 3622898 - RNA, 14 nt, Human
aacugcaaagaaag

SEQ ID NO: 3622899 - RNA, 15 nt, Human
aacugcaaagugaag

SEQ ID NO: 3622900 - RNA, 16 nt, Human
aacugcaagucacaaa

SEQ ID NO: 3622901 - RNA, 19 nt, Human
aacugcaagucacaaagga

SEQ ID NO: 3622902 - RNA, 19 nt, Human
aacugcaauaacuucugac

SEQ ID NO: 3622903 - RNA, 20 nt, Human
aacugcaauacaaguuucau

SEQ ID NO: 3622904 - RNA, 13 nt, Human
aacugcaauagag

SEQ ID NO: 3622905 - RNA, 16 nt, Human
aacugcaauagagacu

SEQ ID NO: 3622906 - RNA, 19 nt, Human
aacugcacaugaagaaaua

SEQ ID NO: 3622907 - RNA, 18 nt, Human
aacugcacaugauuucac

SEQ ID NO: 3622908 - RNA, 23 nt, Human
aacugcacaugauuucacaaaua

SEQ ID NO: 3622909 - RNA, 20 nt, Human
aacugcaccaguugcugcuu

SEQ ID NO: 3622910 - RNA, 20 nt, Human
aacugcagcaaucuuugaaa

SEQ ID NO: 3622911 - RNA, 22 nt, Human
aacugcagcaaucuuugaaaga

SEQ ID NO: 3622912 - RNA, 14 nt, Human
aacugcaggcccug

SEQ ID NO: 3622913 - RNA, 17 nt, Human
aacugcaggcccuggcc

SEQ ID NO: 3622914 - RNA, 21 nt, Human
aacugcauggaccuaacauuc

SEQ ID NO: 3622915 - RNA, 18 nt, Human
aacugcauguauaaauga

SEQ ID NO: 3622916 - RNA, 14 nt, Human
aacugcauuagaaa

SEQ ID NO: 3622917 - RNA, 22 nt, Human
aacugcauugacuuucaguaaa

SEQ ID NO: 3622918 - RNA, 16 nt, Human
aacugcauuggcuuug

SEQ ID NO: 3622919 - RNA, 14 nt, Human
aacugccaggcucu

SEQ ID NO: 3622920 - RNA, 19 nt, Human
aacugccaguuuuguuucc

SEQ ID NO: 3622921 - RNA, 11 nt, Human
aacugccauua

SEQ ID NO: 3622922 - RNA, 22 nt, Human
aacugccauuauuuucugucag

SEQ ID NO: 3622923 - RNA, 23 nt, Human
aacugccauuauuuucugucaga

SEQ ID NO: 3622924 - RNA, 16 nt, Human
aacugcccccucugcc

SEQ ID NO: 3622925 - RNA, 17 nt, Human
aacugcccccucugccc

SEQ ID NO: 3622926 - RNA, 19 nt, Human
aacugcccccucugcccug

SEQ ID NO: 3622927 - RNA, 20 nt, Human
aacugcccccucugcccugc

SEQ ID NO: 3622928 - RNA, 17 nt, Human
aacugccguaauuuaac

SEQ ID NO: 3622929 - RNA, 18 nt, Human
aacugccguaauuuaacu

SEQ ID NO: 3622930 - RNA, 16 nt, Human
aacugccuacuccaaa

SEQ ID NO: 3622931 - RNA, 20 nt, Human
aacugccuacuccaaaaugu

SEQ ID NO: 3622932 - RNA, 14 nt, Human
aacugccuagaaac

SEQ ID NO: 3622933 - RNA, 17 nt, Human
aacugccuuggcuucag

SEQ ID NO: 3622934 - RNA, 20 nt, Human
aacugcugacuguuuucucu

SEQ ID NO: 3622935 - RNA, 20 nt, Human
aacugcugaugcucaugguc

SEQ ID NO: 3622936 - RNA, 14 nt, Human
aacugcugcuuuuu

SEQ ID NO: 3622937 - RNA, 23 nt, Human
aacugcuuccuauaauuuugaua

SEQ ID NO: 3622938 - RNA, 17 nt, Human
aacugcuuguuuccuag

SEQ ID NO: 3622939 - RNA, 20 nt, Human
aacugcuuuuuuuuuuccag

SEQ ID NO: 3622940 - RNA, 13 nt, Human
aacuggaaagaag

SEQ ID NO: 3622941 - RNA, 19 nt, Human
aacuggaaauacuagauuu

SEQ ID NO: 3622942 - RNA, 19 nt, Human
aacuggaaucagcucagga

SEQ ID NO: 3622943 - RNA, 14 nt, Human
aacuggaauuaaaa

SEQ ID NO: 3622944 - RNA, 14 nt, Human
aacuggacccuguu

SEQ ID NO: 3622945 - RNA, 17 nt, Human
aacuggaccuguauauu

SEQ ID NO: 3622946 - RNA, 13 nt, Human
aacuggacucagg

SEQ ID NO: 3622947 - RNA, 21 nt, Human
aacuggacucaggaugcccag

SEQ ID NO: 3622948 - RNA, 12 nt, Human
aacuggagcccc

SEQ ID NO: 3622949 - RNA, 15 nt, Human
aacuggauuaaacuu

SEQ ID NO: 3622950 - RNA, 22 nt, Human
aacuggcaaagcagaaugugau

SEQ ID NO: 3622951 - RNA, 14 nt, Human
aacuggcaggcagg

SEQ ID NO: 3622952 - RNA, 19 nt, Human
aacuggccaagcugaggug

SEQ ID NO: 3622953 - RNA, 20 nt, Human
aacuggccccggaucagagc

SEQ ID NO: 3622954 - RNA, 17 nt, Human
aacuggccggucugcaa

SEQ ID NO: 3622955 - RNA, 23 nt, Human
aacuggccggucugcaagucaga

SEQ ID NO: 3622956 - RNA, 12 nt, Human
aacuggcugugu

SEQ ID NO: 3622957 - RNA, 17 nt, Human
aacugggacaggggaga

SEQ ID NO: 3622958 - RNA, 23 nt, Human
aacugggaugaaacuaaagcaau

SEQ ID NO: 3622959 - RNA, 19 nt, Human
aacugggcauauuucuaau

SEQ ID NO: 3622960 - RNA, 21 nt, Human
aacugggggagggugaaguga

SEQ ID NO: 3622961 - RNA, 18 nt, Human
aacugggguugagggcca

SEQ ID NO: 3622962 - RNA, 19 nt, Human
aacuggucaccaugaaacu

SEQ ID NO: 3622963 - RNA, 20 nt, Human
aacuggugcacuuuguaaau

SEQ ID NO: 3622964 - RNA, 15 nt, Human
aacuguaaaauacuu

SEQ ID NO: 3622965 - RNA, 12 nt, Human
aacuguaaauca

SEQ ID NO: 3622966 - RNA, 13 nt, Human
aacuguaauacaa

SEQ ID NO: 3622967 - RNA, 11 nt, Human
aacuguacagu

SEQ ID NO: 3622968 - RNA, 18 nt, Human
aacuguacauuuaaaauu

SEQ ID NO: 3622969 - RNA, 13 nt, Human
aacuguacuucac

SEQ ID NO: 3622970 - RNA, 15 nt, Human
aacuguacuucacug

SEQ ID NO: 3622971 - RNA, 15 nt, Human
aacuugguuauacau

SEQ ID NO: 3622972 - RNA, 21 nt, Human
aacuugguuauacaugacacu

SEQ ID NO: 3622973 - RNA, 23 nt, Human
aacuugguucccauuugcuccuu

SEQ ID NO: 3622974 - RNA, 21 nt, Human
aacuugguuuugcuacauaau

SEQ ID NO: 3622975 - RNA, 22 nt, Human
aacuugguuuugcuacauaauu

SEQ ID NO: 3622976 - RNA, 14 nt, Human
aacuuguaaauaca

SEQ ID NO: 3622977 - RNA, 15 nt, Human
aacuuguaaauacac

SEQ ID NO: 3622978 - RNA, 18 nt, Human
aacuuguaauaaacccuu

SEQ ID NO: 3622979 - RNA, 13 nt, Human
aacuuguagcugu

SEQ ID NO: 3622980 - RNA, 16 nt, Human
aacuuguauuaugugu

SEQ ID NO: 3622981 - RNA, 12 nt, Human
aacuugucacuu

SEQ ID NO: 3622982 - RNA, 13 nt, Human
aacuugucacuug

SEQ ID NO: 3622983 - RNA, 19 nt, Human
aacuuguucuuccaaagca

SEQ ID NO: 3622984 - RNA, 16 nt, Human
aacuuguuugcuguga

SEQ ID NO: 3622985 - RNA, 20 nt, Human
aacuuguuugcugugaacaa

SEQ ID NO: 3622986 - RNA, 13 nt, Human
aacuuguuuucug

SEQ ID NO: 3622987 - RNA, 19 nt, Human
aacuuuaaaaaauauuuau

SEQ ID NO: 3622988 - RNA, 21 nt, Human
aacuuuaagaacuaaaauguu

SEQ ID NO: 3622989 - RNA, 16 nt, Human
aacuuuaagcagcucu

SEQ ID NO: 3622990 - RNA, 15 nt, Human
aacuuuaauauguau

SEQ ID NO: 3622991 - RNA, 16 nt, Human
aacuuuaauauguauu

SEQ ID NO: 3622992 - RNA, 13 nt, Human
aacuuuaccuuuu

SEQ ID NO: 3622993 - RNA, 22 nt, Human
aacuuuaccuuuuuuauacaua

SEQ ID NO: 3622994 - RNA, 19 nt, Human
aacuuuacuaagaugacau

SEQ ID NO: 3622995 - RNA, 20 nt, Human
aacuuuagaaauaaaccuua

SEQ ID NO: 3622996 - RNA, 22 nt, Human
aacuuuagaagugcauuucuga

SEQ ID NO: 3622997 - RNA, 22 nt, Human
aacuuuagaguagcaugagaga

SEQ ID NO: 3622998 - RNA, 15 nt, Human
aacuuuauaaaucca

SEQ ID NO: 3622999 - RNA, 13 nt, Human
aacuuuauacauu

SEQ ID NO: 3623000 - RNA, 16 nt, Human
aacuuuauacauuagu

SEQ ID NO: 3623001 - RNA, 18 nt, Human
aacuuuauacauuaguaa

SEQ ID NO: 3623002 - RNA, 21 nt, Human
aacuuuaucacauuauuugca

SEQ ID NO: 3623003 - RNA, 22 nt, Human
aacuuuaucagggaaacuaaga

SEQ ID NO: 3623004 - RNA, 14 nt, Human
aacuuuauguguaa

SEQ ID NO: 3623005 - RNA, 19 nt, Human
aacuuuauuaaauacaaaa

SEQ ID NO: 3623006 - RNA, 12 nt, Human
aacuuuauucuu

SEQ ID NO: 3623007 - RNA, 23 nt, Human
aacuuuauucuugaaagaagaau

SEQ ID NO: 3623008 - RNA, 13 nt, Human
aacuuuauuucca

SEQ ID NO: 3623009 - RNA, 16 nt, Human
aacuuucaagaacuug

SEQ ID NO: 3623010 - RNA, 19 nt, Human
aacuuucauuccuucagau

SEQ ID NO: 3623011 - RNA, 12 nt, Human
aagcuuuuugga

SEQ ID NO: 3623012 - RNA, 14 nt, Human
aagcuuuuuggaau

SEQ ID NO: 3623013 - RNA, 16 nt, Human
aaggaaaaaauaacaa

SEQ ID NO: 3623014 - RNA, 17 nt, Human
aaggaaaaaauguugga

SEQ ID NO: 3623015 - RNA, 15 nt, Human
aaggaaaaacaaacu

SEQ ID NO: 3623016 - RNA, 16 nt, Human
aaggaaaaacacaagc

SEQ ID NO: 3623017 - RNA, 19 nt, Human
aaggaaaaagcacaagaag

SEQ ID NO: 3623018 - RNA, 14 nt, Human
aaggaaaaaugugu

SEQ ID NO: 3623019 - RNA, 15 nt, Human
aaggaaaaaugugua

SEQ ID NO: 3623020 - RNA, 16 nt, Human
aaggaaaaauguguaa

SEQ ID NO: 3623021 - RNA, 23 nt, Human
aaggaaaacuaccuguauuuaaa

SEQ ID NO: 3623022 - RNA, 13 nt, Human
aaggaaaagaaaa

SEQ ID NO: 3623023 - RNA, 14 nt, Human
aaggaaaagaaaaa

SEQ ID NO: 3623024 - RNA, 22 nt, Human
aaggaaaaguuuaauauuaaag

SEQ ID NO: 3623025 - RNA, 20 nt, Human
aaggaaacaaccaugucauu

SEQ ID NO: 3623026 - RNA, 22 nt, Human
aaggaaacccagcucuggucca

SEQ ID NO: 3623027 - RNA, 16 nt, Human
aaggaaacgcuaccuc

SEQ ID NO: 3623028 - RNA, 12 nt, Human
aaggaaacucuu

SEQ ID NO: 3623029 - RNA, 13 nt, Human
aaggaaacucuua

SEQ ID NO: 3623030 - RNA, 19 nt, Human
aaggaaacucuuaucucag

SEQ ID NO: 3623031 - RNA, 20 nt, Human
aaggaaacuggguuccugca

SEQ ID NO: 3623032 - RNA, 12 nt, Human
aaggaaagaaaa

SEQ ID NO: 3623033 - RNA, 16 nt, Human
aaggaaagcaauaaau

SEQ ID NO: 3623034 - RNA, 22 nt, Human
aaggaaagggggucccaguggg

SEQ ID NO: 3623035 - RNA, 22 nt, Human
aaggaaauaccaguucugggca

SEQ ID NO: 3623036 - RNA, 20 nt, Human
aaggaaauacccuucuuuua

SEQ ID NO: 3623037 - RNA, 22 nt, Human
aaggaaaucucaccccauccca

SEQ ID NO: 3623038 - RNA, 21 nt, Human
aaggaaaugauugaggaguga

SEQ ID NO: 3623039 - RNA, 23 nt, Human
aaggaaccaaagcgaauuuuaaa

SEQ ID NO: 3623040 - RNA, 21 nt, Human
aaggaaccuuccuuccugcuu

SEQ ID NO: 3623041 - RNA, 23 nt, Human
aaggaaccuuccuuccugcuuga

SEQ ID NO: 3623042 - RNA, 14 nt, Human
aaggaacugcagca

SEQ ID NO: 3623043 - RNA, 14 nt, Human
aaggaagacuucau

SEQ ID NO: 3623044 - RNA, 21 nt, Human
aaggaagagccaauguuuucc

SEQ ID NO: 3623045 - RNA, 20 nt, Human
aaggaagcacucuguauauu

SEQ ID NO: 3623046 - RNA, 17 nt, Human
aaggaaggcagggagga

SEQ ID NO: 3623047 - RNA, 17 nt, Human
aaggaagguaguucaag

SEQ ID NO: 3623048 - RNA, 16 nt, Human
aaggaagguuuucucc

SEQ ID NO: 3623049 - RNA, 17 nt, Human
aaggaauaccugucccc

SEQ ID NO: 3623050 - RNA, 21 nt, Human
aaggaaucuuuaagcagagaa

SEQ ID NO: 3623051 - RNA, 23 nt, Human
aaggaaugauuaauuaaaacaca

SEQ ID NO: 3623052 - RNA, 15 nt, Human
aaggaaugcaaagau

SEQ ID NO: 3623053 - RNA, 14 nt, Human
aaggaauuucuuaa

SEQ ID NO: 3623054 - RNA, 16 nt, Human
aaggaauuucuuaacu

SEQ ID NO: 3623055 - RNA, 19 nt, Human
aaggaauuucuuaacuucu

SEQ ID NO: 3623056 - RNA, 23 nt, Human
aaggacaaaaaugaacugaaguu

SEQ ID NO: 3623057 - RNA, 14 nt, Human
aaggacaauuucaa

SEQ ID NO: 3623058 - RNA, 17 nt, Human
aaggacagaguaugaac

SEQ ID NO: 3623059 - RNA, 16 nt, Human
aaggacaugaugcuuu

SEQ ID NO: 3623060 - RNA, 19 nt, Human
aaggaccaacaagggcagu

SEQ ID NO: 3623061 - RNA, 23 nt, Human
aaggaccacauuuuauauuuauu

SEQ ID NO: 3623062 - RNA, 20 nt, Human
aaggaccccucaccuugcaa

SEQ ID NO: 3623063 - RNA, 22 nt, Human
aaggacccggaggggccuggca

SEQ ID NO: 3623064 - RNA, 22 nt, Human
aaggaccuauguuugcucagaa

SEQ ID NO: 3623065 - RNA, 23 nt, Human
aaggaccuccucuucccccuucc

SEQ ID NO: 3623066 - RNA, 13 nt, Human
aaggaccuccuga

SEQ ID NO: 3623067 - RNA, 19 nt, Human
aaggaccuuaagacagagu

SEQ ID NO: 3623068 - RNA, 14 nt, Human
aaggacgcacugag

SEQ ID NO: 3623069 - RNA, 19 nt, Human
aaggacuaauagaaaagua

SEQ ID NO: 3623070 - RNA, 21 nt, Human
aaggacuacguuaagggaagg

SEQ ID NO: 3623071 - RNA, 13 nt, Human
aaggacuaggguc

SEQ ID NO: 3623072 - RNA, 20 nt, Human
aaggacuaggguccugggga

SEQ ID NO: 3623073 - RNA, 22 nt, Human
aaggacuccuccuuuuuccaug

SEQ ID NO: 3623074 - RNA, 12 nt, Human
aaggacucuggg

SEQ ID NO: 3623075 - RNA, 16 nt, Human
aaggacucuuccagag

SEQ ID NO: 3623076 - RNA, 12 nt, Human
aaggacugacug

SEQ ID NO: 3623077 - RNA, 13 nt, Human
aaggacugaggga

SEQ ID NO: 3623078 - RNA, 14 nt, Human
aaggacuguaaucu

SEQ ID NO: 3623079 - RNA, 13 nt, Human
aaggacuuccuga

SEQ ID NO: 3623080 - RNA, 22 nt, Human
aaggacuuccugauugguuucu

SEQ ID NO: 3623081 - RNA, 14 nt, Human
aaggacuucuuuaa

SEQ ID NO: 3623082 - RNA, 15 nt, Human
aaggacuucuuuaau

SEQ ID NO: 3623083 - RNA, 23 nt, Human
aaggacuucuuuaauuuuggaau

SEQ ID NO: 3623084 - RNA, 12 nt, Human
aaggacuugaaa

SEQ ID NO: 3623085 - RNA, 17 nt, Human
aaggacuugaaagcauc

SEQ ID NO: 3623086 - RNA, 19 nt, Human
aaggacuugaaagcaucca

SEQ ID NO: 3623087 - RNA, 22 nt, Human
aaggacuugaaagcauccaugu

SEQ ID NO: 3623088 - RNA, 23 nt, Human
aaggacuuguuagaucuaguuca

SEQ ID NO: 3623089 - RNA, 14 nt, Human
aaggacuuuguaca

SEQ ID NO: 3623090 - RNA, 15 nt, Human
aaggacuuuguacau

SEQ ID NO: 3623091 - RNA, 12 nt, Human
aaggagaacaaa

SEQ ID NO: 3623092 - RNA, 17 nt, Human
aaggagaaucaucagga

SEQ ID NO: 3623093 - RNA, 18 nt, Human
aaggagaaucaucaggac

SEQ ID NO: 3623094 - RNA, 19 nt, Human
aaggagaaucaucaggacc

SEQ ID NO: 3623095 - RNA, 13 nt, Human
aaggagacacaga

SEQ ID NO: 3623096 - RNA, 16 nt, Human
aaggagacacagaugu

SEQ ID NO: 3623097 - RNA, 20 nt, Human
aaggagacucaccucugccu

SEQ ID NO: 3623098 - RNA, 23 nt, Human
aaggagagacucccaugaagccu

SEQ ID NO: 3623099 - RNA, 19 nt, Human
aaggagagagcaaagggug

SEQ ID NO: 3623100 - RNA, 11 nt, Human
aaggagagcua

SEQ ID NO: 3623101 - RNA, 22 nt, Human
aaggagagucuugcagugauua

SEQ ID NO: 3623102 - RNA, 15 nt, Human
aaggagaguggccau

SEQ ID NO: 3623103 - RNA, 15 nt, Human
aaggagaugaagcaa

SEQ ID NO: 3623104 - RNA, 22 nt, Human
aaggagcaagucagaauagaaa

SEQ ID NO: 3623105 - RNA, 12 nt, Human
aaggagcacagg

SEQ ID NO: 3623106 - RNA, 21 nt, Human
aaggagcacaggucccaccuc

SEQ ID NO: 3623107 - RNA, 23 nt, Human
aaggagccaauugauuucaacag

SEQ ID NO: 3623108 - RNA, 20 nt, Human
aaggagcccuuaucugugcu

SEQ ID NO: 3623109 - RNA, 16 nt, Human
aaggagccuaggccag

SEQ ID NO: 3623110 - RNA, 18 nt, Human
aaggagccuaggccaggu

SEQ ID NO: 3623111 - RNA, 19 nt, Human
aaggagccuaggccaggug

SEQ ID NO: 3623112 - RNA, 21 nt, Human
aaggagccuaggccaggugca

SEQ ID NO: 3623113 - RNA, 10 nt, Human
aaggagccug

SEQ ID NO: 3623114 - RNA, 13 nt, Human
aaggagccuguga

SEQ ID NO: 3623115 - RNA, 16 nt, Human
aaguaauuuggaaauu

SEQ ID NO: 3623116 - RNA, 19 nt, Human
aaguacaaacuaaggugcu

SEQ ID NO: 3623117 - RNA, 21 nt, Human
aaguacaauaauucauauucu

SEQ ID NO: 3623118 - RNA, 19 nt, Human
aaguacaauguguuuuucu

SEQ ID NO: 3623119 - RNA, 17 nt, Human
aaguacacaauaagcaa

SEQ ID NO: 3623120 - RNA, 18 nt, Human
aaguacacaauaagcaaa

SEQ ID NO: 3623121 - RNA, 19 nt, Human
aaguacacaauaagcaaaa

SEQ ID NO: 3623122 - RNA, 15 nt, Human
aaguacacucugcug

SEQ ID NO: 3623123 - RNA, 19 nt, Human
aaguacacucugcuguuug

SEQ ID NO: 3623124 - RNA, 13 nt, Human
aaguacagaauuu

SEQ ID NO: 3623125 - RNA, 16 nt, Human
aaguacagaauuugaa

SEQ ID NO: 3623126 - RNA, 12 nt, Human
aaguacagagaa

SEQ ID NO: 3623127 - RNA, 18 nt, Human
aaguacagguacuuuguc

SEQ ID NO: 3623128 - RNA, 20 nt, Human
aaguacauauuaggaaaaua

SEQ ID NO: 3623129 - RNA, 17 nt, Human
aaguacaugaauacaaa

SEQ ID NO: 3623130 - RNA, 13 nt, Human
aaguacauuuaau

SEQ ID NO: 3623131 - RNA, 16 nt, Human
aaguacauuuuuugaa

SEQ ID NO: 3623132 - RNA, 13 nt, Human
aaguaccagacua

SEQ ID NO: 3623133 - RNA, 18 nt, Human
aaguacccguucacauuu

SEQ ID NO: 3623134 - RNA, 17 nt, Human
aaguacuauaauuuacc

SEQ ID NO: 3623135 - RNA, 17 nt, Human
aaguacugcuguaaaua

SEQ ID NO: 3623136 - RNA, 19 nt, Human
aaguacuguuuaccauuuu

SEQ ID NO: 3623137 - RNA, 11 nt, Human
aaguagaaaug

SEQ ID NO: 3623138 - RNA, 15 nt, Human
aaguagaacuuugua

SEQ ID NO: 3623139 - RNA, 16 nt, Human
aaguagaacuuuguau

SEQ ID NO: 3623140 - RNA, 12 nt, Human
aaguagaagagg

SEQ ID NO: 3623141 - RNA, 19 nt, Human
aaguagaagucuuagaugu

SEQ ID NO: 3623142 - RNA, 19 nt, Human
aaguagacaaucauuguuu

SEQ ID NO: 3623143 - RNA, 19 nt, Human
aaguagacaguuuugagaa

SEQ ID NO: 3623144 - RNA, 16 nt, Human
aaguagcacaggcuga

SEQ ID NO: 3623145 - RNA, 19 nt, Human
aaguaggggaagaauaauu

SEQ ID NO: 3623146 - RNA, 20 nt, Human
aaguaggggaagaauaauuu

SEQ ID NO: 3623147 - RNA, 15 nt, Human
aaguagggggucuaa

SEQ ID NO: 3623148 - RNA, 19 nt, Human
aaguagggguuguggguga

SEQ ID NO: 3623149 - RNA, 22 nt, Human
aaguaguacuucuucuguaaua

SEQ ID NO: 3623150 - RNA, 17 nt, Human
aaguaguccuuggcaua

SEQ ID NO: 3623151 - RNA, 22 nt, Human
aaguagugucuggaucaguaaa

SEQ ID NO: 3623152 - RNA, 23 nt, Human
aaguagugucuggaucaguaaaa

SEQ ID NO: 3623153 - RNA, 13 nt, Human
aaguaguuaucau

SEQ ID NO: 3623154 - RNA, 17 nt, Human
aaguaguuaucauguua

SEQ ID NO: 3623155 - RNA, 14 nt, Human
aaguaguucuguau

SEQ ID NO: 3623156 - RNA, 20 nt, Human
aaguaguucuguauuugaaa

SEQ ID NO: 3623157 - RNA, 21 nt, Human
aaguaguucuguauuugaaag

SEQ ID NO: 3623158 - RNA, 20 nt, Human
aaguaguuuguauaacuucu

SEQ ID NO: 3623159 - RNA, 22 nt, Human
aaguauaaaauaguaugaaaau

SEQ ID NO: 3623160 - RNA, 15 nt, Human
aaguauaaacuuuua

SEQ ID NO: 3623161 - RNA, 21 nt, Human
aaguauaaauuuguguaauau

SEQ ID NO: 3623162 - RNA, 13 nt, Human
aaguauaauguuu

SEQ ID NO: 3623163 - RNA, 21 nt, Human
aaguauacaguucaauaaacu

SEQ ID NO: 3623164 - RNA, 18 nt, Human
aaguauacuguauuuuua

SEQ ID NO: 3623165 - RNA, 15 nt, Human
aaguauacuuauauu

SEQ ID NO: 3623166 - RNA, 12 nt, Human
aaguauagaaaa

SEQ ID NO: 3623167 - RNA, 22 nt, Human
aaguauagccuauggcagaaaa

SEQ ID NO: 3623168 - RNA, 18 nt, Human
aaguauauaaauuggcuu

SEQ ID NO: 3623169 - RNA, 11 nt, Human
aaguauauaua

SEQ ID NO: 3623170 - RNA, 18 nt, Human
aaguauauauauauauua

SEQ ID NO: 3623171 - RNA, 18 nt, Human
aaguaucaaguauagaaa

SEQ ID NO: 3623172 - RNA, 21 nt, Human
aaguaucauggaaauauuaug

SEQ ID NO: 3623173 - RNA, 16 nt, Human
aaguaucccuacugua

SEQ ID NO: 3623174 - RNA, 17 nt, Human
aaguaucccuacuguaa

SEQ ID NO: 3623175 - RNA, 21 nt, Human
aaguaucgggggcuggggcag

SEQ ID NO: 3623176 - RNA, 18 nt, Human
aaguaucuaaaaguguca

SEQ ID NO: 3623177 - RNA, 22 nt, Human
aaguaucugacaucucugcaau

SEQ ID NO: 3623178 - RNA, 14 nt, Human
aaguaugaaucuau

SEQ ID NO: 3623179 - RNA, 23 nt, Human
aaguaugaaucuaugccaaagau

SEQ ID NO: 3623180 - RNA, 15 nt, Human
aaguaugggaaauga

SEQ ID NO: 3623181 - RNA, 13 nt, Human
aaguauguaaaca

SEQ ID NO: 3623182 - RNA, 20 nt, Human
aaguauguauauuaaaaaag

SEQ ID NO: 3623183 - RNA, 21 nt, Human
aaguauguauuauuuacauuu

SEQ ID NO: 3623184 - RNA, 21 nt, Human
aaguauguuagugcaaauugu

SEQ ID NO: 3623185 - RNA, 23 nt, Human
aaguauguuagugcaaauuguca

SEQ ID NO: 3623186 - RNA, 16 nt, Human
aaguauuaagcauaua

SEQ ID NO: 3623187 - RNA, 18 nt, Human
aaguauuaagcauauauu

SEQ ID NO: 3623188 - RNA, 17 nt, Human
aaguauuaauucucuuu

SEQ ID NO: 3623189 - RNA, 16 nt, Human
aaguauuacuaaauug

SEQ ID NO: 3623190 - RNA, 20 nt, Human
aaguauuagggguaauauau

SEQ ID NO: 3623191 - RNA, 22 nt, Human
aaguauuagggguaauauauug

SEQ ID NO: 3623192 - RNA, 17 nt, Human
aaguauuauaaauuaug

SEQ ID NO: 3623193 - RNA, 15 nt, Human
aaguauuauuuucca

SEQ ID NO: 3623194 - RNA, 15 nt, Human
aaguauuccaccuua

SEQ ID NO: 3623195 - RNA, 19 nt, Human
aaguauuccaccuuaaauu

SEQ ID NO: 3623196 - RNA, 21 nt, Human
aaguauuccaccuuaaauuaa

SEQ ID NO: 3623197 - RNA, 22 nt, Human
aaguauuccuuuccugaucacu

SEQ ID NO: 3623198 - RNA, 13 nt, Human
aaguauucuaaau

SEQ ID NO: 3623199 - RNA, 21 nt, Human
aaguauucuguacucuuagau

SEQ ID NO: 3623200 - RNA, 19 nt, Human
aaguauugcaucuguauaa

SEQ ID NO: 3623201 - RNA, 19 nt, Human
aaguauuuaagccuaaaga

SEQ ID NO: 3623202 - RNA, 17 nt, Human
aaguauuuaauuagugc

SEQ ID NO: 3623203 - RNA, 11 nt, Human
aaguauuuagg

SEQ ID NO: 3623204 - RNA, 13 nt, Human
aaguauuuauaau

SEQ ID NO: 3623205 - RNA, 14 nt, Human
aaguauuuauauau

SEQ ID NO: 3623206 - RNA, 15 nt, Human
aaguauuuauauauu

SEQ ID NO: 3623207 - RNA, 17 nt, Human
aaguauuuauauauuua

SEQ ID NO: 3623208 - RNA, 20 nt, Human
aaguauuuauauauuuauaa

SEQ ID NO: 3623209 - RNA, 21 nt, Human
aaguauuuauauauuuauaac

SEQ ID NO: 3623210 - RNA, 13 nt, Human
aaguauuucaaau

SEQ ID NO: 3623211 - RNA, 22 nt, Human
aaguauuucaaauuggagcuuc

SEQ ID NO: 3623212 - RNA, 13 nt, Human
aaguauuugggaa

SEQ ID NO: 3623213 - RNA, 19 nt, Human
aaguauuuguuaauuuaga

SEQ ID NO: 3623214 - RNA, 21 nt, Human
aaguauuuguuaauuuagaaa

SEQ ID NO: 3623215 - RNA, 22 nt, Human
aaguauuuucauaaguauuuca

SEQ ID NO: 3623216 - RNA, 14 nt, Human
aauaaaguaucuac

SEQ ID NO: 3623217 - RNA, 15 nt, Human
aauaaaguaucuaca

SEQ ID NO: 3623218 - RNA, 15 nt, Human
aauaaaguauuuaau

SEQ ID NO: 3623219 - RNA, 18 nt, Human
aauaaaguguaacaauug

SEQ ID NO: 3623220 - RNA, 13 nt, Human
aauaaaguguuuu

SEQ ID NO: 3623221 - RNA, 15 nt, Human
aauaaaguuugaucu

SEQ ID NO: 3623222 - RNA, 19 nt, Human
aauaaaguuugcuuagaaa

SEQ ID NO: 3623223 - RNA, 21 nt, Human
aauaaauagcuagacugguga

SEQ ID NO: 3623224 - RNA, 12 nt, Human
aauaaauauacc

SEQ ID NO: 3623225 - RNA, 11 nt, Human
aauaaauauau

SEQ ID NO: 3623226 - RNA, 16 nt, Human
aauaaauauauauauc

SEQ ID NO: 3623227 - RNA, 15 nt, Human
aauaaauauaucuac

SEQ ID NO: 3623228 - RNA, 20 nt, Human
aauaaauauccuuuaauuga

SEQ ID NO: 3623229 - RNA, 15 nt, Human
aauaaauaucuguac

SEQ ID NO: 3623230 - RNA, 11 nt, Human
aauaaauauga

SEQ ID NO: 3623231 - RNA, 20 nt, Human
aauaaauaugccucuccuuu

SEQ ID NO: 3623232 - RNA, 21 nt, Human
aauaaauauugucuuuuugua

SEQ ID NO: 3623233 - RNA, 22 nt, Human
aauaaaugagcuauguauuaac

SEQ ID NO: 3623234 - RNA, 17 nt, Human
aauaaaugcaauaugua

SEQ ID NO: 3623235 - RNA, 15 nt, Human
aauaaaugcccucuu

SEQ ID NO: 3623236 - RNA, 15 nt, Human
aauaaauggaaauca

SEQ ID NO: 3623237 - RNA, 22 nt, Human
aauaaaugguuuggugcuuuuu

SEQ ID NO: 3623238 - RNA, 14 nt, Human
aauaaauguaccug

SEQ ID NO: 3623239 - RNA, 20 nt, Human
aauaaauguaucuuauucac

SEQ ID NO: 3623240 - RNA, 21 nt, Human
aauaaauguaucuuauucaca

SEQ ID NO: 3623241 - RNA, 11 nt, Human
aauaaauguca

SEQ ID NO: 3623242 - RNA, 12 nt, Human
aauaaaugucuu

SEQ ID NO: 3623243 - RNA, 18 nt, Human
aauaaauguuuuauuucu

SEQ ID NO: 3623244 - RNA, 14 nt, Human
aauaaauucagaua

SEQ ID NO: 3623245 - RNA, 21 nt, Human
aauaaauucccaacuucucuu

SEQ ID NO: 3623246 - RNA, 20 nt, Human
aauaaauuguaauuguaaag

SEQ ID NO: 3623247 - RNA, 12 nt, Human
aauaaauuguau

SEQ ID NO: 3623248 - RNA, 18 nt, Human
aauaaauuguauauucac

SEQ ID NO: 3623249 - RNA, 22 nt, Human
aauaaauuguuuggcuuccucc

SEQ ID NO: 3623250 - RNA, 21 nt, Human
aauaaauuugacuuuucugua

SEQ ID NO: 3623251 - RNA, 18 nt, Human
aauaaauuugguucuaau

SEQ ID NO: 3623252 - RNA, 21 nt, Human
aauaaauuugguucuaauaga

SEQ ID NO: 3623253 - RNA, 13 nt, Human
aauaaauuuugaa

SEQ ID NO: 3623254 - RNA, 20 nt, Human
aauaaauuuugaaaaguaau

SEQ ID NO: 3623255 - RNA, 15 nt, Human
aauaacaauaaaaga

SEQ ID NO: 3623256 - RNA, 12 nt, Human
aauaacacacau

SEQ ID NO: 3623257 - RNA, 16 nt, Human
aauaacacagagagac

SEQ ID NO: 3623258 - RNA, 15 nt, Human
aauaacagauuucuc

SEQ ID NO: 3623259 - RNA, 15 nt, Human
aauaacagugcauau

SEQ ID NO: 3623260 - RNA, 22 nt, Human
aagucagaucugccuaaggacu

SEQ ID NO: 3623261 - RNA, 21 nt, Human
aagucagaugugguaacuguu

SEQ ID NO: 3623262 - RNA, 14 nt, Human
aagucagauguuug

SEQ ID NO: 3623263 - RNA, 22 nt, Human
aagucagcuccagcuuucugcc

SEQ ID NO: 3623264 - RNA, 16 nt, Human
aagucaggaaucauca

SEQ ID NO: 3623265 - RNA, 21 nt, Human
aagucaggcccuuauuuucaa

SEQ ID NO: 3623266 - RNA, 17 nt, Human
aagucaguguugagaug

SEQ ID NO: 3623267 - RNA, 15 nt, Human
aagucaguuucuaca

SEQ ID NO: 3623268 - RNA, 15 nt, Human
aagucauaauugcau

SEQ ID NO: 3623269 - RNA, 17 nt, Human
aagucauagccauaaau

SEQ ID NO: 3623270 - RNA, 20 nt, Human
aagucaucuugcuaccagua

SEQ ID NO: 3623271 - RNA, 23 nt, Human
aagucaucuugcuaccaguauuu

SEQ ID NO: 3623272 - RNA, 14 nt, Human
aagucaugaacaca

SEQ ID NO: 3623273 - RNA, 17 nt, Human
aagucaugaagcccaag

SEQ ID NO: 3623274 - RNA, 17 nt, Human
aagucaugauguuuuua

SEQ ID NO: 3623275 - RNA, 21 nt, Human
aagucaugauguuuuuaaaau

SEQ ID NO: 3623276 - RNA, 17 nt, Human
aagucaugcaaaggcug

SEQ ID NO: 3623277 - RNA, 21 nt, Human
aagucaugcguuuaaucacau

SEQ ID NO: 3623278 - RNA, 15 nt, Human
aagucaugcuccccu

SEQ ID NO: 3623279 - RNA, 15 nt, Human
aagucauggcugugc

SEQ ID NO: 3623280 - RNA, 19 nt, Human
aagucauguaaauacuguu

SEQ ID NO: 3623281 - RNA, 15 nt, Human
aagucauuaaagaca

SEQ ID NO: 3623282 - RNA, 19 nt, Human
aagucauuccuucuuuuua

SEQ ID NO: 3623283 - RNA, 20 nt, Human
aagucauuuuaacuuuauca

SEQ ID NO: 3623284 - RNA, 21 nt, Human
aaguccaaauguuuacaggga

SEQ ID NO: 3623285 - RNA, 15 nt, Human
aaguccaauaagaca

SEQ ID NO: 3623286 - RNA, 23 nt, Human
aaguccaggcuuuuuuaucaugu

SEQ ID NO: 3623287 - RNA, 17 nt, Human
aaguccagguccuggug

SEQ ID NO: 3623288 - RNA, 18 nt, Human
aaguccagguccuggugg

SEQ ID NO: 3623289 - RNA, 20 nt, Human
aaguccaguccaguccuauc

SEQ ID NO: 3623290 - RNA, 20 nt, Human
aagucccaccgguugcuucu

SEQ ID NO: 3623291 - RNA, 21 nt, Human
aaguccccaggccccaggaag

SEQ ID NO: 3623292 - RNA, 23 nt, Human
aaguccccaggccccaggaagcc

SEQ ID NO: 3623293 - RNA, 20 nt, Human
aaguccccucuccuccacau

SEQ ID NO: 3623294 - RNA, 21 nt, Human
aaguccccucuccuccacauu

SEQ ID NO: 3623295 - RNA, 11 nt, Human
aagucccugcc

SEQ ID NO: 3623296 - RNA, 22 nt, Human
aagucccuguaauuguuguuug

SEQ ID NO: 3623297 - RNA, 21 nt, Human
aagucccuguuuucugagccc

SEQ ID NO: 3623298 - RNA, 18 nt, Human
aaguccggccccaguaca

SEQ ID NO: 3623299 - RNA, 17 nt, Human
aaguccuacaagcuaaa

SEQ ID NO: 3623300 - RNA, 15 nt, Human
aaguccuggcuucag

SEQ ID NO: 3623301 - RNA, 19 nt, Human
aaguccuguaugucuguca

SEQ ID NO: 3623302 - RNA, 20 nt, Human
aaguccuguaugucugucau

SEQ ID NO: 3623303 - RNA, 16 nt, Human
aagucgguuaaaaugg

SEQ ID NO: 3623304 - RNA, 21 nt, Human
aagucguccuuacuccugugg

SEQ ID NO: 3623305 - RNA, 19 nt, Human
aagucguuuuccaaacuga

SEQ ID NO: 3623306 - RNA, 15 nt, Human
aagucuaaaguuuac

SEQ ID NO: 3623307 - RNA, 17 nt, Human
aagucuaaaguuuacag

SEQ ID NO: 3623308 - RNA, 20 nt, Human
aagucuaaaguuuacaguaa

SEQ ID NO: 3623309 - RNA, 16 nt, Human
aagucuaaauauuucc

SEQ ID NO: 3623310 - RNA, 19 nt, Human
aagucuaggagcugggagg

SEQ ID NO: 3623311 - RNA, 20 nt, Human
aagucuagguugguagaguu

SEQ ID NO: 3623312 - RNA, 13 nt, Human
aagucucaaggua

SEQ ID NO: 3623313 - RNA, 11 nt, Human
aagucucagcu

SEQ ID NO: 3623314 - RNA, 20 nt, Human
aagucucauagguuaaaaaa

SEQ ID NO: 3623315 - RNA, 21 nt, Human
aagucucauagguuaaaaaaa

SEQ ID NO: 3623316 - RNA, 17 nt, Human
aagucucaucuggggag

SEQ ID NO: 3623317 - RNA, 15 nt, Human
aagucuccaaagucu

SEQ ID NO: 3623318 - RNA, 12 nt, Human
aagucuccagcc

SEQ ID NO: 3623319 - RNA, 16 nt, Human
aagucuccagcccacg

SEQ ID NO: 3623320 - RNA, 19 nt, Human
aagucucccuucuguuucu

SEQ ID NO: 3623321 - RNA, 17 nt, Human
aagucucuaacaaugua

SEQ ID NO: 3623322 - RNA, 12 nt, Human
aagucucuguga

SEQ ID NO: 3623323 - RNA, 14 nt, Human
aagucucuuuuuua

SEQ ID NO: 3623324 - RNA, 15 nt, Human
aagucucuuuuuuac

SEQ ID NO: 3623325 - RNA, 22 nt, Human
aagucugccuauccuggccagg

SEQ ID NO: 3623326 - RNA, 13 nt, Human
aagucuguccuug

SEQ ID NO: 3623327 - RNA, 16 nt, Human
aagucuguccuugaag

SEQ ID NO: 3623328 - RNA, 15 nt, Human
aagucugugccugga

SEQ ID NO: 3623329 - RNA, 23 nt, Human
aagucugugugaugaacuuucuc

SEQ ID NO: 3623330 - RNA, 12 nt, Human
aagucuguuuua

SEQ ID NO: 3623331 - RNA, 22 nt, Human
aagucuuaaggacaaagugcca

SEQ ID NO: 3623332 - RNA, 18 nt, Human
aagucuuagauguauaua

SEQ ID NO: 3623333 - RNA, 17 nt, Human
aagucuugcuguggucu

SEQ ID NO: 3623334 - RNA, 16 nt, Human
aagucuuguauaacua

SEQ ID NO: 3623335 - RNA, 20 nt, Human
aagucuugugacuagugcug

SEQ ID NO: 3623336 - RNA, 14 nt, Human
aagucuuuaauaaa

SEQ ID NO: 3623337 - RNA, 16 nt, Human
aagucuuuaauaaaua

SEQ ID NO: 3623338 - RNA, 18 nt, Human
aagucuuuaggucuuugu

SEQ ID NO: 3623339 - RNA, 15 nt, Human
aagucuuucauggcu

SEQ ID NO: 3623340 - RNA, 12 nt, Human
aagucuuuuaaa

SEQ ID NO: 3623341 - RNA, 17 nt, Human
aagucuuuuaaaaagua

SEQ ID NO: 3623342 - RNA, 12 nt, Human
aagugaaaauau

SEQ ID NO: 3623343 - RNA, 13 nt, Human
aagugaaaaucuu

SEQ ID NO: 3623344 - RNA, 11 nt, Human
aagugaaauaa

SEQ ID NO: 3623345 - RNA, 10 nt, Human
aagugaaauu

SEQ ID NO: 3623346 - RNA, 15 nt, Human
aagugaaauuuauug

SEQ ID NO: 3623347 - RNA, 20 nt, Human
aagugaaauuuauugaggaa

SEQ ID NO: 3623348 - RNA, 13 nt, Human
aagugaaauuucu

SEQ ID NO: 3623349 - RNA, 18 nt, Human
aagugaaauuucuagccu

SEQ ID NO: 3623350 - RNA, 19 nt, Human
aagugaacacauuguguca

SEQ ID NO: 3623351 - RNA, 16 nt, Human
aagugaacacuagcca

SEQ ID NO: 3623352 - RNA, 16 nt, Human
aagugaagaaaaguga

SEQ ID NO: 3623353 - RNA, 23 nt, Human
aagugaagaauccuuuuguagaa

SEQ ID NO: 3623354 - RNA, 19 nt, Human
aagugaagacaaugacuua

SEQ ID NO: 3623355 - RNA, 16 nt, Human
aagugaagacuggaag

SEQ ID NO: 3623356 - RNA, 14 nt, Human
aagugaauaaacuu

SEQ ID NO: 3623357 - RNA, 18 nt, Human
aagugaauaaacuucagc

SEQ ID NO: 3623358 - RNA, 18 nt, Human
aagugaaugcucaaguuu

SEQ ID NO: 3623359 - RNA, 20 nt, Human
aagugaauuugaaugaaaaa

SEQ ID NO: 3623360 - RNA, 16 nt, Human
aagugaauuugccugu

SEQ ID NO: 3623361 - RNA, 20 nt, Human
aagugaauuugccuguaaca

SEQ ID NO: 3623362 - RNA, 18 nt, Human
aagugacaaggccccaga

SEQ ID NO: 3623363 - RNA, 15 nt, Human
aagugacagggaagc

SEQ ID NO: 3623364 - RNA, 19 nt, Human
aagugacagggaagcuaca

SEQ ID NO: 3623365 - RNA, 15 nt, Human
aagugacgguuccua

SEQ ID NO: 3623366 - RNA, 17 nt, Human
aagugacgguuccuaca

SEQ ID NO: 3623367 - RNA, 17 nt, Human
aagugacgguuuaaugg

SEQ ID NO: 3623368 - RNA, 19 nt, Human
aagugacuaauggcaugag

SEQ ID NO: 3623369 - RNA, 21 nt, Human
aagugacuuagcagaugcugg

SEQ ID NO: 3623370 - RNA, 15 nt, Human
aagugagacagucca

SEQ ID NO: 3623371 - RNA, 20 nt, Human
aagugagacaguccagccug

SEQ ID NO: 3623372 - RNA, 16 nt, Human
aagugagaccuuccuu

SEQ ID NO: 3623373 - RNA, 18 nt, Human
aagugagacuuugagggu

SEQ ID NO: 3623374 - RNA, 15 nt, Human
aagugagagcugggu

SEQ ID NO: 3623375 - RNA, 18 nt, Human
aagugagcaaaccugccc

SEQ ID NO: 3623376 - RNA, 16 nt, Human
aagugaggaugaaaaa

SEQ ID NO: 3623377 - RNA, 20 nt, Human
aagagcaucaugccucugag

SEQ ID NO: 3623378 - RNA, 22 nt, Human
aagagcaucaugccucugaggc

SEQ ID NO: 3623379 - RNA, 18 nt, Human
aagagcaugaaauuuuua

SEQ ID NO: 3623380 - RNA, 14 nt, Human
aagagccacugcca

SEQ ID NO: 3623381 - RNA, 20 nt, Human
aagagccauauaaguuugaa

SEQ ID NO: 3623382 - RNA, 14 nt, Human
aagagcccagucug

SEQ ID NO: 3623383 - RNA, 18 nt, Human
aagagccccacucucaga

SEQ ID NO: 3623384 - RNA, 21 nt, Human
aagagccugaucucuuccugu

SEQ ID NO: 3623385 - RNA, 16 nt, Human
aagagccugcaggugc

SEQ ID NO: 3623386 - RNA, 13 nt, Human
aagagccuggaga

SEQ ID NO: 3623387 - RNA, 14 nt, Human
aagagccuggagaa

SEQ ID NO: 3623388 - RNA, 20 nt, Human
aagagccuugguguccaccu

SEQ ID NO: 3623389 - RNA, 21 nt, Human
aagagccuugguguccaccug

SEQ ID NO: 3623390 - RNA, 14 nt, Human
aagagcuacauaau

SEQ ID NO: 3623391 - RNA, 20 nt, Human
aagagcuacguauuuaauag

SEQ ID NO: 3623392 - RNA, 13 nt, Human
aagagcuaggcag

SEQ ID NO: 3623393 - RNA, 15 nt, Human
aagagcuauacaguu

SEQ ID NO: 3623394 - RNA, 13 nt, Human
aagagcugcccuc

SEQ ID NO: 3623395 - RNA, 16 nt, Human
aagagcuuaacagugu

SEQ ID NO: 3623396 - RNA, 13 nt, Human
aagaggaaaagaa

SEQ ID NO: 3623397 - RNA, 16 nt, Human
aagaggaaaagaaauc

SEQ ID NO: 3623398 - RNA, 13 nt, Human
aagaggaagcaaa

SEQ ID NO: 3623399 - RNA, 22 nt, Human
aagaggagagaggaagcucucu

SEQ ID NO: 3623400 - RNA, 13 nt, Human
aagaggagcacuu

SEQ ID NO: 3623401 - RNA, 23 nt, Human
aagaggagcccccacccuguucc

SEQ ID NO: 3623402 - RNA, 14 nt, Human
aagaggcaagaggc

SEQ ID NO: 3623403 - RNA, 18 nt, Human
aagaggcaccaggaagcc

SEQ ID NO: 3623404 - RNA, 18 nt, Human
aagaggcaccugucccag

SEQ ID NO: 3623405 - RNA, 12 nt, Human
aaucuacuuaac

SEQ ID NO: 3623406 - RNA, 21 nt, Human
aaucuacuuaacccugacaaa

SEQ ID NO: 3623407 - RNA, 16 nt, Human
aaucuagaagaaauga

SEQ ID NO: 3623408 - RNA, 21 nt, Human
aaucuagaagaaaugaaauuu

SEQ ID NO: 3623409 - RNA, 16 nt, Human
aaucuagcuuauuuug

SEQ ID NO: 3623410 - RNA, 18 nt, Human
aaucuaggaaaauauuuu

SEQ ID NO: 3623411 - RNA, 19 nt, Human
aaucuaguauuucaugcug

SEQ ID NO: 3623412 - RNA, 17 nt, Human
aaucuaguuuacagaaa

SEQ ID NO: 3623413 - RNA, 17 nt, Human
aaucuauaaacaaugaa

SEQ ID NO: 3623414 - RNA, 18 nt, Human
aaucuauagaaaguguuc

SEQ ID NO: 3623415 - RNA, 20 nt, Human
aaucuaucugcuuaugcagu

SEQ ID NO: 3623416 - RNA, 14 nt, Human
aaucuaugaaguau

SEQ ID NO: 3623417 - RNA, 15 nt, Human
aaucuaugauuccag

SEQ ID NO: 3623418 - RNA, 17 nt, Human
aaucuaugccaaagauc

SEQ ID NO: 3623419 - RNA, 18 nt, Human
aaucuaugccaaagauca

SEQ ID NO: 3623420 - RNA, 22 nt, Human
aaucuauuaauagcugccuuaa

SEQ ID NO: 3623421 - RNA, 12 nt, Human
aaucuauuauac

SEQ ID NO: 3623422 - RNA, 13 nt, Human
aaucuauucagac

SEQ ID NO: 3623423 - RNA, 21 nt, Human
aaucuauucuguguugcauua

SEQ ID NO: 3623424 - RNA, 19 nt, Human
aaucuauugggauuuucua

SEQ ID NO: 3623425 - RNA, 11 nt, Human
aaucuauuuaa

SEQ ID NO: 3623426 - RNA, 21 nt, Human
aaucuauuuucuauguacuag

SEQ ID NO: 3623427 - RNA, 13 nt, Human
aaucucaaauaac

SEQ ID NO: 3623428 - RNA, 18 nt, Human
aaucucaaauuucuaaau

SEQ ID NO: 3623429 - RNA, 15 nt, Human
aaucucaaggaaucu

SEQ ID NO: 3623430 - RNA, 21 nt, Human
aagcauuuuauaaaucgcuuu

SEQ ID NO: 3623431 - RNA, 12 nt, Human
aagcauuuugua

SEQ ID NO: 3623432 - RNA, 14 nt, Human
aagcauuuuguaau

SEQ ID NO: 3623433 - RNA, 17 nt, Human
aagcauuuuguaauaau

SEQ ID NO: 3623434 - RNA, 12 nt, Human
aagccaaaacaa

SEQ ID NO: 3623435 - RNA, 19 nt, Human
aagccaaaacugagcauaa

SEQ ID NO: 3623436 - RNA, 19 nt, Human
aagccaaagaaaugaacau

SEQ ID NO: 3623437 - RNA, 22 nt, Human
aagccaaagcuaggccuggcca

SEQ ID NO: 3623438 - RNA, 16 nt, Human
aagccaacacccuguc

SEQ ID NO: 3623439 - RNA, 17 nt, Human
aagccaacuuguaaaua

SEQ ID NO: 3623440 - RNA, 18 nt, Human
aagccaagaggcugcagc

SEQ ID NO: 3623441 - RNA, 20 nt, Human
aagccaagggaaccuguguc

SEQ ID NO: 3623442 - RNA, 18 nt, Human
aagccaauaacacacagc

SEQ ID NO: 3623443 - RNA, 16 nt, Human
aagccaauccccuccu

SEQ ID NO: 3623444 - RNA, 21 nt, Human
aagccaauuucaaucuuauuu

SEQ ID NO: 3623445 - RNA, 13 nt, Human
aagccaauuuuuc

SEQ ID NO: 3623446 - RNA, 16 nt, Human
aagccaauuuuucugc

SEQ ID NO: 3623447 - RNA, 18 nt, Human
aagccaauuuuucugcac

SEQ ID NO: 3623448 - RNA, 21 nt, Human
aagccaauuuuucugcacuga

SEQ ID NO: 3623449 - RNA, 18 nt, Human
aagccacaagucuuccag

SEQ ID NO: 3623450 - RNA, 16 nt, Human
aagccacagacaauau

SEQ ID NO: 3623451 - RNA, 14 nt, Human
aagccacagcccag

SEQ ID NO: 3623452 - RNA, 14 nt, Human
aagccacagcuggu

SEQ ID NO: 3623453 - RNA, 14 nt, Human
aagccacaggccug

SEQ ID NO: 3623454 - RNA, 19 nt, Human
aagccacauuauuucuagu

SEQ ID NO: 3623455 - RNA, 14 nt, Human
aagccaccaacagc

SEQ ID NO: 3623456 - RNA, 16 nt, Human
aagccacccaaagcag

SEQ ID NO: 3623457 - RNA, 13 nt, Human
aagccaccucucc

SEQ ID NO: 3623458 - RNA, 15 nt, Human
aagccagaaccagau

SEQ ID NO: 3623459 - RNA, 14 nt, Human
aagccagaagcuga

SEQ ID NO: 3623460 - RNA, 16 nt, Human
aagccagaggcugggu

SEQ ID NO: 3623461 - RNA, 17 nt, Human
aagccagcaccggacca

SEQ ID NO: 3623462 - RNA, 15 nt, Human
aagccagcaggcucu

SEQ ID NO: 3623463 - RNA, 22 nt, Human
aagccagccaagcuuuaaauua

SEQ ID NO: 3623464 - RNA, 13 nt, Human
aagccagccuggu

SEQ ID NO: 3623465 - RNA, 14 nt, Human
aagccagcguccuc

SEQ ID NO: 3623466 - RNA, 17 nt, Human
aagccagcguccuccuc

SEQ ID NO: 3623467 - RNA, 20 nt, Human
aagccagcguccuccucugu

SEQ ID NO: 3623468 - RNA, 22 nt, Human
aagccagcugcccuaugggccu

SEQ ID NO: 3623469 - RNA, 21 nt, Human
aagccagcugccgaccagagc

SEQ ID NO: 3623470 - RNA, 14 nt, Human
aagccagcuuguuu

SEQ ID NO: 3623471 - RNA, 14 nt, Human
aagccagcuuuccc

SEQ ID NO: 3623472 - RNA, 15 nt, Human
aagccagcuuucccu

SEQ ID NO: 3623473 - RNA, 20 nt, Human
aagccaggaauuucccagga

SEQ ID NO: 3623474 - RNA, 24 nt, Human
aagccaggaauuucccaggacccu

SEQ ID NO: 3623475 - RNA, 16 nt, Human
aagccaggcucacuca

SEQ ID NO: 3623476 - RNA, 19 nt, Human
aagccagggucucucccuc

SEQ ID NO: 3623477 - RNA, 21 nt, Human
aagccagggucucucccucag

SEQ ID NO: 3623478 - RNA, 16 nt, Human
aagccagggugugucu

SEQ ID NO: 3623479 - RNA, 12 nt, Human
aagccagucuua

SEQ ID NO: 3623480 - RNA, 14 nt, Human
aagccagucuuaac

SEQ ID NO: 3623481 - RNA, 16 nt, Human
aagccaucaccucaga

SEQ ID NO: 3623482 - RNA, 18 nt, Human
aagccaucauguaaauua

SEQ ID NO: 3623483 - RNA, 14 nt, Human
aagccaucuuggua

SEQ ID NO: 3623484 - RNA, 15 nt, Human
aagccaucuuucuuu

SEQ ID NO: 3623485 - RNA, 15 nt, Human
aagccaugcuggaaa

SEQ ID NO: 3623486 - RNA, 20 nt, Human
aagccauggagauucucaua

SEQ ID NO: 3623487 - RNA, 21 nt, Human
aagccauguauaaaugugaua

SEQ ID NO: 3623488 - RNA, 18 nt, Human
aagccauguuuaagauuu

SEQ ID NO: 3623489 - RNA, 15 nt, Human
aagccauguuuauua

SEQ ID NO: 3623490 - RNA, 22 nt, Human
aagccauuaaaugaauauuuug

SEQ ID NO: 3623491 - RNA, 15 nt, Human
aagccauuccaaagu

SEQ ID NO: 3623492 - RNA, 12 nt, Human
aagcccaaccuc

SEQ ID NO: 3623493 - RNA, 17 nt, Human
aagcccaaccuccugac

SEQ ID NO: 3623494 - RNA, 23 nt, Human
aagcccacagcacagcucccugc

SEQ ID NO: 3623495 - RNA, 18 nt, Human
aagcccagagggucuggg

SEQ ID NO: 3623496 - RNA, 20 nt, Human
aagcccagcacugcuugagg

SEQ ID NO: 3623497 - RNA, 23 nt, Human
aagcccagcacugcuugaggaaa

SEQ ID NO: 3623498 - RNA, 22 nt, Human
aagcccagccccuacugcugug

SEQ ID NO: 3623499 - RNA, 13 nt, Human
aagcccagcuuga

SEQ ID NO: 3623500 - RNA, 14 nt, Human
aagcccaggaaagg

SEQ ID NO: 3623501 - RNA, 17 nt, Human
aagcccaggaaaggcuc

SEQ ID NO: 3623502 - RNA, 19 nt, Human
aagcccaggaaaggcucca

SEQ ID NO: 3623503 - RNA, 13 nt, Human
aagcccaggaggg

SEQ ID NO: 3623504 - RNA, 21 nt, Human
aagcccaggugccagccugag

SEQ ID NO: 3623505 - RNA, 20 nt, Human
aagcccauccugaccagcug

SEQ ID NO: 3623506 - RNA, 21 nt, Human
aagcccauucauuccauucug

SEQ ID NO: 3623507 - RNA, 13 nt, Human
aagccccacaugu

SEQ ID NO: 3623508 - RNA, 14 nt, Human
aagccccagcaagc

SEQ ID NO: 3623509 - RNA, 16 nt, Human
aagccccaugcuggag

SEQ ID NO: 3623510 - RNA, 17 nt, Human
aagccccaugcuggagc

SEQ ID NO: 3623511 - RNA, 18 nt, Human
aagccccaugcuggagcc

SEQ ID NO: 3623512 - RNA, 23 nt, Human
aagccccaugcuggagccugugu

SEQ ID NO: 3623513 - RNA, 15 nt, Human
aagccccauuaacug

SEQ ID NO: 3623514 - RNA, 16 nt, Human
aagcccccagcuaaga

SEQ ID NO: 3623515 - RNA, 23 nt, Human
aagcccccagcuaagaaccugga

SEQ ID NO: 3623516 - RNA, 14 nt, Human
aagccccucuuucu

SEQ ID NO: 3623517 - RNA, 12 nt, Human
aagcccuccuuc

SEQ ID NO: 3623518 - RNA, 12 nt, Human
aagcccuggccc

SEQ ID NO: 3623519 - RNA, 21 nt, Human
aagcccugugcuccauggcug

SEQ ID NO: 3623520 - RNA, 22 nt, Human
aagcccuguugacacaggucuu

SEQ ID NO: 3623521 - RNA, 15 nt, Human
aagcccuuccauguc

SEQ ID NO: 3623522 - RNA, 13 nt, Human
aagccggcggccc

SEQ ID NO: 3623523 - RNA, 19 nt, Human
aagccggcggcccaagccc

SEQ ID NO: 3623524 - RNA, 21 nt, Human
aagccggggaagagauccaaa

SEQ ID NO: 3623525 - RNA, 22 nt, Human
aagccggggaagagauccaaag

SEQ ID NO: 3623526 - RNA, 13 nt, Human
aagccguccuggc

SEQ ID NO: 3623527 - RNA, 21 nt, Human
aagccgugauuuucauugcug

SEQ ID NO: 3623528 - RNA, 22 nt, Human
aagccgugcucgccccagcagg

SEQ ID NO: 3623529 - RNA, 15 nt, Human
aagccguggcuuccc

SEQ ID NO: 3623530 - RNA, 23 nt, Human
aagccuaaaagugggcuugauuc

SEQ ID NO: 3623531 - RNA, 22 nt, Human
aagccuaagggauccugccugc

SEQ ID NO: 3623532 - RNA, 14 nt, Human
aagccuaccugcuc

SEQ ID NO: 3623533 - RNA, 20 nt, Human
aagccuagaagagcuucuga

SEQ ID NO: 3623534 - RNA, 22 nt, Human
aagccuagugaaggcuucucuc

SEQ ID NO: 3623535 - RNA, 15 nt, Human
aagccucaaaacaaa

SEQ ID NO: 3623536 - RNA, 17 nt, Human
aagccucaaauuugaac

SEQ ID NO: 3623537 - RNA, 21 nt, Human
aagccucaaauuugaacaugu

SEQ ID NO: 3623538 - RNA, 23 nt, Human
aagccucaagguuuuagguucua

SEQ ID NO: 3623539 - RNA, 20 nt, Human
aagccucauauuuaaagaca

SEQ ID NO: 3623540 - RNA, 12 nt, Human
aagccuccacag

SEQ ID NO: 3623541 - RNA, 23 nt, Human
aagccuccacagcgagggcagcu

SEQ ID NO: 3623542 - RNA, 16 nt, Human
aagccucccacgacug

SEQ ID NO: 3623543 - RNA, 14 nt, Human
aagccucuggcuag

SEQ ID NO: 3623544 - RNA, 13 nt, Human
aagccucuguguc

SEQ ID NO: 3623545 - RNA, 17 nt, Human
aagccucugugucacug

SEQ ID NO: 3623546 - RNA, 24 nt, Human
aagccugagggaaaggccagcacu

SEQ ID NO: 3623547 - RNA, 17 nt, Human
aagccugcaauuucaua

SEQ ID NO: 3623548 - RNA, 22 nt, Human
aagccugcaauuucauaugcug

SEQ ID NO: 3623549 - RNA, 19 nt, Human
aagccugcuuuuuaagugu

SEQ ID NO: 3623550 - RNA, 14 nt, Human
aaucuuuauugaga

SEQ ID NO: 3623551 - RNA, 18 nt, Human
aaucuuuauugagaaaga

SEQ ID NO: 3623552 - RNA, 17 nt, Human
aaucuuuccauauccau

SEQ ID NO: 3623553 - RNA, 17 nt, Human
aaucuuucuuuaccuga

SEQ ID NO: 3623554 - RNA, 16 nt, Human
aaucuuucuuucuuag

SEQ ID NO: 3623555 - RNA, 22 nt, Human
aaucuuucuuuugauucuuccu

SEQ ID NO: 3623556 - RNA, 19 nt, Human
aaucuuugaaagacuucca

SEQ ID NO: 3623557 - RNA, 19 nt, Human
aaucuuuuaugauugccuu

SEQ ID NO: 3623558 - RNA, 15 nt, Human
aaucuuuucacaaau

SEQ ID NO: 3623559 - RNA, 23 nt, Human
aaucuuuuccaggaaaaagaacu

SEQ ID NO: 3623560 - RNA, 22 nt, Human
aaucuuuucugaaucuucugaa

SEQ ID NO: 3623561 - RNA, 13 nt, Human
aaucuuuucuuau

SEQ ID NO: 3623562 - RNA, 15 nt, Human
aaugaaaaacaacca

SEQ ID NO: 3623563 - RNA, 16 nt, Human
aaugaaaaacaaccaa

SEQ ID NO: 3623564 - RNA, 14 nt, Human
aaugaaaaaugaaa

SEQ ID NO: 3623565 - RNA, 17 nt, Human
aaugaaaaauuuaagca

SEQ ID NO: 3623566 - RNA, 19 nt, Human
aaugaaaaauuuaagcauu

SEQ ID NO: 3623567 - RNA, 16 nt, Human
aaugaaaacaaugcag

SEQ ID NO: 3623568 - RNA, 18 nt, Human
aaugaaaacagaaugucu

SEQ ID NO: 3623569 - RNA, 11 nt, Human
aaugaaaauaa

SEQ ID NO: 3623570 - RNA, 13 nt, Human
aaugaaaauguca

SEQ ID NO: 3623571 - RNA, 14 nt, Human
aaugaaaaugucag

SEQ ID NO: 3623572 - RNA, 15 nt, Human
aaugaaaauguccau

SEQ ID NO: 3623573 - RNA, 16 nt, Human
aaugaaacaaagaguu

SEQ ID NO: 3623574 - RNA, 19 nt, Human
aaugaaacaaauaaucaca

SEQ ID NO: 3623575 - RNA, 17 nt, Human
aaugaaacauuuuguca

SEQ ID NO: 3623576 - RNA, 14 nt, Human
aaugaaacuuggau

SEQ ID NO: 3623577 - RNA, 16 nt, Human
aaugaaagacuguaca

SEQ ID NO: 3623578 - RNA, 13 nt, Human
aaugaaagaugau

SEQ ID NO: 3623579 - RNA, 16 nt, Human
aaugaaagcuguuccu

SEQ ID NO: 3623580 - RNA, 17 nt, Human
aaugaaagguacuauau

SEQ ID NO: 3623581 - RNA, 20 nt, Human
aaugaaagguacuauauuug

SEQ ID NO: 3623582 - RNA, 23 nt, Human
aaugaaagguacuauauuugcua

SEQ ID NO: 3623583 - RNA, 19 nt, Human
aaugaaagucuugugacua

SEQ ID NO: 3623584 - RNA, 21 nt, Human
aaugaaagucuugugacuagu

SEQ ID NO: 3623585 - RNA, 15 nt, Human
aaugaaaguuugcac

SEQ ID NO: 3623586 - RNA, 17 nt, Human
aaugaaaugcucuccuu

SEQ ID NO: 3623587 - RNA, 19 nt, Human
aaugaaaugcucuccuuuc

SEQ ID NO: 3623588 - RNA, 16 nt, Human
aaugaaauguaugugc

SEQ ID NO: 3623589 - RNA, 13 nt, Human
aaugaaauguuuu

SEQ ID NO: 3623590 - RNA, 14 nt, Human
aaugaaauguuuua

SEQ ID NO: 3623591 - RNA, 17 nt, Human
aauacugccagaugcug

SEQ ID NO: 3623592 - RNA, 20 nt, Human
aauacugccagaugcugaug

SEQ ID NO: 3623593 - RNA, 22 nt, Human
aauacugccagaugcugauguu

SEQ ID NO: 3623594 - RNA, 23 nt, Human
aauacugcuacagcaauuucuaa

SEQ ID NO: 3623595 - RNA, 13 nt, Human
aauacugcugaga

SEQ ID NO: 3623596 - RNA, 18 nt, Human
aauacugcugagauacau

SEQ ID NO: 3623597 - RNA, 16 nt, Human
aauacuguauuuugua

SEQ ID NO: 3623598 - RNA, 15 nt, Human
aauacuguguggaac

SEQ ID NO: 3623599 - RNA, 15 nt, Human
aauacuguuauucuu

SEQ ID NO: 3623600 - RNA, 18 nt, Human
aauacuguuauucuuugc

SEQ ID NO: 3623601 - RNA, 21 nt, Human
aauacuguuauucuuugcacu

SEQ ID NO: 3623602 - RNA, 16 nt, Human
aauacuguucuuucca

SEQ ID NO: 3623603 - RNA, 14 nt, Human
aauacuuaaauguu

SEQ ID NO: 3623604 - RNA, 22 nt, Human
aauacuuauauuuuuaauaaaa

SEQ ID NO: 3623605 - RNA, 21 nt, Human
aauacuucucaaaccuguuua

SEQ ID NO: 3623606 - RNA, 23 nt, Human
aauacuucucaaaccuguuuaaa

SEQ ID NO: 3623607 - RNA, 13 nt, Human
aauacuucuugug

SEQ ID NO: 3623608 - RNA, 21 nt, Human
aauacuucuuguguguaugca

SEQ ID NO: 3623609 - RNA, 22 nt, Human
aauacuugaaccauaaaauguc

SEQ ID NO: 3623610 - RNA, 14 nt, Human
aauacuuuaaagga

SEQ ID NO: 3623611 - RNA, 16 nt, Human
aauacuuuaaaggaaa

SEQ ID NO: 3623612 - RNA, 12 nt, Human
aauacuuuguau

SEQ ID NO: 3623613 - RNA, 14 nt, Human
aauacuuuuccuua

SEQ ID NO: 3623614 - RNA, 15 nt, Human
aauacuuuuccuuac

SEQ ID NO: 3623615 - RNA, 16 nt, Human
aauacuuuuucuaaug

SEQ ID NO: 3623616 - RNA, 17 nt, Human
aauagaaaacaggaaaa

SEQ ID NO: 3623617 - RNA, 12 nt, Human
aauagaaaagua

SEQ ID NO: 3623618 - RNA, 13 nt, Human
aauagaaaaguag

SEQ ID NO: 3623619 - RNA, 18 nt, Human
aauagaaaaguagacaau

SEQ ID NO: 3623620 - RNA, 12 nt, Human
aauagaaacaag

SEQ ID NO: 3623621 - RNA, 14 nt, Human
aauagaaagaaagu

SEQ ID NO: 3623622 - RNA, 19 nt, Human
aauagaaaguugcaaggca

SEQ ID NO: 3623623 - RNA, 16 nt, Human
aauagaaauuuccaga

SEQ ID NO: 3623624 - RNA, 16 nt, Human
aauagaaauuuuguaa

SEQ ID NO: 3623625 - RNA, 19 nt, Human
aauagaacaacauauacaa

SEQ ID NO: 3623626 - RNA, 17 nt, Human
aauagaacaaggcugag

SEQ ID NO: 3623627 - RNA, 20 nt, Human
aauagaaccauguugguugc

SEQ ID NO: 3623628 - RNA, 13 nt, Human
aauagaaggaaac

SEQ ID NO: 3623629 - RNA, 14 nt, Human
aauagaaggaaacu

SEQ ID NO: 3623630 - RNA, 15 nt, Human
aauagaauugacauu

SEQ ID NO: 3623631 - RNA, 21 nt, Human
aauagaauugacauugaaauc

SEQ ID NO: 3623632 - RNA, 17 nt, Human
aauagacaaaaaguaua

SEQ ID NO: 3623633 - RNA, 14 nt, Human
aauagacaaauaga

SEQ ID NO: 3623634 - RNA, 15 nt, Human
aauagacacauacau

SEQ ID NO: 3623635 - RNA, 22 nt, Human
aauagacacuccccgaagucuu

SEQ ID NO: 3623636 - RNA, 18 nt, Human
aauagacccacaagaggc

SEQ ID NO: 3623637 - RNA, 21 nt, Human
aauagacuguaacuuccaaau

SEQ ID NO: 3623638 - RNA, 15 nt, Human
aauagagacuguaga

SEQ ID NO: 3623639 - RNA, 16 nt, Human
aauagagccugaggga

SEQ ID NO: 3623640 - RNA, 16 nt, Human
aauagaguauaugcac

SEQ ID NO: 3623641 - RNA, 20 nt, Human
aauagauaagaguagaaacu

SEQ ID NO: 3623642 - RNA, 22 nt, Human
aauagauauaaauuuuuaagag

SEQ ID NO: 3623643 - RNA, 21 nt, Human
aauagauauccacuugagaca

SEQ ID NO: 3623644 - RNA, 15 nt, Human
aauagaucuuagggu

SEQ ID NO: 3623645 - RNA, 16 nt, Human
aauagaugucuuuuau

SEQ ID NO: 3623646 - RNA, 13 nt, Human
aauagcaaaagaa

SEQ ID NO: 3623647 - RNA, 19 nt, Human
aauagcaaaagaagaaguu

SEQ ID NO: 3623648 - RNA, 20 nt, Human
aauagcaaaagaagaaguuu

SEQ ID NO: 3623649 - RNA, 17 nt, Human
aauagcaacuuuugugu

SEQ ID NO: 3623650 - RNA, 19 nt, Human
aauagcaacuuuuguguaa

SEQ ID NO: 3623651 - RNA, 14 nt, Human
aauagcagccuuuc

SEQ ID NO: 3623652 - RNA, 13 nt, Human
aauagcauguugu

SEQ ID NO: 3623653 - RNA, 20 nt, Human
aauagccugccucuucucua

SEQ ID NO: 3623654 - RNA, 14 nt, Human
aauagccuguggcc

SEQ ID NO: 3623655 - RNA, 15 nt, Human
aauagcguucuugua

SEQ ID NO: 3623656 - RNA, 16 nt, Human
aauagcuaauaauguu

SEQ ID NO: 3623657 - RNA, 14 nt, Human
aauagcuagacugg

SEQ ID NO: 3623658 - RNA, 17 nt, Human
aauagcuauauccaugu

SEQ ID NO: 3623659 - RNA, 23 nt, Human
aauagcuauauccauguacugua

SEQ ID NO: 3623660 - RNA, 13 nt, Human
aauagcugggacu

SEQ ID NO: 3623661 - RNA, 16 nt, Human
aauagcuuaugaaaag

SEQ ID NO: 3623662 - RNA, 18 nt, Human
aauagcuuaugaaaagaa

SEQ ID NO: 3623663 - RNA, 19 nt, Human
aauagcuuaugaaaagaau

SEQ ID NO: 3623664 - RNA, 17 nt, Human
aauagcuuuuauuguau

SEQ ID NO: 3623665 - RNA, 24 nt, Human
aauagcuuuuuucucugauacaga

SEQ ID NO: 3623666 - RNA, 15 nt, Human
aauaggaaaaacuga

SEQ ID NO: 3623667 - RNA, 16 nt, Human
aauaggaaaaacugau

SEQ ID NO: 3623668 - RNA, 23 nt, Human
aauaggaaucauucagaaauguu

SEQ ID NO: 3623669 - RNA, 13 nt, Human
aauaggagaggau

SEQ ID NO: 3623670 - RNA, 15 nt, Human
aauaggagaggauga

SEQ ID NO: 3623671 - RNA, 20 nt, Human
aauaggagaggaugagagcc

SEQ ID NO: 3623672 - RNA, 17 nt, Human
aauaggagggaaaccuu

SEQ ID NO: 3623673 - RNA, 19 nt, Human
aauaggagggaaaccuuug

SEQ ID NO: 3623674 - RNA, 14 nt, Human
aauaggaugggcuu

SEQ ID NO: 3623675 - RNA, 14 nt, Human
aauaggcacuuuaa

SEQ ID NO: 3623676 - RNA, 17 nt, Human
aauaggcacuuuaaaac

SEQ ID NO: 3623677 - RNA, 22 nt, Human
aauaggcauuaacacaaaggag

SEQ ID NO: 3623678 - RNA, 22 nt, Human
aauaggcgaucacaacgugcau

SEQ ID NO: 3623679 - RNA, 18 nt, Human
aauaggcguaacuaauuu

SEQ ID NO: 3623680 - RNA, 13 nt, Human
aauaguaauauaa

SEQ ID NO: 3623681 - RNA, 14 nt, Human
aauaguaauauaau

SEQ ID NO: 3623682 - RNA, 16 nt, Human
aauaguaauauaauac

SEQ ID NO: 3623683 - RNA, 16 nt, Human
aauaguaauuuguaaa

SEQ ID NO: 3623684 - RNA, 21 nt, Human
aauaguaggcaagauggcaca

SEQ ID NO: 3623685 - RNA, 14 nt, Human
aauaguaugaaaau

SEQ ID NO: 3623686 - RNA, 18 nt, Human
aauaguaugaaaauggaa

SEQ ID NO: 3623687 - RNA, 13 nt, Human
aauaguauuuaug

SEQ ID NO: 3623688 - RNA, 16 nt, Human
aauaguauuucccauu

SEQ ID NO: 3623689 - RNA, 19 nt, Human
aauagucaaauugugugaa

SEQ ID NO: 3623690 - RNA, 16 nt, Human
aauagucauuccaaau

SEQ ID NO: 3623691 - RNA, 18 nt, Human
aauagucauuugugaauu

SEQ ID NO: 3623692 - RNA, 17 nt, Human
aauagucggugaagaaa

SEQ ID NO: 3623693 - RNA, 20 nt, Human
aauagugcuuaaaaaucauu

SEQ ID NO: 3623694 - RNA, 16 nt, Human
aauaguggccagacca

SEQ ID NO: 3623695 - RNA, 19 nt, Human
aauaguguccuaugcaaua

SEQ ID NO: 3623696 - RNA, 17 nt, Human
aaugauauauggauaau

SEQ ID NO: 3623697 - RNA, 16 nt, Human
aaugaucauaagucua

SEQ ID NO: 3623698 - RNA, 21 nt, Human
aaugauccccagcuguuuaug

SEQ ID NO: 3623699 - RNA, 22 nt, Human
aaugauccccagcuguuuaugc

SEQ ID NO: 3623700 - RNA, 23 nt, Human
aaugaucgaaaaaauaauuauuu

SEQ ID NO: 3623701 - RNA, 22 nt, Human
aaugaucucucugaauccuaag

SEQ ID NO: 3623702 - RNA, 12 nt, Human
aaugaucuuuuc

SEQ ID NO: 3623703 - RNA, 21 nt, Human
aaugaugaucaauuauaguuu

SEQ ID NO: 3623704 - RNA, 18 nt, Human
aaugaugaugauaaugau

SEQ ID NO: 3623705 - RNA, 20 nt, Human
aaugaugaugggaauugugu

SEQ ID NO: 3623706 - RNA, 18 nt, Human
aaugaugcccugcuccag

SEQ ID NO: 3623707 - RNA, 19 nt, Human
aaugauggcaauuuuguaa

SEQ ID NO: 3623708 - RNA, 13 nt, Human
aaugauggcccau

SEQ ID NO: 3623709 - RNA, 14 nt, Human
aaugauggcccauu

SEQ ID NO: 3623710 - RNA, 22 nt, Human
aaugauggcccauucuacuugc

SEQ ID NO: 3623711 - RNA, 23 nt, Human
aaugauguauguugaagccuuug

SEQ ID NO: 3623712 - RNA, 18 nt, Human
aaugauguccagaagaau

SEQ ID NO: 3623713 - RNA, 15 nt, Human
aaugaugugauacaa

SEQ ID NO: 3623714 - RNA, 15 nt, Human
aaugaugugcaaaac

SEQ ID NO: 3623715 - RNA, 21 nt, Human
aaugauguguacccaaacgug

SEQ ID NO: 3623716 - RNA, 13 nt, Human
aaugauuaauuaa

SEQ ID NO: 3623717 - RNA, 12 nt, Human
aaugauuauuuu

SEQ ID NO: 3623718 - RNA, 14 nt, Human
aaugauuauuuuca

SEQ ID NO: 3623719 - RNA, 23 nt, Human
aaugauuauuuucauuacaaugg

SEQ ID NO: 3623720 - RNA, 12 nt, Human
aaugauucaaaa

SEQ ID NO: 3623721 - RNA, 17 nt, Human
aaugauucaaaaaguca

SEQ ID NO: 3623722 - RNA, 15 nt, Human
aaugauucauguuau

SEQ ID NO: 3623723 - RNA, 12 nt, Human
aaugauugcuuu

SEQ ID NO: 3623724 - RNA, 16 nt, Human
aaugauugcuuuuaaa

SEQ ID NO: 3623725 - RNA, 22 nt, Human
aaugauugcuuuuaaaauuuua

SEQ ID NO: 3623726 - RNA, 13 nt, Human
aaugauuguaaaa

SEQ ID NO: 3623727 - RNA, 14 nt, Human
aaugauuuaaauuu

SEQ ID NO: 3623728 - RNA, 16 nt, Human
aaugauuucauucaau

SEQ ID NO: 3623729 - RNA, 20 nt, Human
aaugauuuccaaagagaaaa

SEQ ID NO: 3623730 - RNA, 21 nt, Human
aaugauuuuacuuagcaaugu

SEQ ID NO: 3623731 - RNA, 17 nt, Human
aaugauuuuucuuuaca

SEQ ID NO: 3623732 - RNA, 14 nt, Human
aaugcaaaaccuuu

SEQ ID NO: 3623733 - RNA, 20 nt, Human
aaugcaaaauuuuuuuaauc

SEQ ID NO: 3623734 - RNA, 21 nt, Human
aaugcaaagaugaaggucugu

SEQ ID NO: 3623735 - RNA, 16 nt, Human
aaugcaaauaacaaau

SEQ ID NO: 3623736 - RNA, 14 nt, Human
aaugcaacaugugu

SEQ ID NO: 3623737 - RNA, 21 nt, Human
aaugcaagagugauugcagcu

SEQ ID NO: 3623738 - RNA, 15 nt, Human
aaugcaauaugugaa

SEQ ID NO: 3623739 - RNA, 16 nt, Human
aaugcaauuugauuga

SEQ ID NO: 3623740 - RNA, 12 nt, Human
aaugcacaaaca

SEQ ID NO: 3623741 - RNA, 17 nt, Human
aaugcacaagaauggau

SEQ ID NO: 3623742 - RNA, 19 nt, Human
aaugcacaaugucuuggua

SEQ ID NO: 3623743 - RNA, 17 nt, Human
aaugcacagauauacuu

SEQ ID NO: 3623744 - RNA, 18 nt, Human
aaugcacagauauacuuu

SEQ ID NO: 3623745 - RNA, 19 nt, Human
aaugcacauauagacacau

SEQ ID NO: 3623746 - RNA, 17 nt, Human
aaugcacauccauuccc

SEQ ID NO: 3623747 - RNA, 15 nt, Human
aaugcacuuucuauc

SEQ ID NO: 3623748 - RNA, 22 nt, Human
aaugcacuuucuauccucugua

SEQ ID NO: 3623749 - RNA, 20 nt, Human
aaugcacuuuguucuggcuc

SEQ ID NO: 3623750 - RNA, 22 nt, Human
aaugcacuuuguucuggcucuu

SEQ ID NO: 3623751 - RNA, 12 nt, Human
aaugcagaacuc

SEQ ID NO: 3623752 - RNA, 18 nt, Human
aauauacuuuuacaagua

SEQ ID NO: 3623753 - RNA, 19 nt, Human
aauauacuuuuacaaguaa

SEQ ID NO: 3623754 - RNA, 14 nt, Human
aauauagaaacacg

SEQ ID NO: 3623755 - RNA, 15 nt, Human
aauauagauuaaauc

SEQ ID NO: 3623756 - RNA, 17 nt, Human
aauauagauuagaaaaa

SEQ ID NO: 3623757 - RNA, 15 nt, Human
aauauagcuauuuuu

SEQ ID NO: 3623758 - RNA, 18 nt, Human
aauauagcuguacaaaua

SEQ ID NO: 3623759 - RNA, 22 nt, Human
aauauagcuguacaaauauaag

SEQ ID NO: 3623760 - RNA, 23 nt, Human
aauauaggucucuucucccagaa

SEQ ID NO: 3623761 - RNA, 21 nt, Human
aauauauaaaaagaaaagaua

SEQ ID NO: 3623762 - RNA, 20 nt, Human
aauauauagcuggcaagaau

SEQ ID NO: 3623763 - RNA, 12 nt, Human
aauauauauaaa

SEQ ID NO: 3623764 - RNA, 16 nt, Human
aauauauauaaagaau

SEQ ID NO: 3623765 - RNA, 14 nt, Human
aauauauauacaua

SEQ ID NO: 3623766 - RNA, 17 nt, Human
aauauauauacauaugu

SEQ ID NO: 3623767 - RNA, 11 nt, Human
aauauauauau

SEQ ID NO: 3623768 - RNA, 22 nt, Human
aauauauauauauauaaaauaa

SEQ ID NO: 3623769 - RNA, 21 nt, Human
aauauauauauauaucaguuu

SEQ ID NO: 3623770 - RNA, 23 nt, Human
aauauauauauauaucaguuuga

SEQ ID NO: 3623771 - RNA, 20 nt, Human
aauauauaucuaucuauuug

SEQ ID NO: 3623772 - RNA, 22 nt, Human
aauauauaucuaucuauuugag

SEQ ID NO: 3623773 - RNA, 21 nt, Human
aauauauauuauacuuguaau

SEQ ID NO: 3623774 - RNA, 15 nt, Human
aauauauauuaucuu

SEQ ID NO: 3623775 - RNA, 18 nt, Human
aauauauauuaucuuuuc

SEQ ID NO: 3623776 - RNA, 13 nt, Human
aauauauauucug

SEQ ID NO: 3623777 - RNA, 22 nt, Human
aauauaucccagaaauuagaaa

SEQ ID NO: 3623778 - RNA, 21 nt, Human
aauauaucuaaauugaauaau

SEQ ID NO: 3623779 - RNA, 16 nt, Human
aauauaugaacauuag

SEQ ID NO: 3623780 - RNA, 22 nt, Human
aauauauggcauuugcagauuu

SEQ ID NO: 3623781 - RNA, 17 nt, Human
aauauauggucuaaugu

SEQ ID NO: 3623782 - RNA, 13 nt, Human
aauauauguauuu

SEQ ID NO: 3623783 - RNA, 22 nt, Human
aauauauguauuuuuauauaau

SEQ ID NO: 3623784 - RNA, 13 nt, Human
aauauaugugaaa

SEQ ID NO: 3623785 - RNA, 20 nt, Human
aauauauguuuaccuuuuaa

SEQ ID NO: 3623786 - RNA, 23 nt, Human
aauauauguuuaccuuuuaauua

SEQ ID NO: 3623787 - RNA, 15 nt, Human
aauauauuaccagca

SEQ ID NO: 3623788 - RNA, 20 nt, Human
aauauauuaccagcaagaau

SEQ ID NO: 3623789 - RNA, 18 nt, Human
aauauauuacuuaacugu

SEQ ID NO: 3623790 - RNA, 15 nt, Human
aauauauuauuacuu

SEQ ID NO: 3623791 - RNA, 18 nt, Human
aauauauuauuacuugua

SEQ ID NO: 3623792 - RNA, 20 nt, Human
aauauauuauuacuuguaaa

SEQ ID NO: 3623793 - RNA, 22 nt, Human
aauauauuauuacuuguaaaua

SEQ ID NO: 3623794 - RNA, 21 nt, Human
aauauauucagccuggcuuca

SEQ ID NO: 3623795 - RNA, 14 nt, Human
aauauauucucuuu

SEQ ID NO: 3623796 - RNA, 16 nt, Human
aauauauucucuuugg

SEQ ID NO: 3623797 - RNA, 17 nt, Human
aauauauucucuuuggu

SEQ ID NO: 3623798 - RNA, 19 nt, Human
aauauauugaacuuuugua

SEQ ID NO: 3623799 - RNA, 14 nt, Human
aauauauuuaaaaa

SEQ ID NO: 3623800 - RNA, 14 nt, Human
aauauauuuaaagg

SEQ ID NO: 3623801 - RNA, 19 nt, Human
aauauauuuaaagggaaau

SEQ ID NO: 3623802 - RNA, 19 nt, Human
aauauauuuaagauaauua

SEQ ID NO: 3623803 - RNA, 21 nt, Human
aauauauuuauaaggaaauuu

SEQ ID NO: 3623804 - RNA, 20 nt, Human
aauauauuuauuuaaagcau

SEQ ID NO: 3623805 - RNA, 15 nt, Human
aauauauuucagaua

SEQ ID NO: 3623806 - RNA, 19 nt, Human
aauauauuucuaaauguuu

SEQ ID NO: 3623807 - RNA, 14 nt, Human
aauauauuuuaaga

SEQ ID NO: 3623808 - RNA, 18 nt, Human
aauauauuuuaagacgaa

SEQ ID NO: 3623809 - RNA, 21 nt, Human
aauauauuuuaagacgaaaca

SEQ ID NO: 3623810 - RNA, 15 nt, Human
aauauauuuucuguu

SEQ ID NO: 3623811 - RNA, 13 nt, Human
aauauauuuugua

SEQ ID NO: 3623812 - RNA, 16 nt, Human
aauauauuuuguaugc

SEQ ID NO: 3623813 - RNA, 14 nt, Human
aauaucaaagucau

SEQ ID NO: 3623814 - RNA, 14 nt, Human
aauaucaaaugcag

SEQ ID NO: 3623815 - RNA, 22 nt, Human
aauaucaaaugcaguauauuuc

SEQ ID NO: 3623816 - RNA, 13 nt, Human
aauaucaaauuaa

SEQ ID NO: 3623817 - RNA, 14 nt, Human
aauaucaaauuaau

SEQ ID NO: 3623818 - RNA, 15 nt, Human
aauaucaauauaaug

SEQ ID NO: 3623819 - RNA, 14 nt, Human
aauaucaaucauuu

SEQ ID NO: 3623820 - RNA, 23 nt, Human
aauaucaccaaaaaccuauucca

SEQ ID NO: 3623821 - RNA, 17 nt, Human
aauaucacucauuaauu

SEQ ID NO: 3623822 - RNA, 22 nt, Human
aauaucacuugucaauaaaauc

SEQ ID NO: 3623823 - RNA, 21 nt, Human
aauaucaguuacucagcccug

SEQ ID NO: 3623824 - RNA, 14 nt, Human
aauaucauucagca

SEQ ID NO: 3623825 - RNA, 16 nt, Human
aauaucauucagcaac

SEQ ID NO: 3623826 - RNA, 23 nt, Human
aauaucauuuauuuuuuacauua

SEQ ID NO: 3623827 - RNA, 17 nt, Human
aauauccaggucaacag

SEQ ID NO: 3623828 - RNA, 20 nt, Human
aauauccaggucaacagaau

SEQ ID NO: 3623829 - RNA, 21 nt, Human
aauaucccagaaaaaguaacu

SEQ ID NO: 3623830 - RNA, 16 nt, Human
aauauccccucccagu

SEQ ID NO: 3623831 - RNA, 17 nt, Human
aauaucccuacauguau

SEQ ID NO: 3623832 - RNA, 19 nt, Human
aauaucccuacauguauug

SEQ ID NO: 3623833 - RNA, 19 nt, Human
aauaucccuccuguuggga

SEQ ID NO: 3623834 - RNA, 22 nt, Human
aauaucccuccuguugggagag

SEQ ID NO: 3623835 - RNA, 22 nt, Human
aauaucccuuggacauuuuaug

SEQ ID NO: 3623836 - RNA, 15 nt, Human
aauauccuaaacauc

SEQ ID NO: 3623837 - RNA, 17 nt, Human
aauauccuaaacaucau

SEQ ID NO: 3623838 - RNA, 13 nt, Human
aauauccucaauu

SEQ ID NO: 3623839 - RNA, 20 nt, Human
aauaucuaauauauaugaau

SEQ ID NO: 3623840 - RNA, 13 nt, Human
aauccucuuccuc

SEQ ID NO: 3623841 - RNA, 14 nt, Human
aauccucuuccucu

SEQ ID NO: 3623842 - RNA, 15 nt, Human
aauccucuuccucug

SEQ ID NO: 3623843 - RNA, 20 nt, Human
aauccucuuccucugaggcu

SEQ ID NO: 3623844 - RNA, 11 nt, Human
aauccuggcug

SEQ ID NO: 3623845 - RNA, 14 nt, Human
aauccuggggaaca

SEQ ID NO: 3623846 - RNA, 12 nt, Human
aauccugguucc

SEQ ID NO: 3623847 - RNA, 14 nt, Human
aauccugugugguu

SEQ ID NO: 3623848 - RNA, 22 nt, Human
aauccugugugguuuaguguaa

SEQ ID NO: 3623849 - RNA, 14 nt, Human
aauccuguugaaaa

SEQ ID NO: 3623850 - RNA, 20 nt, Human
aauccuugaagguauaucua

SEQ ID NO: 3623851 - RNA, 17 nt, Human
aauccuugauaauauau

SEQ ID NO: 3623852 - RNA, 17 nt, Human
aauccuugaugauugac

SEQ ID NO: 3623853 - RNA, 13 nt, Human
aaucgauggggga

SEQ ID NO: 3623854 - RNA, 20 nt, Human
aaucgaugggggaugcuuca

SEQ ID NO: 3623855 - RNA, 21 nt, Human
aaucgaugggggaugcuucau

SEQ ID NO: 3623856 - RNA, 23 nt, Human
aaucgcuccaccuugcagcucuc

SEQ ID NO: 3623857 - RNA, 18 nt, Human
aaucggcccacagcuccc

SEQ ID NO: 3623858 - RNA, 15 nt, Human
aaucgggguauaaua

SEQ ID NO: 3623859 - RNA, 19 nt, Human
aaucgggguauaauaggcu

SEQ ID NO: 3623860 - RNA, 16 nt, Human
aaucuaaaucuauuua

SEQ ID NO: 3623861 - RNA, 19 nt, Human
aaucuaaaucuauuuauua

SEQ ID NO: 3623862 - RNA, 13 nt, Human
aaucuaaauggaa

SEQ ID NO: 3623863 - RNA, 15 nt, Human
aaucuaacauuauua

SEQ ID NO: 3623864 - RNA, 20 nt, Human
aaucuaagcagcuuauuguu

SEQ ID NO: 3623865 - RNA, 12 nt, Human
aaucuaagggaa

SEQ ID NO: 3623866 - RNA, 18 nt, Human
aaucuaauauccccaaau

SEQ ID NO: 3623867 - RNA, 19 nt, Human
aaucuaauauuaaaaauau

SEQ ID NO: 3623868 - RNA, 19 nt, Human
aaucuacacuccagugaga

SEQ ID NO: 3623869 - RNA, 22 nt, Human
aaucuaccuucuguaguuuuau

SEQ ID NO: 3623870 - RNA, 15 nt, Human
aaucuacuaauucca

SEQ ID NO: 3623871 - RNA, 16 nt, Human
aaucuacucaaagcau

SEQ ID NO: 3623872 - RNA, 14 nt, Human
aaucuacugcauuu

SEQ ID NO: 3623873 - RNA, 15 nt, Human
aaucuacugcauuua

SEQ ID NO: 3623874 - RNA, 20 nt, Human
aaucuacugugguguuuugu

SEQ ID NO: 3623875 - RNA, 22 nt, Human
aaucuagaagaaaugaaauuuu

SEQ ID NO: 3623876 - RNA, 13 nt, Human
aaucuagacaaua

SEQ ID NO: 3623877 - RNA, 16 nt, Human
aaucuagacaauauac

SEQ ID NO: 3623878 - RNA, 21 nt, Human
aaucuagaggaaaagaaagaa

SEQ ID NO: 3623879 - RNA, 22 nt, Human
aaucuagccagugaacauaauu

SEQ ID NO: 3623880 - RNA, 16 nt, Human
aaucuaggaaaauauu

SEQ ID NO: 3623881 - RNA, 15 nt, Human
aaucuaguuuacaga

SEQ ID NO: 3623882 - RNA, 14 nt, Human
aaucuauagaaagu

SEQ ID NO: 3623883 - RNA, 21 nt, Human
aaucuauccaaaucugaagau

SEQ ID NO: 3623884 - RNA, 16 nt, Human
aaucuaugccaaagau

SEQ ID NO: 3623885 - RNA, 20 nt, Human
aaucuaugccaaagaucacu

SEQ ID NO: 3623886 - RNA, 17 nt, Human
aaucuauuauacuguau

SEQ ID NO: 3623887 - RNA, 18 nt, Human
aaucuauuggguucauua

SEQ ID NO: 3623888 - RNA, 19 nt, Human
aaucuauuggguucauuau

SEQ ID NO: 3623889 - RNA, 12 nt, Human
aaucuauuuaag

SEQ ID NO: 3623890 - RNA, 17 nt, Human
aaucuauuuaucuucau

SEQ ID NO: 3623891 - RNA, 16 nt, Human
aaucuauuuauuaaua

SEQ ID NO: 3623892 - RNA, 17 nt, Human
aaucuauuuauuaauau

SEQ ID NO: 3623893 - RNA, 22 nt, Human
aaucuauuuauuggacaugucc

SEQ ID NO: 3623894 - RNA, 17 nt, Human
aaucuauuuucuaugua

SEQ ID NO: 3623895 - RNA, 19 nt, Human
aaucuauuuucucauugcu

SEQ ID NO: 3623896 - RNA, 14 nt, Human
aaucuauuuuguaa

SEQ ID NO: 3623897 - RNA, 22 nt, Human
aaucucaaauaggcuauuaaaa

SEQ ID NO: 3623898 - RNA, 20 nt, Human
aaucucaaauucucaaccua

SEQ ID NO: 3623899 - RNA, 12 nt, Human
aaucucaaauuu

SEQ ID NO: 3623900 - RNA, 14 nt, Human
aaucucaaauuucu

SEQ ID NO: 3623901 - RNA, 16 nt, Human
aaucucaaauuucuaa

SEQ ID NO: 3623902 - RNA, 17 nt, Human
aaucucaaauuucuaaa

SEQ ID NO: 3623903 - RNA, 23 nt, Human
aaucucagagguagggcugccac

SEQ ID NO: 3623904 - RNA, 16 nt, Human
aaucucagugcuuucc

SEQ ID NO: 3623905 - RNA, 21 nt, Human
aaucucaguugauuuucugga

SEQ ID NO: 3623906 - RNA, 22 nt, Human
aaucucaguugauuuucuggau

SEQ ID NO: 3623907 - RNA, 17 nt, Human
aaucucauugcuuacaa

SEQ ID NO: 3623908 - RNA, 14 nt, Human
aaucuccaaaauaa

SEQ ID NO: 3623909 - RNA, 21 nt, Human
aaucuccaccagucauuuuuc

SEQ ID NO: 3623910 - RNA, 22 nt, Human
aaucuccaccagucauuuuuca

SEQ ID NO: 3623911 - RNA, 14 nt, Human
aaucuccuauuuuu

SEQ ID NO: 3623912 - RNA, 23 nt, Human
aaucucgcucugucgcccaggcu

SEQ ID NO: 3623913 - RNA, 15 nt, Human
aaucucguuucaaaa

SEQ ID NO: 3623914 - RNA, 19 nt, Human
aaucucucaaaucuguuau

SEQ ID NO: 3623915 - RNA, 20 nt, Human
aaucucuccacuuucagcug

SEQ ID NO: 3623916 - RNA, 14 nt, Human
aaucucucucuguu

SEQ ID NO: 3623917 - RNA, 18 nt, Human
aaucucucucuguugugu

SEQ ID NO: 3623918 - RNA, 15 nt, Human
aaucucucugcagcu

SEQ ID NO: 3623919 - RNA, 14 nt, Human
aaucucuguaggaa

SEQ ID NO: 3623920 - RNA, 14 nt, Human
aaucucuguuaugu

SEQ ID NO: 3623921 - RNA, 20 nt, Human
aaucucuguuauguacugua

SEQ ID NO: 3623922 - RNA, 21 nt, Human
aaucucuucauuauucucugc

SEQ ID NO: 3623923 - RNA, 21 nt, Human
aaucucuucuaaaaaaaaaca

SEQ ID NO: 3623924 - RNA, 11 nt, Human
aaucucuucug

SEQ ID NO: 3623925 - RNA, 17 nt, Human
aaucugaagauuguuua

SEQ ID NO: 3623926 - RNA, 18 nt, Human
aaucugaagauuguuuau

SEQ ID NO: 3623927 - RNA, 18 nt, Human
aaucugaagcuucacuca

SEQ ID NO: 3623928 - RNA, 23 nt, Human
aaucugaggaauggacauuucua

SEQ ID NO: 3623929 - RNA, 15 nt, Human
aaucugagggaaaug

SEQ ID NO: 3623930 - RNA, 20 nt, Human
aaucugagggaaauguuuug

SEQ ID NO: 3623931 - RNA, 16 nt, Human
aaucugaucguucuuu

SEQ ID NO: 3623932 - RNA, 17 nt, Human
aaucugauggccuuaau

SEQ ID NO: 3623933 - RNA, 18 nt, Human
aaucugauggccuuaauu

SEQ ID NO: 3623934 - RNA, 20 nt, Human
aaucugauggccuuaauuuc

SEQ ID NO: 3623935 - RNA, 18 nt, Human
aaucugauuggacauuuu

SEQ ID NO: 3623936 - RNA, 19 nt, Human
aaucugauuggacauuuuc

SEQ ID NO: 3623937 - RNA, 19 nt, Human
aaucugcaaagcauguuuu

SEQ ID NO: 3623938 - RNA, 19 nt, Human
aaucugcaauuucuacuac

SEQ ID NO: 3623939 - RNA, 18 nt, Human
aaucugcauuauuggaau

SEQ ID NO: 3623940 - RNA, 10 nt, Human
aaucugccug

SEQ ID NO: 3623941 - RNA, 14 nt, Human
aaucugcucacuuu

SEQ ID NO: 3623942 - RNA, 21 nt, Human
aaucuggaccccaucugugaa

SEQ ID NO: 3623943 - RNA, 22 nt, Human
aaucuggaccccaucugugaau

SEQ ID NO: 3623944 - RNA, 23 nt, Human
aaucuggaccccaucugugaaua

SEQ ID NO: 3623945 - RNA, 18 nt, Human
aaucuggacuccucuguc

SEQ ID NO: 3623946 - RNA, 20 nt, Human
aaucuggacuccucugucca

SEQ ID NO: 3623947 - RNA, 15 nt, Human
aaucuggagaccagg

SEQ ID NO: 3623948 - RNA, 18 nt, Human
aaucuggauucauauuua

SEQ ID NO: 3623949 - RNA, 21 nt, Human
aaucuggcuucuggccaggaa

SEQ ID NO: 3623950 - RNA, 16 nt, Human
aaucugggccagaauu

SEQ ID NO: 3623951 - RNA, 12 nt, Human
aaucuguaaacu

SEQ ID NO: 3623952 - RNA, 14 nt, Human
aaucuguaaacugu

SEQ ID NO: 3623953 - RNA, 16 nt, Human
aaucuguaaacugugu

SEQ ID NO: 3623954 - RNA, 13 nt, Human
aaucuguacaaug

SEQ ID NO: 3623955 - RNA, 13 nt, Human
aaucuguacauuu

SEQ ID NO: 3623956 - RNA, 14 nt, Human
aaucuguacauuuu

SEQ ID NO: 3623957 - RNA, 19 nt, Human
aaucuguacauuuuguugu

SEQ ID NO: 3623958 - RNA, 22 nt, Human
aagguagaaugaccuuguaaug

SEQ ID NO: 3623959 - RNA, 13 nt, Human
aagguagaauguu

SEQ ID NO: 3623960 - RNA, 14 nt, Human
aagguagaauguuu

SEQ ID NO: 3623961 - RNA, 20 nt, Human
aagguagcccuggccagagg

SEQ ID NO: 3623962 - RNA, 15 nt, Human
aagguaguucaagaa

SEQ ID NO: 3623963 - RNA, 16 nt, Human
aagguauaauaaaauu

SEQ ID NO: 3623964 - RNA, 20 nt, Human
aagguaucaguugcaauaau

SEQ ID NO: 3623965 - RNA, 21 nt, Human
aagguauuaagauuauaauug

SEQ ID NO: 3623966 - RNA, 22 nt, Human
aagguauuaagauuauaauugu

SEQ ID NO: 3623967 - RNA, 19 nt, Human
aagguauuugggaaacuug

SEQ ID NO: 3623968 - RNA, 15 nt, Human
aagguauuuugaaua

SEQ ID NO: 3623969 - RNA, 23 nt, Human
aaggucauggccacacugugaca

SEQ ID NO: 3623970 - RNA, 14 nt, Human
aaggucauuuccau

SEQ ID NO: 3623971 - RNA, 20 nt, Human
aaggucauuuccauguaugc

SEQ ID NO: 3623972 - RNA, 14 nt, Human
aaggucauuucuuc

SEQ ID NO: 3623973 - RNA, 17 nt, Human
aaggucauuucuucagu

SEQ ID NO: 3623974 - RNA, 20 nt, Human
aagguccucugucagucaca

SEQ ID NO: 3623975 - RNA, 18 nt, Human
aagguccugaaaguaacu

SEQ ID NO: 3623976 - RNA, 14 nt, Human
aaggucggaccagc

SEQ ID NO: 3623977 - RNA, 18 nt, Human
aaggucggaggcuuggga

SEQ ID NO: 3623978 - RNA, 20 nt, Human
aaggucggaggcuugggacc

SEQ ID NO: 3623979 - RNA, 13 nt, Human
aaggucuaugcag

SEQ ID NO: 3623980 - RNA, 12 nt, Human
aaggucucucuu

SEQ ID NO: 3623981 - RNA, 16 nt, Human
aaggucucucuuugga

SEQ ID NO: 3623982 - RNA, 20 nt, Human
aaggucucucuuuggacucu

SEQ ID NO: 3623983 - RNA, 14 nt, Human
aaggucugagccac

SEQ ID NO: 3623984 - RNA, 19 nt, Human
aaggucugagccacagcag

SEQ ID NO: 3623985 - RNA, 15 nt, Human
aaucuguuuuucuaa

SEQ ID NO: 3623986 - RNA, 23 nt, Human
aaucuguuuuuguuuauuucauu

SEQ ID NO: 3623987 - RNA, 21 nt, Human
aaucuuaaaaaguuguucaac

SEQ ID NO: 3623988 - RNA, 12 nt, Human
aaucuuaauacu

SEQ ID NO: 3623989 - RNA, 14 nt, Human
aaucuuaauacugu

SEQ ID NO: 3623990 - RNA, 15 nt, Human
aaucuuaauguuccu

SEQ ID NO: 3623991 - RNA, 14 nt, Human
aaucuuacagcugg

SEQ ID NO: 3623992 - RNA, 13 nt, Human
aaucuuacuuugu

SEQ ID NO: 3623993 - RNA, 14 nt, Human
aaucuuacuuugua

SEQ ID NO: 3623994 - RNA, 15 nt, Human
aaucuuacuuuguaa

SEQ ID NO: 3623995 - RNA, 18 nt, Human
aaucuuaguguaugauua

SEQ ID NO: 3623996 - RNA, 15 nt, Human
aaucuuauaguucua

SEQ ID NO: 3623997 - RNA, 18 nt, Human
aaucuuauaguucuaggc

SEQ ID NO: 3623998 - RNA, 22 nt, Human
aaucuuaucaagaguugugaca

SEQ ID NO: 3623999 - RNA, 13 nt, Human
aaucuuauuaaag

SEQ ID NO: 3624000 - RNA, 15 nt, Human
aaucuuauuaaaguu

SEQ ID NO: 3624001 - RNA, 16 nt, Human
aaucuuauuaaaguuu

SEQ ID NO: 3624002 - RNA, 19 nt, Human
aaucuuauuaaaguuucaa

SEQ ID NO: 3624003 - RNA, 20 nt, Human
aaucuuauuagggagaaaau

SEQ ID NO: 3624004 - RNA, 14 nt, Human
aaucuucaguauuu

SEQ ID NO: 3624005 - RNA, 22 nt, Human
aaucuucaguuuuaucuuuaau

SEQ ID NO: 3624006 - RNA, 21 nt, Human
aaucuuccuggucgaaaguua

SEQ ID NO: 3624007 - RNA, 23 nt, Human
aaucuuccuggucgaaaguuagu

SEQ ID NO: 3624008 - RNA, 14 nt, Human
aaucuuccuuuuau

SEQ ID NO: 3624009 - RNA, 20 nt, Human
aaucuucugaacuuggcgcu

SEQ ID NO: 3624010 - RNA, 23 nt, Human
aaucuucugaacuuggcgcugcc

SEQ ID NO: 3624011 - RNA, 17 nt, Human
aaucuugaaauuaagaa

SEQ ID NO: 3624012 - RNA, 22 nt, Human
aaucuugacuacagucaggaaa

SEQ ID NO: 3624013 - RNA, 13 nt, Human
aaucuugcaugua

SEQ ID NO: 3624014 - RNA, 12 nt, Human
aaucuuggaagu

SEQ ID NO: 3624015 - RNA, 13 nt, Human
aaucuugguuugc

SEQ ID NO: 3624016 - RNA, 15 nt, Human
aaucuugucaugugu

SEQ ID NO: 3624017 - RNA, 15 nt, Human
aaucuugucucaaug

SEQ ID NO: 3624018 - RNA, 18 nt, Human
aaucuugucucaaugcuc

SEQ ID NO: 3624019 - RNA, 14 nt, Human
aaucuugugaaaau

SEQ ID NO: 3624020 - RNA, 19 nt, Human
aaucuugugaaaauaauug

SEQ ID NO: 3624021 - RNA, 18 nt, Human
aaucuugugcuagaauac

SEQ ID NO: 3624022 - RNA, 19 nt, Human
aaucuugugcuagaauacu

SEQ ID NO: 3624023 - RNA, 16 nt, Human
aaucuuguuucugaaa

SEQ ID NO: 3624024 - RNA, 23 nt, Human
aaucuuguuuugaaaauaaccua

SEQ ID NO: 3624025 - RNA, 20 nt, Human
aaucuuuaaaaaaaaaauug

SEQ ID NO: 3624026 - RNA, 13 nt, Human
aaucuuuaauuaa

SEQ ID NO: 3624027 - RNA, 16 nt, Human
aaucuuuaauuuuaca

SEQ ID NO: 3624028 - RNA, 18 nt, Human
aaucuuuaccuguauaca

SEQ ID NO: 3624029 - RNA, 20 nt, Human
aaucuuuaccuguauacagu

SEQ ID NO: 3624030 - RNA, 17 nt, Human
aaucuuuagaaaaggca

SEQ ID NO: 3624031 - RNA, 15 nt, Human
aaucuuucuuuaccu

SEQ ID NO: 3624032 - RNA, 17 nt, Human
aaucuuucuuucuuaga

SEQ ID NO: 3624033 - RNA, 19 nt, Human
aaucuuucuuucuuagaaa

SEQ ID NO: 3624034 - RNA, 14 nt, Human
aaucuuugaaagac

SEQ ID NO: 3624035 - RNA, 16 nt, Human
aaucuuugaaagacuu

SEQ ID NO: 3624036 - RNA, 21 nt, Human
aaucuuugaaagguuagagaa

SEQ ID NO: 3624037 - RNA, 18 nt, Human
aaucuuuguaccaaaauu

SEQ ID NO: 3624038 - RNA, 13 nt, Human
aaucuuuguuaag

SEQ ID NO: 3624039 - RNA, 21 nt, Human
aaucuuuuaaaaauucaaaug

SEQ ID NO: 3624040 - RNA, 12 nt, Human
aaucuuuuacaa

SEQ ID NO: 3624041 - RNA, 14 nt, Human
aaucuuuucacaaa

SEQ ID NO: 3624042 - RNA, 15 nt, Human
aaucuuuucuuauuu

SEQ ID NO: 3624043 - RNA, 13 nt, Human
aaucuuuugaagc

SEQ ID NO: 3624044 - RNA, 21 nt, Human
aaucuuuuuuagcauaaaauu

SEQ ID NO: 3624045 - RNA, 14 nt, Human
aaucuuuuuuaugu

SEQ ID NO: 3624046 - RNA, 21 nt, Human
aaugaaaaauagugucuuugu

SEQ ID NO: 3624047 - RNA, 13 nt, Human
aaugaaaaaugaa

SEQ ID NO: 3624048 - RNA, 14 nt, Human
aaugaaaaauucca

SEQ ID NO: 3624049 - RNA, 17 nt, Human
aaugaaaaauucucagu

SEQ ID NO: 3624050 - RNA, 12 nt, Human
aaugaaaacaau

SEQ ID NO: 3624051 - RNA, 22 nt, Human
aaugaaaacaguguguaaacaa

SEQ ID NO: 3624052 - RNA, 13 nt, Human
aaugaaaagagaa

SEQ ID NO: 3624053 - RNA, 16 nt, Human
aaugaaaaugaauauc

SEQ ID NO: 3624054 - RNA, 20 nt, Human
aaugaaaauuguauguuaag

SEQ ID NO: 3624055 - RNA, 17 nt, Human
aaugaaaauuguauuau

SEQ ID NO: 3624056 - RNA, 23 nt, Human
aaugaaacaaagaguucaagaaa

SEQ ID NO: 3624057 - RNA, 16 nt, Human
aaugaaacaccuucuc

SEQ ID NO: 3624058 - RNA, 20 nt, Human
aaugaaacaccuucucugga

SEQ ID NO: 3624059 - RNA, 13 nt, Human
aaugaaagaaaau

SEQ ID NO: 3624060 - RNA, 21 nt, Human
aaugaaagacuguacaaagua

SEQ ID NO: 3624061 - RNA, 13 nt, Human
aaugaaagauuaa

SEQ ID NO: 3624062 - RNA, 15 nt, Human
aaugaaagauuaaac

SEQ ID NO: 3624063 - RNA, 19 nt, Human
aaugaaaguauaacugagu

SEQ ID NO: 3624064 - RNA, 20 nt, Human
aaugaaagucuugugacuag

SEQ ID NO: 3624065 - RNA, 13 nt, Human
aaugaaauacugu

SEQ ID NO: 3624066 - RNA, 12 nt, Human
aaugaaauaucu

SEQ ID NO: 3624067 - RNA, 14 nt, Human
aaugaaauauugcu

SEQ ID NO: 3624068 - RNA, 19 nt, Human
aaugaaauauuguuuccaa

SEQ ID NO: 3624069 - RNA, 18 nt, Human
aaugaaaugcucuccuuu

SEQ ID NO: 3624070 - RNA, 17 nt, Human
aaugaaauguaugugcu

SEQ ID NO: 3624071 - RNA, 14 nt, Human
aaugaaauuaacug

SEQ ID NO: 3624072 - RNA, 17 nt, Human
aaugaaauuacuacaaa

SEQ ID NO: 3624073 - RNA, 16 nt, Human
aaugaacaaaauuauu

SEQ ID NO: 3624074 - RNA, 13 nt, Human
aaugaacaagaga

SEQ ID NO: 3624075 - RNA, 14 nt, Human
aaugaacaagagaa

SEQ ID NO: 3624076 - RNA, 16 nt, Human
aaugaacaagagaagc

SEQ ID NO: 3624077 - RNA, 22 nt, Human
aaugaacaagagaagcauucuc

SEQ ID NO: 3624078 - RNA, 17 nt, Human
aaugaacacaaauuaug

SEQ ID NO: 3624079 - RNA, 21 nt, Human
aaugaacacucuuuugcuuua

SEQ ID NO: 3624080 - RNA, 17 nt, Human
aaugaaccccacugggu

SEQ ID NO: 3624081 - RNA, 15 nt, Human
aaugaagaauucaga

SEQ ID NO: 3624082 - RNA, 14 nt, Human
aaugaagaauuuaa

SEQ ID NO: 3624083 - RNA, 18 nt, Human
aaugaagaauuuaaagaa

SEQ ID NO: 3624084 - RNA, 19 nt, Human
aaugaagacaaaacauaca

SEQ ID NO: 3624085 - RNA, 20 nt, Human
aaugaagauacugaaauaaa

SEQ ID NO: 3624086 - RNA, 22 nt, Human
aaugaagauuauuuuuuaugag

SEQ ID NO: 3624087 - RNA, 14 nt, Human
aaugaagcaaugcu

SEQ ID NO: 3624088 - RNA, 15 nt, Human
aaugaagcagcuuua

SEQ ID NO: 3624089 - RNA, 17 nt, Human
aaugaagcagcuuuaaa

SEQ ID NO: 3624090 - RNA, 19 nt, Human
aaugaagcagcuuuaaaca

SEQ ID NO: 3624091 - RNA, 16 nt, Human
aaugaagcaguauuuu

SEQ ID NO: 3624092 - RNA, 15 nt, Human
aaugaagcuugugua

SEQ ID NO: 3624093 - RNA, 22 nt, Human
aaugaagcuuguguauccauua

SEQ ID NO: 3624094 - RNA, 19 nt, Human
aaugaagcuuuauacgugu

SEQ ID NO: 3624095 - RNA, 22 nt, Human
aaugaagguuaggauuuaacag

SEQ ID NO: 3624096 - RNA, 14 nt, Human
aaugaaguuggggu

SEQ ID NO: 3624097 - RNA, 20 nt, Human
aaugaaguuugaauguuaaa

SEQ ID NO: 3624098 - RNA, 15 nt, Human
aaugaauaauaauua

SEQ ID NO: 3624099 - RNA, 21 nt, Human
aaugaauaauaauuauccaga

SEQ ID NO: 3624100 - RNA, 13 nt, Human
aaugaauaccuua

SEQ ID NO: 3624101 - RNA, 18 nt, Human
aaugaauaucuauuaaua

SEQ ID NO: 3624102 - RNA, 20 nt, Human
aaugaauaucuauuaauaua

SEQ ID NO: 3624103 - RNA, 13 nt, Human
aaugaauauugaa

SEQ ID NO: 3624104 - RNA, 17 nt, Human
aaugaauauuuugauaa

SEQ ID NO: 3624105 - RNA, 12 nt, Human
aaugaaugaccu

SEQ ID NO: 3624106 - RNA, 16 nt, Human
aaugaaugaggucugg

SEQ ID NO: 3624107 - RNA, 20 nt, Human
aaugaaugucagugugacug

SEQ ID NO: 3624108 - RNA, 21 nt, Human
aaugaaugucagugugacuga

SEQ ID NO: 3624109 - RNA, 16 nt, Human
aaugaauguguguggu

SEQ ID NO: 3624110 - RNA, 16 nt, Human
aaugaauuccuagaau

SEQ ID NO: 3624111 - RNA, 17 nt, Human
aaugaauuuuuaugaua

SEQ ID NO: 3624112 - RNA, 15 nt, Human
aaugacaaucaugug

SEQ ID NO: 3624113 - RNA, 16 nt, Human
aaugacaaucaugugu

SEQ ID NO: 3624114 - RNA, 13 nt, Human
aaugacacagucu

SEQ ID NO: 3624115 - RNA, 14 nt, Human
aaugacacucauau

SEQ ID NO: 3624116 - RNA, 11 nt, Human
aaugacacugu

SEQ ID NO: 3624117 - RNA, 17 nt, Human
aaugacacuugucccca

SEQ ID NO: 3624118 - RNA, 11 nt, Human
aaugacagagc

SEQ ID NO: 3624119 - RNA, 16 nt, Human
aauuguaaggaaugau

SEQ ID NO: 3624120 - RNA, 13 nt, Human
aauuguaaucuga

SEQ ID NO: 3624121 - RNA, 16 nt, Human
aauuguaauuauaucu

SEQ ID NO: 3624122 - RNA, 19 nt, Human
aauuguacaaaauuaagca

SEQ ID NO: 3624123 - RNA, 20 nt, Human
aauuguacaaaauuaagcaa

SEQ ID NO: 3624124 - RNA, 15 nt, Human
aauuguacauauuug

SEQ ID NO: 3624125 - RNA, 14 nt, Human
aauuguauaacagg

SEQ ID NO: 3624126 - RNA, 15 nt, Human
aauuguauaacaggu

SEQ ID NO: 3624127 - RNA, 18 nt, Human
aauuguauaacagguuau

SEQ ID NO: 3624128 - RNA, 24 nt, Human
aauuguaucauuugaacaacuagg

SEQ ID NO: 3624129 - RNA, 22 nt, Human
aauuguaucguauagcuguauu

SEQ ID NO: 3624130 - RNA, 12 nt, Human
aauuguauguua

SEQ ID NO: 3624131 - RNA, 20 nt, Human
acaaauguuaaaauguguug

SEQ ID NO: 3624132 - RNA, 13 nt, Human
acaaauguuucua

SEQ ID NO: 3624133 - RNA, 14 nt, Human
acaaauguuuugcu

SEQ ID NO: 3624134 - RNA, 15 nt, Human
acaaauuaguuauau

SEQ ID NO: 3624135 - RNA, 16 nt, Human
acaaauuauaauguau

SEQ ID NO: 3624136 - RNA, 17 nt, Human
acaaauuauaauguauu

SEQ ID NO: 3624137 - RNA, 21 nt, Human
acaaauuaugcuaagaauuuu

SEQ ID NO: 3624138 - RNA, 22 nt, Human
acaaauugaacucuuugaauga

SEQ ID NO: 3624139 - RNA, 14 nt, Human
acaaauugcacaga

SEQ ID NO: 3624140 - RNA, 16 nt, Human
acaaauuggagcaggg

SEQ ID NO: 3624141 - RNA, 18 nt, Human
acaaauuuacagagacag

SEQ ID NO: 3624142 - RNA, 20 nt, Human
acaaauuucucuguuccaua

SEQ ID NO: 3624143 - RNA, 18 nt, Human
acaaauuuuucugcuuua

SEQ ID NO: 3624144 - RNA, 14 nt, Human
acaacaaaaauuug

SEQ ID NO: 3624145 - RNA, 18 nt, Human
acaacaaaggcaaguuaa

SEQ ID NO: 3624146 - RNA, 23 nt, Human
acaacaaaggcaaguuaagagaa

SEQ ID NO: 3624147 - RNA, 14 nt, Human
acaacaauccuucu

SEQ ID NO: 3624148 - RNA, 14 nt, Human
acaacacaaagaga

SEQ ID NO: 3624149 - RNA, 14 nt, Human
acaacacacacacu

SEQ ID NO: 3624150 - RNA, 19 nt, Human
acaacaccaaaaaauaucu

SEQ ID NO: 3624151 - RNA, 13 nt, Human
acaacacccauuu

SEQ ID NO: 3624152 - RNA, 21 nt, Human
acaacacucauugaccugagg

SEQ ID NO: 3624153 - RNA, 23 nt, Human
acaacacucauugaccugaggcc

SEQ ID NO: 3624154 - RNA, 13 nt, Human
acaacagaagcuu

SEQ ID NO: 3624155 - RNA, 13 nt, Human
acaacagaaguca

SEQ ID NO: 3624156 - RNA, 20 nt, Human
acaacagauuggauuuuaug

SEQ ID NO: 3624157 - RNA, 24 nt, Human
acaacagccaacagcuacaacagc

SEQ ID NO: 3624158 - RNA, 18 nt, Human
acaacagcucgauccaaa

SEQ ID NO: 3624159 - RNA, 16 nt, Human
acaacagguaaaacag

SEQ ID NO: 3624160 - RNA, 23 nt, Human
acaacagugcuaaaaaugggacu

SEQ ID NO: 3624161 - RNA, 22 nt, Human
acaacauccauguccuaugugu

SEQ ID NO: 3624162 - RNA, 17 nt, Human
acaacaucuuuuucuac

SEQ ID NO: 3624163 - RNA, 16 nt, Human
acaacauuaaaacaau

SEQ ID NO: 3624164 - RNA, 17 nt, Human
acaacauuuauauguag

SEQ ID NO: 3624165 - RNA, 20 nt, Human
acaacauuucuauagccaaa

SEQ ID NO: 3624166 - RNA, 15 nt, Human
acaaccaccgcuccc

SEQ ID NO: 3624167 - RNA, 15 nt, Human
acaaccacuggucug

SEQ ID NO: 3624168 - RNA, 22 nt, Human
acaaccaugucauuucagaagu

SEQ ID NO: 3624169 - RNA, 16 nt, Human
acaacccccagcuccc

SEQ ID NO: 3624170 - RNA, 19 nt, Human
acaacccugcaaaggacug

SEQ ID NO: 3624171 - RNA, 22 nt, Human
acaaccgaugcuccagccaacc

SEQ ID NO: 3624172 - RNA, 21 nt, Human
acaaccucccucuuguuuugu

SEQ ID NO: 3624173 - RNA, 14 nt, Human
acaaccugaaccua

SEQ ID NO: 3624174 - RNA, 18 nt, Human
acaaccugaaccuaggag

SEQ ID NO: 3624175 - RNA, 22 nt, Human
acaaccugcuuggguggagaag

SEQ ID NO: 3624176 - RNA, 23 nt, Human
acaaccuuggcuuggcccuggca

SEQ ID NO: 3624177 - RNA, 14 nt, Human
acaacgaggaagcc

SEQ ID NO: 3624178 - RNA, 14 nt, Human
acaacggagucaaa

SEQ ID NO: 3624179 - RNA, 22 nt, Human
acaacggagucaaaaauuaaac

SEQ ID NO: 3624180 - RNA, 15 nt, Human
acaacgugcauugug

SEQ ID NO: 3624181 - RNA, 10 nt, Human
acaacuaagu

SEQ ID NO: 3624182 - RNA, 22 nt, Human
acaacuaagugauuuguauguc

SEQ ID NO: 3624183 - RNA, 18 nt, Human
acaacuaugauuuggaaa

SEQ ID NO: 3624184 - RNA, 17 nt, Human
acaacuauuucggccuu

SEQ ID NO: 3624185 - RNA, 19 nt, Human
acaacuauuucggccuuuu

SEQ ID NO: 3624186 - RNA, 16 nt, Human
acaacuauuuucagau

SEQ ID NO: 3624187 - RNA, 16 nt, Human
acaacucacuccuuuu

SEQ ID NO: 3624188 - RNA, 21 nt, Human
acaacucacuccuuuuaaaga

SEQ ID NO: 3624189 - RNA, 12 nt, Human
acaacugacaca

SEQ ID NO: 3624190 - RNA, 14 nt, Human
acaacugacacagg

SEQ ID NO: 3624191 - RNA, 12 nt, Human
acaacugagucc

SEQ ID NO: 3624192 - RNA, 19 nt, Human
acaacuggaauaguuuuuu

SEQ ID NO: 3624193 - RNA, 20 nt, Human
acaacuggaauaguuuuuuu

SEQ ID NO: 3624194 - RNA, 11 nt, Human
acaacugugac

SEQ ID NO: 3624195 - RNA, 14 nt, Human
acaacuuaaaaagu

SEQ ID NO: 3624196 - RNA, 15 nt, Human
acaacuuaaauaaua

SEQ ID NO: 3624197 - RNA, 13 nt, Human
acaacuuagugua

SEQ ID NO: 3624198 - RNA, 18 nt, Human
acaacuucccagugaauu

SEQ ID NO: 3624199 - RNA, 17 nt, Human
acaacuuuaagaggaca

SEQ ID NO: 3624200 - RNA, 13 nt, Human
acaacuuuauacc

SEQ ID NO: 3624201 - RNA, 14 nt, Human
acaacuuuauaccc

SEQ ID NO: 3624202 - RNA, 16 nt, Human
acaacuuucucuugua

SEQ ID NO: 3624203 - RNA, 18 nt, Human
acaacuuucucuuguaaa

SEQ ID NO: 3624204 - RNA, 20 nt, Human
acaacuuuuuuuucuuuuuu

SEQ ID NO: 3624205 - RNA, 17 nt, Human
acaagaaaggagagucu

SEQ ID NO: 3624206 - RNA, 18 nt, Human
acaagaaaggagagucuu

SEQ ID NO: 3624207 - RNA, 21 nt, Human
acaagaaaggagagucuugca

SEQ ID NO: 3624208 - RNA, 21 nt, Human
acaagaaaggcugcuguacug

SEQ ID NO: 3624209 - RNA, 16 nt, Human
acaagaaaucccuguu

SEQ ID NO: 3624210 - RNA, 18 nt, Human
acaagaaauuugauuucu

SEQ ID NO: 3624211 - RNA, 12 nt, Human
acaagaagauga

SEQ ID NO: 3624212 - RNA, 15 nt, Human
acaagaagcauuuug

SEQ ID NO: 3624213 - RNA, 17 nt, Human
acaagaagcauuuugua

SEQ ID NO: 3624214 - RNA, 23 nt, Human
acaagaaggguuuuccacccugg

SEQ ID NO: 3624215 - RNA, 21 nt, Human
acaagaaguuuauucucauuu

SEQ ID NO: 3624216 - RNA, 12 nt, Human
acaagaaugcau

SEQ ID NO: 3624217 - RNA, 15 nt, Human
acaagaaugcauuga

SEQ ID NO: 3624218 - RNA, 15 nt, Human
acaagacaacauugu

SEQ ID NO: 3624219 - RNA, 17 nt, Human
acaagacaacauuguaa

SEQ ID NO: 3624220 - RNA, 17 nt, Human
acaagaccacguuucua

SEQ ID NO: 3624221 - RNA, 18 nt, Human
acaagaccacguuucuaa

SEQ ID NO: 3624222 - RNA, 19 nt, Human
acaagaccacguuucuaaa

SEQ ID NO: 3624223 - RNA, 20 nt, Human
acaagacccaaaaggcagaa

SEQ ID NO: 3624224 - RNA, 22 nt, Human
acaagacugacgccaggguaug

SEQ ID NO: 3624225 - RNA, 14 nt, Human
acaagacugcacau

SEQ ID NO: 3624226 - RNA, 16 nt, Human
acaagacuucaguaug

SEQ ID NO: 3624227 - RNA, 14 nt, Human
acaagagaaaaagc

SEQ ID NO: 3624228 - RNA, 14 nt, Human
acaagagaagcauu

SEQ ID NO: 3624229 - RNA, 21 nt, Human
acaagagcacuacauucauuu

SEQ ID NO: 3624230 - RNA, 18 nt, Human
acaagagcagccuguggc

SEQ ID NO: 3624231 - RNA, 20 nt, Human
acaagagcccagcagggccu

SEQ ID NO: 3624232 - RNA, 22 nt, Human
acaagagcccaggccuccuaca

SEQ ID NO: 3624233 - RNA, 18 nt, Human
acaagagcuuaacagugu

SEQ ID NO: 3624234 - RNA, 19 nt, Human
acaagagcuuaacagugug

SEQ ID NO: 3624235 - RNA, 16 nt, Human
acaagagguacagggu

SEQ ID NO: 3624236 - RNA, 22 nt, Human
acaagagugauucuugcugcua

SEQ ID NO: 3624237 - RNA, 17 nt, Human
acaagauaagcuuccag

SEQ ID NO: 3624238 - RNA, 18 nt, Human
acaagauagagagcuauu

SEQ ID NO: 3624239 - RNA, 16 nt, Human
acaagauauuguacau

SEQ ID NO: 3624240 - RNA, 19 nt, Human
acaagauauuguacauaaa

SEQ ID NO: 3624241 - RNA, 16 nt, Human
acaagaucuuucagga

SEQ ID NO: 3624242 - RNA, 15 nt, Human
acaagauucccagag

SEQ ID NO: 3624243 - RNA, 24 nt, Human
acaagauugguguuuuuuucuaug

SEQ ID NO: 3624244 - RNA, 16 nt, Human
acaagauuuagaaaaa

SEQ ID NO: 3624245 - RNA, 20 nt, Human
acaagauuuuaaagacaugu

SEQ ID NO: 3624246 - RNA, 21 nt, Human
acaagcagagugcacagcugu

SEQ ID NO: 3624247 - RNA, 22 nt, Human
acaagcagagugcacagcuguc

SEQ ID NO: 3624248 - RNA, 21 nt, Human
acaagcauucugucuugaagg

SEQ ID NO: 3624249 - RNA, 21 nt, Human
acaagccaacuuguaaauaca

SEQ ID NO: 3624250 - RNA, 12 nt, Human
acaagccaagaa

SEQ ID NO: 3624251 - RNA, 18 nt, Human
acaagccacaagucuucc

SEQ ID NO: 3624252 - RNA, 18 nt, Human
acaagccacgaaugaaug

SEQ ID NO: 3624253 - RNA, 14 nt, Human
acaagccagaacuu

SEQ ID NO: 3624254 - RNA, 16 nt, Human
acaagccccaggcagg

SEQ ID NO: 3624255 - RNA, 11 nt, Human
acaagccucug

SEQ ID NO: 3624256 - RNA, 23 nt, Human
acaagccucugcccaggcacugc

SEQ ID NO: 3624257 - RNA, 12 nt, Human
acaagccugagg

SEQ ID NO: 3624258 - RNA, 22 nt, Human
acaagccuggaaaaaaacauca

SEQ ID NO: 3624259 - RNA, 18 nt, Human
acaagccuggcaacacac

SEQ ID NO: 3624260 - RNA, 20 nt, Human
acaagcgugagccacugcac

SEQ ID NO: 3624261 - RNA, 21 nt, Human
acaagcgugagccacugcacc

SEQ ID NO: 3624262 - RNA, 22 nt, Human
acaagcuaauugggaguccagg

SEQ ID NO: 3624263 - RNA, 23 nt, Human
acaagcuaauugggaguccaggc

SEQ ID NO: 3624264 - RNA, 22 nt, Human
acaagcuaggugcuaauuaaua

SEQ ID NO: 3624265 - RNA, 15 nt, Human
acaagcuccaagcuc

SEQ ID NO: 3624266 - RNA, 17 nt, Human
acaagcuccaagcuccc

SEQ ID NO: 3624267 - RNA, 15 nt, Human
acaagcucccaggcc

SEQ ID NO: 3624268 - RNA, 16 nt, Human
acaagcuccuggucuu

SEQ ID NO: 3624269 - RNA, 19 nt, Human
acaagcugcacccucaggc

SEQ ID NO: 3624270 - RNA, 21 nt, Human
acaagcugcacccucaggcag

SEQ ID NO: 3624271 - RNA, 16 nt, Human
acaagcugccucccug

SEQ ID NO: 3624272 - RNA, 20 nt, Human
acaagcuguugaccaggcac

SEQ ID NO: 3624273 - RNA, 16 nt, Human
acaagcuucaguaagu

SEQ ID NO: 3624274 - RNA, 19 nt, Human
acaaggaagaaauuaacuu

SEQ ID NO: 3624275 - RNA, 14 nt, Human
aauguuaaagucag

SEQ ID NO: 3624276 - RNA, 20 nt, Human
aauguuaaauaaauuguaua

SEQ ID NO: 3624277 - RNA, 23 nt, Human
aauguuaaauaaauuguauauuc

SEQ ID NO: 3624278 - RNA, 17 nt, Human
aauguuaaauuuguaag

SEQ ID NO: 3624279 - RNA, 21 nt, Human
aauguuaaauuuguaaguuuc

SEQ ID NO: 3624280 - RNA, 22 nt, Human
aauguuaaauuuguaaguuuca

SEQ ID NO: 3624281 - RNA, 16 nt, Human
aauguuaacauuuuug

SEQ ID NO: 3624282 - RNA, 22 nt, Human
aauguuaaggaaacucuuaucu

SEQ ID NO: 3624283 - RNA, 21 nt, Human
aauguuaauggauuucagaag

SEQ ID NO: 3624284 - RNA, 20 nt, Human
aauguuacauaguguaggcu

SEQ ID NO: 3624285 - RNA, 16 nt, Human
aauguuacauuauuau

SEQ ID NO: 3624286 - RNA, 22 nt, Human
aauguuacugaucaugcauugu

SEQ ID NO: 3624287 - RNA, 17 nt, Human
aauguuacugccuuaau

SEQ ID NO: 3624288 - RNA, 17 nt, Human
aauguuagagguuuuaa

SEQ ID NO: 3624289 - RNA, 12 nt, Human
aauguuagagua

SEQ ID NO: 3624290 - RNA, 16 nt, Human
aauguuauagugaauu

SEQ ID NO: 3624291 - RNA, 22 nt, Human
aauguuauagugaauuaucccu

SEQ ID NO: 3624292 - RNA, 17 nt, Human
aauguuauaucauaugu

SEQ ID NO: 3624293 - RNA, 17 nt, Human
aauguuauuucugcaaa

SEQ ID NO: 3624294 - RNA, 23 nt, Human
aauguuauuuguuauuuucagua

SEQ ID NO: 3624295 - RNA, 12 nt, Human
aauguucaucau

SEQ ID NO: 3624296 - RNA, 11 nt, Human
aauguucauug

SEQ ID NO: 3624297 - RNA, 17 nt, Human
aauguucauuguaaugu

SEQ ID NO: 3624298 - RNA, 21 nt, Human
aauguuccucaaagcuuggau

SEQ ID NO: 3624299 - RNA, 22 nt, Human
aauguuccucaaagcuuggauu

SEQ ID NO: 3624300 - RNA, 23 nt, Human
aauguucuaaguuucuaagauuc

SEQ ID NO: 3624301 - RNA, 20 nt, Human
aauguucuaugguuaugaaa

SEQ ID NO: 3624302 - RNA, 21 nt, Human
aauguucuaugguuaugaaag

SEQ ID NO: 3624303 - RNA, 17 nt, Human
aauguucucagauuucu

SEQ ID NO: 3624304 - RNA, 21 nt, Human
aauguucugaauaauuucuua

SEQ ID NO: 3624305 - RNA, 15 nt, Human
aauguucugacauua

SEQ ID NO: 3624306 - RNA, 12 nt, Human
aauguucuguga

SEQ ID NO: 3624307 - RNA, 21 nt, Human
aauguucuuaugcaaaaugga

SEQ ID NO: 3624308 - RNA, 14 nt, Human
aauguucuuccagu

SEQ ID NO: 3624309 - RNA, 23 nt, Human
aauguucuuuauauacaauaaug

SEQ ID NO: 3624310 - RNA, 17 nt, Human
aauguucuuuggaaagu

SEQ ID NO: 3624311 - RNA, 16 nt, Human
aauguugaaaagucaa

SEQ ID NO: 3624312 - RNA, 19 nt, Human
aauguugaaaagucaaacu

SEQ ID NO: 3624313 - RNA, 15 nt, Human
aauguugaaauauga

SEQ ID NO: 3624314 - RNA, 16 nt, Human
aauguugaacaaaaua

SEQ ID NO: 3624315 - RNA, 17 nt, Human
aauguugaacaaaauaa

SEQ ID NO: 3624316 - RNA, 16 nt, Human
aauguugaagaacuca

SEQ ID NO: 3624317 - RNA, 23 nt, Human
aauguugaagaacucaugugauu

SEQ ID NO: 3624318 - RNA, 14 nt, Human
aauguugaauuuug

SEQ ID NO: 3624319 - RNA, 12 nt, Human
aauguugauuuc

SEQ ID NO: 3624320 - RNA, 17 nt, Human
aauguugauuucuaguu

SEQ ID NO: 3624321 - RNA, 20 nt, Human
aauguugauuucuaguuauu

SEQ ID NO: 3624322 - RNA, 14 nt, Human
aauguugcugaaaa

SEQ ID NO: 3624323 - RNA, 13 nt, Human
aauguuggauaag

SEQ ID NO: 3624324 - RNA, 18 nt, Human
aauguuggauaaggaauu

SEQ ID NO: 3624325 - RNA, 23 nt, Human
aauguuggcagaugcagcucuuc

SEQ ID NO: 3624326 - RNA, 22 nt, Human
aauguugggacugcuaaauaaa

SEQ ID NO: 3624327 - RNA, 17 nt, Human
aauguuguauucaguga

SEQ ID NO: 3624328 - RNA, 20 nt, Human
aauguugugaauaauuacag

SEQ ID NO: 3624329 - RNA, 21 nt, Human
aauguugugaauaauuacagu

SEQ ID NO: 3624330 - RNA, 17 nt, Human
aauguugugguuuguug

SEQ ID NO: 3624331 - RNA, 20 nt, Human
aauguuuaagcagaauugga

SEQ ID NO: 3624332 - RNA, 22 nt, Human
aauguuuaagcagaauuggaaa

SEQ ID NO: 3624333 - RNA, 14 nt, Human
aauguuuaaucaua

SEQ ID NO: 3624334 - RNA, 16 nt, Human
aauguuuaaucauaua

SEQ ID NO: 3624335 - RNA, 17 nt, Human
aauguuuaaucauauaa

SEQ ID NO: 3624336 - RNA, 23 nt, Human
aauguuuacacucuuuguaagag

SEQ ID NO: 3624337 - RNA, 15 nt, Human
aauguuuaugagcca

SEQ ID NO: 3624338 - RNA, 18 nt, Human
aauguuuaugagccagac

SEQ ID NO: 3624339 - RNA, 23 nt, Human
aauguuuaugcaaggaaggaaag

SEQ ID NO: 3624340 - RNA, 20 nt, Human
aauguuuauuccugauaaua

SEQ ID NO: 3624341 - RNA, 15 nt, Human
aauguuucugcagua

SEQ ID NO: 3624342 - RNA, 23 nt, Human
aauguuucuucuagguucuaaaa

SEQ ID NO: 3624343 - RNA, 21 nt, Human
aauguuucuuuuguuugguaa

SEQ ID NO: 3624344 - RNA, 20 nt, Human
aauguuugaggagcauguuu

SEQ ID NO: 3624345 - RNA, 21 nt, Human
aauguuugaggagcauguuuu

SEQ ID NO: 3624346 - RNA, 23 nt, Human
aauguuugaggagcauguuuugu

SEQ ID NO: 3624347 - RNA, 13 nt, Human
aauguuugcauau

SEQ ID NO: 3624348 - RNA, 16 nt, Human
aauguuugccucugcc

SEQ ID NO: 3624349 - RNA, 19 nt, Human
aauguuugccucugccucu

SEQ ID NO: 3624350 - RNA, 12 nt, Human
aauguuugcuau

SEQ ID NO: 3624351 - RNA, 21 nt, Human
aauguuuggcauguaaaugua

SEQ ID NO: 3624352 - RNA, 19 nt, Human
aauguuugucucaguugga

SEQ ID NO: 3624353 - RNA, 20 nt, Human
aauguuugucucaguuggaa

SEQ ID NO: 3624354 - RNA, 16 nt, Human
aauguuuuaaauguac

SEQ ID NO: 3624355 - RNA, 14 nt, Human
aauguuuuaaauuc

SEQ ID NO: 3624356 - RNA, 22 nt, Human
aauguuuuacugugaaacuggc

SEQ ID NO: 3624357 - RNA, 17 nt, Human
aauguuuuauacuguuu

SEQ ID NO: 3624358 - RNA, 14 nt, Human
aauguuuucagcua

SEQ ID NO: 3624359 - RNA, 16 nt, Human
aauguuuuguaaacau

SEQ ID NO: 3624360 - RNA, 20 nt, Human
aauguuuuguaaacauuuau

SEQ ID NO: 3624361 - RNA, 20 nt, Human
aauguuuuguaaacuuugaa

SEQ ID NO: 3624362 - RNA, 22 nt, Human
aauguuuuuaagaugaucaucu

SEQ ID NO: 3624363 - RNA, 13 nt, Human
aauguuuuuugcc

SEQ ID NO: 3624364 - RNA, 23 nt, Human
aauguuuuuugccacagcuuuug

SEQ ID NO: 3624365 - RNA, 20 nt, Human
aauguuuuuuuuuaaagacu

SEQ ID NO: 3624366 - RNA, 21 nt, Human
aauuaaaaaaaaagaucuguu

SEQ ID NO: 3624367 - RNA, 17 nt, Human
aauuaaaaaagauaaac

SEQ ID NO: 3624368 - RNA, 24 nt, Human
aauuaaaaaagauaaacacaagau

SEQ ID NO: 3624369 - RNA, 23 nt, Human
aauuaaaaagauucuuuuucuga

SEQ ID NO: 3624370 - RNA, 20 nt, Human
aauuaaaacaaugucaaggu

SEQ ID NO: 3624371 - RNA, 14 nt, Human
aauuaaaacacuuu

SEQ ID NO: 3624372 - RNA, 13 nt, Human
aauuaaaacugaa

SEQ ID NO: 3624373 - RNA, 16 nt, Human
aauuaaaacuucuuaa

SEQ ID NO: 3624374 - RNA, 20 nt, Human
aauuaaaacuucuuaaauau

SEQ ID NO: 3624375 - RNA, 18 nt, Human
aauuaaaagcaaaucauu

SEQ ID NO: 3624376 - RNA, 18 nt, Human
aauuaaaaguugaauuuu

SEQ ID NO: 3624377 - RNA, 15 nt, Human
aauuaaacggauuau

SEQ ID NO: 3624378 - RNA, 16 nt, Human
aauuaaacggauuauu

SEQ ID NO: 3624379 - RNA, 22 nt, Human
aauuaaacggauuauuuuuuca

SEQ ID NO: 3624380 - RNA, 21 nt, Human
aauuaaacuuccaaagaaagu

SEQ ID NO: 3624381 - RNA, 19 nt, Human
aauuaaacuuuuaauucau

SEQ ID NO: 3624382 - RNA, 12 nt, Human
aauuaaagaaaa

SEQ ID NO: 3624383 - RNA, 18 nt, Human
aauuaaagaaaauaaaau

SEQ ID NO: 3624384 - RNA, 15 nt, Human
aauuaaagcuguuau

SEQ ID NO: 3624385 - RNA, 14 nt, Human
aauuaaaguacuuu

SEQ ID NO: 3624386 - RNA, 16 nt, Human
aauuaaaguacuuuaa

SEQ ID NO: 3624387 - RNA, 14 nt, Human
aauuaaauauaugu

SEQ ID NO: 3624388 - RNA, 12 nt, Human
aauuaaauguag

SEQ ID NO: 3624389 - RNA, 12 nt, Human
aauuaacacugc

SEQ ID NO: 3624390 - RNA, 16 nt, Human
aauuaacauauaauau

SEQ ID NO: 3624391 - RNA, 21 nt, Human
aauuaacauauaauauauguu

SEQ ID NO: 3624392 - RNA, 13 nt, Human
aauuaacauguua

SEQ ID NO: 3624393 - RNA, 20 nt, Human
aauuaaccccauaauuagau

SEQ ID NO: 3624394 - RNA, 22 nt, Human
aauuaacuggguaaugaaacaa

SEQ ID NO: 3624395 - RNA, 15 nt, Human
aauuaacuugaguuu

SEQ ID NO: 3624396 - RNA, 12 nt, Human
aauuaacuuuua

SEQ ID NO: 3624397 - RNA, 18 nt, Human
aauuaacuuuuauaaacu

SEQ ID NO: 3624398 - RNA, 22 nt, Human
aauuaacuuuuauaaacuuuac

SEQ ID NO: 3624399 - RNA, 14 nt, Human
aauuaagaaggcaa

SEQ ID NO: 3624400 - RNA, 19 nt, Human
aauuaagaaggcaaaaaug

SEQ ID NO: 3624401 - RNA, 15 nt, Human
aauuaagacugaaaa

SEQ ID NO: 3624402 - RNA, 15 nt, Human
aauuaagagagucua

SEQ ID NO: 3624403 - RNA, 13 nt, Human
aauuaagcaaaug

SEQ ID NO: 3624404 - RNA, 15 nt, Human
aauuaagcaaauguu

SEQ ID NO: 3624405 - RNA, 19 nt, Human
aauuaagcccuaagguccu

SEQ ID NO: 3624406 - RNA, 16 nt, Human
aauuaaggauuuuaug

SEQ ID NO: 3624407 - RNA, 20 nt, Human
aauuaaggauuuuaugcuuu

SEQ ID NO: 3624408 - RNA, 21 nt, Human
aauuaaggcaacugaacaaaa

SEQ ID NO: 3624409 - RNA, 13 nt, Human
aauuaagguguuu

SEQ ID NO: 3624410 - RNA, 13 nt, Human
aauuaaguacuau

SEQ ID NO: 3624411 - RNA, 22 nt, Human
aauuaaguuagggaauggcaca

SEQ ID NO: 3624412 - RNA, 15 nt, Human
aauuaauaaucuuau

SEQ ID NO: 3624413 - RNA, 20 nt, Human
aauuaauaguuugucuauuu

SEQ ID NO: 3624414 - RNA, 17 nt, Human
aauuaauauauuaaaau

SEQ ID NO: 3624415 - RNA, 17 nt, Human
aauuaauaucuuucugc

SEQ ID NO: 3624416 - RNA, 16 nt, Human
aauuaaugaaauaucu

SEQ ID NO: 3624417 - RNA, 16 nt, Human
aauuaauggaaucuuc

SEQ ID NO: 3624418 - RNA, 14 nt, Human
aauaacuacugugu

SEQ ID NO: 3624419 - RNA, 17 nt, Human
aauaacuccucccaggg

SEQ ID NO: 3624420 - RNA, 21 nt, Human
aauaacuccuucuuguaguag

SEQ ID NO: 3624421 - RNA, 20 nt, Human
aauaacuggaaaacagaaca

SEQ ID NO: 3624422 - RNA, 17 nt, Human
aauaacuggaacacucu

SEQ ID NO: 3624423 - RNA, 20 nt, Human
aauaacugugaaguuuacau

SEQ ID NO: 3624424 - RNA, 14 nt, Human
aauaacuucagucc

SEQ ID NO: 3624425 - RNA, 24 nt, Human
aauaacuucaguccugcuccagaa

SEQ ID NO: 3624426 - RNA, 12 nt, Human
aauaagaaggua

SEQ ID NO: 3624427 - RNA, 13 nt, Human
aauaagaauagaa

SEQ ID NO: 3624428 - RNA, 15 nt, Human
aauaagaauuugcau

SEQ ID NO: 3624429 - RNA, 15 nt, Human
aauaagagaaagaaa

SEQ ID NO: 3624430 - RNA, 21 nt, Human
aauaagagaagcuacuuuguu

SEQ ID NO: 3624431 - RNA, 13 nt, Human
aauaagagauuug

SEQ ID NO: 3624432 - RNA, 12 nt, Human
aauaagauucua

SEQ ID NO: 3624433 - RNA, 15 nt, Human
aauaagcaaaauccu

SEQ ID NO: 3624434 - RNA, 19 nt, Human
aauaagcacuguaaacuuc

SEQ ID NO: 3624435 - RNA, 14 nt, Human
aauaagcaggugga

SEQ ID NO: 3624436 - RNA, 23 nt, Human
aauaagcagguggaucuauuuca

SEQ ID NO: 3624437 - RNA, 17 nt, Human
aauaagcaucaaacucu

SEQ ID NO: 3624438 - RNA, 16 nt, Human
aauaagcuaguugaau

SEQ ID NO: 3624439 - RNA, 22 nt, Human
aauaagcuaguugaauacuuga

SEQ ID NO: 3624440 - RNA, 22 nt, Human
aauaagcucuaguucuuaacaa

SEQ ID NO: 3624441 - RNA, 16 nt, Human
aauaaggcacccaucu

SEQ ID NO: 3624442 - RNA, 18 nt, Human
aauaaggcacccaucugu

SEQ ID NO: 3624443 - RNA, 16 nt, Human
aauaaggucaaugcca

SEQ ID NO: 3624444 - RNA, 15 nt, Human
aauaagucaacagua

SEQ ID NO: 3624445 - RNA, 22 nt, Human
aauaagucaacaguaaaccacu

SEQ ID NO: 3624446 - RNA, 12 nt, Human
aauaagucugau

SEQ ID NO: 3624447 - RNA, 17 nt, Human
aauaagugcccucuccc

SEQ ID NO: 3624448 - RNA, 21 nt, Human
aauaaguucaaauucuucuga

SEQ ID NO: 3624449 - RNA, 20 nt, Human
aauaauaaagaauagcuuua

SEQ ID NO: 3624450 - RNA, 13 nt, Human
aauaauaaagauc

SEQ ID NO: 3624451 - RNA, 19 nt, Human
aauaauaaagaugcucuuu

SEQ ID NO: 3624452 - RNA, 14 nt, Human
aauaauaaauaguu

SEQ ID NO: 3624453 - RNA, 16 nt, Human
aauaauaaaugcccuc

SEQ ID NO: 3624454 - RNA, 21 nt, Human
aauaauaauuagguuaacauu

SEQ ID NO: 3624455 - RNA, 20 nt, Human
aauaauaauuuuuauauuua

SEQ ID NO: 3624456 - RNA, 20 nt, Human
aauaauacauugaauuagaa

SEQ ID NO: 3624457 - RNA, 13 nt, Human
aauaauaccucaa

SEQ ID NO: 3624458 - RNA, 21 nt, Human
aauaauaccucaauguuugag

SEQ ID NO: 3624459 - RNA, 15 nt, Human
aauaauaccuuagaa

SEQ ID NO: 3624460 - RNA, 14 nt, Human
aauaauauauguuu

SEQ ID NO: 3624461 - RNA, 15 nt, Human
aauaauauauuuucu

SEQ ID NO: 3624462 - RNA, 13 nt, Human
aauaauaugauuu

SEQ ID NO: 3624463 - RNA, 13 nt, Human
aauaauaugcauu

SEQ ID NO: 3624464 - RNA, 17 nt, Human
aauaauaugcauuguca

SEQ ID NO: 3624465 - RNA, 12 nt, Human
aauaauauuguu

SEQ ID NO: 3624466 - RNA, 20 nt, Human
aauaauauuguuguauaauu

SEQ ID NO: 3624467 - RNA, 16 nt, Human
aauaauauuguuuuuc

SEQ ID NO: 3624468 - RNA, 15 nt, Human
aauaaucacauugac

SEQ ID NO: 3624469 - RNA, 17 nt, Human
aauaaucacauugacuu

SEQ ID NO: 3624470 - RNA, 21 nt, Human
aauaauccuaaacauaugaau

SEQ ID NO: 3624471 - RNA, 16 nt, Human
aauaaucggcccacag

SEQ ID NO: 3624472 - RNA, 15 nt, Human
aauaaucuuguuucu

SEQ ID NO: 3624473 - RNA, 20 nt, Human
aauaaugagcuauuaaaacu

SEQ ID NO: 3624474 - RNA, 21 nt, Human
aauaaugagcuauuaaaacuc

SEQ ID NO: 3624475 - RNA, 15 nt, Human
aauaaugcaguaugg

SEQ ID NO: 3624476 - RNA, 17 nt, Human
aauaaugcaguauggua

SEQ ID NO: 3624477 - RNA, 22 nt, Human
aauaaugcaguaugguacauuu

SEQ ID NO: 3624478 - RNA, 23 nt, Human
aauaaugcauccagcaguacaau

SEQ ID NO: 3624479 - RNA, 16 nt, Human
aauaaugccuuuguaa

SEQ ID NO: 3624480 - RNA, 21 nt, Human
aauaaugcuacaauuuuaaga

SEQ ID NO: 3624481 - RNA, 15 nt, Human
aauaaugcuuugaaa

SEQ ID NO: 3624482 - RNA, 15 nt, Human
aauaauggaaaaaaa

SEQ ID NO: 3624483 - RNA, 22 nt, Human
aauaauggaaaaaaaaaaaaga

SEQ ID NO: 3624484 - RNA, 20 nt, Human
aauaauggucccauccaggc

SEQ ID NO: 3624485 - RNA, 22 nt, Human
aauaauguaagacaaauauguu

SEQ ID NO: 3624486 - RNA, 12 nt, Human
aauaaugucucu

SEQ ID NO: 3624487 - RNA, 21 nt, Human
aauaauguguaguucauguaa

SEQ ID NO: 3624488 - RNA, 21 nt, Human
aauaauguuaaccaaggaaau

SEQ ID NO: 3624489 - RNA, 16 nt, Human
aauaauguucuauugu

SEQ ID NO: 3624490 - RNA, 17 nt, Human
aauuaguauuuauuuaa

SEQ ID NO: 3624491 - RNA, 17 nt, Human
aauuagugccacuuaau

SEQ ID NO: 3624492 - RNA, 18 nt, Human
aauuagugcuaaguguga

SEQ ID NO: 3624493 - RNA, 21 nt, Human
aauuagugcuaagugugaacu

SEQ ID NO: 3624494 - RNA, 18 nt, Human
aauuaguggcacuugcuu

SEQ ID NO: 3624495 - RNA, 14 nt, Human
aauuaguuuccuuu

SEQ ID NO: 3624496 - RNA, 15 nt, Human
aauuaguuuccuuuu

SEQ ID NO: 3624497 - RNA, 14 nt, Human
aauuaguuuuauau

SEQ ID NO: 3624498 - RNA, 20 nt, Human
aauuauaaacucauuuugcu

SEQ ID NO: 3624499 - RNA, 13 nt, Human
aauuauaaaugac

SEQ ID NO: 3624500 - RNA, 20 nt, Human
aauuauaacuguaaagaugu

SEQ ID NO: 3624501 - RNA, 14 nt, Human
aauuauaaggacug

SEQ ID NO: 3624502 - RNA, 16 nt, Human
aauuauaaggacugca

SEQ ID NO: 3624503 - RNA, 16 nt, Human
aauuauaauauacuau

SEQ ID NO: 3624504 - RNA, 14 nt, Human
aauuauaauguauu

SEQ ID NO: 3624505 - RNA, 22 nt, Human
aauuauaauguauucauauuug

SEQ ID NO: 3624506 - RNA, 19 nt, Human
aauuauacccccugcaaag

SEQ ID NO: 3624507 - RNA, 18 nt, Human
aauuauagaccucuagua

SEQ ID NO: 3624508 - RNA, 15 nt, Human
aauuauagaugggaa

SEQ ID NO: 3624509 - RNA, 22 nt, Human
aauuauagcucuaauguuugca

SEQ ID NO: 3624510 - RNA, 21 nt, Human
aauuauaggaauaucaauaua

SEQ ID NO: 3624511 - RNA, 18 nt, Human
aauuauaggagacuugua

SEQ ID NO: 3624512 - RNA, 22 nt, Human
aauuauagugauguaaucuuga

SEQ ID NO: 3624513 - RNA, 19 nt, Human
aauuauaguguagaaaaga

SEQ ID NO: 3624514 - RNA, 13 nt, Human
aauuauaguuuca

SEQ ID NO: 3624515 - RNA, 21 nt, Human
aauuauaguuucugaggcuuu

SEQ ID NO: 3624516 - RNA, 19 nt, Human
aauuauauaacuguauuug

SEQ ID NO: 3624517 - RNA, 21 nt, Human
aauuauauaacuguauuugaa

SEQ ID NO: 3624518 - RNA, 21 nt, Human
aauuauauagguugugcaaau

SEQ ID NO: 3624519 - RNA, 20 nt, Human
aauuauauaguuacccaaau

SEQ ID NO: 3624520 - RNA, 20 nt, Human
aauuauaucugaggaauucu

SEQ ID NO: 3624521 - RNA, 22 nt, Human
aauuauaucugaggaauucugu

SEQ ID NO: 3624522 - RNA, 23 nt, Human
aauuauaucugaggaauucugua

SEQ ID NO: 3624523 - RNA, 12 nt, Human
aauuauaucugu

SEQ ID NO: 3624524 - RNA, 20 nt, Human
aauuaucaauaucuaauaua

SEQ ID NO: 3624525 - RNA, 20 nt, Human
aauuaucagcaaagaaaaaa

SEQ ID NO: 3624526 - RNA, 17 nt, Human
aauuaucgggaacagug

SEQ ID NO: 3624527 - RNA, 19 nt, Human
aauuaucgggaacaguguu

SEQ ID NO: 3624528 - RNA, 14 nt, Human
aauuaucuaauuua

SEQ ID NO: 3624529 - RNA, 23 nt, Human
aauuaucuauuuguauauauaca

SEQ ID NO: 3624530 - RNA, 17 nt, Human
aauuaucuugauacauu

SEQ ID NO: 3624531 - RNA, 20 nt, Human
aauuaucuugauacauucaa

SEQ ID NO: 3624532 - RNA, 13 nt, Human
aauuaugaaacuu

SEQ ID NO: 3624533 - RNA, 15 nt, Human
aauuaugaaacuuuu

SEQ ID NO: 3624534 - RNA, 12 nt, Human
aauuaugacaau

SEQ ID NO: 3624535 - RNA, 17 nt, Human
aauuaugagauugguuu

SEQ ID NO: 3624536 - RNA, 22 nt, Human
aauuaugauggaagacaggaaa

SEQ ID NO: 3624537 - RNA, 13 nt, Human
aauuaugauuugg

SEQ ID NO: 3624538 - RNA, 15 nt, Human
aauuaugauuugggu

SEQ ID NO: 3624539 - RNA, 17 nt, Human
aauuaugccuuuuuuga

SEQ ID NO: 3624540 - RNA, 19 nt, Human
aauuaugccuuuuuugauc

SEQ ID NO: 3624541 - RNA, 21 nt, Human
aauuaugggaauaauugcuuu

SEQ ID NO: 3624542 - RNA, 15 nt, Human
aauuauguaaugcaa

SEQ ID NO: 3624543 - RNA, 18 nt, Human
aauuauguaaugcaaaau

SEQ ID NO: 3624544 - RNA, 16 nt, Human
aauuauguauguuuac

SEQ ID NO: 3624545 - RNA, 11 nt, Human
aauuaugugac

SEQ ID NO: 3624546 - RNA, 20 nt, Human
aauuaugugacauuuuacau

SEQ ID NO: 3624547 - RNA, 22 nt, Human
aauuaugugccagauuuaugca

SEQ ID NO: 3624548 - RNA, 23 nt, Human
aauuauguuaaacuagcauaucu

SEQ ID NO: 3624549 - RNA, 14 nt, Human
aauuauguuauuga

SEQ ID NO: 3624550 - RNA, 14 nt, Human
aauuauguuuauau

SEQ ID NO: 3624551 - RNA, 22 nt, Human
aauuauguuugccacuuugcaa

SEQ ID NO: 3624552 - RNA, 22 nt, Human
aauuauguuuuuauuaagauua

SEQ ID NO: 3624553 - RNA, 18 nt, Human
aauuauuaacuacauuua

SEQ ID NO: 3624554 - RNA, 22 nt, Human
aauuauuaaugaaaauaagaau

SEQ ID NO: 3624555 - RNA, 18 nt, Human
aauuauuacaguguuuau

SEQ ID NO: 3624556 - RNA, 23 nt, Human
aauuauuacaguguuuauccuuu

SEQ ID NO: 3624557 - RNA, 15 nt, Human
aauuauuauaaaaau

SEQ ID NO: 3624558 - RNA, 22 nt, Human
aauuauuauaaaaauauuaaga

SEQ ID NO: 3624559 - RNA, 13 nt, Human
aauuauuauucuu

SEQ ID NO: 3624560 - RNA, 18 nt, Human
aauuauuauuuauauaug

SEQ ID NO: 3624561 - RNA, 15 nt, Human
aauuauuauuugugu

SEQ ID NO: 3624562 - RNA, 14 nt, Human
acacuaaccugacc

SEQ ID NO: 3624563 - RNA, 17 nt, Human
acacuaacgaaauauca

SEQ ID NO: 3624564 - RNA, 20 nt, Human
acacuaacucaccagcccca

SEQ ID NO: 3624565 - RNA, 14 nt, Human
acacuaagagagaa

SEQ ID NO: 3624566 - RNA, 19 nt, Human
acacuaagagagaaugaga

SEQ ID NO: 3624567 - RNA, 14 nt, Human
acacuaauauauuu

SEQ ID NO: 3624568 - RNA, 12 nt, Human
acacuaauucau

SEQ ID NO: 3624569 - RNA, 12 nt, Human
acacuaauuccu

SEQ ID NO: 3624570 - RNA, 21 nt, Human
acacuacaccacacacaacag

SEQ ID NO: 3624571 - RNA, 20 nt, Human
acacuaccgaaugugucuuu

SEQ ID NO: 3624572 - RNA, 21 nt, Human
acacuaccgaaugugucuuua

SEQ ID NO: 3624573 - RNA, 23 nt, Human
acacuaccgaaugugucuuuaga

SEQ ID NO: 3624574 - RNA, 15 nt, Human
acacuagccucucca

SEQ ID NO: 3624575 - RNA, 23 nt, Human
acacuagccuuggccucuuuccu

SEQ ID NO: 3624576 - RNA, 22 nt, Human
acacuaguaccuucagauccua

SEQ ID NO: 3624577 - RNA, 18 nt, Human
acacuaguuuugugccag

SEQ ID NO: 3624578 - RNA, 23 nt, Human
acacuaguuuugugccagccgug

SEQ ID NO: 3624579 - RNA, 15 nt, Human
acacuauaucuguau

SEQ ID NO: 3624580 - RNA, 21 nt, Human
acacuauaucuguauauaaaa

SEQ ID NO: 3624581 - RNA, 18 nt, Human
acacuaucauaguuaaca

SEQ ID NO: 3624582 - RNA, 17 nt, Human
acacuaugguauuugag

SEQ ID NO: 3624583 - RNA, 18 nt, Human
acacuaugguauuugagu

SEQ ID NO: 3624584 - RNA, 13 nt, Human
acacuauuuuaug

SEQ ID NO: 3624585 - RNA, 15 nt, Human
acacucaaaagcugg

SEQ ID NO: 3624586 - RNA, 18 nt, Human
acacucaaaucaagaaac

SEQ ID NO: 3624587 - RNA, 16 nt, Human
acacucacccaacaau

SEQ ID NO: 3624588 - RNA, 19 nt, Human
acacucaccucuaaaacag

SEQ ID NO: 3624589 - RNA, 20 nt, Human
acacucagaagccugggggc

SEQ ID NO: 3624590 - RNA, 19 nt, Human
acacucagauccuccucau

SEQ ID NO: 3624591 - RNA, 16 nt, Human
acacucagcacaaggc

SEQ ID NO: 3624592 - RNA, 22 nt, Human
acacucagcacccccuucucug

SEQ ID NO: 3624593 - RNA, 13 nt, Human
acacucagcuguu

SEQ ID NO: 3624594 - RNA, 14 nt, Human
acacucagcuguuc

SEQ ID NO: 3624595 - RNA, 22 nt, Human
acacucaguggcccauggcauu

SEQ ID NO: 3624596 - RNA, 23 nt, Human
acacucaguggcccauggcauuu

SEQ ID NO: 3624597 - RNA, 16 nt, Human
acacucaguuguucaa

SEQ ID NO: 3624598 - RNA, 12 nt, Human
acacucaugcug

SEQ ID NO: 3624599 - RNA, 13 nt, Human
acacucaugcuga

SEQ ID NO: 3624600 - RNA, 19 nt, Human
acacucauugaccugaggc

SEQ ID NO: 3624601 - RNA, 11 nt, Human
acacuccaacg

SEQ ID NO: 3624602 - RNA, 17 nt, Human
acacuccaauuaaggau

SEQ ID NO: 3624603 - RNA, 15 nt, Human
acacuccacccucca

SEQ ID NO: 3624604 - RNA, 22 nt, Human
acacuccacccuccaccuucca

SEQ ID NO: 3624605 - RNA, 14 nt, Human
acacuccagggaca

SEQ ID NO: 3624606 - RNA, 20 nt, Human
acacuccagggacacacagc

SEQ ID NO: 3624607 - RNA, 14 nt, Human
acacuccagugcca

SEQ ID NO: 3624608 - RNA, 19 nt, Human
acacuccagugccagcaau

SEQ ID NO: 3624609 - RNA, 16 nt, Human
acacuccaucagcuua

SEQ ID NO: 3624610 - RNA, 21 nt, Human
acacucccaagguuggagccc

SEQ ID NO: 3624611 - RNA, 22 nt, Human
acacucccacccagucucugcu

SEQ ID NO: 3624612 - RNA, 14 nt, Human
acacuccuagagaa

SEQ ID NO: 3624613 - RNA, 17 nt, Human
acacuccucugcgucua

SEQ ID NO: 3624614 - RNA, 16 nt, Human
acacucgcccgcccac

SEQ ID NO: 3624615 - RNA, 17 nt, Human
acacucuaacuguauau

SEQ ID NO: 3624616 - RNA, 15 nt, Human
acacucuauaacaaa

SEQ ID NO: 3624617 - RNA, 11 nt, Human
acacucuccug

SEQ ID NO: 3624618 - RNA, 20 nt, Human
acacucuccugggccccucc

SEQ ID NO: 3624619 - RNA, 17 nt, Human
acacucuccuugcaguu

SEQ ID NO: 3624620 - RNA, 23 nt, Human
acacucuccuugcaguucuugag

SEQ ID NO: 3624621 - RNA, 11 nt, Human
acacucugaga

SEQ ID NO: 3624622 - RNA, 19 nt, Human
acacucugccagcaaagag

SEQ ID NO: 3624623 - RNA, 16 nt, Human
acacucugcuguuuga

SEQ ID NO: 3624624 - RNA, 17 nt, Human
acacucugcuguuugac

SEQ ID NO: 3624625 - RNA, 17 nt, Human
acacucuuucuccugcu

SEQ ID NO: 3624626 - RNA, 12 nt, Human
acacucuuugua

SEQ ID NO: 3624627 - RNA, 13 nt, Human
acacugaaaaauu

SEQ ID NO: 3624628 - RNA, 14 nt, Human
acacugaaaaauua

SEQ ID NO: 3624629 - RNA, 14 nt, Human
acacugaaaguuuu

SEQ ID NO: 3624630 - RNA, 20 nt, Human
acacugaaaguuuuguaaaa

SEQ ID NO: 3624631 - RNA, 23 nt, Human
acacugaaaguuuuguaaaagaa

SEQ ID NO: 3624632 - RNA, 12 nt, Human
acacugaacuua

SEQ ID NO: 3624633 - RNA, 21 nt, Human
acacugaagcucuugaagaca

SEQ ID NO: 3624634 - RNA, 17 nt, Human
acacugaagucaguucu

SEQ ID NO: 3624635 - RNA, 18 nt, Human
acacugaauauuuauauu

SEQ ID NO: 3624636 - RNA, 16 nt, Human
acacugaauuuuuaug

SEQ ID NO: 3624637 - RNA, 22 nt, Human
acacugaauuuuuaugugugau

SEQ ID NO: 3624638 - RNA, 19 nt, Human
acacugagaauguaagaac

SEQ ID NO: 3624639 - RNA, 20 nt, Human
acacugagaauguaagaacu

SEQ ID NO: 3624640 - RNA, 22 nt, Human
acacugaugggcaacccccagc

SEQ ID NO: 3624641 - RNA, 15 nt, Human
acacugcaaucauau

SEQ ID NO: 3624642 - RNA, 16 nt, Human
acacugcacaauaacu

SEQ ID NO: 3624643 - RNA, 18 nt, Human
acacugcagccccaccca

SEQ ID NO: 3624644 - RNA, 20 nt, Human
acacugcaggcaucacagcu

SEQ ID NO: 3624645 - RNA, 11 nt, Human
acacugccagc

SEQ ID NO: 3624646 - RNA, 22 nt, Human
acacugccaucuuaguuuggau

SEQ ID NO: 3624647 - RNA, 14 nt, Human
acacugccugggcu

SEQ ID NO: 3624648 - RNA, 16 nt, Human
acacugccugggcuga

SEQ ID NO: 3624649 - RNA, 20 nt, Human
acacugccuguauacuuuag

SEQ ID NO: 3624650 - RNA, 20 nt, Human
acacugccuuuuuauuuaua

SEQ ID NO: 3624651 - RNA, 22 nt, Human
acacugccuuuuuauuuauaug

SEQ ID NO: 3624652 - RNA, 18 nt, Human
acacugcggggcuuggcu

SEQ ID NO: 3624653 - RNA, 19 nt, Human
acacugcuuguguuuuuaa

SEQ ID NO: 3624654 - RNA, 23 nt, Human
acacugcuuguguuuuuaacuca

SEQ ID NO: 3624655 - RNA, 18 nt, Human
acacuggaggagagaaga

SEQ ID NO: 3624656 - RNA, 15 nt, Human
acacuggcagacugu

SEQ ID NO: 3624657 - RNA, 18 nt, Human
acacuggcagacugugua

SEQ ID NO: 3624658 - RNA, 13 nt, Human
acacuggccccuc

SEQ ID NO: 3624659 - RNA, 22 nt, Human
acacuggcguagaaguuuuugu

SEQ ID NO: 3624660 - RNA, 22 nt, Human
acacuggcuaaagauaauugcu

SEQ ID NO: 3624661 - RNA, 20 nt, Human
acacuggcucacccaguccu

SEQ ID NO: 3624662 - RNA, 21 nt, Human
acacuggcugccagcuauuuu

SEQ ID NO: 3624663 - RNA, 13 nt, Human
acacugggacuug

SEQ ID NO: 3624664 - RNA, 23 nt, Human
acacugggagaggugccagcaac

SEQ ID NO: 3624665 - RNA, 14 nt, Human
acacugggaggcca

SEQ ID NO: 3624666 - RNA, 22 nt, Human
acacuggggacuuggccucucu

SEQ ID NO: 3624667 - RNA, 21 nt, Human
acacuggggugccgccugccc

SEQ ID NO: 3624668 - RNA, 13 nt, Human
acacuggguggug

SEQ ID NO: 3624669 - RNA, 16 nt, Human
acacuggucugcuguc

SEQ ID NO: 3624670 - RNA, 20 nt, Human
acacuggucugcuguuccag

SEQ ID NO: 3624671 - RNA, 20 nt, Human
acacuggugugaccugaggg

SEQ ID NO: 3624672 - RNA, 13 nt, Human
acacugguucuca

SEQ ID NO: 3624673 - RNA, 14 nt, Human
acacugguucucaa

SEQ ID NO: 3624674 - RNA, 21 nt, Human
acacugguucucaaugaaaaa

SEQ ID NO: 3624675 - RNA, 15 nt, Human
acacuguacugcaau

SEQ ID NO: 3624676 - RNA, 19 nt, Human
acacuguaguaaauaaugc

SEQ ID NO: 3624677 - RNA, 21 nt, Human
acacugucaugcuucaucauu

SEQ ID NO: 3624678 - RNA, 18 nt, Human
acacuguccuauuauauu

SEQ ID NO: 3624679 - RNA, 22 nt, Human
acacugucugguuucaccgagg

SEQ ID NO: 3624680 - RNA, 13 nt, Human
acacugucuugaa

SEQ ID NO: 3624681 - RNA, 22 nt, Human
acacugugaagagcuggacucc

SEQ ID NO: 3624682 - RNA, 13 nt, Human
acacugugacaca

SEQ ID NO: 3624683 - RNA, 18 nt, Human
acacugugcacaucugug

SEQ ID NO: 3624684 - RNA, 20 nt, Human
acacugugcacaucuguguc

SEQ ID NO: 3624685 - RNA, 21 nt, Human
acacugugcacaucugugucu

SEQ ID NO: 3624686 - RNA, 23 nt, Human
acacugugcccagcccggaccuu

SEQ ID NO: 3624687 - RNA, 15 nt, Human
acacugugcuauaaa

SEQ ID NO: 3624688 - RNA, 22 nt, Human
acacugugcuuucuauuguaca

SEQ ID NO: 3624689 - RNA, 21 nt, Human
acacuguuagaacacuauuuu

SEQ ID NO: 3624690 - RNA, 21 nt, Human
acacuguuauuuucagcauga

SEQ ID NO: 3624691 - RNA, 15 nt, Human
acacuguucuuagcu

SEQ ID NO: 3624692 - RNA, 18 nt, Human
aauauugauaugcuuaua

SEQ ID NO: 3624693 - RNA, 16 nt, Human
aauauugauugggaaa

SEQ ID NO: 3624694 - RNA, 13 nt, Human
aauauugcaaaau

SEQ ID NO: 3624695 - RNA, 18 nt, Human
aauauugcaaaauacaug

SEQ ID NO: 3624696 - RNA, 19 nt, Human
aauauugcaaaauacauga

SEQ ID NO: 3624697 - RNA, 20 nt, Human
aauauugcaaaauacaugaa

SEQ ID NO: 3624698 - RNA, 23 nt, Human
aauauugcaaaauacaugaagcu

SEQ ID NO: 3624699 - RNA, 12 nt, Human
aauauugcugau

SEQ ID NO: 3624700 - RNA, 15 nt, Human
aauauugcugauggu

SEQ ID NO: 3624701 - RNA, 21 nt, Human
aauauugcugauggugcaaug

SEQ ID NO: 3624702 - RNA, 21 nt, Human
aauauugguugggaugacuug

SEQ ID NO: 3624703 - RNA, 15 nt, Human
aauauuguacaguuu

SEQ ID NO: 3624704 - RNA, 17 nt, Human
aauauuguacaguuuuu

SEQ ID NO: 3624705 - RNA, 20 nt, Human
aauauuguauauuuuuaucu

SEQ ID NO: 3624706 - RNA, 16 nt, Human
acacuuaauucuguuc

SEQ ID NO: 3624707 - RNA, 19 nt, Human
acacuuacuguaagacauu

SEQ ID NO: 3624708 - RNA, 17 nt, Human
acacuuacuuuuucugg

SEQ ID NO: 3624709 - RNA, 19 nt, Human
acacuuaggguuuggagcu

SEQ ID NO: 3624710 - RNA, 13 nt, Human
acacuucagacug

SEQ ID NO: 3624711 - RNA, 19 nt, Human
acacuucagagagcuggua

SEQ ID NO: 3624712 - RNA, 16 nt, Human
acacuuccaccagccu

SEQ ID NO: 3624713 - RNA, 12 nt, Human
acacuucccugg

SEQ ID NO: 3624714 - RNA, 13 nt, Human
acacuucccuggc

SEQ ID NO: 3624715 - RNA, 13 nt, Human
acacuuccugccu

SEQ ID NO: 3624716 - RNA, 14 nt, Human
acacuuccugucca

SEQ ID NO: 3624717 - RNA, 16 nt, Human
acacuuccuguccaga

SEQ ID NO: 3624718 - RNA, 19 nt, Human
acacuuccuguccagagag

SEQ ID NO: 3624719 - RNA, 17 nt, Human
acacuucuguccuguga

SEQ ID NO: 3624720 - RNA, 19 nt, Human
acacuucuuacgcaaugcu

SEQ ID NO: 3624721 - RNA, 13 nt, Human
acacuugaaaccu

SEQ ID NO: 3624722 - RNA, 14 nt, Human
acacuugagaggau

SEQ ID NO: 3624723 - RNA, 16 nt, Human
acacuugagaggauga

SEQ ID NO: 3624724 - RNA, 19 nt, Human
acacuugagaugauuucca

SEQ ID NO: 3624725 - RNA, 14 nt, Human
acacuugcccugcu

SEQ ID NO: 3624726 - RNA, 20 nt, Human
acacuugccuucuucaccca

SEQ ID NO: 3624727 - RNA, 14 nt, Human
acacuugguaauug

SEQ ID NO: 3624728 - RNA, 16 nt, Human
acacuuggugcuggga

SEQ ID NO: 3624729 - RNA, 17 nt, Human
acacuuggugcugggaa

SEQ ID NO: 3624730 - RNA, 22 nt, Human
acacuugguuggguccucacau

SEQ ID NO: 3624731 - RNA, 16 nt, Human
acacuuguauaaaugu

SEQ ID NO: 3624732 - RNA, 20 nt, Human
acacuuguauaaauguauau

SEQ ID NO: 3624733 - RNA, 18 nt, Human
acacuugugaauaaagag

SEQ ID NO: 3624734 - RNA, 15 nt, Human
acacuugugacuuuu

SEQ ID NO: 3624735 - RNA, 18 nt, Human
acacuugugacuuuugcu

SEQ ID NO: 3624736 - RNA, 21 nt, Human
acacuugugacuuuugcuuua

SEQ ID NO: 3624737 - RNA, 19 nt, Human
acacuugugauuauaaaau

SEQ ID NO: 3624738 - RNA, 14 nt, Human
acacuuguguuaug

SEQ ID NO: 3624739 - RNA, 13 nt, Human
acacuuuauuuac

SEQ ID NO: 3624740 - RNA, 18 nt, Human
acacuuugaaauguguuu

SEQ ID NO: 3624741 - RNA, 20 nt, Human
acacuuugaaauguguuucu

SEQ ID NO: 3624742 - RNA, 16 nt, Human
acacuuugccuccugu

SEQ ID NO: 3624743 - RNA, 20 nt, Human
acacuuugccuccuguguac

SEQ ID NO: 3624744 - RNA, 23 nt, Human
acacuuugccuccuguguacugu

SEQ ID NO: 3624745 - RNA, 16 nt, Human
acacuuugguaccaga

SEQ ID NO: 3624746 - RNA, 23 nt, Human
acacuuuguugcaagaugugaau

SEQ ID NO: 3624747 - RNA, 11 nt, Human
acacuuuuaug

SEQ ID NO: 3624748 - RNA, 18 nt, Human
acacuuuugagacuuuuu

SEQ ID NO: 3624749 - RNA, 22 nt, Human
acacuuuugguuaagucuguuu

SEQ ID NO: 3624750 - RNA, 16 nt, Human
acagaaaaaaaacaca

SEQ ID NO: 3624751 - RNA, 18 nt, Human
acagaaaaaaaacacaca

SEQ ID NO: 3624752 - RNA, 22 nt, Human
acagaaaaaucuugugcuagaa

SEQ ID NO: 3624753 - RNA, 10 nt, Human
acagaaaaca

SEQ ID NO: 3624754 - RNA, 14 nt, Human
acagaaaacaacaa

SEQ ID NO: 3624755 - RNA, 17 nt, Human
acagaaaacaacaaaaa

SEQ ID NO: 3624756 - RNA, 22 nt, Human
acagaaaacauucugauuugga

SEQ ID NO: 3624757 - RNA, 13 nt, Human
acagaaaauauac

SEQ ID NO: 3624758 - RNA, 15 nt, Human
acagaaaauauacug

SEQ ID NO: 3624759 - RNA, 16 nt, Human
acagaaaauauacugu

SEQ ID NO: 3624760 - RNA, 17 nt, Human
acagaaaauauacugua

SEQ ID NO: 3624761 - RNA, 20 nt, Human
acagaaaauggaagacagcu

SEQ ID NO: 3624762 - RNA, 18 nt, Human
acagaaaauucuucucca

SEQ ID NO: 3624763 - RNA, 12 nt, Human
acagaaacaaaa

SEQ ID NO: 3624764 - RNA, 17 nt, Human
acagaaacaaaaacacu

SEQ ID NO: 3624765 - RNA, 13 nt, Human
acagaaacacugc

SEQ ID NO: 3624766 - RNA, 22 nt, Human
acagaaaccuauccucacugcc

SEQ ID NO: 3624767 - RNA, 20 nt, Human
acagaaaccuuuuuaaaaau

SEQ ID NO: 3624768 - RNA, 18 nt, Human
acagaaacgcauccagca

SEQ ID NO: 3624769 - RNA, 23 nt, Human
acagaaacuaaacucuuaccaua

SEQ ID NO: 3624770 - RNA, 19 nt, Human
acagaaagcagaacaguga

SEQ ID NO: 3624771 - RNA, 19 nt, Human
acagaaagucauuccuucu

SEQ ID NO: 3624772 - RNA, 14 nt, Human
acagaaaguggugc

SEQ ID NO: 3624773 - RNA, 19 nt, Human
acagaaaguggugcucagu

SEQ ID NO: 3624774 - RNA, 22 nt, Human
acagaaaguggugcucaguugu

SEQ ID NO: 3624775 - RNA, 18 nt, Human
acagaaauauauauacau

SEQ ID NO: 3624776 - RNA, 22 nt, Human
acagaaauauauauacauaugu

SEQ ID NO: 3624777 - RNA, 20 nt, Human
acagaaaugcugcuggccaa

SEQ ID NO: 3624778 - RNA, 12 nt, Human
acagaaauuggu

SEQ ID NO: 3624779 - RNA, 15 nt, Human
acagaaauuguauau

SEQ ID NO: 3624780 - RNA, 16 nt, Human
acagaacagcuucagg

SEQ ID NO: 3624781 - RNA, 17 nt, Human
acagaacagcuucaggu

SEQ ID NO: 3624782 - RNA, 17 nt, Human
acagaaccccuacauga

SEQ ID NO: 3624783 - RNA, 13 nt, Human
acagaacuaaaug

SEQ ID NO: 3624784 - RNA, 17 nt, Human
acagaacuaaauguucu

SEQ ID NO: 3624785 - RNA, 22 nt, Human
acagaacucgguguccccacca

SEQ ID NO: 3624786 - RNA, 18 nt, Human
acagaacuucagaaagac

SEQ ID NO: 3624787 - RNA, 19 nt, Human
acagaacuucagaaagacu

SEQ ID NO: 3624788 - RNA, 21 nt, Human
acagaacuucagaaagacuug

SEQ ID NO: 3624789 - RNA, 19 nt, Human
acagaacuugaauguguca

SEQ ID NO: 3624790 - RNA, 12 nt, Human
acagaagcagcu

SEQ ID NO: 3624791 - RNA, 18 nt, Human
acagaagcaggcuggagg

SEQ ID NO: 3624792 - RNA, 22 nt, Human
acagaagcaguugagucgucau

SEQ ID NO: 3624793 - RNA, 16 nt, Human
acagaagcauuuguau

SEQ ID NO: 3624794 - RNA, 13 nt, Human
acagaagccagga

SEQ ID NO: 3624795 - RNA, 16 nt, Human
acagaagcuccaggua

SEQ ID NO: 3624796 - RNA, 21 nt, Human
acagaagcugaagugcaucca

SEQ ID NO: 3624797 - RNA, 13 nt, Human
acagaagcuucag

SEQ ID NO: 3624798 - RNA, 19 nt, Human
acagaagggagggcagagc

SEQ ID NO: 3624799 - RNA, 23 nt, Human
acagaagggagggcagagcuggu

SEQ ID NO: 3624800 - RNA, 22 nt, Human
acagaaggggacugccaccucc

SEQ ID NO: 3624801 - RNA, 14 nt, Human
acagaaguccugua

SEQ ID NO: 3624802 - RNA, 21 nt, Human
acagaaguccuguaugucugu

SEQ ID NO: 3624803 - RNA, 16 nt, Human
acagaagugacugaug

SEQ ID NO: 3624804 - RNA, 15 nt, Human
acagaaguuugcacu

SEQ ID NO: 3624805 - RNA, 18 nt, Human
acagaauacuagccagag

SEQ ID NO: 3624806 - RNA, 16 nt, Human
acagaauauuuuuaua

SEQ ID NO: 3624807 - RNA, 16 nt, Human
acagaaucauugcuua

SEQ ID NO: 3624808 - RNA, 18 nt, Human
acagaaucuuguuuugaa

SEQ ID NO: 3624809 - RNA, 17 nt, Human
acagaaugaaaaaugaa

SEQ ID NO: 3624810 - RNA, 18 nt, Human
acagaaugaaaaaugaaa

SEQ ID NO: 3624811 - RNA, 21 nt, Human
acagaaugaaaaaugaaagau

SEQ ID NO: 3624812 - RNA, 20 nt, Human
acagaaugcaaccaagucac

SEQ ID NO: 3624813 - RNA, 22 nt, Human
acagaaugcaaccaagucacac

SEQ ID NO: 3624814 - RNA, 17 nt, Human
acagaauguaucuguga

SEQ ID NO: 3624815 - RNA, 21 nt, Human
acagaauguuuuacugugaaa

SEQ ID NO: 3624816 - RNA, 22 nt, Human
acagaauuacuguaacugauua

SEQ ID NO: 3624817 - RNA, 13 nt, Human
acagaauuugaau

SEQ ID NO: 3624818 - RNA, 23 nt, Human
acagaauuugaauuaucagcaaa

SEQ ID NO: 3624819 - RNA, 18 nt, Human
acagaauuuuauggugca

SEQ ID NO: 3624820 - RNA, 18 nt, Human
acagacaaaaacagccuc

SEQ ID NO: 3624821 - RNA, 22 nt, Human
acagacaagguagcccuggcca

SEQ ID NO: 3624822 - RNA, 11 nt, Human
acagacacaca

SEQ ID NO: 3624823 - RNA, 12 nt, Human
acagacacacac

SEQ ID NO: 3624824 - RNA, 14 nt, Human
acagacacacacac

SEQ ID NO: 3624825 - RNA, 22 nt, Human
acagacacacacacgcacgcac

SEQ ID NO: 3624826 - RNA, 23 nt, Human
acagacacaggcccggcuccagg

SEQ ID NO: 3624827 - RNA, 14 nt, Human
acagacaggagaaa

SEQ ID NO: 3624828 - RNA, 19 nt, Human
acagacauacuaaccagca

SEQ ID NO: 3624829 - RNA, 22 nt, Human
acagaccacaucuuuaucuguu

SEQ ID NO: 3624830 - RNA, 18 nt, Human
acagaccccucgcaacug

SEQ ID NO: 3624831 - RNA, 15 nt, Human
acagacccugcccug

SEQ ID NO: 3624832 - RNA, 21 nt, Human
acagaccugcuuuuugaaaug

SEQ ID NO: 3624833 - RNA, 17 nt, Human
acagaccuggagccccu

SEQ ID NO: 3624834 - RNA, 19 nt, Human
acagaccuggagccccugg

SEQ ID NO: 3624835 - RNA, 18 nt, Human
acagacgcugcugucaca

SEQ ID NO: 3624836 - RNA, 23 nt, Human
acagacggaaggguaaacaauau

SEQ ID NO: 3624837 - RNA, 19 nt, Human
acagacuauugacaucagc

SEQ ID NO: 3624838 - RNA, 22 nt, Human
acagacucacaaccugaaccua

SEQ ID NO: 3624839 - RNA, 23 nt, Human
acagacucauccugaacagcaug

SEQ ID NO: 3624840 - RNA, 22 nt, Human
acagacucgauucauauugaau

SEQ ID NO: 3624841 - RNA, 17 nt, Human
acagacuggaagcacag

SEQ ID NO: 3624842 - RNA, 19 nt, Human
acagacuguugucccugca

SEQ ID NO: 3624843 - RNA, 15 nt, Human
acagacuucuccaga

SEQ ID NO: 3624844 - RNA, 14 nt, Human
acagacuucugaaa

SEQ ID NO: 3624845 - RNA, 14 nt, Human
acagacuugagaac

SEQ ID NO: 3624846 - RNA, 16 nt, Human
acagacuugagaacuu

SEQ ID NO: 3624847 - RNA, 16 nt, Human
acagacuuuagcuuuc

SEQ ID NO: 3624848 - RNA, 19 nt, Human
acagacuuuagcuuucuga

SEQ ID NO: 3624849 - RNA, 22 nt, Human
acagagaaaccagcuuccuuca

SEQ ID NO: 3624850 - RNA, 12 nt, Human
aaugcaaagaug

SEQ ID NO: 3624851 - RNA, 16 nt, Human
aaugcaaaguucugug

SEQ ID NO: 3624852 - RNA, 20 nt, Human
aaugcaaaguucuguguuua

SEQ ID NO: 3624853 - RNA, 13 nt, Human
aaugcaaauaaca

SEQ ID NO: 3624854 - RNA, 16 nt, Human
aaugcaaauccuaugu

SEQ ID NO: 3624855 - RNA, 14 nt, Human
aaugcaaauucuca

SEQ ID NO: 3624856 - RNA, 16 nt, Human
aaugcaaauucucaag

SEQ ID NO: 3624857 - RNA, 18 nt, Human
aaugcaacaacauguaua

SEQ ID NO: 3624858 - RNA, 13 nt, Human
aaugcaaccauuu

SEQ ID NO: 3624859 - RNA, 18 nt, Human
aaugcaaccauuugaaac

SEQ ID NO: 3624860 - RNA, 22 nt, Human
aaugcaauagaagugcuccccu

SEQ ID NO: 3624861 - RNA, 23 nt, Human
aaugcaauagaagugcuccccuc

SEQ ID NO: 3624862 - RNA, 24 nt, Human
aaugcaaucuccccuugauuuaaa

SEQ ID NO: 3624863 - RNA, 19 nt, Human
aaugcacaaacagaggccg

SEQ ID NO: 3624864 - RNA, 20 nt, Human
aaugcacaaacagaggccgc

SEQ ID NO: 3624865 - RNA, 15 nt, Human
aaugcacaaugucuu

SEQ ID NO: 3624866 - RNA, 17 nt, Human
aaugcacaaugucuugg

SEQ ID NO: 3624867 - RNA, 17 nt, Human
aaugcacacaaaacaac

SEQ ID NO: 3624868 - RNA, 17 nt, Human
aaugcacacuagccucu

SEQ ID NO: 3624869 - RNA, 16 nt, Human
aaugcaccuaaagaaa

SEQ ID NO: 3624870 - RNA, 19 nt, Human
aaugcaccuagcugugcaa

SEQ ID NO: 3624871 - RNA, 11 nt, Human
aaugcacggcc

SEQ ID NO: 3624872 - RNA, 11 nt, Human
aaugcacuuuc

SEQ ID NO: 3624873 - RNA, 16 nt, Human
aaugcacuuuguucug

SEQ ID NO: 3624874 - RNA, 21 nt, Human
aaugcacuuuguucuggcucu

SEQ ID NO: 3624875 - RNA, 22 nt, Human
aaugcagcgaaccaauauuugu

SEQ ID NO: 3624876 - RNA, 22 nt, Human
aaugcagcuugugugcaaaagc

SEQ ID NO: 3624877 - RNA, 22 nt, Human
aaugcagggauugcugccacuu

SEQ ID NO: 3624878 - RNA, 20 nt, Human
aaugcaguacaggacauaua

SEQ ID NO: 3624879 - RNA, 17 nt, Human
aaugcagugaauuguga

SEQ ID NO: 3624880 - RNA, 16 nt, Human
aaugcaguugucucug

SEQ ID NO: 3624881 - RNA, 16 nt, Human
aaugcauaaaauguua

SEQ ID NO: 3624882 - RNA, 14 nt, Human
aaugcauaaaugca

SEQ ID NO: 3624883 - RNA, 14 nt, Human
aaugcauacaaguu

SEQ ID NO: 3624884 - RNA, 13 nt, Human
aaugcauauugua

SEQ ID NO: 3624885 - RNA, 23 nt, Human
aaugcauauuugcaaaguguauu

SEQ ID NO: 3624886 - RNA, 20 nt, Human
aaugcaucaauccugugugg

SEQ ID NO: 3624887 - RNA, 21 nt, Human
aaugcaucaauccuguguggu

SEQ ID NO: 3624888 - RNA, 15 nt, Human
aaugcaucuguccuc

SEQ ID NO: 3624889 - RNA, 14 nt, Human
aaugcaucuuugau

SEQ ID NO: 3624890 - RNA, 18 nt, Human
aaugcaucuuugaugugu

SEQ ID NO: 3624891 - RNA, 19 nt, Human
aaugcaugcagccacugug

SEQ ID NO: 3624892 - RNA, 18 nt, Human
aaugcaugcuuuccauau

SEQ ID NO: 3624893 - RNA, 14 nt, Human
aaugcauugauauu

SEQ ID NO: 3624894 - RNA, 20 nt, Human
aaugcauugauauugugaac

SEQ ID NO: 3624895 - RNA, 18 nt, Human
aaugcauuguaucgaugu

SEQ ID NO: 3624896 - RNA, 22 nt, Human
aaugcauuguaucgauguuaug

SEQ ID NO: 3624897 - RNA, 12 nt, Human
aaugcauuuugu

SEQ ID NO: 3624898 - RNA, 23 nt, Human
aaugcauuuuguuugguauugua

SEQ ID NO: 3624899 - RNA, 15 nt, Human
aaugccaaauuaaaa

SEQ ID NO: 3624900 - RNA, 23 nt, Human
aaugccaacuuguccuuuuguac

SEQ ID NO: 3624901 - RNA, 17 nt, Human
aaugccaagauaauuca

SEQ ID NO: 3624902 - RNA, 19 nt, Human
aaugccaagcacuucuuuu

SEQ ID NO: 3624903 - RNA, 14 nt, Human
aaugccacagcccu

SEQ ID NO: 3624904 - RNA, 19 nt, Human
aaugccacagcccugucag

SEQ ID NO: 3624905 - RNA, 11 nt, Human
aaugccagggc

SEQ ID NO: 3624906 - RNA, 23 nt, Human
aaugccaguaacgcgucuuccug

SEQ ID NO: 3624907 - RNA, 18 nt, Human
acacuccacccuccaccu

SEQ ID NO: 3624908 - RNA, 15 nt, Human
acacuccagccugag

SEQ ID NO: 3624909 - RNA, 16 nt, Human
acacuccagccugagc

SEQ ID NO: 3624910 - RNA, 16 nt, Human
acacuccagugccagc

SEQ ID NO: 3624911 - RNA, 20 nt, Human
acacucccaagguuggagcc

SEQ ID NO: 3624912 - RNA, 16 nt, Human
acacucccacccaguc

SEQ ID NO: 3624913 - RNA, 16 nt, Human
acacuccuacaccuaa

SEQ ID NO: 3624914 - RNA, 23 nt, Human
acacuccuagagaacgcagcccu

SEQ ID NO: 3624915 - RNA, 16 nt, Human
acacucuaacuguaua

SEQ ID NO: 3624916 - RNA, 14 nt, Human
acacucuccugggc

SEQ ID NO: 3624917 - RNA, 17 nt, Human
acacucuccugggcccc

SEQ ID NO: 3624918 - RNA, 22 nt, Human
acacucuccugggccccucccu

SEQ ID NO: 3624919 - RNA, 18 nt, Human
acacucuccuugcaguuc

SEQ ID NO: 3624920 - RNA, 22 nt, Human
acacucuccuugcaguucuuga

SEQ ID NO: 3624921 - RNA, 23 nt, Human
acacucucuggaagcccuggaga

SEQ ID NO: 3624922 - RNA, 16 nt, Human
acacucugcagacugc

SEQ ID NO: 3624923 - RNA, 14 nt, Human
acacucugcucugc

SEQ ID NO: 3624924 - RNA, 16 nt, Human
acacucugcucugccc

SEQ ID NO: 3624925 - RNA, 14 nt, Human
acacucuggcuggu

SEQ ID NO: 3624926 - RNA, 20 nt, Human
acacucugggcuccagagug

SEQ ID NO: 3624927 - RNA, 22 nt, Human
acacucuucuaugacccagcau

SEQ ID NO: 3624928 - RNA, 23 nt, Human
acacugaaaaaucuaagugauau

SEQ ID NO: 3624929 - RNA, 22 nt, Human
acacugaaaagaaggaaagaug

SEQ ID NO: 3624930 - RNA, 18 nt, Human
acacugaaaguuuuguaa

SEQ ID NO: 3624931 - RNA, 20 nt, Human
acacugaaauauacacacag

SEQ ID NO: 3624932 - RNA, 14 nt, Human
acacugaagaagca

SEQ ID NO: 3624933 - RNA, 23 nt, Human
acacugaauauuuauauuucacu

SEQ ID NO: 3624934 - RNA, 23 nt, Human
acacugaccuuggagagacacag

SEQ ID NO: 3624935 - RNA, 19 nt, Human
acacugagagccuuuuuga

SEQ ID NO: 3624936 - RNA, 22 nt, Human
acacugaugcuuagauguucca

SEQ ID NO: 3624937 - RNA, 22 nt, Human
acacugauuuccccuuuugcau

SEQ ID NO: 3624938 - RNA, 18 nt, Human
acacugcaagagccuugg

SEQ ID NO: 3624939 - RNA, 19 nt, Human
acacugcaaucauauguga

SEQ ID NO: 3624940 - RNA, 23 nt, Human
acacugcacaauaacuccuccca

SEQ ID NO: 3624941 - RNA, 22 nt, Human
acacugcacucuuaagcuuccg

SEQ ID NO: 3624942 - RNA, 15 nt, Human
acacugccugccuua

SEQ ID NO: 3624943 - RNA, 12 nt, Human
acacugccuggg

SEQ ID NO: 3624944 - RNA, 13 nt, Human
acacugccugggc

SEQ ID NO: 3624945 - RNA, 15 nt, Human
acacugccugggcug

SEQ ID NO: 3624946 - RNA, 18 nt, Human
acacugccuguauacuuu

SEQ ID NO: 3624947 - RNA, 19 nt, Human
acacugcggggcuuggcug

SEQ ID NO: 3624948 - RNA, 23 nt, Human
acacugcuaggugggccagcccc

SEQ ID NO: 3624949 - RNA, 20 nt, Human
acacugcucuaacagcccuc

SEQ ID NO: 3624950 - RNA, 20 nt, Human
acacuggaggagagaagaau

SEQ ID NO: 3624951 - RNA, 20 nt, Human
acacuggcaaugguaguuuc

SEQ ID NO: 3624952 - RNA, 21 nt, Human
acacuggcaaugguaguuucu

SEQ ID NO: 3624953 - RNA, 12 nt, Human
acacuggccccu

SEQ ID NO: 3624954 - RNA, 21 nt, Human
acacuggcucauauuccugca

SEQ ID NO: 3624955 - RNA, 22 nt, Human
acacugggagaggugccagcaa

SEQ ID NO: 3624956 - RNA, 16 nt, Human
acacugggggagggga

SEQ ID NO: 3624957 - RNA, 23 nt, Human
acacugggugguggccugguccc

SEQ ID NO: 3624958 - RNA, 21 nt, Human
acacugguauuccugccucca

SEQ ID NO: 3624959 - RNA, 14 nt, Human
acacuggugacugc

SEQ ID NO: 3624960 - RNA, 16 nt, Human
acacuggugugaccug

SEQ ID NO: 3624961 - RNA, 21 nt, Human
acacuguauguuauagaacuu

SEQ ID NO: 3624962 - RNA, 21 nt, Human
acacuguauuuguaucucuga

SEQ ID NO: 3624963 - RNA, 20 nt, Human
acacugucaaacaucuggaa

SEQ ID NO: 3624964 - RNA, 15 nt, Human
acacugugacacacu

SEQ ID NO: 3624965 - RNA, 18 nt, Human
acacugugacacacuaca

SEQ ID NO: 3624966 - RNA, 16 nt, Human
acacugugacaucucu

SEQ ID NO: 3624967 - RNA, 13 nt, Human
acacugugcccug

SEQ ID NO: 3624968 - RNA, 14 nt, Human
acacugugcccugg

SEQ ID NO: 3624969 - RNA, 16 nt, Human
acacugugcccuggug

SEQ ID NO: 3624970 - RNA, 17 nt, Human
acacugugcugagucug

SEQ ID NO: 3624971 - RNA, 22 nt, Human
acacugugcugagucugaaggc

SEQ ID NO: 3624972 - RNA, 23 nt, Human
acacugugcuuucuauuguacag

SEQ ID NO: 3624973 - RNA, 19 nt, Human
acacuguggaacuaauaaa

SEQ ID NO: 3624974 - RNA, 20 nt, Human
acacuguggaacuaauaaau

SEQ ID NO: 3624975 - RNA, 23 nt, Human
acacuguggaacuaauaaauaca

SEQ ID NO: 3624976 - RNA, 20 nt, Human
acacugugguagguguuuga

SEQ ID NO: 3624977 - RNA, 13 nt, Human
acacuguguccug

SEQ ID NO: 3624978 - RNA, 19 nt, Human
acacuguguccuggugcuc

SEQ ID NO: 3624979 - RNA, 20 nt, Human
acacuguguccuggugcucu

SEQ ID NO: 3624980 - RNA, 21 nt, Human
acacuguguccuggugcucuc

SEQ ID NO: 3624981 - RNA, 22 nt, Human
acacuguguccuggugcucucu

SEQ ID NO: 3624982 - RNA, 17 nt, Human
acacuguuagaacacua

SEQ ID NO: 3624983 - RNA, 18 nt, Human
acacuguuagaacacuau

SEQ ID NO: 3624984 - RNA, 10 nt, Human
acacuguuau

SEQ ID NO: 3624985 - RNA, 18 nt, Human
acacuguucucugcccuc

SEQ ID NO: 3624986 - RNA, 20 nt, Human
acacuguucucugcccucca

SEQ ID NO: 3624987 - RNA, 22 nt, Human
acacuguucucugcccuccaag

SEQ ID NO: 3624988 - RNA, 23 nt, Human
acacuguucucugcccuccaaga

SEQ ID NO: 3624989 - RNA, 22 nt, Human
acacuguucuuagcucaaugag

SEQ ID NO: 3624990 - RNA, 16 nt, Human
acacuguuucaaacuu

SEQ ID NO: 3624991 - RNA, 17 nt, Human
acacuguuucaaacuuu

SEQ ID NO: 3624992 - RNA, 19 nt, Human
acacuguuuguuccagaau

SEQ ID NO: 3624993 - RNA, 21 nt, Human
aaugcuuuuagugugugcaua

SEQ ID NO: 3624994 - RNA, 19 nt, Human
aaugcuuuuuauuucugca

SEQ ID NO: 3624995 - RNA, 19 nt, Human
aauggaaaccacaacuuuu

SEQ ID NO: 3624996 - RNA, 14 nt, Human
aauggaaaccucac

SEQ ID NO: 3624997 - RNA, 12 nt, Human
aauggaaacuga

SEQ ID NO: 3624998 - RNA, 14 nt, Human
aauggaaacugaaa

SEQ ID NO: 3624999 - RNA, 20 nt, Human
aauggaaaugggcagagcag

SEQ ID NO: 3625000 - RNA, 16 nt, Human
aauggaaccaggcuug

SEQ ID NO: 3625001 - RNA, 17 nt, Human
aauggaaccaggcuugg

SEQ ID NO: 3625002 - RNA, 22 nt, Human
aauggaaccuccuuucucuucu

SEQ ID NO: 3625003 - RNA, 13 nt, Human
aauggaagacagc

SEQ ID NO: 3625004 - RNA, 14 nt, Human
aauggaagagaaau

SEQ ID NO: 3625005 - RNA, 15 nt, Human
aauggaagauuugcc

SEQ ID NO: 3625006 - RNA, 18 nt, Human
aauggaauaaaaggcuug

SEQ ID NO: 3625007 - RNA, 13 nt, Human
aauggaaugagaa

SEQ ID NO: 3625008 - RNA, 12 nt, Human
aauggacacuuu

SEQ ID NO: 3625009 - RNA, 14 nt, Human
aauggacauggugg

SEQ ID NO: 3625010 - RNA, 13 nt, Human
aauggacauuucu

SEQ ID NO: 3625011 - RNA, 16 nt, Human
aauggacuauccauua

SEQ ID NO: 3625012 - RNA, 21 nt, Human
aauggacuuauuucuucaaau

SEQ ID NO: 3625013 - RNA, 15 nt, Human
aauggagaagcugca

SEQ ID NO: 3625014 - RNA, 15 nt, Human
aauggaggaauauga

SEQ ID NO: 3625015 - RNA, 20 nt, Human
aauggaggggcagagccagg

SEQ ID NO: 3625016 - RNA, 21 nt, Human
aauggaggggcagagccagga

SEQ ID NO: 3625017 - RNA, 20 nt, Human
aauggaguuaaacuuuagug

SEQ ID NO: 3625018 - RNA, 19 nt, Human
aauggaguuggaguucauu

SEQ ID NO: 3625019 - RNA, 18 nt, Human
aauggauaaaaucugaua

SEQ ID NO: 3625020 - RNA, 16 nt, Human
aauggauacauaaaga

SEQ ID NO: 3625021 - RNA, 18 nt, Human
aauggauacauaaagacu

SEQ ID NO: 3625022 - RNA, 14 nt, Human
aauggauauuauua

SEQ ID NO: 3625023 - RNA, 17 nt, Human
aauggauauuauuagaa

SEQ ID NO: 3625024 - RNA, 22 nt, Human
aauggauauuuguacuguuuaa

SEQ ID NO: 3625025 - RNA, 17 nt, Human
aauggaucacaagaugg

SEQ ID NO: 3625026 - RNA, 13 nt, Human
aauggaugaaauc

SEQ ID NO: 3625027 - RNA, 17 nt, Human
aauggaugccuugaaua

SEQ ID NO: 3625028 - RNA, 14 nt, Human
aauggauucuauuu

SEQ ID NO: 3625029 - RNA, 22 nt, Human
aauggauuggauuauuuaauaa

SEQ ID NO: 3625030 - RNA, 14 nt, Human
aauggauuguuaau

SEQ ID NO: 3625031 - RNA, 19 nt, Human
aauggauuguuaauuucag

SEQ ID NO: 3625032 - RNA, 15 nt, Human
aauggauuucagaag

SEQ ID NO: 3625033 - RNA, 17 nt, Human
aauggauuuuucuuuaa

SEQ ID NO: 3625034 - RNA, 18 nt, Human
aauggauuuuucuuuaac

SEQ ID NO: 3625035 - RNA, 17 nt, Human
aauggcaacaaacugca

SEQ ID NO: 3625036 - RNA, 23 nt, Human
aauggcaaggcagcccugucuga

SEQ ID NO: 3625037 - RNA, 16 nt, Human
aauggcaaguuuugau

SEQ ID NO: 3625038 - RNA, 20 nt, Human
aauggcaauguuuugcuuuu

SEQ ID NO: 3625039 - RNA, 23 nt, Human
aauggcacaaucucggcucacug

SEQ ID NO: 3625040 - RNA, 19 nt, Human
aauggcacagcccaaagaa

SEQ ID NO: 3625041 - RNA, 16 nt, Human
aauggcagcagaaaac

SEQ ID NO: 3625042 - RNA, 23 nt, Human
aauggcaugagaaauacaaaaau

SEQ ID NO: 3625043 - RNA, 17 nt, Human
aauggccauuugcuuuu

SEQ ID NO: 3625044 - RNA, 20 nt, Human
aauggccucauguggcugga

SEQ ID NO: 3625045 - RNA, 22 nt, Human
aauggccucauguggcuggaag

SEQ ID NO: 3625046 - RNA, 17 nt, Human
aauggccuccucccuua

SEQ ID NO: 3625047 - RNA, 20 nt, Human
aauggccugccuugaagcca

SEQ ID NO: 3625048 - RNA, 18 nt, Human
aauggcgcagugccucug

SEQ ID NO: 3625049 - RNA, 19 nt, Human
aauggcgcagugccucugg

SEQ ID NO: 3625050 - RNA, 19 nt, Human
aauggcgugaacccgggag

SEQ ID NO: 3625051 - RNA, 14 nt, Human
aauggcuauuaaca

SEQ ID NO: 3625052 - RNA, 21 nt, Human
aauggcucacuauggugccaa

SEQ ID NO: 3625053 - RNA, 13 nt, Human
aauggcuucagug

SEQ ID NO: 3625054 - RNA, 13 nt, Human
aauggcuuuguau

SEQ ID NO: 3625055 - RNA, 18 nt, Human
aauggcuuuguauagaac

SEQ ID NO: 3625056 - RNA, 14 nt, Human
aaugggaccugugg

SEQ ID NO: 3625057 - RNA, 17 nt, Human
aaugggacuucuuuuca

SEQ ID NO: 3625058 - RNA, 13 nt, Human
aaugggcagagca

SEQ ID NO: 3625059 - RNA, 20 nt, Human
aaugggccacugaaaucugu

SEQ ID NO: 3625060 - RNA, 16 nt, Human
aaugggcucaaccaga

SEQ ID NO: 3625061 - RNA, 17 nt, Human
aauggggaucacagaga

SEQ ID NO: 3625062 - RNA, 17 nt, Human
aauggggccagauccag

SEQ ID NO: 3625063 - RNA, 17 nt, Human
aaugggguccuggccau

SEQ ID NO: 3625064 - RNA, 18 nt, Human
aaugggguccuggccauc

SEQ ID NO: 3625065 - RNA, 13 nt, Human
acagaaaugagga

SEQ ID NO: 3625066 - RNA, 14 nt, Human
acagaaaugcugcu

SEQ ID NO: 3625067 - RNA, 16 nt, Human
acagaaaugcugcugg

SEQ ID NO: 3625068 - RNA, 15 nt, Human
acagaaauggacugg

SEQ ID NO: 3625069 - RNA, 14 nt, Human
acagaaauguacag

SEQ ID NO: 3625070 - RNA, 16 nt, Human
acagaaauguacagca

SEQ ID NO: 3625071 - RNA, 17 nt, Human
acagaaauguacagcaa

SEQ ID NO: 3625072 - RNA, 19 nt, Human
acagaaauuguauauugua

SEQ ID NO: 3625073 - RNA, 14 nt, Human
acagaacacugucu

SEQ ID NO: 3625074 - RNA, 13 nt, Human
acagaacacuuau

SEQ ID NO: 3625075 - RNA, 12 nt, Human
acagaacagcuu

SEQ ID NO: 3625076 - RNA, 13 nt, Human
acagaacagcuuc

SEQ ID NO: 3625077 - RNA, 20 nt, Human
acagaacagcuucagguuau

SEQ ID NO: 3625078 - RNA, 15 nt, Human
acagaacagggucau

SEQ ID NO: 3625079 - RNA, 17 nt, Human
acagaaccuuguuauuu

SEQ ID NO: 3625080 - RNA, 22 nt, Human
acagaaccuuguuauuucucag

SEQ ID NO: 3625081 - RNA, 14 nt, Human
acagaacuaaaugu

SEQ ID NO: 3625082 - RNA, 18 nt, Human
acagaacuaaauguucua

SEQ ID NO: 3625083 - RNA, 22 nt, Human
acagaacuaucucagcaucaga

SEQ ID NO: 3625084 - RNA, 19 nt, Human
acagaacucggugucccca

SEQ ID NO: 3625085 - RNA, 20 nt, Human
acagaacucuuucaaaaccu

SEQ ID NO: 3625086 - RNA, 14 nt, Human
acagaagaaacaag

SEQ ID NO: 3625087 - RNA, 14 nt, Human
acagaagcacaugc

SEQ ID NO: 3625088 - RNA, 19 nt, Human
acagaagcaggcuggaggu

SEQ ID NO: 3625089 - RNA, 12 nt, Human
acagaagcauuu

SEQ ID NO: 3625090 - RNA, 15 nt, Human
acagaagcauuugua

SEQ ID NO: 3625091 - RNA, 17 nt, Human
acagaagcauuuguauu

SEQ ID NO: 3625092 - RNA, 16 nt, Human
acagaagccaggagca

SEQ ID NO: 3625093 - RNA, 14 nt, Human
acagaagcuucaga

SEQ ID NO: 3625094 - RNA, 18 nt, Human
acagaagcuucagaaguu

SEQ ID NO: 3625095 - RNA, 16 nt, Human
acagaagggagggcag

SEQ ID NO: 3625096 - RNA, 21 nt, Human
acagaagggagggcagagcug

SEQ ID NO: 3625097 - RNA, 23 nt, Human
acagaaggggacugccaccuccc

SEQ ID NO: 3625098 - RNA, 17 nt, Human
acagaagucaugaagcc

SEQ ID NO: 3625099 - RNA, 18 nt, Human
acagaagucaugaagccc

SEQ ID NO: 3625100 - RNA, 16 nt, Human
acagaauauguuucaa

SEQ ID NO: 3625101 - RNA, 21 nt, Human
acagaauauguuucaaacuuu

SEQ ID NO: 3625102 - RNA, 19 nt, Human
acagaauauuucuauugaa

SEQ ID NO: 3625103 - RNA, 19 nt, Human
acagaaucuuccuuuuauu

SEQ ID NO: 3625104 - RNA, 14 nt, Human
acagaaugaaaaau

SEQ ID NO: 3625105 - RNA, 24 nt, Human
acagaaugaaaaaugaaagaugau

SEQ ID NO: 3625106 - RNA, 15 nt, Human
acagaauguaucugu

SEQ ID NO: 3625107 - RNA, 15 nt, Human
acagaauucugcuac

SEQ ID NO: 3625108 - RNA, 17 nt, Human
acagaauucugcuaccu

SEQ ID NO: 3625109 - RNA, 16 nt, Human
acagaauugcuuguuu

SEQ ID NO: 3625110 - RNA, 14 nt, Human
acagaauuuuggaa

SEQ ID NO: 3625111 - RNA, 15 nt, Human
acagaauuuuuuuug

SEQ ID NO: 3625112 - RNA, 13 nt, Human
acagacaaagcgu

SEQ ID NO: 3625113 - RNA, 14 nt, Human
acagacaaagcgug

SEQ ID NO: 3625114 - RNA, 13 nt, Human
acagacacacaca

SEQ ID NO: 3625115 - RNA, 15 nt, Human
acagacacacacacg

SEQ ID NO: 3625116 - RNA, 16 nt, Human
acagacacacacacgc

SEQ ID NO: 3625117 - RNA, 17 nt, Human
acagacacacacacgca

SEQ ID NO: 3625118 - RNA, 23 nt, Human
acagacacacacacgcacgcaca

SEQ ID NO: 3625119 - RNA, 17 nt, Human
acagacacaggcccggc

SEQ ID NO: 3625120 - RNA, 18 nt, Human
acagacacuaaguuauag

SEQ ID NO: 3625121 - RNA, 16 nt, Human
acagacagacacacac

SEQ ID NO: 3625122 - RNA, 15 nt, Human
acagacagcccucca

SEQ ID NO: 3625123 - RNA, 11 nt, Human
acagacaggag

SEQ ID NO: 3625124 - RNA, 15 nt, Human
acagacaggcucuua

SEQ ID NO: 3625125 - RNA, 15 nt, Human
acagacaucucugca

SEQ ID NO: 3625126 - RNA, 11 nt, Human
acagacauugu

SEQ ID NO: 3625127 - RNA, 20 nt, Human
acagaccacaucuuuaucug

SEQ ID NO: 3625128 - RNA, 13 nt, Human
acagacccugccc

SEQ ID NO: 3625129 - RNA, 16 nt, Human
acagacccugcccugu

SEQ ID NO: 3625130 - RNA, 20 nt, Human
acagacccugcccugugggc

SEQ ID NO: 3625131 - RNA, 15 nt, Human
acagaccugcuuuuu

SEQ ID NO: 3625132 - RNA, 16 nt, Human
acagaccugcuuuuug

SEQ ID NO: 3625133 - RNA, 17 nt, Human
acagaccugcuuuuuga

SEQ ID NO: 3625134 - RNA, 20 nt, Human
acagaccuggagccccuggg

SEQ ID NO: 3625135 - RNA, 21 nt, Human
acagaccuggagccccugggu

SEQ ID NO: 3625136 - RNA, 17 nt, Human
acagacggaaggguaaa

SEQ ID NO: 3625137 - RNA, 15 nt, Human
acagacgucccucca

SEQ ID NO: 3625138 - RNA, 16 nt, Human
acagacgucccuccac

SEQ ID NO: 3625139 - RNA, 19 nt, Human
acauccuuucuaaacaaga

SEQ ID NO: 3625140 - RNA, 15 nt, Human
acaucgcacugugga

SEQ ID NO: 3625141 - RNA, 16 nt, Human
acaucuaaccucaucu

SEQ ID NO: 3625142 - RNA, 17 nt, Human
acaucuaaccucaucuu

SEQ ID NO: 3625143 - RNA, 13 nt, Human
acaucuaagccug

SEQ ID NO: 3625144 - RNA, 16 nt, Human
acaucuacaaaacauu

SEQ ID NO: 3625145 - RNA, 16 nt, Human
acaucuaguaguuguu

SEQ ID NO: 3625146 - RNA, 14 nt, Human
acaucuauucucuc

SEQ ID NO: 3625147 - RNA, 19 nt, Human
acaucuauuuuggauugua

SEQ ID NO: 3625148 - RNA, 23 nt, Human
acaucuauuuuggauuguauauu

SEQ ID NO: 3625149 - RNA, 22 nt, Human
acaucucaacaggccucagggc

SEQ ID NO: 3625150 - RNA, 20 nt, Human
acaucucaauaaagugcuuu

SEQ ID NO: 3625151 - RNA, 12 nt, Human
acaucucagacc

SEQ ID NO: 3625152 - RNA, 19 nt, Human
acaucucaggggccagagg

SEQ ID NO: 3625153 - RNA, 20 nt, Human
acaucucaggggccagagga

SEQ ID NO: 3625154 - RNA, 12 nt, Human
acaucucauuuu

SEQ ID NO: 3625155 - RNA, 21 nt, Human
acaucuccuccauacucagga

SEQ ID NO: 3625156 - RNA, 15 nt, Human
acaucucuauucccc

SEQ ID NO: 3625157 - RNA, 12 nt, Human
acaucucugcuu

SEQ ID NO: 3625158 - RNA, 13 nt, Human
acaucucuuccuc

SEQ ID NO: 3625159 - RNA, 12 nt, Human
acaucugauaac

SEQ ID NO: 3625160 - RNA, 22 nt, Human
acaucuggaaaauaaaaggucu

SEQ ID NO: 3625161 - RNA, 17 nt, Human
acaucuggcuuauuuua

SEQ ID NO: 3625162 - RNA, 15 nt, Human
acaucugugucuugu

SEQ ID NO: 3625163 - RNA, 16 nt, Human
acaucugugucuuguu

SEQ ID NO: 3625164 - RNA, 13 nt, Human
acaucuguuuugu

SEQ ID NO: 3625165 - RNA, 16 nt, Human
acaucuucagcaaaua

SEQ ID NO: 3625166 - RNA, 15 nt, Human
acaucuuccacaggu

SEQ ID NO: 3625167 - RNA, 23 nt, Human
acaucuuccacaggucucagaau

SEQ ID NO: 3625168 - RNA, 24 nt, Human
acaucuuccauuuccauguccccu

SEQ ID NO: 3625169 - RNA, 23 nt, Human
acaucuucccuagaggguuccug

SEQ ID NO: 3625170 - RNA, 13 nt, Human
acaucuugcucug

SEQ ID NO: 3625171 - RNA, 14 nt, Human
acaucuugcucugc

SEQ ID NO: 3625172 - RNA, 16 nt, Human
acaucuugcucugcug

SEQ ID NO: 3625173 - RNA, 13 nt, Human
acaucuuggcagg

SEQ ID NO: 3625174 - RNA, 23 nt, Human
acaucuugucauuuuuuuucuuu

SEQ ID NO: 3625175 - RNA, 11 nt, Human
acaucuuuaag

SEQ ID NO: 3625176 - RNA, 15 nt, Human
acaucuuucacacuu

SEQ ID NO: 3625177 - RNA, 14 nt, Human
acaucuuuccuguc

SEQ ID NO: 3625178 - RNA, 18 nt, Human
acaucuuucucuuuucua

SEQ ID NO: 3625179 - RNA, 14 nt, Human
acaucuuugaaauu

SEQ ID NO: 3625180 - RNA, 17 nt, Human
acaucuuugaaauuaug

SEQ ID NO: 3625181 - RNA, 22 nt, Human
acaucuuugaaauuauguaaau

SEQ ID NO: 3625182 - RNA, 24 nt, Human
acaucuuuucuugccucugucccc

SEQ ID NO: 3625183 - RNA, 19 nt, Human
acaucuuuuuaaagcuuau

SEQ ID NO: 3625184 - RNA, 15 nt, Human
acaucuuuuucacug

SEQ ID NO: 3625185 - RNA, 15 nt, Human
acaugaaaacacauu

SEQ ID NO: 3625186 - RNA, 15 nt, Human
acaugaaaauuuuaa

SEQ ID NO: 3625187 - RNA, 15 nt, Human
acaugaaacagaaac

SEQ ID NO: 3625188 - RNA, 23 nt, Human
acaugaaaccuacacacugucau

SEQ ID NO: 3625189 - RNA, 21 nt, Human
acaugaaaguagcagugugaa

SEQ ID NO: 3625190 - RNA, 14 nt, Human
acaugaacauacug

SEQ ID NO: 3625191 - RNA, 20 nt, Human
acaugaacuuagauuuuaca

SEQ ID NO: 3625192 - RNA, 13 nt, Human
acaugaagaaaua

SEQ ID NO: 3625193 - RNA, 13 nt, Human
acaugaagaccuu

SEQ ID NO: 3625194 - RNA, 15 nt, Human
acaugaagauucuuu

SEQ ID NO: 3625195 - RNA, 17 nt, Human
acaugaagauucuuucc

SEQ ID NO: 3625196 - RNA, 19 nt, Human
acaugaagcuguuguguga

SEQ ID NO: 3625197 - RNA, 12 nt, Human
acaugaaguauu

SEQ ID NO: 3625198 - RNA, 13 nt, Human
acaugaaguauuu

SEQ ID NO: 3625199 - RNA, 18 nt, Human
acaugaaucaaaagugcc

SEQ ID NO: 3625200 - RNA, 20 nt, Human
acaugaaucccacccacaug

SEQ ID NO: 3625201 - RNA, 23 nt, Human
acaugaaucccacccacauguga

SEQ ID NO: 3625202 - RNA, 17 nt, Human
acaugaauuauuacagu

SEQ ID NO: 3625203 - RNA, 21 nt, Human
acaugaauuauuacaguguuu

SEQ ID NO: 3625204 - RNA, 19 nt, Human
acaugaauuuuagcuuuug

SEQ ID NO: 3625205 - RNA, 15 nt, Human
acaugacacccguga

SEQ ID NO: 3625206 - RNA, 19 nt, Human
acaugacccuaaaucuuga

SEQ ID NO: 3625207 - RNA, 18 nt, Human
acaugacgacaaagcugc

SEQ ID NO: 3625208 - RNA, 17 nt, Human
acaugacucuuuauugu

SEQ ID NO: 3625209 - RNA, 19 nt, Human
acaugacucuuuauugucu

SEQ ID NO: 3625210 - RNA, 20 nt, Human
acaugacucuuuauugucug

SEQ ID NO: 3625211 - RNA, 22 nt, Human
acaugacucuuuauugucugua

SEQ ID NO: 3625212 - RNA, 14 nt, Human
acaugagauuuaua

SEQ ID NO: 3625213 - RNA, 18 nt, Human
acaugagcaucaggccag

SEQ ID NO: 3625214 - RNA, 20 nt, Human
acaugagcaucaggccaggc

SEQ ID NO: 3625215 - RNA, 23 nt, Human
acaugagcaucaggccaggcccu

SEQ ID NO: 3625216 - RNA, 14 nt, Human
acaugaggaacugu

SEQ ID NO: 3625217 - RNA, 22 nt, Human
acaugaggaacuguagaugaug

SEQ ID NO: 3625218 - RNA, 13 nt, Human
acaugaggacucu

SEQ ID NO: 3625219 - RNA, 20 nt, Human
acaugaggacucuauucuuu

SEQ ID NO: 3625220 - RNA, 15 nt, Human
acaugaggccacugg

SEQ ID NO: 3625221 - RNA, 22 nt, Human
acaugaguagauaauuucaggg

SEQ ID NO: 3625222 - RNA, 16 nt, Human
acaugaugauuucaga

SEQ ID NO: 3625223 - RNA, 12 nt, Human
acaugaugcuuu

SEQ ID NO: 3625224 - RNA, 14 nt, Human
acaugauguuaugu

SEQ ID NO: 3625225 - RNA, 13 nt, Human
acaugauuucaca

SEQ ID NO: 3625226 - RNA, 21 nt, Human
acaugauuucacaaauauuaa

SEQ ID NO: 3625227 - RNA, 16 nt, Human
acaugauuuccuugaa

SEQ ID NO: 3625228 - RNA, 14 nt, Human
acaugcaaaaagaa

SEQ ID NO: 3625229 - RNA, 16 nt, Human
aauggguaucuauauu

SEQ ID NO: 3625230 - RNA, 13 nt, Human
aaugguaaaauug

SEQ ID NO: 3625231 - RNA, 17 nt, Human
aaugguaaaauugcaug

SEQ ID NO: 3625232 - RNA, 14 nt, Human
aaugguaauaagca

SEQ ID NO: 3625233 - RNA, 14 nt, Human
aaugguagcauuuu

SEQ ID NO: 3625234 - RNA, 19 nt, Human
aaugguagcauuuuaaaca

SEQ ID NO: 3625235 - RNA, 19 nt, Human
aaugguagucuaaccaaau

SEQ ID NO: 3625236 - RNA, 14 nt, Human
aaugguaguuucug

SEQ ID NO: 3625237 - RNA, 22 nt, Human
aaugguauuugaauuaaauguu

SEQ ID NO: 3625238 - RNA, 16 nt, Human
aaugguccaggguuga

SEQ ID NO: 3625239 - RNA, 19 nt, Human
aauggucccauccaggcag

SEQ ID NO: 3625240 - RNA, 15 nt, Human
aauggucgcccagga

SEQ ID NO: 3625241 - RNA, 16 nt, Human
aauggucgcccaggag

SEQ ID NO: 3625242 - RNA, 18 nt, Human
aauggucuaaaaauaaac

SEQ ID NO: 3625243 - RNA, 22 nt, Human
aauggugaaaauaaaauaaagc

SEQ ID NO: 3625244 - RNA, 18 nt, Human
aauggugacuuaauccgu

SEQ ID NO: 3625245 - RNA, 10 nt, Human
aauggugccu

SEQ ID NO: 3625246 - RNA, 17 nt, Human
aaugguggcuucagcuc

SEQ ID NO: 3625247 - RNA, 20 nt, Human
aaugguggcuucagcuccag

SEQ ID NO: 3625248 - RNA, 16 nt, Human
aaugguguacauaaug

SEQ ID NO: 3625249 - RNA, 15 nt, Human
aaugguguagaacac

SEQ ID NO: 3625250 - RNA, 17 nt, Human
aaugguuauaaaaguga

SEQ ID NO: 3625251 - RNA, 15 nt, Human
aaugguucagaauua

SEQ ID NO: 3625252 - RNA, 17 nt, Human
aaugguugacuggguuu

SEQ ID NO: 3625253 - RNA, 15 nt, Human
aaugguugccuuaaa

SEQ ID NO: 3625254 - RNA, 15 nt, Human
aaugguuguauuaga

SEQ ID NO: 3625255 - RNA, 24 nt, Human
aaugguuguauuagauguucucua

SEQ ID NO: 3625256 - RNA, 17 nt, Human
aaugguuuaacuucugc

SEQ ID NO: 3625257 - RNA, 13 nt, Human
aaugguuucaaag

SEQ ID NO: 3625258 - RNA, 23 nt, Human
aaugguuugaauauaaacacuau

SEQ ID NO: 3625259 - RNA, 17 nt, Human
aaugguuugcaaggaag

SEQ ID NO: 3625260 - RNA, 23 nt, Human
aaugguuuggugcuuuuuauaaa

SEQ ID NO: 3625261 - RNA, 16 nt, Human
aaugguuuucaaaaua

SEQ ID NO: 3625262 - RNA, 18 nt, Human
aaugguuuucuugugugu

SEQ ID NO: 3625263 - RNA, 16 nt, Human
aaugguuuuuaaauuu

SEQ ID NO: 3625264 - RNA, 17 nt, Human
aauguaaaaaagaaaaa

SEQ ID NO: 3625265 - RNA, 14 nt, Human
aauguaaacugcca

SEQ ID NO: 3625266 - RNA, 21 nt, Human
aauguaaacuguuucuuuaaa

SEQ ID NO: 3625267 - RNA, 15 nt, Human
aauguaaagccaugc

SEQ ID NO: 3625268 - RNA, 20 nt, Human
aauguaaaggagucaaaacu

SEQ ID NO: 3625269 - RNA, 19 nt, Human
aauguaaaggucacuuuuc

SEQ ID NO: 3625270 - RNA, 12 nt, Human
aauguaaauaaa

SEQ ID NO: 3625271 - RNA, 20 nt, Human
aauguaaauauuuuaaagaa

SEQ ID NO: 3625272 - RNA, 15 nt, Human
aauguaaaugucuca

SEQ ID NO: 3625273 - RNA, 24 nt, Human
aauguaaaugucucacugagcacu

SEQ ID NO: 3625274 - RNA, 13 nt, Human
aauguaaauuugu

SEQ ID NO: 3625275 - RNA, 16 nt, Human
aauguaacugcucuug

SEQ ID NO: 3625276 - RNA, 13 nt, Human
aauguaacuguua

SEQ ID NO: 3625277 - RNA, 13 nt, Human
aauguaacuuacu

SEQ ID NO: 3625278 - RNA, 14 nt, Human
aauguaagcuguuu

SEQ ID NO: 3625279 - RNA, 16 nt, Human
aauguaagcuguuuau

SEQ ID NO: 3625280 - RNA, 17 nt, Human
aauguaaguaaaugucu

SEQ ID NO: 3625281 - RNA, 13 nt, Human
aauguaaugcgau

SEQ ID NO: 3625282 - RNA, 21 nt, Human
aauguaauugauuguauauag

SEQ ID NO: 3625283 - RNA, 13 nt, Human
aauguaauuguaa

SEQ ID NO: 3625284 - RNA, 15 nt, Human
aauguaauuguaauu

SEQ ID NO: 3625285 - RNA, 18 nt, Human
accacaaaaaaauaccuc

SEQ ID NO: 3625286 - RNA, 22 nt, Human
accacaaacuguaauacaauga

SEQ ID NO: 3625287 - RNA, 19 nt, Human
accacaacugacacaggaa

SEQ ID NO: 3625288 - RNA, 21 nt, Human
accacaaggcuguugcauggg

SEQ ID NO: 3625289 - RNA, 17 nt, Human
accacaaugcagugccu

SEQ ID NO: 3625290 - RNA, 14 nt, Human
accacacacaacag

SEQ ID NO: 3625291 - RNA, 15 nt, Human
accacacacaacagc

SEQ ID NO: 3625292 - RNA, 17 nt, Human
accacacaucccagccc

SEQ ID NO: 3625293 - RNA, 18 nt, Human
accacacaucccagccca

SEQ ID NO: 3625294 - RNA, 19 nt, Human
accacacaucccagcccaa

SEQ ID NO: 3625295 - RNA, 15 nt, Human
accacacaucuauga

SEQ ID NO: 3625296 - RNA, 15 nt, Human
accacaccaaaccuc

SEQ ID NO: 3625297 - RNA, 16 nt, Human
accacacccagcccac

SEQ ID NO: 3625298 - RNA, 20 nt, Human
accacacccagcccacuucu

SEQ ID NO: 3625299 - RNA, 14 nt, Human
accacacccagccu

SEQ ID NO: 3625300 - RNA, 15 nt, Human
accacacccagccuc

SEQ ID NO: 3625301 - RNA, 22 nt, Human
accacacccagccucaguccuc

SEQ ID NO: 3625302 - RNA, 22 nt, Human
accacacuuccuguccagagag

SEQ ID NO: 3625303 - RNA, 16 nt, Human
accacagacacacaca

SEQ ID NO: 3625304 - RNA, 21 nt, Human
accacagacauacuaaccagc

SEQ ID NO: 3625305 - RNA, 22 nt, Human
accacagacauacuaaccagca

SEQ ID NO: 3625306 - RNA, 12 nt, Human
accacagacuuu

SEQ ID NO: 3625307 - RNA, 23 nt, Human
accacagacuuuagcuuucugag

SEQ ID NO: 3625308 - RNA, 10 nt, Human
accacagcaa

SEQ ID NO: 3625309 - RNA, 18 nt, Human
accacagcaaggcaccug

SEQ ID NO: 3625310 - RNA, 15 nt, Human
accacagcacagcca

SEQ ID NO: 3625311 - RNA, 17 nt, Human
accacagcaggugucau

SEQ ID NO: 3625312 - RNA, 11 nt, Human
accacagcagu

SEQ ID NO: 3625313 - RNA, 16 nt, Human
accacagcaucauuuu

SEQ ID NO: 3625314 - RNA, 19 nt, Human
accacagccagcaccuggc

SEQ ID NO: 3625315 - RNA, 17 nt, Human
accacagcuccuuuucc

SEQ ID NO: 3625316 - RNA, 21 nt, Human
accacagcuccuuuuccagag

SEQ ID NO: 3625317 - RNA, 13 nt, Human
accacagcugcug

SEQ ID NO: 3625318 - RNA, 14 nt, Human
accacagcugcugg

SEQ ID NO: 3625319 - RNA, 15 nt, Human
accacagcugcugga

SEQ ID NO: 3625320 - RNA, 21 nt, Human
accacaggcccuuuccucagg

SEQ ID NO: 3625321 - RNA, 16 nt, Human
accacaggcucaggca

SEQ ID NO: 3625322 - RNA, 17 nt, Human
accacaggguucaaaau

SEQ ID NO: 3625323 - RNA, 16 nt, Human
accacaggugugagcc

SEQ ID NO: 3625324 - RNA, 22 nt, Human
accacaguguaccauuaaaaua

SEQ ID NO: 3625325 - RNA, 13 nt, Human
accacagugucug

SEQ ID NO: 3625326 - RNA, 18 nt, Human
accacaucuugcucugcu

SEQ ID NO: 3625327 - RNA, 24 nt, Human
accacaucuugcucugcugacaga

SEQ ID NO: 3625328 - RNA, 22 nt, Human
accacaugccccaucccaugcu

SEQ ID NO: 3625329 - RNA, 23 nt, Human
accacaugccccaucccaugcug

SEQ ID NO: 3625330 - RNA, 13 nt, Human
accacauugcuuu

SEQ ID NO: 3625331 - RNA, 15 nt, Human
accacauugcuuuuc

SEQ ID NO: 3625332 - RNA, 19 nt, Human
accacauuuuauauuuauu

SEQ ID NO: 3625333 - RNA, 19 nt, Human
accaccaagccuugauugg

SEQ ID NO: 3625334 - RNA, 15 nt, Human
accaccacacccagc

SEQ ID NO: 3625335 - RNA, 16 nt, Human
accaccaccccuacca

SEQ ID NO: 3625336 - RNA, 16 nt, Human
accaccacgccuggcu

SEQ ID NO: 3625337 - RNA, 16 nt, Human
accaccacuggccacc

SEQ ID NO: 3625338 - RNA, 17 nt, Human
accaccagcugugucca

SEQ ID NO: 3625339 - RNA, 17 nt, Human
accaccaggucucccgg

SEQ ID NO: 3625340 - RNA, 15 nt, Human
accacccauaucaug

SEQ ID NO: 3625341 - RNA, 13 nt, Human
accaccccugccu

SEQ ID NO: 3625342 - RNA, 14 nt, Human
accaccccugccuc

SEQ ID NO: 3625343 - RNA, 15 nt, Human
accaccccuuccugu

SEQ ID NO: 3625344 - RNA, 16 nt, Human
accacccgguccccac

SEQ ID NO: 3625345 - RNA, 17 nt, Human
accacccgguccccacu

SEQ ID NO: 3625346 - RNA, 21 nt, Human
accacccuagucccuuccccu

SEQ ID NO: 3625347 - RNA, 18 nt, Human
accacccuccccucucuu

SEQ ID NO: 3625348 - RNA, 12 nt, Human
accacccuccuu

SEQ ID NO: 3625349 - RNA, 13 nt, Human
accacccugagcc

SEQ ID NO: 3625350 - RNA, 21 nt, Human
accacccugagccggccccag

SEQ ID NO: 3625351 - RNA, 16 nt, Human
accaccgcccgucugu

SEQ ID NO: 3625352 - RNA, 13 nt, Human
accaccgcucccc

SEQ ID NO: 3625353 - RNA, 17 nt, Human
accaccgcuccccagcc

SEQ ID NO: 3625354 - RNA, 19 nt, Human
accaccuaccuuacaguga

SEQ ID NO: 3625355 - RNA, 16 nt, Human
accaccuaggccacuc

SEQ ID NO: 3625356 - RNA, 12 nt, Human
accaccucugug

SEQ ID NO: 3625357 - RNA, 13 nt, Human
accaccucugugg

SEQ ID NO: 3625358 - RNA, 14 nt, Human
accaccucuguggc

SEQ ID NO: 3625359 - RNA, 15 nt, Human
accaccucuguggca

SEQ ID NO: 3625360 - RNA, 17 nt, Human
accaccuucccagcucu

SEQ ID NO: 3625361 - RNA, 22 nt, Human
accaccuuuguuucucccccau

SEQ ID NO: 3625362 - RNA, 17 nt, Human
accaccuuuuauuacau

SEQ ID NO: 3625363 - RNA, 19 nt, Human
accacgacuggccagggcc

SEQ ID NO: 3625364 - RNA, 18 nt, Human
accacgauguggcccugg

SEQ ID NO: 3625365 - RNA, 21 nt, Human
accacgcccguccugccugug

SEQ ID NO: 3625366 - RNA, 16 nt, Human
accacgcuggaccuug

SEQ ID NO: 3625367 - RNA, 16 nt, Human
accacgcuggggucug

SEQ ID NO: 3625368 - RNA, 19 nt, Human
accacgggcccggguuggg

SEQ ID NO: 3625369 - RNA, 14 nt, Human
accacguuucuaaa

SEQ ID NO: 3625370 - RNA, 15 nt, Human
accacguuucuaaag

SEQ ID NO: 3625371 - RNA, 23 nt, Human
accacuaaaagaucgcaguuugc

SEQ ID NO: 3625372 - RNA, 16 nt, Human
accacuaacuccugag

SEQ ID NO: 3625373 - RNA, 17 nt, Human
accacuacauucuguua

SEQ ID NO: 3625374 - RNA, 12 nt, Human
accacucagaga

SEQ ID NO: 3625375 - RNA, 13 nt, Human
accacucagagac

SEQ ID NO: 3625376 - RNA, 20 nt, Human
accacucagagacaugcaga

SEQ ID NO: 3625377 - RNA, 18 nt, Human
accacucagccccuagga

SEQ ID NO: 3625378 - RNA, 14 nt, Human
accacucgugcauc

SEQ ID NO: 3625379 - RNA, 20 nt, Human
accacucuaucaaguauuau

SEQ ID NO: 3625380 - RNA, 12 nt, Human
accacucuggca

SEQ ID NO: 3625381 - RNA, 14 nt, Human
accacucuggcagc

SEQ ID NO: 3625382 - RNA, 16 nt, Human
accacucuggcagcca

SEQ ID NO: 3625383 - RNA, 17 nt, Human
accacucuggcagccac

SEQ ID NO: 3625384 - RNA, 14 nt, Human
accacucuguaauu

SEQ ID NO: 3625385 - RNA, 21 nt, Human
accacugaagauagaagaaaa

SEQ ID NO: 3625386 - RNA, 14 nt, Human
accacugaaucugu

SEQ ID NO: 3625387 - RNA, 17 nt, Human
accacugcacuccagcc

SEQ ID NO: 3625388 - RNA, 20 nt, Human
accacugcacuccagccugg

SEQ ID NO: 3625389 - RNA, 13 nt, Human
accacugcagaag

SEQ ID NO: 3625390 - RNA, 14 nt, Human
accacugcagaaga

SEQ ID NO: 3625391 - RNA, 17 nt, Human
accacugcucugaugaa

SEQ ID NO: 3625392 - RNA, 23 nt, Human
accacugcucugaugaagaggag

SEQ ID NO: 3625393 - RNA, 18 nt, Human
accacuggccaccaggcu

SEQ ID NO: 3625394 - RNA, 20 nt, Human
accacuguaaaaugaaauua

SEQ ID NO: 3625395 - RNA, 19 nt, Human
accacuguuucuugcuugu

SEQ ID NO: 3625396 - RNA, 23 nt, Human
accacuguuucuugcuuguaccu

SEQ ID NO: 3625397 - RNA, 17 nt, Human
accacuucacugaaaga

SEQ ID NO: 3625398 - RNA, 13 nt, Human
accacuucagcug

SEQ ID NO: 3625399 - RNA, 15 nt, Human
accacuucagggcuu

SEQ ID NO: 3625400 - RNA, 17 nt, Human
accacuucauucuugaa

SEQ ID NO: 3625401 - RNA, 23 nt, Human
accacuuccaggggaaccugcca

SEQ ID NO: 3625402 - RNA, 16 nt, Human
accacuucuuuuauaa

SEQ ID NO: 3625403 - RNA, 13 nt, Human
accacuugcugca

SEQ ID NO: 3625404 - RNA, 18 nt, Human
accacuuguguuuugcaa

SEQ ID NO: 3625405 - RNA, 19 nt, Human
accacuuguguuuugcaag

SEQ ID NO: 3625406 - RNA, 15 nt, Human
accacuuucuuauuu

SEQ ID NO: 3625407 - RNA, 15 nt, Human
accacuuuuguucuu

SEQ ID NO: 3625408 - RNA, 13 nt, Human
accacuuuuugca

SEQ ID NO: 3625409 - RNA, 20 nt, Human
accacuuuuugcagcuuucu

SEQ ID NO: 3625410 - RNA, 16 nt, Human
accagaaaucaaaaag

SEQ ID NO: 3625411 - RNA, 13 nt, Human
accagaagcccag

SEQ ID NO: 3625412 - RNA, 14 nt, Human
accagaagcccaga

SEQ ID NO: 3625413 - RNA, 17 nt, Human
accagaagcucccccag

SEQ ID NO: 3625414 - RNA, 20 nt, Human
accagaagcucccccagcaa

SEQ ID NO: 3625415 - RNA, 17 nt, Human
accagaauugugcaaau

SEQ ID NO: 3625416 - RNA, 16 nt, Human
accagacaaggaaaua

SEQ ID NO: 3625417 - RNA, 14 nt, Human
accagacacccagg

SEQ ID NO: 3625418 - RNA, 15 nt, Human
accagacacccagga

SEQ ID NO: 3625419 - RNA, 22 nt, Human
accagaccuggaagaacaggcc

SEQ ID NO: 3625420 - RNA, 23 nt, Human
accagaccuggaagaacaggccu

SEQ ID NO: 3625421 - RNA, 16 nt, Human
accagacggggcugga

SEQ ID NO: 3625422 - RNA, 21 nt, Human
accagacggggcuggagugug

SEQ ID NO: 3625423 - RNA, 19 nt, Human
accagacgguucaccagcc

SEQ ID NO: 3625424 - RNA, 23 nt, Human
accagacuacuugggagcaccgc

SEQ ID NO: 3625425 - RNA, 16 nt, Human
accagacucgccaaca

SEQ ID NO: 3625426 - RNA, 17 nt, Human
accagacucgccaacau

SEQ ID NO: 3625427 - RNA, 20 nt, Human
accagacucgccaacauggu

SEQ ID NO: 3625428 - RNA, 13 nt, Human
accagacugcagg

SEQ ID NO: 3625429 - RNA, 13 nt, Human
accagacugugga

SEQ ID NO: 3625430 - RNA, 21 nt, Human
accagacuguggagaaauaaa

SEQ ID NO: 3625431 - RNA, 16 nt, Human
aauucugcuaccucac

SEQ ID NO: 3625432 - RNA, 12 nt, Human
aauucuguacau

SEQ ID NO: 3625433 - RNA, 17 nt, Human
aauucuguacauagccu

SEQ ID NO: 3625434 - RNA, 21 nt, Human
aauucuguacauagccuauau

SEQ ID NO: 3625435 - RNA, 22 nt, Human
aauucuguacugauuuuuguaa

SEQ ID NO: 3625436 - RNA, 16 nt, Human
aauucugugccuuguu

SEQ ID NO: 3625437 - RNA, 16 nt, Human
aauucuguucauuugu

SEQ ID NO: 3625438 - RNA, 16 nt, Human
acaguuuucugagaaa

SEQ ID NO: 3625439 - RNA, 20 nt, Human
acaguuuucugagaaagacu

SEQ ID NO: 3625440 - RNA, 21 nt, Human
acaguuuucuggcuggagccu

SEQ ID NO: 3625441 - RNA, 18 nt, Human
acaguuuugguugcuuua

SEQ ID NO: 3625442 - RNA, 24 nt, Human
acaguuuugguugcuuuaauauca

SEQ ID NO: 3625443 - RNA, 12 nt, Human
acaguuuuuaaa

SEQ ID NO: 3625444 - RNA, 15 nt, Human
acaguuuuuauugcu

SEQ ID NO: 3625445 - RNA, 16 nt, Human
acauaaaaacaacuuu

SEQ ID NO: 3625446 - RNA, 22 nt, Human
acauaaaaaggacaucagcaaa

SEQ ID NO: 3625447 - RNA, 17 nt, Human
acauaaaaaguuaaaaa

SEQ ID NO: 3625448 - RNA, 11 nt, Human
acauaaaacaa

SEQ ID NO: 3625449 - RNA, 14 nt, Human
acauaaaagaauuu

SEQ ID NO: 3625450 - RNA, 13 nt, Human
acauaaacaauga

SEQ ID NO: 3625451 - RNA, 16 nt, Human
acauaaaccauuuuug

SEQ ID NO: 3625452 - RNA, 17 nt, Human
acauaaaggaaaagaca

SEQ ID NO: 3625453 - RNA, 18 nt, Human
acauaaaggaaaagacac

SEQ ID NO: 3625454 - RNA, 19 nt, Human
acauaaauaaaaugaccag

SEQ ID NO: 3625455 - RNA, 11 nt, Human
acauaaaugca

SEQ ID NO: 3625456 - RNA, 13 nt, Human
acauaacagaaug

SEQ ID NO: 3625457 - RNA, 18 nt, Human
acauaacagaaugcacca

SEQ ID NO: 3625458 - RNA, 20 nt, Human
acauaacaggguaaauuauu

SEQ ID NO: 3625459 - RNA, 22 nt, Human
acauaacaggguaaauuauuca

SEQ ID NO: 3625460 - RNA, 15 nt, Human
acauaacguuuuucc

SEQ ID NO: 3625461 - RNA, 16 nt, Human
acauaacguuuuuccu

SEQ ID NO: 3625462 - RNA, 18 nt, Human
acauaacuaaauuugaua

SEQ ID NO: 3625463 - RNA, 15 nt, Human
acauaacugccuuga

SEQ ID NO: 3625464 - RNA, 14 nt, Human
acauaagaccauaa

SEQ ID NO: 3625465 - RNA, 16 nt, Human
acauaagauaaaugug

SEQ ID NO: 3625466 - RNA, 23 nt, Human
acauaagaucacugccagagaua

SEQ ID NO: 3625467 - RNA, 19 nt, Human
acauaagggguuugccauu

SEQ ID NO: 3625468 - RNA, 17 nt, Human
acauaauaaaaaauuau

SEQ ID NO: 3625469 - RNA, 23 nt, Human
acauaauaaaaaauuaugacaau

SEQ ID NO: 3625470 - RNA, 21 nt, Human
acauaauacacuugcccugcu

SEQ ID NO: 3625471 - RNA, 22 nt, Human
acauaaucuaguuuacagaaaa

SEQ ID NO: 3625472 - RNA, 19 nt, Human
acauaaugaaaauauuuuu

SEQ ID NO: 3625473 - RNA, 21 nt, Human
acauaaugcgugcauaccacu

SEQ ID NO: 3625474 - RNA, 22 nt, Human
acauaaugcgugcauaccacuu

SEQ ID NO: 3625475 - RNA, 19 nt, Human
acauaaugcuuaauuucua

SEQ ID NO: 3625476 - RNA, 20 nt, Human
acauaaugggccacugaaau

SEQ ID NO: 3625477 - RNA, 19 nt, Human
acauaauuaaauuuugagu

SEQ ID NO: 3625478 - RNA, 21 nt, Human
acauaauuaacacuuaagguu

SEQ ID NO: 3625479 - RNA, 23 nt, Human
acauaauuauccaggaagggaau

SEQ ID NO: 3625480 - RNA, 20 nt, Human
acauaauucaggaagcagcu

SEQ ID NO: 3625481 - RNA, 21 nt, Human
acauaauuuaguuucauauaa

SEQ ID NO: 3625482 - RNA, 12 nt, Human
acauaauuuuuu

SEQ ID NO: 3625483 - RNA, 21 nt, Human
acauaauuuuuuuuuuuuaac

SEQ ID NO: 3625484 - RNA, 17 nt, Human
acauacaacacaaagag

SEQ ID NO: 3625485 - RNA, 16 nt, Human
acauacaauuauuuuu

SEQ ID NO: 3625486 - RNA, 21 nt, Human
acauacaccuaugucauuuca

SEQ ID NO: 3625487 - RNA, 16 nt, Human
acauacacuuguauaa

SEQ ID NO: 3625488 - RNA, 19 nt, Human
acauacacuuguauaaaug

SEQ ID NO: 3625489 - RNA, 23 nt, Human
acauacaggaagguagaaauauc

SEQ ID NO: 3625490 - RNA, 20 nt, Human
acauacaguuuuaugcucuu

SEQ ID NO: 3625491 - RNA, 15 nt, Human
acauacaugucacau

SEQ ID NO: 3625492 - RNA, 20 nt, Human
acauacccccucccccaccg

SEQ ID NO: 3625493 - RNA, 20 nt, Human
acauacccuggccgcccccu

SEQ ID NO: 3625494 - RNA, 16 nt, Human
acauaccuuuuauuuu

SEQ ID NO: 3625495 - RNA, 15 nt, Human
acauacgcuuuuaau

SEQ ID NO: 3625496 - RNA, 21 nt, Human
acauacgugugcaugugucuu

SEQ ID NO: 3625497 - RNA, 13 nt, Human
acauacucauuuu

SEQ ID NO: 3625498 - RNA, 14 nt, Human
acauacucugcuua

SEQ ID NO: 3625499 - RNA, 19 nt, Human
acauacuggccuggacugu

SEQ ID NO: 3625500 - RNA, 16 nt, Human
acauacuugaagggcc

SEQ ID NO: 3625501 - RNA, 17 nt, Human
acauacuugaagggcca

SEQ ID NO: 3625502 - RNA, 18 nt, Human
acauacuugaagggccag

SEQ ID NO: 3625503 - RNA, 19 nt, Human
acauacuugaagggccaga

SEQ ID NO: 3625504 - RNA, 21 nt, Human
acauacuugaagggccagagc

SEQ ID NO: 3625505 - RNA, 22 nt, Human
acauacuugaagggccagagcc

SEQ ID NO: 3625506 - RNA, 11 nt, Human
acauacuuuuu

SEQ ID NO: 3625507 - RNA, 16 nt, Human
acauagaaauugccug

SEQ ID NO: 3625508 - RNA, 22 nt, Human
acauagagaucauccuuuccag

SEQ ID NO: 3625509 - RNA, 14 nt, Human
acauagagguauau

SEQ ID NO: 3625510 - RNA, 16 nt, Human
acauagagguauauug

SEQ ID NO: 3625511 - RNA, 18 nt, Human
acauagagguauauugga

SEQ ID NO: 3625512 - RNA, 20 nt, Human
acauagagguauauuggaag

SEQ ID NO: 3625513 - RNA, 18 nt, Human
acauagauauuuucacaa

SEQ ID NO: 3625514 - RNA, 20 nt, Human
acauagauucaccuguaaaa

SEQ ID NO: 3625515 - RNA, 22 nt, Human
acauagauucaccuguaaaacu

SEQ ID NO: 3625516 - RNA, 22 nt, Human
acauagauuuauuuuucaguuc

SEQ ID NO: 3625517 - RNA, 20 nt, Human
acauagcauccaaguggcau

SEQ ID NO: 3625518 - RNA, 16 nt, Human
acauagcaugacauuu

SEQ ID NO: 3625519 - RNA, 21 nt, Human
acauagcaugacauuucuuug

SEQ ID NO: 3625520 - RNA, 16 nt, Human
acauagccaaaaugug

SEQ ID NO: 3625521 - RNA, 22 nt, Human
acauagcccaucccugccuggu

SEQ ID NO: 3625522 - RNA, 13 nt, Human
acauagccuauau

SEQ ID NO: 3625523 - RNA, 20 nt, Human
acauagccuauauuuacagu

SEQ ID NO: 3625524 - RNA, 19 nt, Human
acauagcuaucaagugugc

SEQ ID NO: 3625525 - RNA, 14 nt, Human
acauagcugugauu

SEQ ID NO: 3625526 - RNA, 16 nt, Human
acauaggacucaaagu

SEQ ID NO: 3625527 - RNA, 13 nt, Human
acauagugaaaau

SEQ ID NO: 3625528 - RNA, 22 nt, Human
acauagugcauuguuucugugg

SEQ ID NO: 3625529 - RNA, 12 nt, Human
acauaguguaau

SEQ ID NO: 3625530 - RNA, 17 nt, Human
acauaguucguuuaccu

SEQ ID NO: 3625531 - RNA, 17 nt, Human
acauaguuuuaaacuca

SEQ ID NO: 3625532 - RNA, 20 nt, Human
acauaguuuuaaacucauuu

SEQ ID NO: 3625533 - RNA, 21 nt, Human
acauaguuuuaaacucauuuu

SEQ ID NO: 3625534 - RNA, 22 nt, Human
acauauaaaauaaugcaaagaa

SEQ ID NO: 3625535 - RNA, 21 nt, Human
acauauaaagcacuauacaga

SEQ ID NO: 3625536 - RNA, 22 nt, Human
acauauaaauugucuuaaugga

SEQ ID NO: 3625537 - RNA, 16 nt, Human
acauauaauauauguu

SEQ ID NO: 3625538 - RNA, 23 nt, Human
acauauaauguuguuauuuaaag

SEQ ID NO: 3625539 - RNA, 14 nt, Human
acauauacacacac

SEQ ID NO: 3625540 - RNA, 13 nt, Human
acauauacauacu

SEQ ID NO: 3625541 - RNA, 19 nt, Human
acauauaccuauaaugugu

SEQ ID NO: 3625542 - RNA, 21 nt, Human
acauauaccuauaaugugugu

SEQ ID NO: 3625543 - RNA, 22 nt, Human
acauauaccuauaaugugugua

SEQ ID NO: 3625544 - RNA, 19 nt, Human
acauauauaacaaugcugu

SEQ ID NO: 3625545 - RNA, 15 nt, Human
acauauauacacaca

SEQ ID NO: 3625546 - RNA, 17 nt, Human
acauauauauauauaac

SEQ ID NO: 3625547 - RNA, 14 nt, Human
acauauauauuaca

SEQ ID NO: 3625548 - RNA, 16 nt, Human
acauaucaucugugga

SEQ ID NO: 3625549 - RNA, 23 nt, Human
acauaucuaguaugaaauuauau

SEQ ID NO: 3625550 - RNA, 19 nt, Human
acauaucucuuaucuuacg

SEQ ID NO: 3625551 - RNA, 16 nt, Human
acauaucuuuauuaau

SEQ ID NO: 3625552 - RNA, 15 nt, Human
acauaugaaaauaca

SEQ ID NO: 3625553 - RNA, 14 nt, Human
acauaugaggggga

SEQ ID NO: 3625554 - RNA, 15 nt, Human
acauaugauuucacu

SEQ ID NO: 3625555 - RNA, 22 nt, Human
acauaugauuucacuagaaaag

SEQ ID NO: 3625556 - RNA, 23 nt, Human
acauauggacucugcacaugaau

SEQ ID NO: 3625557 - RNA, 23 nt, Human
acauauggucuccauuuuacagu

SEQ ID NO: 3625558 - RNA, 17 nt, Human
acauauguagacuauau

SEQ ID NO: 3625559 - RNA, 20 nt, Human
acauauguagacuauauaca

SEQ ID NO: 3625560 - RNA, 21 nt, Human
acauauuagugcagccaagua

SEQ ID NO: 3625561 - RNA, 14 nt, Human
acauauuaugucuu

SEQ ID NO: 3625562 - RNA, 22 nt, Human
acauauugauuuccguuaaaau

SEQ ID NO: 3625563 - RNA, 14 nt, Human
acauauuuaacugg

SEQ ID NO: 3625564 - RNA, 15 nt, Human
acauauuuaacuggu

SEQ ID NO: 3625565 - RNA, 16 nt, Human
acauauuuaauguuuu

SEQ ID NO: 3625566 - RNA, 20 nt, Human
acauauuuaauguuuuaaau

SEQ ID NO: 3625567 - RNA, 21 nt, Human
acauauuuaauguuuuaaaug

SEQ ID NO: 3625568 - RNA, 19 nt, Human
acauauuuguggaauaaug

SEQ ID NO: 3625569 - RNA, 14 nt, Human
acauauuuuaaaau

SEQ ID NO: 3625570 - RNA, 18 nt, Human
acaucaacccgagucauu

SEQ ID NO: 3625571 - RNA, 14 nt, Human
acaucaagcacaga

SEQ ID NO: 3625572 - RNA, 18 nt, Human
acaucaagcacagaagga

SEQ ID NO: 3625573 - RNA, 23 nt, Human
acaucaauauugucauuccugua

SEQ ID NO: 3625574 - RNA, 16 nt, Human
accagugaaccaaaga

SEQ ID NO: 3625575 - RNA, 13 nt, Human
accagugaauuuu

SEQ ID NO: 3625576 - RNA, 17 nt, Human
accagugaauuuuugca

SEQ ID NO: 3625577 - RNA, 21 nt, Human
accagugaauuuuugcaauaa

SEQ ID NO: 3625578 - RNA, 12 nt, Human
accagugacuuu

SEQ ID NO: 3625579 - RNA, 14 nt, Human
accagugagcgcuu

SEQ ID NO: 3625580 - RNA, 18 nt, Human
accagugcaacagcacug

SEQ ID NO: 3625581 - RNA, 16 nt, Human
accagugcaggcuggc

SEQ ID NO: 3625582 - RNA, 19 nt, Human
accagugcaggcuggccag

SEQ ID NO: 3625583 - RNA, 13 nt, Human
accagugccaagg

SEQ ID NO: 3625584 - RNA, 15 nt, Human
accagugccaaggac

SEQ ID NO: 3625585 - RNA, 10 nt, Human
accagugccu

SEQ ID NO: 3625586 - RNA, 18 nt, Human
accagugccucucccugc

SEQ ID NO: 3625587 - RNA, 22 nt, Human
accagugccucucccugcugcu

SEQ ID NO: 3625588 - RNA, 18 nt, Human
accagugcgauucuggau

SEQ ID NO: 3625589 - RNA, 21 nt, Human
accaguggcguuguugcaugu

SEQ ID NO: 3625590 - RNA, 16 nt, Human
accaguguagccuugc

SEQ ID NO: 3625591 - RNA, 18 nt, Human
accaguguccccuccacu

SEQ ID NO: 3625592 - RNA, 21 nt, Human
accagugugguuuguguuuga

SEQ ID NO: 3625593 - RNA, 23 nt, Human
accaguguguggcuuucagagcc

SEQ ID NO: 3625594 - RNA, 17 nt, Human
accaguguuguggauuu

SEQ ID NO: 3625595 - RNA, 21 nt, Human
accaguguuguggauuuaaca

SEQ ID NO: 3625596 - RNA, 16 nt, Human
accaguucucaugggu

SEQ ID NO: 3625597 - RNA, 12 nt, Human
acaugcauuuga

SEQ ID NO: 3625598 - RNA, 17 nt, Human
acaugcauuugagguca

SEQ ID NO: 3625599 - RNA, 14 nt, Human
acaugccaagcacu

SEQ ID NO: 3625600 - RNA, 15 nt, Human
acaugccaggggccu

SEQ ID NO: 3625601 - RNA, 14 nt, Human
acaugcccucccuu

SEQ ID NO: 3625602 - RNA, 19 nt, Human
acaugcccucccuucuccc

SEQ ID NO: 3625603 - RNA, 22 nt, Human
acaugcccucccuucucccugg

SEQ ID NO: 3625604 - RNA, 18 nt, Human
acaugccuaccaauauuu

SEQ ID NO: 3625605 - RNA, 22 nt, Human
acaugccuauaugagaagaaua

SEQ ID NO: 3625606 - RNA, 13 nt, Human
acaugccucucuc

SEQ ID NO: 3625607 - RNA, 15 nt, Human
acaugccucucucag

SEQ ID NO: 3625608 - RNA, 18 nt, Human
acaugccucucucaggcc

SEQ ID NO: 3625609 - RNA, 15 nt, Human
acaugccugccccaa

SEQ ID NO: 3625610 - RNA, 14 nt, Human
acaugcgggcuggg

SEQ ID NO: 3625611 - RNA, 24 nt, Human
acaugcuaagagaaguagaaauca

SEQ ID NO: 3625612 - RNA, 19 nt, Human
acaugcucuuagaaaauuc

SEQ ID NO: 3625613 - RNA, 14 nt, Human
acaugcugaagcca

SEQ ID NO: 3625614 - RNA, 21 nt, Human
acaugcugagucucccaaggc

SEQ ID NO: 3625615 - RNA, 19 nt, Human
acaugcuuagcaguccccu

SEQ ID NO: 3625616 - RNA, 23 nt, Human
acaugcuuagcaguccccuuccc

SEQ ID NO: 3625617 - RNA, 22 nt, Human
acaugcuuauuccaugacugcu

SEQ ID NO: 3625618 - RNA, 15 nt, Human
acaugcuucaauagu

SEQ ID NO: 3625619 - RNA, 23 nt, Human
acaugcuucaauaguucaaggaa

SEQ ID NO: 3625620 - RNA, 20 nt, Human
acaugcuucaugaaaauccu

SEQ ID NO: 3625621 - RNA, 16 nt, Human
acaugcuucccuuucc

SEQ ID NO: 3625622 - RNA, 22 nt, Human
acaugcuuguugacagagagag

SEQ ID NO: 3625623 - RNA, 15 nt, Human
acauggaaacccaua

SEQ ID NO: 3625624 - RNA, 12 nt, Human
acauggaacagu

SEQ ID NO: 3625625 - RNA, 17 nt, Human
acauggaacucauuccu

SEQ ID NO: 3625626 - RNA, 20 nt, Human
acauggaauaacauguaauu

SEQ ID NO: 3625627 - RNA, 15 nt, Human
acauggacagaauuu

SEQ ID NO: 3625628 - RNA, 12 nt, Human
acauggacccgg

SEQ ID NO: 3625629 - RNA, 13 nt, Human
acauggacuugua

SEQ ID NO: 3625630 - RNA, 21 nt, Human
acauggagacuccugcccugu

SEQ ID NO: 3625631 - RNA, 14 nt, Human
acauggagguucua

SEQ ID NO: 3625632 - RNA, 17 nt, Human
acauggagguucuaagg

SEQ ID NO: 3625633 - RNA, 15 nt, Human
acauggccaguguga

SEQ ID NO: 3625634 - RNA, 22 nt, Human
acauggccccucccccugccag

SEQ ID NO: 3625635 - RNA, 23 nt, Human
acauggcucuggacucuaaagac

SEQ ID NO: 3625636 - RNA, 14 nt, Human
acauggcuuaguuu

SEQ ID NO: 3625637 - RNA, 19 nt, Human
acauggcuuaguuuucaua

SEQ ID NO: 3625638 - RNA, 20 nt, Human
acauggcuugccacagcucu

SEQ ID NO: 3625639 - RNA, 18 nt, Human
acauggcuuucagaaaac

SEQ ID NO: 3625640 - RNA, 20 nt, Human
acaugggacauuugcucaug

SEQ ID NO: 3625641 - RNA, 20 nt, Human
acaugggacuaugcuuuucu

SEQ ID NO: 3625642 - RNA, 13 nt, Human
acaugggaguuua

SEQ ID NO: 3625643 - RNA, 16 nt, Human
acauggggaggaagga

SEQ ID NO: 3625644 - RNA, 13 nt, Human
acauggggaggag

SEQ ID NO: 3625645 - RNA, 21 nt, Human
acaugggguuggcugggccca

SEQ ID NO: 3625646 - RNA, 18 nt, Human
acaugggguuuucaauuu

SEQ ID NO: 3625647 - RNA, 21 nt, Human
acaugguaaacgcugucccua

SEQ ID NO: 3625648 - RNA, 14 nt, Human
acaugguacucuug

SEQ ID NO: 3625649 - RNA, 17 nt, Human
acauggucugucaauga

SEQ ID NO: 3625650 - RNA, 13 nt, Human
acauggugccuga

SEQ ID NO: 3625651 - RNA, 16 nt, Human
acauggugccugagag

SEQ ID NO: 3625652 - RNA, 20 nt, Human
acauggugccugagaggcag

SEQ ID NO: 3625653 - RNA, 23 nt, Human
acauggugccugagaggcaggca

SEQ ID NO: 3625654 - RNA, 23 nt, Human
acauggugucuggauucccagga

SEQ ID NO: 3625655 - RNA, 18 nt, Human
acaugguuacaaucauug

SEQ ID NO: 3625656 - RNA, 22 nt, Human
acaugguuacaaucauugcuga

SEQ ID NO: 3625657 - RNA, 18 nt, Human
acaugguugugaccugag

SEQ ID NO: 3625658 - RNA, 17 nt, Human
acauguaauaaaaagua

SEQ ID NO: 3625659 - RNA, 17 nt, Human
acauguaauuaaguacu

SEQ ID NO: 3625660 - RNA, 13 nt, Human
acauguaauuuga

SEQ ID NO: 3625661 - RNA, 15 nt, Human
acauguagguguuug

SEQ ID NO: 3625662 - RNA, 20 nt, Human
acauguaguaguacuugaaa

SEQ ID NO: 3625663 - RNA, 11 nt, Human
acauguaugug

SEQ ID NO: 3625664 - RNA, 15 nt, Human
acauguauguuuugg

SEQ ID NO: 3625665 - RNA, 22 nt, Human
acauguauguuuugguaucugu

SEQ ID NO: 3625666 - RNA, 23 nt, Human
acauguauguuuugguaucuguu

SEQ ID NO: 3625667 - RNA, 20 nt, Human
acauguauuaaauuacauuu

SEQ ID NO: 3625668 - RNA, 22 nt, Human
acauguauuaaauuacauuugu

SEQ ID NO: 3625669 - RNA, 14 nt, Human
acauguauuuaugu

SEQ ID NO: 3625670 - RNA, 18 nt, Human
acauguauuuauguaaug

SEQ ID NO: 3625671 - RNA, 12 nt, Human
acauguauuugu

SEQ ID NO: 3625672 - RNA, 17 nt, Human
acauguauuuguuugca

SEQ ID NO: 3625673 - RNA, 12 nt, Human
acaugucaaucu

SEQ ID NO: 3625674 - RNA, 17 nt, Human
acauguccagcaccuug

SEQ ID NO: 3625675 - RNA, 23 nt, Human
acauguccagcaccuugugccug

SEQ ID NO: 3625676 - RNA, 19 nt, Human
acauguccuaauucuucug

SEQ ID NO: 3625677 - RNA, 20 nt, Human
acauguccuaauucuucugu

SEQ ID NO: 3625678 - RNA, 23 nt, Human
acauguccugccuauuaucuguc

SEQ ID NO: 3625679 - RNA, 23 nt, Human
acaugucuuaaugaaguuugaau

SEQ ID NO: 3625680 - RNA, 13 nt, Human
acaugucuuguac

SEQ ID NO: 3625681 - RNA, 14 nt, Human
acaugucuuguaca

SEQ ID NO: 3625682 - RNA, 22 nt, Human
acaugucuuguacauguguagc

SEQ ID NO: 3625683 - RNA, 21 nt, Human
acaugucuuuucuugcaugag

SEQ ID NO: 3625684 - RNA, 21 nt, Human
acaugugacacauaugcaccu

SEQ ID NO: 3625685 - RNA, 14 nt, Human
acaugugacauuua

SEQ ID NO: 3625686 - RNA, 16 nt, Human
acaugugacauuuaua

SEQ ID NO: 3625687 - RNA, 23 nt, Human
acaugugauacauuuuuuaagcu

SEQ ID NO: 3625688 - RNA, 20 nt, Human
acaugugccgaaugugcagg

SEQ ID NO: 3625689 - RNA, 17 nt, Human
acauguguagccugugc

SEQ ID NO: 3625690 - RNA, 16 nt, Human
acaugugugcgugugc

SEQ ID NO: 3625691 - RNA, 14 nt, Human
acauguguguauau

SEQ ID NO: 3625692 - RNA, 22 nt, Human
acauguguguauauauguguau

SEQ ID NO: 3625693 - RNA, 20 nt, Human
acauguguuaaguauuuuca

SEQ ID NO: 3625694 - RNA, 21 nt, Human
acauguuaaaccaugggauaa

SEQ ID NO: 3625695 - RNA, 23 nt, Human
acauguuaaaccaugggauaaau

SEQ ID NO: 3625696 - RNA, 16 nt, Human
acauguuaaugacaau

SEQ ID NO: 3625697 - RNA, 20 nt, Human
acauguuaaugacaauauuc

SEQ ID NO: 3625698 - RNA, 11 nt, Human
acauguuacug

SEQ ID NO: 3625699 - RNA, 19 nt, Human
acauguuacugaccagcaa

SEQ ID NO: 3625700 - RNA, 21 nt, Human
acauguuuaauaaauaaaaau

SEQ ID NO: 3625701 - RNA, 21 nt, Human
acauguuuacuuuucagggca

SEQ ID NO: 3625702 - RNA, 14 nt, Human
acauguuuccagca

SEQ ID NO: 3625703 - RNA, 21 nt, Human
acauguuuccagcauucccag

SEQ ID NO: 3625704 - RNA, 22 nt, Human
acauguuuccagcauucccagg

SEQ ID NO: 3625705 - RNA, 19 nt, Human
acauguuucuuuguaauga

SEQ ID NO: 3625706 - RNA, 17 nt, Human
acauguuuuagacaaau

SEQ ID NO: 3625707 - RNA, 20 nt, Human
acauguuuuagacaaauacu

SEQ ID NO: 3625708 - RNA, 13 nt, Human
acauguuuucaaa

SEQ ID NO: 3625709 - RNA, 15 nt, Human
acauguuuucaaaug

SEQ ID NO: 3625710 - RNA, 18 nt, Human
acauguuuugauaaagua

SEQ ID NO: 3625711 - RNA, 21 nt, Human
acauguuuugauaaaguagua

SEQ ID NO: 3625712 - RNA, 23 nt, Human
acauguuuuuguuuucuuugaau

SEQ ID NO: 3625713 - RNA, 15 nt, Human
acauuaaaaauggaa

SEQ ID NO: 3625714 - RNA, 22 nt, Human
acauuaaagaaggguugagcug

SEQ ID NO: 3625715 - RNA, 13 nt, Human
acauuaaagcagu

SEQ ID NO: 3625716 - RNA, 11 nt, Human
acauuaaauga

SEQ ID NO: 3625717 - RNA, 19 nt, Human
acauuaaaugacucuuccc

SEQ ID NO: 3625718 - RNA, 19 nt, Human
acaaaaaaaccacaaaggc

SEQ ID NO: 3625719 - RNA, 23 nt, Human
acaaaaaaaccucuuaauauucu

SEQ ID NO: 3625720 - RNA, 21 nt, Human
acaaaaaaauaccucaggaaa

SEQ ID NO: 3625721 - RNA, 13 nt, Human
acaaaaaaauaua

SEQ ID NO: 3625722 - RNA, 17 nt, Human
acaaaaaaauauauuua

SEQ ID NO: 3625723 - RNA, 13 nt, Human
acaaaaaaaucug

SEQ ID NO: 3625724 - RNA, 14 nt, Human
acaaaaaaaucuuc

SEQ ID NO: 3625725 - RNA, 14 nt, Human
acaaaaaacaauau

SEQ ID NO: 3625726 - RNA, 18 nt, Human
acaaaaaacaauauuuau

SEQ ID NO: 3625727 - RNA, 17 nt, Human
acaaaaaacgaaugaaa

SEQ ID NO: 3625728 - RNA, 15 nt, Human
acaaaaaacuccccu

SEQ ID NO: 3625729 - RNA, 12 nt, Human
acaaaaaagaag

SEQ ID NO: 3625730 - RNA, 15 nt, Human
acaaaaacagccuca

SEQ ID NO: 3625731 - RNA, 13 nt, Human
acaaaaacauggc

SEQ ID NO: 3625732 - RNA, 20 nt, Human
acaaaaaccaaauguuuauu

SEQ ID NO: 3625733 - RNA, 14 nt, Human
acaaaaagaaaaga

SEQ ID NO: 3625734 - RNA, 15 nt, Human
acaaaaagacaaaca

SEQ ID NO: 3625735 - RNA, 12 nt, Human
acaaaaagacac

SEQ ID NO: 3625736 - RNA, 19 nt, Human
acaaaaagcuaauaccagu

SEQ ID NO: 3625737 - RNA, 10 nt, Human
acaaaaauaa

SEQ ID NO: 3625738 - RNA, 14 nt, Human
acaaaaauaaauuu

SEQ ID NO: 3625739 - RNA, 16 nt, Human
acaaaaauacucagau

SEQ ID NO: 3625740 - RNA, 18 nt, Human
acaaaaauacucuaauuc

SEQ ID NO: 3625741 - RNA, 19 nt, Human
acaaaaauacucuaauucu

SEQ ID NO: 3625742 - RNA, 17 nt, Human
acaaaaaucagccagac

SEQ ID NO: 3625743 - RNA, 20 nt, Human
acaaaaauuaucuauuugua

SEQ ID NO: 3625744 - RNA, 13 nt, Human
acaaaaauuugaa

SEQ ID NO: 3625745 - RNA, 12 nt, Human
acaaaacaaaaa

SEQ ID NO: 3625746 - RNA, 17 nt, Human
acaaaacaaaacaacau

SEQ ID NO: 3625747 - RNA, 12 nt, Human
acaaaacaaaug

SEQ ID NO: 3625748 - RNA, 19 nt, Human
acaaaaccaaaaguuauua

SEQ ID NO: 3625749 - RNA, 17 nt, Human
acaaaacccaugcauuu

SEQ ID NO: 3625750 - RNA, 19 nt, Human
acaaaaccccccagauauc

SEQ ID NO: 3625751 - RNA, 16 nt, Human
acaaaacgcgcagaug

SEQ ID NO: 3625752 - RNA, 10 nt, Human
acaaaacuau

SEQ ID NO: 3625753 - RNA, 16 nt, Human
acaaaacuauacuuga

SEQ ID NO: 3625754 - RNA, 11 nt, Human
acaaaacuucc

SEQ ID NO: 3625755 - RNA, 11 nt, Human
acaaaacuucu

SEQ ID NO: 3625756 - RNA, 14 nt, Human
acaaaacuuuucua

SEQ ID NO: 3625757 - RNA, 15 nt, Human
acaaaagaaaagacu

SEQ ID NO: 3625758 - RNA, 20 nt, Human
acaaaagaaaagacuuguaa

SEQ ID NO: 3625759 - RNA, 16 nt, Human
acaaaagaaauaccuu

SEQ ID NO: 3625760 - RNA, 13 nt, Human
acaaaagagcagu

SEQ ID NO: 3625761 - RNA, 11 nt, Human
acaaaagcaug

SEQ ID NO: 3625762 - RNA, 22 nt, Human
acaaaagcaugugagacugguu

SEQ ID NO: 3625763 - RNA, 10 nt, Human
acaaaaggca

SEQ ID NO: 3625764 - RNA, 16 nt, Human
acaaaagugcuuugga

SEQ ID NO: 3625765 - RNA, 13 nt, Human
acaaaauaaauug

SEQ ID NO: 3625766 - RNA, 22 nt, Human
acaaaauaaccaauccuggaca

SEQ ID NO: 3625767 - RNA, 15 nt, Human
acaaaauagaagcug

SEQ ID NO: 3625768 - RNA, 18 nt, Human
acaaaauagaagcuguag

SEQ ID NO: 3625769 - RNA, 20 nt, Human
acaaaaucagguaacuaacu

SEQ ID NO: 3625770 - RNA, 15 nt, Human
acaaaauggaauuca

SEQ ID NO: 3625771 - RNA, 13 nt, Human
acaaaauguaacu

SEQ ID NO: 3625772 - RNA, 23 nt, Human
acaaaauguaacuguuaccauug

SEQ ID NO: 3625773 - RNA, 22 nt, Human
acaaaauguagaauauucagac

SEQ ID NO: 3625774 - RNA, 16 nt, Human
acaaaauguaugucug

SEQ ID NO: 3625775 - RNA, 16 nt, Human
acaaaauuuucucauu

SEQ ID NO: 3625776 - RNA, 22 nt, Human
acaaaauuuucucauuuucuuu

SEQ ID NO: 3625777 - RNA, 14 nt, Human
acaaacaaaagcau

SEQ ID NO: 3625778 - RNA, 18 nt, Human
acaaacaaaauuucuauu

SEQ ID NO: 3625779 - RNA, 12 nt, Human
acaaacaaauuu

SEQ ID NO: 3625780 - RNA, 21 nt, Human
acaaacaaccccccaucacaa

SEQ ID NO: 3625781 - RNA, 18 nt, Human
acaaacaagcuaggugcu

SEQ ID NO: 3625782 - RNA, 21 nt, Human
acaaacaaggccugucagcua

SEQ ID NO: 3625783 - RNA, 14 nt, Human
acaaacaaucucuu

SEQ ID NO: 3625784 - RNA, 18 nt, Human
acaaacaauuaacugagc

SEQ ID NO: 3625785 - RNA, 17 nt, Human
acaaacacacacaaaag

SEQ ID NO: 3625786 - RNA, 23 nt, Human
acaaacacuacagacaauaaaua

SEQ ID NO: 3625787 - RNA, 13 nt, Human
acaaacagcucag

SEQ ID NO: 3625788 - RNA, 19 nt, Human
acaaacaugugguuaaugc

SEQ ID NO: 3625789 - RNA, 19 nt, Human
acaaacauuguguugacau

SEQ ID NO: 3625790 - RNA, 11 nt, Human
acaaacauuuu

SEQ ID NO: 3625791 - RNA, 16 nt, Human
acaaacauuuuucaac

SEQ ID NO: 3625792 - RNA, 16 nt, Human
acaaaccacaacugac

SEQ ID NO: 3625793 - RNA, 12 nt, Human
acaaaccugccu

SEQ ID NO: 3625794 - RNA, 18 nt, Human
acaaaccugccuggguuu

SEQ ID NO: 3625795 - RNA, 18 nt, Human
acaaacguauguaaaugu

SEQ ID NO: 3625796 - RNA, 15 nt, Human
acaaacucucugaac

SEQ ID NO: 3625797 - RNA, 19 nt, Human
acaaacugcaauagagacu

SEQ ID NO: 3625798 - RNA, 23 nt, Human
acaaacugcacaugauuucacaa

SEQ ID NO: 3625799 - RNA, 14 nt, Human
acaaacuggagucu

SEQ ID NO: 3625800 - RNA, 17 nt, Human
acaaacuguaauacaau

SEQ ID NO: 3625801 - RNA, 15 nt, Human
acaaacuguguaacu

SEQ ID NO: 3625802 - RNA, 21 nt, Human
acaaacuucuuucacucacau

SEQ ID NO: 3625803 - RNA, 15 nt, Human
accccuguaggccuc

SEQ ID NO: 3625804 - RNA, 11 nt, Human
accccuguccc

SEQ ID NO: 3625805 - RNA, 17 nt, Human
accccugucucuagcca

SEQ ID NO: 3625806 - RNA, 21 nt, Human
accccugugcuccgugccucc

SEQ ID NO: 3625807 - RNA, 13 nt, Human
accccuguuucug

SEQ ID NO: 3625808 - RNA, 20 nt, Human
accccuuaagcccuggcccc

SEQ ID NO: 3625809 - RNA, 14 nt, Human
accccuuagccucc

SEQ ID NO: 3625810 - RNA, 15 nt, Human
accccuuauccagga

SEQ ID NO: 3625811 - RNA, 17 nt, Human
accccuuauccaggacu

SEQ ID NO: 3625812 - RNA, 18 nt, Human
accccuuauccaggacuc

SEQ ID NO: 3625813 - RNA, 15 nt, Human
accccuuccagauca

SEQ ID NO: 3625814 - RNA, 16 nt, Human
accccuuccccacugc

SEQ ID NO: 3625815 - RNA, 12 nt, Human
accccuuccugu

SEQ ID NO: 3625816 - RNA, 14 nt, Human
accccuuccugucc

SEQ ID NO: 3625817 - RNA, 15 nt, Human
accccuucgcuccug

SEQ ID NO: 3625818 - RNA, 13 nt, Human
accccuucucugu

SEQ ID NO: 3625819 - RNA, 21 nt, Human
accccuugucgccccucccuc

SEQ ID NO: 3625820 - RNA, 13 nt, Human
accccuuucccac

SEQ ID NO: 3625821 - RNA, 16 nt, Human
accccuuuucagcuuc

SEQ ID NO: 3625822 - RNA, 21 nt, Human
acccgacagagggaagaaaag

SEQ ID NO: 3625823 - RNA, 17 nt, Human
acccgacauaagucgag

SEQ ID NO: 3625824 - RNA, 15 nt, Human
acccgacuccagucc

SEQ ID NO: 3625825 - RNA, 14 nt, Human
acccgaggcccgca

SEQ ID NO: 3625826 - RNA, 14 nt, Human
acccgaggcugccc

SEQ ID NO: 3625827 - RNA, 17 nt, Human
acccgaggguugauuaa

SEQ ID NO: 3625828 - RNA, 21 nt, Human
acccgagucauucguucugug

SEQ ID NO: 3625829 - RNA, 14 nt, Human
acccgaugcugcuu

SEQ ID NO: 3625830 - RNA, 23 nt, Human
acccgauuccaccaaaugugcuu

SEQ ID NO: 3625831 - RNA, 14 nt, Human
acccgccccugccc

SEQ ID NO: 3625832 - RNA, 23 nt, Human
acccgccucucccgucagggccc

SEQ ID NO: 3625833 - RNA, 24 nt, Human
acccgccucucccgucagggccca

SEQ ID NO: 3625834 - RNA, 18 nt, Human
acccgcucaucacuggau

SEQ ID NO: 3625835 - RNA, 12 nt, Human
acccgcucugga

SEQ ID NO: 3625836 - RNA, 13 nt, Human
acccgcucuggac

SEQ ID NO: 3625837 - RNA, 15 nt, Human
acccggaggccacau

SEQ ID NO: 3625838 - RNA, 19 nt, Human
acccggcacccccugcagc

SEQ ID NO: 3625839 - RNA, 14 nt, Human
acccggccccugcu

SEQ ID NO: 3625840 - RNA, 16 nt, Human
acccggccccugcugg

SEQ ID NO: 3625841 - RNA, 20 nt, Human
acccggccccugcugguuca

SEQ ID NO: 3625842 - RNA, 22 nt, Human
acccggccccugcugguucagg

SEQ ID NO: 3625843 - RNA, 12 nt, Human
acccgggaaggg

SEQ ID NO: 3625844 - RNA, 20 nt, Human
acccgggcagggcucccaca

SEQ ID NO: 3625845 - RNA, 14 nt, Human
acccgguccccacu

SEQ ID NO: 3625846 - RNA, 22 nt, Human
acccgguucaguguuucugggg

SEQ ID NO: 3625847 - RNA, 18 nt, Human
acccgguuucuuuuuaag

SEQ ID NO: 3625848 - RNA, 14 nt, Human
acccguccagaccu

SEQ ID NO: 3625849 - RNA, 16 nt, Human
acccgucuccagcugc

SEQ ID NO: 3625850 - RNA, 17 nt, Human
acccgucuccagcugcu

SEQ ID NO: 3625851 - RNA, 17 nt, Human
acccguggaggcugcuc

SEQ ID NO: 3625852 - RNA, 23 nt, Human
acccguucaugggggagggggca

SEQ ID NO: 3625853 - RNA, 18 nt, Human
acccguucugcuggccug

SEQ ID NO: 3625854 - RNA, 20 nt, Human
acccguucugcuggccugga

SEQ ID NO: 3625855 - RNA, 22 nt, Human
acccguucugcuggccuggauc

SEQ ID NO: 3625856 - RNA, 20 nt, Human
acccuaaauaauaaaaauaa

SEQ ID NO: 3625857 - RNA, 16 nt, Human
acccuaaaucuugacu

SEQ ID NO: 3625858 - RNA, 16 nt, Human
acccuaaccaaguucc

SEQ ID NO: 3625859 - RNA, 16 nt, Human
acccuaagacuccucg

SEQ ID NO: 3625860 - RNA, 23 nt, Human
acccuaaugucuucauaaaguac

SEQ ID NO: 3625861 - RNA, 14 nt, Human
acccuaccccacca

SEQ ID NO: 3625862 - RNA, 17 nt, Human
acccuaccugugccuga

SEQ ID NO: 3625863 - RNA, 18 nt, Human
acccuacuucuuuugcuc

SEQ ID NO: 3625864 - RNA, 19 nt, Human
acccuagccaaugucuccu

SEQ ID NO: 3625865 - RNA, 17 nt, Human
accauuggggcucccag

SEQ ID NO: 3625866 - RNA, 18 nt, Human
accauugucucagagcag

SEQ ID NO: 3625867 - RNA, 14 nt, Human
accauugucuuguu

SEQ ID NO: 3625868 - RNA, 17 nt, Human
accauugucuuguucug

SEQ ID NO: 3625869 - RNA, 14 nt, Human
accauuuaacaugc

SEQ ID NO: 3625870 - RNA, 12 nt, Human
accauuuauaau

SEQ ID NO: 3625871 - RNA, 22 nt, Human
accauuuauacaaauuagaaaa

SEQ ID NO: 3625872 - RNA, 11 nt, Human
accauuucaga

SEQ ID NO: 3625873 - RNA, 23 nt, Human
accauuucaguaaaccugucuga

SEQ ID NO: 3625874 - RNA, 19 nt, Human
accauuuccguaauucuua

SEQ ID NO: 3625875 - RNA, 15 nt, Human
accauuuccucagac

SEQ ID NO: 3625876 - RNA, 19 nt, Human
accauuuccucagacucua

SEQ ID NO: 3625877 - RNA, 22 nt, Human
accauuugcauggcuccagaaa

SEQ ID NO: 3625878 - RNA, 18 nt, Human
accauuugcuacuguaca

SEQ ID NO: 3625879 - RNA, 19 nt, Human
accauuuggcaucccuggg

SEQ ID NO: 3625880 - RNA, 15 nt, Human
accauuuguaauaaa

SEQ ID NO: 3625881 - RNA, 16 nt, Human
accauuuguaauaaag

SEQ ID NO: 3625882 - RNA, 15 nt, Human
accauuuuauaaagu

SEQ ID NO: 3625883 - RNA, 15 nt, Human
accauuuuccugcau

SEQ ID NO: 3625884 - RNA, 13 nt, Human
accauuuucuggu

SEQ ID NO: 3625885 - RNA, 23 nt, Human
accauuuugcugucccuuuuccu

SEQ ID NO: 3625886 - RNA, 21 nt, Human
accauuuugggguacccacug

SEQ ID NO: 3625887 - RNA, 22 nt, Human
accauuuuuaaaguagaagagg

SEQ ID NO: 3625888 - RNA, 11 nt, Human
accauuuuuca

SEQ ID NO: 3625889 - RNA, 17 nt, Human
accauuuuucauucacu

SEQ ID NO: 3625890 - RNA, 16 nt, Human
accauuuuuguuacuc

SEQ ID NO: 3625891 - RNA, 20 nt, Human
accauuuuuuaaggaaacaa

SEQ ID NO: 3625892 - RNA, 22 nt, Human
acccaaaagcucagccagcccc

SEQ ID NO: 3625893 - RNA, 14 nt, Human
acccaaacccuagg

SEQ ID NO: 3625894 - RNA, 15 nt, Human
acccaaacccuaggu

SEQ ID NO: 3625895 - RNA, 16 nt, Human
acccaaaccuggagau

SEQ ID NO: 3625896 - RNA, 17 nt, Human
acccaaagcauggacua

SEQ ID NO: 3625897 - RNA, 17 nt, Human
acccaaauccucuccag

SEQ ID NO: 3625898 - RNA, 18 nt, Human
acccaacccuaucuccug

SEQ ID NO: 3625899 - RNA, 20 nt, Human
acccaacccuaucuccugac

SEQ ID NO: 3625900 - RNA, 15 nt, Human
acccaacggcccugc

SEQ ID NO: 3625901 - RNA, 18 nt, Human
acccaagaccucagggca

SEQ ID NO: 3625902 - RNA, 15 nt, Human
acccaagcaaggcca

SEQ ID NO: 3625903 - RNA, 15 nt, Human
acccaagcuccaacc

SEQ ID NO: 3625904 - RNA, 13 nt, Human
acccaagcuuggc

SEQ ID NO: 3625905 - RNA, 18 nt, Human
acccaagcuuggcagccg

SEQ ID NO: 3625906 - RNA, 22 nt, Human
acccaagcuuggcagccgagcu

SEQ ID NO: 3625907 - RNA, 17 nt, Human
acccaaggaaaacugca

SEQ ID NO: 3625908 - RNA, 15 nt, Human
acccaaggaggaaaa

SEQ ID NO: 3625909 - RNA, 13 nt, Human
acccaagggccug

SEQ ID NO: 3625910 - RNA, 18 nt, Human
acccaagggccuggccug

SEQ ID NO: 3625911 - RNA, 19 nt, Human
acccaagggccuggccuga

SEQ ID NO: 3625912 - RNA, 22 nt, Human
acccaagggccuggccugagcu

SEQ ID NO: 3625913 - RNA, 14 nt, Human
acccaauccaaaug

SEQ ID NO: 3625914 - RNA, 13 nt, Human
acccaaugauuca

SEQ ID NO: 3625915 - RNA, 12 nt, Human
acccaauuuccc

SEQ ID NO: 3625916 - RNA, 21 nt, Human
acccacaagaaaugaaagcag

SEQ ID NO: 3625917 - RNA, 15 nt, Human
acccacacugcaaca

SEQ ID NO: 3625918 - RNA, 16 nt, Human
acccacagaaagagag

SEQ ID NO: 3625919 - RNA, 12 nt, Human
acccacagccuc

SEQ ID NO: 3625920 - RNA, 18 nt, Human
acccacauguaaaugaua

SEQ ID NO: 3625921 - RNA, 15 nt, Human
acccacaugugacac

SEQ ID NO: 3625922 - RNA, 16 nt, Human
acccacaugugacaca

SEQ ID NO: 3625923 - RNA, 12 nt, Human
acccacccagaa

SEQ ID NO: 3625924 - RNA, 15 nt, Human
acccacccagaauga

SEQ ID NO: 3625925 - RNA, 17 nt, Human
acccacccccacccaag

SEQ ID NO: 3625926 - RNA, 15 nt, Human
acccaccccugcaca

SEQ ID NO: 3625927 - RNA, 12 nt, Human
acccaccccugu

SEQ ID NO: 3625928 - RNA, 16 nt, Human
acccaccccugugcuc

SEQ ID NO: 3625929 - RNA, 16 nt, Human
acccaccgggccacuc

SEQ ID NO: 3625930 - RNA, 23 nt, Human
acccaccgggccacuccuuccug

SEQ ID NO: 3625931 - RNA, 14 nt, Human
acccaccugagcuu

SEQ ID NO: 3625932 - RNA, 18 nt, Human
acccaccugagcuuugga

SEQ ID NO: 3625933 - RNA, 10 nt, Human
acccaccugc

SEQ ID NO: 3625934 - RNA, 14 nt, Human
acccaccugcgucu

SEQ ID NO: 3625935 - RNA, 13 nt, Human
acccaccugcuga

SEQ ID NO: 3625936 - RNA, 17 nt, Human
acccaccugcugagaga

SEQ ID NO: 3625937 - RNA, 22 nt, Human
acccaccugcugagagacccaa

SEQ ID NO: 3625938 - RNA, 19 nt, Human
acccaccuuguuggagccu

SEQ ID NO: 3625939 - RNA, 20 nt, Human
acccaccuuguuggagccug

SEQ ID NO: 3625940 - RNA, 22 nt, Human
acccaccuuguuggagccugca

SEQ ID NO: 3625941 - RNA, 20 nt, Human
acccacguguaacugucagc

SEQ ID NO: 3625942 - RNA, 21 nt, Human
acccacguucucacacccacc

SEQ ID NO: 3625943 - RNA, 10 nt, Human
acccacugcu

SEQ ID NO: 3625944 - RNA, 13 nt, Human
acccacugcucug

SEQ ID NO: 3625945 - RNA, 15 nt, Human
acccacugcucuggu

SEQ ID NO: 3625946 - RNA, 11 nt, Human
acccacugcuu

SEQ ID NO: 3625947 - RNA, 20 nt, Human
acccacugcuuuuggucugu

SEQ ID NO: 3625948 - RNA, 17 nt, Human
acccacuggacucaccu

SEQ ID NO: 3625949 - RNA, 16 nt, Human
acccacuucccugggc

SEQ ID NO: 3625950 - RNA, 18 nt, Human
acccacuucucaucacac

SEQ ID NO: 3625951 - RNA, 19 nt, Human
acccacuucucaucacaca

SEQ ID NO: 3625952 - RNA, 21 nt, Human
acccacuucucaucacacaca

SEQ ID NO: 3625953 - RNA, 23 nt, Human
acccacuucucaucacacacaug

SEQ ID NO: 3625954 - RNA, 15 nt, Human
acccacuucugcacu

SEQ ID NO: 3625955 - RNA, 17 nt, Human
acccacuucugcacuug

SEQ ID NO: 3625956 - RNA, 19 nt, Human
acccacuugcuuuuaaaau

SEQ ID NO: 3625957 - RNA, 19 nt, Human
acccacuugucacugacac

SEQ ID NO: 3625958 - RNA, 22 nt, Human
acccacuuuaaaauaucuacau

SEQ ID NO: 3625959 - RNA, 21 nt, Human
acccagaaaaucugaauugga

SEQ ID NO: 3625960 - RNA, 20 nt, Human
acccagaaacgccacauccc

SEQ ID NO: 3625961 - RNA, 16 nt, Human
acccagaagaaaauag

SEQ ID NO: 3625962 - RNA, 13 nt, Human
acccagacccagu

SEQ ID NO: 3625963 - RNA, 15 nt, Human
acccagacccagugg

SEQ ID NO: 3625964 - RNA, 17 nt, Human
acccagacggcuccacu

SEQ ID NO: 3625965 - RNA, 22 nt, Human
acccugaggucagggagugcug

SEQ ID NO: 3625966 - RNA, 23 nt, Human
acccugaggucagggagugcugg

SEQ ID NO: 3625967 - RNA, 16 nt, Human
acccugaguucaucca

SEQ ID NO: 3625968 - RNA, 19 nt, Human
acccugauaggaagagggg

SEQ ID NO: 3625969 - RNA, 14 nt, Human
acccugaugaaaac

SEQ ID NO: 3625970 - RNA, 22 nt, Human
acccugauuauauccaguaaca

SEQ ID NO: 3625971 - RNA, 18 nt, Human
acccugcaaggcccacag

SEQ ID NO: 3625972 - RNA, 12 nt, Human
acccugcacccu

SEQ ID NO: 3625973 - RNA, 14 nt, Human
acccugcacccucc

SEQ ID NO: 3625974 - RNA, 16 nt, Human
acccugcacccuccua

SEQ ID NO: 3625975 - RNA, 17 nt, Human
acccugccaggcacagg

SEQ ID NO: 3625976 - RNA, 13 nt, Human
acccugccaugga

SEQ ID NO: 3625977 - RNA, 12 nt, Human
acccugccccug

SEQ ID NO: 3625978 - RNA, 13 nt, Human
acccugccccugc

SEQ ID NO: 3625979 - RNA, 14 nt, Human
acccugcccugugg

SEQ ID NO: 3625980 - RNA, 18 nt, Human
acccugccgucaccacca

SEQ ID NO: 3625981 - RNA, 13 nt, Human
acccugccucucc

SEQ ID NO: 3625982 - RNA, 17 nt, Human
acccugcguggggacag

SEQ ID NO: 3625983 - RNA, 18 nt, Human
acccugcucauccacucu

SEQ ID NO: 3625984 - RNA, 15 nt, Human
acccugcuuggccca

SEQ ID NO: 3625985 - RNA, 17 nt, Human
acccuggaaaaugaauc

SEQ ID NO: 3625986 - RNA, 14 nt, Human
acccuggaaaugga

SEQ ID NO: 3625987 - RNA, 20 nt, Human
acccuggaccaguggucuca

SEQ ID NO: 3625988 - RNA, 17 nt, Human
acccuggaggcaccugg

SEQ ID NO: 3625989 - RNA, 14 nt, Human
acccuggccccucu

SEQ ID NO: 3625990 - RNA, 17 nt, Human
acccuggccccucuccc

SEQ ID NO: 3625991 - RNA, 18 nt, Human
acccuggccccucucccu

SEQ ID NO: 3625992 - RNA, 19 nt, Human
acccuggccccucucccuu

SEQ ID NO: 3625993 - RNA, 17 nt, Human
acccuggccgcccccug

SEQ ID NO: 3625994 - RNA, 19 nt, Human
acccuggccgcccccugcc

SEQ ID NO: 3625995 - RNA, 22 nt, Human
acccuggccgcccccugccccc

SEQ ID NO: 3625996 - RNA, 12 nt, Human
acccugggaccu

SEQ ID NO: 3625997 - RNA, 17 nt, Human
acccugggagacagacc

SEQ ID NO: 3625998 - RNA, 14 nt, Human
acccugggcccugg

SEQ ID NO: 3625999 - RNA, 18 nt, Human
acccugggcccugggcug

SEQ ID NO: 3626000 - RNA, 18 nt, Human
acccugggcucugugggc

SEQ ID NO: 3626001 - RNA, 20 nt, Human
acccugggcucugugggcug

SEQ ID NO: 3626002 - RNA, 19 nt, Human
acccuggggaaggagccag

SEQ ID NO: 3626003 - RNA, 13 nt, Human
acccuggggccug

SEQ ID NO: 3626004 - RNA, 17 nt, Human
acccuggggccuggacc

SEQ ID NO: 3626005 - RNA, 19 nt, Human
acccuggggccuggaccug

SEQ ID NO: 3626006 - RNA, 14 nt, Human
acccugggggcaca

SEQ ID NO: 3626007 - RNA, 18 nt, Human
acccuggugguugcuguu

SEQ ID NO: 3626008 - RNA, 15 nt, Human
acccuguaccucauc

SEQ ID NO: 3626009 - RNA, 17 nt, Human
acccuguaccucauccc

SEQ ID NO: 3626010 - RNA, 20 nt, Human
acccuguacuguucuguguc

SEQ ID NO: 3626011 - RNA, 13 nt, Human
accugcucucuug

SEQ ID NO: 3626012 - RNA, 14 nt, Human
accugcucugcuga

SEQ ID NO: 3626013 - RNA, 19 nt, Human
accugcugaagggcagagg

SEQ ID NO: 3626014 - RNA, 16 nt, Human
accugcugagagaccc

SEQ ID NO: 3626015 - RNA, 11 nt, Human
accugcugagc

SEQ ID NO: 3626016 - RNA, 12 nt, Human
accugcugagcu

SEQ ID NO: 3626017 - RNA, 16 nt, Human
acaccacacccagccu

SEQ ID NO: 3626018 - RNA, 17 nt, Human
acaccacacccagccuc

SEQ ID NO: 3626019 - RNA, 18 nt, Human
acaccacacccagccuca

SEQ ID NO: 3626020 - RNA, 18 nt, Human
acaccacagacacacaca

SEQ ID NO: 3626021 - RNA, 21 nt, Human
acaccacagacacacacacgc

SEQ ID NO: 3626022 - RNA, 17 nt, Human
acaccacucuggcagcc

SEQ ID NO: 3626023 - RNA, 18 nt, Human
acaccacucuggcagcca

SEQ ID NO: 3626024 - RNA, 20 nt, Human
acaccacucuggcagccaca

SEQ ID NO: 3626025 - RNA, 20 nt, Human
acaccagagcagaugcagag

SEQ ID NO: 3626026 - RNA, 12 nt, Human
acaccagagccc

SEQ ID NO: 3626027 - RNA, 23 nt, Human
acaccagagcccaccuuggcuca

SEQ ID NO: 3626028 - RNA, 14 nt, Human
acaccagcauuccu

SEQ ID NO: 3626029 - RNA, 19 nt, Human
acaccagcauuccuuuuga

SEQ ID NO: 3626030 - RNA, 22 nt, Human
acaccagccaggcucugugcug

SEQ ID NO: 3626031 - RNA, 13 nt, Human
acaccagccccug

SEQ ID NO: 3626032 - RNA, 15 nt, Human
acaccagccccugcc

SEQ ID NO: 3626033 - RNA, 21 nt, Human
acaccagccccugccccagcc

SEQ ID NO: 3626034 - RNA, 17 nt, Human
acaccaggagucccugg

SEQ ID NO: 3626035 - RNA, 19 nt, Human
acaccaggagucccuggua

SEQ ID NO: 3626036 - RNA, 22 nt, Human
acaccaggauagagacuggaac

SEQ ID NO: 3626037 - RNA, 12 nt, Human
acaccaggccgu

SEQ ID NO: 3626038 - RNA, 22 nt, Human
acaccaggccguccucccgggc

SEQ ID NO: 3626039 - RNA, 17 nt, Human
acaccagggccagccuc

SEQ ID NO: 3626040 - RNA, 17 nt, Human
acaccagucacaugacc

SEQ ID NO: 3626041 - RNA, 20 nt, Human
acaccauaagcuacugccau

SEQ ID NO: 3626042 - RNA, 21 nt, Human
acaccauaagcuacugccauc

SEQ ID NO: 3626043 - RNA, 19 nt, Human
acaccaucacagcuuguuu

SEQ ID NO: 3626044 - RNA, 20 nt, Human
acaccaucgaucaugaugua

SEQ ID NO: 3626045 - RNA, 18 nt, Human
acaccaucgcuggccccu

SEQ ID NO: 3626046 - RNA, 15 nt, Human
acaccaucuuuuauu

SEQ ID NO: 3626047 - RNA, 18 nt, Human
acaccaucuuuuauucuu

SEQ ID NO: 3626048 - RNA, 21 nt, Human
acaccaucuuuuauucuuuuu

SEQ ID NO: 3626049 - RNA, 16 nt, Human
acaccauuaccaaaau

SEQ ID NO: 3626050 - RNA, 20 nt, Human
acacccaaagagguauuuau

SEQ ID NO: 3626051 - RNA, 19 nt, Human
acacccaaagcugagccug

SEQ ID NO: 3626052 - RNA, 23 nt, Human
acacccagcaauagagacgggac

SEQ ID NO: 3626053 - RNA, 19 nt, Human
acacccagcccacuucugc

SEQ ID NO: 3626054 - RNA, 20 nt, Human
acacccagcccacuucugcc

SEQ ID NO: 3626055 - RNA, 13 nt, Human
acacccagccuca

SEQ ID NO: 3626056 - RNA, 12 nt, Human
acacccagggaa

SEQ ID NO: 3626057 - RNA, 15 nt, Human
acacccaucuguuuu

SEQ ID NO: 3626058 - RNA, 16 nt, Human
acaccccaccugcgcu

SEQ ID NO: 3626059 - RNA, 14 nt, Human
acacccccaccccu

SEQ ID NO: 3626060 - RNA, 18 nt, Human
acacccccaccuccugca

SEQ ID NO: 3626061 - RNA, 16 nt, Human
acacccucccccgcca

SEQ ID NO: 3626062 - RNA, 16 nt, Human
acacccucucccagga

SEQ ID NO: 3626063 - RNA, 17 nt, Human
acacccugcccucaugc

SEQ ID NO: 3626064 - RNA, 13 nt, Human
acacccuuagaaa

SEQ ID NO: 3626065 - RNA, 20 nt, Human
acacccuucacauacccucc

SEQ ID NO: 3626066 - RNA, 21 nt, Human
acacccuucucccacucuccu

SEQ ID NO: 3626067 - RNA, 18 nt, Human
acacccuuggacuugagg

SEQ ID NO: 3626068 - RNA, 16 nt, Human
acaccgacuagccagg

SEQ ID NO: 3626069 - RNA, 22 nt, Human
acaccuaaagguguauuuaaac

SEQ ID NO: 3626070 - RNA, 14 nt, Human
acaccuaagggaca

SEQ ID NO: 3626071 - RNA, 18 nt, Human
acaccuaccaaaaaauaa

SEQ ID NO: 3626072 - RNA, 14 nt, Human
acaccuagaucaga

SEQ ID NO: 3626073 - RNA, 15 nt, Human
acaccuagcaucuca

SEQ ID NO: 3626074 - RNA, 13 nt, Human
acaccuagccagc

SEQ ID NO: 3626075 - RNA, 23 nt, Human
acaccuagccagcugucaagggc

SEQ ID NO: 3626076 - RNA, 17 nt, Human
acaccuaugucauuuca

SEQ ID NO: 3626077 - RNA, 19 nt, Human
acaccuauuaucccagcug

SEQ ID NO: 3626078 - RNA, 22 nt, Human
acaccuauuuuagacaaaucua

SEQ ID NO: 3626079 - RNA, 17 nt, Human
acaccucacaccucacu

SEQ ID NO: 3626080 - RNA, 20 nt, Human
acaccucagaggcuguucuu

SEQ ID NO: 3626081 - RNA, 21 nt, Human
acaccucagaggcuguucuug

SEQ ID NO: 3626082 - RNA, 23 nt, Human
acaccucaguucccuuggccuca

SEQ ID NO: 3626083 - RNA, 13 nt, Human
acaccucccagga

SEQ ID NO: 3626084 - RNA, 11 nt, Human
acaccuccugg

SEQ ID NO: 3626085 - RNA, 12 nt, Human
acaccucugcca

SEQ ID NO: 3626086 - RNA, 16 nt, Human
acaccucuuggggagu

SEQ ID NO: 3626087 - RNA, 17 nt, Human
acaccugagccagccug

SEQ ID NO: 3626088 - RNA, 12 nt, Human
acaccugaugug

SEQ ID NO: 3626089 - RNA, 17 nt, Human
acaccugauguguacau

SEQ ID NO: 3626090 - RNA, 12 nt, Human
acaccugcccug

SEQ ID NO: 3626091 - RNA, 14 nt, Human
acaccugcccugcc

SEQ ID NO: 3626092 - RNA, 18 nt, Human
acaccugcccugcccugc

SEQ ID NO: 3626093 - RNA, 23 nt, Human
acaccugcccugcccugccaccu

SEQ ID NO: 3626094 - RNA, 12 nt, Human
acaccuggcccu

SEQ ID NO: 3626095 - RNA, 19 nt, Human
acaccuggcugagguuccu

SEQ ID NO: 3626096 - RNA, 16 nt, Human
acaccuguacuggaga

SEQ ID NO: 3626097 - RNA, 16 nt, Human
acaccuguagucccag

SEQ ID NO: 3626098 - RNA, 17 nt, Human
acaccuguagucccagc

SEQ ID NO: 3626099 - RNA, 19 nt, Human
acaccuguagucccagcua

SEQ ID NO: 3626100 - RNA, 21 nt, Human
acaccuguagucccagcuacu

SEQ ID NO: 3626101 - RNA, 13 nt, Human
acaccuucucugg

SEQ ID NO: 3626102 - RNA, 14 nt, Human
acaccuucucugga

SEQ ID NO: 3626103 - RNA, 20 nt, Human
acaccuuggacauccuccuc

SEQ ID NO: 3626104 - RNA, 22 nt, Human
acaccuuggacauccuccuccc

SEQ ID NO: 3626105 - RNA, 23 nt, Human
acaccuuggacauccuccuccca

SEQ ID NO: 3626106 - RNA, 22 nt, Human
acaccuugugaccuucucuaua

SEQ ID NO: 3626107 - RNA, 14 nt, Human
acacgaaagaaaug

SEQ ID NO: 3626108 - RNA, 13 nt, Human
acacgaaagagag

SEQ ID NO: 3626109 - RNA, 15 nt, Human
acacgaauauugcug

SEQ ID NO: 3626110 - RNA, 14 nt, Human
acacgagcaggcua

SEQ ID NO: 3626111 - RNA, 19 nt, Human
acacgagcaggcuacuguc

SEQ ID NO: 3626112 - RNA, 13 nt, Human
acacgcaccugcc

SEQ ID NO: 3626113 - RNA, 17 nt, Human
acacgcacgcacacaca

SEQ ID NO: 3626114 - RNA, 19 nt, Human
acacgcaggaacucccagc

SEQ ID NO: 3626115 - RNA, 13 nt, Human
acacgcaggagca

SEQ ID NO: 3626116 - RNA, 19 nt, Human
acacgccuuguucuuggcc

SEQ ID NO: 3626117 - RNA, 20 nt, Human
acacgcgccccccucccaga

SEQ ID NO: 3626118 - RNA, 22 nt, Human
acacgcgccccccucccagagg

SEQ ID NO: 3626119 - RNA, 13 nt, Human
acacgcgcgcaca

SEQ ID NO: 3626120 - RNA, 17 nt, Human
acacgcgcgcacacaca

SEQ ID NO: 3626121 - RNA, 15 nt, Human
acacgcgugcacaca

SEQ ID NO: 3626122 - RNA, 17 nt, Human
acacgcgugcacacacc

SEQ ID NO: 3626123 - RNA, 14 nt, Human
acacgcuccuuccu

SEQ ID NO: 3626124 - RNA, 15 nt, Human
acacgcuguucuaau

SEQ ID NO: 3626125 - RNA, 14 nt, Human
acacgcuuuuguga

SEQ ID NO: 3626126 - RNA, 17 nt, Human
acacgcuuuugugaugg

SEQ ID NO: 3626127 - RNA, 15 nt, Human
acacggacacucaaa

SEQ ID NO: 3626128 - RNA, 23 nt, Human
acacggagcggauugcaaagcaa

SEQ ID NO: 3626129 - RNA, 20 nt, Human
acacggccacaucaaagagg

SEQ ID NO: 3626130 - RNA, 23 nt, Human
acacggucggggcaucuggccug

SEQ ID NO: 3626131 - RNA, 19 nt, Human
acacguaccucucaucagu

SEQ ID NO: 3626132 - RNA, 16 nt, Human
acacguacuuaaauga

SEQ ID NO: 3626133 - RNA, 23 nt, Human
acacguacuuaaaugaaagcaug

SEQ ID NO: 3626134 - RNA, 19 nt, Human
acacguaucccaccugaca

SEQ ID NO: 3626135 - RNA, 17 nt, Human
acacgugacacaaacac

SEQ ID NO: 3626136 - RNA, 17 nt, Human
acacguggaggaaugcu

SEQ ID NO: 3626137 - RNA, 24 nt, Human
acacguggaggaaugcucccccau

SEQ ID NO: 3626138 - RNA, 20 nt, Human
acacgugggcuccccucuuc

SEQ ID NO: 3626139 - RNA, 12 nt, Human
acacguguccug

SEQ ID NO: 3626140 - RNA, 23 nt, Human
acacguucacccaucuuaucaag

SEQ ID NO: 3626141 - RNA, 18 nt, Human
acacuaaauguuaaagau

SEQ ID NO: 3626142 - RNA, 18 nt, Human
acacuaaccaaaucucuc

SEQ ID NO: 3626143 - RNA, 16 nt, Human
acacuaaccaagcuga

SEQ ID NO: 3626144 - RNA, 15 nt, Human
acacuaaccacgcug

SEQ ID NO: 3626145 - RNA, 17 nt, Human
acacuaaccacgcugga

SEQ ID NO: 3626146 - RNA, 20 nt, Human
acacuaaccacgcuggaccu

SEQ ID NO: 3626147 - RNA, 15 nt, Human
acacuaaccuggguu

SEQ ID NO: 3626148 - RNA, 17 nt, Human
acacuaacucaccagcc

SEQ ID NO: 3626149 - RNA, 17 nt, Human
acacuaagagagaauga

SEQ ID NO: 3626150 - RNA, 18 nt, Human
acacuaagagagaaugag

SEQ ID NO: 3626151 - RNA, 23 nt, Human
acacuaaguuauaguauaucugg

SEQ ID NO: 3626152 - RNA, 13 nt, Human
acacuaauauauu

SEQ ID NO: 3626153 - RNA, 19 nt, Human
acacuaauauauuuaaaaa

SEQ ID NO: 3626154 - RNA, 21 nt, Human
acacuaauauauuuaaaaaua

SEQ ID NO: 3626155 - RNA, 14 nt, Human
acacuacaccacac

SEQ ID NO: 3626156 - RNA, 12 nt, Human
accuuaaaacua

SEQ ID NO: 3626157 - RNA, 21 nt, Human
accuuaaaauuugaaacauug

SEQ ID NO: 3626158 - RNA, 17 nt, Human
accuuaaauuaaacaau

SEQ ID NO: 3626159 - RNA, 16 nt, Human
accuuaccaacuuucu

SEQ ID NO: 3626160 - RNA, 17 nt, Human
accuuaccaacuuucug

SEQ ID NO: 3626161 - RNA, 18 nt, Human
accuuaccaacuuucugu

SEQ ID NO: 3626162 - RNA, 20 nt, Human
accuuaccaacuuucuguaa

SEQ ID NO: 3626163 - RNA, 22 nt, Human
accuuaccccuggcuguuugga

SEQ ID NO: 3626164 - RNA, 17 nt, Human
accuuagacagucccug

SEQ ID NO: 3626165 - RNA, 21 nt, Human
accuuagaccaccaagccuug

SEQ ID NO: 3626166 - RNA, 22 nt, Human
accuuagaccaccaagccuuga

SEQ ID NO: 3626167 - RNA, 17 nt, Human
accuuagauuagcucug

SEQ ID NO: 3626168 - RNA, 18 nt, Human
accuuagauuagcucugg

SEQ ID NO: 3626169 - RNA, 19 nt, Human
accuuagauuagcucugga

SEQ ID NO: 3626170 - RNA, 15 nt, Human
accuuaggccuuccu

SEQ ID NO: 3626171 - RNA, 16 nt, Human
accuuaggccuuccuc

SEQ ID NO: 3626172 - RNA, 15 nt, Human
accuuaguguuucug

SEQ ID NO: 3626173 - RNA, 14 nt, Human
accuuauaguuacu

SEQ ID NO: 3626174 - RNA, 20 nt, Human
accuuauaguuacuguguaa

SEQ ID NO: 3626175 - RNA, 22 nt, Human
accuuauaguuacuguguaauu

SEQ ID NO: 3626176 - RNA, 23 nt, Human
accuuauaguuacuguguaauua

SEQ ID NO: 3626177 - RNA, 16 nt, Human
accuuauccugcauug

SEQ ID NO: 3626178 - RNA, 13 nt, Human
accuuaucugugc

SEQ ID NO: 3626179 - RNA, 18 nt, Human
accuuauuguacguuuaa

SEQ ID NO: 3626180 - RNA, 22 nt, Human
accuuauuugcuaaucaaagcc

SEQ ID NO: 3626181 - RNA, 20 nt, Human
accucaggugauccacccac

SEQ ID NO: 3626182 - RNA, 21 nt, Human
accucaguaauuuagaaauca

SEQ ID NO: 3626183 - RNA, 16 nt, Human
accucagugucauuua

SEQ ID NO: 3626184 - RNA, 21 nt, Human
accucagugucauuuaugaaa

SEQ ID NO: 3626185 - RNA, 18 nt, Human
accucaguucccuuggcc

SEQ ID NO: 3626186 - RNA, 19 nt, Human
accucaguucccuuggccu

SEQ ID NO: 3626187 - RNA, 21 nt, Human
accucaguucccuuggccuca

SEQ ID NO: 3626188 - RNA, 22 nt, Human
accucaguucccuuggccucag

SEQ ID NO: 3626189 - RNA, 23 nt, Human
accucaguucccuuggccucaga

SEQ ID NO: 3626190 - RNA, 18 nt, Human
accucaguuuuaucauuu

SEQ ID NO: 3626191 - RNA, 15 nt, Human
accucaucaggauga

SEQ ID NO: 3626192 - RNA, 18 nt, Human
accucaucaggaugaacc

SEQ ID NO: 3626193 - RNA, 20 nt, Human
accucaucaggaugaaccca

SEQ ID NO: 3626194 - RNA, 15 nt, Human
accucaucuucuuca

SEQ ID NO: 3626195 - RNA, 20 nt, Human
accucauguuuaugaaaaua

SEQ ID NO: 3626196 - RNA, 21 nt, Human
accuccaaagcuucccacggc

SEQ ID NO: 3626197 - RNA, 14 nt, Human
accuccaacccugc

SEQ ID NO: 3626198 - RNA, 15 nt, Human
accuccaacccugcc

SEQ ID NO: 3626199 - RNA, 16 nt, Human
accuccaacccugccg

SEQ ID NO: 3626200 - RNA, 12 nt, Human
accuccacagcu

SEQ ID NO: 3626201 - RNA, 20 nt, Human
accuccacaguucaguggca

SEQ ID NO: 3626202 - RNA, 21 nt, Human
accuccagaaacggccauuca

SEQ ID NO: 3626203 - RNA, 19 nt, Human
accuccagcccgggagccu

SEQ ID NO: 3626204 - RNA, 13 nt, Human
accuccagcuguu

SEQ ID NO: 3626205 - RNA, 16 nt, Human
accuccagcuuuccug

SEQ ID NO: 3626206 - RNA, 18 nt, Human
accuccagcuuuccugua

SEQ ID NO: 3626207 - RNA, 10 nt, Human
accuccaucu

SEQ ID NO: 3626208 - RNA, 19 nt, Human
accuccauuaaagucugaa

SEQ ID NO: 3626209 - RNA, 20 nt, Human
accucccacaaaggagagcu

SEQ ID NO: 3626210 - RNA, 16 nt, Human
accucccacacuccca

SEQ ID NO: 3626211 - RNA, 16 nt, Human
accucccagaggucca

SEQ ID NO: 3626212 - RNA, 12 nt, Human
accucccagccc

SEQ ID NO: 3626213 - RNA, 13 nt, Human
accucccagcccu

SEQ ID NO: 3626214 - RNA, 14 nt, Human
accucccagcccua

SEQ ID NO: 3626215 - RNA, 14 nt, Human
accuccccacgccc

SEQ ID NO: 3626216 - RNA, 23 nt, Human
accuccccagcauuccagccccu

SEQ ID NO: 3626217 - RNA, 13 nt, Human
accuccccagccu

SEQ ID NO: 3626218 - RNA, 15 nt, Human
accuccccagccugc

SEQ ID NO: 3626219 - RNA, 18 nt, Human
accuccccccacugcagg

SEQ ID NO: 3626220 - RNA, 22 nt, Human
accuccccccacugcaggcccc

SEQ ID NO: 3626221 - RNA, 12 nt, Human
accucccccucc

SEQ ID NO: 3626222 - RNA, 15 nt, Human
accucccccuccuuc

SEQ ID NO: 3626223 - RNA, 16 nt, Human
accucccccuccuucc

SEQ ID NO: 3626224 - RNA, 15 nt, Human
accucccccugcccc

SEQ ID NO: 3626225 - RNA, 21 nt, Human
accuccccuauccacccagcc

SEQ ID NO: 3626226 - RNA, 23 nt, Human
accuccccuauccacccagccca

SEQ ID NO: 3626227 - RNA, 22 nt, Human
accuccccuccuugccuccugu

SEQ ID NO: 3626228 - RNA, 15 nt, Human
accuccccugaggcu

SEQ ID NO: 3626229 - RNA, 14 nt, Human
accuccccugccuu

SEQ ID NO: 3626230 - RNA, 16 nt, Human
accuccccugccuugc

SEQ ID NO: 3626231 - RNA, 15 nt, Human
accuccccuugccag

SEQ ID NO: 3626232 - RNA, 14 nt, Human
accuccccuugggc

SEQ ID NO: 3626233 - RNA, 22 nt, Human
accuccccuugggcccacaccu

SEQ ID NO: 3626234 - RNA, 17 nt, Human
accucccucaaccucau

SEQ ID NO: 3626235 - RNA, 19 nt, Human
accucccucaaccucaucc

SEQ ID NO: 3626236 - RNA, 10 nt, Human
accucccucc

SEQ ID NO: 3626237 - RNA, 11 nt, Human
accucccuccc

SEQ ID NO: 3626238 - RNA, 14 nt, Human
accucccucuuguu

SEQ ID NO: 3626239 - RNA, 14 nt, Human
accucccugaacca

SEQ ID NO: 3626240 - RNA, 17 nt, Human
accucccugacccgucu

SEQ ID NO: 3626241 - RNA, 13 nt, Human
accucccugccca

SEQ ID NO: 3626242 - RNA, 19 nt, Human
accuccuaaaaggcccaga

SEQ ID NO: 3626243 - RNA, 21 nt, Human
accuccuaaaaggcccagaga

SEQ ID NO: 3626244 - RNA, 23 nt, Human
accuccuacgucaaacaugaagu

SEQ ID NO: 3626245 - RNA, 14 nt, Human
accuccucagccug

SEQ ID NO: 3626246 - RNA, 23 nt, Human
accuccucagccugaaccccagg

SEQ ID NO: 3626247 - RNA, 16 nt, Human
accuccuccacaccag

SEQ ID NO: 3626248 - RNA, 14 nt, Human
accuccucccacug

SEQ ID NO: 3626249 - RNA, 19 nt, Human
accuccucccacugcccac

SEQ ID NO: 3626250 - RNA, 14 nt, Human
accuccucccuguu

SEQ ID NO: 3626251 - RNA, 22 nt, Human
accuccucggcuggcuguccac

SEQ ID NO: 3626252 - RNA, 12 nt, Human
accuccucucag

SEQ ID NO: 3626253 - RNA, 17 nt, Human
accuccucucaguguuu

SEQ ID NO: 3626254 - RNA, 11 nt, Human
accuccucugu

SEQ ID NO: 3626255 - RNA, 21 nt, Human
accuccugacacccuucuccc

SEQ ID NO: 3626256 - RNA, 16 nt, Human
accuccugcaauaaaa

SEQ ID NO: 3626257 - RNA, 14 nt, Human
accuccugcccagg

SEQ ID NO: 3626258 - RNA, 18 nt, Human
accuccugcccaggagag

SEQ ID NO: 3626259 - RNA, 11 nt, Human
accuccugccu

SEQ ID NO: 3626260 - RNA, 16 nt, Human
accuccugcugggcag

SEQ ID NO: 3626261 - RNA, 16 nt, Human
accuccugucucuggc

SEQ ID NO: 3626262 - RNA, 17 nt, Human
accuccugucucuggcc

SEQ ID NO: 3626263 - RNA, 20 nt, Human
accuccuguggaacccagca

SEQ ID NO: 3626264 - RNA, 16 nt, Human
accuccuucccucucu

SEQ ID NO: 3626265 - RNA, 22 nt, Human
accuccuucccucucuggagaa

SEQ ID NO: 3626266 - RNA, 21 nt, Human
accuccuuguaacaucaggga

SEQ ID NO: 3626267 - RNA, 18 nt, Human
accuccuugucacuuuau

SEQ ID NO: 3626268 - RNA, 18 nt, Human
accuccuuuacccucauc

SEQ ID NO: 3626269 - RNA, 19 nt, Human
accuccuuuacccucaucu

SEQ ID NO: 3626270 - RNA, 22 nt, Human
accuccuuucaagguaacugua

SEQ ID NO: 3626271 - RNA, 17 nt, Human
accuccuuucucuucuc

SEQ ID NO: 3626272 - RNA, 11 nt, Human
accucgagcca

SEQ ID NO: 3626273 - RNA, 14 nt, Human
accucgcccucucc

SEQ ID NO: 3626274 - RNA, 14 nt, Human
accucgcugagggc

SEQ ID NO: 3626275 - RNA, 14 nt, Human
accucggcuccugg

SEQ ID NO: 3626276 - RNA, 15 nt, Human
accucggcuccugga

SEQ ID NO: 3626277 - RNA, 15 nt, Human
accucgggccugcug

SEQ ID NO: 3626278 - RNA, 18 nt, Human
accucggucacuccaacu

SEQ ID NO: 3626279 - RNA, 14 nt, Human
accucgugcuuuaa

SEQ ID NO: 3626280 - RNA, 17 nt, Human
accucgugcuuuaagug

SEQ ID NO: 3626281 - RNA, 15 nt, Human
accucuaacagcacc

SEQ ID NO: 3626282 - RNA, 12 nt, Human
accucuaauagu

SEQ ID NO: 3626283 - RNA, 17 nt, Human
accucuaauaguauaaa

SEQ ID NO: 3626284 - RNA, 19 nt, Human
accucuaauaguauaaacc

SEQ ID NO: 3626285 - RNA, 23 nt, Human
accucuacuaaaaagaaggaaaa

SEQ ID NO: 3626286 - RNA, 14 nt, Human
accucuacuuucca

SEQ ID NO: 3626287 - RNA, 15 nt, Human
accucuagcccugcc

SEQ ID NO: 3626288 - RNA, 21 nt, Human
accucucaauauucaauaaag

SEQ ID NO: 3626289 - RNA, 16 nt, Human
accucucacuccccau

SEQ ID NO: 3626290 - RNA, 11 nt, Human
accucuccaag

SEQ ID NO: 3626291 - RNA, 20 nt, Human
accucuccaagggcuucugc

SEQ ID NO: 3626292 - RNA, 16 nt, Human
accucuccagccucag

SEQ ID NO: 3626293 - RNA, 23 nt, Human
accucuccaucuucagcuucuuc

SEQ ID NO: 3626294 - RNA, 17 nt, Human
accucuccccuggaacu

SEQ ID NO: 3626295 - RNA, 14 nt, Human
accucucccugacc

SEQ ID NO: 3626296 - RNA, 14 nt, Human
accucuccucaugu

SEQ ID NO: 3626297 - RNA, 12 nt, Human
accucucugucc

SEQ ID NO: 3626298 - RNA, 19 nt, Human
accucucugucccuugcug

SEQ ID NO: 3626299 - RNA, 23 nt, Human
accucucuuauagaauauuuauu

SEQ ID NO: 3626300 - RNA, 14 nt, Human
accucucuuuuuca

SEQ ID NO: 3626301 - RNA, 15 nt, Human
accuuuguauucucu

SEQ ID NO: 3626302 - RNA, 11 nt, Human
accuuugucac

SEQ ID NO: 3626303 - RNA, 15 nt, Human
accuuuguccccacc

SEQ ID NO: 3626304 - RNA, 18 nt, Human
accuuuguccccaccgca

SEQ ID NO: 3626305 - RNA, 16 nt, Human
accuuuguuuuuuguu

SEQ ID NO: 3626306 - RNA, 13 nt, Human
accuuuuaaagug

SEQ ID NO: 3626307 - RNA, 14 nt, Human
accuuuuaaagugu

SEQ ID NO: 3626308 - RNA, 19 nt, Human
accuuuuaaauccuguuga

SEQ ID NO: 3626309 - RNA, 21 nt, Human
accuuuuaaauccuguugaaa

SEQ ID NO: 3626310 - RNA, 23 nt, Human
accuuuuaaauccuguugaaaag

SEQ ID NO: 3626311 - RNA, 20 nt, Human
accuuuuaacaccugaugug

SEQ ID NO: 3626312 - RNA, 20 nt, Human
accuuuuaccagcuuuuaac

SEQ ID NO: 3626313 - RNA, 21 nt, Human
accuuuuacugguugcaugga

SEQ ID NO: 3626314 - RNA, 24 nt, Human
accuuuuacugguugcauggaaau

SEQ ID NO: 3626315 - RNA, 20 nt, Human
accuuuuauugacacagaaa

SEQ ID NO: 3626316 - RNA, 22 nt, Human
accuuuucaggaaaauaacuua

SEQ ID NO: 3626317 - RNA, 15 nt, Human
accuuuucagggcug

SEQ ID NO: 3626318 - RNA, 21 nt, Human
accuuuugaggagccccagcu

SEQ ID NO: 3626319 - RNA, 17 nt, Human
accuuuugagugccuua

SEQ ID NO: 3626320 - RNA, 21 nt, Human
accuuuugcaccugcucucuu

SEQ ID NO: 3626321 - RNA, 22 nt, Human
accuuuugggaauguuuuaaau

SEQ ID NO: 3626322 - RNA, 14 nt, Human
accuuuuuccuucc

SEQ ID NO: 3626323 - RNA, 13 nt, Human
accuuuuuuauac

SEQ ID NO: 3626324 - RNA, 18 nt, Human
accuuuuuuauacauaaa

SEQ ID NO: 3626325 - RNA, 24 nt, Human
accuuuuuuuaucguuuuuguauu

SEQ ID NO: 3626326 - RNA, 18 nt, Human
accuuuuuuuuuuuucca

SEQ ID NO: 3626327 - RNA, 12 nt, Human
acgaaagagaga

SEQ ID NO: 3626328 - RNA, 17 nt, Human
acgaaauaauuguuguu

SEQ ID NO: 3626329 - RNA, 13 nt, Human
acgaaauguuauu

SEQ ID NO: 3626330 - RNA, 13 nt, Human
acgaacaaaacac

SEQ ID NO: 3626331 - RNA, 19 nt, Human
acgaaccuacaguuuuaac

SEQ ID NO: 3626332 - RNA, 12 nt, Human
acgaagaaaaaa

SEQ ID NO: 3626333 - RNA, 15 nt, Human
acgaagaagagccac

SEQ ID NO: 3626334 - RNA, 18 nt, Human
acgaagaagagccacagu

SEQ ID NO: 3626335 - RNA, 22 nt, Human
acgaagaguauuuuugacagaa

SEQ ID NO: 3626336 - RNA, 16 nt, Human
acgaagggggcaucug

SEQ ID NO: 3626337 - RNA, 21 nt, Human
acgaagguaaaaaguauuuuu

SEQ ID NO: 3626338 - RNA, 14 nt, Human
acgaauacuuuugc

SEQ ID NO: 3626339 - RNA, 22 nt, Human
acgaauacuuuugcccuuugau

SEQ ID NO: 3626340 - RNA, 16 nt, Human
acgaauagacaucaaa

SEQ ID NO: 3626341 - RNA, 21 nt, Human
acgacaaagcugcuaaaucuc

SEQ ID NO: 3626342 - RNA, 20 nt, Human
acgacaacgaugaugcuugu

SEQ ID NO: 3626343 - RNA, 15 nt, Human
accucuuagcugagu

SEQ ID NO: 3626344 - RNA, 13 nt, Human
accucuuccccag

SEQ ID NO: 3626345 - RNA, 14 nt, Human
accucuuccccaga

SEQ ID NO: 3626346 - RNA, 22 nt, Human
accucuuccccagaaaggagac

SEQ ID NO: 3626347 - RNA, 23 nt, Human
accucuuccccagaaaggagacu

SEQ ID NO: 3626348 - RNA, 19 nt, Human
accucuuccggagauguag

SEQ ID NO: 3626349 - RNA, 21 nt, Human
accucuucucuuccuguaaca

SEQ ID NO: 3626350 - RNA, 17 nt, Human
accucuugagccuugaa

SEQ ID NO: 3626351 - RNA, 20 nt, Human
accucuugagccuugaacuu

SEQ ID NO: 3626352 - RNA, 14 nt, Human
accucuugcugucu

SEQ ID NO: 3626353 - RNA, 24 nt, Human
accucuugcugucucugcucgccc

SEQ ID NO: 3626354 - RNA, 14 nt, Human
accucuuggggagu

SEQ ID NO: 3626355 - RNA, 22 nt, Human
accucuuugaaagaaggaagac

SEQ ID NO: 3626356 - RNA, 17 nt, Human
accucuuuuagucauuu

SEQ ID NO: 3626357 - RNA, 15 nt, Human
accugaaaaaaaguu

SEQ ID NO: 3626358 - RNA, 19 nt, Human
accugaaaaaaaguuuaca

SEQ ID NO: 3626359 - RNA, 15 nt, Human
accugaaaauguuag

SEQ ID NO: 3626360 - RNA, 16 nt, Human
accugaaauuccaaag

SEQ ID NO: 3626361 - RNA, 16 nt, Human
accugaacugaacacc

SEQ ID NO: 3626362 - RNA, 11 nt, Human
accugaagaau

SEQ ID NO: 3626363 - RNA, 16 nt, Human
accugaagaaucacaa

SEQ ID NO: 3626364 - RNA, 18 nt, Human
accugaagacucauucuu

SEQ ID NO: 3626365 - RNA, 13 nt, Human
accugaagacuga

SEQ ID NO: 3626366 - RNA, 19 nt, Human
accugaagacugaggacaa

SEQ ID NO: 3626367 - RNA, 23 nt, Human
accugaagaguggucagaacaga

SEQ ID NO: 3626368 - RNA, 15 nt, Human
accugaagcuagacg

SEQ ID NO: 3626369 - RNA, 21 nt, Human
accugaagggguuuucuugau

SEQ ID NO: 3626370 - RNA, 23 nt, Human
accugaauagcucccagauuuca

SEQ ID NO: 3626371 - RNA, 19 nt, Human
accugaccaacauggagaa

SEQ ID NO: 3626372 - RNA, 18 nt, Human
accugaccgugggcgggg

SEQ ID NO: 3626373 - RNA, 20 nt, Human
accugaccgugggcggggcc

SEQ ID NO: 3626374 - RNA, 14 nt, Human
accugaccucuugc

SEQ ID NO: 3626375 - RNA, 15 nt, Human
accugaccucuugcu

SEQ ID NO: 3626376 - RNA, 17 nt, Human
accugaccucuugcugu

SEQ ID NO: 3626377 - RNA, 19 nt, Human
accugaccucuugcugucu

SEQ ID NO: 3626378 - RNA, 20 nt, Human
accugaccucuugcugucuc

SEQ ID NO: 3626379 - RNA, 22 nt, Human
accugacucgucugacugugug

SEQ ID NO: 3626380 - RNA, 18 nt, Human
accugacucugaaaucug

SEQ ID NO: 3626381 - RNA, 19 nt, Human
accugacucugaaaucuga

SEQ ID NO: 3626382 - RNA, 23 nt, Human
accugacucugaaaucugaagac

SEQ ID NO: 3626383 - RNA, 15 nt, Human
accugagauuuauua

SEQ ID NO: 3626384 - RNA, 18 nt, Human
accugagcaggaccucug

SEQ ID NO: 3626385 - RNA, 16 nt, Human
accugagccagccugc

SEQ ID NO: 3626386 - RNA, 17 nt, Human
accugagccccaaaagg

SEQ ID NO: 3626387 - RNA, 21 nt, Human
accugagccugccgagcaacc

SEQ ID NO: 3626388 - RNA, 14 nt, Human
accugagcucccca

SEQ ID NO: 3626389 - RNA, 13 nt, Human
accugaggaagcg

SEQ ID NO: 3626390 - RNA, 20 nt, Human
accugaggcccuucucucca

SEQ ID NO: 3626391 - RNA, 19 nt, Human
accugaggcuccugugcua

SEQ ID NO: 3626392 - RNA, 16 nt, Human
accugaggggccucuu

SEQ ID NO: 3626393 - RNA, 14 nt, Human
accugaggugggcc

SEQ ID NO: 3626394 - RNA, 21 nt, Human
accugaggugggcccaggacc

SEQ ID NO: 3626395 - RNA, 14 nt, Human
accugaguuccuga

SEQ ID NO: 3626396 - RNA, 17 nt, Human
accugaguugaagaggg

SEQ ID NO: 3626397 - RNA, 16 nt, Human
accugaucaaugacag

SEQ ID NO: 3626398 - RNA, 20 nt, Human
accugaucaaugacagagcc

SEQ ID NO: 3626399 - RNA, 22 nt, Human
accugaucacuagccugucauc

SEQ ID NO: 3626400 - RNA, 15 nt, Human
accugauuuacaguu

SEQ ID NO: 3626401 - RNA, 21 nt, Human
accugauuuacaguuucaaaa

SEQ ID NO: 3626402 - RNA, 15 nt, Human
accugauuucuccug

SEQ ID NO: 3626403 - RNA, 20 nt, Human
accugauuuuuuuuccuuuu

SEQ ID NO: 3626404 - RNA, 18 nt, Human
accugcaagggcucccca

SEQ ID NO: 3626405 - RNA, 18 nt, Human
accugcaaucccagcuac

SEQ ID NO: 3626406 - RNA, 14 nt, Human
accugcaccucccc

SEQ ID NO: 3626407 - RNA, 20 nt, Human
accugcaccuccccccacug

SEQ ID NO: 3626408 - RNA, 22 nt, Human
accugcaccuccccccacugca

SEQ ID NO: 3626409 - RNA, 15 nt, Human
accugcaggccaaga

SEQ ID NO: 3626410 - RNA, 22 nt, Human
accugcauccguaguucccuga

SEQ ID NO: 3626411 - RNA, 17 nt, Human
accugcaucuggggccc

SEQ ID NO: 3626412 - RNA, 15 nt, Human
accugcauuguaaau

SEQ ID NO: 3626413 - RNA, 19 nt, Human
accugccacuaggcugggu

SEQ ID NO: 3626414 - RNA, 13 nt, Human
accugccacucac

SEQ ID NO: 3626415 - RNA, 15 nt, Human
accugccagccuggc

SEQ ID NO: 3626416 - RNA, 18 nt, Human
accugccagccuggcuuc

SEQ ID NO: 3626417 - RNA, 15 nt, Human
accugccaggaagcc

SEQ ID NO: 3626418 - RNA, 16 nt, Human
accugccaggaagcca

SEQ ID NO: 3626419 - RNA, 18 nt, Human
accugccaggaagccagc

SEQ ID NO: 3626420 - RNA, 23 nt, Human
accugccaggaagccagcaggcu

SEQ ID NO: 3626421 - RNA, 20 nt, Human
accugccaggcagggguggg

SEQ ID NO: 3626422 - RNA, 18 nt, Human
accugccagggacagagg

SEQ ID NO: 3626423 - RNA, 19 nt, Human
accugcccaaccugcucuc

SEQ ID NO: 3626424 - RNA, 21 nt, Human
accugcccaaccugcucuccu

SEQ ID NO: 3626425 - RNA, 20 nt, Human
accugcccagaucccagaag

SEQ ID NO: 3626426 - RNA, 17 nt, Human
accugccccacuugucc

SEQ ID NO: 3626427 - RNA, 16 nt, Human
accugcccccaaucca

SEQ ID NO: 3626428 - RNA, 18 nt, Human
accugcccccgcaucccc

SEQ ID NO: 3626429 - RNA, 20 nt, Human
accugcccccgcauccccug

SEQ ID NO: 3626430 - RNA, 23 nt, Human
accugcccccgcauccccugccu

SEQ ID NO: 3626431 - RNA, 13 nt, Human
accugcccccugg

SEQ ID NO: 3626432 - RNA, 15 nt, Human
accugcccccuggug

SEQ ID NO: 3626433 - RNA, 12 nt, Human
accugcccccuu

SEQ ID NO: 3626434 - RNA, 15 nt, Human
accugcccccuucuc

SEQ ID NO: 3626435 - RNA, 19 nt, Human
accugcccccuucucccac

SEQ ID NO: 3626436 - RNA, 20 nt, Human
accugcccccuucucccaca

SEQ ID NO: 3626437 - RNA, 17 nt, Human
accugccccgcccagcu

SEQ ID NO: 3626438 - RNA, 14 nt, Human
accugccccuccuc

SEQ ID NO: 3626439 - RNA, 13 nt, Human
accugcccugccc

SEQ ID NO: 3626440 - RNA, 15 nt, Human
accugcccugccuga

SEQ ID NO: 3626441 - RNA, 17 nt, Human
accugcccugccugagg

SEQ ID NO: 3626442 - RNA, 18 nt, Human
accugcccugccugaggg

SEQ ID NO: 3626443 - RNA, 20 nt, Human
accugcccugccugagggcc

SEQ ID NO: 3626444 - RNA, 13 nt, Human
accugcccuggaa

SEQ ID NO: 3626445 - RNA, 14 nt, Human
acaggcgagagagg

SEQ ID NO: 3626446 - RNA, 19 nt, Human
acaggcgagagaggagcca

SEQ ID NO: 3626447 - RNA, 22 nt, Human
acaggcgugagccaccgugccu

SEQ ID NO: 3626448 - RNA, 20 nt, Human
acaggcgugagccaccucgc

SEQ ID NO: 3626449 - RNA, 20 nt, Human
acaggcucaaacaaugacaa

SEQ ID NO: 3626450 - RNA, 15 nt, Human
acaggcucaggcagg

SEQ ID NO: 3626451 - RNA, 12 nt, Human
acaggcuccugc

SEQ ID NO: 3626452 - RNA, 21 nt, Human
acaggcuccugccaccacgcc

SEQ ID NO: 3626453 - RNA, 22 nt, Human
acaggcuccugccaccacgccc

SEQ ID NO: 3626454 - RNA, 19 nt, Human
acaggcucuuagcagcuuc

SEQ ID NO: 3626455 - RNA, 20 nt, Human
acaggcucuuagcagcuucc

SEQ ID NO: 3626456 - RNA, 16 nt, Human
acaggcugagugcagg

SEQ ID NO: 3626457 - RNA, 21 nt, Human
acaggcugagugcaggcccac

SEQ ID NO: 3626458 - RNA, 14 nt, Human
acaggcugggcuuc

SEQ ID NO: 3626459 - RNA, 21 nt, Human
acaggcugggcuucaguggca

SEQ ID NO: 3626460 - RNA, 22 nt, Human
acaggcugggcuucaguggcag

SEQ ID NO: 3626461 - RNA, 20 nt, Human
acaggcuguucugcacugaa

SEQ ID NO: 3626462 - RNA, 16 nt, Human
acaggcuuagggacag

SEQ ID NO: 3626463 - RNA, 20 nt, Human
acaggcuuagugauguaauu

SEQ ID NO: 3626464 - RNA, 16 nt, Human
acaggcuucugagcag

SEQ ID NO: 3626465 - RNA, 15 nt, Human
acagggaaggcaggc

SEQ ID NO: 3626466 - RNA, 21 nt, Human
acagggaaggcaggcagggcu

SEQ ID NO: 3626467 - RNA, 22 nt, Human
acagggacugaaaaccucuccu

SEQ ID NO: 3626468 - RNA, 13 nt, Human
acagggagccucc

SEQ ID NO: 3626469 - RNA, 16 nt, Human
acagggagcugggaca

SEQ ID NO: 3626470 - RNA, 22 nt, Human
acagggauaaggccuguggggg

SEQ ID NO: 3626471 - RNA, 13 nt, Human
acagggaugagca

SEQ ID NO: 3626472 - RNA, 22 nt, Human
acagggauugauuuuaaaaugu

SEQ ID NO: 3626473 - RNA, 12 nt, Human
acagggcacacc

SEQ ID NO: 3626474 - RNA, 16 nt, Human
acagggcacaggccau

SEQ ID NO: 3626475 - RNA, 16 nt, Human
acagggcagagccggg

SEQ ID NO: 3626476 - RNA, 16 nt, Human
acagggcagcugggcc

SEQ ID NO: 3626477 - RNA, 21 nt, Human
acagggcagcugggcccaacc

SEQ ID NO: 3626478 - RNA, 20 nt, Human
acagggcaguaccugagggu

SEQ ID NO: 3626479 - RNA, 18 nt, Human
acagggccaguggggccu

SEQ ID NO: 3626480 - RNA, 19 nt, Human
acagggccaguggggccug

SEQ ID NO: 3626481 - RNA, 21 nt, Human
acagggccaguggggccugug

SEQ ID NO: 3626482 - RNA, 22 nt, Human
acagggcuaagagcuagcgcug

SEQ ID NO: 3626483 - RNA, 16 nt, Human
acagggcugccuucug

SEQ ID NO: 3626484 - RNA, 13 nt, Human
acagggcuggccc

SEQ ID NO: 3626485 - RNA, 14 nt, Human
acagggcuggccca

SEQ ID NO: 3626486 - RNA, 22 nt, Human
acagggcuggcccagcccugcu

SEQ ID NO: 3626487 - RNA, 23 nt, Human
acagggcuggcccagcccugcug

SEQ ID NO: 3626488 - RNA, 23 nt, Human
acaggggaggugauagcauugcu

SEQ ID NO: 3626489 - RNA, 14 nt, Human
acaggggccagaag

SEQ ID NO: 3626490 - RNA, 23 nt, Human
acaggggccagaagaugaacaga

SEQ ID NO: 3626491 - RNA, 19 nt, Human
acaggggcuggugggcacc

SEQ ID NO: 3626492 - RNA, 15 nt, Human
acagggggucuggcu

SEQ ID NO: 3626493 - RNA, 17 nt, Human
acagggggucuggcugg

SEQ ID NO: 3626494 - RNA, 21 nt, Human
acagggggucuggcugguguu

SEQ ID NO: 3626495 - RNA, 16 nt, Human
acagggguuccuucug

SEQ ID NO: 3626496 - RNA, 21 nt, Human
acagggguuccuucugggcau

SEQ ID NO: 3626497 - RNA, 22 nt, Human
acaggguaacuaacuaaaacaa

SEQ ID NO: 3626498 - RNA, 23 nt, Human
acaggguaacugugcugaaugcu

SEQ ID NO: 3626499 - RNA, 17 nt, Human
acaggguagcagguacc

SEQ ID NO: 3626500 - RNA, 18 nt, Human
acagggucccacagccac

SEQ ID NO: 3626501 - RNA, 22 nt, Human
acagggucugcucuuucucugc

SEQ ID NO: 3626502 - RNA, 15 nt, Human
acagggugggccucg

SEQ ID NO: 3626503 - RNA, 16 nt, Human
acaggguguugucagc

SEQ ID NO: 3626504 - RNA, 16 nt, Human
acaggguucaaaaugu

SEQ ID NO: 3626505 - RNA, 15 nt, Human
acaggguuucaccau

SEQ ID NO: 3626506 - RNA, 23 nt, Human
acaggguuuuuaccugucacauu

SEQ ID NO: 3626507 - RNA, 22 nt, Human
acagguaaaacagggccacaua

SEQ ID NO: 3626508 - RNA, 18 nt, Human
acagguaaacuaucuugg

SEQ ID NO: 3626509 - RNA, 19 nt, Human
acagguaacgucuguaagc

SEQ ID NO: 3626510 - RNA, 15 nt, Human
acagguaauauaaaa

SEQ ID NO: 3626511 - RNA, 19 nt, Human
acagguauauacuuugaaa

SEQ ID NO: 3626512 - RNA, 21 nt, Human
acagguauuuuguuucuuuua

SEQ ID NO: 3626513 - RNA, 22 nt, Human
acaggucaauacaguacaggca

SEQ ID NO: 3626514 - RNA, 18 nt, Human
acaggucccaccuccagc

SEQ ID NO: 3626515 - RNA, 13 nt, Human
acaggucccuccc

SEQ ID NO: 3626516 - RNA, 14 nt, Human
acaggucuccucuu

SEQ ID NO: 3626517 - RNA, 18 nt, Human
acaggucuccucuuaaaa

SEQ ID NO: 3626518 - RNA, 21 nt, Human
acaggucuuuccuaaggcugc

SEQ ID NO: 3626519 - RNA, 19 nt, Human
acagguggcaggaccagga

SEQ ID NO: 3626520 - RNA, 21 nt, Human
acagguggcaggaccaggacu

SEQ ID NO: 3626521 - RNA, 20 nt, Human
acaggugggcuucccagugg

SEQ ID NO: 3626522 - RNA, 17 nt, Human
acagguggugucacugu

SEQ ID NO: 3626523 - RNA, 19 nt, Human
acagguggugucacugucc

SEQ ID NO: 3626524 - RNA, 22 nt, Human
acagguggugucacugucccuc

SEQ ID NO: 3626525 - RNA, 19 nt, Human
acaggugugaaccaccaca

SEQ ID NO: 3626526 - RNA, 20 nt, Human
acaggugugaaccaccacac

SEQ ID NO: 3626527 - RNA, 23 nt, Human
acaggugugaaccaccacaccca

SEQ ID NO: 3626528 - RNA, 22 nt, Human
acaggugugagccaccacgccc

SEQ ID NO: 3626529 - RNA, 22 nt, Human
acaggugugagucaccaagccc

SEQ ID NO: 3626530 - RNA, 13 nt, Human
acagguuacaaca

SEQ ID NO: 3626531 - RNA, 16 nt, Human
acagguuacaacagau

SEQ ID NO: 3626532 - RNA, 23 nt, Human
acagguuacaacagauuugugaa

SEQ ID NO: 3626533 - RNA, 18 nt, Human
acagguuuuaaaagccuu

SEQ ID NO: 3626534 - RNA, 22 nt, Human
acagguuuuccugaagaauuga

SEQ ID NO: 3626535 - RNA, 20 nt, Human
acaguaaaccacugaaaaaa

SEQ ID NO: 3626536 - RNA, 12 nt, Human
acaguaaauaaa

SEQ ID NO: 3626537 - RNA, 18 nt, Human
acaguaaauaaauuguuu

SEQ ID NO: 3626538 - RNA, 21 nt, Human
acaguaacauagcugugauuu

SEQ ID NO: 3626539 - RNA, 19 nt, Human
acaguaacccaaaccucaa

SEQ ID NO: 3626540 - RNA, 10 nt, Human
acaguaacuu

SEQ ID NO: 3626541 - RNA, 14 nt, Human
acaguaacuugguu

SEQ ID NO: 3626542 - RNA, 17 nt, Human
acaguaacuugguuaua

SEQ ID NO: 3626543 - RNA, 16 nt, Human
acaguaacuuuaugug

SEQ ID NO: 3626544 - RNA, 19 nt, Human
acaguaacuuuauguguaa

SEQ ID NO: 3626545 - RNA, 16 nt, Human
aggaaaauaguaaugu

SEQ ID NO: 3626546 - RNA, 13 nt, Human
aggaaaauauuuu

SEQ ID NO: 3626547 - RNA, 14 nt, Human
aggaaaauccucug

SEQ ID NO: 3626548 - RNA, 23 nt, Human
aggaaaaugucuguaauaauaga

SEQ ID NO: 3626549 - RNA, 13 nt, Human
aggaaaauuucac

SEQ ID NO: 3626550 - RNA, 21 nt, Human
aggaaacaaagcuuagcagga

SEQ ID NO: 3626551 - RNA, 15 nt, Human
aggaaacaacagcuu

SEQ ID NO: 3626552 - RNA, 19 nt, Human
aggaaacaguugcauguag

SEQ ID NO: 3626553 - RNA, 20 nt, Human
aggaaacaguugcauguagu

SEQ ID NO: 3626554 - RNA, 21 nt, Human
aggaaacaguugcauguagua

SEQ ID NO: 3626555 - RNA, 21 nt, Human
aggaaacccagcucuggucca

SEQ ID NO: 3626556 - RNA, 16 nt, Human
aggaaaccgccuaguu

SEQ ID NO: 3626557 - RNA, 21 nt, Human
aggaaacuacugccuuuagaa

SEQ ID NO: 3626558 - RNA, 17 nt, Human
aggaaacucaccugcug

SEQ ID NO: 3626559 - RNA, 16 nt, Human
aggaaacuccacaucu

SEQ ID NO: 3626560 - RNA, 21 nt, Human
aggaaacuccacaucugccuu

SEQ ID NO: 3626561 - RNA, 21 nt, Human
aggaaacucugcauucuagua

SEQ ID NO: 3626562 - RNA, 17 nt, Human
aggaaacucuuaucuca

SEQ ID NO: 3626563 - RNA, 22 nt, Human
aggaaacucuuaucucagucau

SEQ ID NO: 3626564 - RNA, 13 nt, Human
aggaaagaaaaca

SEQ ID NO: 3626565 - RNA, 16 nt, Human
aggaaagaagcauuuc

SEQ ID NO: 3626566 - RNA, 13 nt, Human
aggaaagagaacu

SEQ ID NO: 3626567 - RNA, 15 nt, Human
aggaaagauuuguac

SEQ ID NO: 3626568 - RNA, 22 nt, Human
aggaaagauuuuuguuguuauu

SEQ ID NO: 3626569 - RNA, 16 nt, Human
aggaaagcaauaaaug

SEQ ID NO: 3626570 - RNA, 13 nt, Human
aggaaagcacaga

SEQ ID NO: 3626571 - RNA, 20 nt, Human
aggaaagccccagcacuaac

SEQ ID NO: 3626572 - RNA, 22 nt, Human
aggaaagcuuuggcaguguuuu

SEQ ID NO: 3626573 - RNA, 15 nt, Human
aggaaaggccagcug

SEQ ID NO: 3626574 - RNA, 16 nt, Human
aggaaaggccagcugg

SEQ ID NO: 3626575 - RNA, 13 nt, Human
aggaaaggcucca

SEQ ID NO: 3626576 - RNA, 14 nt, Human
aggaaaggcuccag

SEQ ID NO: 3626577 - RNA, 18 nt, Human
aggaaaggcuccaggagc

SEQ ID NO: 3626578 - RNA, 14 nt, Human
aggaaagggaggag

SEQ ID NO: 3626579 - RNA, 21 nt, Human
aggaaagggggucccaguggg

SEQ ID NO: 3626580 - RNA, 17 nt, Human
aggaaaguacauuuuuu

SEQ ID NO: 3626581 - RNA, 23 nt, Human
aggaaagucauuggcuuuauccu

SEQ ID NO: 3626582 - RNA, 17 nt, Human
aggaaaguguuauuuuu

SEQ ID NO: 3626583 - RNA, 17 nt, Human
aggaaaguucagaguuu

SEQ ID NO: 3626584 - RNA, 21 nt, Human
aggaaaguuuacccaugaaga

SEQ ID NO: 3626585 - RNA, 17 nt, Human
aggaaauaaaaaagucu

SEQ ID NO: 3626586 - RNA, 21 nt, Human
aggaaauaaaaaagucucuau

SEQ ID NO: 3626587 - RNA, 14 nt, Human
aggaaauaaaaccu

SEQ ID NO: 3626588 - RNA, 18 nt, Human
aggaaauaagaaaaauca

SEQ ID NO: 3626589 - RNA, 15 nt, Human
aggaaauagaauuga

SEQ ID NO: 3626590 - RNA, 12 nt, Human
aggaaauauuua

SEQ ID NO: 3626591 - RNA, 13 nt, Human
aggaaauauuuau

SEQ ID NO: 3626592 - RNA, 14 nt, Human
aggaaauauuuauu

SEQ ID NO: 3626593 - RNA, 23 nt, Human
aggaaaucaaauaugcaaagcac

SEQ ID NO: 3626594 - RNA, 15 nt, Human
aggaaauccagggug

SEQ ID NO: 3626595 - RNA, 17 nt, Human
aggaaauccaggguggu

SEQ ID NO: 3626596 - RNA, 13 nt, Human
aggaaaucccuuc

SEQ ID NO: 3626597 - RNA, 16 nt, Human
aggaaaucccuucaua

SEQ ID NO: 3626598 - RNA, 22 nt, Human
aggaaaucuuguccagagacaa

SEQ ID NO: 3626599 - RNA, 19 nt, Human
aggaaaugaaaaugucuug

SEQ ID NO: 3626600 - RNA, 16 nt, Human
aggaaaugaauuucuc

SEQ ID NO: 3626601 - RNA, 20 nt, Human
aggaaauggcuguggagugu

SEQ ID NO: 3626602 - RNA, 23 nt, Human
aggaaaugucacagaagcagcua

SEQ ID NO: 3626603 - RNA, 13 nt, Human
aggaacaaggcaa

SEQ ID NO: 3626604 - RNA, 16 nt, Human
aggaacaaggcaaggc

SEQ ID NO: 3626605 - RNA, 23 nt, Human
aggaacaaggcaaggcugucaau

SEQ ID NO: 3626606 - RNA, 21 nt, Human
aggaacagaaggaugaaugag

SEQ ID NO: 3626607 - RNA, 21 nt, Human
aggaacagcuaugggagcccc

SEQ ID NO: 3626608 - RNA, 19 nt, Human
aggaacauaugaaaauaca

SEQ ID NO: 3626609 - RNA, 16 nt, Human
aggaacauugugucua

SEQ ID NO: 3626610 - RNA, 23 nt, Human
aggaaccauaguugacaguucca

SEQ ID NO: 3626611 - RNA, 22 nt, Human
aggaaccgugguaugucugcca

SEQ ID NO: 3626612 - RNA, 17 nt, Human
aggaaccucgaguacug

SEQ ID NO: 3626613 - RNA, 18 nt, Human
aggaaccucgaguacugu

SEQ ID NO: 3626614 - RNA, 20 nt, Human
aggaaccucgaguacugugg

SEQ ID NO: 3626615 - RNA, 14 nt, Human
aggaaccucugauu

SEQ ID NO: 3626616 - RNA, 17 nt, Human
aggaaccucugauuuau

SEQ ID NO: 3626617 - RNA, 14 nt, Human
aggaaccuuccuuc

SEQ ID NO: 3626618 - RNA, 22 nt, Human
aggaaccuuccuuccugcuuga

SEQ ID NO: 3626619 - RNA, 16 nt, Human
aggaacgguaaauuuc

SEQ ID NO: 3626620 - RNA, 22 nt, Human
aggaacguuuagcugacaaaau

SEQ ID NO: 3626621 - RNA, 23 nt, Human
aggaacucccagcaacacaagcu

SEQ ID NO: 3626622 - RNA, 13 nt, Human
aggaacucuggcu

SEQ ID NO: 3626623 - RNA, 16 nt, Human
aggaacucuggcuucc

SEQ ID NO: 3626624 - RNA, 21 nt, Human
aggaacucuggcuuccaggua

SEQ ID NO: 3626625 - RNA, 21 nt, Human
aggaacugcagcaaucuuuga

SEQ ID NO: 3626626 - RNA, 15 nt, Human
aggaacuguccagag

SEQ ID NO: 3626627 - RNA, 16 nt, Human
aggaacuguccagaga

SEQ ID NO: 3626628 - RNA, 21 nt, Human
aggaacuuaaauaaugugaaa

SEQ ID NO: 3626629 - RNA, 13 nt, Human
aggaacuucagag

SEQ ID NO: 3626630 - RNA, 15 nt, Human
aggaagaaagaaugu

SEQ ID NO: 3626631 - RNA, 13 nt, Human
aggaagaaaucac

SEQ ID NO: 3626632 - RNA, 15 nt, Human
aggaagaaaucacag

SEQ ID NO: 3626633 - RNA, 16 nt, Human
aggaagaaauuaacuu

SEQ ID NO: 3626634 - RNA, 19 nt, Human
aggaagaacugaaaggcuu

SEQ ID NO: 3626635 - RNA, 16 nt, Human
aggaagaagcuuaggc

SEQ ID NO: 3626636 - RNA, 13 nt, Human
aggaagacuucau

SEQ ID NO: 3626637 - RNA, 12 nt, Human
aggaagagaagg

SEQ ID NO: 3626638 - RNA, 14 nt, Human
aggaagagaaggag

SEQ ID NO: 3626639 - RNA, 12 nt, Human
aggaagagcagg

SEQ ID NO: 3626640 - RNA, 20 nt, Human
aggaagagcaggcacaugga

SEQ ID NO: 3626641 - RNA, 15 nt, Human
aggaagagccuucca

SEQ ID NO: 3626642 - RNA, 21 nt, Human
aggaagaucucugcagggccg

SEQ ID NO: 3626643 - RNA, 18 nt, Human
aggaagaucuuaaauuuu

SEQ ID NO: 3626644 - RNA, 17 nt, Human
aggaagcaagcuuaaug

SEQ ID NO: 3626645 - RNA, 23 nt, Human
aggaagcacaugccucucucagg

SEQ ID NO: 3626646 - RNA, 12 nt, Human
aggaagcagaau

SEQ ID NO: 3626647 - RNA, 16 nt, Human
aggaagcagaauaaag

SEQ ID NO: 3626648 - RNA, 18 nt, Human
aggaagcagaauaaagca

SEQ ID NO: 3626649 - RNA, 20 nt, Human
aggaagcagaauaaagcaau

SEQ ID NO: 3626650 - RNA, 23 nt, Human
aggaagcagaauaaagcaauuuu

SEQ ID NO: 3626651 - RNA, 18 nt, Human
aggaagcagcuuucccca

SEQ ID NO: 3626652 - RNA, 16 nt, Human
aggaagccaaauuuau

SEQ ID NO: 3626653 - RNA, 18 nt, Human
aggaagccacagcuggug

SEQ ID NO: 3626654 - RNA, 15 nt, Human
aggaagccagcaggc

SEQ ID NO: 3626655 - RNA, 18 nt, Human
aggaagccagcaggcucu

SEQ ID NO: 3626656 - RNA, 18 nt, Human
aggaagccgccaguacuu

SEQ ID NO: 3626657 - RNA, 22 nt, Human
aggaagccgccaguacuuguca

SEQ ID NO: 3626658 - RNA, 20 nt, Human
aggaagccgugcccugcccc

SEQ ID NO: 3626659 - RNA, 21 nt, Human
aggaagccugauuaaagaaug

SEQ ID NO: 3626660 - RNA, 19 nt, Human
aggaagccugcaguccugg

SEQ ID NO: 3626661 - RNA, 13 nt, Human
aggaagcucaggg

SEQ ID NO: 3626662 - RNA, 22 nt, Human
aggaagcucagggccuggcuca

SEQ ID NO: 3626663 - RNA, 16 nt, Human
aggaagcucucuuucc

SEQ ID NO: 3626664 - RNA, 17 nt, Human
aggaagcuuacaugccu

SEQ ID NO: 3626665 - RNA, 22 nt, Human
aggaagcuuucucugcuucagc

SEQ ID NO: 3626666 - RNA, 20 nt, Human
aggaaggaaacccagcucug

SEQ ID NO: 3626667 - RNA, 21 nt, Human
aggaaggagacucaccucugc

SEQ ID NO: 3626668 - RNA, 23 nt, Human
aggaaggagacucaccucugccu

SEQ ID NO: 3626669 - RNA, 21 nt, Human
aggaaggagagaaggggagga

SEQ ID NO: 3626670 - RNA, 17 nt, Human
aggaaggagagccugcu

SEQ ID NO: 3626671 - RNA, 15 nt, Human
aggaaggagaggaga

SEQ ID NO: 3626672 - RNA, 14 nt, Human
aggaaggagcugcc

SEQ ID NO: 3626673 - RNA, 22 nt, Human
aggaaggagcugccuggacccg

SEQ ID NO: 3626674 - RNA, 21 nt, Human
aggaaggaggacccaggacag

SEQ ID NO: 3626675 - RNA, 15 nt, Human
aggaaggauuguaaa

SEQ ID NO: 3626676 - RNA, 22 nt, Human
aggaaggcagggaggaggcaga

SEQ ID NO: 3626677 - RNA, 20 nt, Human
aggaaggcugucucagauaa

SEQ ID NO: 3626678 - RNA, 15 nt, Human
aggaaggcuuugaaa

SEQ ID NO: 3626679 - RNA, 16 nt, Human
aggaagggaccaaggc

SEQ ID NO: 3626680 - RNA, 20 nt, Human
aggaagggcauccuucugcc

SEQ ID NO: 3626681 - RNA, 20 nt, Human
aggaaggggccagaggcucg

SEQ ID NO: 3626682 - RNA, 17 nt, Human
aggaaggggcuggacug

SEQ ID NO: 3626683 - RNA, 23 nt, Human
aggaaggggcuggacuggcuguc

SEQ ID NO: 3626684 - RNA, 14 nt, Human
aggaagguaaaaag

SEQ ID NO: 3626685 - RNA, 15 nt, Human
aggaagguacuguau

SEQ ID NO: 3626686 - RNA, 14 nt, Human
aggaagguagaaau

SEQ ID NO: 3626687 - RNA, 16 nt, Human
aggaagguggauggcc

SEQ ID NO: 3626688 - RNA, 16 nt, Human
aggaagguucuggugu

SEQ ID NO: 3626689 - RNA, 22 nt, Human
aggaccuggggcacaguccagg

SEQ ID NO: 3626690 - RNA, 18 nt, Human
aggaccuguauuuaagca

SEQ ID NO: 3626691 - RNA, 16 nt, Human
aggaccuguggccaag

SEQ ID NO: 3626692 - RNA, 21 nt, Human
aggaccuguggccaaguucuu

SEQ ID NO: 3626693 - RNA, 17 nt, Human
aggaccuuaagacagag

SEQ ID NO: 3626694 - RNA, 16 nt, Human
aggaccuuaucugugc

SEQ ID NO: 3626695 - RNA, 18 nt, Human
aggaccuucgggcugugc

SEQ ID NO: 3626696 - RNA, 20 nt, Human
aggaccuucgggcugugccc

SEQ ID NO: 3626697 - RNA, 15 nt, Human
aggacgccacccagc

SEQ ID NO: 3626698 - RNA, 14 nt, Human
aggacgcucucugg

SEQ ID NO: 3626699 - RNA, 17 nt, Human
aggacgcucucuggccu

SEQ ID NO: 3626700 - RNA, 20 nt, Human
aggacgcuucacaggacagg

SEQ ID NO: 3626701 - RNA, 15 nt, Human
aggacgcuucugaau

SEQ ID NO: 3626702 - RNA, 20 nt, Human
aggacgugggcggcagagag

SEQ ID NO: 3626703 - RNA, 15 nt, Human
aggacgugggcuggg

SEQ ID NO: 3626704 - RNA, 17 nt, Human
aggacuaacacucagaa

SEQ ID NO: 3626705 - RNA, 17 nt, Human
aggacuaauagaaaagu

SEQ ID NO: 3626706 - RNA, 13 nt, Human
aggacucagcucc

SEQ ID NO: 3626707 - RNA, 17 nt, Human
aggacuccacccauccu

SEQ ID NO: 3626708 - RNA, 14 nt, Human
aggacuccaggcag

SEQ ID NO: 3626709 - RNA, 18 nt, Human
aggacuccccaggccagg

SEQ ID NO: 3626710 - RNA, 20 nt, Human
aggacuccccaggccaggcc

SEQ ID NO: 3626711 - RNA, 17 nt, Human
aggacucccuccucacc

SEQ ID NO: 3626712 - RNA, 17 nt, Human
aggacuccuuaaauuug

SEQ ID NO: 3626713 - RNA, 14 nt, Human
aggacucgcuugua

SEQ ID NO: 3626714 - RNA, 12 nt, Human
aggacucucagg

SEQ ID NO: 3626715 - RNA, 13 nt, Human
aggacucugcagc

SEQ ID NO: 3626716 - RNA, 19 nt, Human
aggacucugcagccucaga

SEQ ID NO: 3626717 - RNA, 18 nt, Human
aggacucugcccagacca

SEQ ID NO: 3626718 - RNA, 17 nt, Human
aggacucugccuccucu

SEQ ID NO: 3626719 - RNA, 18 nt, Human
aggacucugccuccucuu

SEQ ID NO: 3626720 - RNA, 17 nt, Human
aggacugaauugucccc

SEQ ID NO: 3626721 - RNA, 19 nt, Human
aggacugaauuguccccag

SEQ ID NO: 3626722 - RNA, 15 nt, Human
aggacugacugaggc

SEQ ID NO: 3626723 - RNA, 16 nt, Human
aggacugacugaggca

SEQ ID NO: 3626724 - RNA, 18 nt, Human
aggacugacugaggcagu

SEQ ID NO: 3626725 - RNA, 19 nt, Human
aggacugagcacccucugg

SEQ ID NO: 3626726 - RNA, 16 nt, Human
aggacugagccccgca

SEQ ID NO: 3626727 - RNA, 12 nt, Human
aggacugaggga

SEQ ID NO: 3626728 - RNA, 18 nt, Human
aggacugagggacucuga

SEQ ID NO: 3626729 - RNA, 16 nt, Human
aggacugaugucuccu

SEQ ID NO: 3626730 - RNA, 20 nt, Human
aggacugaugucuccuaagc

SEQ ID NO: 3626731 - RNA, 23 nt, Human
aggacugcacagcguccugucca

SEQ ID NO: 3626732 - RNA, 12 nt, Human
aggacugcacca

SEQ ID NO: 3626733 - RNA, 21 nt, Human
aggacugcaugguaauuuaua

SEQ ID NO: 3626734 - RNA, 13 nt, Human
aggacugccgacc

SEQ ID NO: 3626735 - RNA, 17 nt, Human
aggacugccgaccgagg

SEQ ID NO: 3626736 - RNA, 20 nt, Human
aggacugcugguuuguaguu

SEQ ID NO: 3626737 - RNA, 16 nt, Human
aggacugggagccccc

SEQ ID NO: 3626738 - RNA, 20 nt, Human
aggacugggagcccccagcc

SEQ ID NO: 3626739 - RNA, 23 nt, Human
aggacuguccccuugaaggagaa

SEQ ID NO: 3626740 - RNA, 20 nt, Human
aggacugugacaggcagcag

SEQ ID NO: 3626741 - RNA, 15 nt, Human
aggacuguuucaaac

SEQ ID NO: 3626742 - RNA, 18 nt, Human
aggacuguuuuuuccuga

SEQ ID NO: 3626743 - RNA, 19 nt, Human
aggacuuauuuaaacucug

SEQ ID NO: 3626744 - RNA, 16 nt, Human
aggacuugaaagaaau

SEQ ID NO: 3626745 - RNA, 17 nt, Human
aggacuuguuagaucua

SEQ ID NO: 3626746 - RNA, 22 nt, Human
aggacuuugauugcacauuguu

SEQ ID NO: 3626747 - RNA, 15 nt, Human
aggacuuuguacauu

SEQ ID NO: 3626748 - RNA, 17 nt, Human
aggacuuuucuuugugg

SEQ ID NO: 3626749 - RNA, 13 nt, Human
aggagaaaaacaa

SEQ ID NO: 3626750 - RNA, 13 nt, Human
aggagaaacacau

SEQ ID NO: 3626751 - RNA, 12 nt, Human
aggagaaaugca

SEQ ID NO: 3626752 - RNA, 16 nt, Human
aggagaaaugcaucca

SEQ ID NO: 3626753 - RNA, 16 nt, Human
aggagaaccaaaucug

SEQ ID NO: 3626754 - RNA, 22 nt, Human
aggagaaccaaaucuggaagcc

SEQ ID NO: 3626755 - RNA, 17 nt, Human
aggagaacuugcugccu

SEQ ID NO: 3626756 - RNA, 15 nt, Human
aggagaagcucagcu

SEQ ID NO: 3626757 - RNA, 14 nt, Human
aggagaagcugcau

SEQ ID NO: 3626758 - RNA, 16 nt, Human
aggagaaggaaggaga

SEQ ID NO: 3626759 - RNA, 22 nt, Human
aggagaagucuucuauuuauuu

SEQ ID NO: 3626760 - RNA, 23 nt, Human
aggagaagucuucuauuuauuua

SEQ ID NO: 3626761 - RNA, 20 nt, Human
aggagaauagccugaaccug

SEQ ID NO: 3626762 - RNA, 17 nt, Human
aggagaaucauguuucu

SEQ ID NO: 3626763 - RNA, 19 nt, Human
aggagaaucauguuucuuu

SEQ ID NO: 3626764 - RNA, 23 nt, Human
aggagaauuaaguccuacuuuua

SEQ ID NO: 3626765 - RNA, 13 nt, Human
aggagaauugcuu

SEQ ID NO: 3626766 - RNA, 13 nt, Human
aggagacaaaaga

SEQ ID NO: 3626767 - RNA, 12 nt, Human
aggagacacaga

SEQ ID NO: 3626768 - RNA, 13 nt, Human
aggagacacagau

SEQ ID NO: 3626769 - RNA, 21 nt, Human
aggagaccuggcacuggaugc

SEQ ID NO: 3626770 - RNA, 11 nt, Human
aggagacucac

SEQ ID NO: 3626771 - RNA, 16 nt, Human
aggagacucaccucug

SEQ ID NO: 3626772 - RNA, 17 nt, Human
aggagacucaccucugc

SEQ ID NO: 3626773 - RNA, 18 nt, Human
aggagacucaccucugcc

SEQ ID NO: 3626774 - RNA, 20 nt, Human
aggagacuguggagacugcu

SEQ ID NO: 3626775 - RNA, 15 nt, Human
aggagagaaaauaua

SEQ ID NO: 3626776 - RNA, 13 nt, Human
aggagagaagaau

SEQ ID NO: 3626777 - RNA, 20 nt, Human
aggagagacucccaugaagc

SEQ ID NO: 3626778 - RNA, 19 nt, Human
aggagagagaaagccaggc

SEQ ID NO: 3626779 - RNA, 22 nt, Human
aggagagagaaagccaggcagg

SEQ ID NO: 3626780 - RNA, 18 nt, Human
aggagagagaucaugaga

SEQ ID NO: 3626781 - RNA, 17 nt, Human
aggagagagcagcuucu

SEQ ID NO: 3626782 - RNA, 18 nt, Human
aggagagaggcagagagc

SEQ ID NO: 3626783 - RNA, 17 nt, Human
aggagagauagccugug

SEQ ID NO: 3626784 - RNA, 20 nt, Human
aggagagauagccuguggcc

SEQ ID NO: 3626785 - RNA, 17 nt, Human
aggagagauuauuuaca

SEQ ID NO: 3626786 - RNA, 21 nt, Human
aggagagccagagaagugaca

SEQ ID NO: 3626787 - RNA, 12 nt, Human
aggagagccugg

SEQ ID NO: 3626788 - RNA, 15 nt, Human
aggagagcuagcagc

SEQ ID NO: 3626789 - RNA, 15 nt, Human
aggagaggaaaagua

SEQ ID NO: 3626790 - RNA, 20 nt, Human
aggagaggaaaaguaaggug

SEQ ID NO: 3626791 - RNA, 18 nt, Human
aggagaggagagaggcag

SEQ ID NO: 3626792 - RNA, 19 nt, Human
aggagaggagagccagaga

SEQ ID NO: 3626793 - RNA, 17 nt, Human
aggagaggaugagagcc

SEQ ID NO: 3626794 - RNA, 20 nt, Human
aggagaggcaacauccaaaa

SEQ ID NO: 3626795 - RNA, 22 nt, Human
aggagaggggaagggccagucu

SEQ ID NO: 3626796 - RNA, 18 nt, Human
aggagaggggcagaacag

SEQ ID NO: 3626797 - RNA, 17 nt, Human
aggagagucacagaaca

SEQ ID NO: 3626798 - RNA, 17 nt, Human
aggagagucuugcagug

SEQ ID NO: 3626799 - RNA, 21 nt, Human
aggagauaaaucuaguauaca

SEQ ID NO: 3626800 - RNA, 14 nt, Human
aggagauaucugag

SEQ ID NO: 3626801 - RNA, 23 nt, Human
aggagauaucugagggaggaggc

SEQ ID NO: 3626802 - RNA, 15 nt, Human
aggagaucagaaaaa

SEQ ID NO: 3626803 - RNA, 20 nt, Human
aggagauggaaguugcagug

SEQ ID NO: 3626804 - RNA, 17 nt, Human
aggagauggggacaggg

SEQ ID NO: 3626805 - RNA, 16 nt, Human
aggagauugagaagga

SEQ ID NO: 3626806 - RNA, 17 nt, Human
aggagauugagaaggag

SEQ ID NO: 3626807 - RNA, 13 nt, Human
aggagcaaagccu

SEQ ID NO: 3626808 - RNA, 15 nt, Human
aggagcaaagccugu

SEQ ID NO: 3626809 - RNA, 15 nt, Human
aggagcacggcucug

SEQ ID NO: 3626810 - RNA, 17 nt, Human
aggagcacuuccaaaau

SEQ ID NO: 3626811 - RNA, 13 nt, Human
aggagcagcauug

SEQ ID NO: 3626812 - RNA, 14 nt, Human
aggagcagccacau

SEQ ID NO: 3626813 - RNA, 19 nt, Human
aggagcagccucagaacaa

SEQ ID NO: 3626814 - RNA, 19 nt, Human
aggagcaggagccugagcc

SEQ ID NO: 3626815 - RNA, 20 nt, Human
aggagcaggggcguggaggg

SEQ ID NO: 3626816 - RNA, 14 nt, Human
aggagcagugcagg

SEQ ID NO: 3626817 - RNA, 16 nt, Human
aggagcauccaccucc

SEQ ID NO: 3626818 - RNA, 21 nt, Human
aggagcauuuggagagaaggc

SEQ ID NO: 3626819 - RNA, 18 nt, Human
aggagcauuuuuuaaaaa

SEQ ID NO: 3626820 - RNA, 23 nt, Human
aggagccaguuugccggauacaa

SEQ ID NO: 3626821 - RNA, 20 nt, Human
aggagcccacgacacugcag

SEQ ID NO: 3626822 - RNA, 14 nt, Human
aggagcccaggcca

SEQ ID NO: 3626823 - RNA, 19 nt, Human
aggagcccaggccaggacu

SEQ ID NO: 3626824 - RNA, 19 nt, Human
aggagccccauuccuggga

SEQ ID NO: 3626825 - RNA, 21 nt, Human
aggagccccauuccugggaaa

SEQ ID NO: 3626826 - RNA, 22 nt, Human
aggagcccccacccuguuccug

SEQ ID NO: 3626827 - RNA, 23 nt, Human
aggagcccugggaggcucuggag

SEQ ID NO: 3626828 - RNA, 23 nt, Human
aggagcccuuaucugugcucagg

SEQ ID NO: 3626829 - RNA, 15 nt, Human
aggagccuaggccag

SEQ ID NO: 3626830 - RNA, 17 nt, Human
aggagccuauggcaucu

SEQ ID NO: 3626831 - RNA, 17 nt, Human
aggagccuccugcccuu

SEQ ID NO: 3626832 - RNA, 11 nt, Human
aggagccuggc

SEQ ID NO: 3626833 - RNA, 17 nt, Human
aggagccuguccugccu

SEQ ID NO: 3626834 - RNA, 21 nt, Human
aggcacugcccugguggcccu

SEQ ID NO: 3626835 - RNA, 13 nt, Human
aggcacugccuga

SEQ ID NO: 3626836 - RNA, 22 nt, Human
aggcacugcugcccagccucca

SEQ ID NO: 3626837 - RNA, 16 nt, Human
aggcacugggcaugag

SEQ ID NO: 3626838 - RNA, 16 nt, Human
aggcacuguaguucua

SEQ ID NO: 3626839 - RNA, 16 nt, Human
aggcacuuaagcacaa

SEQ ID NO: 3626840 - RNA, 17 nt, Human
aggcacuucauguaaag

SEQ ID NO: 3626841 - RNA, 20 nt, Human
aggcacuuuagggcuguaaa

SEQ ID NO: 3626842 - RNA, 14 nt, Human
aggcacuuuggggg

SEQ ID NO: 3626843 - RNA, 16 nt, Human
aggcagaaagcaaaau

SEQ ID NO: 3626844 - RNA, 16 nt, Human
aggcagaaagcagagg

SEQ ID NO: 3626845 - RNA, 17 nt, Human
aggcagaaagcagaggc

SEQ ID NO: 3626846 - RNA, 18 nt, Human
aggcagaaagcagaggcu

SEQ ID NO: 3626847 - RNA, 21 nt, Human
aggcagaaagcagaggcuggc

SEQ ID NO: 3626848 - RNA, 21 nt, Human
aggcagaagaauugaacccag

SEQ ID NO: 3626849 - RNA, 23 nt, Human
aggcagaagaauugaacccagga

SEQ ID NO: 3626850 - RNA, 17 nt, Human
aggcagaaggaagcagg

SEQ ID NO: 3626851 - RNA, 18 nt, Human
aggcagacacggaucuga

SEQ ID NO: 3626852 - RNA, 20 nt, Human
aggcagacagcagcucaggc

SEQ ID NO: 3626853 - RNA, 21 nt, Human
aggcagacagcagcucaggca

SEQ ID NO: 3626854 - RNA, 9 nt, Human
aggcagaga

SEQ ID NO: 3626855 - RNA, 17 nt, Human
aggcagagaaagaagag

SEQ ID NO: 3626856 - RNA, 18 nt, Human
aggcagagaaagaagaga

SEQ ID NO: 3626857 - RNA, 21 nt, Human
aggcagagaaagaagagacag

SEQ ID NO: 3626858 - RNA, 13 nt, Human
aggcagagaagaa

SEQ ID NO: 3626859 - RNA, 15 nt, Human
aggcagagaagaaag

SEQ ID NO: 3626860 - RNA, 13 nt, Human
aggcagagagcgg

SEQ ID NO: 3626861 - RNA, 17 nt, Human
aggcagaggcccaggcu

SEQ ID NO: 3626862 - RNA, 20 nt, Human
aggcagaggcccaggcugcc

SEQ ID NO: 3626863 - RNA, 14 nt, Human
aggcagaggccugg

SEQ ID NO: 3626864 - RNA, 17 nt, Human
aggcagaggccugggcu

SEQ ID NO: 3626865 - RNA, 18 nt, Human
aggcagaggccugggcug

SEQ ID NO: 3626866 - RNA, 22 nt, Human
aggcagaggccugggcugggaa

SEQ ID NO: 3626867 - RNA, 17 nt, Human
aggcagagugccccacc

SEQ ID NO: 3626868 - RNA, 19 nt, Human
aggcagagugccccaccug

SEQ ID NO: 3626869 - RNA, 11 nt, Human
aggcagaucca

SEQ ID NO: 3626870 - RNA, 17 nt, Human
aggcagauccaggacua

SEQ ID NO: 3626871 - RNA, 21 nt, Human
aggcagaucugugccccaugc

SEQ ID NO: 3626872 - RNA, 22 nt, Human
aggcagaucugugccccaugcc

SEQ ID NO: 3626873 - RNA, 15 nt, Human
aggcagauugaaaag

SEQ ID NO: 3626874 - RNA, 15 nt, Human
aggcagcaaggcccg

SEQ ID NO: 3626875 - RNA, 17 nt, Human
aggcagcaaggcccgag

SEQ ID NO: 3626876 - RNA, 15 nt, Human
aggcagcagacacau

SEQ ID NO: 3626877 - RNA, 19 nt, Human
aggcagccaaccuaagcaa

SEQ ID NO: 3626878 - RNA, 15 nt, Human
aggcagccagcaucu

SEQ ID NO: 3626879 - RNA, 20 nt, Human
aggcagccagcaucugggcc

SEQ ID NO: 3626880 - RNA, 15 nt, Human
aggcagccaggccac

SEQ ID NO: 3626881 - RNA, 18 nt, Human
aggcagccaggccacaag

SEQ ID NO: 3626882 - RNA, 15 nt, Human
aggcagccagugaga

SEQ ID NO: 3626883 - RNA, 15 nt, Human
aggcagcccaggaag

SEQ ID NO: 3626884 - RNA, 17 nt, Human
aggcagcccaggaaguc

SEQ ID NO: 3626885 - RNA, 21 nt, Human
aggcagcccaggaagucucau

SEQ ID NO: 3626886 - RNA, 14 nt, Human
aggcagccucuggg

SEQ ID NO: 3626887 - RNA, 19 nt, Human
aggcagcgccaagugcgug

SEQ ID NO: 3626888 - RNA, 21 nt, Human
aggcagcgccaagugcgugcc

SEQ ID NO: 3626889 - RNA, 20 nt, Human
aggcagcucuaaaugucaau

SEQ ID NO: 3626890 - RNA, 22 nt, Human
aggcagcuggaugagacuucca

SEQ ID NO: 3626891 - RNA, 13 nt, Human
aggcagcuguugu

SEQ ID NO: 3626892 - RNA, 20 nt, Human
aggcagcuguugucucuucu

SEQ ID NO: 3626893 - RNA, 15 nt, Human
aggcagcuugaaacu

SEQ ID NO: 3626894 - RNA, 22 nt, Human
aggcagcuuuaaccauuaaaac

SEQ ID NO: 3626895 - RNA, 23 nt, Human
aggcaggacaugcugaagccaaa

SEQ ID NO: 3626896 - RNA, 21 nt, Human
aggcaggaccuucgggcugug

SEQ ID NO: 3626897 - RNA, 22 nt, Human
aggcaggaccuucgggcugugc

SEQ ID NO: 3626898 - RNA, 17 nt, Human
aggcaggagaaucacuu

SEQ ID NO: 3626899 - RNA, 18 nt, Human
aggcaggagaauggugug

SEQ ID NO: 3626900 - RNA, 18 nt, Human
aggcaggagacuggcgug

SEQ ID NO: 3626901 - RNA, 15 nt, Human
aggcaggagagacag

SEQ ID NO: 3626902 - RNA, 12 nt, Human
aggcaggauggc

SEQ ID NO: 3626903 - RNA, 14 nt, Human
aggcaggauugaaa

SEQ ID NO: 3626904 - RNA, 22 nt, Human
aggcaggauugaaaauguccag

SEQ ID NO: 3626905 - RNA, 16 nt, Human
aggcaggauuggggaa

SEQ ID NO: 3626906 - RNA, 20 nt, Human
aggcaggauuggggaagaga

SEQ ID NO: 3626907 - RNA, 13 nt, Human
aggcaggcagggc

SEQ ID NO: 3626908 - RNA, 18 nt, Human
aggcaggcagggcucucc

SEQ ID NO: 3626909 - RNA, 15 nt, Human
aggcaggcauggccc

SEQ ID NO: 3626910 - RNA, 21 nt, Human
aggcaggccaaggccuucucc

SEQ ID NO: 3626911 - RNA, 22 nt, Human
aggcaggccaaggccuucuccu

SEQ ID NO: 3626912 - RNA, 15 nt, Human
aggcaggcucccagg

SEQ ID NO: 3626913 - RNA, 12 nt, Human
aggcagggaagu

SEQ ID NO: 3626914 - RNA, 21 nt, Human
aggcagggaaguguaagaaac

SEQ ID NO: 3626915 - RNA, 22 nt, Human
aggcagggaggaggcagagaag

SEQ ID NO: 3626916 - RNA, 16 nt, Human
aggcagggaggggacu

SEQ ID NO: 3626917 - RNA, 16 nt, Human
aggcagggauuugagg

SEQ ID NO: 3626918 - RNA, 18 nt, Human
aggcagggcaaaugacau

SEQ ID NO: 3626919 - RNA, 17 nt, Human
aggcagggcucuccugg

SEQ ID NO: 3626920 - RNA, 18 nt, Human
aggcagggcucuccuggc

SEQ ID NO: 3626921 - RNA, 23 nt, Human
aggcagggcucuccuggcuuccc

SEQ ID NO: 3626922 - RNA, 16 nt, Human
aggcaggggaauguau

SEQ ID NO: 3626923 - RNA, 17 nt, Human
aggcaggggcccugcag

SEQ ID NO: 3626924 - RNA, 16 nt, Human
aggcaggggcuuccug

SEQ ID NO: 3626925 - RNA, 15 nt, Human
aggcagggguggggg

SEQ ID NO: 3626926 - RNA, 19 nt, Human
aggcaggggugggggugga

SEQ ID NO: 3626927 - RNA, 20 nt, Human
aggcagggguggggguggag

SEQ ID NO: 3626928 - RNA, 23 nt, Human
aggcagggucaggagaggggcag

SEQ ID NO: 3626929 - RNA, 21 nt, Human
aggcagggucucacucugucg

SEQ ID NO: 3626930 - RNA, 15 nt, Human
aggcagggugucugc

SEQ ID NO: 3626931 - RNA, 19 nt, Human
aggcagggugucugccccc

SEQ ID NO: 3626932 - RNA, 22 nt, Human
aggcaggucuugaacuccuggc

SEQ ID NO: 3626933 - RNA, 18 nt, Human
aggcaggugaauuguuug

SEQ ID NO: 3626934 - RNA, 20 nt, Human
aggcaggugaucugcugcag

SEQ ID NO: 3626935 - RNA, 21 nt, Human
aggcaggugccuccaggugug

SEQ ID NO: 3626936 - RNA, 19 nt, Human
aggcaguaauaaaaagauu

SEQ ID NO: 3626937 - RNA, 19 nt, Human
aggcaguauuuuguguccu

SEQ ID NO: 3626938 - RNA, 21 nt, Human
aggcaguauuuuguguccucc

SEQ ID NO: 3626939 - RNA, 18 nt, Human
aggcagucgggggcuggc

SEQ ID NO: 3626940 - RNA, 21 nt, Human
aggcagucgggggcuggccua

SEQ ID NO: 3626941 - RNA, 22 nt, Human
aggcagugcaagagacucuggc

SEQ ID NO: 3626942 - RNA, 13 nt, Human
aggcagugucauu

SEQ ID NO: 3626943 - RNA, 19 nt, Human
aggcagugucauuugcucu

SEQ ID NO: 3626944 - RNA, 21 nt, Human
aggcaguuaccauuaaaccau

SEQ ID NO: 3626945 - RNA, 22 nt, Human
aggcaguuaccauuaaaccauc

SEQ ID NO: 3626946 - RNA, 23 nt, Human
aggcaguuaccauuaaaccaucu

SEQ ID NO: 3626947 - RNA, 17 nt, Human
aggcaguugcccagccu

SEQ ID NO: 3626948 - RNA, 20 nt, Human
aggcaguuugaggauuaguu

SEQ ID NO: 3626949 - RNA, 12 nt, Human
aggcaguuuucu

SEQ ID NO: 3626950 - RNA, 13 nt, Human
aggcaguuuucua

SEQ ID NO: 3626951 - RNA, 15 nt, Human
aggcauaaagucagg

SEQ ID NO: 3626952 - RNA, 15 nt, Human
aggcauagaggcuuc

SEQ ID NO: 3626953 - RNA, 13 nt, Human
aggcauaggccug

SEQ ID NO: 3626954 - RNA, 15 nt, Human
aggcauaggccuggg

SEQ ID NO: 3626955 - RNA, 20 nt, Human
aggcauaucagucucugagg

SEQ ID NO: 3626956 - RNA, 18 nt, Human
aggcauaucaugcuuuga

SEQ ID NO: 3626957 - RNA, 20 nt, Human
aggcaucagucccuauguau

SEQ ID NO: 3626958 - RNA, 17 nt, Human
aggcaucccaggggacc

SEQ ID NO: 3626959 - RNA, 18 nt, Human
aggcaucccaggggacca

SEQ ID NO: 3626960 - RNA, 18 nt, Human
aggcauccuuccucacac

SEQ ID NO: 3626961 - RNA, 23 nt, Human
aggcaucgucaugcacaguauuu

SEQ ID NO: 3626962 - RNA, 14 nt, Human
aggcaucugagggg

SEQ ID NO: 3626963 - RNA, 16 nt, Human
aggcaucugauuugca

SEQ ID NO: 3626964 - RNA, 14 nt, Human
aggcaucugcaccc

SEQ ID NO: 3626965 - RNA, 19 nt, Human
aggcaucugugggcauggu

SEQ ID NO: 3626966 - RNA, 23 nt, Human
aggcaugagggaucacagggccc

SEQ ID NO: 3626967 - RNA, 13 nt, Human
aggcaugccugug

SEQ ID NO: 3626968 - RNA, 19 nt, Human
aggcauggaugaauaaaug

SEQ ID NO: 3626969 - RNA, 15 nt, Human
aggcauggcccuggg

SEQ ID NO: 3626970 - RNA, 16 nt, Human
aggcaugggcuugcug

SEQ ID NO: 3626971 - RNA, 21 nt, Human
aggcaugggggguggggggag

SEQ ID NO: 3626972 - RNA, 12 nt, Human
aggcauggugga

SEQ ID NO: 3626973 - RNA, 17 nt, Human
aggcauguaggacccug

SEQ ID NO: 3626974 - RNA, 24 nt, Human
aggcaugugaugagaggaaaucac

SEQ ID NO: 3626975 - RNA, 12 nt, Human
aggcauguucuc

SEQ ID NO: 3626976 - RNA, 19 nt, Human
aggcauguucucugaggac

SEQ ID NO: 3626977 - RNA, 22 nt, Human
aggcauuaaauuuuagcaaaga

SEQ ID NO: 3626978 - RNA, 14 nt, Human
aggucaacagagaa

SEQ ID NO: 3626979 - RNA, 21 nt, Human
aggucaacagagaaggcagga

SEQ ID NO: 3626980 - RNA, 19 nt, Human
aggucaagaagaagaugga

SEQ ID NO: 3626981 - RNA, 16 nt, Human
aggucaagcccaggag

SEQ ID NO: 3626982 - RNA, 18 nt, Human
aggucaaguaagaagaca

SEQ ID NO: 3626983 - RNA, 19 nt, Human
aggucaaguaagaagacau

SEQ ID NO: 3626984 - RNA, 16 nt, Human
aggucaaguugucagg

SEQ ID NO: 3626985 - RNA, 18 nt, Human
aggucaauacaguacagg

SEQ ID NO: 3626986 - RNA, 22 nt, Human
aggucaauacaguacaggcagc

SEQ ID NO: 3626987 - RNA, 15 nt, Human
aggucacauucagga

SEQ ID NO: 3626988 - RNA, 18 nt, Human
aggucacauucaggaaga

SEQ ID NO: 3626989 - RNA, 18 nt, Human
aggucaccucacucagca

SEQ ID NO: 3626990 - RNA, 19 nt, Human
aggucaccucacucagcac

SEQ ID NO: 3626991 - RNA, 21 nt, Human
aggucaccucacucagcacca

SEQ ID NO: 3626992 - RNA, 18 nt, Human
aggucaccuuuauucugg

SEQ ID NO: 3626993 - RNA, 19 nt, Human
aggucacuagauggcgagc

SEQ ID NO: 3626994 - RNA, 18 nt, Human
aggucacuccuggggccu

SEQ ID NO: 3626995 - RNA, 21 nt, Human
aggucacuggaaaggggagag

SEQ ID NO: 3626996 - RNA, 15 nt, Human
aggucacuggcucuc

SEQ ID NO: 3626997 - RNA, 14 nt, Human
aggucacuguuucc

SEQ ID NO: 3626998 - RNA, 16 nt, Human
aggucagcaugucuau

SEQ ID NO: 3626999 - RNA, 15 nt, Human
aggucagccacuguu

SEQ ID NO: 3627000 - RNA, 18 nt, Human
aggucagcuugcugcccu

SEQ ID NO: 3627001 - RNA, 19 nt, Human
aggucaggaguuagaggcc

SEQ ID NO: 3627002 - RNA, 20 nt, Human
aggucaggaguuccuaacca

SEQ ID NO: 3627003 - RNA, 16 nt, Human
aggucaggcccuggaa

SEQ ID NO: 3627004 - RNA, 20 nt, Human
aggucagggagugcuggcuc

SEQ ID NO: 3627005 - RNA, 17 nt, Human
aggucaguacccaccug

SEQ ID NO: 3627006 - RNA, 18 nt, Human
aggucaguacccaccuga

SEQ ID NO: 3627007 - RNA, 19 nt, Human
aggucaguacccaccugag

SEQ ID NO: 3627008 - RNA, 19 nt, Human
aggucaguuguguuuuuua

SEQ ID NO: 3627009 - RNA, 20 nt, Human
aggucauacaauccauucuu

SEQ ID NO: 3627010 - RNA, 19 nt, Human
aggucauauuaauauauuu

SEQ ID NO: 3627011 - RNA, 18 nt, Human
aggucauggaauggaaac

SEQ ID NO: 3627012 - RNA, 21 nt, Human
aggucauuuccauguaugcau

SEQ ID NO: 3627013 - RNA, 14 nt, Human
aggucauuucuuca

SEQ ID NO: 3627014 - RNA, 15 nt, Human
agguccaaugagcuu

SEQ ID NO: 3627015 - RNA, 20 nt, Human
agguccaaugagcuuucuga

SEQ ID NO: 3627016 - RNA, 24 nt, Human
agguccaauucucgagcuuggggc

SEQ ID NO: 3627017 - RNA, 19 nt, Human
agguccagagagaccgagg

SEQ ID NO: 3627018 - RNA, 18 nt, Human
agguccagcccuggcuga

SEQ ID NO: 3627019 - RNA, 22 nt, Human
agguccagcccuggcugaagga

SEQ ID NO: 3627020 - RNA, 15 nt, Human
agguccagcucugga

SEQ ID NO: 3627021 - RNA, 18 nt, Human
agguccagcucuggaggg

SEQ ID NO: 3627022 - RNA, 23 nt, Human
agguccagcucuggaggggaggg

SEQ ID NO: 3627023 - RNA, 16 nt, Human
aggucccaccuccagc

SEQ ID NO: 3627024 - RNA, 13 nt, Human
aggucccaggcag

SEQ ID NO: 3627025 - RNA, 16 nt, Human
aggucccuaauaaagc

SEQ ID NO: 3627026 - RNA, 18 nt, Human
aggucccuaauaaagcug

SEQ ID NO: 3627027 - RNA, 19 nt, Human
aggucccuaauaaagcugu

SEQ ID NO: 3627028 - RNA, 20 nt, Human
aggucccuaauaaagcugug

SEQ ID NO: 3627029 - RNA, 14 nt, Human
aggucccuuguuuc

SEQ ID NO: 3627030 - RNA, 19 nt, Human
aggucccuuucauuugcua

SEQ ID NO: 3627031 - RNA, 15 nt, Human
agguccucagagaau

SEQ ID NO: 3627032 - RNA, 20 nt, Human
agguccucugauacccagag

SEQ ID NO: 3627033 - RNA, 14 nt, Human
agguccucugucag

SEQ ID NO: 3627034 - RNA, 22 nt, Human
agguccugagcacugccaggag

SEQ ID NO: 3627035 - RNA, 17 nt, Human
agguccugguggggcag

SEQ ID NO: 3627036 - RNA, 19 nt, Human
agguccugugaucuuauuu

SEQ ID NO: 3627037 - RNA, 20 nt, Human
agguccuuaggccucugaga

SEQ ID NO: 3627038 - RNA, 16 nt, Human
agguccuucugcugga

SEQ ID NO: 3627039 - RNA, 17 nt, Human
agguccuugcccuuugu

SEQ ID NO: 3627040 - RNA, 21 nt, Human
aggucgaccccaaagccccuu

SEQ ID NO: 3627041 - RNA, 14 nt, Human
aggucgaggcagga

SEQ ID NO: 3627042 - RNA, 22 nt, Human
aggucgguagguucagccaagg

SEQ ID NO: 3627043 - RNA, 21 nt, Human
aggucguuuuaaaaacaaaaa

SEQ ID NO: 3627044 - RNA, 11 nt, Human
aggucuagccu

SEQ ID NO: 3627045 - RNA, 14 nt, Human
aggucuauuuggau

SEQ ID NO: 3627046 - RNA, 13 nt, Human
aggucucagcccc

SEQ ID NO: 3627047 - RNA, 21 nt, Human
aggucuccaguuggcuuuacu

SEQ ID NO: 3627048 - RNA, 17 nt, Human
aggucucccacguggga

SEQ ID NO: 3627049 - RNA, 21 nt, Human
aggucuccccaugugccugca

SEQ ID NO: 3627050 - RNA, 14 nt, Human
aggucuccucuuaa

SEQ ID NO: 3627051 - RNA, 15 nt, Human
aggucuccucuuaaa

SEQ ID NO: 3627052 - RNA, 17 nt, Human
aggucucgcugaugcug

SEQ ID NO: 3627053 - RNA, 21 nt, Human
aggucucggacuaagccuacc

SEQ ID NO: 3627054 - RNA, 15 nt, Human
aggucucucuuugga

SEQ ID NO: 3627055 - RNA, 15 nt, Human
aggucucugccggcu

SEQ ID NO: 3627056 - RNA, 19 nt, Human
aggucucugccggcucuuu

SEQ ID NO: 3627057 - RNA, 15 nt, Human
aggucucuuccccuc

SEQ ID NO: 3627058 - RNA, 22 nt, Human
aggucucuucucccagaauccc

SEQ ID NO: 3627059 - RNA, 13 nt, Human
aggucugaaaugg

SEQ ID NO: 3627060 - RNA, 15 nt, Human
aggucugaaauggag

SEQ ID NO: 3627061 - RNA, 21 nt, Human
aggucugaaauggagguccuu

SEQ ID NO: 3627062 - RNA, 13 nt, Human
aggucugaaauuu

SEQ ID NO: 3627063 - RNA, 23 nt, Human
aggucuggagaagcucccaggaa

SEQ ID NO: 3627064 - RNA, 16 nt, Human
aggucugggagaggca

SEQ ID NO: 3627065 - RNA, 18 nt, Human
aggucugggagaggcaga

SEQ ID NO: 3627066 - RNA, 21 nt, Human
aggucugggagaggcagagug

SEQ ID NO: 3627067 - RNA, 11 nt, Human
aggucugugcu

SEQ ID NO: 3627068 - RNA, 18 nt, Human
aggucuguucuuuccaaa

SEQ ID NO: 3627069 - RNA, 18 nt, Human
aggucuugaacuccuggc

SEQ ID NO: 3627070 - RNA, 23 nt, Human
aggucuugaacuccuggccucaa

SEQ ID NO: 3627071 - RNA, 21 nt, Human
aggucuuggaacuugccugcc

SEQ ID NO: 3627072 - RNA, 18 nt, Human
aggucuuugguucagcua

SEQ ID NO: 3627073 - RNA, 16 nt, Human
aggucuuuugacaugu

SEQ ID NO: 3627074 - RNA, 19 nt, Human
aggugaaacuccagaugcc

SEQ ID NO: 3627075 - RNA, 15 nt, Human
aggugaaaggaaauu

SEQ ID NO: 3627076 - RNA, 16 nt, Human
aggugaacaaucaacu

SEQ ID NO: 3627077 - RNA, 23 nt, Human
aggugaauuaauuaaacauugug

SEQ ID NO: 3627078 - RNA, 15 nt, Human
aggugacagagugag

SEQ ID NO: 3627079 - RNA, 15 nt, Human
aggugacagcagucg

SEQ ID NO: 3627080 - RNA, 19 nt, Human
aggugacaucggaaaaaua

SEQ ID NO: 3627081 - RNA, 19 nt, Human
aggugaccaaaucagugug

SEQ ID NO: 3627082 - RNA, 19 nt, Human
aggugacccaaugauucag

SEQ ID NO: 3627083 - RNA, 17 nt, Human
aggugaccccagggcac

SEQ ID NO: 3627084 - RNA, 19 nt, Human
aggugaccccagggcacag

SEQ ID NO: 3627085 - RNA, 20 nt, Human
aggugacugggcccugccuc

SEQ ID NO: 3627086 - RNA, 21 nt, Human
aggugacugucuggggagcgg

SEQ ID NO: 3627087 - RNA, 22 nt, Human
aggugagcaagcccaggagaau

SEQ ID NO: 3627088 - RNA, 20 nt, Human
aggugauaaaugucaguagu

SEQ ID NO: 3627089 - RNA, 18 nt, Human
aggugauauauuuaaaaa

SEQ ID NO: 3627090 - RNA, 18 nt, Human
aggugauauccauucuuu

SEQ ID NO: 3627091 - RNA, 19 nt, Human
aggugauauccauucuuuc

SEQ ID NO: 3627092 - RNA, 22 nt, Human
aggugauauccauucuuucuga

SEQ ID NO: 3627093 - RNA, 19 nt, Human
aggugauccauguaacugc

SEQ ID NO: 3627094 - RNA, 15 nt, Human
aggugaucccguuuu

SEQ ID NO: 3627095 - RNA, 23 nt, Human
aggugaucccguuuuccccauga

SEQ ID NO: 3627096 - RNA, 17 nt, Human
aggugauuccagugaag

SEQ ID NO: 3627097 - RNA, 15 nt, Human
aggugcaaccaggga

SEQ ID NO: 3627098 - RNA, 16 nt, Human
aggugcaauuucaagg

SEQ ID NO: 3627099 - RNA, 20 nt, Human
aggugcaauuucaagguucu

SEQ ID NO: 3627100 - RNA, 21 nt, Human
aggugcacaagcuccaagcuc

SEQ ID NO: 3627101 - RNA, 22 nt, Human
aggugcacugggaggcuccccu

SEQ ID NO: 3627102 - RNA, 20 nt, Human
aggugcacuuggggcacagg

SEQ ID NO: 3627103 - RNA, 23 nt, Human
aggugcacuuggggcacagggag

SEQ ID NO: 3627104 - RNA, 11 nt, Human
aggugcagagg

SEQ ID NO: 3627105 - RNA, 21 nt, Human
aggugcagagguacccugggu

SEQ ID NO: 3627106 - RNA, 13 nt, Human
aggugcagccaga

SEQ ID NO: 3627107 - RNA, 18 nt, Human
aggugcagccagaggcac

SEQ ID NO: 3627108 - RNA, 21 nt, Human
aggugcaucuggggaacuaga

SEQ ID NO: 3627109 - RNA, 18 nt, Human
aggugccacuggagugug

SEQ ID NO: 3627110 - RNA, 19 nt, Human
aggugccagcaaagcccca

SEQ ID NO: 3627111 - RNA, 16 nt, Human
aggugccauggaagag

SEQ ID NO: 3627112 - RNA, 17 nt, Human
aggugccauggaagagg

SEQ ID NO: 3627113 - RNA, 21 nt, Human
aggugccauggaagaggcuac

SEQ ID NO: 3627114 - RNA, 20 nt, Human
aggugcccacauguguccau

SEQ ID NO: 3627115 - RNA, 13 nt, Human
aggugcccaggag

SEQ ID NO: 3627116 - RNA, 14 nt, Human
aggugcccaggaga

SEQ ID NO: 3627117 - RNA, 19 nt, Human
aggugcccuuggaggccag

SEQ ID NO: 3627118 - RNA, 21 nt, Human
aggugcccuuggaggccagcc

SEQ ID NO: 3627119 - RNA, 14 nt, Human
aggugccuccaggu

SEQ ID NO: 3627120 - RNA, 16 nt, Human
aggugccuccaggugu

SEQ ID NO: 3627121 - RNA, 14 nt, Human
aguaaccauuugca

SEQ ID NO: 3627122 - RNA, 19 nt, Human
aguaacccccuuaaauuua

SEQ ID NO: 3627123 - RNA, 12 nt, Human
aguaaccugggu

SEQ ID NO: 3627124 - RNA, 17 nt, Human
aguaacgcgucuuccug

SEQ ID NO: 3627125 - RNA, 21 nt, Human
aguaacgggucguaaugacuu

SEQ ID NO: 3627126 - RNA, 15 nt, Human
aguaacuauuauuau

SEQ ID NO: 3627127 - RNA, 14 nt, Human
aguaacugacauga

SEQ ID NO: 3627128 - RNA, 17 nt, Human
aguaacuucuuauggaa

SEQ ID NO: 3627129 - RNA, 15 nt, Human
aguaacuugguuaua

SEQ ID NO: 3627130 - RNA, 20 nt, Human
aguaacuugguuauacauga

SEQ ID NO: 3627131 - RNA, 20 nt, Human
aguaacuugucuuaaauaaa

SEQ ID NO: 3627132 - RNA, 15 nt, Human
aguaacuuuauucuu

SEQ ID NO: 3627133 - RNA, 13 nt, Human
aguaagaaaagug

SEQ ID NO: 3627134 - RNA, 12 nt, Human
aguaagaaaaua

SEQ ID NO: 3627135 - RNA, 13 nt, Human
aguaagaaaauau

SEQ ID NO: 3627136 - RNA, 23 nt, Human
aguaagaaaauauuuugucuaaa

SEQ ID NO: 3627137 - RNA, 18 nt, Human
aguaagaaauuucagguu

SEQ ID NO: 3627138 - RNA, 23 nt, Human
aguaagaauaccacaucaaauaa

SEQ ID NO: 3627139 - RNA, 24 nt, Human
aguaagacauugggucuauuccag

SEQ ID NO: 3627140 - RNA, 21 nt, Human
aguaagaccggaagcuccugg

SEQ ID NO: 3627141 - RNA, 12 nt, Human
aguaagagcugg

SEQ ID NO: 3627142 - RNA, 14 nt, Human
aguaagauaucuca

SEQ ID NO: 3627143 - RNA, 14 nt, Human
aguaagaucacugu

SEQ ID NO: 3627144 - RNA, 14 nt, Human
aguaagcugcuuuu

SEQ ID NO: 3627145 - RNA, 18 nt, Human
aguaaggaguucauuuua

SEQ ID NO: 3627146 - RNA, 16 nt, Human
aguaagggaaauagaa

SEQ ID NO: 3627147 - RNA, 17 nt, Human
aguaagggaaauagaaa

SEQ ID NO: 3627148 - RNA, 21 nt, Human
aguaagggaacaaguugagcu

SEQ ID NO: 3627149 - RNA, 20 nt, Human
aguaaguaccacucaggcca

SEQ ID NO: 3627150 - RNA, 15 nt, Human
aguaaguaucuucgu

SEQ ID NO: 3627151 - RNA, 15 nt, Human
aguaagugccuucca

SEQ ID NO: 3627152 - RNA, 16 nt, Human
aguaaguuaucuuuga

SEQ ID NO: 3627153 - RNA, 20 nt, Human
aguaaguuaucuuugaauau

SEQ ID NO: 3627154 - RNA, 14 nt, Human
aguaaguucagcac

SEQ ID NO: 3627155 - RNA, 15 nt, Human
aguaauaaaacaucu

SEQ ID NO: 3627156 - RNA, 17 nt, Human
aguaauaaaacaucuuu

SEQ ID NO: 3627157 - RNA, 20 nt, Human
aguaauaccucuaauaguau

SEQ ID NO: 3627158 - RNA, 14 nt, Human
aguaauagagcaaa

SEQ ID NO: 3627159 - RNA, 14 nt, Human
aguaauauaauaca

SEQ ID NO: 3627160 - RNA, 13 nt, Human
aguaauauauucu

SEQ ID NO: 3627161 - RNA, 15 nt, Human
aguaauaugcacaca

SEQ ID NO: 3627162 - RNA, 17 nt, Human
aguaauaugcacacauu

SEQ ID NO: 3627163 - RNA, 19 nt, Human
aguaauaugcacacauuuu

SEQ ID NO: 3627164 - RNA, 12 nt, Human
aguaaucaucua

SEQ ID NO: 3627165 - RNA, 22 nt, Human
aguaaucaucuaagucaguacc

SEQ ID NO: 3627166 - RNA, 21 nt, Human
aguaauccaagcaaaugugaa

SEQ ID NO: 3627167 - RNA, 17 nt, Human
aguaaucccgccaccua

SEQ ID NO: 3627168 - RNA, 17 nt, Human
aguaaucgcuuaaagau

SEQ ID NO: 3627169 - RNA, 20 nt, Human
aguaaucugagaaacaauga

SEQ ID NO: 3627170 - RNA, 19 nt, Human
aguaaucuguacauuuugu

SEQ ID NO: 3627171 - RNA, 23 nt, Human
aguaaucuguacauuuuguugua

SEQ ID NO: 3627172 - RNA, 19 nt, Human
aguaaucuguauaauacuu

SEQ ID NO: 3627173 - RNA, 22 nt, Human
aguaaucuguauaauacuuugu

SEQ ID NO: 3627174 - RNA, 17 nt, Human
aguaaugaguuuaaaaa

SEQ ID NO: 3627175 - RNA, 13 nt, Human
aguaaugauaacu

SEQ ID NO: 3627176 - RNA, 18 nt, Human
aguaaugcauacagaaau

SEQ ID NO: 3627177 - RNA, 17 nt, Human
aguaaugcuacguguga

SEQ ID NO: 3627178 - RNA, 18 nt, Human
aguaaugcuacgugugau

SEQ ID NO: 3627179 - RNA, 15 nt, Human
aguaauggguuucau

SEQ ID NO: 3627180 - RNA, 23 nt, Human
aguaauggguuucauauuucuua

SEQ ID NO: 3627181 - RNA, 23 nt, Human
aguaaugguguagaacacuaauu

SEQ ID NO: 3627182 - RNA, 17 nt, Human
aguaauguuauuuucuu

SEQ ID NO: 3627183 - RNA, 21 nt, Human
aguaauguuauuuucuucuaa

SEQ ID NO: 3627184 - RNA, 17 nt, Human
aguaauucugcugucuc

SEQ ID NO: 3627185 - RNA, 18 nt, Human
aguaauugacaugugcca

SEQ ID NO: 3627186 - RNA, 13 nt, Human
aguaauuggaaag

SEQ ID NO: 3627187 - RNA, 15 nt, Human
aguaauugugaaaaa

SEQ ID NO: 3627188 - RNA, 16 nt, Human
aguaauuguguuuaca

SEQ ID NO: 3627189 - RNA, 18 nt, Human
aguaauuguguuuacauu

SEQ ID NO: 3627190 - RNA, 19 nt, Human
aguaauuguugguuaucuu

SEQ ID NO: 3627191 - RNA, 14 nt, Human
aguaauuuagaaau

SEQ ID NO: 3627192 - RNA, 17 nt, Human
aguaauuuagaaaucau

SEQ ID NO: 3627193 - RNA, 15 nt, Human
aguaauuugaggaca

SEQ ID NO: 3627194 - RNA, 22 nt, Human
aguaauuuggaaauuagguuga

SEQ ID NO: 3627195 - RNA, 23 nt, Human
aguacaaaugccuuaaaauggaa

SEQ ID NO: 3627196 - RNA, 22 nt, Human
aguacaaugugacuuugaaaau

SEQ ID NO: 3627197 - RNA, 15 nt, Human
aguacaauucuuacu

SEQ ID NO: 3627198 - RNA, 21 nt, Human
aguacacaauaagcaaaaaca

SEQ ID NO: 3627199 - RNA, 22 nt, Human
aguacacaauaagcaaaaacaa

SEQ ID NO: 3627200 - RNA, 21 nt, Human
aguacacugaauuuuuaugug

SEQ ID NO: 3627201 - RNA, 17 nt, Human
aguacacugccugccuu

SEQ ID NO: 3627202 - RNA, 19 nt, Human
aguacacugccugccuuaa

SEQ ID NO: 3627203 - RNA, 14 nt, Human
aguacacuguuuca

SEQ ID NO: 3627204 - RNA, 21 nt, Human
aguacacuguuucaaacuuua

SEQ ID NO: 3627205 - RNA, 12 nt, Human
aguacagaauuu

SEQ ID NO: 3627206 - RNA, 17 nt, Human
aguacagaauuugaauu

SEQ ID NO: 3627207 - RNA, 15 nt, Human
aguacagagaagcca

SEQ ID NO: 3627208 - RNA, 15 nt, Human
aguacagcaugugcc

SEQ ID NO: 3627209 - RNA, 20 nt, Human
aguacagguacuuugucuaa

SEQ ID NO: 3627210 - RNA, 18 nt, Human
aguacauauuaggaaaau

SEQ ID NO: 3627211 - RNA, 21 nt, Human
aguacauauuuauuuucuuuu

SEQ ID NO: 3627212 - RNA, 16 nt, Human
aguacauucucaguuu

SEQ ID NO: 3627213 - RNA, 13 nt, Human
aguacauuuaaau

SEQ ID NO: 3627214 - RNA, 16 nt, Human
aguacauuuaaauuuu

SEQ ID NO: 3627215 - RNA, 15 nt, Human
aguacauuuuuugaa

SEQ ID NO: 3627216 - RNA, 18 nt, Human
aguacauuuuuugaaaug

SEQ ID NO: 3627217 - RNA, 21 nt, Human
aguaccagcgcucuaaaagca

SEQ ID NO: 3627218 - RNA, 22 nt, Human
aguaccagcgcucuaaaagcac

SEQ ID NO: 3627219 - RNA, 14 nt, Human
aguaccauuuauac

SEQ ID NO: 3627220 - RNA, 22 nt, Human
aguacccaccaccuucuucucc

SEQ ID NO: 3627221 - RNA, 12 nt, Human
aguacccaccug

SEQ ID NO: 3627222 - RNA, 17 nt, Human
aguacccaccugagcuu

SEQ ID NO: 3627223 - RNA, 22 nt, Human
aguacccaccugagcuuuggac

SEQ ID NO: 3627224 - RNA, 23 nt, Human
aguacccacucuggagcauuucu

SEQ ID NO: 3627225 - RNA, 19 nt, Human
aguacccguucacauuuuu

SEQ ID NO: 3627226 - RNA, 16 nt, Human
aguacccucucagcuc

SEQ ID NO: 3627227 - RNA, 19 nt, Human
aguacccucucagcuccag

SEQ ID NO: 3627228 - RNA, 21 nt, Human
aguaccuauaaaguaaagcua

SEQ ID NO: 3627229 - RNA, 15 nt, Human
aguaccuccugcccc

SEQ ID NO: 3627230 - RNA, 22 nt, Human
aguaccuccugucucuggccug

SEQ ID NO: 3627231 - RNA, 13 nt, Human
aguaccugagggu

SEQ ID NO: 3627232 - RNA, 21 nt, Human
aguaccugagggucuguaggu

SEQ ID NO: 3627233 - RNA, 19 nt, Human
aguaccuggguccccagcc

SEQ ID NO: 3627234 - RNA, 22 nt, Human
aguaccuggguccccagcccuu

SEQ ID NO: 3627235 - RNA, 16 nt, Human
aguaccuucagauccu

SEQ ID NO: 3627236 - RNA, 13 nt, Human
aguaccuugcuuc

SEQ ID NO: 3627237 - RNA, 18 nt, Human
aguaccuuugcucuugca

SEQ ID NO: 3627238 - RNA, 18 nt, Human
aguacgaaccuacaguuu

SEQ ID NO: 3627239 - RNA, 15 nt, Human
aguacguugugcauu

SEQ ID NO: 3627240 - RNA, 16 nt, Human
aguacuaacauuuauu

SEQ ID NO: 3627241 - RNA, 23 nt, Human
aguacuaacuccuaggaaaauac

SEQ ID NO: 3627242 - RNA, 14 nt, Human
aguacuaagcauuu

SEQ ID NO: 3627243 - RNA, 16 nt, Human
aguacuacacauuuuu

SEQ ID NO: 3627244 - RNA, 22 nt, Human
aguacuacacauuuuuaaauug

SEQ ID NO: 3627245 - RNA, 16 nt, Human
aguacuauaucuguuu

SEQ ID NO: 3627246 - RNA, 13 nt, Human
aguacuccacacu

SEQ ID NO: 3627247 - RNA, 20 nt, Human
aguacuccacacugcacaau

SEQ ID NO: 3627248 - RNA, 20 nt, Human
aguacuccugcaaaauuuua

SEQ ID NO: 3627249 - RNA, 17 nt, Human
aguacuccuuaagaaca

SEQ ID NO: 3627250 - RNA, 18 nt, Human
aguacuccuuaagaacac

SEQ ID NO: 3627251 - RNA, 17 nt, Human
aguacugcucuuguuuc

SEQ ID NO: 3627252 - RNA, 15 nt, Human
aguacuggagaaaau

SEQ ID NO: 3627253 - RNA, 15 nt, Human
aguacuggcauggua

SEQ ID NO: 3627254 - RNA, 20 nt, Human
aguacugggauuacaggcgu

SEQ ID NO: 3627255 - RNA, 19 nt, Human
aguacugguaagauuguua

SEQ ID NO: 3627256 - RNA, 20 nt, Human
aguacugguaagauuguuau

SEQ ID NO: 3627257 - RNA, 18 nt, Human
aguacuguaauaauaccu

SEQ ID NO: 3627258 - RNA, 20 nt, Human
aguacuguaauaauaccuca

SEQ ID NO: 3627259 - RNA, 13 nt, Human
aguacugugaauc

SEQ ID NO: 3627260 - RNA, 15 nt, Human
aguacuucagcaaga

SEQ ID NO: 3627261 - RNA, 20 nt, Human
aguacuucuccacccugcuc

SEQ ID NO: 3627262 - RNA, 16 nt, Human
aguacuucuucuguaa

SEQ ID NO: 3627263 - RNA, 17 nt, Human
aguacuucuucuguaau

SEQ ID NO: 3627264 - RNA, 20 nt, Human
aguacuugaguguaauguuu

SEQ ID NO: 3627265 - RNA, 17 nt, Human
agucaccucauggaauu

SEQ ID NO: 3627266 - RNA, 14 nt, Human
agucaccuuccagg

SEQ ID NO: 3627267 - RNA, 13 nt, Human
agucaccuucccu

SEQ ID NO: 3627268 - RNA, 23 nt, Human
agucaccuucccuugccacuuug

SEQ ID NO: 3627269 - RNA, 13 nt, Human
agucaccuuuuaa

SEQ ID NO: 3627270 - RNA, 14 nt, Human
agucaccuuuuaaa

SEQ ID NO: 3627271 - RNA, 21 nt, Human
agucaccuuuuaaauccuguu

SEQ ID NO: 3627272 - RNA, 20 nt, Human
agucacggcugcgcacugug

SEQ ID NO: 3627273 - RNA, 21 nt, Human
agucacguggaggagcagugc

SEQ ID NO: 3627274 - RNA, 16 nt, Human
agucacuaaaaggaag

SEQ ID NO: 3627275 - RNA, 21 nt, Human
agucacuaugggaugagaaaa

SEQ ID NO: 3627276 - RNA, 22 nt, Human
agucacuaugggaugagaaaau

SEQ ID NO: 3627277 - RNA, 22 nt, Human
agucacucuagucaaugacaug

SEQ ID NO: 3627278 - RNA, 18 nt, Human
agucacugagacagcccg

SEQ ID NO: 3627279 - RNA, 20 nt, Human
agucacugcacguuuucauc

SEQ ID NO: 3627280 - RNA, 17 nt, Human
agucacugccacuuugc

SEQ ID NO: 3627281 - RNA, 19 nt, Human
agucacugccacuuugcac

SEQ ID NO: 3627282 - RNA, 11 nt, Human
agucacugccu

SEQ ID NO: 3627283 - RNA, 21 nt, Human
agucacugccucucccuggcc

SEQ ID NO: 3627284 - RNA, 10 nt, Human
agucacuguc

SEQ ID NO: 3627285 - RNA, 24 nt, Human
agucacugugagcucccaggugca

SEQ ID NO: 3627286 - RNA, 20 nt, Human
agucacuucggccagagcug

SEQ ID NO: 3627287 - RNA, 14 nt, Human
agucagaacagcag

SEQ ID NO: 3627288 - RNA, 13 nt, Human
agucagagacaga

SEQ ID NO: 3627289 - RNA, 14 nt, Human
agucagagagaauc

SEQ ID NO: 3627290 - RNA, 17 nt, Human
agucagagagaguguuu

SEQ ID NO: 3627291 - RNA, 20 nt, Human
agucagaggauggccagugu

SEQ ID NO: 3627292 - RNA, 22 nt, Human
agucagaggauggccagugucu

SEQ ID NO: 3627293 - RNA, 17 nt, Human
agucagaucugccuaag

SEQ ID NO: 3627294 - RNA, 14 nt, Human
agucagaugcccag

SEQ ID NO: 3627295 - RNA, 23 nt, Human
agucagaugcccagagggcccag

SEQ ID NO: 3627296 - RNA, 21 nt, Human
agucagauguuugagcagugg

SEQ ID NO: 3627297 - RNA, 18 nt, Human
agucagccaggagcuguc

SEQ ID NO: 3627298 - RNA, 23 nt, Human
agucagccucgcaggccucccug

SEQ ID NO: 3627299 - RNA, 15 nt, Human
agucagccucucucc

SEQ ID NO: 3627300 - RNA, 17 nt, Human
agucagccucucuccca

SEQ ID NO: 3627301 - RNA, 18 nt, Human
agucagccucucucccag

SEQ ID NO: 3627302 - RNA, 21 nt, Human
agucagccucucucccagucu

SEQ ID NO: 3627303 - RNA, 22 nt, Human
agucagccuucccccucccagg

SEQ ID NO: 3627304 - RNA, 13 nt, Human
agucagcucucug

SEQ ID NO: 3627305 - RNA, 17 nt, Human
agucagcucucugcccu

SEQ ID NO: 3627306 - RNA, 22 nt, Human
agucagcuuugccuuccacgcu

SEQ ID NO: 3627307 - RNA, 14 nt, Human
agucaggaaagaga

SEQ ID NO: 3627308 - RNA, 16 nt, Human
agucaggaaagagaac

SEQ ID NO: 3627309 - RNA, 15 nt, Human
agucagggcccagag

SEQ ID NO: 3627310 - RNA, 15 nt, Human
agucaguauuguuuu

SEQ ID NO: 3627311 - RNA, 21 nt, Human
agucagucauucagauaugau

SEQ ID NO: 3627312 - RNA, 16 nt, Human
agucagugccaggucc

SEQ ID NO: 3627313 - RNA, 15 nt, Human
agucaguguugagau

SEQ ID NO: 3627314 - RNA, 16 nt, Human
agucaguguugagaug

SEQ ID NO: 3627315 - RNA, 16 nt, Human
agucaguugaaauucu

SEQ ID NO: 3627316 - RNA, 23 nt, Human
agucaguugcucaaaaagaaauc

SEQ ID NO: 3627317 - RNA, 14 nt, Human
agucaguuucuaca

SEQ ID NO: 3627318 - RNA, 14 nt, Human
agucauaaaccuua

SEQ ID NO: 3627319 - RNA, 20 nt, Human
agucauaaaccuuaaguaag

SEQ ID NO: 3627320 - RNA, 21 nt, Human
agucauaaucauuagggggaa

SEQ ID NO: 3627321 - RNA, 17 nt, Human
agucauaauugcauuga

SEQ ID NO: 3627322 - RNA, 14 nt, Human
agucauaccaauga

SEQ ID NO: 3627323 - RNA, 23 nt, Human
agucauaccaaugaaaaaaugua

SEQ ID NO: 3627324 - RNA, 23 nt, Human
agucauaucuuaauauauuucua

SEQ ID NO: 3627325 - RNA, 20 nt, Human
agucauauuuugauuauugu

SEQ ID NO: 3627326 - RNA, 15 nt, Human
agucaucaucagggc

SEQ ID NO: 3627327 - RNA, 16 nt, Human
agucaucaucagggcc

SEQ ID NO: 3627328 - RNA, 18 nt, Human
agucaucguaggugauuu

SEQ ID NO: 3627329 - RNA, 14 nt, Human
agucaucucaacca

SEQ ID NO: 3627330 - RNA, 19 nt, Human
agucaucuccaucagcugu

SEQ ID NO: 3627331 - RNA, 19 nt, Human
agucaucuguuagggccuu

SEQ ID NO: 3627332 - RNA, 20 nt, Human
agucaucuugaccaagcagg

SEQ ID NO: 3627333 - RNA, 13 nt, Human
agucaugaagccc

SEQ ID NO: 3627334 - RNA, 19 nt, Human
agucaugaucucccugccg

SEQ ID NO: 3627335 - RNA, 23 nt, Human
agucaugaucucccugccgccuc

SEQ ID NO: 3627336 - RNA, 13 nt, Human
agucaugauguuu

SEQ ID NO: 3627337 - RNA, 14 nt, Human
agucaugauguuuu

SEQ ID NO: 3627338 - RNA, 18 nt, Human
agucaugauguuuuuaaa

SEQ ID NO: 3627339 - RNA, 19 nt, Human
agucaugcaaaggcuggga

SEQ ID NO: 3627340 - RNA, 19 nt, Human
agucaugcauaaauaugca

SEQ ID NO: 3627341 - RNA, 20 nt, Human
agucaugcauaaauaugcag

SEQ ID NO: 3627342 - RNA, 22 nt, Human
agucaugcauaaauaugcagug

SEQ ID NO: 3627343 - RNA, 18 nt, Human
agucaugcuccccugugc

SEQ ID NO: 3627344 - RNA, 15 nt, Human
agucauguaaauacu

SEQ ID NO: 3627345 - RNA, 15 nt, Human
agucauguauguuuc

SEQ ID NO: 3627346 - RNA, 22 nt, Human
agucauguauguuucucuuuga

SEQ ID NO: 3627347 - RNA, 13 nt, Human
agucauguuccuu

SEQ ID NO: 3627348 - RNA, 19 nt, Human
agucauguuuaucugcuua

SEQ ID NO: 3627349 - RNA, 14 nt, Human
agucauuaaagaca

SEQ ID NO: 3627350 - RNA, 17 nt, Human
agucauuaaauuacuau

SEQ ID NO: 3627351 - RNA, 23 nt, Human
agucauuaaauuacuauagcaaa

SEQ ID NO: 3627352 - RNA, 20 nt, Human
agucauuagacuccuccucc

SEQ ID NO: 3627353 - RNA, 19 nt, Human
agucauuauagauccccca

SEQ ID NO: 3627354 - RNA, 23 nt, Human
agucauuauagaucccccagacu

SEQ ID NO: 3627355 - RNA, 20 nt, Human
agucauuauccuugcuauga

SEQ ID NO: 3627356 - RNA, 12 nt, Human
agucauuauguu

SEQ ID NO: 3627357 - RNA, 20 nt, Human
agucauucagauaugauuca

SEQ ID NO: 3627358 - RNA, 22 nt, Human
agucauucagcagcaaauuuuc

SEQ ID NO: 3627359 - RNA, 23 nt, Human
agucauucagcagcaaauuuuca

SEQ ID NO: 3627360 - RNA, 16 nt, Human
agucauugcuguagga

SEQ ID NO: 3627361 - RNA, 15 nt, Human
agucauuggcuuuau

SEQ ID NO: 3627362 - RNA, 15 nt, Human
agucauuguaauguu

SEQ ID NO: 3627363 - RNA, 17 nt, Human
agucauuuaacugaaga

SEQ ID NO: 3627364 - RNA, 18 nt, Human
agucauuuacuaaacaua

SEQ ID NO: 3627365 - RNA, 19 nt, Human
agucauuuacuaaacauau

SEQ ID NO: 3627366 - RNA, 13 nt, Human
agucauuucugau

SEQ ID NO: 3627367 - RNA, 18 nt, Human
agucauuugagucucuua

SEQ ID NO: 3627368 - RNA, 22 nt, Human
agucauuugcugagcauguacu

SEQ ID NO: 3627369 - RNA, 16 nt, Human
agucauuuuguguuga

SEQ ID NO: 3627370 - RNA, 14 nt, Human
agucauuuuuguuu

SEQ ID NO: 3627371 - RNA, 19 nt, Human
aguccaaauguuuacaggg

SEQ ID NO: 3627372 - RNA, 19 nt, Human
aguccaacguggggcagca

SEQ ID NO: 3627373 - RNA, 11 nt, Human
aguccaagcau

SEQ ID NO: 3627374 - RNA, 16 nt, Human
aguccaagcauuuaga

SEQ ID NO: 3627375 - RNA, 11 nt, Human
aguccaagcug

SEQ ID NO: 3627376 - RNA, 21 nt, Human
aguccaagggguccccuccag

SEQ ID NO: 3627377 - RNA, 18 nt, Human
aguccaaugucuuuuuaa

SEQ ID NO: 3627378 - RNA, 19 nt, Human
aguccaauuuuaauuuagu

SEQ ID NO: 3627379 - RNA, 16 nt, Human
aguccacaguggaacc

SEQ ID NO: 3627380 - RNA, 17 nt, Human
aguccacccugccugcc

SEQ ID NO: 3627381 - RNA, 19 nt, Human
aguccacccugccugccgu

SEQ ID NO: 3627382 - RNA, 20 nt, Human
aguccacuucugacagccuc

SEQ ID NO: 3627383 - RNA, 13 nt, Human
aguccaggcacag

SEQ ID NO: 3627384 - RNA, 19 nt, Human
aguccaggccauggaggca

SEQ ID NO: 3627385 - RNA, 13 nt, Human
aguccaggcccca

SEQ ID NO: 3627386 - RNA, 18 nt, Human
aguccaggcugccguggg

SEQ ID NO: 3627387 - RNA, 15 nt, Human
aguccagguccuggu

SEQ ID NO: 3627388 - RNA, 16 nt, Human
aguccagguccuggug

SEQ ID NO: 3627389 - RNA, 17 nt, Human
aguccaggucgggcuca

SEQ ID NO: 3627390 - RNA, 18 nt, Human
aguccaggucgggcucag

SEQ ID NO: 3627391 - RNA, 22 nt, Human
aguccaggucgggcucagcucu

SEQ ID NO: 3627392 - RNA, 17 nt, Human
aguccaguccuaucugg

SEQ ID NO: 3627393 - RNA, 14 nt, Human
aguccaucagccuc

SEQ ID NO: 3627394 - RNA, 22 nt, Human
aguccaugcaugacagccucua

SEQ ID NO: 3627395 - RNA, 14 nt, Human
aguccauucuccca

SEQ ID NO: 3627396 - RNA, 16 nt, Human
aguccauucucccagg

SEQ ID NO: 3627397 - RNA, 17 nt, Human
aguccauucucccaggu

SEQ ID NO: 3627398 - RNA, 19 nt, Human
aguccauucucccagguac

SEQ ID NO: 3627399 - RNA, 19 nt, Human
agucccaagcggugucucu

SEQ ID NO: 3627400 - RNA, 20 nt, Human
agucccaaggaaagccccag

SEQ ID NO: 3627401 - RNA, 20 nt, Human
agucccaccuuggcugcagg

SEQ ID NO: 3627402 - RNA, 23 nt, Human
agucccaccuuggcugcagggag

SEQ ID NO: 3627403 - RNA, 14 nt, Human
agucccacuccaag

SEQ ID NO: 3627404 - RNA, 17 nt, Human
agucccacugccucagg

SEQ ID NO: 3627405 - RNA, 13 nt, Human
agucccacugugc

SEQ ID NO: 3627406 - RNA, 23 nt, Human
agucccagagcaggaggccccug

SEQ ID NO: 3627407 - RNA, 19 nt, Human
agucccagcuacucaggag

SEQ ID NO: 3627408 - RNA, 19 nt, Human
agucccagcuacucgggag

SEQ ID NO: 3627409 - RNA, 14 nt, Human
auaaaacuaggaau

SEQ ID NO: 3627410 - RNA, 16 nt, Human
auaaaacugaugugaa

SEQ ID NO: 3627411 - RNA, 19 nt, Human
auaaaacugaugugaaacu

SEQ ID NO: 3627412 - RNA, 17 nt, Human
auaaaacuuugcugcca

SEQ ID NO: 3627413 - RNA, 14 nt, Human
auaaaagaaaauua

SEQ ID NO: 3627414 - RNA, 18 nt, Human
auaaaagaaaugcacaau

SEQ ID NO: 3627415 - RNA, 15 nt, Human
auaaaagauucaccu

SEQ ID NO: 3627416 - RNA, 17 nt, Human
auaaaagcaauuccaac

SEQ ID NO: 3627417 - RNA, 20 nt, Human
auaaaagcaauuccaaccuu

SEQ ID NO: 3627418 - RNA, 20 nt, Human
auaaaagcauaaaugcaaac

SEQ ID NO: 3627419 - RNA, 13 nt, Human
auaaaagcccagg

SEQ ID NO: 3627420 - RNA, 15 nt, Human
auaaaagcccaggag

SEQ ID NO: 3627421 - RNA, 18 nt, Human
auaaaagccuguuuaaga

SEQ ID NO: 3627422 - RNA, 20 nt, Human
auaaaagccuguuuaagaga

SEQ ID NO: 3627423 - RNA, 15 nt, Human
auaaaaggaagccaa

SEQ ID NO: 3627424 - RNA, 17 nt, Human
auaaaaggaagccaaag

SEQ ID NO: 3627425 - RNA, 20 nt, Human
auaaaaggcuugaagcugug

SEQ ID NO: 3627426 - RNA, 22 nt, Human
auaaaagggacugagaaauuua

SEQ ID NO: 3627427 - RNA, 20 nt, Human
auaaaaggggguccguggaa

SEQ ID NO: 3627428 - RNA, 18 nt, Human
auaaaagugaucaauaaa

SEQ ID NO: 3627429 - RNA, 16 nt, Human
auaaaaguugcaaagg

SEQ ID NO: 3627430 - RNA, 15 nt, Human
auaaaauaaauauau

SEQ ID NO: 3627431 - RNA, 21 nt, Human
auaaaauaaauauauauaaac

SEQ ID NO: 3627432 - RNA, 13 nt, Human
auaaaauaacuaa

SEQ ID NO: 3627433 - RNA, 18 nt, Human
auaaaauaacuaaaaugu

SEQ ID NO: 3627434 - RNA, 13 nt, Human
auaaaauaaugca

SEQ ID NO: 3627435 - RNA, 23 nt, Human
auaaaauaaugggauuuucuuuu

SEQ ID NO: 3627436 - RNA, 12 nt, Human
auaaaauaauuu

SEQ ID NO: 3627437 - RNA, 16 nt, Human
auaaaauacuauuuuu

SEQ ID NO: 3627438 - RNA, 19 nt, Human
auaaaauacuauuuuuacu

SEQ ID NO: 3627439 - RNA, 17 nt, Human
auaaaauauaucuuaua

SEQ ID NO: 3627440 - RNA, 16 nt, Human
auaaaauauuauugaa

SEQ ID NO: 3627441 - RNA, 18 nt, Human
auaaaauauuuucugugu

SEQ ID NO: 3627442 - RNA, 21 nt, Human
auaaaauauuuucuguguguu

SEQ ID NO: 3627443 - RNA, 22 nt, Human
auaaaauauuuucuguguguuc

SEQ ID NO: 3627444 - RNA, 11 nt, Human
auaaaaucagc

SEQ ID NO: 3627445 - RNA, 15 nt, Human
auaaaaucagccaau

SEQ ID NO: 3627446 - RNA, 22 nt, Human
auaaaaucagccaauuauguua

SEQ ID NO: 3627447 - RNA, 19 nt, Human
auaaaaucauaaguauuug

SEQ ID NO: 3627448 - RNA, 20 nt, Human
auaaaaucauguacauuucu

SEQ ID NO: 3627449 - RNA, 19 nt, Human
auaaaauccauacauuugu

SEQ ID NO: 3627450 - RNA, 17 nt, Human
auaaaaugaaaauugua

SEQ ID NO: 3627451 - RNA, 13 nt, Human
auaaaaugaccag

SEQ ID NO: 3627452 - RNA, 15 nt, Human
auaaaaugaccagua

SEQ ID NO: 3627453 - RNA, 12 nt, Human
auaaaaugacua

SEQ ID NO: 3627454 - RNA, 15 nt, Human
auaaaaugacuacuu

SEQ ID NO: 3627455 - RNA, 16 nt, Human
auaaaaugacuacuua

SEQ ID NO: 3627456 - RNA, 18 nt, Human
auaaaaugaggacauguu

SEQ ID NO: 3627457 - RNA, 21 nt, Human
auaaaaugguguuuucaugua

SEQ ID NO: 3627458 - RNA, 21 nt, Human
auaaaauguccaguaagauca

SEQ ID NO: 3627459 - RNA, 23 nt, Human
auaaaauguccaguaagaucacu

SEQ ID NO: 3627460 - RNA, 20 nt, Human
auaaaaugucuucaaggcuu

SEQ ID NO: 3627461 - RNA, 20 nt, Human
auaaaaugugauuuuucuga

SEQ ID NO: 3627462 - RNA, 13 nt, Human
auaaaauguugaa

SEQ ID NO: 3627463 - RNA, 21 nt, Human
auaaaauuauagaugggaaug

SEQ ID NO: 3627464 - RNA, 21 nt, Human
auaaaauuauagcucuaaugu

SEQ ID NO: 3627465 - RNA, 18 nt, Human
auaaaauucccuaaagcc

SEQ ID NO: 3627466 - RNA, 21 nt, Human
auaaaauuguaaaauuguaua

SEQ ID NO: 3627467 - RNA, 13 nt, Human
auaaaauuuguug

SEQ ID NO: 3627468 - RNA, 17 nt, Human
auaaaauuuuuuuucau

SEQ ID NO: 3627469 - RNA, 19 nt, Human
auaaaauuuuuuuucaugu

SEQ ID NO: 3627470 - RNA, 23 nt, Human
auaaaauuuuuuuucauguuuua

SEQ ID NO: 3627471 - RNA, 19 nt, Human
auaaacaacuuaauguucu

SEQ ID NO: 3627472 - RNA, 13 nt, Human
auaaacaagaaaa

SEQ ID NO: 3627473 - RNA, 20 nt, Human
auaaacaagaaaaauaaaga

SEQ ID NO: 3627474 - RNA, 23 nt, Human
auaaacaagaccacguuucuaaa

SEQ ID NO: 3627475 - RNA, 13 nt, Human
auaaacaaugaaa

SEQ ID NO: 3627476 - RNA, 14 nt, Human
auaaacaaugaugc

SEQ ID NO: 3627477 - RNA, 18 nt, Human
auaaacaaugaugcccug

SEQ ID NO: 3627478 - RNA, 23 nt, Human
auaaacacagcugcuuucuucuu

SEQ ID NO: 3627479 - RNA, 23 nt, Human
auaaacacauagauucaccugua

SEQ ID NO: 3627480 - RNA, 18 nt, Human
auaaacaccacuggauua

SEQ ID NO: 3627481 - RNA, 20 nt, Human
auaaacaccacuggauuaau

SEQ ID NO: 3627482 - RNA, 23 nt, Human
auaaacacucuugaaaaaugcau

SEQ ID NO: 3627483 - RNA, 22 nt, Human
auaaacaguggaauauaaggaa

SEQ ID NO: 3627484 - RNA, 22 nt, Human
auaaacauacgugugcaugugu

SEQ ID NO: 3627485 - RNA, 15 nt, Human
auaaacauuaaaugu

SEQ ID NO: 3627486 - RNA, 22 nt, Human
auaaacauuuguagcauccucu

SEQ ID NO: 3627487 - RNA, 16 nt, Human
auaaaccaaaggacau

SEQ ID NO: 3627488 - RNA, 21 nt, Human
auaaaccaaaggacauuaugu

SEQ ID NO: 3627489 - RNA, 15 nt, Human
auaaaccacugugcg

SEQ ID NO: 3627490 - RNA, 23 nt, Human
auaaaccccaccccaaaauuagc

SEQ ID NO: 3627491 - RNA, 16 nt, Human
auaaaccgaacugaug

SEQ ID NO: 3627492 - RNA, 17 nt, Human
auaaaccuaaaaaagau

SEQ ID NO: 3627493 - RNA, 22 nt, Human
auaaaccucuaauuuauuuugu

SEQ ID NO: 3627494 - RNA, 16 nt, Human
auaaaccuuaaguaag

SEQ ID NO: 3627495 - RNA, 19 nt, Human
auaaacgauuuaauucucu

SEQ ID NO: 3627496 - RNA, 22 nt, Human
auaaacguggagaaucacaggc

SEQ ID NO: 3627497 - RNA, 18 nt, Human
auaaacguggauguuacu

SEQ ID NO: 3627498 - RNA, 12 nt, Human
auaaacuaaaga

SEQ ID NO: 3627499 - RNA, 15 nt, Human
auaaacuaauaauug

SEQ ID NO: 3627500 - RNA, 19 nt, Human
auaaacuagauuacauuca

SEQ ID NO: 3627501 - RNA, 16 nt, Human
auaaacuauaaaacaa

SEQ ID NO: 3627502 - RNA, 18 nt, Human
auaaacuauuggaaagua

SEQ ID NO: 3627503 - RNA, 15 nt, Human
auaaacucauuucua

SEQ ID NO: 3627504 - RNA, 22 nt, Human
auaaacugacuaucauaaaauc

SEQ ID NO: 3627505 - RNA, 16 nt, Human
auaaacuguguuuacu

SEQ ID NO: 3627506 - RNA, 13 nt, Human
auaaacuucagca

SEQ ID NO: 3627507 - RNA, 17 nt, Human
auaaacuuggauucucu

SEQ ID NO: 3627508 - RNA, 15 nt, Human
auaaacuuuaccuuu

SEQ ID NO: 3627509 - RNA, 18 nt, Human
auaaacuuuuagaaacuu

SEQ ID NO: 3627510 - RNA, 15 nt, Human
auaaacuuuuuuuca

SEQ ID NO: 3627511 - RNA, 20 nt, Human
auaaacuuuuuuucaaugug

SEQ ID NO: 3627512 - RNA, 15 nt, Human
auaaagaaaagaugc

SEQ ID NO: 3627513 - RNA, 21 nt, Human
auaaagaacaagguaguuuuu

SEQ ID NO: 3627514 - RNA, 14 nt, Human
auaaagaagauguu

SEQ ID NO: 3627515 - RNA, 13 nt, Human
auaaagaauacuu

SEQ ID NO: 3627516 - RNA, 15 nt, Human
auaaagaauauauau

SEQ ID NO: 3627517 - RNA, 12 nt, Human
auaaagacaccu

SEQ ID NO: 3627518 - RNA, 16 nt, Human
auaaagacccaggggg

SEQ ID NO: 3627519 - RNA, 20 nt, Human
auaaagacguuuuauaagca

SEQ ID NO: 3627520 - RNA, 21 nt, Human
auaaagacguuuuauaagcau

SEQ ID NO: 3627521 - RNA, 13 nt, Human
auaaagagaaaau

SEQ ID NO: 3627522 - RNA, 17 nt, Human
auaaagagaaaauugaa

SEQ ID NO: 3627523 - RNA, 16 nt, Human
auaaagauauuguuca

SEQ ID NO: 3627524 - RNA, 14 nt, Human
auaaagaugaucua

SEQ ID NO: 3627525 - RNA, 14 nt, Human
auaaagaugcucuu

SEQ ID NO: 3627526 - RNA, 18 nt, Human
auaaagauggcugacuuu

SEQ ID NO: 3627527 - RNA, 13 nt, Human
auaaagauuuuuu

SEQ ID NO: 3627528 - RNA, 16 nt, Human
auaaagauuuuuuaau

SEQ ID NO: 3627529 - RNA, 19 nt, Human
auaaagcaauaagaacaaa

SEQ ID NO: 3627530 - RNA, 11 nt, Human
auaaagcaauu

SEQ ID NO: 3627531 - RNA, 15 nt, Human
auaaagcaauuuucc

SEQ ID NO: 3627532 - RNA, 20 nt, Human
auaaagcaauuuuccuugaa

SEQ ID NO: 3627533 - RNA, 23 nt, Human
auaaagcaauuuuccuugaagcc

SEQ ID NO: 3627534 - RNA, 17 nt, Human
auaaagcagacaggugu

SEQ ID NO: 3627535 - RNA, 14 nt, Human
auaaagcauaagua

SEQ ID NO: 3627536 - RNA, 20 nt, Human
auaaagcauaaguauacagu

SEQ ID NO: 3627537 - RNA, 15 nt, Human
auaaagcaucuaaac

SEQ ID NO: 3627538 - RNA, 14 nt, Human
auaaagcccuggga

SEQ ID NO: 3627539 - RNA, 14 nt, Human
auaaagccugcuuu

SEQ ID NO: 3627540 - RNA, 22 nt, Human
auaaagcucaaaugaaauguau

SEQ ID NO: 3627541 - RNA, 15 nt, Human
auaaaggaaaagaca

SEQ ID NO: 3627542 - RNA, 16 nt, Human
auaaaggaaaagacac

SEQ ID NO: 3627543 - RNA, 14 nt, Human
auaaaggauaaaga

SEQ ID NO: 3627544 - RNA, 14 nt, Human
auaaaggaugugau

SEQ ID NO: 3627545 - RNA, 22 nt, Human
auaaaggaugugauuguggaau

SEQ ID NO: 3627546 - RNA, 15 nt, Human
auaaagguaaaacaa

SEQ ID NO: 3627547 - RNA, 19 nt, Human
auaaaggugguaugugugu

SEQ ID NO: 3627548 - RNA, 21 nt, Human
auaaaggugguaugugugugu

SEQ ID NO: 3627549 - RNA, 19 nt, Human
auaaaggugugcugugucc

SEQ ID NO: 3627550 - RNA, 19 nt, Human
auaaagguuauuuucuccu

SEQ ID NO: 3627551 - RNA, 17 nt, Human
auaaagguucaugcaaa

SEQ ID NO: 3627552 - RNA, 14 nt, Human
auaaaguaaagcua

SEQ ID NO: 3627553 - RNA, 22 nt, Human
auaaguuaacuauuuuauuuuc

SEQ ID NO: 3627554 - RNA, 17 nt, Human
auaaguuaacuuccaau

SEQ ID NO: 3627555 - RNA, 13 nt, Human
auaaguuauugca

SEQ ID NO: 3627556 - RNA, 20 nt, Human
auaaguuauugcaguuuauc

SEQ ID NO: 3627557 - RNA, 18 nt, Human
auaaguuauuuuuguaca

SEQ ID NO: 3627558 - RNA, 20 nt, Human
auaaguucaaauucuucuga

SEQ ID NO: 3627559 - RNA, 21 nt, Human
auaaguucaaauucuucugaa

SEQ ID NO: 3627560 - RNA, 15 nt, Human
auaaguucacaaaau

SEQ ID NO: 3627561 - RNA, 11 nt, Human
auaaguucaua

SEQ ID NO: 3627562 - RNA, 23 nt, Human
auaaguucuaguugcuuguaaaa

SEQ ID NO: 3627563 - RNA, 16 nt, Human
auaaguuggaaacacu

SEQ ID NO: 3627564 - RNA, 21 nt, Human
auaaguuggaaacacuaaaug

SEQ ID NO: 3627565 - RNA, 22 nt, Human
auaaguuggaaacacuaaaugu

SEQ ID NO: 3627566 - RNA, 18 nt, Human
auaaguuuauuucuuaaa

SEQ ID NO: 3627567 - RNA, 18 nt, Human
auaaguuucuuugcuuca

SEQ ID NO: 3627568 - RNA, 21 nt, Human
auaaguuugaaggaaacaguu

SEQ ID NO: 3627569 - RNA, 18 nt, Human
auaaguuugcaauuuggg

SEQ ID NO: 3627570 - RNA, 13 nt, Human
auaauaaaaauau

SEQ ID NO: 3627571 - RNA, 12 nt, Human
auaauaaaauca

SEQ ID NO: 3627572 - RNA, 13 nt, Human
auaauaaaauuau

SEQ ID NO: 3627573 - RNA, 20 nt, Human
auaauaaacaguggaauaua

SEQ ID NO: 3627574 - RNA, 19 nt, Human
auaauaaacuuuuuugaaa

SEQ ID NO: 3627575 - RNA, 14 nt, Human
auaauaaagaauag

SEQ ID NO: 3627576 - RNA, 18 nt, Human
auaauaaaggacuguaau

SEQ ID NO: 3627577 - RNA, 13 nt, Human
auaauaaaguauu

SEQ ID NO: 3627578 - RNA, 11 nt, Human
auaauaaauag

SEQ ID NO: 3627579 - RNA, 12 nt, Human
auaauaaauuga

SEQ ID NO: 3627580 - RNA, 15 nt, Human
auaauaaauugaaau

SEQ ID NO: 3627581 - RNA, 23 nt, Human
auaauaaauuguuuggcuuccuc

SEQ ID NO: 3627582 - RNA, 16 nt, Human
auaauaaggaaaaguu

SEQ ID NO: 3627583 - RNA, 19 nt, Human
auaauaaggaaaaguuuaa

SEQ ID NO: 3627584 - RNA, 19 nt, Human
auaauaaucuaggcaugaa

SEQ ID NO: 3627585 - RNA, 22 nt, Human
auaauaauuagguuaacauugu

SEQ ID NO: 3627586 - RNA, 14 nt, Human
auaauaauuuuuau

SEQ ID NO: 3627587 - RNA, 12 nt, Human
auaauacaaaag

SEQ ID NO: 3627588 - RNA, 17 nt, Human
auaauacacaaaaucaa

SEQ ID NO: 3627589 - RNA, 21 nt, Human
auaauacagaaucuuguuuug

SEQ ID NO: 3627590 - RNA, 21 nt, Human
auaauacagccaaagauaauc

SEQ ID NO: 3627591 - RNA, 16 nt, Human
auaauaccucaauguu

SEQ ID NO: 3627592 - RNA, 19 nt, Human
auaauaccucaauguuuga

SEQ ID NO: 3627593 - RNA, 17 nt, Human
auaauacucuguuguac

SEQ ID NO: 3627594 - RNA, 13 nt, Human
auaauacugaacc

SEQ ID NO: 3627595 - RNA, 14 nt, Human
auaauacugaacca

SEQ ID NO: 3627596 - RNA, 16 nt, Human
auaauacugaaccacu

SEQ ID NO: 3627597 - RNA, 12 nt, Human
auaauagaaaug

SEQ ID NO: 3627598 - RNA, 13 nt, Human
auaauagaaaugu

SEQ ID NO: 3627599 - RNA, 15 nt, Human
auaauagaaaugucu

SEQ ID NO: 3627600 - RNA, 12 nt, Human
auaauagaagaa

SEQ ID NO: 3627601 - RNA, 13 nt, Human
auaauagaagaac

SEQ ID NO: 3627602 - RNA, 20 nt, Human
auaauaguuuacauguagua

SEQ ID NO: 3627603 - RNA, 14 nt, Human
auaauauacuugug

SEQ ID NO: 3627604 - RNA, 21 nt, Human
auaauauauauauauaucagu

SEQ ID NO: 3627605 - RNA, 22 nt, Human
auaauauauguuuaccuuuuaa

SEQ ID NO: 3627606 - RNA, 17 nt, Human
auaauauauuguguuga

SEQ ID NO: 3627607 - RNA, 14 nt, Human
auaauauauuugug

SEQ ID NO: 3627608 - RNA, 19 nt, Human
auaauauauuuuaaauauu

SEQ ID NO: 3627609 - RNA, 21 nt, Human
auaauauccaggucaacagaa

SEQ ID NO: 3627610 - RNA, 14 nt, Human
auaauaucuaaagu

SEQ ID NO: 3627611 - RNA, 17 nt, Human
auaauaucuaaaguuau

SEQ ID NO: 3627612 - RNA, 18 nt, Human
auaauaucuaaaguuaua

SEQ ID NO: 3627613 - RNA, 16 nt, Human
auaauaucucuaauau

SEQ ID NO: 3627614 - RNA, 22 nt, Human
auaauauggcuaugcuuaaaag

SEQ ID NO: 3627615 - RNA, 23 nt, Human
auaauauggcuaugcuuaaaagg

SEQ ID NO: 3627616 - RNA, 18 nt, Human
auaauauguuuccuuccc

SEQ ID NO: 3627617 - RNA, 14 nt, Human
auaauauuacuguu

SEQ ID NO: 3627618 - RNA, 18 nt, Human
auaauauugaaaauugaa

SEQ ID NO: 3627619 - RNA, 19 nt, Human
auaauauugaaaauugaaa

SEQ ID NO: 3627620 - RNA, 22 nt, Human
auaauauuguuguauaauuucg

SEQ ID NO: 3627621 - RNA, 16 nt, Human
auaauauuguuuggua

SEQ ID NO: 3627622 - RNA, 16 nt, Human
auaauauuguuuuucu

SEQ ID NO: 3627623 - RNA, 20 nt, Human
auaauauuuuuaauuaaaua

SEQ ID NO: 3627624 - RNA, 17 nt, Human
auaaucaagagccuuaa

SEQ ID NO: 3627625 - RNA, 19 nt, Human
auaaucacuuuuuuccaca

SEQ ID NO: 3627626 - RNA, 19 nt, Human
auaaucagaauggaagaga

SEQ ID NO: 3627627 - RNA, 20 nt, Human
auaaucagugugucuaaauu

SEQ ID NO: 3627628 - RNA, 17 nt, Human
auaaucccagcacuuug

SEQ ID NO: 3627629 - RNA, 15 nt, Human
auaauccugcaaagu

SEQ ID NO: 3627630 - RNA, 14 nt, Human
auaaucuaguuuac

SEQ ID NO: 3627631 - RNA, 15 nt, Human
auaaucuauaugcug

SEQ ID NO: 3627632 - RNA, 21 nt, Human
auaaucuauuucuaugagaaa

SEQ ID NO: 3627633 - RNA, 18 nt, Human
auaaucucuccauucccg

SEQ ID NO: 3627634 - RNA, 14 nt, Human
auaaucucugauuc

SEQ ID NO: 3627635 - RNA, 17 nt, Human
auaaucugucaaaacac

SEQ ID NO: 3627636 - RNA, 15 nt, Human
auaaucuuauuaggg

SEQ ID NO: 3627637 - RNA, 23 nt, Human
auaaucuuauuagggagaaaauu

SEQ ID NO: 3627638 - RNA, 14 nt, Human
auaaucuucugccu

SEQ ID NO: 3627639 - RNA, 15 nt, Human
auaaucuucugccuu

SEQ ID NO: 3627640 - RNA, 17 nt, Human
auaaucuucugccuucu

SEQ ID NO: 3627641 - RNA, 14 nt, Human
auaaucuuucacag

SEQ ID NO: 3627642 - RNA, 13 nt, Human
auaaucuuugggu

SEQ ID NO: 3627643 - RNA, 13 nt, Human
auaaugaacccau

SEQ ID NO: 3627644 - RNA, 13 nt, Human
auaaugaauaaau

SEQ ID NO: 3627645 - RNA, 18 nt, Human
auaaugaggaguuuauga

SEQ ID NO: 3627646 - RNA, 18 nt, Human
auaaugcauccagcagua

SEQ ID NO: 3627647 - RNA, 17 nt, Human
auaaugccggugagaau

SEQ ID NO: 3627648 - RNA, 21 nt, Human
auaauggaaaaaaaaaaaaga

SEQ ID NO: 3627649 - RNA, 16 nt, Human
auaauggaagagaaau

SEQ ID NO: 3627650 - RNA, 20 nt, Human
auaauggaagagaaaucuca

SEQ ID NO: 3627651 - RNA, 20 nt, Human
auaauggacagauuaauauu

SEQ ID NO: 3627652 - RNA, 19 nt, Human
auaaugggguccuggccau

SEQ ID NO: 3627653 - RNA, 15 nt, Human
auaaugguaccagau

SEQ ID NO: 3627654 - RNA, 18 nt, Human
auaaugguaccagauaaa

SEQ ID NO: 3627655 - RNA, 13 nt, Human
auaauggucagag

SEQ ID NO: 3627656 - RNA, 19 nt, Human
auaauguaaacaauaucag

SEQ ID NO: 3627657 - RNA, 15 nt, Human
auaauguaaauaaag

SEQ ID NO: 3627658 - RNA, 14 nt, Human
auaauguaauugua

SEQ ID NO: 3627659 - RNA, 15 nt, Human
auaauguauucauau

SEQ ID NO: 3627660 - RNA, 23 nt, Human
auaauguauucauauuuguacuu

SEQ ID NO: 3627661 - RNA, 14 nt, Human
auaauguauuguug

SEQ ID NO: 3627662 - RNA, 12 nt, Human
auaaugugaagu

SEQ ID NO: 3627663 - RNA, 16 nt, Human
auaaugugaaguguua

SEQ ID NO: 3627664 - RNA, 17 nt, Human
auaaugugggaagaaac

SEQ ID NO: 3627665 - RNA, 12 nt, Human
auaaugugugua

SEQ ID NO: 3627666 - RNA, 16 nt, Human
auaauguguguaugug

SEQ ID NO: 3627667 - RNA, 16 nt, Human
auaauguuaaauuugu

SEQ ID NO: 3627668 - RNA, 19 nt, Human
auaauguuaaauuuguaag

SEQ ID NO: 3627669 - RNA, 22 nt, Human
auaauguuaaauuuguaaguuu

SEQ ID NO: 3627670 - RNA, 19 nt, Human
auaauguuaaccaaggaaa

SEQ ID NO: 3627671 - RNA, 13 nt, Human
auaauguuucaaa

SEQ ID NO: 3627672 - RNA, 13 nt, Human
auaauguuugcua

SEQ ID NO: 3627673 - RNA, 16 nt, Human
auaauuaaagugucca

SEQ ID NO: 3627674 - RNA, 18 nt, Human
auaauuaacacuuaaggu

SEQ ID NO: 3627675 - RNA, 15 nt, Human
auaauuaacauguua

SEQ ID NO: 3627676 - RNA, 17 nt, Human
auaauuagguuaacauu

SEQ ID NO: 3627677 - RNA, 19 nt, Human
auaauuauaugcuauuucu

SEQ ID NO: 3627678 - RNA, 13 nt, Human
auaauuauauguu

SEQ ID NO: 3627679 - RNA, 14 nt, Human
auaauuauauguug

SEQ ID NO: 3627680 - RNA, 20 nt, Human
auaauuaucggaagcagugc

SEQ ID NO: 3627681 - RNA, 19 nt, Human
auaauuaugacaguuauac

SEQ ID NO: 3627682 - RNA, 20 nt, Human
auaauuaugacaguuauacu

SEQ ID NO: 3627683 - RNA, 18 nt, Human
auaauuauguuauugaaa

SEQ ID NO: 3627684 - RNA, 20 nt, Human
auaauuauguuauugaaaaa

SEQ ID NO: 3627685 - RNA, 16 nt, Human
auaauucacucaagca

SEQ ID NO: 3627686 - RNA, 20 nt, Human
auaauucacucaagcacuga

SEQ ID NO: 3627687 - RNA, 22 nt, Human
auaauucacucaagcacugaua

SEQ ID NO: 3627688 - RNA, 17 nt, Human
auaauucagaaggaucu

SEQ ID NO: 3627689 - RNA, 20 nt, Human
auaauucaggaagcagcuuu

SEQ ID NO: 3627690 - RNA, 21 nt, Human
auaauucaguauguuuuacac

SEQ ID NO: 3627691 - RNA, 20 nt, Human
auaauucccuaucuuuuagu

SEQ ID NO: 3627692 - RNA, 13 nt, Human
auaauuccuacag

SEQ ID NO: 3627693 - RNA, 16 nt, Human
auaauuccuacagcac

SEQ ID NO: 3627694 - RNA, 18 nt, Human
auaauuccuacagcacua

SEQ ID NO: 3627695 - RNA, 22 nt, Human
auaauuccuauauccugugacu

SEQ ID NO: 3627696 - RNA, 12 nt, Human
auaauucuaaau

SEQ ID NO: 3627697 - RNA, 14 nt, Human
auaauucuacuuug

SEQ ID NO: 3627698 - RNA, 14 nt, Human
auaauucucauuaa

SEQ ID NO: 3627699 - RNA, 15 nt, Human
aucaauaaaauguga

SEQ ID NO: 3627700 - RNA, 18 nt, Human
aucaauaacagccgcucc

SEQ ID NO: 3627701 - RNA, 13 nt, Human
aucaauaagaagg

SEQ ID NO: 3627702 - RNA, 17 nt, Human
aucaauacacuaguugu

SEQ ID NO: 3627703 - RNA, 19 nt, Human
aucaauacacuaguuguuu

SEQ ID NO: 3627704 - RNA, 13 nt, Human
aucaauaguugaa

SEQ ID NO: 3627705 - RNA, 17 nt, Human
aucaauaguugaauuag

SEQ ID NO: 3627706 - RNA, 15 nt, Human
aucaauaucuaauau

SEQ ID NO: 3627707 - RNA, 13 nt, Human
aucaaucaaauaa

SEQ ID NO: 3627708 - RNA, 13 nt, Human
aucaaucaacuua

SEQ ID NO: 3627709 - RNA, 20 nt, Human
aucaaucacagcuuguauuu

SEQ ID NO: 3627710 - RNA, 20 nt, Human
aucaaucaucugugugaaaa

SEQ ID NO: 3627711 - RNA, 20 nt, Human
aucaauccagcgguucucaa

SEQ ID NO: 3627712 - RNA, 19 nt, Human
aucaauccugauuccucuc

SEQ ID NO: 3627713 - RNA, 20 nt, Human
aucaauccugauuccucucu

SEQ ID NO: 3627714 - RNA, 12 nt, Human
aucaaugacaga

SEQ ID NO: 3627715 - RNA, 20 nt, Human
aucaaugagguaucuucuuu

SEQ ID NO: 3627716 - RNA, 22 nt, Human
aucaaugcaagagugauugcag

SEQ ID NO: 3627717 - RNA, 14 nt, Human
aucaaugggaaaua

SEQ ID NO: 3627718 - RNA, 23 nt, Human
aucaauguaccuuuuuugguagu

SEQ ID NO: 3627719 - RNA, 14 nt, Human
aucaaugugucuuu

SEQ ID NO: 3627720 - RNA, 15 nt, Human
aucaauguucauugu

SEQ ID NO: 3627721 - RNA, 14 nt, Human
aucaauuaaaugua

SEQ ID NO: 3627722 - RNA, 16 nt, Human
aucaauuauaguuucu

SEQ ID NO: 3627723 - RNA, 19 nt, Human
aucaauucuguauuccaga

SEQ ID NO: 3627724 - RNA, 13 nt, Human
aucaauuuaaaaa

SEQ ID NO: 3627725 - RNA, 21 nt, Human
aucaauuuaaacccauuuuag

SEQ ID NO: 3627726 - RNA, 12 nt, Human
aucaauuuaagu

SEQ ID NO: 3627727 - RNA, 20 nt, Human
aucaauuugucauuuugaag

SEQ ID NO: 3627728 - RNA, 22 nt, Human
aucaauuugucauuuugaagcu

SEQ ID NO: 3627729 - RNA, 15 nt, Human
aucaauuuuuaggaa

SEQ ID NO: 3627730 - RNA, 13 nt, Human
aucacaaaugacu

SEQ ID NO: 3627731 - RNA, 16 nt, Human
aucacaaaugacuuua

SEQ ID NO: 3627732 - RNA, 15 nt, Human
aucacaacgugcauu

SEQ ID NO: 3627733 - RNA, 18 nt, Human
aucacaacgugcauugug

SEQ ID NO: 3627734 - RNA, 21 nt, Human
aucacaacgugcauugugcuu

SEQ ID NO: 3627735 - RNA, 13 nt, Human
aucacaauacaga

SEQ ID NO: 3627736 - RNA, 16 nt, Human
aucacaauacagauaa

SEQ ID NO: 3627737 - RNA, 17 nt, Human
aucacaauuuuuaaugg

SEQ ID NO: 3627738 - RNA, 13 nt, Human
aucacacacaugg

SEQ ID NO: 3627739 - RNA, 21 nt, Human
aucacaccaucgcuggccccu

SEQ ID NO: 3627740 - RNA, 18 nt, Human
aucacacuucugugagac

SEQ ID NO: 3627741 - RNA, 14 nt, Human
aucacagagacauu

SEQ ID NO: 3627742 - RNA, 15 nt, Human
aucacagagacauuc

SEQ ID NO: 3627743 - RNA, 17 nt, Human
aucacagagacauuccu

SEQ ID NO: 3627744 - RNA, 18 nt, Human
aucacagagacauuccuc

SEQ ID NO: 3627745 - RNA, 14 nt, Human
aucacagaggcuuc

SEQ ID NO: 3627746 - RNA, 15 nt, Human
aucacagaggcuucu

SEQ ID NO: 3627747 - RNA, 14 nt, Human
aucacagcagccuc

SEQ ID NO: 3627748 - RNA, 13 nt, Human
aucacagcccagc

SEQ ID NO: 3627749 - RNA, 16 nt, Human
aucacagcccagcccg

SEQ ID NO: 3627750 - RNA, 13 nt, Human
aucacagccucug

SEQ ID NO: 3627751 - RNA, 18 nt, Human
aucacagcuucagccagg

SEQ ID NO: 3627752 - RNA, 20 nt, Human
aucacaggcugggcugggca

SEQ ID NO: 3627753 - RNA, 20 nt, Human
aucacagggcagagccggga

SEQ ID NO: 3627754 - RNA, 18 nt, Human
aucacaggguugggccca

SEQ ID NO: 3627755 - RNA, 20 nt, Human
aucacaggguugggcccaga

SEQ ID NO: 3627756 - RNA, 15 nt, Human
aucacagucuaauuu

SEQ ID NO: 3627757 - RNA, 19 nt, Human
aucacagucuaauuuuuau

SEQ ID NO: 3627758 - RNA, 22 nt, Human
aucacagucuaauuuuuauuca

SEQ ID NO: 3627759 - RNA, 15 nt, Human
aucacauaacagaau

SEQ ID NO: 3627760 - RNA, 12 nt, Human
aucacauccugg

SEQ ID NO: 3627761 - RNA, 20 nt, Human
aucacaugaauuauuacagu

SEQ ID NO: 3627762 - RNA, 17 nt, Human
aucacauguauguuuug

SEQ ID NO: 3627763 - RNA, 12 nt, Human
aucaccagagag

SEQ ID NO: 3627764 - RNA, 15 nt, Human
aucaccauguaagca

SEQ ID NO: 3627765 - RNA, 16 nt, Human
aucacccaacgcucca

SEQ ID NO: 3627766 - RNA, 15 nt, Human
aucacccucuuccug

SEQ ID NO: 3627767 - RNA, 14 nt, Human
aucaccgaaaacgu

SEQ ID NO: 3627768 - RNA, 19 nt, Human
aucaccgaaaacguggcug

SEQ ID NO: 3627769 - RNA, 22 nt, Human
aucaccgacgcgucuccuguuu

SEQ ID NO: 3627770 - RNA, 20 nt, Human
aucaccgagaguagccgaga

SEQ ID NO: 3627771 - RNA, 17 nt, Human
aucaccuaauuaauuuc

SEQ ID NO: 3627772 - RNA, 20 nt, Human
aucaccuaauuaauuucagu

SEQ ID NO: 3627773 - RNA, 19 nt, Human
aucaccuacucacacaggc

SEQ ID NO: 3627774 - RNA, 16 nt, Human
aucaccuagcugaaug

SEQ ID NO: 3627775 - RNA, 23 nt, Human
aucaccuagcugaauguuuuucu

SEQ ID NO: 3627776 - RNA, 16 nt, Human
aucaccucagauggca

SEQ ID NO: 3627777 - RNA, 23 nt, Human
aucaccucagauggcagcuuuua

SEQ ID NO: 3627778 - RNA, 12 nt, Human
aucaccucaggc

SEQ ID NO: 3627779 - RNA, 15 nt, Human
aucaccuccccuccu

SEQ ID NO: 3627780 - RNA, 12 nt, Human
aucaccugaggu

SEQ ID NO: 3627781 - RNA, 12 nt, Human
aucaccugcccu

SEQ ID NO: 3627782 - RNA, 13 nt, Human
aucaccugcccug

SEQ ID NO: 3627783 - RNA, 14 nt, Human
aucaccugccuguu

SEQ ID NO: 3627784 - RNA, 15 nt, Human
aucaccugccuguua

SEQ ID NO: 3627785 - RNA, 21 nt, Human
aucaccuggcuuguuuauuuu

SEQ ID NO: 3627786 - RNA, 22 nt, Human
aucaccugucuugccuuuuuca

SEQ ID NO: 3627787 - RNA, 20 nt, Human
aucaccuuagaccaccaagc

SEQ ID NO: 3627788 - RNA, 15 nt, Human
aucaccuuaggcagg

SEQ ID NO: 3627789 - RNA, 20 nt, Human
aucaccuuaggcagggaagu

SEQ ID NO: 3627790 - RNA, 17 nt, Human
aucacgacgcugcagag

SEQ ID NO: 3627791 - RNA, 17 nt, Human
aucacgccacugcacua

SEQ ID NO: 3627792 - RNA, 17 nt, Human
aucacgccacugcacuc

SEQ ID NO: 3627793 - RNA, 23 nt, Human
aucacgcuccccgccuguucccc

SEQ ID NO: 3627794 - RNA, 18 nt, Human
aucacgcuuuccugaauc

SEQ ID NO: 3627795 - RNA, 18 nt, Human
aucacgcuuuuugaaaaa

SEQ ID NO: 3627796 - RNA, 19 nt, Human
aucacggcucacugcagcc

SEQ ID NO: 3627797 - RNA, 22 nt, Human
aucacggcucacugcagccuca

SEQ ID NO: 3627798 - RNA, 16 nt, Human
aucacguguacuggcu

SEQ ID NO: 3627799 - RNA, 22 nt, Human
aucacguuagaggaaaaauauu

SEQ ID NO: 3627800 - RNA, 16 nt, Human
aucacuaacauuauau

SEQ ID NO: 3627801 - RNA, 18 nt, Human
aucacuaacauuauauug

SEQ ID NO: 3627802 - RNA, 17 nt, Human
aucacuagcccuccuuu

SEQ ID NO: 3627803 - RNA, 15 nt, Human
aucacuauccaugca

SEQ ID NO: 3627804 - RNA, 18 nt, Human
aucacuccccaaggaaga

SEQ ID NO: 3627805 - RNA, 20 nt, Human
aucacuccccaaggaagagc

SEQ ID NO: 3627806 - RNA, 12 nt, Human
aucacuccccuc

SEQ ID NO: 3627807 - RNA, 13 nt, Human
aucacuccccucc

SEQ ID NO: 3627808 - RNA, 20 nt, Human
aucacucuaauuaauuguaa

SEQ ID NO: 3627809 - RNA, 18 nt, Human
aucacucuagguuuuaca

SEQ ID NO: 3627810 - RNA, 21 nt, Human
aucacucugcugcuuagacau

SEQ ID NO: 3627811 - RNA, 16 nt, Human
aucacucuuguggaug

SEQ ID NO: 3627812 - RNA, 12 nt, Human
aucacugaaaua

SEQ ID NO: 3627813 - RNA, 16 nt, Human
aucacugaguuuucca

SEQ ID NO: 3627814 - RNA, 18 nt, Human
aucacugaguuuuccaug

SEQ ID NO: 3627815 - RNA, 22 nt, Human
aucacugcauuauucucuuuua

SEQ ID NO: 3627816 - RNA, 18 nt, Human
aucacugccacacucucc

SEQ ID NO: 3627817 - RNA, 19 nt, Human
aucacugccacacucucca

SEQ ID NO: 3627818 - RNA, 20 nt, Human
aucacugccacacucuccau

SEQ ID NO: 3627819 - RNA, 22 nt, Human
aucacugccacacucuccauca

SEQ ID NO: 3627820 - RNA, 19 nt, Human
aucacugcuugaugaagca

SEQ ID NO: 3627821 - RNA, 21 nt, Human
aucacugcuugaugaagcaag

SEQ ID NO: 3627822 - RNA, 17 nt, Human
aucacuggagcaccagg

SEQ ID NO: 3627823 - RNA, 23 nt, Human
aucacuggagcaccaggcacgaa

SEQ ID NO: 3627824 - RNA, 12 nt, Human
aucacuggagcc

SEQ ID NO: 3627825 - RNA, 14 nt, Human
aucacuggagccca

SEQ ID NO: 3627826 - RNA, 18 nt, Human
aucacuggcaaugaaaaa

SEQ ID NO: 3627827 - RNA, 16 nt, Human
aucacuggcauggugg

SEQ ID NO: 3627828 - RNA, 17 nt, Human
aucacuggcaugguggu

SEQ ID NO: 3627829 - RNA, 22 nt, Human
aucacugguugcacuuaugauu

SEQ ID NO: 3627830 - RNA, 19 nt, Human
aucacugucuuuccuagau

SEQ ID NO: 3627831 - RNA, 16 nt, Human
aucacuguggcugucu

SEQ ID NO: 3627832 - RNA, 15 nt, Human
aucacuguguauauu

SEQ ID NO: 3627833 - RNA, 20 nt, Human
aucacuguuuagaacacaca

SEQ ID NO: 3627834 - RNA, 14 nt, Human
aucacuguuuuuag

SEQ ID NO: 3627835 - RNA, 12 nt, Human
aucacuuaaaac

SEQ ID NO: 3627836 - RNA, 19 nt, Human
aucacuuagcgaacccuuu

SEQ ID NO: 3627837 - RNA, 19 nt, Human
aucacuugagacaaaucua

SEQ ID NO: 3627838 - RNA, 15 nt, Human
aucacuugauucaua

SEQ ID NO: 3627839 - RNA, 18 nt, Human
aucacuugauucauaaag

SEQ ID NO: 3627840 - RNA, 18 nt, Human
aucacuuguacaaaauaa

SEQ ID NO: 3627841 - RNA, 21 nt, Human
aucacuuguacaaaauaaaca

SEQ ID NO: 3627842 - RNA, 18 nt, Human
aucacuuucucaguuuuc

SEQ ID NO: 3627843 - RNA, 20 nt, Human
aucacuuugagccugggaaa

SEQ ID NO: 3627844 - RNA, 14 nt, Human
auccaacuccagca

SEQ ID NO: 3627845 - RNA, 15 nt, Human
auccaacuccagcaa

SEQ ID NO: 3627846 - RNA, 14 nt, Human
auccaacuccagga

SEQ ID NO: 3627847 - RNA, 21 nt, Human
auccaagcaccaccaaacaca

SEQ ID NO: 3627848 - RNA, 19 nt, Human
auccaagccuccacagcga

SEQ ID NO: 3627849 - RNA, 18 nt, Human
auccaagcuggucccacu

SEQ ID NO: 3627850 - RNA, 21 nt, Human
auccaaggaagggauguauuu

SEQ ID NO: 3627851 - RNA, 13 nt, Human
auccaaggagaaa

SEQ ID NO: 3627852 - RNA, 13 nt, Human
auccaaguggccu

SEQ ID NO: 3627853 - RNA, 19 nt, Human
auccaauauuuucuuuaau

SEQ ID NO: 3627854 - RNA, 17 nt, Human
auccaaucagagaccag

SEQ ID NO: 3627855 - RNA, 22 nt, Human
auccaaucagagaccaggcccu

SEQ ID NO: 3627856 - RNA, 19 nt, Human
auccaauccucacugggug

SEQ ID NO: 3627857 - RNA, 20 nt, Human
auccaauccucacugggugg

SEQ ID NO: 3627858 - RNA, 22 nt, Human
auccaauggacugcauaaauaa

SEQ ID NO: 3627859 - RNA, 16 nt, Human
auccaauugcugcuug

SEQ ID NO: 3627860 - RNA, 13 nt, Human
auccaauuggaua

SEQ ID NO: 3627861 - RNA, 20 nt, Human
auccacacacagaggaagag

SEQ ID NO: 3627862 - RNA, 19 nt, Human
auccacacacgcaggaacu

SEQ ID NO: 3627863 - RNA, 14 nt, Human
auccacacaugaau

SEQ ID NO: 3627864 - RNA, 20 nt, Human
auccacagagagucccacug

SEQ ID NO: 3627865 - RNA, 20 nt, Human
auccacaggaaaguguuauu

SEQ ID NO: 3627866 - RNA, 20 nt, Human
auccacagucucccccaccc

SEQ ID NO: 3627867 - RNA, 15 nt, Human
auccacauuguuuua

SEQ ID NO: 3627868 - RNA, 18 nt, Human
auccacauuguuuuaaaa

SEQ ID NO: 3627869 - RNA, 19 nt, Human
auccacauuguuuuaaaaa

SEQ ID NO: 3627870 - RNA, 16 nt, Human
auccacauuucuaaaa

SEQ ID NO: 3627871 - RNA, 15 nt, Human
auccacccaccucag

SEQ ID NO: 3627872 - RNA, 20 nt, Human
auccacccaccucagccucc

SEQ ID NO: 3627873 - RNA, 14 nt, Human
auccacccagccca

SEQ ID NO: 3627874 - RNA, 15 nt, Human
auccacccagcccau

SEQ ID NO: 3627875 - RNA, 16 nt, Human
auccacccauguuauc

SEQ ID NO: 3627876 - RNA, 14 nt, Human
auccaccuccaucu

SEQ ID NO: 3627877 - RNA, 22 nt, Human
auccacguauuccccuucccac

SEQ ID NO: 3627878 - RNA, 19 nt, Human
auccacuagugcaaaucau

SEQ ID NO: 3627879 - RNA, 20 nt, Human
auccacuggguguaaacaca

SEQ ID NO: 3627880 - RNA, 14 nt, Human
auccagaaaaacug

SEQ ID NO: 3627881 - RNA, 12 nt, Human
auccagaaaacu

SEQ ID NO: 3627882 - RNA, 15 nt, Human
auccagaaaacugug

SEQ ID NO: 3627883 - RNA, 14 nt, Human
auccagaaagaaaa

SEQ ID NO: 3627884 - RNA, 22 nt, Human
auccagacaucaugaauuuuac

SEQ ID NO: 3627885 - RNA, 20 nt, Human
auccagaggguugugauuuu

SEQ ID NO: 3627886 - RNA, 20 nt, Human
auccagagucccugccugga

SEQ ID NO: 3627887 - RNA, 20 nt, Human
auccagaucauuccucagaa

SEQ ID NO: 3627888 - RNA, 18 nt, Human
auccagcaguacaauaaa

SEQ ID NO: 3627889 - RNA, 18 nt, Human
auccagcagucucugccu

SEQ ID NO: 3627890 - RNA, 19 nt, Human
auccagcagucucugccuu

SEQ ID NO: 3627891 - RNA, 21 nt, Human
auccagcccugaguuccuagc

SEQ ID NO: 3627892 - RNA, 19 nt, Human
auccagcuugccagaugcu

SEQ ID NO: 3627893 - RNA, 20 nt, Human
auccagcuugccagaugcug

SEQ ID NO: 3627894 - RNA, 23 nt, Human
auccaggacccugccaggcacag

SEQ ID NO: 3627895 - RNA, 22 nt, Human
auccaggacuauauuugggccu

SEQ ID NO: 3627896 - RNA, 13 nt, Human
auccaggacucug

SEQ ID NO: 3627897 - RNA, 15 nt, Human
auccaggagcuccag

SEQ ID NO: 3627898 - RNA, 15 nt, Human
auccaggcaauggcc

SEQ ID NO: 3627899 - RNA, 15 nt, Human
auccaggcacagcug

SEQ ID NO: 3627900 - RNA, 16 nt, Human
auccaggcacagcuga

SEQ ID NO: 3627901 - RNA, 17 nt, Human
auccaggcacagcugag

SEQ ID NO: 3627902 - RNA, 15 nt, Human
auccaggcaccagga

SEQ ID NO: 3627903 - RNA, 15 nt, Human
auccaggcagaucca

SEQ ID NO: 3627904 - RNA, 19 nt, Human
auccaggcagauccaggac

SEQ ID NO: 3627905 - RNA, 22 nt, Human
auccaggcagauccaggacuau

SEQ ID NO: 3627906 - RNA, 21 nt, Human
auccaggccccucccucucca

SEQ ID NO: 3627907 - RNA, 23 nt, Human
auccaggccggcuugccacaccc

SEQ ID NO: 3627908 - RNA, 19 nt, Human
auccagggacagaggcccc

SEQ ID NO: 3627909 - RNA, 19 nt, Human
auccagggcucugaccagu

SEQ ID NO: 3627910 - RNA, 17 nt, Human
auccaggguggugguga

SEQ ID NO: 3627911 - RNA, 15 nt, Human
auccagguacgcaca

SEQ ID NO: 3627912 - RNA, 16 nt, Human
auccagguacgcacag

SEQ ID NO: 3627913 - RNA, 17 nt, Human
auccagguacgcacaga

SEQ ID NO: 3627914 - RNA, 22 nt, Human
auccagguacgcacagacaggu

SEQ ID NO: 3627915 - RNA, 16 nt, Human
auccaggucaacagaa

SEQ ID NO: 3627916 - RNA, 17 nt, Human
auccaggucaacagaau

SEQ ID NO: 3627917 - RNA, 13 nt, Human
auccaguauaaga

SEQ ID NO: 3627918 - RNA, 14 nt, Human
auccaguaucuuga

SEQ ID NO: 3627919 - RNA, 15 nt, Human
auccaguaucuugaa

SEQ ID NO: 3627920 - RNA, 11 nt, Human
auccagugacc

SEQ ID NO: 3627921 - RNA, 21 nt, Human
auccagugaccucucucucug

SEQ ID NO: 3627922 - RNA, 22 nt, Human
auccagugaccucucucucugg

SEQ ID NO: 3627923 - RNA, 16 nt, Human
auccagugauccuuac

SEQ ID NO: 3627924 - RNA, 17 nt, Human
auccagugucucacagc

SEQ ID NO: 3627925 - RNA, 14 nt, Human
auccaguuuuucau

SEQ ID NO: 3627926 - RNA, 13 nt, Human
auccauaaaaaaa

SEQ ID NO: 3627927 - RNA, 14 nt, Human
auccauaaagaagc

SEQ ID NO: 3627928 - RNA, 18 nt, Human
auccauaguaacugacau

SEQ ID NO: 3627929 - RNA, 15 nt, Human
auccauagugacuuu

SEQ ID NO: 3627930 - RNA, 19 nt, Human
auccauaguggacauuguu

SEQ ID NO: 3627931 - RNA, 13 nt, Human
auccauauuuuau

SEQ ID NO: 3627932 - RNA, 23 nt, Human
auccauauuuuauuacuguuuau

SEQ ID NO: 3627933 - RNA, 13 nt, Human
auccaucagugcc

SEQ ID NO: 3627934 - RNA, 15 nt, Human
auccaucagugccaa

SEQ ID NO: 3627935 - RNA, 14 nt, Human
auccauccagaggc

SEQ ID NO: 3627936 - RNA, 22 nt, Human
auccaugaccuaguuuuccaug

SEQ ID NO: 3627937 - RNA, 12 nt, Human
auccaugccuca

SEQ ID NO: 3627938 - RNA, 12 nt, Human
auccauggccag

SEQ ID NO: 3627939 - RNA, 14 nt, Human
auccauggccagca

SEQ ID NO: 3627940 - RNA, 16 nt, Human
auccaugggggcaggg

SEQ ID NO: 3627941 - RNA, 22 nt, Human
auccauggggucucucacagac

SEQ ID NO: 3627942 - RNA, 18 nt, Human
auccauguacuguaguuu

SEQ ID NO: 3627943 - RNA, 16 nt, Human
auccauguuuguaaaa

SEQ ID NO: 3627944 - RNA, 15 nt, Human
auccauuaauuuaaa

SEQ ID NO: 3627945 - RNA, 18 nt, Human
auccauuaggccagcaac

SEQ ID NO: 3627946 - RNA, 16 nt, Human
auccauuaucaugugu

SEQ ID NO: 3627947 - RNA, 19 nt, Human
auccauucccaagaaaugc

SEQ ID NO: 3627948 - RNA, 22 nt, Human
auccauuccucagggacagaga

SEQ ID NO: 3627949 - RNA, 15 nt, Human
auccauucuccugag

SEQ ID NO: 3627950 - RNA, 18 nt, Human
auccauuucaucuauuuc

SEQ ID NO: 3627951 - RNA, 18 nt, Human
auccauuuccccuccuuc

SEQ ID NO: 3627952 - RNA, 15 nt, Human
auccauuucuaauua

SEQ ID NO: 3627953 - RNA, 20 nt, Human
auccauuuggaaaucuuuaa

SEQ ID NO: 3627954 - RNA, 13 nt, Human
auccauuuguaau

SEQ ID NO: 3627955 - RNA, 22 nt, Human
auccauuuuuuauauuucaagu

SEQ ID NO: 3627956 - RNA, 14 nt, Human
aucccaaacuguga

SEQ ID NO: 3627957 - RNA, 20 nt, Human
aucccaaaggacagccgccu

SEQ ID NO: 3627958 - RNA, 11 nt, Human
aucccaacacu

SEQ ID NO: 3627959 - RNA, 16 nt, Human
aucccaaccagugcca

SEQ ID NO: 3627960 - RNA, 17 nt, Human
aucccaaccagugccaa

SEQ ID NO: 3627961 - RNA, 15 nt, Human
aucccaacugucuuu

SEQ ID NO: 3627962 - RNA, 21 nt, Human
aucccaagaucugugcagccc

SEQ ID NO: 3627963 - RNA, 14 nt, Human
aucccaagccuccu

SEQ ID NO: 3627964 - RNA, 17 nt, Human
aucccaaguagaaucuc

SEQ ID NO: 3627965 - RNA, 12 nt, Human
aucccacacagg

SEQ ID NO: 3627966 - RNA, 13 nt, Human
aucccacauccaa

SEQ ID NO: 3627967 - RNA, 18 nt, Human
aucccacccacaugugac

SEQ ID NO: 3627968 - RNA, 20 nt, Human
aucccacccacaugugacac

SEQ ID NO: 3627969 - RNA, 20 nt, Human
aucccaccucuggauaauuu

SEQ ID NO: 3627970 - RNA, 17 nt, Human
aucccacgcacuccaug

SEQ ID NO: 3627971 - RNA, 16 nt, Human
aucccacgcuucucuu

SEQ ID NO: 3627972 - RNA, 19 nt, Human
aucccacuaaugcaaacug

SEQ ID NO: 3627973 - RNA, 12 nt, Human
aucccacuccua

SEQ ID NO: 3627974 - RNA, 16 nt, Human
aucccacuuuugccag

SEQ ID NO: 3627975 - RNA, 14 nt, Human
aucccagcacuuug

SEQ ID NO: 3627976 - RNA, 20 nt, Human
aucccagcacuuugggaggc

SEQ ID NO: 3627977 - RNA, 19 nt, Human
aucccagccccaauuuucu

SEQ ID NO: 3627978 - RNA, 24 nt, Human
aucccagcccccugaccacucaga

SEQ ID NO: 3627979 - RNA, 20 nt, Human
aucccagcuacuugggaagc

SEQ ID NO: 3627980 - RNA, 13 nt, Human
aucccagcucacg

SEQ ID NO: 3627981 - RNA, 14 nt, Human
aucccagcugccua

SEQ ID NO: 3627982 - RNA, 17 nt, Human
aucccaggacaccacac

SEQ ID NO: 3627983 - RNA, 21 nt, Human
aucccaggacaccacacccag

SEQ ID NO: 3627984 - RNA, 19 nt, Human
aucccaggaugcugggugg

SEQ ID NO: 3627985 - RNA, 18 nt, Human
aucccaggccccuggagg

SEQ ID NO: 3627986 - RNA, 12 nt, Human
aucccaggggac

SEQ ID NO: 3627987 - RNA, 20 nt, Human
aucccaggggaccacaccuc

SEQ ID NO: 3627988 - RNA, 23 nt, Human
aucccaggggaccacaccucccu

SEQ ID NO: 3627989 - RNA, 15 nt, Human
augaucuugugacau

SEQ ID NO: 3627990 - RNA, 20 nt, Human
augaucuuucuuuccuuucu

SEQ ID NO: 3627991 - RNA, 18 nt, Human
augaucuuugcagacagg

SEQ ID NO: 3627992 - RNA, 21 nt, Human
augaucuuugcagacaggcaa

SEQ ID NO: 3627993 - RNA, 15 nt, Human
augaucuuuucaagu

SEQ ID NO: 3627994 - RNA, 20 nt, Human
augaugaaaaccuacauauu

SEQ ID NO: 3627995 - RNA, 12 nt, Human
augaugaaaauu

SEQ ID NO: 3627996 - RNA, 18 nt, Human
augaugaaaugaggucag

SEQ ID NO: 3627997 - RNA, 15 nt, Human
augaugaaugagaau

SEQ ID NO: 3627998 - RNA, 17 nt, Human
augaugacaaaaaaugu

SEQ ID NO: 3627999 - RNA, 20 nt, Human
augaugacaacuacagaaaa

SEQ ID NO: 3628000 - RNA, 19 nt, Human
augaugacuuaguacaaag

SEQ ID NO: 3628001 - RNA, 19 nt, Human
augaugagaauuucuaaaa

SEQ ID NO: 3628002 - RNA, 20 nt, Human
augaugagccuucgugcccc

SEQ ID NO: 3628003 - RNA, 22 nt, Human
augaugauccggauuuaauuug

SEQ ID NO: 3628004 - RNA, 20 nt, Human
augaugauguggaagaacuu

SEQ ID NO: 3628005 - RNA, 11 nt, Human
augaugcacau

SEQ ID NO: 3628006 - RNA, 16 nt, Human
augaugcacauuucau

SEQ ID NO: 3628007 - RNA, 14 nt, Human
augaugcagucucc

SEQ ID NO: 3628008 - RNA, 18 nt, Human
augaugccacaccaagcu

SEQ ID NO: 3628009 - RNA, 16 nt, Human
augaugccaugaggaa

SEQ ID NO: 3628010 - RNA, 16 nt, Human
augaugcccugcucca

SEQ ID NO: 3628011 - RNA, 16 nt, Human
augaugcucuuuccca

SEQ ID NO: 3628012 - RNA, 16 nt, Human
augaugcuuuuacuga

SEQ ID NO: 3628013 - RNA, 15 nt, Human
augauggaauuucau

SEQ ID NO: 3628014 - RNA, 17 nt, Human
augauggagcgcaccug

SEQ ID NO: 3628015 - RNA, 15 nt, Human
augauggagucaggu

SEQ ID NO: 3628016 - RNA, 12 nt, Human
augauggcccau

SEQ ID NO: 3628017 - RNA, 15 nt, Human
augauggcccauucu

SEQ ID NO: 3628018 - RNA, 19 nt, Human
augauggcccauucuacuu

SEQ ID NO: 3628019 - RNA, 21 nt, Human
augauggcccauucuacuugc

SEQ ID NO: 3628020 - RNA, 20 nt, Human
augaugguuuccaauuucau

SEQ ID NO: 3628021 - RNA, 21 nt, Human
augauguaaucucucugcagc

SEQ ID NO: 3628022 - RNA, 21 nt, Human
augauguacagauucuuucag

SEQ ID NO: 3628023 - RNA, 21 nt, Human
augauguagugccucuuucau

SEQ ID NO: 3628024 - RNA, 18 nt, Human
augauguauacugccacu

SEQ ID NO: 3628025 - RNA, 12 nt, Human
augauguauauu

SEQ ID NO: 3628026 - RNA, 14 nt, Human
augauguccagaag

SEQ ID NO: 3628027 - RNA, 18 nt, Human
augauguccagaagaaua

SEQ ID NO: 3628028 - RNA, 19 nt, Human
augauguccagaagaauau

SEQ ID NO: 3628029 - RNA, 20 nt, Human
augaugugaaacacuuugcc

SEQ ID NO: 3628030 - RNA, 14 nt, Human
augaugugccuggg

SEQ ID NO: 3628031 - RNA, 13 nt, Human
augaugugcuuaa

SEQ ID NO: 3628032 - RNA, 23 nt, Human
augauguggaguggggcaguaga

SEQ ID NO: 3628033 - RNA, 19 nt, Human
augaugugggucaaggaau

SEQ ID NO: 3628034 - RNA, 14 nt, Human
augauguguauaua

SEQ ID NO: 3628035 - RNA, 16 nt, Human
augaugugugaaaacu

SEQ ID NO: 3628036 - RNA, 15 nt, Human
augauguguugugau

SEQ ID NO: 3628037 - RNA, 21 nt, Human
augauguuaaaaaaauaagaa

SEQ ID NO: 3628038 - RNA, 15 nt, Human
augauguuucacaua

SEQ ID NO: 3628039 - RNA, 16 nt, Human
augauguuugcccaaa

SEQ ID NO: 3628040 - RNA, 19 nt, Human
augauguuugcccaaaauu

SEQ ID NO: 3628041 - RNA, 21 nt, Human
augauguuugcccaaaauuua

SEQ ID NO: 3628042 - RNA, 22 nt, Human
augauguuuuuaaaaucuuauu

SEQ ID NO: 3628043 - RNA, 17 nt, Human
augauuaaauaagauuc

SEQ ID NO: 3628044 - RNA, 20 nt, Human
augauuaaauaagauucuaa

SEQ ID NO: 3628045 - RNA, 19 nt, Human
augauuaaccacuucagcu

SEQ ID NO: 3628046 - RNA, 19 nt, Human
augauuacucuuugagaua

SEQ ID NO: 3628047 - RNA, 22 nt, Human
augauuacuggccuuuuucauu

SEQ ID NO: 3628048 - RNA, 15 nt, Human
augauuaguaaagaa

SEQ ID NO: 3628049 - RNA, 22 nt, Human
augauuaugaauuacauuugua

SEQ ID NO: 3628050 - RNA, 14 nt, Human
augauuauuuucaa

SEQ ID NO: 3628051 - RNA, 20 nt, Human
augauuauuuuuuucuguaa

SEQ ID NO: 3628052 - RNA, 17 nt, Human
augauucauauauuuua

SEQ ID NO: 3628053 - RNA, 15 nt, Human
augauuccagguggc

SEQ ID NO: 3628054 - RNA, 16 nt, Human
augauuccagguggca

SEQ ID NO: 3628055 - RNA, 15 nt, Human
augauuccuuccugu

SEQ ID NO: 3628056 - RNA, 18 nt, Human
augauucguguaauuacu

SEQ ID NO: 3628057 - RNA, 22 nt, Human
augauucuauuuauauguacau

SEQ ID NO: 3628058 - RNA, 23 nt, Human
augauucuauuuauauguacaug

SEQ ID NO: 3628059 - RNA, 23 nt, Human
augauucugcuuuuaccaugccc

SEQ ID NO: 3628060 - RNA, 19 nt, Human
augauugaauuauauguuc

SEQ ID NO: 3628061 - RNA, 13 nt, Human
augauugcuuuua

SEQ ID NO: 3628062 - RNA, 22 nt, Human
augauuggauuauucauuuaaa

SEQ ID NO: 3628063 - RNA, 18 nt, Human
augauuguaaaauagcuu

SEQ ID NO: 3628064 - RNA, 12 nt, Human
augauuguuucu

SEQ ID NO: 3628065 - RNA, 14 nt, Human
augauuuaauaaaa

SEQ ID NO: 3628066 - RNA, 19 nt, Human
augauuuaauaaaauaauu

SEQ ID NO: 3628067 - RNA, 22 nt, Human
augauuuaauaaaauaauucua

SEQ ID NO: 3628068 - RNA, 14 nt, Human
augauuuacucauu

SEQ ID NO: 3628069 - RNA, 13 nt, Human
augauuuauaguu

SEQ ID NO: 3628070 - RNA, 14 nt, Human
augauuuauaguuu

SEQ ID NO: 3628071 - RNA, 22 nt, Human
augauuucacaaauauuaaaaa

SEQ ID NO: 3628072 - RNA, 18 nt, Human
augauuucacuagaaaag

SEQ ID NO: 3628073 - RNA, 13 nt, Human
augauuucagaaa

SEQ ID NO: 3628074 - RNA, 14 nt, Human
augauuucagaaac

SEQ ID NO: 3628075 - RNA, 13 nt, Human
augauuucaugua

SEQ ID NO: 3628076 - RNA, 14 nt, Human
augauuucauguac

SEQ ID NO: 3628077 - RNA, 19 nt, Human
augauuuccccccuccgcc

SEQ ID NO: 3628078 - RNA, 12 nt, Human
augauuugcaau

SEQ ID NO: 3628079 - RNA, 21 nt, Human
augauuuuacuuagcaauguu

SEQ ID NO: 3628080 - RNA, 16 nt, Human
augauuuuauuugaca

SEQ ID NO: 3628081 - RNA, 15 nt, Human
augauuuucauaacu

SEQ ID NO: 3628082 - RNA, 22 nt, Human
augauuuucauaacuuauugcu

SEQ ID NO: 3628083 - RNA, 13 nt, Human
augauuuuuagau

SEQ ID NO: 3628084 - RNA, 15 nt, Human
augauuuuucuuuac

SEQ ID NO: 3628085 - RNA, 19 nt, Human
augauuuuucuuuacaaaa

SEQ ID NO: 3628086 - RNA, 21 nt, Human
augauuuuuuuuucauacacu

SEQ ID NO: 3628087 - RNA, 19 nt, Human
augcaaaaauuagccgggc

SEQ ID NO: 3628088 - RNA, 14 nt, Human
augcaaaagguuua

SEQ ID NO: 3628089 - RNA, 21 nt, Human
augcaaaaguucugacuugac

SEQ ID NO: 3628090 - RNA, 17 nt, Human
augcaaaauauguuuaa

SEQ ID NO: 3628091 - RNA, 12 nt, Human
augcaaaaugga

SEQ ID NO: 3628092 - RNA, 16 nt, Human
augcaaaccaucauug

SEQ ID NO: 3628093 - RNA, 19 nt, Human
augcaaaccaucauugaaa

SEQ ID NO: 3628094 - RNA, 22 nt, Human
augcaaaccaucauugaaaucu

SEQ ID NO: 3628095 - RNA, 14 nt, Human
augcaaagcacuga

SEQ ID NO: 3628096 - RNA, 15 nt, Human
augcaaaggcuggga

SEQ ID NO: 3628097 - RNA, 16 nt, Human
augcaaaguacaaugu

SEQ ID NO: 3628098 - RNA, 13 nt, Human
augcaaaguauaa

SEQ ID NO: 3628099 - RNA, 18 nt, Human
augcaaauauuuuuuugu

SEQ ID NO: 3628100 - RNA, 21 nt, Human
augcaaaugagcucugaaauc

SEQ ID NO: 3628101 - RNA, 21 nt, Human
augcaacaacauguauaauau

SEQ ID NO: 3628102 - RNA, 20 nt, Human
augcaacacgcauggucaac

SEQ ID NO: 3628103 - RNA, 19 nt, Human
augcaacauguguacuuaa

SEQ ID NO: 3628104 - RNA, 13 nt, Human
augcaagaaggag

SEQ ID NO: 3628105 - RNA, 17 nt, Human
augcaagacgcccucua

SEQ ID NO: 3628106 - RNA, 23 nt, Human
augcaagcagaggaccagggccu

SEQ ID NO: 3628107 - RNA, 22 nt, Human
augcaagcaguuucaauaaagu

SEQ ID NO: 3628108 - RNA, 23 nt, Human
augcaagcaguuucaauaaaguu

SEQ ID NO: 3628109 - RNA, 15 nt, Human
augcaaggaaggaaa

SEQ ID NO: 3628110 - RNA, 18 nt, Human
augcaaggaaggaaagaa

SEQ ID NO: 3628111 - RNA, 14 nt, Human
augcaaggaccagg

SEQ ID NO: 3628112 - RNA, 13 nt, Human
augcaagggacug

SEQ ID NO: 3628113 - RNA, 22 nt, Human
augcaaggucauuuuuuuuaag

SEQ ID NO: 3628114 - RNA, 18 nt, Human
augcaauaaaauuauuug

SEQ ID NO: 3628115 - RNA, 19 nt, Human
augcaauauaucuaaauug

SEQ ID NO: 3628116 - RNA, 17 nt, Human
augcaauccuuacaaau

SEQ ID NO: 3628117 - RNA, 19 nt, Human
augcaaugacaucuucaaa

SEQ ID NO: 3628118 - RNA, 23 nt, Human
augcaaugagauagaagauguuu

SEQ ID NO: 3628119 - RNA, 24 nt, Human
augcaauguaagcauacuuuguaa

SEQ ID NO: 3628120 - RNA, 18 nt, Human
augcaaugugcuacugau

SEQ ID NO: 3628121 - RNA, 16 nt, Human
augcacaaacagaggc

SEQ ID NO: 3628122 - RNA, 18 nt, Human
augcacaaacagaggccg

SEQ ID NO: 3628123 - RNA, 14 nt, Human
augcacacaaaaca

SEQ ID NO: 3628124 - RNA, 10 nt, Human
augcacacac

SEQ ID NO: 3628125 - RNA, 15 nt, Human
augcacacacauaua

SEQ ID NO: 3628126 - RNA, 13 nt, Human
augcacacauuuu

SEQ ID NO: 3628127 - RNA, 14 nt, Human
augcacacauuuuu

SEQ ID NO: 3628128 - RNA, 22 nt, Human
augcacacauuuuuuaaaugca

SEQ ID NO: 3628129 - RNA, 16 nt, Human
augcacaccucccccu

SEQ ID NO: 3628130 - RNA, 20 nt, Human
augcacacuagccucuccag

SEQ ID NO: 3628131 - RNA, 11 nt, Human
augcacagaga

SEQ ID NO: 3628132 - RNA, 19 nt, Human
augcacagaguuguuacau

SEQ ID NO: 3628133 - RNA, 22 nt, Human
augcacagaguuguuacauuuu

SEQ ID NO: 3628134 - RNA, 18 nt, Human
augccacagcccugucag

SEQ ID NO: 3628135 - RNA, 15 nt, Human
augccacccacaucu

SEQ ID NO: 3628136 - RNA, 19 nt, Human
augccacccccgcuggagg

SEQ ID NO: 3628137 - RNA, 21 nt, Human
augccacccccgcuggaggau

SEQ ID NO: 3628138 - RNA, 22 nt, Human
augccacgcgguacaaaggaaa

SEQ ID NO: 3628139 - RNA, 15 nt, Human
augccacugccuucg

SEQ ID NO: 3628140 - RNA, 22 nt, Human
augccagagacggaagccuuuu

SEQ ID NO: 3628141 - RNA, 22 nt, Human
augccagccaagcucugcaguc

SEQ ID NO: 3628142 - RNA, 18 nt, Human
augccagcucagucccau

SEQ ID NO: 3628143 - RNA, 12 nt, Human
augccagcuggc

SEQ ID NO: 3628144 - RNA, 23 nt, Human
augccagggccaugucagacaca

SEQ ID NO: 3628145 - RNA, 21 nt, Human
augccagggccgaccagagga

SEQ ID NO: 3628146 - RNA, 13 nt, Human
augccaggggccu

SEQ ID NO: 3628147 - RNA, 18 nt, Human
augccagguucuauuugg

SEQ ID NO: 3628148 - RNA, 17 nt, Human
augccaguaacaggcuc

SEQ ID NO: 3628149 - RNA, 13 nt, Human
augccaguauuuu

SEQ ID NO: 3628150 - RNA, 14 nt, Human
augccaguauuuuu

SEQ ID NO: 3628151 - RNA, 22 nt, Human
augccaguauuuuuaaaggcau

SEQ ID NO: 3628152 - RNA, 20 nt, Human
augccaguccagaugugccu

SEQ ID NO: 3628153 - RNA, 14 nt, Human
augccaucaauaaa

SEQ ID NO: 3628154 - RNA, 14 nt, Human
augccaucaucucc

SEQ ID NO: 3628155 - RNA, 13 nt, Human
augccauccucuu

SEQ ID NO: 3628156 - RNA, 15 nt, Human
augccauccucuuuc

SEQ ID NO: 3628157 - RNA, 17 nt, Human
augccaucugugggcac

SEQ ID NO: 3628158 - RNA, 15 nt, Human
augccauuuguuuau

SEQ ID NO: 3628159 - RNA, 17 nt, Human
augcccaagcccugaga

SEQ ID NO: 3628160 - RNA, 12 nt, Human
augcccaaggga

SEQ ID NO: 3628161 - RNA, 17 nt, Human
augcccacccccugccc

SEQ ID NO: 3628162 - RNA, 19 nt, Human
augcccaccugcccaucac

SEQ ID NO: 3628163 - RNA, 20 nt, Human
augcccaccugcccaucaca

SEQ ID NO: 3628164 - RNA, 14 nt, Human
augcccagagaccc

SEQ ID NO: 3628165 - RNA, 17 nt, Human
augcccagagacccagc

SEQ ID NO: 3628166 - RNA, 22 nt, Human
augcccagagggcccaggcagg

SEQ ID NO: 3628167 - RNA, 23 nt, Human
augcccagagggcccaggcaggc

SEQ ID NO: 3628168 - RNA, 14 nt, Human
augcccagccccuu

SEQ ID NO: 3628169 - RNA, 16 nt, Human
augcccagccccuucu

SEQ ID NO: 3628170 - RNA, 16 nt, Human
augcccagcucagagg

SEQ ID NO: 3628171 - RNA, 15 nt, Human
augccccagagcugu

SEQ ID NO: 3628172 - RNA, 18 nt, Human
augccccaucccaugcug

SEQ ID NO: 3628173 - RNA, 13 nt, Human
augcccccagcug

SEQ ID NO: 3628174 - RNA, 14 nt, Human
augcccccagcugg

SEQ ID NO: 3628175 - RNA, 15 nt, Human
augcccccucgugcc

SEQ ID NO: 3628176 - RNA, 17 nt, Human
augcccccucgugccag

SEQ ID NO: 3628177 - RNA, 21 nt, Human
augcccccuuucagaugucuu

SEQ ID NO: 3628178 - RNA, 18 nt, Human
augccccggccaccucug

SEQ ID NO: 3628179 - RNA, 19 nt, Human
augccccggccaccucugc

SEQ ID NO: 3628180 - RNA, 15 nt, Human
augccccugaauuua

SEQ ID NO: 3628181 - RNA, 14 nt, Human
augccccuuucugg

SEQ ID NO: 3628182 - RNA, 17 nt, Human
augcccggcuaauuuuu

SEQ ID NO: 3628183 - RNA, 16 nt, Human
augcccucccuucucc

SEQ ID NO: 3628184 - RNA, 17 nt, Human
augcccucccuucuccc

SEQ ID NO: 3628185 - RNA, 20 nt, Human
augcccucccuucucccugg

SEQ ID NO: 3628186 - RNA, 14 nt, Human
augcccuccucucc

SEQ ID NO: 3628187 - RNA, 22 nt, Human
augcccugcuagaugagaauuc

SEQ ID NO: 3628188 - RNA, 23 nt, Human
augcccugcucugaacacgaagc

SEQ ID NO: 3628189 - RNA, 15 nt, Human
augcccuuaaaucau

SEQ ID NO: 3628190 - RNA, 12 nt, Human
augcccuucacu

SEQ ID NO: 3628191 - RNA, 21 nt, Human
augccgaaugcccucagggga

SEQ ID NO: 3628192 - RNA, 19 nt, Human
augccgauuucuguaaacu

SEQ ID NO: 3628193 - RNA, 16 nt, Human
augccggaugugcuuu

SEQ ID NO: 3628194 - RNA, 14 nt, Human
augccguuacuuuu

SEQ ID NO: 3628195 - RNA, 16 nt, Human
augccuaccaauauuu

SEQ ID NO: 3628196 - RNA, 16 nt, Human
augccuaugguggauc

SEQ ID NO: 3628197 - RNA, 19 nt, Human
augccuaugguggauccaa

SEQ ID NO: 3628198 - RNA, 21 nt, Human
augccuaugguggauccaaac

SEQ ID NO: 3628199 - RNA, 12 nt, Human
augccuauugua

SEQ ID NO: 3628200 - RNA, 15 nt, Human
augccucaaugugac

SEQ ID NO: 3628201 - RNA, 21 nt, Human
augccucacuaauuuuuguau

SEQ ID NO: 3628202 - RNA, 23 nt, Human
augccucagaagugcaucuggag

SEQ ID NO: 3628203 - RNA, 23 nt, Human
augccucagccacuugccugugc

SEQ ID NO: 3628204 - RNA, 13 nt, Human
augccucagcccu

SEQ ID NO: 3628205 - RNA, 16 nt, Human
augccucaguguauuu

SEQ ID NO: 3628206 - RNA, 22 nt, Human
augccucccuaucccucacaca

SEQ ID NO: 3628207 - RNA, 14 nt, Human
augccucccugagc

SEQ ID NO: 3628208 - RNA, 20 nt, Human
augccucuccuuuguauauu

SEQ ID NO: 3628209 - RNA, 13 nt, Human
augccucucucag

SEQ ID NO: 3628210 - RNA, 14 nt, Human
augccucucucagg

SEQ ID NO: 3628211 - RNA, 17 nt, Human
augccucucucaggcca

SEQ ID NO: 3628212 - RNA, 18 nt, Human
augccucugaggccagcc

SEQ ID NO: 3628213 - RNA, 22 nt, Human
augccucugauaugggacugag

SEQ ID NO: 3628214 - RNA, 23 nt, Human
augccugcuuuuuggaaagucag

SEQ ID NO: 3628215 - RNA, 19 nt, Human
augccuggauggggcugca

SEQ ID NO: 3628216 - RNA, 21 nt, Human
augccuggauggggcugcacc

SEQ ID NO: 3628217 - RNA, 18 nt, Human
augccuggucuuuccucu

SEQ ID NO: 3628218 - RNA, 17 nt, Human
augccuggugagcauua

SEQ ID NO: 3628219 - RNA, 11 nt, Human
augccuggugg

SEQ ID NO: 3628220 - RNA, 13 nt, Human
augccugguggca

SEQ ID NO: 3628221 - RNA, 21 nt, Human
augccuguacucgcuugugca

SEQ ID NO: 3628222 - RNA, 23 nt, Human
augccuguacucgcuugugcaga

SEQ ID NO: 3628223 - RNA, 18 nt, Human
augccuguccagccuggg

SEQ ID NO: 3628224 - RNA, 14 nt, Human
augccuguggcugc

SEQ ID NO: 3628225 - RNA, 16 nt, Human
augccuuaaaauggaa

SEQ ID NO: 3628226 - RNA, 19 nt, Human
augccuuccagcacccugc

SEQ ID NO: 3628227 - RNA, 20 nt, Human
augccuucuuauugcuuuua

SEQ ID NO: 3628228 - RNA, 22 nt, Human
augccuuggggaggacaaaacu

SEQ ID NO: 3628229 - RNA, 18 nt, Human
augccuuguuucauauuu

SEQ ID NO: 3628230 - RNA, 22 nt, Human
augccuuuaaaguaugaaucua

SEQ ID NO: 3628231 - RNA, 21 nt, Human
augccuuuaaaucugugauga

SEQ ID NO: 3628232 - RNA, 13 nt, Human
augccuuugagac

SEQ ID NO: 3628233 - RNA, 22 nt, Human
augccuuugagacaguuucuua

SEQ ID NO: 3628234 - RNA, 12 nt, Human
augccuuuguaa

SEQ ID NO: 3628235 - RNA, 21 nt, Human
augccuuuguacuuuagggaa

SEQ ID NO: 3628236 - RNA, 16 nt, Human
augccuuuuuuguagu

SEQ ID NO: 3628237 - RNA, 19 nt, Human
augcgauuuuauuacuggc

SEQ ID NO: 3628238 - RNA, 14 nt, Human
augcgcaggcuggc

SEQ ID NO: 3628239 - RNA, 14 nt, Human
augcgcagugccuu

SEQ ID NO: 3628240 - RNA, 16 nt, Human
augcgcauucuaaccu

SEQ ID NO: 3628241 - RNA, 22 nt, Human
augcgcauucuaaccuggaggu

SEQ ID NO: 3628242 - RNA, 18 nt, Human
augcgccaauaaaccaau

SEQ ID NO: 3628243 - RNA, 18 nt, Human
augcgcccccuccgcccu

SEQ ID NO: 3628244 - RNA, 15 nt, Human
augcgcucagggcca

SEQ ID NO: 3628245 - RNA, 14 nt, Human
augcgcuguggcca

SEQ ID NO: 3628246 - RNA, 18 nt, Human
augcggcccagcccggcu

SEQ ID NO: 3628247 - RNA, 20 nt, Human
augcggcccaggauggcuuu

SEQ ID NO: 3628248 - RNA, 14 nt, Human
augcgguagccagc

SEQ ID NO: 3628249 - RNA, 21 nt, Human
augcguacguuuccugagaag

SEQ ID NO: 3628250 - RNA, 19 nt, Human
augcgucccaagauguuga

SEQ ID NO: 3628251 - RNA, 20 nt, Human
augcgugcauaccacuuuug

SEQ ID NO: 3628252 - RNA, 12 nt, Human
augcgugugugu

SEQ ID NO: 3628253 - RNA, 16 nt, Human
augcgugugugugugu

SEQ ID NO: 3628254 - RNA, 12 nt, Human
augcuaaaccuu

SEQ ID NO: 3628255 - RNA, 14 nt, Human
augcuaaagaaaaa

SEQ ID NO: 3628256 - RNA, 23 nt, Human
augcuaaagaaaaagucauccaa

SEQ ID NO: 3628257 - RNA, 21 nt, Human
augcuaaauguaagaaucauu

SEQ ID NO: 3628258 - RNA, 23 nt, Human
augcuaacaguucacuugcagug

SEQ ID NO: 3628259 - RNA, 16 nt, Human
augcuaagaauuuuuu

SEQ ID NO: 3628260 - RNA, 16 nt, Human
augcuaagagaaguag

SEQ ID NO: 3628261 - RNA, 13 nt, Human
augcuaagugaaa

SEQ ID NO: 3628262 - RNA, 19 nt, Human
augcuaauauuaaaaguca

SEQ ID NO: 3628263 - RNA, 17 nt, Human
augcuacaauuuuaaga

SEQ ID NO: 3628264 - RNA, 15 nt, Human
augcuacaguaauaa

SEQ ID NO: 3628265 - RNA, 14 nt, Human
augcuaccaccagc

SEQ ID NO: 3628266 - RNA, 15 nt, Human
augcuaccaccagcu

SEQ ID NO: 3628267 - RNA, 22 nt, Human
augcuaccaccagcugugucca

SEQ ID NO: 3628268 - RNA, 19 nt, Human
augcuaccaugccucucca

SEQ ID NO: 3628269 - RNA, 19 nt, Human
augcuaccccacuaugaca

SEQ ID NO: 3628270 - RNA, 17 nt, Human
augcuacgugugauuuu

SEQ ID NO: 3628271 - RNA, 20 nt, Human
augcuacgugugauuuuucu

SEQ ID NO: 3628272 - RNA, 15 nt, Human
augcuagaacucccu

SEQ ID NO: 3628273 - RNA, 19 nt, Human
augcuagaacucccuuuca

SEQ ID NO: 3628274 - RNA, 22 nt, Human
augcuagaacucccuuucaaca

SEQ ID NO: 3628275 - RNA, 18 nt, Human
augcuagcgcguugccug

SEQ ID NO: 3628276 - RNA, 13 nt, Human
augcuagguucua

SEQ ID NO: 3628277 - RNA, 17 nt, Human
augcuauggucagguua

SEQ ID NO: 3628278 - RNA, 16 nt, Human
auggaguguacaagua

SEQ ID NO: 3628279 - RNA, 23 nt, Human
auggaguuggaguucauucauau

SEQ ID NO: 3628280 - RNA, 15 nt, Human
auggaguuucuaagg

SEQ ID NO: 3628281 - RNA, 21 nt, Human
auggauaaaauaaugcugcaa

SEQ ID NO: 3628282 - RNA, 18 nt, Human
auggauaaccuauaugau

SEQ ID NO: 3628283 - RNA, 19 nt, Human
auggauaaccuauaugauu

SEQ ID NO: 3628284 - RNA, 18 nt, Human
auggauaggcacaggaaa

SEQ ID NO: 3628285 - RNA, 21 nt, Human
auggauauuuguacuguuuaa

SEQ ID NO: 3628286 - RNA, 15 nt, Human
auggaucacaagaug

SEQ ID NO: 3628287 - RNA, 17 nt, Human
auggauccccagugaaa

SEQ ID NO: 3628288 - RNA, 20 nt, Human
auggaucgauauuaauguau

SEQ ID NO: 3628289 - RNA, 13 nt, Human
auggaugauucag

SEQ ID NO: 3628290 - RNA, 18 nt, Human
auggaugauucagaaauu

SEQ ID NO: 3628291 - RNA, 22 nt, Human
auggaugccaauauuaaaucug

SEQ ID NO: 3628292 - RNA, 19 nt, Human
auggaugcccagaggacuc

SEQ ID NO: 3628293 - RNA, 12 nt, Human
auggauggaaaa

SEQ ID NO: 3628294 - RNA, 17 nt, Human
auggauguggggucccc

SEQ ID NO: 3628295 - RNA, 22 nt, Human
auggauguuuuagccauuguug

SEQ ID NO: 3628296 - RNA, 18 nt, Human
auggauuauaaucagaau

SEQ ID NO: 3628297 - RNA, 16 nt, Human
auggauucaguuucua

SEQ ID NO: 3628298 - RNA, 18 nt, Human
auggauucauuacagcuu

SEQ ID NO: 3628299 - RNA, 14 nt, Human
auggauucuaaaau

SEQ ID NO: 3628300 - RNA, 15 nt, Human
auggauucuaaaaug

SEQ ID NO: 3628301 - RNA, 16 nt, Human
auggauucucagauau

SEQ ID NO: 3628302 - RNA, 22 nt, Human
auggauuggauuauuuaauaac

SEQ ID NO: 3628303 - RNA, 23 nt, Human
auggauuggguaucaaaaugaau

SEQ ID NO: 3628304 - RNA, 14 nt, Human
auggauuugaagca

SEQ ID NO: 3628305 - RNA, 21 nt, Human
auggauuugccugugccaccc

SEQ ID NO: 3628306 - RNA, 22 nt, Human
auggauuuggcacuagccaaag

SEQ ID NO: 3628307 - RNA, 21 nt, Human
auggauuuugggagugacuca

SEQ ID NO: 3628308 - RNA, 18 nt, Human
auggcaaccauuauaacc

SEQ ID NO: 3628309 - RNA, 19 nt, Human
auggcaaggacugcaggga

SEQ ID NO: 3628310 - RNA, 21 nt, Human
auggcaaggcagcccugucug

SEQ ID NO: 3628311 - RNA, 16 nt, Human
auggcaauguuuugcu

SEQ ID NO: 3628312 - RNA, 20 nt, Human
auggcaauguuuugcuuuug

SEQ ID NO: 3628313 - RNA, 21 nt, Human
auggcacagggcaugaaauga

SEQ ID NO: 3628314 - RNA, 17 nt, Human
auggcacaucagcacga

SEQ ID NO: 3628315 - RNA, 17 nt, Human
auggcaccuucagacuu

SEQ ID NO: 3628316 - RNA, 18 nt, Human
auggcacucccuccagca

SEQ ID NO: 3628317 - RNA, 21 nt, Human
auggcacucccuccagcacaa

SEQ ID NO: 3628318 - RNA, 22 nt, Human
auggcacuuagcuaucagaaga

SEQ ID NO: 3628319 - RNA, 17 nt, Human
auggcacuugcaucugu

SEQ ID NO: 3628320 - RNA, 21 nt, Human
auggcagaaaaaaugucugua

SEQ ID NO: 3628321 - RNA, 19 nt, Human
auggcagaagacaccagag

SEQ ID NO: 3628322 - RNA, 19 nt, Human
auggcagaggaauaucaau

SEQ ID NO: 3628323 - RNA, 15 nt, Human
auggcagaguuguaa

SEQ ID NO: 3628324 - RNA, 17 nt, Human
auggcagaguuguaaau

SEQ ID NO: 3628325 - RNA, 18 nt, Human
auggcagaguuguaaaua

SEQ ID NO: 3628326 - RNA, 19 nt, Human
auggcagaguuuguguguu

SEQ ID NO: 3628327 - RNA, 20 nt, Human
auggcagaguuuguguguug

SEQ ID NO: 3628328 - RNA, 23 nt, Human
auggcagaguuuguguguugucu

SEQ ID NO: 3628329 - RNA, 14 nt, Human
auggcagauguagg

SEQ ID NO: 3628330 - RNA, 20 nt, Human
auggcagauguaggagggac

SEQ ID NO: 3628331 - RNA, 16 nt, Human
auggcagcaggccugu

SEQ ID NO: 3628332 - RNA, 19 nt, Human
auggcagcaggccuguugc

SEQ ID NO: 3628333 - RNA, 19 nt, Human
auggcagccuacucuccuu

SEQ ID NO: 3628334 - RNA, 20 nt, Human
auggcagcuguuuaaauguu

SEQ ID NO: 3628335 - RNA, 15 nt, Human
auggcagggggcugc

SEQ ID NO: 3628336 - RNA, 22 nt, Human
auggcagggggcugcugcuggg

SEQ ID NO: 3628337 - RNA, 17 nt, Human
auggcaggggguggaau

SEQ ID NO: 3628338 - RNA, 24 nt, Human
auggcaggggguggaauuauuacu

SEQ ID NO: 3628339 - RNA, 19 nt, Human
auggcaggugauguccugu

SEQ ID NO: 3628340 - RNA, 22 nt, Human
auggcaucccuuuuucauaaau

SEQ ID NO: 3628341 - RNA, 17 nt, Human
auggcauccugugaagu

SEQ ID NO: 3628342 - RNA, 16 nt, Human
auggccaccuuuucag

SEQ ID NO: 3628343 - RNA, 17 nt, Human
auggccaccuuuucagc

SEQ ID NO: 3628344 - RNA, 21 nt, Human
auggccagccccuuagacaga

SEQ ID NO: 3628345 - RNA, 22 nt, Human
auggccagccccuuagacagag

SEQ ID NO: 3628346 - RNA, 22 nt, Human
auggccagguggccacuccaga

SEQ ID NO: 3628347 - RNA, 15 nt, Human
auggccagugucugu

SEQ ID NO: 3628348 - RNA, 17 nt, Human
auggccagugucugucc

SEQ ID NO: 3628349 - RNA, 22 nt, Human
auggccagugucugucccgggg

SEQ ID NO: 3628350 - RNA, 14 nt, Human
auggccccagcaca

SEQ ID NO: 3628351 - RNA, 20 nt, Human
auggccccagcacagcuuga

SEQ ID NO: 3628352 - RNA, 17 nt, Human
auggcccggaugcugcu

SEQ ID NO: 3628353 - RNA, 19 nt, Human
auggcccggaugcugcuuc

SEQ ID NO: 3628354 - RNA, 21 nt, Human
auggcccuguagccagcaccu

SEQ ID NO: 3628355 - RNA, 14 nt, Human
auggccgggcaggg

SEQ ID NO: 3628356 - RNA, 21 nt, Human
auggccgggcgcgguggcuca

SEQ ID NO: 3628357 - RNA, 18 nt, Human
auggccgugaaugggugc

SEQ ID NO: 3628358 - RNA, 16 nt, Human
auggccguggauggcc

SEQ ID NO: 3628359 - RNA, 20 nt, Human
auggccguggauggccgugg

SEQ ID NO: 3628360 - RNA, 16 nt, Human
auggccucagcugccu

SEQ ID NO: 3628361 - RNA, 17 nt, Human
auggccucagcugccuc

SEQ ID NO: 3628362 - RNA, 21 nt, Human
auggccucagcugccucacuu

SEQ ID NO: 3628363 - RNA, 17 nt, Human
auggccucauguggcug

SEQ ID NO: 3628364 - RNA, 17 nt, Human
auggccugagaagagag

SEQ ID NO: 3628365 - RNA, 17 nt, Human
auggccugcaaacuggg

SEQ ID NO: 3628366 - RNA, 20 nt, Human
auggccugccuugaagccac

SEQ ID NO: 3628367 - RNA, 12 nt, Human
auggccuggcca

SEQ ID NO: 3628368 - RNA, 18 nt, Human
auggccuuaauuuccuuu

SEQ ID NO: 3628369 - RNA, 14 nt, Human
auggccuucauauc

SEQ ID NO: 3628370 - RNA, 23 nt, Human
auggccuucauaucauccacaca

SEQ ID NO: 3628371 - RNA, 21 nt, Human
auggcgauucccauugaaaau

SEQ ID NO: 3628372 - RNA, 22 nt, Human
auggcgauucccauugaaaaug

SEQ ID NO: 3628373 - RNA, 13 nt, Human
auggcgcaggaac

SEQ ID NO: 3628374 - RNA, 14 nt, Human
auggcgcagugccu

SEQ ID NO: 3628375 - RNA, 19 nt, Human
auggcgcagugccucuggu

SEQ ID NO: 3628376 - RNA, 18 nt, Human
auggcguaaguacagaga

SEQ ID NO: 3628377 - RNA, 19 nt, Human
auggcguaaguacagagaa

SEQ ID NO: 3628378 - RNA, 21 nt, Human
auggcguaaguacagagaagc

SEQ ID NO: 3628379 - RNA, 23 nt, Human
auggcguaaguacagagaagcca

SEQ ID NO: 3628380 - RNA, 20 nt, Human
auggcguagagggugcugcc

SEQ ID NO: 3628381 - RNA, 17 nt, Human
auggcgugaucucggcu

SEQ ID NO: 3628382 - RNA, 19 nt, Human
auggcuaagcaaaauguga

SEQ ID NO: 3628383 - RNA, 21 nt, Human
auggcuaagcuuaaaaaaaac

SEQ ID NO: 3628384 - RNA, 17 nt, Human
auggcuaauucccagag

SEQ ID NO: 3628385 - RNA, 17 nt, Human
auggcuacuugcuuuga

SEQ ID NO: 3628386 - RNA, 22 nt, Human
auggcuagaauauccuacuucu

SEQ ID NO: 3628387 - RNA, 13 nt, Human
auggcuauaaaua

SEQ ID NO: 3628388 - RNA, 21 nt, Human
auggcuauaaauauauaaaaa

SEQ ID NO: 3628389 - RNA, 14 nt, Human
auggcuauauggca

SEQ ID NO: 3628390 - RNA, 19 nt, Human
auggcuauauggcaagaaa

SEQ ID NO: 3628391 - RNA, 14 nt, Human
auggcuauuaacaa

SEQ ID NO: 3628392 - RNA, 16 nt, Human
auggcucacuaugaau

SEQ ID NO: 3628393 - RNA, 18 nt, Human
auggcucacuauggugcc

SEQ ID NO: 3628394 - RNA, 12 nt, Human
auggcucagagg

SEQ ID NO: 3628395 - RNA, 22 nt, Human
auggcucagagggggacugcug

SEQ ID NO: 3628396 - RNA, 14 nt, Human
auggcucagggugg

SEQ ID NO: 3628397 - RNA, 17 nt, Human
auggcuccagaaauguc

SEQ ID NO: 3628398 - RNA, 23 nt, Human
auggcuccagucugcugcccucc

SEQ ID NO: 3628399 - RNA, 23 nt, Human
auggcucugcaccccucugcccu

SEQ ID NO: 3628400 - RNA, 23 nt, Human
auggcugccaaugggagcucaug

SEQ ID NO: 3628401 - RNA, 23 nt, Human
auggcugcugaagcugccugcuu

SEQ ID NO: 3628402 - RNA, 22 nt, Human
auggcuggccacugcacagagc

SEQ ID NO: 3628403 - RNA, 23 nt, Human
auggcuggccacugcacagagcu

SEQ ID NO: 3628404 - RNA, 13 nt, Human
auggcugugagga

SEQ ID NO: 3628405 - RNA, 20 nt, Human
auggcugugccucugccugu

SEQ ID NO: 3628406 - RNA, 20 nt, Human
auggcuguguuugcagccug

SEQ ID NO: 3628407 - RNA, 14 nt, Human
auggcuuaauguuu

SEQ ID NO: 3628408 - RNA, 16 nt, Human
auggcuuaauguuuau

SEQ ID NO: 3628409 - RNA, 17 nt, Human
auggcuuccuccucccu

SEQ ID NO: 3628410 - RNA, 20 nt, Human
auggcuucggacaaaauauc

SEQ ID NO: 3628411 - RNA, 14 nt, Human
auggcuucuaacaa

SEQ ID NO: 3628412 - RNA, 18 nt, Human
auggcuugccacagcucu

SEQ ID NO: 3628413 - RNA, 13 nt, Human
auggcuugucuau

SEQ ID NO: 3628414 - RNA, 20 nt, Human
auggcuugucuauacuccuu

SEQ ID NO: 3628415 - RNA, 23 nt, Human
auggcuuguucaucauccagaug

SEQ ID NO: 3628416 - RNA, 20 nt, Human
auggcuuuauuuguuuuuuu

SEQ ID NO: 3628417 - RNA, 15 nt, Human
auggcuuucagaaaa

SEQ ID NO: 3628418 - RNA, 18 nt, Human
auggcuuuguauagaacc

SEQ ID NO: 3628419 - RNA, 17 nt, Human
augggaaagccaccucu

SEQ ID NO: 3628420 - RNA, 12 nt, Human
auuauauuugga

SEQ ID NO: 3628421 - RNA, 20 nt, Human
auuaucaaagggauaaagaa

SEQ ID NO: 3628422 - RNA, 16 nt, Human
auuaucaagcuaauaa

SEQ ID NO: 3628423 - RNA, 12 nt, Human
auuaucagaugc

SEQ ID NO: 3628424 - RNA, 12 nt, Human
auuaucaugugu

SEQ ID NO: 3628425 - RNA, 17 nt, Human
auuauccuauuucagua

SEQ ID NO: 3628426 - RNA, 18 nt, Human
auuaucgccuuuugacag

SEQ ID NO: 3628427 - RNA, 19 nt, Human
auuaucggaagcagugccu

SEQ ID NO: 3628428 - RNA, 18 nt, Human
auuaucgggaacaguguu

SEQ ID NO: 3628429 - RNA, 20 nt, Human
auuaucgggagcagugucuu

SEQ ID NO: 3628430 - RNA, 18 nt, Human
auuaucuaaaaucugcua

SEQ ID NO: 3628431 - RNA, 19 nt, Human
auuaucuaaaaucugcuag

SEQ ID NO: 3628432 - RNA, 17 nt, Human
auuaucuaaaguguguu

SEQ ID NO: 3628433 - RNA, 23 nt, Human
auuaucuaaaguguguuguugcu

SEQ ID NO: 3628434 - RNA, 14 nt, Human
auuaucuaauuuau

SEQ ID NO: 3628435 - RNA, 22 nt, Human
auuaucuauacauaucuuuauu

SEQ ID NO: 3628436 - RNA, 22 nt, Human
auuaucuauagcuaaguacaca

SEQ ID NO: 3628437 - RNA, 15 nt, Human
auuaucuugauacau

SEQ ID NO: 3628438 - RNA, 22 nt, Human
auuaucuugggauaguucccaa

SEQ ID NO: 3628439 - RNA, 22 nt, Human
auuaucuuuucauacauuuucu

SEQ ID NO: 3628440 - RNA, 18 nt, Human
auuaugaaacuuguguaa

SEQ ID NO: 3628441 - RNA, 21 nt, Human
auuaugaaagcaacaaagaaa

SEQ ID NO: 3628442 - RNA, 20 nt, Human
auuaugaaugugaagccuuc

SEQ ID NO: 3628443 - RNA, 15 nt, Human
auuaugacaguuaua

SEQ ID NO: 3628444 - RNA, 17 nt, Human
auuaugacaguuauacu

SEQ ID NO: 3628445 - RNA, 23 nt, Human
auuaugaugaaaaccuacauauu

SEQ ID NO: 3628446 - RNA, 21 nt, Human
auuaugaugugggucaaggaa

SEQ ID NO: 3628447 - RNA, 12 nt, Human
auuaugauucuu

SEQ ID NO: 3628448 - RNA, 21 nt, Human
auuaugcaggggcaaacaccu

SEQ ID NO: 3628449 - RNA, 15 nt, Human
auuaugcauaacuga

SEQ ID NO: 3628450 - RNA, 17 nt, Human
auuaugcauaacugaca

SEQ ID NO: 3628451 - RNA, 22 nt, Human
auuaugccacuuccuuuuaacu

SEQ ID NO: 3628452 - RNA, 16 nt, Human
auuaugcuaagaauuu

SEQ ID NO: 3628453 - RNA, 22 nt, Human
auuauggagucauuuuuacaau

SEQ ID NO: 3628454 - RNA, 22 nt, Human
auuauggcauauauuaaaagca

SEQ ID NO: 3628455 - RNA, 17 nt, Human
auuaugggaaucaagau

SEQ ID NO: 3628456 - RNA, 15 nt, Human
auuauguagcucuuu

SEQ ID NO: 3628457 - RNA, 16 nt, Human
auuauguagcucuuug

SEQ ID NO: 3628458 - RNA, 19 nt, Human
auuauguagcucuuuguca

SEQ ID NO: 3628459 - RNA, 15 nt, Human
auuauguauguuuac

SEQ ID NO: 3628460 - RNA, 17 nt, Human
auuauguauguuuacau

SEQ ID NO: 3628461 - RNA, 15 nt, Human
auuaugucaaccagg

SEQ ID NO: 3628462 - RNA, 19 nt, Human
auuauguccacuguguaua

SEQ ID NO: 3628463 - RNA, 23 nt, Human
auuaugucuuuuauauuuguauc

SEQ ID NO: 3628464 - RNA, 20 nt, Human
auuaugugaccauaauguac

SEQ ID NO: 3628465 - RNA, 17 nt, Human
auuaugugguuuuagau

SEQ ID NO: 3628466 - RNA, 19 nt, Human
auuaugugugcaugugugu

SEQ ID NO: 3628467 - RNA, 20 nt, Human
auuauguguguuuuaaaaug

SEQ ID NO: 3628468 - RNA, 21 nt, Human
auuauguguguuuuaaaauga

SEQ ID NO: 3628469 - RNA, 15 nt, Human
auuauguguguuuug

SEQ ID NO: 3628470 - RNA, 21 nt, Human
auuauguuaaaacugggacag

SEQ ID NO: 3628471 - RNA, 13 nt, Human
auuauguuaaacu

SEQ ID NO: 3628472 - RNA, 14 nt, Human
auuauguuaaacua

SEQ ID NO: 3628473 - RNA, 23 nt, Human
auuauguuaaacuagcauaucug

SEQ ID NO: 3628474 - RNA, 20 nt, Human
auuauguuguuagagaaaaa

SEQ ID NO: 3628475 - RNA, 18 nt, Human
auuauguuuuuauuaaga

SEQ ID NO: 3628476 - RNA, 23 nt, Human
auuauguuuuuauuaagauuauu

SEQ ID NO: 3628477 - RNA, 20 nt, Human
auuauguuuuuuaaaauauu

SEQ ID NO: 3628478 - RNA, 23 nt, Human
auuauuaaauuguaaaacuccaa

SEQ ID NO: 3628479 - RNA, 15 nt, Human
auuauuaaugcuuug

SEQ ID NO: 3628480 - RNA, 13 nt, Human
auuauuaauugca

SEQ ID NO: 3628481 - RNA, 20 nt, Human
auuauuacuuauuuuugaca

SEQ ID NO: 3628482 - RNA, 13 nt, Human
auuauuacuugua

SEQ ID NO: 3628483 - RNA, 14 nt, Human
auuauuacuuguaa

SEQ ID NO: 3628484 - RNA, 16 nt, Human
auuauuacuuguaaau

SEQ ID NO: 3628485 - RNA, 17 nt, Human
auuauuacuuguaaaua

SEQ ID NO: 3628486 - RNA, 20 nt, Human
auuauuacuuguaaauauaa

SEQ ID NO: 3628487 - RNA, 23 nt, Human
auuauuacuuguaaauauaaaga

SEQ ID NO: 3628488 - RNA, 22 nt, Human
auuauuacuuuuccucuuagaa

SEQ ID NO: 3628489 - RNA, 12 nt, Human
auuauuagaaau

SEQ ID NO: 3628490 - RNA, 22 nt, Human
auuauuagccagguaaugugaa

SEQ ID NO: 3628491 - RNA, 14 nt, Human
auuauuauaaaaau

SEQ ID NO: 3628492 - RNA, 19 nt, Human
auuauuauaaaaggggguc

SEQ ID NO: 3628493 - RNA, 15 nt, Human
auuauuauagguaau

SEQ ID NO: 3628494 - RNA, 17 nt, Human
auuauucaaaguugccu

SEQ ID NO: 3628495 - RNA, 18 nt, Human
auuauucaaaguugccua

SEQ ID NO: 3628496 - RNA, 19 nt, Human
auuauucaaaguugccuaa

SEQ ID NO: 3628497 - RNA, 14 nt, Human
auuauucaguguca

SEQ ID NO: 3628498 - RNA, 15 nt, Human
auuauucagugucac

SEQ ID NO: 3628499 - RNA, 12 nt, Human
auuauucauuua

SEQ ID NO: 3628500 - RNA, 13 nt, Human
auuauucauuuaa

SEQ ID NO: 3628501 - RNA, 15 nt, Human
auuauucauuuaaaa

SEQ ID NO: 3628502 - RNA, 18 nt, Human
auuauucauuuaaaauga

SEQ ID NO: 3628503 - RNA, 19 nt, Human
auuauucauuuaaaaugau

SEQ ID NO: 3628504 - RNA, 15 nt, Human
auuauucauuuagug

SEQ ID NO: 3628505 - RNA, 14 nt, Human
auuauucucuuuua

SEQ ID NO: 3628506 - RNA, 18 nt, Human
auuauucucuuuuaucug

SEQ ID NO: 3628507 - RNA, 15 nt, Human
auuauugaaauauua

SEQ ID NO: 3628508 - RNA, 12 nt, Human
auuauugacacu

SEQ ID NO: 3628509 - RNA, 13 nt, Human
auuauugacacug

SEQ ID NO: 3628510 - RNA, 15 nt, Human
auuauugacacugaa

SEQ ID NO: 3628511 - RNA, 19 nt, Human
auuauugagagcccuagaa

SEQ ID NO: 3628512 - RNA, 13 nt, Human
auuauugauauau

SEQ ID NO: 3628513 - RNA, 18 nt, Human
auuauugcuguugcuuga

SEQ ID NO: 3628514 - RNA, 21 nt, Human
auuauuggaaaggaccuaaaa

SEQ ID NO: 3628515 - RNA, 14 nt, Human
auuauuggaauuaa

SEQ ID NO: 3628516 - RNA, 18 nt, Human
auuauuggaauuaaccug

SEQ ID NO: 3628517 - RNA, 16 nt, Human
auuauuguauuuauuc

SEQ ID NO: 3628518 - RNA, 22 nt, Human
auuauuguccuuugauuccaaa

SEQ ID NO: 3628519 - RNA, 18 nt, Human
auuauugugguaggccuu

SEQ ID NO: 3628520 - RNA, 12 nt, Human
auuauuguuuau

SEQ ID NO: 3628521 - RNA, 12 nt, Human
auuauuuaauaa

SEQ ID NO: 3628522 - RNA, 21 nt, Human
auuauuuaauaaaaaaacaau

SEQ ID NO: 3628523 - RNA, 18 nt, Human
auuauuuaauaacauuac

SEQ ID NO: 3628524 - RNA, 22 nt, Human
auuauuuaauaacauuaccuua

SEQ ID NO: 3628525 - RNA, 16 nt, Human
auuauuuauauaugua

SEQ ID NO: 3628526 - RNA, 14 nt, Human
auuauuuauuuaau

SEQ ID NO: 3628527 - RNA, 20 nt, Human
auuauuuauuucugguaacu

SEQ ID NO: 3628528 - RNA, 18 nt, Human
auuauuucacaaauaaua

SEQ ID NO: 3628529 - RNA, 20 nt, Human
auuauuucuaggaagaauuu

SEQ ID NO: 3628530 - RNA, 21 nt, Human
auuauuugagaagcugcucaa

SEQ ID NO: 3628531 - RNA, 15 nt, Human
auuauuugauuauuu

SEQ ID NO: 3628532 - RNA, 12 nt, Human
auuauuugcaug

SEQ ID NO: 3628533 - RNA, 15 nt, Human
auuauuugcauguua

SEQ ID NO: 3628534 - RNA, 11 nt, Human
auuauuuggca

SEQ ID NO: 3628535 - RNA, 20 nt, Human
auuauuugggagggaaaagg

SEQ ID NO: 3628536 - RNA, 20 nt, Human
auuauuuguguaauagaaaa

SEQ ID NO: 3628537 - RNA, 23 nt, Human
auuauuuguguaauagaaaacug

SEQ ID NO: 3628538 - RNA, 22 nt, Human
auuauuuguguuuuaauuuaaa

SEQ ID NO: 3628539 - RNA, 14 nt, Human
auuauuuuaaacaa

SEQ ID NO: 3628540 - RNA, 21 nt, Human
auuauuuuaaacaaaauagaa

SEQ ID NO: 3628541 - RNA, 14 nt, Human
auuauuuuaaauua

SEQ ID NO: 3628542 - RNA, 18 nt, Human
auuauuuuaauuagguua

SEQ ID NO: 3628543 - RNA, 18 nt, Human
auuauuuuauguugcaua

SEQ ID NO: 3628544 - RNA, 21 nt, Human
auuauuuuauuaugaaacuug

SEQ ID NO: 3628545 - RNA, 14 nt, Human
auuauuuucauuac

SEQ ID NO: 3628546 - RNA, 21 nt, Human
auuauuuucauuacaauggaa

SEQ ID NO: 3628547 - RNA, 13 nt, Human
auuauuuuccaaa

SEQ ID NO: 3628548 - RNA, 14 nt, Human
auuauuuuccaaaa

SEQ ID NO: 3628549 - RNA, 14 nt, Human
auuauuuucuguca

SEQ ID NO: 3628550 - RNA, 21 nt, Human
auuauuuucuucauccaacuu

SEQ ID NO: 3628551 - RNA, 12 nt, Human
auuauuuugggg

SEQ ID NO: 3628552 - RNA, 19 nt, Human
auuauuuugguacuuuuau

SEQ ID NO: 3628553 - RNA, 20 nt, Human
auuauuuugguacuuuuaug

SEQ ID NO: 3628554 - RNA, 19 nt, Human
auuauuuuguucauacaua

SEQ ID NO: 3628555 - RNA, 12 nt, Human
auuauuuuuaau

SEQ ID NO: 3628556 - RNA, 17 nt, Human
auuauuuuuaauaugua

SEQ ID NO: 3628557 - RNA, 15 nt, Human
auuauuuuuucagac

SEQ ID NO: 3628558 - RNA, 20 nt, Human
auuauuuuuuuaaaauuuug

SEQ ID NO: 3628559 - RNA, 16 nt, Human
auucaaaaaguguuua

SEQ ID NO: 3628560 - RNA, 23 nt, Human
auucaaaaauuaucuauagcuaa

SEQ ID NO: 3628561 - RNA, 14 nt, Human
auucaaaaguucca

SEQ ID NO: 3628562 - RNA, 17 nt, Human
auucaaaaguuccaaga

SEQ ID NO: 3628563 - RNA, 16 nt, Human
auucaaaaguugaaau

SEQ ID NO: 3628564 - RNA, 14 nt, Human
auucugccaggccc

SEQ ID NO: 3628565 - RNA, 23 nt, Human
auucugccaggcccccaagccug

SEQ ID NO: 3628566 - RNA, 19 nt, Human
auucugcccuccuuaauuu

SEQ ID NO: 3628567 - RNA, 21 nt, Human
auucugccgcccccuccugaa

SEQ ID NO: 3628568 - RNA, 22 nt, Human
auucugccgugugcccucgggc

SEQ ID NO: 3628569 - RNA, 18 nt, Human
auucugccugcccaggcc

SEQ ID NO: 3628570 - RNA, 15 nt, Human
auucugcuaccucac

SEQ ID NO: 3628571 - RNA, 19 nt, Human
auucugcuaccucacuggg

SEQ ID NO: 3628572 - RNA, 18 nt, Human
auucugcucacauaucug

SEQ ID NO: 3628573 - RNA, 21 nt, Human
auucugcucacauaucuguca

SEQ ID NO: 3628574 - RNA, 22 nt, Human
auucugcucacauaucugucau

SEQ ID NO: 3628575 - RNA, 16 nt, Human
auucugcuggccucug

SEQ ID NO: 3628576 - RNA, 20 nt, Human
auucuggacagucagcucuu

SEQ ID NO: 3628577 - RNA, 12 nt, Human
auucuggaccuc

SEQ ID NO: 3628578 - RNA, 15 nt, Human
auucuggagauacug

SEQ ID NO: 3628579 - RNA, 21 nt, Human
auucuggauuuugucaagcag

SEQ ID NO: 3628580 - RNA, 19 nt, Human
auucuggccagacucgaug

SEQ ID NO: 3628581 - RNA, 17 nt, Human
auucuggccuagucccu

SEQ ID NO: 3628582 - RNA, 14 nt, Human
auucuggcugaaaa

SEQ ID NO: 3628583 - RNA, 14 nt, Human
auucuggcuuuaag

SEQ ID NO: 3628584 - RNA, 19 nt, Human
auucuggcuuuaagccuuc

SEQ ID NO: 3628585 - RNA, 19 nt, Human
auucugggaauguauagua

SEQ ID NO: 3628586 - RNA, 22 nt, Human
auucuggggaaacaacauuuau

SEQ ID NO: 3628587 - RNA, 17 nt, Human
auucugggggcugcagu

SEQ ID NO: 3628588 - RNA, 23 nt, Human
auucugguuccagggucccucug

SEQ ID NO: 3628589 - RNA, 14 nt, Human
auucuguaaaaugu

SEQ ID NO: 3628590 - RNA, 15 nt, Human
auucuguacauagcc

SEQ ID NO: 3628591 - RNA, 18 nt, Human
auucuguacauagccuau

SEQ ID NO: 3628592 - RNA, 11 nt, Human
auucuguauag

SEQ ID NO: 3628593 - RNA, 13 nt, Human
auucuguauagau

SEQ ID NO: 3628594 - RNA, 19 nt, Human
auucugucgccuuagcaug

SEQ ID NO: 3628595 - RNA, 21 nt, Human
auucugucgccuuagcauguu

SEQ ID NO: 3628596 - RNA, 20 nt, Human
auucugugccuuguuuuuug

SEQ ID NO: 3628597 - RNA, 17 nt, Human
auucuguguguuuucau

SEQ ID NO: 3628598 - RNA, 22 nt, Human
auucuguguguuuucauaauaa

SEQ ID NO: 3628599 - RNA, 23 nt, Human
auucuguguguuuucauaauaaa

SEQ ID NO: 3628600 - RNA, 14 nt, Human
auucuguguugcau

SEQ ID NO: 3628601 - RNA, 21 nt, Human
auucuguuggccagugugaca

SEQ ID NO: 3628602 - RNA, 18 nt, Human
auucuuaaaaugcaauau

SEQ ID NO: 3628603 - RNA, 22 nt, Human
auucuuaaaaugcaauauuugu

SEQ ID NO: 3628604 - RNA, 19 nt, Human
auucuuaaaguacuuguua

SEQ ID NO: 3628605 - RNA, 14 nt, Human
auucuuaaaguuga

SEQ ID NO: 3628606 - RNA, 16 nt, Human
auucuuaaaguugaau

SEQ ID NO: 3628607 - RNA, 20 nt, Human
auucuuaaaguugaauuuau

SEQ ID NO: 3628608 - RNA, 21 nt, Human
auucuuaagacuugcauuuaa

SEQ ID NO: 3628609 - RNA, 16 nt, Human
auucuuacaaacaugu

SEQ ID NO: 3628610 - RNA, 20 nt, Human
auucuuacacugccuguaua

SEQ ID NO: 3628611 - RNA, 22 nt, Human
auucuuacacugccuguauacu

SEQ ID NO: 3628612 - RNA, 23 nt, Human
auucuuacccuguacauauguaa

SEQ ID NO: 3628613 - RNA, 16 nt, Human
auucuuauaaauauga

SEQ ID NO: 3628614 - RNA, 18 nt, Human
auucuuauaaauaugaag

SEQ ID NO: 3628615 - RNA, 15 nt, Human
auucuuauacacauu

SEQ ID NO: 3628616 - RNA, 22 nt, Human
auucuuauguagcaggaaauaa

SEQ ID NO: 3628617 - RNA, 18 nt, Human
auucuuauucaaagaaau

SEQ ID NO: 3628618 - RNA, 13 nt, Human
auucuuauuccau

SEQ ID NO: 3628619 - RNA, 23 nt, Human
auucuuauuccauauuagaaaac

SEQ ID NO: 3628620 - RNA, 13 nt, Human
auucuuauuuaau

SEQ ID NO: 3628621 - RNA, 17 nt, Human
auucuuauuucaugaaa

SEQ ID NO: 3628622 - RNA, 15 nt, Human
auucuuauuuugugg

SEQ ID NO: 3628623 - RNA, 17 nt, Human
auucuucagauauacug

SEQ ID NO: 3628624 - RNA, 15 nt, Human
auucuucagcaaaaa

SEQ ID NO: 3628625 - RNA, 22 nt, Human
auucuuccaagcugagagucua

SEQ ID NO: 3628626 - RNA, 18 nt, Human
auucuuccagaugugaug

SEQ ID NO: 3628627 - RNA, 21 nt, Human
auucuucccaacuugccuuug

SEQ ID NO: 3628628 - RNA, 18 nt, Human
auucuucccauucuccau

SEQ ID NO: 3628629 - RNA, 20 nt, Human
auucuucccuuuuaaacaca

SEQ ID NO: 3628630 - RNA, 10 nt, Human
auucuuccuu

SEQ ID NO: 3628631 - RNA, 12 nt, Human
auucuuccuuug

SEQ ID NO: 3628632 - RNA, 13 nt, Human
auucuuccuuugu

SEQ ID NO: 3628633 - RNA, 12 nt, Human
auucuucuagag

SEQ ID NO: 3628634 - RNA, 13 nt, Human
auucuucuagagu

SEQ ID NO: 3628635 - RNA, 13 nt, Human
auucuucuccacu

SEQ ID NO: 3628636 - RNA, 15 nt, Human
auucuucucuuccuu

SEQ ID NO: 3628637 - RNA, 11 nt, Human
auucuucugcu

SEQ ID NO: 3628638 - RNA, 15 nt, Human
auucuucuguguuua

SEQ ID NO: 3628639 - RNA, 19 nt, Human
auucuucuguguuuauaaa

SEQ ID NO: 3628640 - RNA, 18 nt, Human
auucuugaaggaaaauga

SEQ ID NO: 3628641 - RNA, 13 nt, Human
auucuugaguuua

SEQ ID NO: 3628642 - RNA, 14 nt, Human
auucuugaugaaaa

SEQ ID NO: 3628643 - RNA, 18 nt, Human
auucuugaugaaaagcuu

SEQ ID NO: 3628644 - RNA, 22 nt, Human
auucuugaugaaaagcuuuguu

SEQ ID NO: 3628645 - RNA, 19 nt, Human
auucuugauuuauuugcuu

SEQ ID NO: 3628646 - RNA, 21 nt, Human
auucuugauuuauuugcuucu

SEQ ID NO: 3628647 - RNA, 21 nt, Human
auucuuggcccgcacagagcu

SEQ ID NO: 3628648 - RNA, 18 nt, Human
auucuuggcuuaaucauu

SEQ ID NO: 3628649 - RNA, 17 nt, Human
auucuugguuggcuggc

SEQ ID NO: 3628650 - RNA, 13 nt, Human
auucuuguacagu

SEQ ID NO: 3628651 - RNA, 17 nt, Human
auucuugugaauaugua

SEQ ID NO: 3628652 - RNA, 19 nt, Human
auucuuguugcuguacaaa

SEQ ID NO: 3628653 - RNA, 21 nt, Human
auucuuguuuucuuucuuuaa

SEQ ID NO: 3628654 - RNA, 13 nt, Human
auucuuuauacaa

SEQ ID NO: 3628655 - RNA, 17 nt, Human
auucuuuaucuugacau

SEQ ID NO: 3628656 - RNA, 17 nt, Human
auucuuuauuucuguca

SEQ ID NO: 3628657 - RNA, 21 nt, Human
auucuuuauuucugucauuca

SEQ ID NO: 3628658 - RNA, 18 nt, Human
auucuuucaauacagaua

SEQ ID NO: 3628659 - RNA, 22 nt, Human
auucuuucaauacagauauauu

SEQ ID NO: 3628660 - RNA, 15 nt, Human
auucuuuccauuugc

SEQ ID NO: 3628661 - RNA, 17 nt, Human
auucuuuccauuugcau

SEQ ID NO: 3628662 - RNA, 20 nt, Human
auucuuuccauuugcauuug

SEQ ID NO: 3628663 - RNA, 16 nt, Human
auucuuucccaacacc

SEQ ID NO: 3628664 - RNA, 11 nt, Human
auucuuuccug

SEQ ID NO: 3628665 - RNA, 17 nt, Human
auucuuuccugaggcug

SEQ ID NO: 3628666 - RNA, 17 nt, Human
auucuuucgaaagaaga

SEQ ID NO: 3628667 - RNA, 14 nt, Human
auucuuucuccuuu

SEQ ID NO: 3628668 - RNA, 19 nt, Human
auucuuugaccuguuggga

SEQ ID NO: 3628669 - RNA, 18 nt, Human
auucuuugauguuaacac

SEQ ID NO: 3628670 - RNA, 21 nt, Human
auucuuugauguuaacacauu

SEQ ID NO: 3628671 - RNA, 22 nt, Human
auucuuugauguuaacacauuu

SEQ ID NO: 3628672 - RNA, 15 nt, Human
auucuuugcaaaaau

SEQ ID NO: 3628673 - RNA, 21 nt, Human
auucuuugcacuuuuucuuaa

SEQ ID NO: 3628674 - RNA, 19 nt, Human
auucuuugcuugaacacag

SEQ ID NO: 3628675 - RNA, 21 nt, Human
auucuuuggaguuaaaaugca

SEQ ID NO: 3628676 - RNA, 22 nt, Human
auucuuuggaguugucacauca

SEQ ID NO: 3628677 - RNA, 17 nt, Human
auucuuuguuaauuugg

SEQ ID NO: 3628678 - RNA, 18 nt, Human
auucuuuuaaaagacaag

SEQ ID NO: 3628679 - RNA, 14 nt, Human
auucuuuuaaauua

SEQ ID NO: 3628680 - RNA, 18 nt, Human
auucuuuuaaauuagaaa

SEQ ID NO: 3628681 - RNA, 19 nt, Human
auucuuuuaaauuagaaaa

SEQ ID NO: 3628682 - RNA, 23 nt, Human
auucuuuuaaauuagaaaauauu

SEQ ID NO: 3628683 - RNA, 16 nt, Human
auucuuuugaauuguu

SEQ ID NO: 3628684 - RNA, 14 nt, Human
auucuuuuuaaagu

SEQ ID NO: 3628685 - RNA, 13 nt, Human
auucuuuuugcuc

SEQ ID NO: 3628686 - RNA, 19 nt, Human
auucuuuuuuaaauuuucu

SEQ ID NO: 3628687 - RNA, 14 nt, Human
auucuuuuuuauua

SEQ ID NO: 3628688 - RNA, 17 nt, Human
auucuuuuuuauuaauc

SEQ ID NO: 3628689 - RNA, 22 nt, Human
auugaaaaaaauuggcauuaaa

SEQ ID NO: 3628690 - RNA, 18 nt, Human
auugaaaaaauagagccu

SEQ ID NO: 3628691 - RNA, 19 nt, Human
auugaaaaaauagagccug

SEQ ID NO: 3628692 - RNA, 15 nt, Human
auugaaaaaccauuu

SEQ ID NO: 3628693 - RNA, 16 nt, Human
auugaaaaacucuuua

SEQ ID NO: 3628694 - RNA, 21 nt, Human
auugaaaaguuauuucccuuu

SEQ ID NO: 3628695 - RNA, 23 nt, Human
auugaaaaguuuuuguuuggaga

SEQ ID NO: 3628696 - RNA, 16 nt, Human
auugaaaauugaaaag

SEQ ID NO: 3628697 - RNA, 14 nt, Human
auugaaagaaugua

SEQ ID NO: 3628698 - RNA, 17 nt, Human
auugaaagaauguaaag

SEQ ID NO: 3628699 - RNA, 20 nt, Human
auugaaagaauguaaagcaa

SEQ ID NO: 3628700 - RNA, 16 nt, Human
auugaaauauuauaga

SEQ ID NO: 3628701 - RNA, 18 nt, Human
auugaaaucuuuuugcuu

SEQ ID NO: 3628702 - RNA, 20 nt, Human
auugaaaucuuuuugcuuug

SEQ ID NO: 3628703 - RNA, 16 nt, Human
auugaaaugacuaaaa

SEQ ID NO: 3628704 - RNA, 19 nt, Human
auugaaauuauaguuucaa

SEQ ID NO: 3628705 - RNA, 17 nt, Human
auugaaauucugagaaa

SEQ ID NO: 3628706 - RNA, 21 nt, Human
auugaaauuguacauauuugu

SEQ ID NO: 3628707 - RNA, 15 nt, Human
auugaacacaaacug

SEQ ID NO: 3628708 - RNA, 23 nt, Human
auuggauuuccuaauacugucau

SEQ ID NO: 3628709 - RNA, 13 nt, Human
auuggauuuuaug

SEQ ID NO: 3628710 - RNA, 19 nt, Human
auuggcaaagaugugggga

SEQ ID NO: 3628711 - RNA, 18 nt, Human
auuggcaccgaagcccag

SEQ ID NO: 3628712 - RNA, 11 nt, Human
auuggcagcag

SEQ ID NO: 3628713 - RNA, 22 nt, Human
auuggcagcaggugcugcuacc

SEQ ID NO: 3628714 - RNA, 16 nt, Human
auuggcauuaaaacuu

SEQ ID NO: 3628715 - RNA, 23 nt, Human
auuggccuguagaguugcugaga

SEQ ID NO: 3628716 - RNA, 18 nt, Human
auuggcuauuuaaaacuu

SEQ ID NO: 3628717 - RNA, 21 nt, Human
auuggcucuugaacugagcuu

SEQ ID NO: 3628718 - RNA, 17 nt, Human
auuggcugggaguggug

SEQ ID NO: 3628719 - RNA, 21 nt, Human
auuggcuuuauccucuuuaga

SEQ ID NO: 3628720 - RNA, 15 nt, Human
auuggcuuuucugau

SEQ ID NO: 3628721 - RNA, 19 nt, Human
auuggcuuuucugauccag

SEQ ID NO: 3628722 - RNA, 13 nt, Human
auugggaaaucuu

SEQ ID NO: 3628723 - RNA, 15 nt, Human
auugggaauaaauau

SEQ ID NO: 3628724 - RNA, 17 nt, Human
auugggauauucugaaa

SEQ ID NO: 3628725 - RNA, 18 nt, Human
auugggcaagugauugaa

SEQ ID NO: 3628726 - RNA, 18 nt, Human
auugggcacaucauuuca

SEQ ID NO: 3628727 - RNA, 19 nt, Human
auugggcacaucauuucaa

SEQ ID NO: 3628728 - RNA, 23 nt, Human
auugggcacaucauuucaagaag

SEQ ID NO: 3628729 - RNA, 21 nt, Human
auugggcacuauuuauuuaca

SEQ ID NO: 3628730 - RNA, 16 nt, Human
auugggccagcuuuuc

SEQ ID NO: 3628731 - RNA, 16 nt, Human
auugggccccugccag

SEQ ID NO: 3628732 - RNA, 19 nt, Human
auuggggaagacuguggcu

SEQ ID NO: 3628733 - RNA, 19 nt, Human
auuggggaauuaaaaguca

SEQ ID NO: 3628734 - RNA, 12 nt, Human
auuggggaggag

SEQ ID NO: 3628735 - RNA, 16 nt, Human
auuggggauucuuaaa

SEQ ID NO: 3628736 - RNA, 22 nt, Human
auuggggcucccagccaggccc

SEQ ID NO: 3628737 - RNA, 21 nt, Human
auugggggucaccggccgaug

SEQ ID NO: 3628738 - RNA, 15 nt, Human
auuggguaucaccac

SEQ ID NO: 3628739 - RNA, 19 nt, Human
auuggguccugggucuuuc

SEQ ID NO: 3628740 - RNA, 16 nt, Human
auugggucuauuccag

SEQ ID NO: 3628741 - RNA, 21 nt, Human
auugggucuauuccagcucau

SEQ ID NO: 3628742 - RNA, 20 nt, Human
auuggguggggggcuucaua

SEQ ID NO: 3628743 - RNA, 22 nt, Human
auuggguggggggcuucauaca

SEQ ID NO: 3628744 - RNA, 18 nt, Human
auuggguggguaaauuca

SEQ ID NO: 3628745 - RNA, 18 nt, Human
auuggguucaugaugcag

SEQ ID NO: 3628746 - RNA, 19 nt, Human
auuggguucaugaugcagu

SEQ ID NO: 3628747 - RNA, 19 nt, Human
auuggguuuuuggacuucu

SEQ ID NO: 3628748 - RNA, 21 nt, Human
auugguaaaacucacugugau

SEQ ID NO: 3628749 - RNA, 15 nt, Human
auugguaccuugcac

SEQ ID NO: 3628750 - RNA, 19 nt, Human
auugguaccuugcacacau

SEQ ID NO: 3628751 - RNA, 14 nt, Human
auugguagaggaag

SEQ ID NO: 3628752 - RNA, 16 nt, Human
auugguguugccaguu

SEQ ID NO: 3628753 - RNA, 21 nt, Human
auugguguugccaguuguccu

SEQ ID NO: 3628754 - RNA, 22 nt, Human
auugguguugccaguuguccuc

SEQ ID NO: 3628755 - RNA, 23 nt, Human
auugguguuguacucaauuuuaa

SEQ ID NO: 3628756 - RNA, 18 nt, Human
auugguguuuuuuucuau

SEQ ID NO: 3628757 - RNA, 13 nt, Human
auugguuaauuuu

SEQ ID NO: 3628758 - RNA, 18 nt, Human
auugguucccuuugcucc

SEQ ID NO: 3628759 - RNA, 15 nt, Human
auugguucuuguauu

SEQ ID NO: 3628760 - RNA, 16 nt, Human
auugguucuuguauua

SEQ ID NO: 3628761 - RNA, 18 nt, Human
auugguuucucuucuccc

SEQ ID NO: 3628762 - RNA, 19 nt, Human
auugguuucucuucucccc

SEQ ID NO: 3628763 - RNA, 17 nt, Human
auugguuuuaugaugac

SEQ ID NO: 3628764 - RNA, 22 nt, Human
auugguuuuccaaucauuugac

SEQ ID NO: 3628765 - RNA, 21 nt, Human
auuguaaaaaaaaaugccuuu

SEQ ID NO: 3628766 - RNA, 23 nt, Human
auuguaaaaaaaaaugccuuuga

SEQ ID NO: 3628767 - RNA, 21 nt, Human
auuguaaaaccugucaaugau

SEQ ID NO: 3628768 - RNA, 20 nt, Human
auuguaaaagcauuuuguaa

SEQ ID NO: 3628769 - RNA, 13 nt, Human
auuguaaaauggu

SEQ ID NO: 3628770 - RNA, 14 nt, Human
auuguaaaauggug

SEQ ID NO: 3628771 - RNA, 23 nt, Human
auuguaaacaaacuguguaacug

SEQ ID NO: 3628772 - RNA, 16 nt, Human
auuguaaacauguguu

SEQ ID NO: 3628773 - RNA, 13 nt, Human
auuguaaacugua

SEQ ID NO: 3628774 - RNA, 14 nt, Human
auuguaaacuguac

SEQ ID NO: 3628775 - RNA, 14 nt, Human
auuguaaauauugu

SEQ ID NO: 3628776 - RNA, 17 nt, Human
auuguaaaugugcuuuu

SEQ ID NO: 3628777 - RNA, 23 nt, Human
auuguaaauugaaucaguauaaa

SEQ ID NO: 3628778 - RNA, 15 nt, Human
auuguaacagacauu

SEQ ID NO: 3628779 - RNA, 20 nt, Human
auuguaacguugcuguggga

SEQ ID NO: 3628780 - RNA, 10 nt, Human
auuguaacuc

SEQ ID NO: 3628781 - RNA, 12 nt, Human
auuguaagaaau

SEQ ID NO: 3628782 - RNA, 16 nt, Human
auuguaagauaaaaaa

SEQ ID NO: 3628783 - RNA, 15 nt, Human
auuguaaggaaugau

SEQ ID NO: 3628784 - RNA, 16 nt, Human
auuguaaggaaugauu

SEQ ID NO: 3628785 - RNA, 21 nt, Human
auuguaauaaugcuaaagaaa

SEQ ID NO: 3628786 - RNA, 15 nt, Human
auuguaauauagaaa

SEQ ID NO: 3628787 - RNA, 12 nt, Human
auuguaaucacu

SEQ ID NO: 3628788 - RNA, 13 nt, Human
auuguaauguuac

SEQ ID NO: 3628789 - RNA, 12 nt, Human
auuguaauguug

SEQ ID NO: 3628790 - RNA, 14 nt, Human
auuguaauguugug

SEQ ID NO: 3628791 - RNA, 17 nt, Human
auuguaauguugugaau

SEQ ID NO: 3628792 - RNA, 22 nt, Human
auuguaauguugugaauaauua

SEQ ID NO: 3628793 - RNA, 13 nt, Human
auuguaauuauau

SEQ ID NO: 3628794 - RNA, 12 nt, Human
auuguaauuuug

SEQ ID NO: 3628795 - RNA, 21 nt, Human
auuguacaaaauuaagcaaau

SEQ ID NO: 3628796 - RNA, 20 nt, Human
auuguacaaaguauuaagca

SEQ ID NO: 3628797 - RNA, 23 nt, Human
auuguacaaaguauuaagcauau

SEQ ID NO: 3628798 - RNA, 13 nt, Human
auuguacaaccug

SEQ ID NO: 3628799 - RNA, 12 nt, Human
auuguacacuuu

SEQ ID NO: 3628800 - RNA, 14 nt, Human
auuguacacuuuuu

SEQ ID NO: 3628801 - RNA, 20 nt, Human
auuguacagaaucauugcuu

SEQ ID NO: 3628802 - RNA, 21 nt, Human
auuguacagaaucauugcuua

SEQ ID NO: 3628803 - RNA, 13 nt, Human
auuguacaguuuu

SEQ ID NO: 3628804 - RNA, 21 nt, Human
auuguacaguuuuuauugcuu

SEQ ID NO: 3628805 - RNA, 12 nt, Human
auuguacauaaa

SEQ ID NO: 3628806 - RNA, 15 nt, Human
auuguacauauuugu

SEQ ID NO: 3628807 - RNA, 16 nt, Human
auuguacgaagaguau

SEQ ID NO: 3628808 - RNA, 21 nt, Human
auuguacuaaagccaaacaua

SEQ ID NO: 3628809 - RNA, 17 nt, Human
auuguagcauccuggaa

SEQ ID NO: 3628810 - RNA, 16 nt, Human
auuguaguccuguaau

SEQ ID NO: 3628811 - RNA, 14 nt, Human
auuguagugcuuug

SEQ ID NO: 3628812 - RNA, 23 nt, Human
auuguagugcuuugagagagaaa

SEQ ID NO: 3628813 - RNA, 15 nt, Human
auuguauaaaaauag

SEQ ID NO: 3628814 - RNA, 13 nt, Human
auuguauaacagg

SEQ ID NO: 3628815 - RNA, 21 nt, Human
auuguauaagauuagaaugaa

SEQ ID NO: 3628816 - RNA, 18 nt, Human
auuguauagauauaauga

SEQ ID NO: 3628817 - RNA, 13 nt, Human
auuguauauaugu

SEQ ID NO: 3628818 - RNA, 22 nt, Human
auuguauauauguguguuuaaa

SEQ ID NO: 3628819 - RNA, 15 nt, Human
auuguauauuguaau

SEQ ID NO: 3628820 - RNA, 17 nt, Human
auuguauauuguguuug

SEQ ID NO: 3628821 - RNA, 20 nt, Human
auuguaucagaggccuauaa

SEQ ID NO: 3628822 - RNA, 15 nt, Human
auuguaucgauguua

SEQ ID NO: 3628823 - RNA, 24 nt, Human
auuguaucguauagcuguauugaa

SEQ ID NO: 3628824 - RNA, 15 nt, Human
auuguaucuagugca

SEQ ID NO: 3628825 - RNA, 19 nt, Human
auuguaucuagugcagcug

SEQ ID NO: 3628826 - RNA, 18 nt, Human
auuguaucucauuacuua

SEQ ID NO: 3628827 - RNA, 14 nt, Human
auuguaugaugugu

SEQ ID NO: 3628828 - RNA, 15 nt, Human
auuguaugauguguu

SEQ ID NO: 3628829 - RNA, 16 nt, Human
auuguauggaaauaua

SEQ ID NO: 3628830 - RNA, 12 nt, Human
auuguauucugg

SEQ ID NO: 3628831 - RNA, 14 nt, Human
auuguauuuauuca

SEQ ID NO: 3628832 - RNA, 20 nt, Human
auuguauuuauucaauaaag

SEQ ID NO: 3628833 - RNA, 23 nt, Human
auuguauuuauucaauaaaguau

SEQ ID NO: 3628834 - RNA, 18 nt, Human
auuguauuuauuccauau

SEQ ID NO: 3628835 - RNA, 15 nt, Human
auuguauuuguuucu

SEQ ID NO: 3628836 - RNA, 19 nt, Human
auugucaaugcuggagaaa

SEQ ID NO: 3628837 - RNA, 19 nt, Human
auugucagaguucugcucu

SEQ ID NO: 3628838 - RNA, 23 nt, Human
auugucagauauuuuuucagaaa

SEQ ID NO: 3628839 - RNA, 13 nt, Human
auugucauuuaua

SEQ ID NO: 3628840 - RNA, 19 nt, Human
auuguccagagcugcuucc

SEQ ID NO: 3628841 - RNA, 14 nt, Human
auuguccaguuugu

SEQ ID NO: 3628842 - RNA, 23 nt, Human
auuguccaguuugucuuggauau

SEQ ID NO: 3628843 - RNA, 17 nt, Human
auuguccccgacccuug

SEQ ID NO: 3628844 - RNA, 17 nt, Human
auugucccucugcccca

SEQ ID NO: 3628845 - RNA, 23 nt, Human
auuguccuauuaguguuauauga

SEQ ID NO: 3628846 - RNA, 18 nt, Human
auuguccucauuucucca

SEQ ID NO: 3628847 - RNA, 13 nt, Human
auugucuagugaa

SEQ ID NO: 3628848 - RNA, 14 nt, Human
auugucucagagca

SEQ ID NO: 3628849 - RNA, 18 nt, Human
auugucucccgcccccca

SEQ ID NO: 3628850 - RNA, 15 nt, Human
auugucucccuucca

SEQ ID NO: 3628851 - RNA, 18 nt, Human
auugucuccuauauauuu

SEQ ID NO: 3628852 - RNA, 16 nt, Human
auuuuuuuuaaagaaa

SEQ ID NO: 3628853 - RNA, 22 nt, Human
auuuuuuuuaauuguauuuuug

SEQ ID NO: 3628854 - RNA, 20 nt, Human
auuuuuuuuauuaguauugu

SEQ ID NO: 3628855 - RNA, 15 nt, Human
auuuuuuuucauguu

SEQ ID NO: 3628856 - RNA, 16 nt, Human
auuuuuuuucauguuu

SEQ ID NO: 3628857 - RNA, 17 nt, Human
auuuuuuuucuguuaua

SEQ ID NO: 3628858 - RNA, 18 nt, Human
auuuuuuuucuguuauau

SEQ ID NO: 3628859 - RNA, 19 nt, Human
auuuuuuuucuguuauaua

SEQ ID NO: 3628860 - RNA, 20 nt, Human
auuuuuuuucuguuauauaa

SEQ ID NO: 3628861 - RNA, 20 nt, Human
auuuuuuuucuuugaauaaa

SEQ ID NO: 3628862 - RNA, 21 nt, Human
auuuuuuuucuuugaauaaau

SEQ ID NO: 3628863 - RNA, 22 nt, Human
auuuuuuuuguuguuucaguga

SEQ ID NO: 3628864 - RNA, 23 nt, Human
auuuuuuuuuagaacagaaaaca

SEQ ID NO: 3628865 - RNA, 14 nt, Human
auuuuuuuuucaua

SEQ ID NO: 3628866 - RNA, 16 nt, Human
auuuuuuuuucauaca

SEQ ID NO: 3628867 - RNA, 23 nt, Human
auuuuuuuuucauagagauuugu

SEQ ID NO: 3628868 - RNA, 17 nt, Human
auuuuuuuuuccuagcc

SEQ ID NO: 3628869 - RNA, 20 nt, Human
auuuuuuuuuccuucagugc

SEQ ID NO: 3628870 - RNA, 19 nt, Human
auuuuuuuuuuuucucuca

SEQ ID NO: 3628871 - RNA, 21 nt, Human
auuuuuuuuuuuugaaaaaag

SEQ ID NO: 3628872 - RNA, 19 nt, Human
caaaaaaaaaguuuuauuu

SEQ ID NO: 3628873 - RNA, 13 nt, Human
caaaaaaaccaca

SEQ ID NO: 3628874 - RNA, 18 nt, Human
caaaaaaaccacaaaggc

SEQ ID NO: 3628875 - RNA, 22 nt, Human
caaaaaaaccacaaaggccaaa

SEQ ID NO: 3628876 - RNA, 23 nt, Human
caaaaaaaccucuuaauauucug

SEQ ID NO: 3628877 - RNA, 12 nt, Human
caaaaaaaguug

SEQ ID NO: 3628878 - RNA, 18 nt, Human
caaaaaaaguuguaugau

SEQ ID NO: 3628879 - RNA, 13 nt, Human
caaaaaaauacug

SEQ ID NO: 3628880 - RNA, 12 nt, Human
caaaaaacaaua

SEQ ID NO: 3628881 - RNA, 14 nt, Human
caaaaaagaaaacc

SEQ ID NO: 3628882 - RNA, 17 nt, Human
caaaaaaguccaauuuu

SEQ ID NO: 3628883 - RNA, 18 nt, Human
caaaaaaguccaauuuua

SEQ ID NO: 3628884 - RNA, 22 nt, Human
caaaaaaguccaauuuuaauuu

SEQ ID NO: 3628885 - RNA, 19 nt, Human
caaaaaauaucuaguaaua

SEQ ID NO: 3628886 - RNA, 15 nt, Human
caaaaacacagcaag

SEQ ID NO: 3628887 - RNA, 13 nt, Human
caaaaacagccuc

SEQ ID NO: 3628888 - RNA, 16 nt, Human
caaaaacagccucaca

SEQ ID NO: 3628889 - RNA, 15 nt, Human
caaaaacauguaugu

SEQ ID NO: 3628890 - RNA, 16 nt, Human
caaaaacuauuuggga

SEQ ID NO: 3628891 - RNA, 22 nt, Human
caaaaacugucuuuaaaagaga

SEQ ID NO: 3628892 - RNA, 15 nt, Human
caaaaagaaaugaug

SEQ ID NO: 3628893 - RNA, 14 nt, Human
caaaaagaacaaaa

SEQ ID NO: 3628894 - RNA, 17 nt, Human
caaaaagaaccacuugu

SEQ ID NO: 3628895 - RNA, 18 nt, Human
caaaaagauaccuuaaaa

SEQ ID NO: 3628896 - RNA, 19 nt, Human
caaaaagauaccuuaaaau

SEQ ID NO: 3628897 - RNA, 16 nt, Human
caaaaagcaaaaucau

SEQ ID NO: 3628898 - RNA, 22 nt, Human
caaaaagcucuuacacuacauu

SEQ ID NO: 3628899 - RNA, 17 nt, Human
caaaaaggauacauaau

SEQ ID NO: 3628900 - RNA, 13 nt, Human
caaaaagguugcu

SEQ ID NO: 3628901 - RNA, 15 nt, Human
caaaaaguuuccaua

SEQ ID NO: 3628902 - RNA, 10 nt, Human
caaaaauaaa

SEQ ID NO: 3628903 - RNA, 12 nt, Human
caaaaauaaauu

SEQ ID NO: 3628904 - RNA, 16 nt, Human
caaaaauaaucaugaa

SEQ ID NO: 3628905 - RNA, 13 nt, Human
caaaaauacaaaa

SEQ ID NO: 3628906 - RNA, 19 nt, Human
caaaaauacucuaauucua

SEQ ID NO: 3628907 - RNA, 11 nt, Human
caaaaauauaa

SEQ ID NO: 3628908 - RNA, 12 nt, Human
caaaaauauaaa

SEQ ID NO: 3628909 - RNA, 14 nt, Human
caaaaauauuuuau

SEQ ID NO: 3628910 - RNA, 15 nt, Human
caaaaaucagccaga

SEQ ID NO: 3628911 - RNA, 20 nt, Human
caaaaauccaaauauuguua

SEQ ID NO: 3628912 - RNA, 18 nt, Human
caaaaaucugaagauugu

SEQ ID NO: 3628913 - RNA, 14 nt, Human
caaaaaucugccug

SEQ ID NO: 3628914 - RNA, 19 nt, Human
caaaaauguuaagcaucua

SEQ ID NO: 3628915 - RNA, 13 nt, Human
caaaaauguugaa

SEQ ID NO: 3628916 - RNA, 15 nt, Human
caaaaauuagccggg

SEQ ID NO: 3628917 - RNA, 17 nt, Human
caaaaauuagccgggcg

SEQ ID NO: 3628918 - RNA, 11 nt, Human
caaaaauuagg

SEQ ID NO: 3628919 - RNA, 16 nt, Human
caaaaauuagguauuu

SEQ ID NO: 3628920 - RNA, 18 nt, Human
caaaaauuagguauuuug

SEQ ID NO: 3628921 - RNA, 20 nt, Human
caaaaauuaucuauuuguau

SEQ ID NO: 3628922 - RNA, 12 nt, Human
caaaaauuauua

SEQ ID NO: 3628923 - RNA, 17 nt, Human
caaaaauucacaagcug

SEQ ID NO: 3628924 - RNA, 13 nt, Human
caaaaauuugaac

SEQ ID NO: 3628925 - RNA, 19 nt, Human
caaaaauuugcuucacuca

SEQ ID NO: 3628926 - RNA, 13 nt, Human
caaaaauuuuugg

SEQ ID NO: 3628927 - RNA, 16 nt, Human
caaaacaaaaagaugu

SEQ ID NO: 3628928 - RNA, 17 nt, Human
caaaacaaaaauuaggu

SEQ ID NO: 3628929 - RNA, 23 nt, Human
caaaacaaaaauuagguauuuug

SEQ ID NO: 3628930 - RNA, 11 nt, Human
caaaacaaaac

SEQ ID NO: 3628931 - RNA, 15 nt, Human
caaaacaaagucuuu

SEQ ID NO: 3628932 - RNA, 21 nt, Human
caaaacaaaugccacacauca

SEQ ID NO: 3628933 - RNA, 20 nt, Human
caaaacaaguuuuucuguca

SEQ ID NO: 3628934 - RNA, 20 nt, Human
caaaacaccugacagccccu

SEQ ID NO: 3628935 - RNA, 13 nt, Human
caaaacacugugg

SEQ ID NO: 3628936 - RNA, 14 nt, Human
caaaacacugugga

SEQ ID NO: 3628937 - RNA, 15 nt, Human
caaaacacuguggaa

SEQ ID NO: 3628938 - RNA, 16 nt, Human
caaaacacuuguaauu

SEQ ID NO: 3628939 - RNA, 18 nt, Human
caaaacacuuguaauuuu

SEQ ID NO: 3628940 - RNA, 18 nt, Human
caaaacagaggcacuuaa

SEQ ID NO: 3628941 - RNA, 16 nt, Human
caaaaccacagcccug

SEQ ID NO: 3628942 - RNA, 19 nt, Human
caaaaccacagcccuguca

SEQ ID NO: 3628943 - RNA, 16 nt, Human
caaaaccagguccaau

SEQ ID NO: 3628944 - RNA, 13 nt, Human
caaaacccaccuu

SEQ ID NO: 3628945 - RNA, 13 nt, Human
caaaacccagcug

SEQ ID NO: 3628946 - RNA, 21 nt, Human
caaaacccagcugcaccccuu

SEQ ID NO: 3628947 - RNA, 15 nt, Human
caaaaccccccagau

SEQ ID NO: 3628948 - RNA, 21 nt, Human
caaaaccccccagauaucauc

SEQ ID NO: 3628949 - RNA, 23 nt, Human
caaaaccccuaagagacugcguu

SEQ ID NO: 3628950 - RNA, 14 nt, Human
caaaaccuaacuug

SEQ ID NO: 3628951 - RNA, 21 nt, Human
caaaaccugauguuaaaauuc

SEQ ID NO: 3628952 - RNA, 15 nt, Human
caaaaccuguccuau

SEQ ID NO: 3628953 - RNA, 23 nt, Human
caaaaccuugcuaauuuucucaa

SEQ ID NO: 3628954 - RNA, 17 nt, Human
caaaacgcgcagaugug

SEQ ID NO: 3628955 - RNA, 18 nt, Human
caaaacgcgcagaugugc

SEQ ID NO: 3628956 - RNA, 15 nt, Human
caaaacgguuuuacu

SEQ ID NO: 3628957 - RNA, 15 nt, Human
caaaacgucuuauug

SEQ ID NO: 3628958 - RNA, 19 nt, Human
caaaacuauacuugaacaa

SEQ ID NO: 3628959 - RNA, 21 nt, Human
caaaacuauacuugaacaaaa

SEQ ID NO: 3628960 - RNA, 17 nt, Human
caaaacuccgcccccag

SEQ ID NO: 3628961 - RNA, 20 nt, Human
caaaacuccgcccccagccu

SEQ ID NO: 3628962 - RNA, 21 nt, Human
caaaacuccgcccccagccua

SEQ ID NO: 3628963 - RNA, 11 nt, Human
caaaacucuac

SEQ ID NO: 3628964 - RNA, 16 nt, Human
caaaacucuccucugc

SEQ ID NO: 3628965 - RNA, 19 nt, Human
caaaacucuccucugcugc

SEQ ID NO: 3628966 - RNA, 17 nt, Human
caaaacugcacugucaa

SEQ ID NO: 3628967 - RNA, 18 nt, Human
caaaacugcacugucaag

SEQ ID NO: 3628968 - RNA, 14 nt, Human
caaaacugugcaga

SEQ ID NO: 3628969 - RNA, 13 nt, Human
caaaacuuaacau

SEQ ID NO: 3628970 - RNA, 21 nt, Human
caaaacuucuugucagacaua

SEQ ID NO: 3628971 - RNA, 23 nt, Human
caaaacuuuaucagggaaacuaa

SEQ ID NO: 3628972 - RNA, 14 nt, Human
caaaacuuuuaaac

SEQ ID NO: 3628973 - RNA, 21 nt, Human
caaaagaaaaaaaaaagcacc

SEQ ID NO: 3628974 - RNA, 15 nt, Human
caaaagaaauaccuu

SEQ ID NO: 3628975 - RNA, 12 nt, Human
caaaagaacuua

SEQ ID NO: 3628976 - RNA, 14 nt, Human
caaaagaagaaguu

SEQ ID NO: 3628977 - RNA, 17 nt, Human
caaaagaagcccccagc

SEQ ID NO: 3628978 - RNA, 14 nt, Human
caaaagaaguaaca

SEQ ID NO: 3628979 - RNA, 17 nt, Human
caaaagaaguaacaaga

SEQ ID NO: 3628980 - RNA, 19 nt, Human
caaaagaaucagaaacagg

SEQ ID NO: 3628981 - RNA, 20 nt, Human
caaaagaauggcagaaaagu

SEQ ID NO: 3628982 - RNA, 21 nt, Human
caaaagacauguuguaaauua

SEQ ID NO: 3628983 - RNA, 16 nt, Human
caaaagaguguaaaau

SEQ ID NO: 3628984 - RNA, 18 nt, Human
caaaagaguguaaaauau

SEQ ID NO: 3628985 - RNA, 20 nt, Human
caaaagaguguaaaauauuu

SEQ ID NO: 3628986 - RNA, 20 nt, Human
caaaagauaauauuuuacau

SEQ ID NO: 3628987 - RNA, 12 nt, Human
caaaagaugaaa

SEQ ID NO: 3628988 - RNA, 16 nt, Human
caaaagaugcuucuca

SEQ ID NO: 3628989 - RNA, 16 nt, Human
caaaagauugcugaaa

SEQ ID NO: 3628990 - RNA, 20 nt, Human
caaaagauugcugaaauuuu

SEQ ID NO: 3628991 - RNA, 22 nt, Human
caaaagauugcugaaauuuuau

SEQ ID NO: 3628992 - RNA, 14 nt, Human
caaaagcaagacug

SEQ ID NO: 3628993 - RNA, 16 nt, Human
caaaagcaagacuguu

SEQ ID NO: 3628994 - RNA, 20 nt, Human
caaaagcaguaaauuugcua

SEQ ID NO: 3628995 - RNA, 21 nt, Human
caaaagcagugggcuccuggc

SEQ ID NO: 3628996 - RNA, 13 nt, Human
caaaagcauguga

SEQ ID NO: 3628997 - RNA, 21 nt, Human
caaaagcauuuaucauucuug

SEQ ID NO: 3628998 - RNA, 21 nt, Human
caaagaugggugaaggcuggc

SEQ ID NO: 3628999 - RNA, 13 nt, Human
caaagauucauga

SEQ ID NO: 3629000 - RNA, 19 nt, Human
caaagauucaugauuuaua

SEQ ID NO: 3629001 - RNA, 17 nt, Human
caaagauucucuaugua

SEQ ID NO: 3629002 - RNA, 15 nt, Human
caaagcaaaaccaga

SEQ ID NO: 3629003 - RNA, 14 nt, Human
caaagcaagacccu

SEQ ID NO: 3629004 - RNA, 22 nt, Human
caaagcaagcauucagaagaaa

SEQ ID NO: 3629005 - RNA, 14 nt, Human
caaagcaauaauag

SEQ ID NO: 3629006 - RNA, 15 nt, Human
caaagcaaugcauuu

SEQ ID NO: 3629007 - RNA, 13 nt, Human
caaagcacagaga

SEQ ID NO: 3629008 - RNA, 19 nt, Human
caaagcacaguguuaaaug

SEQ ID NO: 3629009 - RNA, 17 nt, Human
caaagcaccaaaauaag

SEQ ID NO: 3629010 - RNA, 12 nt, Human
caaagcaccagc

SEQ ID NO: 3629011 - RNA, 21 nt, Human
caaagcaccagcuucuccagg

SEQ ID NO: 3629012 - RNA, 22 nt, Human
caaagcacgaaauguuauuuuu

SEQ ID NO: 3629013 - RNA, 20 nt, Human
caaagcacugacuucuaagu

SEQ ID NO: 3629014 - RNA, 19 nt, Human
caaagcagauucagaaaug

SEQ ID NO: 3629015 - RNA, 21 nt, Human
caaagcaggggaguaugcaaa

SEQ ID NO: 3629016 - RNA, 21 nt, Human
caaagcagugcaugcuguccc

SEQ ID NO: 3629017 - RNA, 21 nt, Human
caaagcaguggagcccaggag

SEQ ID NO: 3629018 - RNA, 13 nt, Human
caaagcauagaug

SEQ ID NO: 3629019 - RNA, 17 nt, Human
caaagcauggacauuua

SEQ ID NO: 3629020 - RNA, 22 nt, Human
caaagccaaagcuaggccuggc

SEQ ID NO: 3629021 - RNA, 20 nt, Human
caaagccaccaacagccacu

SEQ ID NO: 3629022 - RNA, 13 nt, Human
caaagccagaagc

SEQ ID NO: 3629023 - RNA, 18 nt, Human
caaagccagaagcugagc

SEQ ID NO: 3629024 - RNA, 14 nt, Human
caaagccagacagc

SEQ ID NO: 3629025 - RNA, 21 nt, Human
caaagccagcguccuccucug

SEQ ID NO: 3629026 - RNA, 23 nt, Human
caaagccagcguccuccucugug

SEQ ID NO: 3629027 - RNA, 17 nt, Human
caaagcccaaaguggua

SEQ ID NO: 3629028 - RNA, 15 nt, Human
caaagccccaugcug

SEQ ID NO: 3629029 - RNA, 20 nt, Human
caaagccccaugcuggagcc

SEQ ID NO: 3629030 - RNA, 21 nt, Human
caaagccccaugcuggagccu

SEQ ID NO: 3629031 - RNA, 17 nt, Human
caaagccccauuaacug

SEQ ID NO: 3629032 - RNA, 16 nt, Human
caaagcccccagagcc

SEQ ID NO: 3629033 - RNA, 17 nt, Human
caaagcccccagagccc

SEQ ID NO: 3629034 - RNA, 23 nt, Human
caaagccccuugcucuccccugc

SEQ ID NO: 3629035 - RNA, 15 nt, Human
caaagcccuaaaauu

SEQ ID NO: 3629036 - RNA, 18 nt, Human
caaagcccuuccaugucg

SEQ ID NO: 3629037 - RNA, 17 nt, Human
caaagccuccuccagcc

SEQ ID NO: 3629038 - RNA, 18 nt, Human
caaagccuccuccagccg

SEQ ID NO: 3629039 - RNA, 11 nt, Human
caaagccuuau

SEQ ID NO: 3629040 - RNA, 13 nt, Human
caaagcgggggga

SEQ ID NO: 3629041 - RNA, 21 nt, Human
caaagcguucacucccaaccu

SEQ ID NO: 3629042 - RNA, 22 nt, Human
caaagcugaagccgccaggacc

SEQ ID NO: 3629043 - RNA, 18 nt, Human
caaagcugacgaggcugg

SEQ ID NO: 3629044 - RNA, 13 nt, Human
caaagcugagccu

SEQ ID NO: 3629045 - RNA, 23 nt, Human
caaagcugagccugcagggaagc

SEQ ID NO: 3629046 - RNA, 19 nt, Human
caaagcugaugacaacuuc

SEQ ID NO: 3629047 - RNA, 21 nt, Human
caaagcugccugucccuaccc

SEQ ID NO: 3629048 - RNA, 16 nt, Human
caaagcugcuaaaucu

SEQ ID NO: 3629049 - RNA, 16 nt, Human
caaagcuggcucaccu

SEQ ID NO: 3629050 - RNA, 18 nt, Human
caaagcuguucuuccugg

SEQ ID NO: 3629051 - RNA, 14 nt, Human
caaagcuuagcagg

SEQ ID NO: 3629052 - RNA, 15 nt, Human
caaagcuuagcagga

SEQ ID NO: 3629053 - RNA, 17 nt, Human
caaagcuuagcaggaga

SEQ ID NO: 3629054 - RNA, 18 nt, Human
caaagcuuagcaggagag

SEQ ID NO: 3629055 - RNA, 20 nt, Human
caaagcuucccgauuaacug

SEQ ID NO: 3629056 - RNA, 20 nt, Human
caaagcuucuaucccaggag

SEQ ID NO: 3629057 - RNA, 19 nt, Human
caaagcuuggagggaagcc

SEQ ID NO: 3629058 - RNA, 21 nt, Human
caaagcuuggauuaaauacau

SEQ ID NO: 3629059 - RNA, 14 nt, Human
caaagcuuuccugc

SEQ ID NO: 3629060 - RNA, 18 nt, Human
caaagcuuuccugcccca

SEQ ID NO: 3629061 - RNA, 16 nt, Human
caaagcuuuuuccaga

SEQ ID NO: 3629062 - RNA, 21 nt, Human
caaaggaaaaagcacaagaag

SEQ ID NO: 3629063 - RNA, 19 nt, Human
caaaggaaaaaguaucaug

SEQ ID NO: 3629064 - RNA, 22 nt, Human
caaaggaaaauaguaauguuuu

SEQ ID NO: 3629065 - RNA, 17 nt, Human
caaaggaaaaugucugu

SEQ ID NO: 3629066 - RNA, 18 nt, Human
caaaggaaacuuugcaga

SEQ ID NO: 3629067 - RNA, 13 nt, Human
caaaggaagcaca

SEQ ID NO: 3629068 - RNA, 16 nt, Human
caaaggaagucuagga

SEQ ID NO: 3629069 - RNA, 21 nt, Human
caaaggaauggaggcucuaau

SEQ ID NO: 3629070 - RNA, 24 nt, Human
caaaggaauggaggcucuaauuga

SEQ ID NO: 3629071 - RNA, 19 nt, Human
caaaggacauuaugugugc

SEQ ID NO: 3629072 - RNA, 20 nt, Human
caaaggacauuaugugugca

SEQ ID NO: 3629073 - RNA, 13 nt, Human
caaaggacgcacu

SEQ ID NO: 3629074 - RNA, 18 nt, Human
caaaggacgcacugagca

SEQ ID NO: 3629075 - RNA, 20 nt, Human
caaaggagagucacagaaca

SEQ ID NO: 3629076 - RNA, 20 nt, Human
caaaggagauaaaucuagua

SEQ ID NO: 3629077 - RNA, 20 nt, Human
caaaggagauuggaaggaac

SEQ ID NO: 3629078 - RNA, 12 nt, Human
caaaggagccug

SEQ ID NO: 3629079 - RNA, 13 nt, Human
caaaggagccugu

SEQ ID NO: 3629080 - RNA, 14 nt, Human
caaaggagccugug

SEQ ID NO: 3629081 - RNA, 16 nt, Human
caaaggauacuuauuu

SEQ ID NO: 3629082 - RNA, 21 nt, Human
caaaggauacuuauuuaaaua

SEQ ID NO: 3629083 - RNA, 22 nt, Human
caaaggauagugcgauguuuca

SEQ ID NO: 3629084 - RNA, 21 nt, Human
caaaggaugcccaaagaugca

SEQ ID NO: 3629085 - RNA, 15 nt, Human
caaaggcaagcacuu

SEQ ID NO: 3629086 - RNA, 14 nt, Human
caaaggcaaguuaa

SEQ ID NO: 3629087 - RNA, 23 nt, Human
caaaggcaaguuaagagaaacuu

SEQ ID NO: 3629088 - RNA, 20 nt, Human
caaaggcacagugaaggcug

SEQ ID NO: 3629089 - RNA, 20 nt, Human
caaaggccagaccugcagac

SEQ ID NO: 3629090 - RNA, 21 nt, Human
caaaggccagaccugcagacg

SEQ ID NO: 3629091 - RNA, 13 nt, Human
caaaggccaugga

SEQ ID NO: 3629092 - RNA, 13 nt, Human
caaaggcccccua

SEQ ID NO: 3629093 - RNA, 11 nt, Human
caaaggcuggg

SEQ ID NO: 3629094 - RNA, 12 nt, Human
caaaggcuggga

SEQ ID NO: 3629095 - RNA, 15 nt, Human
caaagggaaauauca

SEQ ID NO: 3629096 - RNA, 22 nt, Human
caaagggagcacuggguugacu

SEQ ID NO: 3629097 - RNA, 22 nt, Human
caaagggcuccucuccagucug

SEQ ID NO: 3629098 - RNA, 18 nt, Human
caaagggcugaaagccau

SEQ ID NO: 3629099 - RNA, 21 nt, Human
caaagggcugaaagccauuug

SEQ ID NO: 3629100 - RNA, 21 nt, Human
caaaggggacaggccucaccu

SEQ ID NO: 3629101 - RNA, 17 nt, Human
caaaggggaccuggaag

SEQ ID NO: 3629102 - RNA, 18 nt, Human
caaaggggaccuggaagg

SEQ ID NO: 3629103 - RNA, 22 nt, Human
caaaggggaggcaucagugucc

SEQ ID NO: 3629104 - RNA, 21 nt, Human
caaaggguccagaaggagaca

SEQ ID NO: 3629105 - RNA, 19 nt, Human
caaagggugaagcuauuua

SEQ ID NO: 3629106 - RNA, 21 nt, Human
caaagggugaagcuauuuauc

SEQ ID NO: 3629107 - RNA, 18 nt, Human
caaaggucuuuuuaaacc

SEQ ID NO: 3629108 - RNA, 16 nt, Human
caaaggugaaggaaua

SEQ ID NO: 3629109 - RNA, 19 nt, Human
caaagguucuagguuucaa

SEQ ID NO: 3629110 - RNA, 13 nt, Human
caaagguuuaaau

SEQ ID NO: 3629111 - RNA, 19 nt, Human
caaagguuuggaaggagca

SEQ ID NO: 3629112 - RNA, 19 nt, Human
caaagguuuuccucuucua

SEQ ID NO: 3629113 - RNA, 16 nt, Human
caaaguaaaacuugcu

SEQ ID NO: 3629114 - RNA, 13 nt, Human
caaaguaaaagaa

SEQ ID NO: 3629115 - RNA, 16 nt, Human
caaaguacagaauuug

SEQ ID NO: 3629116 - RNA, 14 nt, Human
caaaguacuguaag

SEQ ID NO: 3629117 - RNA, 22 nt, Human
caaaguagaagucuuagaugua

SEQ ID NO: 3629118 - RNA, 22 nt, Human
caaaguaguacuucuucuguaa

SEQ ID NO: 3629119 - RNA, 21 nt, Human
caaaguauaaauuuguguaau

SEQ ID NO: 3629120 - RNA, 17 nt, Human
caaaguauuaagcauau

SEQ ID NO: 3629121 - RNA, 17 nt, Human
caaaguauuguaaauua

SEQ ID NO: 3629122 - RNA, 20 nt, Human
caaaguauuguaaauuauau

SEQ ID NO: 3629123 - RNA, 18 nt, Human
caaagucaggaaucauca

SEQ ID NO: 3629124 - RNA, 18 nt, Human
caaagucauaauugcauu

SEQ ID NO: 3629125 - RNA, 15 nt, Human
caaagucaugauguu

SEQ ID NO: 3629126 - RNA, 19 nt, Human
caaagucaugauguuuuua

SEQ ID NO: 3629127 - RNA, 22 nt, Human
caaagucaugcaaaggcuggga

SEQ ID NO: 3629128 - RNA, 16 nt, Human
caaagucauuaaagac

SEQ ID NO: 3629129 - RNA, 23 nt, Human
caaaguccuuuuuuuccaucuuu

SEQ ID NO: 3629130 - RNA, 13 nt, Human
caaagucuaaagu

SEQ ID NO: 3629131 - RNA, 19 nt, Human
caaagucucaaugaaauag

SEQ ID NO: 3629132 - RNA, 13 nt, Human
caaagucuccagc

SEQ ID NO: 3629133 - RNA, 13 nt, Human
caaagucucuaau

SEQ ID NO: 3629134 - RNA, 21 nt, Human
caaagucucuggaauuugaaa

SEQ ID NO: 3629135 - RNA, 23 nt, Human
caaagucugcucucauauaagac

SEQ ID NO: 3629136 - RNA, 16 nt, Human
caaagucuuugggguc

SEQ ID NO: 3629137 - RNA, 16 nt, Human
caaagugcaaggaccu

SEQ ID NO: 3629138 - RNA, 22 nt, Human
caaagugccacucauuccugua

SEQ ID NO: 3629139 - RNA, 18 nt, Human
caaagugcugggauuaca

SEQ ID NO: 3629140 - RNA, 19 nt, Human
caaagugcugggauuacag

SEQ ID NO: 3629141 - RNA, 12 nt, Human
caaucuguaaac

SEQ ID NO: 3629142 - RNA, 17 nt, Human
caaucuguaaacugugu

SEQ ID NO: 3629143 - RNA, 15 nt, Human
caaucuuacuuugua

SEQ ID NO: 3629144 - RNA, 17 nt, Human
caaucuuacuuuguaaa

SEQ ID NO: 3629145 - RNA, 17 nt, Human
caaucuugcauguaacg

SEQ ID NO: 3629146 - RNA, 20 nt, Human
caaucuuugaaagacuucca

SEQ ID NO: 3629147 - RNA, 23 nt, Human
caaucuuugaaagacuuccaaag

SEQ ID NO: 3629148 - RNA, 21 nt, Human
caaugaaaaauagugucuuug

SEQ ID NO: 3629149 - RNA, 16 nt, Human
caaugaaaacucuuug

SEQ ID NO: 3629150 - RNA, 19 nt, Human
caaugaaaaggugauuguc

SEQ ID NO: 3629151 - RNA, 17 nt, Human
caaugaaaguuugcacu

SEQ ID NO: 3629152 - RNA, 22 nt, Human
caaugaaauacacaaguaaaca

SEQ ID NO: 3629153 - RNA, 11 nt, Human
caaugaaauga

SEQ ID NO: 3629154 - RNA, 19 nt, Human
caaugaaaugcucuccuuu

SEQ ID NO: 3629155 - RNA, 18 nt, Human
caaugaacacuuauaagu

SEQ ID NO: 3629156 - RNA, 19 nt, Human
caaugaaccauaaauucaa

SEQ ID NO: 3629157 - RNA, 21 nt, Human
caaugaaguugaaaaucauag

SEQ ID NO: 3629158 - RNA, 22 nt, Human
caaugaauaaaaacucaaggag

SEQ ID NO: 3629159 - RNA, 17 nt, Human
caaugaauauacucauu

SEQ ID NO: 3629160 - RNA, 18 nt, Human
caaugaauauacucauua

SEQ ID NO: 3629161 - RNA, 13 nt, Human
caaugaauuauua

SEQ ID NO: 3629162 - RNA, 16 nt, Human
caaugacaucucaggg

SEQ ID NO: 3629163 - RNA, 22 nt, Human
caaugacaucucaggggccaga

SEQ ID NO: 3629164 - RNA, 15 nt, Human
caaugacaugaauuu

SEQ ID NO: 3629165 - RNA, 23 nt, Human
caaugaccuuucaauaggaaaaa

SEQ ID NO: 3629166 - RNA, 15 nt, Human
caaugacucaaaguc

SEQ ID NO: 3629167 - RNA, 14 nt, Human
caaugacucucugg

SEQ ID NO: 3629168 - RNA, 17 nt, Human
caaugagacuugccuuc

SEQ ID NO: 3629169 - RNA, 22 nt, Human
caaugagauagaagauguuugc

SEQ ID NO: 3629170 - RNA, 12 nt, Human
caaugagcaugu

SEQ ID NO: 3629171 - RNA, 20 nt, Human
caaugagcauguuuagacuu

SEQ ID NO: 3629172 - RNA, 12 nt, Human
caaugagcuuuc

SEQ ID NO: 3629173 - RNA, 13 nt, Human
caaugagcuuucu

SEQ ID NO: 3629174 - RNA, 15 nt, Human
caaugagcuuucuga

SEQ ID NO: 3629175 - RNA, 21 nt, Human
caaugagcuuucugaacagcu

SEQ ID NO: 3629176 - RNA, 20 nt, Human
caaugagguguccaacuggc

SEQ ID NO: 3629177 - RNA, 18 nt, Human
caaugauaguaagaaaag

SEQ ID NO: 3629178 - RNA, 20 nt, Human
caaugaucaccgacugaaaa

SEQ ID NO: 3629179 - RNA, 18 nt, Human
caaugaucuagguuuaac

SEQ ID NO: 3629180 - RNA, 23 nt, Human
caaugaucuagguuuaacucaga

SEQ ID NO: 3629181 - RNA, 19 nt, Human
caaugaugaugauaaugau

SEQ ID NO: 3629182 - RNA, 13 nt, Human
caaugaugcuauu

SEQ ID NO: 3629183 - RNA, 17 nt, Human
caaugaugcuauuugca

SEQ ID NO: 3629184 - RNA, 19 nt, Human
caaugaugcuauuugcaau

SEQ ID NO: 3629185 - RNA, 13 nt, Human
caaugauggcaau

SEQ ID NO: 3629186 - RNA, 17 nt, Human
caaugcaaaccaucauu

SEQ ID NO: 3629187 - RNA, 20 nt, Human
caaugcaaaccaucauugaa

SEQ ID NO: 3629188 - RNA, 22 nt, Human
caaugcaagagugauugcagcu

SEQ ID NO: 3629189 - RNA, 23 nt, Human
caaugcaagagugauugcagcuu

SEQ ID NO: 3629190 - RNA, 22 nt, Human
caaugcacacaaaacaacccua

SEQ ID NO: 3629191 - RNA, 14 nt, Human
caaugcacauccau

SEQ ID NO: 3629192 - RNA, 16 nt, Human
caaugcacauggugca

SEQ ID NO: 3629193 - RNA, 17 nt, Human
caaugcaccuaaagaaa

SEQ ID NO: 3629194 - RNA, 14 nt, Human
caaugcacugacau

SEQ ID NO: 3629195 - RNA, 14 nt, Human
caaugcacuuuguu

SEQ ID NO: 3629196 - RNA, 20 nt, Human
caaugcacuuuguucuggcu

SEQ ID NO: 3629197 - RNA, 21 nt, Human
caaugcacuuuguucuggcuc

SEQ ID NO: 3629198 - RNA, 17 nt, Human
caaugcagaugccagag

SEQ ID NO: 3629199 - RNA, 18 nt, Human
caaugcagaugccagagc

SEQ ID NO: 3629200 - RNA, 18 nt, Human
caaugcagcaaggcccug

SEQ ID NO: 3629201 - RNA, 20 nt, Human
caaugcagcaaggcccugcu

SEQ ID NO: 3629202 - RNA, 16 nt, Human
caaugcagugccuuuc

SEQ ID NO: 3629203 - RNA, 17 nt, Human
caaugcaguugucucug

SEQ ID NO: 3629204 - RNA, 12 nt, Human
caaugcauuuug

SEQ ID NO: 3629205 - RNA, 16 nt, Human
caaugccacagcccug

SEQ ID NO: 3629206 - RNA, 20 nt, Human
caaugccacauacuugcagc

SEQ ID NO: 3629207 - RNA, 16 nt, Human
caaugccauccucaaa

SEQ ID NO: 3629208 - RNA, 20 nt, Human
caaugccuauuguaauauag

SEQ ID NO: 3629209 - RNA, 23 nt, Human
caaugccuauuguaauauagaaa

SEQ ID NO: 3629210 - RNA, 20 nt, Human
caaugccucuugucuuccua

SEQ ID NO: 3629211 - RNA, 20 nt, Human
caaugcugaugaaucacugu

SEQ ID NO: 3629212 - RNA, 16 nt, Human
caaugcuggagaaaaa

SEQ ID NO: 3629213 - RNA, 15 nt, Human
caaugcuguauuuua

SEQ ID NO: 3629214 - RNA, 22 nt, Human
caaugcugugcccuaaagugua

SEQ ID NO: 3629215 - RNA, 21 nt, Human
caaugcuuugccccugagaca

SEQ ID NO: 3629216 - RNA, 15 nt, Human
caauggaaaccucac

SEQ ID NO: 3629217 - RNA, 13 nt, Human
caauggaaacuga

SEQ ID NO: 3629218 - RNA, 15 nt, Human
caauggaaacugaau

SEQ ID NO: 3629219 - RNA, 17 nt, Human
caauggaaacugaaugc

SEQ ID NO: 3629220 - RNA, 17 nt, Human
caauggaaccuccuuuc

SEQ ID NO: 3629221 - RNA, 15 nt, Human
caauggaguauucuc

SEQ ID NO: 3629222 - RNA, 13 nt, Human
caauggauauuug

SEQ ID NO: 3629223 - RNA, 14 nt, Human
caauggcagaugua

SEQ ID NO: 3629224 - RNA, 13 nt, Human
caauggcagccuu

SEQ ID NO: 3629225 - RNA, 16 nt, Human
caauggcagccuuggc

SEQ ID NO: 3629226 - RNA, 15 nt, Human
caauggccuaaacuu

SEQ ID NO: 3629227 - RNA, 21 nt, Human
caauggcgcagugccucuggu

SEQ ID NO: 3629228 - RNA, 14 nt, Human
caauggcugcugaa

SEQ ID NO: 3629229 - RNA, 15 nt, Human
caauggcuuuuuaaa

SEQ ID NO: 3629230 - RNA, 21 nt, Human
caaugggaaauacuacuccug

SEQ ID NO: 3629231 - RNA, 15 nt, Human
caaugggagcucaug

SEQ ID NO: 3629232 - RNA, 23 nt, Human
caaugggauguaugaauacagca

SEQ ID NO: 3629233 - RNA, 16 nt, Human
caaugggcucuuccaa

SEQ ID NO: 3629234 - RNA, 22 nt, Human
caauggggauguuguguuucug

SEQ ID NO: 3629235 - RNA, 14 nt, Human
caaugguaguuucu

SEQ ID NO: 3629236 - RNA, 20 nt, Human
caaugguaguuucugugguu

SEQ ID NO: 3629237 - RNA, 16 nt, Human
caaugguccugacuuu

SEQ ID NO: 3629238 - RNA, 21 nt, Human
caauggugucaguauccaggc

SEQ ID NO: 3629239 - RNA, 20 nt, Human
caaugguguuauuugaaacu

SEQ ID NO: 3629240 - RNA, 22 nt, Human
caaugguguuuuucuuguaaau

SEQ ID NO: 3629241 - RNA, 16 nt, Human
caaugguuugcaagga

SEQ ID NO: 3629242 - RNA, 18 nt, Human
caaugguuuucuugugug

SEQ ID NO: 3629243 - RNA, 17 nt, Human
caauguaaauauuuuaa

SEQ ID NO: 3629244 - RNA, 23 nt, Human
caauguaauuauuuauguauggu

SEQ ID NO: 3629245 - RNA, 19 nt, Human
caauguacccaccgggcca

SEQ ID NO: 3629246 - RNA, 22 nt, Human
caauguacccaccgggccacuc

SEQ ID NO: 3629247 - RNA, 21 nt, Human
caauguacuaggauacugcug

SEQ ID NO: 3629248 - RNA, 20 nt, Human
caauguagauaaguguucug

SEQ ID NO: 3629249 - RNA, 18 nt, Human
caauguauuuauuuaaaa

SEQ ID NO: 3629250 - RNA, 22 nt, Human
caauguauuuauuuaaaagauu

SEQ ID NO: 3629251 - RNA, 21 nt, Human
caaugucauauacugccaugu

SEQ ID NO: 3629252 - RNA, 22 nt, Human
caaugucugcagcccugagaaa

SEQ ID NO: 3629253 - RNA, 14 nt, Human
caaugucuggagac

SEQ ID NO: 3629254 - RNA, 23 nt, Human
caaugucuugguacuugcugcua

SEQ ID NO: 3629255 - RNA, 14 nt, Human
caaugugaaaaauc

SEQ ID NO: 3629256 - RNA, 21 nt, Human
caaugugaacuuuauuaaaua

SEQ ID NO: 3629257 - RNA, 19 nt, Human
caaugugaaucagacccua

SEQ ID NO: 3629258 - RNA, 13 nt, Human
caaugugaccagg

SEQ ID NO: 3629259 - RNA, 15 nt, Human
caaugugauaaaacc

SEQ ID NO: 3629260 - RNA, 20 nt, Human
caaugugauauaaacagcuu

SEQ ID NO: 3629261 - RNA, 22 nt, Human
caaugugauauaaacagcuucu

SEQ ID NO: 3629262 - RNA, 16 nt, Human
caaugugaucuauguu

SEQ ID NO: 3629263 - RNA, 15 nt, Human
caaugugauucuaau

SEQ ID NO: 3629264 - RNA, 17 nt, Human
caauguguauaaacaag

SEQ ID NO: 3629265 - RNA, 18 nt, Human
caauguguauaaacaaga

SEQ ID NO: 3629266 - RNA, 15 nt, Human
caaugugucuuucua

SEQ ID NO: 3629267 - RNA, 23 nt, Human
caaugugugccgagcccuugccc

SEQ ID NO: 3629268 - RNA, 17 nt, Human
caauguguguauaugga

SEQ ID NO: 3629269 - RNA, 17 nt, Human
caauguguuuuucucca

SEQ ID NO: 3629270 - RNA, 21 nt, Human
caauguuaaacuuauaaccca

SEQ ID NO: 3629271 - RNA, 14 nt, Human
caauguuaacauuu

SEQ ID NO: 3629272 - RNA, 18 nt, Human
caauguuaaggaaacucu

SEQ ID NO: 3629273 - RNA, 16 nt, Human
caauguuagagacuuu

SEQ ID NO: 3629274 - RNA, 13 nt, Human
caauguucauugu

SEQ ID NO: 3629275 - RNA, 15 nt, Human
caauguucauuguaa

SEQ ID NO: 3629276 - RNA, 15 nt, Human
caauguucuuuauau

SEQ ID NO: 3629277 - RNA, 18 nt, Human
caauguucuuuauauaca

SEQ ID NO: 3629278 - RNA, 22 nt, Human
caauguucuuuauauacaauaa

SEQ ID NO: 3629279 - RNA, 18 nt, Human
caauguuuaaaaaaguuu

SEQ ID NO: 3629280 - RNA, 11 nt, Human
caauguuuaca

SEQ ID NO: 3629281 - RNA, 21 nt, Human
caauguuuauuucauaaagaa

SEQ ID NO: 3629282 - RNA, 17 nt, Human
caauguuucuucuaggu

SEQ ID NO: 3629283 - RNA, 16 nt, Human
caauguuucuuuuauc

SEQ ID NO: 3629284 - RNA, 13 nt, Human
caauguuuuccuu

SEQ ID NO: 3629285 - RNA, 19 nt, Human
cacagaaucauaugauucu

SEQ ID NO: 3629286 - RNA, 12 nt, Human
cacagaaugcaa

SEQ ID NO: 3629287 - RNA, 12 nt, Human
cacagacacaca

SEQ ID NO: 3629288 - RNA, 20 nt, Human
cacagacacacacacgcacg

SEQ ID NO: 3629289 - RNA, 10 nt, Human
cacagacagg

SEQ ID NO: 3629290 - RNA, 14 nt, Human
cacagacaggaccc

SEQ ID NO: 3629291 - RNA, 18 nt, Human
cacagacaggaccccugc

SEQ ID NO: 3629292 - RNA, 19 nt, Human
cacagacagggucaaagug

SEQ ID NO: 3629293 - RNA, 21 nt, Human
cacagacauacuaaccagcag

SEQ ID NO: 3629294 - RNA, 18 nt, Human
cacagacauucugccagg

SEQ ID NO: 3629295 - RNA, 13 nt, Human
cacagacccugcc

SEQ ID NO: 3629296 - RNA, 14 nt, Human
cacagaccuggagc

SEQ ID NO: 3629297 - RNA, 15 nt, Human
cacagaccuggagcc

SEQ ID NO: 3629298 - RNA, 18 nt, Human
cacagaccuggagccccu

SEQ ID NO: 3629299 - RNA, 19 nt, Human
cacagaccuggagccccug

SEQ ID NO: 3629300 - RNA, 14 nt, Human
cacagacucauauu

SEQ ID NO: 3629301 - RNA, 21 nt, Human
cacagacucauccugaacagc

SEQ ID NO: 3629302 - RNA, 23 nt, Human
cacagacucauccugaacagcau

SEQ ID NO: 3629303 - RNA, 12 nt, Human
cacagagaaagu

SEQ ID NO: 3629304 - RNA, 19 nt, Human
cacagagaaaguacuucuc

SEQ ID NO: 3629305 - RNA, 20 nt, Human
cacagagaaaguacuucucc

SEQ ID NO: 3629306 - RNA, 14 nt, Human
cacagagaagacaa

SEQ ID NO: 3629307 - RNA, 17 nt, Human
cacagagaagacaaaau

SEQ ID NO: 3629308 - RNA, 20 nt, Human
cacagagaagcuggggagga

SEQ ID NO: 3629309 - RNA, 14 nt, Human
cacagagacacagg

SEQ ID NO: 3629310 - RNA, 18 nt, Human
cacagagacacagggcau

SEQ ID NO: 3629311 - RNA, 23 nt, Human
cacagagacccccggaacaagcc

SEQ ID NO: 3629312 - RNA, 10 nt, Human
cacagagaga

SEQ ID NO: 3629313 - RNA, 14 nt, Human
cacagagagaguca

SEQ ID NO: 3629314 - RNA, 22 nt, Human
cacagagagggagagcagagaa

SEQ ID NO: 3629315 - RNA, 18 nt, Human
cacagagagucccacugc

SEQ ID NO: 3629316 - RNA, 19 nt, Human
cacagagagucccacugcc

SEQ ID NO: 3629317 - RNA, 23 nt, Human
cacagagcaagagauaagucuuu

SEQ ID NO: 3629318 - RNA, 14 nt, Human
cacagagcaggacu

SEQ ID NO: 3629319 - RNA, 21 nt, Human
cacagagcaggacugcacagc

SEQ ID NO: 3629320 - RNA, 16 nt, Human
cacagagcucuccagc

SEQ ID NO: 3629321 - RNA, 15 nt, Human
cacagaggaagagca

SEQ ID NO: 3629322 - RNA, 17 nt, Human
cacagaggaagagcagg

SEQ ID NO: 3629323 - RNA, 15 nt, Human
cacagaggacacaga

SEQ ID NO: 3629324 - RNA, 23 nt, Human
cacagagguagucucacugcuug

SEQ ID NO: 3629325 - RNA, 15 nt, Human
cacagaguaagacau

SEQ ID NO: 3629326 - RNA, 17 nt, Human
cacagaguaagacauug

SEQ ID NO: 3629327 - RNA, 19 nt, Human
cacagagucaaggccugcu

SEQ ID NO: 3629328 - RNA, 22 nt, Human
cacagaguggucuuucuggaga

SEQ ID NO: 3629329 - RNA, 15 nt, Human
cacagaguguagcca

SEQ ID NO: 3629330 - RNA, 16 nt, Human
cacagaguuguuacau

SEQ ID NO: 3629331 - RNA, 17 nt, Human
cacagaguuguuacauu

SEQ ID NO: 3629332 - RNA, 20 nt, Human
cacagaguuguuacauuuuu

SEQ ID NO: 3629333 - RNA, 14 nt, Human
cacagauaaaaagu

SEQ ID NO: 3629334 - RNA, 15 nt, Human
cacagauaaaaagug

SEQ ID NO: 3629335 - RNA, 16 nt, Human
cacagauacacacaca

SEQ ID NO: 3629336 - RNA, 19 nt, Human
cacagauauacuuugugga

SEQ ID NO: 3629337 - RNA, 22 nt, Human
cacagaucacagcuucagccag

SEQ ID NO: 3629338 - RNA, 11 nt, Human
cacagaucaug

SEQ ID NO: 3629339 - RNA, 20 nt, Human
cacagaugaguuaucuaaga

SEQ ID NO: 3629340 - RNA, 11 nt, Human
cacagaugccu

SEQ ID NO: 3629341 - RNA, 15 nt, Human
cacagaugcuccagg

SEQ ID NO: 3629342 - RNA, 19 nt, Human
cacagauggauuugccugu

SEQ ID NO: 3629343 - RNA, 13 nt, Human
cacagauggccag

SEQ ID NO: 3629344 - RNA, 18 nt, Human
cacagaugggugcuugga

SEQ ID NO: 3629345 - RNA, 19 nt, Human
cacagauguucccccaucu

SEQ ID NO: 3629346 - RNA, 20 nt, Human
cacagauuguuucuauacaa

SEQ ID NO: 3629347 - RNA, 22 nt, Human
cacagauuugagcucagcccug

SEQ ID NO: 3629348 - RNA, 18 nt, Human
cacagauuuuaauuguca

SEQ ID NO: 3629349 - RNA, 19 nt, Human
cacagauuuuaauugucau

SEQ ID NO: 3629350 - RNA, 17 nt, Human
cacagcaaggcaccugc

SEQ ID NO: 3629351 - RNA, 19 nt, Human
cacagcaaggcaccugcag

SEQ ID NO: 3629352 - RNA, 16 nt, Human
cacagcaauuccucag

SEQ ID NO: 3629353 - RNA, 18 nt, Human
cacagcaauuccucaggc

SEQ ID NO: 3629354 - RNA, 15 nt, Human
cacagcacagccaac

SEQ ID NO: 3629355 - RNA, 13 nt, Human
cacagcacagcuc

SEQ ID NO: 3629356 - RNA, 17 nt, Human
cacagcacagcucccug

SEQ ID NO: 3629357 - RNA, 19 nt, Human
cacagcacaugcuggccag

SEQ ID NO: 3629358 - RNA, 15 nt, Human
cacagcacccuauau

SEQ ID NO: 3629359 - RNA, 13 nt, Human
cacagcagcauuu

SEQ ID NO: 3629360 - RNA, 16 nt, Human
cacagcagccccugca

SEQ ID NO: 3629361 - RNA, 18 nt, Human
cacagcagccucugaagu

SEQ ID NO: 3629362 - RNA, 13 nt, Human
cacagcagcuuca

SEQ ID NO: 3629363 - RNA, 15 nt, Human
cacagcagcuucacc

SEQ ID NO: 3629364 - RNA, 18 nt, Human
cacagcagcuucaccaga

SEQ ID NO: 3629365 - RNA, 20 nt, Human
cacagcaggcugccagugcc

SEQ ID NO: 3629366 - RNA, 13 nt, Human
cacagcagguccu

SEQ ID NO: 3629367 - RNA, 21 nt, Human
cacagcaguucugcagaggac

SEQ ID NO: 3629368 - RNA, 19 nt, Human
cacagcaguugaaaagacu

SEQ ID NO: 3629369 - RNA, 21 nt, Human
cacagcaguugaaaagacucc

SEQ ID NO: 3629370 - RNA, 23 nt, Human
cacagcaucauuuugcauucaaa

SEQ ID NO: 3629371 - RNA, 12 nt, Human
cacagcaucuca

SEQ ID NO: 3629372 - RNA, 13 nt, Human
cacagcaucucag

SEQ ID NO: 3629373 - RNA, 22 nt, Human
cacagccaacacgcaccugccu

SEQ ID NO: 3629374 - RNA, 11 nt, Human
cacagccacac

SEQ ID NO: 3629375 - RNA, 15 nt, Human
cacagccacacacac

SEQ ID NO: 3629376 - RNA, 19 nt, Human
cacagccacacacacagaa

SEQ ID NO: 3629377 - RNA, 21 nt, Human
cacagccacacacacagaaaa

SEQ ID NO: 3629378 - RNA, 16 nt, Human
cacagccaggugccuu

SEQ ID NO: 3629379 - RNA, 22 nt, Human
cacagccaucccagccuuggca

SEQ ID NO: 3629380 - RNA, 19 nt, Human
cacagcccaaagaaggaaa

SEQ ID NO: 3629381 - RNA, 16 nt, Human
cacagcccacguccug

SEQ ID NO: 3629382 - RNA, 18 nt, Human
cacagcccacguccuguc

SEQ ID NO: 3629383 - RNA, 16 nt, Human
cacagcccagccacgg

SEQ ID NO: 3629384 - RNA, 15 nt, Human
cacagcccucccgcc

SEQ ID NO: 3629385 - RNA, 20 nt, Human
cacagcccucccgccccuuc

SEQ ID NO: 3629386 - RNA, 11 nt, Human
cacagcccugu

SEQ ID NO: 3629387 - RNA, 12 nt, Human
cacagcccuguc

SEQ ID NO: 3629388 - RNA, 14 nt, Human
cacagcccugucag

SEQ ID NO: 3629389 - RNA, 23 nt, Human
cacagccgcagccucccucugac

SEQ ID NO: 3629390 - RNA, 20 nt, Human
cacagccggggccugccuag

SEQ ID NO: 3629391 - RNA, 22 nt, Human
cacagccggggccugccuagca

SEQ ID NO: 3629392 - RNA, 14 nt, Human
cacagccuccccug

SEQ ID NO: 3629393 - RNA, 23 nt, Human
cacagccuccucugucugcccuu

SEQ ID NO: 3629394 - RNA, 13 nt, Human
cacagccucugac

SEQ ID NO: 3629395 - RNA, 15 nt, Human
cacagccucugaccc

SEQ ID NO: 3629396 - RNA, 20 nt, Human
cacagccucugaccccuccu

SEQ ID NO: 3629397 - RNA, 22 nt, Human
cacagccucugaccccuccuca

SEQ ID NO: 3629398 - RNA, 14 nt, Human
cacagccucugccu

SEQ ID NO: 3629399 - RNA, 17 nt, Human
cacagccucuuagaugc

SEQ ID NO: 3629400 - RNA, 14 nt, Human
cacagccugcacuu

SEQ ID NO: 3629401 - RNA, 14 nt, Human
cacagcgagggcag

SEQ ID NO: 3629402 - RNA, 15 nt, Human
cacagcgagggcagc

SEQ ID NO: 3629403 - RNA, 19 nt, Human
cacagcgagggcagcugcu

SEQ ID NO: 3629404 - RNA, 14 nt, Human
cacagcgcuggccg

SEQ ID NO: 3629405 - RNA, 19 nt, Human
cacagcgcuggccgggacc

SEQ ID NO: 3629406 - RNA, 16 nt, Human
cacagcggccccugca

SEQ ID NO: 3629407 - RNA, 15 nt, Human
cacagcgucccuagc

SEQ ID NO: 3629408 - RNA, 15 nt, Human
cacagcgucccuggc

SEQ ID NO: 3629409 - RNA, 18 nt, Human
cacagcgucccuggcgca

SEQ ID NO: 3629410 - RNA, 19 nt, Human
cacagcgucccuggcgcag

SEQ ID NO: 3629411 - RNA, 19 nt, Human
cacagcguccuguccacac

SEQ ID NO: 3629412 - RNA, 20 nt, Human
cacagcuaacacacagcucc

SEQ ID NO: 3629413 - RNA, 16 nt, Human
cacagcuaacauggaa

SEQ ID NO: 3629414 - RNA, 12 nt, Human
cacagcuaugaa

SEQ ID NO: 3629415 - RNA, 16 nt, Human
cacagcucccacccca

SEQ ID NO: 3629416 - RNA, 17 nt, Human
cacagcucccaccccac

SEQ ID NO: 3629417 - RNA, 15 nt, Human
cacagcucccugcca

SEQ ID NO: 3629418 - RNA, 16 nt, Human
cacagcucccugccaa

SEQ ID NO: 3629419 - RNA, 16 nt, Human
cacagcucccuucugu

SEQ ID NO: 3629420 - RNA, 15 nt, Human
cacagcuccucccac

SEQ ID NO: 3629421 - RNA, 12 nt, Human
cacagcuccuuu

SEQ ID NO: 3629422 - RNA, 21 nt, Human
cacagcucuccggucucucuc

SEQ ID NO: 3629423 - RNA, 14 nt, Human
cacagcucuguccu

SEQ ID NO: 3629424 - RNA, 19 nt, Human
cacagcucuguccugggag

SEQ ID NO: 3629425 - RNA, 20 nt, Human
cacagcucuguccugggagu

SEQ ID NO: 3629426 - RNA, 23 nt, Human
cacagcucuguccugggagugag

SEQ ID NO: 3629427 - RNA, 10 nt, Human
cacagcucuu

SEQ ID NO: 3629428 - RNA, 20 nt, Human
cacagcugaaaguucuugcu

SEQ ID NO: 3629429 - RNA, 18 nt, Human
cacagcugcagagacaga

SEQ ID NO: 3629430 - RNA, 20 nt, Human
cacagcugcuggagacuccu

SEQ ID NO: 3629431 - RNA, 14 nt, Human
caccaagccaaggg

SEQ ID NO: 3629432 - RNA, 13 nt, Human
caccaagcccaca

SEQ ID NO: 3629433 - RNA, 12 nt, Human
caccaagcccag

SEQ ID NO: 3629434 - RNA, 15 nt, Human
caccaagcccaguua

SEQ ID NO: 3629435 - RNA, 16 nt, Human
caccaagcucaaagcg

SEQ ID NO: 3629436 - RNA, 20 nt, Human
caccaagcucacaguuccuc

SEQ ID NO: 3629437 - RNA, 22 nt, Human
caccaagcugugccacccuggg

SEQ ID NO: 3629438 - RNA, 21 nt, Human
caccaaggaaacgcuaccucu

SEQ ID NO: 3629439 - RNA, 23 nt, Human
caccaagggcgcaagaguagcgg

SEQ ID NO: 3629440 - RNA, 14 nt, Human
caccaaggucuuca

SEQ ID NO: 3629441 - RNA, 15 nt, Human
caccaaggucuucag

SEQ ID NO: 3629442 - RNA, 21 nt, Human
caccaagugcggguccggcag

SEQ ID NO: 3629443 - RNA, 18 nt, Human
caccaaucuuacuuugua

SEQ ID NO: 3629444 - RNA, 19 nt, Human
caccaaucuuacuuuguaa

SEQ ID NO: 3629445 - RNA, 17 nt, Human
caccaauguacccaccg

SEQ ID NO: 3629446 - RNA, 24 nt, Human
caccaauugguuaaucuuuccuga

SEQ ID NO: 3629447 - RNA, 14 nt, Human
caccacacccagcc

SEQ ID NO: 3629448 - RNA, 15 nt, Human
caccacacccagccu

SEQ ID NO: 3629449 - RNA, 14 nt, Human
caccacacucagcc

SEQ ID NO: 3629450 - RNA, 12 nt, Human
caccacagacac

SEQ ID NO: 3629451 - RNA, 20 nt, Human
caccacagacacacacacgc

SEQ ID NO: 3629452 - RNA, 13 nt, Human
caccacagccagc

SEQ ID NO: 3629453 - RNA, 23 nt, Human
caccacaggcccuuuccucaggc

SEQ ID NO: 3629454 - RNA, 21 nt, Human
caccacauccuccguccagcc

SEQ ID NO: 3629455 - RNA, 15 nt, Human
caccacaugugcaca

SEQ ID NO: 3629456 - RNA, 19 nt, Human
caccacaugugcacaugca

SEQ ID NO: 3629457 - RNA, 16 nt, Human
caccaccacuggccac

SEQ ID NO: 3629458 - RNA, 23 nt, Human
caccaccacuggccaccaggcug

SEQ ID NO: 3629459 - RNA, 13 nt, Human
caccaccaggucu

SEQ ID NO: 3629460 - RNA, 14 nt, Human
caccaccccagcug

SEQ ID NO: 3629461 - RNA, 16 nt, Human
caccaccccagcugcu

SEQ ID NO: 3629462 - RNA, 21 nt, Human
caccaccccagcugcuccccu

SEQ ID NO: 3629463 - RNA, 15 nt, Human
caccaccccccacuc

SEQ ID NO: 3629464 - RNA, 23 nt, Human
caccaccuaggccacuccuccaa

SEQ ID NO: 3629465 - RNA, 16 nt, Human
caccaccucacuccug

SEQ ID NO: 3629466 - RNA, 17 nt, Human
caccaccucacuccugu

SEQ ID NO: 3629467 - RNA, 14 nt, Human
caccaccucagagu

SEQ ID NO: 3629468 - RNA, 14 nt, Human
caccaccucccuca

SEQ ID NO: 3629469 - RNA, 18 nt, Human
caccaccuucccagcucu

SEQ ID NO: 3629470 - RNA, 21 nt, Human
caccaccuucccagcucuccc

SEQ ID NO: 3629471 - RNA, 14 nt, Human
caccacgcccggcu

SEQ ID NO: 3629472 - RNA, 15 nt, Human
caccacgcccggcua

SEQ ID NO: 3629473 - RNA, 16 nt, Human
caccacggccacuggc

SEQ ID NO: 3629474 - RNA, 22 nt, Human
caccacggcguuguaccuguag

SEQ ID NO: 3629475 - RNA, 15 nt, Human
caccacguccagcug

SEQ ID NO: 3629476 - RNA, 18 nt, Human
caccacuagccucagggg

SEQ ID NO: 3629477 - RNA, 14 nt, Human
caccacuauaaaau

SEQ ID NO: 3629478 - RNA, 22 nt, Human
caccacucaaaggccagaccug

SEQ ID NO: 3629479 - RNA, 13 nt, Human
caccacuccauuc

SEQ ID NO: 3629480 - RNA, 15 nt, Human
caccacuccauuccc

SEQ ID NO: 3629481 - RNA, 17 nt, Human
caccacucuggcagcca

SEQ ID NO: 3629482 - RNA, 13 nt, Human
caccacugcacuc

SEQ ID NO: 3629483 - RNA, 16 nt, Human
caccacuggccaccag

SEQ ID NO: 3629484 - RNA, 16 nt, Human
caccacuucuuuuaua

SEQ ID NO: 3629485 - RNA, 16 nt, Human
caccagaagcccagaa

SEQ ID NO: 3629486 - RNA, 17 nt, Human
caccagaagcccagaau

SEQ ID NO: 3629487 - RNA, 19 nt, Human
caccagacacccaggacuu

SEQ ID NO: 3629488 - RNA, 20 nt, Human
caccagacacccaggacuua

SEQ ID NO: 3629489 - RNA, 14 nt, Human
caccagagagggac

SEQ ID NO: 3629490 - RNA, 22 nt, Human
caccagagcaaccucucacucc

SEQ ID NO: 3629491 - RNA, 17 nt, Human
caccagagcccaccuug

SEQ ID NO: 3629492 - RNA, 22 nt, Human
caccagagcccaccuuggcuca

SEQ ID NO: 3629493 - RNA, 11 nt, Human
caccagagcug

SEQ ID NO: 3629494 - RNA, 14 nt, Human
caccagcagccugg

SEQ ID NO: 3629495 - RNA, 19 nt, Human
caccagcaucaccugccug

SEQ ID NO: 3629496 - RNA, 14 nt, Human
caccagccaggcuc

SEQ ID NO: 3629497 - RNA, 15 nt, Human
caccagccaggcucu

SEQ ID NO: 3629498 - RNA, 18 nt, Human
caccagccaggcucugug

SEQ ID NO: 3629499 - RNA, 15 nt, Human
caccagcccagaagu

SEQ ID NO: 3629500 - RNA, 22 nt, Human
caccagcccaucgccacaaacu

SEQ ID NO: 3629501 - RNA, 19 nt, Human
caccagcccauggcccugu

SEQ ID NO: 3629502 - RNA, 12 nt, Human
caccagccccac

SEQ ID NO: 3629503 - RNA, 14 nt, Human
caccagccccacug

SEQ ID NO: 3629504 - RNA, 21 nt, Human
caccagccccacugccagcag

SEQ ID NO: 3629505 - RNA, 23 nt, Human
caccagccccacugccagcagca

SEQ ID NO: 3629506 - RNA, 16 nt, Human
caccagccccagugcc

SEQ ID NO: 3629507 - RNA, 21 nt, Human
caccagccccagugcccacag

SEQ ID NO: 3629508 - RNA, 22 nt, Human
caccagccccagugcccacagg

SEQ ID NO: 3629509 - RNA, 19 nt, Human
caccagccccugccccagc

SEQ ID NO: 3629510 - RNA, 18 nt, Human
caccagcccggccugcuc

SEQ ID NO: 3629511 - RNA, 13 nt, Human
caccagccugcac

SEQ ID NO: 3629512 - RNA, 22 nt, Human
caccagccuuucucccaggcca

SEQ ID NO: 3629513 - RNA, 19 nt, Human
caccagcguuugaggggcu

SEQ ID NO: 3629514 - RNA, 15 nt, Human
caccagcuccucccu

SEQ ID NO: 3629515 - RNA, 12 nt, Human
caccagcugcaa

SEQ ID NO: 3629516 - RNA, 13 nt, Human
caccagcugcaaa

SEQ ID NO: 3629517 - RNA, 15 nt, Human
caccagcugccucuu

SEQ ID NO: 3629518 - RNA, 16 nt, Human
caccagcugccucuuc

SEQ ID NO: 3629519 - RNA, 15 nt, Human
caccagcugugucca

SEQ ID NO: 3629520 - RNA, 16 nt, Human
caccagcuucuccagg

SEQ ID NO: 3629521 - RNA, 17 nt, Human
caccaggaaccucuuca

SEQ ID NO: 3629522 - RNA, 21 nt, Human
caccaggaauguuaaagucag

SEQ ID NO: 3629523 - RNA, 23 nt, Human
caccaggaauguuaaagucagug

SEQ ID NO: 3629524 - RNA, 16 nt, Human
caccaggacuagggcu

SEQ ID NO: 3629525 - RNA, 13 nt, Human
caccaggauggcc

SEQ ID NO: 3629526 - RNA, 21 nt, Human
caccaggauggcccuucccac

SEQ ID NO: 3629527 - RNA, 20 nt, Human
caccaggcaccucacagaaa

SEQ ID NO: 3629528 - RNA, 23 nt, Human
caccaggcaccucacagaaauga

SEQ ID NO: 3629529 - RNA, 21 nt, Human
caccaggcacgaacccaccug

SEQ ID NO: 3629530 - RNA, 22 nt, Human
caccaggcacgaacccaccugc

SEQ ID NO: 3629531 - RNA, 17 nt, Human
caccaggccccccuguc

SEQ ID NO: 3629532 - RNA, 21 nt, Human
caccaggccguccucccgggc

SEQ ID NO: 3629533 - RNA, 17 nt, Human
caccaggcgcuaauuca

SEQ ID NO: 3629534 - RNA, 23 nt, Human
caccaggcgcuaauucaaggaau

SEQ ID NO: 3629535 - RNA, 15 nt, Human
caccaggcgcugccc

SEQ ID NO: 3629536 - RNA, 13 nt, Human
caccaggcuggcg

SEQ ID NO: 3629537 - RNA, 16 nt, Human
caccaggcuggcgcag

SEQ ID NO: 3629538 - RNA, 18 nt, Human
caccaggcuggcgcagcc

SEQ ID NO: 3629539 - RNA, 19 nt, Human
caccaggcuggcgcagcca

SEQ ID NO: 3629540 - RNA, 15 nt, Human
caccaggcugugggc

SEQ ID NO: 3629541 - RNA, 15 nt, Human
caccagggaagaaga

SEQ ID NO: 3629542 - RNA, 13 nt, Human
caccagggaaggg

SEQ ID NO: 3629543 - RNA, 18 nt, Human
caccagggaaggggacaa

SEQ ID NO: 3629544 - RNA, 21 nt, Human
caccagggcaucucugggcug

SEQ ID NO: 3629545 - RNA, 13 nt, Human
caccaggggcagg

SEQ ID NO: 3629546 - RNA, 15 nt, Human
caccagggguuucuc

SEQ ID NO: 3629547 - RNA, 14 nt, Human
caccaggucucccg

SEQ ID NO: 3629548 - RNA, 22 nt, Human
caccaggugccuuucaaauuua

SEQ ID NO: 3629549 - RNA, 13 nt, Human
caccaguacauuc

SEQ ID NO: 3629550 - RNA, 21 nt, Human
caccaguacauucucaguuuu

SEQ ID NO: 3629551 - RNA, 16 nt, Human
caccagucacaugacc

SEQ ID NO: 3629552 - RNA, 15 nt, Human
caccagugaccugga

SEQ ID NO: 3629553 - RNA, 11 nt, Human
caccagugccu

SEQ ID NO: 3629554 - RNA, 15 nt, Human
caccaguguccuccc

SEQ ID NO: 3629555 - RNA, 19 nt, Human
caccaguguccuccccuca

SEQ ID NO: 3629556 - RNA, 11 nt, Human
caccaguucuc

SEQ ID NO: 3629557 - RNA, 20 nt, Human
caccaguucucauggguggc

SEQ ID NO: 3629558 - RNA, 15 nt, Human
caccaguugcugcuu

SEQ ID NO: 3629559 - RNA, 18 nt, Human
caccauaagcuacugcca

SEQ ID NO: 3629560 - RNA, 19 nt, Human
caccauaagcuacugccau

SEQ ID NO: 3629561 - RNA, 18 nt, Human
caccauaugaauuguaca

SEQ ID NO: 3629562 - RNA, 20 nt, Human
caccauaugaauuguacaga

SEQ ID NO: 3629563 - RNA, 16 nt, Human
caccauauucagugcu

SEQ ID NO: 3629564 - RNA, 13 nt, Human
caccaucaagcca

SEQ ID NO: 3629565 - RNA, 19 nt, Human
caccaucaagccaccaaca

SEQ ID NO: 3629566 - RNA, 15 nt, Human
caccaucaauccuga

SEQ ID NO: 3629567 - RNA, 19 nt, Human
caccaucccuuuuugaagu

SEQ ID NO: 3629568 - RNA, 20 nt, Human
caccaucccuuuuugaagug

SEQ ID NO: 3629569 - RNA, 13 nt, Human
caccauccugcug

SEQ ID NO: 3629570 - RNA, 14 nt, Human
caccaucgcuggcc

SEQ ID NO: 3629571 - RNA, 21 nt, Human
caccaucucaggccaccugcc

SEQ ID NO: 3629572 - RNA, 22 nt, Human
caccaucucaggccaccugccc

SEQ ID NO: 3629573 - RNA, 15 nt, Human
caccaucugcugucu

SEQ ID NO: 3629574 - RNA, 14 nt, Human
caccaucuuugcag

SEQ ID NO: 3629575 - RNA, 15 nt, Human
caccaugauggccag

SEQ ID NO: 3629576 - RNA, 18 nt, Human
cacuuuuauuuagcacca

SEQ ID NO: 3629577 - RNA, 15 nt, Human
cacuuuucauaucau

SEQ ID NO: 3629578 - RNA, 12 nt, Human
cacuuuucccac

SEQ ID NO: 3629579 - RNA, 15 nt, Human
cacuuuucccacucc

SEQ ID NO: 3629580 - RNA, 19 nt, Human
cacuuuucccacuccaagc

SEQ ID NO: 3629581 - RNA, 18 nt, Human
cacuuuugacaaaggcaa

SEQ ID NO: 3629582 - RNA, 14 nt, Human
cacuuuuguucuug

SEQ ID NO: 3629583 - RNA, 19 nt, Human
cacuuuuucauuugccuau

SEQ ID NO: 3629584 - RNA, 14 nt, Human
cacuuuuugaggca

SEQ ID NO: 3629585 - RNA, 20 nt, Human
cacuuuuugaggcaaaagaa

SEQ ID NO: 3629586 - RNA, 12 nt, Human
cacuuuuuucca

SEQ ID NO: 3629587 - RNA, 21 nt, Human
cacuuuuuugaguggaugaug

SEQ ID NO: 3629588 - RNA, 23 nt, Human
cacuuuuuuuuuccaaaaaaaua

SEQ ID NO: 3629589 - RNA, 21 nt, Human
cagaaaaagaaaugaacauaa

SEQ ID NO: 3629590 - RNA, 18 nt, Human
cagaaaaauggagcaaag

SEQ ID NO: 3629591 - RNA, 14 nt, Human
cagaaaacaaaacu

SEQ ID NO: 3629592 - RNA, 18 nt, Human
cagaaaacaacaaaaaau

SEQ ID NO: 3629593 - RNA, 14 nt, Human
cagaaaacauuguu

SEQ ID NO: 3629594 - RNA, 18 nt, Human
cagaaaacauuguuccag

SEQ ID NO: 3629595 - RNA, 17 nt, Human
cagaaaacccuugggcc

SEQ ID NO: 3629596 - RNA, 22 nt, Human
cagaaaacccuugggccagaag

SEQ ID NO: 3629597 - RNA, 20 nt, Human
cagaaaacgguuaaaacugu

SEQ ID NO: 3629598 - RNA, 13 nt, Human
cagaaaacuagaa

SEQ ID NO: 3629599 - RNA, 20 nt, Human
cagaaaacuuuaaaaaauau

SEQ ID NO: 3629600 - RNA, 21 nt, Human
cagaaaagaaaguucaugcuu

SEQ ID NO: 3629601 - RNA, 12 nt, Human
cagaaaagcaua

SEQ ID NO: 3629602 - RNA, 13 nt, Human
cagaaaaggacag

SEQ ID NO: 3629603 - RNA, 17 nt, Human
cagaaaauauacuguaa

SEQ ID NO: 3629604 - RNA, 21 nt, Human
cagaaaauauacuguaaagaa

SEQ ID NO: 3629605 - RNA, 16 nt, Human
cagaaaauauguauua

SEQ ID NO: 3629606 - RNA, 21 nt, Human
cagaaaauauguauuaacacu

SEQ ID NO: 3629607 - RNA, 19 nt, Human
cagaaaauauuauguguuu

SEQ ID NO: 3629608 - RNA, 21 nt, Human
cagaaaauggaagacagcucu

SEQ ID NO: 3629609 - RNA, 23 nt, Human
cagaaaauggaagacagcucuua

SEQ ID NO: 3629610 - RNA, 18 nt, Human
cagaaacaaaaacacuaa

SEQ ID NO: 3629611 - RNA, 19 nt, Human
cagaaacacccacaggcau

SEQ ID NO: 3629612 - RNA, 17 nt, Human
cagaaacacugccuuuu

SEQ ID NO: 3629613 - RNA, 23 nt, Human
cagaaacagauuuggugaauuug

SEQ ID NO: 3629614 - RNA, 13 nt, Human
cagaaacaggacc

SEQ ID NO: 3629615 - RNA, 22 nt, Human
cagaaacaggugcaucugggga

SEQ ID NO: 3629616 - RNA, 13 nt, Human
cagaaaccaguua

SEQ ID NO: 3629617 - RNA, 15 nt, Human
cagaaaccaguuaug

SEQ ID NO: 3629618 - RNA, 22 nt, Human
cagaaacccucauuguguuucu

SEQ ID NO: 3629619 - RNA, 20 nt, Human
cagaaacuugugaaguggaa

SEQ ID NO: 3629620 - RNA, 16 nt, Human
cagaaagcagaggcug

SEQ ID NO: 3629621 - RNA, 20 nt, Human
cagaaagcagaggcuggccu

SEQ ID NO: 3629622 - RNA, 22 nt, Human
cagaaagcagaggcuggccuca

SEQ ID NO: 3629623 - RNA, 18 nt, Human
cagaaagcauaaaauucu

SEQ ID NO: 3629624 - RNA, 13 nt, Human
cagaaagccaaca

SEQ ID NO: 3629625 - RNA, 19 nt, Human
cagaaagccccaagcaauu

SEQ ID NO: 3629626 - RNA, 19 nt, Human
cagaaagccugggugacau

SEQ ID NO: 3629627 - RNA, 15 nt, Human
cagaaagcugccugg

SEQ ID NO: 3629628 - RNA, 17 nt, Human
cagaaaggaaaaacaaa

SEQ ID NO: 3629629 - RNA, 15 nt, Human
cagaaaggaaaaccu

SEQ ID NO: 3629630 - RNA, 20 nt, Human
cagaaaggaaaaccugaaga

SEQ ID NO: 3629631 - RNA, 18 nt, Human
cagaaaguaauuucuucu

SEQ ID NO: 3629632 - RNA, 16 nt, Human
cagaaagugccugaca

SEQ ID NO: 3629633 - RNA, 23 nt, Human
cagaaagugccugacacacuaac

SEQ ID NO: 3629634 - RNA, 15 nt, Human
cagaaagugccuuuc

SEQ ID NO: 3629635 - RNA, 18 nt, Human
cagaaagugccuuucagg

SEQ ID NO: 3629636 - RNA, 22 nt, Human
cagaaagugccuuucaggaucu

SEQ ID NO: 3629637 - RNA, 23 nt, Human
cagaaaguggugcucaguuguag

SEQ ID NO: 3629638 - RNA, 17 nt, Human
cagaaagugugcuuuau

SEQ ID NO: 3629639 - RNA, 15 nt, Human
cagaaauaauaaaaa

SEQ ID NO: 3629640 - RNA, 20 nt, Human
cagaaauacagauuuugaua

SEQ ID NO: 3629641 - RNA, 14 nt, Human
cagaaauacuacug

SEQ ID NO: 3629642 - RNA, 22 nt, Human
cagaaauacuauaacauaugua

SEQ ID NO: 3629643 - RNA, 16 nt, Human
cagaaauagacaaaaa

SEQ ID NO: 3629644 - RNA, 20 nt, Human
cagaaauagacaaaaaguau

SEQ ID NO: 3629645 - RNA, 21 nt, Human
cagaaauauaauaaaaugugu

SEQ ID NO: 3629646 - RNA, 17 nt, Human
cagaaauauauauacau

SEQ ID NO: 3629647 - RNA, 19 nt, Human
cagaaauauauauacauau

SEQ ID NO: 3629648 - RNA, 22 nt, Human
cagaaauauuugugacaaaaaa

SEQ ID NO: 3629649 - RNA, 23 nt, Human
cagaaaugacuuuuugaaaguaa

SEQ ID NO: 3629650 - RNA, 21 nt, Human
cagaaaugaggagacacaccu

SEQ ID NO: 3629651 - RNA, 14 nt, Human
cagaaaugcugccu

SEQ ID NO: 3629652 - RNA, 16 nt, Human
cagaaaugcugccugc

SEQ ID NO: 3629653 - RNA, 17 nt, Human
cagaaaugcugccugcc

SEQ ID NO: 3629654 - RNA, 19 nt, Human
cagaaaugcugccugccug

SEQ ID NO: 3629655 - RNA, 23 nt, Human
cagaaaugcugccugccugucug

SEQ ID NO: 3629656 - RNA, 16 nt, Human
cagaaaugcugcuggc

SEQ ID NO: 3629657 - RNA, 18 nt, Human
cagaaaugcugcuggcca

SEQ ID NO: 3629658 - RNA, 23 nt, Human
cagaaauguacaacuuuuuaccu

SEQ ID NO: 3629659 - RNA, 11 nt, Human
cagaaaugucu

SEQ ID NO: 3629660 - RNA, 14 nt, Human
cagaaaugucuaaa

SEQ ID NO: 3629661 - RNA, 23 nt, Human
cagaaauuagaaaccuuaauaug

SEQ ID NO: 3629662 - RNA, 14 nt, Human
cagaaauucuguuu

SEQ ID NO: 3629663 - RNA, 18 nt, Human
cagaaauucuguuuuuaa

SEQ ID NO: 3629664 - RNA, 11 nt, Human
cagaaauugga

SEQ ID NO: 3629665 - RNA, 21 nt, Human
cagaaauugguaccuugcaca

SEQ ID NO: 3629666 - RNA, 12 nt, Human
cagaaauuguau

SEQ ID NO: 3629667 - RNA, 14 nt, Human
cagaaauuguauau

SEQ ID NO: 3629668 - RNA, 16 nt, Human
cagaaauuguauauug

SEQ ID NO: 3629669 - RNA, 14 nt, Human
cagaaauuuuuauu

SEQ ID NO: 3629670 - RNA, 19 nt, Human
cagaaauuuuuauuuuucu

SEQ ID NO: 3629671 - RNA, 15 nt, Human
cagaacaacaacuau

SEQ ID NO: 3629672 - RNA, 15 nt, Human
cagaacacuaaccug

SEQ ID NO: 3629673 - RNA, 12 nt, Human
cagaacagcugu

SEQ ID NO: 3629674 - RNA, 13 nt, Human
cagaacagcuguu

SEQ ID NO: 3629675 - RNA, 12 nt, Human
cagaacagcuuc

SEQ ID NO: 3629676 - RNA, 13 nt, Human
cagaacagcuuca

SEQ ID NO: 3629677 - RNA, 19 nt, Human
cagaacagcuucagguuau

SEQ ID NO: 3629678 - RNA, 14 nt, Human
cagaacagcuucau

SEQ ID NO: 3629679 - RNA, 24 nt, Human
cagaacagguguuggugacaauug

SEQ ID NO: 3629680 - RNA, 15 nt, Human
cagaacaguaucuuu

SEQ ID NO: 3629681 - RNA, 18 nt, Human
cagaacaguaugaauuug

SEQ ID NO: 3629682 - RNA, 17 nt, Human
cagaacagugauuacca

SEQ ID NO: 3629683 - RNA, 23 nt, Human
cagaacagugauuaccagggacu

SEQ ID NO: 3629684 - RNA, 15 nt, Human
cagaacaucauuaga

SEQ ID NO: 3629685 - RNA, 17 nt, Human
cagaacaucauuagaac

SEQ ID NO: 3629686 - RNA, 20 nt, Human
cagaaccaccccggcccccu

SEQ ID NO: 3629687 - RNA, 18 nt, Human
cagaaccagaugaguaaa

SEQ ID NO: 3629688 - RNA, 16 nt, Human
cagaaccagucuuuca

SEQ ID NO: 3629689 - RNA, 15 nt, Human
cagaaccauccauag

SEQ ID NO: 3629690 - RNA, 15 nt, Human
cagaacccagggcuc

SEQ ID NO: 3629691 - RNA, 18 nt, Human
cagaacccagggcucugc

SEQ ID NO: 3629692 - RNA, 21 nt, Human
cagaacccagggcucugcccc

SEQ ID NO: 3629693 - RNA, 22 nt, Human
cagaacccagggcucugcccca

SEQ ID NO: 3629694 - RNA, 15 nt, Human
cagaacccugccaug

SEQ ID NO: 3629695 - RNA, 19 nt, Human
cagaaccggagagccagcu

SEQ ID NO: 3629696 - RNA, 12 nt, Human
cagaaccuggag

SEQ ID NO: 3629697 - RNA, 16 nt, Human
cagaaccuuguuauuu

SEQ ID NO: 3629698 - RNA, 21 nt, Human
cagaacggagccccaggccuc

SEQ ID NO: 3629699 - RNA, 15 nt, Human
cagaacguggcucug

SEQ ID NO: 3629700 - RNA, 19 nt, Human
cagaacguggcucugcugg

SEQ ID NO: 3629701 - RNA, 18 nt, Human
cagaacuaaacucauuua

SEQ ID NO: 3629702 - RNA, 20 nt, Human
cagaacuaaacucauuuaua

SEQ ID NO: 3629703 - RNA, 18 nt, Human
cagaacuaaauguucuau

SEQ ID NO: 3629704 - RNA, 20 nt, Human
cagaacucaaauggggccag

SEQ ID NO: 3629705 - RNA, 15 nt, Human
cagaacucacugggg

SEQ ID NO: 3629706 - RNA, 18 nt, Human
cagaacucggugucccca

SEQ ID NO: 3629707 - RNA, 19 nt, Human
cagaacucgguguccccac

SEQ ID NO: 3629708 - RNA, 14 nt, Human
cagaacucuguguc

SEQ ID NO: 3629709 - RNA, 20 nt, Human
cagaacucuuaaaaauguuu

SEQ ID NO: 3629710 - RNA, 14 nt, Human
cagaacucuuccuc

SEQ ID NO: 3629711 - RNA, 16 nt, Human
cagaacucuuucaaaa

SEQ ID NO: 3629712 - RNA, 21 nt, Human
cagaacugaaccggcuuuacc

SEQ ID NO: 3629713 - RNA, 19 nt, Human
cagaacugccauuauuuuc

SEQ ID NO: 3629714 - RNA, 18 nt, Human
cagaacuuagcaauuucc

SEQ ID NO: 3629715 - RNA, 13 nt, Human
cagaacuucagaa

SEQ ID NO: 3629716 - RNA, 19 nt, Human
cagaacuucagaaagacuu

SEQ ID NO: 3629717 - RNA, 18 nt, Human
cagaacuugaagccugcu

SEQ ID NO: 3629718 - RNA, 19 nt, Human
cagaacuugaagccugcuc

SEQ ID NO: 3629719 - RNA, 22 nt, Human
cagaacuugaagccugcuccuu

SEQ ID NO: 3629720 - RNA, 15 nt, Human
cagagcaggaggccc

SEQ ID NO: 3629721 - RNA, 23 nt, Human
cagagcaggaggccccuggccca

SEQ ID NO: 3629722 - RNA, 23 nt, Human
cagagcagggguccuugguguga

SEQ ID NO: 3629723 - RNA, 17 nt, Human
cagagcagugggccugg

SEQ ID NO: 3629724 - RNA, 22 nt, Human
cagagcagugggccuggccagc

SEQ ID NO: 3629725 - RNA, 22 nt, Human
cagagcauuacgugagccaggu

SEQ ID NO: 3629726 - RNA, 23 nt, Human
cagagcauuacgugagccaggua

SEQ ID NO: 3629727 - RNA, 19 nt, Human
cagagcauuccagucaggc

SEQ ID NO: 3629728 - RNA, 18 nt, Human
cagagccaaauugguaga

SEQ ID NO: 3629729 - RNA, 20 nt, Human
cagagccaaggggcuucagg

SEQ ID NO: 3629730 - RNA, 14 nt, Human
cagagccacacaug

SEQ ID NO: 3629731 - RNA, 13 nt, Human
cagagccacaguu

SEQ ID NO: 3629732 - RNA, 22 nt, Human
cagagccaccccuaaagagaua

SEQ ID NO: 3629733 - RNA, 12 nt, Human
cagagccaggag

SEQ ID NO: 3629734 - RNA, 16 nt, Human
cagagccaggagaagc

SEQ ID NO: 3629735 - RNA, 20 nt, Human
cagagccaggagaagcucag

SEQ ID NO: 3629736 - RNA, 20 nt, Human
cagagcccaccuuggcucaa

SEQ ID NO: 3629737 - RNA, 23 nt, Human
cagagcccacgcccccacuggug

SEQ ID NO: 3629738 - RNA, 18 nt, Human
cagagcccacuccaucug

SEQ ID NO: 3629739 - RNA, 14 nt, Human
cagagcccagaccc

SEQ ID NO: 3629740 - RNA, 14 nt, Human
cagagcccagcucc

SEQ ID NO: 3629741 - RNA, 13 nt, Human
cagagcccaggcu

SEQ ID NO: 3629742 - RNA, 16 nt, Human
cagagccccacacgga

SEQ ID NO: 3629743 - RNA, 13 nt, Human
cagagccccacag

SEQ ID NO: 3629744 - RNA, 20 nt, Human
cagagccccacccucagaug

SEQ ID NO: 3629745 - RNA, 18 nt, Human
cagagcccccaggaagcc

SEQ ID NO: 3629746 - RNA, 16 nt, Human
cagagccccuacagca

SEQ ID NO: 3629747 - RNA, 18 nt, Human
cagagccccuccuccagc

SEQ ID NO: 3629748 - RNA, 21 nt, Human
cagagccccuccuccagcccc

SEQ ID NO: 3629749 - RNA, 14 nt, Human
cagagcccugcucc

SEQ ID NO: 3629750 - RNA, 20 nt, Human
cagagccggcccgccucucc

SEQ ID NO: 3629751 - RNA, 21 nt, Human
cagagccguaaaaacugaagu

SEQ ID NO: 3629752 - RNA, 19 nt, Human
cagagccgugguccuuugg

SEQ ID NO: 3629753 - RNA, 23 nt, Human
cagagccucccaaggagaacaaa

SEQ ID NO: 3629754 - RNA, 20 nt, Human
cagagccuccuuucuggcuu

SEQ ID NO: 3629755 - RNA, 13 nt, Human
cagagccugcagu

SEQ ID NO: 3629756 - RNA, 11 nt, Human
cagagccuggg

SEQ ID NO: 3629757 - RNA, 15 nt, Human
cagagccuucucaga

SEQ ID NO: 3629758 - RNA, 16 nt, Human
cagagccuucucagaa

SEQ ID NO: 3629759 - RNA, 18 nt, Human
cagagccuucucagaagc

SEQ ID NO: 3629760 - RNA, 23 nt, Human
cagagccuucugaggacauucca

SEQ ID NO: 3629761 - RNA, 16 nt, Human
cagagccuuuggauga

SEQ ID NO: 3629762 - RNA, 18 nt, Human
cagagccuuuggaugacc

SEQ ID NO: 3629763 - RNA, 20 nt, Human
cagagcgagagucugucuca

SEQ ID NO: 3629764 - RNA, 21 nt, Human
cagagcgccgugaguucucag

SEQ ID NO: 3629765 - RNA, 17 nt, Human
cagagcgcgccccuagc

SEQ ID NO: 3629766 - RNA, 21 nt, Human
cagagcuaaacuccuuccugg

SEQ ID NO: 3629767 - RNA, 22 nt, Human
cagagcuaaacuccuuccuggc

SEQ ID NO: 3629768 - RNA, 20 nt, Human
cagagcuacccgcagaguuc

SEQ ID NO: 3629769 - RNA, 17 nt, Human
cagagcuacuugggcca

SEQ ID NO: 3629770 - RNA, 17 nt, Human
cagagcucuccagcucc

SEQ ID NO: 3629771 - RNA, 18 nt, Human
cagagcucucucuacaga

SEQ ID NO: 3629772 - RNA, 15 nt, Human
cagagcucuggagcc

SEQ ID NO: 3629773 - RNA, 15 nt, Human
cagagcugacacagg

SEQ ID NO: 3629774 - RNA, 21 nt, Human
cagagcugauggagaaggaag

SEQ ID NO: 3629775 - RNA, 12 nt, Human
cagagcugccag

SEQ ID NO: 3629776 - RNA, 20 nt, Human
cagagcugcccucuccuggg

SEQ ID NO: 3629777 - RNA, 10 nt, Human
cagagcuggg

SEQ ID NO: 3629778 - RNA, 13 nt, Human
cagagcugggagg

SEQ ID NO: 3629779 - RNA, 14 nt, Human
cagagcugggaggc

SEQ ID NO: 3629780 - RNA, 20 nt, Human
cagagcugggauguuucugu

SEQ ID NO: 3629781 - RNA, 13 nt, Human
cagagcuggggcu

SEQ ID NO: 3629782 - RNA, 11 nt, Human
cagagcuggug

SEQ ID NO: 3629783 - RNA, 13 nt, Human
cagagcuggugcg

SEQ ID NO: 3629784 - RNA, 15 nt, Human
cagagcuguggagga

SEQ ID NO: 3629785 - RNA, 23 nt, Human
cagagcuucccugacucauucug

SEQ ID NO: 3629786 - RNA, 20 nt, Human
cagagcuuuggucugugugu

SEQ ID NO: 3629787 - RNA, 13 nt, Human
cagagcuuuucag

SEQ ID NO: 3629788 - RNA, 15 nt, Human
cagagcuuuucagau

SEQ ID NO: 3629789 - RNA, 17 nt, Human
cagaggaacuguccaga

SEQ ID NO: 3629790 - RNA, 14 nt, Human
cagaggaagagcag

SEQ ID NO: 3629791 - RNA, 15 nt, Human
cagaggaagagcagg

SEQ ID NO: 3629792 - RNA, 16 nt, Human
cagaggaagagcaggc

SEQ ID NO: 3629793 - RNA, 16 nt, Human
cagaggaaggggccag

SEQ ID NO: 3629794 - RNA, 19 nt, Human
cagaggaauccuggcagcc

SEQ ID NO: 3629795 - RNA, 22 nt, Human
cagaggaauccuggcagcccag

SEQ ID NO: 3629796 - RNA, 18 nt, Human
cagaggaauuuauaccuc

SEQ ID NO: 3629797 - RNA, 20 nt, Human
cagaggaccagcacacuccc

SEQ ID NO: 3629798 - RNA, 14 nt, Human
cagaggaccuguau

SEQ ID NO: 3629799 - RNA, 17 nt, Human
cagaggaccuguauuua

SEQ ID NO: 3629800 - RNA, 22 nt, Human
cagaggacucccaacccuggcu

SEQ ID NO: 3629801 - RNA, 20 nt, Human
cagaggagaacuugcugccu

SEQ ID NO: 3629802 - RNA, 15 nt, Human
cagaggagagaggac

SEQ ID NO: 3629803 - RNA, 19 nt, Human
cagaggagagaggaccccc

SEQ ID NO: 3629804 - RNA, 22 nt, Human
cagaggagagucccagagcagg

SEQ ID NO: 3629805 - RNA, 19 nt, Human
cagaggagccaccaguucu

SEQ ID NO: 3629806 - RNA, 14 nt, Human
cagaggagccuuuu

SEQ ID NO: 3629807 - RNA, 22 nt, Human
cagaggagccuuuuuaaaacac

SEQ ID NO: 3629808 - RNA, 20 nt, Human
cagaggagcugggagccggg

SEQ ID NO: 3629809 - RNA, 21 nt, Human
cagaggagcugggagccgggc

SEQ ID NO: 3629810 - RNA, 18 nt, Human
cagaggaggcgaggaggc

SEQ ID NO: 3629811 - RNA, 14 nt, Human
cagaggaggggccg

SEQ ID NO: 3629812 - RNA, 19 nt, Human
cagaggaugagcucuaccc

SEQ ID NO: 3629813 - RNA, 17 nt, Human
cagaggauggccagugu

SEQ ID NO: 3629814 - RNA, 22 nt, Human
cagaggauggccagugucuguc

SEQ ID NO: 3629815 - RNA, 13 nt, Human
cagaggcagaacc

SEQ ID NO: 3629816 - RNA, 15 nt, Human
cagaggcagccccau

SEQ ID NO: 3629817 - RNA, 22 nt, Human
cagaggcagccccauucugccu

SEQ ID NO: 3629818 - RNA, 14 nt, Human
cagaggccaaggag

SEQ ID NO: 3629819 - RNA, 20 nt, Human
cagaggccaugggccuccug

SEQ ID NO: 3629820 - RNA, 20 nt, Human
cagaggcccacauuggaaga

SEQ ID NO: 3629821 - RNA, 14 nt, Human
cagaggcccaggcu

SEQ ID NO: 3629822 - RNA, 15 nt, Human
cagaggcccaggcug

SEQ ID NO: 3629823 - RNA, 13 nt, Human
cagaggccccagc

SEQ ID NO: 3629824 - RNA, 23 nt, Human
cagaggcccccagcccagggcuc

SEQ ID NO: 3629825 - RNA, 21 nt, Human
cagaggcccucaagucuuucu

SEQ ID NO: 3629826 - RNA, 19 nt, Human
cagaggcccucgcugccag

SEQ ID NO: 3629827 - RNA, 20 nt, Human
cagaggccuagucagccaca

SEQ ID NO: 3629828 - RNA, 23 nt, Human
cagaggccuagucagccacaugg

SEQ ID NO: 3629829 - RNA, 13 nt, Human
cagaggccuccug

SEQ ID NO: 3629830 - RNA, 13 nt, Human
cagaggccugccc

SEQ ID NO: 3629831 - RNA, 14 nt, Human
cagaggccugggcu

SEQ ID NO: 3629832 - RNA, 19 nt, Human
cagaggccugggcugggaa

SEQ ID NO: 3629833 - RNA, 17 nt, Human
cagaggcgcacugugac

SEQ ID NO: 3629834 - RNA, 18 nt, Human
cagaggcgcacugugacc

SEQ ID NO: 3629835 - RNA, 17 nt, Human
cagaggcuaauucugca

SEQ ID NO: 3629836 - RNA, 21 nt, Human
cagaggcuggaggcagggccu

SEQ ID NO: 3629837 - RNA, 15 nt, Human
cagaggcuggccuca

SEQ ID NO: 3629838 - RNA, 16 nt, Human
cagaggcuucuucaga

SEQ ID NO: 3629839 - RNA, 18 nt, Human
cagagggagugacagagg

SEQ ID NO: 3629840 - RNA, 19 nt, Human
cagagggagugacagaggc

SEQ ID NO: 3629841 - RNA, 20 nt, Human
cagagggagugacagaggca

SEQ ID NO: 3629842 - RNA, 22 nt, Human
cagagggagugacagaggcagc

SEQ ID NO: 3629843 - RNA, 23 nt, Human
cagagggccauugaacucugaga

SEQ ID NO: 3629844 - RNA, 13 nt, Human
cagagggcccagg

SEQ ID NO: 3629845 - RNA, 16 nt, Human
cagagggcccaggcag

SEQ ID NO: 3629846 - RNA, 18 nt, Human
cagagggcccaggcaggc

SEQ ID NO: 3629847 - RNA, 22 nt, Human
cagagggcccaggcaggccacc

SEQ ID NO: 3629848 - RNA, 15 nt, Human
cagagggccugcaag

SEQ ID NO: 3629849 - RNA, 18 nt, Human
cagagggcuggaggccca

SEQ ID NO: 3629850 - RNA, 23 nt, Human
cagaggggaaaccaguguagccu

SEQ ID NO: 3629851 - RNA, 14 nt, Human
cagaggggacucug

SEQ ID NO: 3629852 - RNA, 16 nt, Human
cagaggggacucuggg

SEQ ID NO: 3629853 - RNA, 14 nt, Human
cagaggggccugcc

SEQ ID NO: 3629854 - RNA, 18 nt, Human
cagaggggcuuucuggag

SEQ ID NO: 3629855 - RNA, 21 nt, Human
cagagggggacugcugcugcc

SEQ ID NO: 3629856 - RNA, 13 nt, Human
cagaggggguggc

SEQ ID NO: 3629857 - RNA, 16 nt, Human
cagaggggguggccuc

SEQ ID NO: 3629858 - RNA, 18 nt, Human
cagaggggguggccuccc

SEQ ID NO: 3629859 - RNA, 22 nt, Human
cagaggggguggccucccaacu

SEQ ID NO: 3629860 - RNA, 20 nt, Human
cagagggucacaguguuuac

SEQ ID NO: 3629861 - RNA, 17 nt, Human
cagagguaacagaacag

SEQ ID NO: 3629862 - RNA, 18 nt, Human
cagagguaacagaacagc

SEQ ID NO: 3629863 - RNA, 20 nt, Human
cagagguaacagaacagcuu

SEQ ID NO: 3629864 - RNA, 18 nt, Human
cagcuuugccuuccacgc

SEQ ID NO: 3629865 - RNA, 11 nt, Human
cagcuuugcua

SEQ ID NO: 3629866 - RNA, 12 nt, Human
cagcuuugcugc

SEQ ID NO: 3629867 - RNA, 18 nt, Human
cagcuuugugacuguaua

SEQ ID NO: 3629868 - RNA, 18 nt, Human
cagcuuuuaaaagauuuu

SEQ ID NO: 3629869 - RNA, 21 nt, Human
cagcuuuuaaccaucugauau

SEQ ID NO: 3629870 - RNA, 20 nt, Human
cagcuuuucauugcugugac

SEQ ID NO: 3629871 - RNA, 20 nt, Human
cagcuuuucccaaaagccca

SEQ ID NO: 3629872 - RNA, 16 nt, Human
cagcuuuuccucccuu

SEQ ID NO: 3629873 - RNA, 15 nt, Human
cagcuuuugcuucau

SEQ ID NO: 3629874 - RNA, 18 nt, Human
caggaaaaaaacuuuuau

SEQ ID NO: 3629875 - RNA, 16 nt, Human
caggaaaaaggacagg

SEQ ID NO: 3629876 - RNA, 19 nt, Human
caggaaaacacccagggaa

SEQ ID NO: 3629877 - RNA, 23 nt, Human
caggaaaacgggaccggccaggc

SEQ ID NO: 3629878 - RNA, 16 nt, Human
caggaaaaggccuggg

SEQ ID NO: 3629879 - RNA, 21 nt, Human
caggaaaaggccuggggugac

SEQ ID NO: 3629880 - RNA, 22 nt, Human
caggaaaagguagcuuaccuga

SEQ ID NO: 3629881 - RNA, 23 nt, Human
caggaaaauuguuugaacccagg

SEQ ID NO: 3629882 - RNA, 13 nt, Human
caggaaaccgagu

SEQ ID NO: 3629883 - RNA, 19 nt, Human
caggaaacuccacaucugc

SEQ ID NO: 3629884 - RNA, 19 nt, Human
caggaaagcucagcuacug

SEQ ID NO: 3629885 - RNA, 18 nt, Human
caggaaaggcccagccac

SEQ ID NO: 3629886 - RNA, 17 nt, Human
caggaaaggcuccagga

SEQ ID NO: 3629887 - RNA, 20 nt, Human
caggaaaggcuccaggagca

SEQ ID NO: 3629888 - RNA, 22 nt, Human
caggaaaggcuccaggagcagc

SEQ ID NO: 3629889 - RNA, 23 nt, Human
caggaaaguggcaccugucugcu

SEQ ID NO: 3629890 - RNA, 13 nt, Human
caggaaauaaagu

SEQ ID NO: 3629891 - RNA, 17 nt, Human
caggaaauauauaugug

SEQ ID NO: 3629892 - RNA, 23 nt, Human
caggaaauauauaugugugugua

SEQ ID NO: 3629893 - RNA, 23 nt, Human
caggaaaucaaauaugcaaagca

SEQ ID NO: 3629894 - RNA, 16 nt, Human
caggaaaugcugaccc

SEQ ID NO: 3629895 - RNA, 14 nt, Human
caggaacaaacagg

SEQ ID NO: 3629896 - RNA, 15 nt, Human
caggaacaaacaggg

SEQ ID NO: 3629897 - RNA, 22 nt, Human
caggaacaaacagggcugccuu

SEQ ID NO: 3629898 - RNA, 22 nt, Human
caggaacaacauuuacaacuca

SEQ ID NO: 3629899 - RNA, 14 nt, Human
caggaacagcuaug

SEQ ID NO: 3629900 - RNA, 20 nt, Human
caggaacagcuaugggagcc

SEQ ID NO: 3629901 - RNA, 19 nt, Human
caggaaccacaccacaucu

SEQ ID NO: 3629902 - RNA, 15 nt, Human
caggaaccuggacca

SEQ ID NO: 3629903 - RNA, 19 nt, Human
caggaaccuggaccaaagc

SEQ ID NO: 3629904 - RNA, 21 nt, Human
caggaaccuguccuaaggaac

SEQ ID NO: 3629905 - RNA, 15 nt, Human
caggaacguuuagcu

SEQ ID NO: 3629906 - RNA, 17 nt, Human
caggaacuauaaaaaca

SEQ ID NO: 3629907 - RNA, 22 nt, Human
caggaagaaaggagucugcaca

SEQ ID NO: 3629908 - RNA, 22 nt, Human
caggaagaaaucacagaaucau

SEQ ID NO: 3629909 - RNA, 19 nt, Human
caggaagacccaacacaug

SEQ ID NO: 3629910 - RNA, 14 nt, Human
caggaagagaagga

SEQ ID NO: 3629911 - RNA, 18 nt, Human
caggaagaucccccagaa

SEQ ID NO: 3629912 - RNA, 19 nt, Human
caggaagcauucagagagc

SEQ ID NO: 3629913 - RNA, 22 nt, Human
caggaagccagcaggcucucag

SEQ ID NO: 3629914 - RNA, 18 nt, Human
caggaagcccaauugcug

SEQ ID NO: 3629915 - RNA, 16 nt, Human
caggaagcccaggagc

SEQ ID NO: 3629916 - RNA, 15 nt, Human
caggaagccguccug

SEQ ID NO: 3629917 - RNA, 18 nt, Human
caggaagccguccuggcg

SEQ ID NO: 3629918 - RNA, 21 nt, Human
caggaagccgugcccugcccc

SEQ ID NO: 3629919 - RNA, 14 nt, Human
caggaagcucaggg

SEQ ID NO: 3629920 - RNA, 15 nt, Human
caggaagcucagggc

SEQ ID NO: 3629921 - RNA, 17 nt, Human
caggaagcucagggccu

SEQ ID NO: 3629922 - RNA, 18 nt, Human
caggaagcucagggccug

SEQ ID NO: 3629923 - RNA, 19 nt, Human
caggaagcucagggccugg

SEQ ID NO: 3629924 - RNA, 17 nt, Human
caggaagcugcuccgug

SEQ ID NO: 3629925 - RNA, 18 nt, Human
caggaagcugcuccgugc

SEQ ID NO: 3629926 - RNA, 22 nt, Human
caggaagcugugagagcaguuu

SEQ ID NO: 3629927 - RNA, 12 nt, Human
caggaaggagag

SEQ ID NO: 3629928 - RNA, 14 nt, Human
caggaaggagagcc

SEQ ID NO: 3629929 - RNA, 16 nt, Human
caggaaggagagccug

SEQ ID NO: 3629930 - RNA, 12 nt, Human
caggaaggagcu

SEQ ID NO: 3629931 - RNA, 14 nt, Human
caggaaggccuggg

SEQ ID NO: 3629932 - RNA, 18 nt, Human
caggaaggccugggugga

SEQ ID NO: 3629933 - RNA, 13 nt, Human
caggaaggcuugu

SEQ ID NO: 3629934 - RNA, 23 nt, Human
caggaaggggcuggacuggcugu

SEQ ID NO: 3629935 - RNA, 14 nt, Human
caggaaguacugga

SEQ ID NO: 3629936 - RNA, 16 nt, Human
caggaaguagcacagg

SEQ ID NO: 3629937 - RNA, 21 nt, Human
caggaaguagcacaggcugag

SEQ ID NO: 3629938 - RNA, 21 nt, Human
caggaagucccuugccauccu

SEQ ID NO: 3629939 - RNA, 10 nt, Human
caggaaguga

SEQ ID NO: 3629940 - RNA, 18 nt, Human
caggaaucaaaaauugaa

SEQ ID NO: 3629941 - RNA, 17 nt, Human
caggaaucaagagcugc

SEQ ID NO: 3629942 - RNA, 21 nt, Human
caggaaucaguuuaaaagcac

SEQ ID NO: 3629943 - RNA, 14 nt, Human
caggaaucuuaagg

SEQ ID NO: 3629944 - RNA, 16 nt, Human
caggaauguguggccu

SEQ ID NO: 3629945 - RNA, 19 nt, Human
caggaauguguggccugca

SEQ ID NO: 3629946 - RNA, 21 nt, Human
caggaauguguggccugcaca

SEQ ID NO: 3629947 - RNA, 16 nt, Human
caggaauuucccagga

SEQ ID NO: 3629948 - RNA, 19 nt, Human
caggaauuucccaggaccc

SEQ ID NO: 3629949 - RNA, 20 nt, Human
caggaauuucccaggacccu

SEQ ID NO: 3629950 - RNA, 21 nt, Human
caggaauuucccaggacccug

SEQ ID NO: 3629951 - RNA, 20 nt, Human
caggaauuugaagcugcagu

SEQ ID NO: 3629952 - RNA, 22 nt, Human
caggaauuugggacccugcuuu

SEQ ID NO: 3629953 - RNA, 15 nt, Human
caggacaacgaggaa

SEQ ID NO: 3629954 - RNA, 19 nt, Human
caggacaacgaggaagccc

SEQ ID NO: 3629955 - RNA, 14 nt, Human
caggacacaggccu

SEQ ID NO: 3629956 - RNA, 15 nt, Human
caggacacaggccug

SEQ ID NO: 3629957 - RNA, 17 nt, Human
caggacaccacacccag

SEQ ID NO: 3629958 - RNA, 20 nt, Human
caggacaccacacccagccu

SEQ ID NO: 3629959 - RNA, 15 nt, Human
caggacaccgggcag

SEQ ID NO: 3629960 - RNA, 16 nt, Human
caggacagagaaauug

SEQ ID NO: 3629961 - RNA, 14 nt, Human
caggacaggaaaaa

SEQ ID NO: 3629962 - RNA, 23 nt, Human
caggacaggcugcggccccuccc

SEQ ID NO: 3629963 - RNA, 17 nt, Human
caggacagggguuccuu

SEQ ID NO: 3629964 - RNA, 21 nt, Human
caggacagggguuccuucugg

SEQ ID NO: 3629965 - RNA, 22 nt, Human
caggacagugcuucagccugag

SEQ ID NO: 3629966 - RNA, 18 nt, Human
caggacaugcgguagcca

SEQ ID NO: 3629967 - RNA, 17 nt, Human
caggacaugcugaagcc

SEQ ID NO: 3629968 - RNA, 18 nt, Human
caggaccacaggcucagg

SEQ ID NO: 3629969 - RNA, 13 nt, Human
caggaccagaagc

SEQ ID NO: 3629970 - RNA, 13 nt, Human
caggaccagccca

SEQ ID NO: 3629971 - RNA, 14 nt, Human
caggaccagcccac

SEQ ID NO: 3629972 - RNA, 16 nt, Human
caggaccagcccacgc

SEQ ID NO: 3629973 - RNA, 12 nt, Human
caggaccagcuc

SEQ ID NO: 3629974 - RNA, 16 nt, Human
caggaccagcucagga

SEQ ID NO: 3629975 - RNA, 16 nt, Human
caggaccagcuggggc

SEQ ID NO: 3629976 - RNA, 14 nt, Human
caggaccaggacua

SEQ ID NO: 3629977 - RNA, 23 nt, Human
caggaccaggguuggcaccuucc

SEQ ID NO: 3629978 - RNA, 22 nt, Human
caggaccaugggaccaggucuu

SEQ ID NO: 3629979 - RNA, 15 nt, Human
caggacccagaggaa

SEQ ID NO: 3629980 - RNA, 16 nt, Human
caggacccagaggaag

SEQ ID NO: 3629981 - RNA, 13 nt, Human
caggaccccagcu

SEQ ID NO: 3629982 - RNA, 16 nt, Human
caggaccccagcucug

SEQ ID NO: 3629983 - RNA, 17 nt, Human
caggaccccagcucugc

SEQ ID NO: 3629984 - RNA, 18 nt, Human
caggaccccagcucugcg

SEQ ID NO: 3629985 - RNA, 17 nt, Human
caggacccccuuccccu

SEQ ID NO: 3629986 - RNA, 12 nt, Human
caggaccccuga

SEQ ID NO: 3629987 - RNA, 14 nt, Human
caggaccccugagu

SEQ ID NO: 3629988 - RNA, 15 nt, Human
caggacccucgcugg

SEQ ID NO: 3629989 - RNA, 14 nt, Human
caggacccugaagg

SEQ ID NO: 3629990 - RNA, 16 nt, Human
caggacccugaagggg

SEQ ID NO: 3629991 - RNA, 14 nt, Human
caggacccugccag

SEQ ID NO: 3629992 - RNA, 18 nt, Human
caggacccugccaggcac

SEQ ID NO: 3629993 - RNA, 20 nt, Human
caggacccugccaggcacag

SEQ ID NO: 3629994 - RNA, 21 nt, Human
caggacccugccaggcacagg

SEQ ID NO: 3629995 - RNA, 22 nt, Human
caggacccugccaggcacaggc

SEQ ID NO: 3629996 - RNA, 14 nt, Human
caggacccuggacc

SEQ ID NO: 3629997 - RNA, 15 nt, Human
caggacccuggaccu

SEQ ID NO: 3629998 - RNA, 23 nt, Human
caggaccuaggauaucuucucca

SEQ ID NO: 3629999 - RNA, 20 nt, Human
caggaccucagaguccaggc

SEQ ID NO: 3630000 - RNA, 21 nt, Human
caggaccucagaguccaggcc

SEQ ID NO: 3630001 - RNA, 13 nt, Human
caggaccucaggu

SEQ ID NO: 3630002 - RNA, 23 nt, Human
caggaccuccaagccacugagca

SEQ ID NO: 3630003 - RNA, 21 nt, Human
caggaccucugaaacccugga

SEQ ID NO: 3630004 - RNA, 13 nt, Human
caggaccugccug

SEQ ID NO: 3630005 - RNA, 19 nt, Human
caggaccugccuguagccc

SEQ ID NO: 3630006 - RNA, 21 nt, Human
caggaccuucgggcugugccc

SEQ ID NO: 3630007 - RNA, 12 nt, Human
caggacgccacu

SEQ ID NO: 3630008 - RNA, 16 nt, Human
caggcagucgggggcu

SEQ ID NO: 3630009 - RNA, 21 nt, Human
caggcagucgggggcuggccu

SEQ ID NO: 3630010 - RNA, 24 nt, Human
caggcagucgggggcuggccuagg

SEQ ID NO: 3630011 - RNA, 20 nt, Human
caggcagugaugcuggaugc

SEQ ID NO: 3630012 - RNA, 22 nt, Human
caggcagugaugcuggaugcuc

SEQ ID NO: 3630013 - RNA, 20 nt, Human
caggcauaaaauagaguaaa

SEQ ID NO: 3630014 - RNA, 21 nt, Human
caggcauagaggcuucuccgc

SEQ ID NO: 3630015 - RNA, 23 nt, Human
caggcauagaggcuucuccgcca

SEQ ID NO: 3630016 - RNA, 15 nt, Human
caggcauaggccugg

SEQ ID NO: 3630017 - RNA, 12 nt, Human
caggcauccucc

SEQ ID NO: 3630018 - RNA, 20 nt, Human
caggcaucggggagccggga

SEQ ID NO: 3630019 - RNA, 21 nt, Human
caggcaucggggagccgggag

SEQ ID NO: 3630020 - RNA, 22 nt, Human
caggcaugaggaaucugggagg

SEQ ID NO: 3630021 - RNA, 17 nt, Human
caggcaugcaugugcuu

SEQ ID NO: 3630022 - RNA, 16 nt, Human
caggcauggcccuggg

SEQ ID NO: 3630023 - RNA, 18 nt, Human
caggcauggcccugggcg

SEQ ID NO: 3630024 - RNA, 14 nt, Human
caggcauggggggu

SEQ ID NO: 3630025 - RNA, 23 nt, Human
caggcaugggugcaaggaaaauu

SEQ ID NO: 3630026 - RNA, 13 nt, Human
caggcaugugcca

SEQ ID NO: 3630027 - RNA, 13 nt, Human
caggcauucccca

SEQ ID NO: 3630028 - RNA, 17 nt, Human
caggcauuccccaggag

SEQ ID NO: 3630029 - RNA, 22 nt, Human
caggcauuccccaggaggccag

SEQ ID NO: 3630030 - RNA, 17 nt, Human
caggcauuuagcccuca

SEQ ID NO: 3630031 - RNA, 19 nt, Human
caggcauuuccuggguggc

SEQ ID NO: 3630032 - RNA, 22 nt, Human
caggccaaagagucuccaguuu

SEQ ID NO: 3630033 - RNA, 19 nt, Human
caggccaaaggggaccugg

SEQ ID NO: 3630034 - RNA, 21 nt, Human
caggccaaaggggaccuggaa

SEQ ID NO: 3630035 - RNA, 13 nt, Human
caggccaacccca

SEQ ID NO: 3630036 - RNA, 19 nt, Human
caggccaaggccuucuccu

SEQ ID NO: 3630037 - RNA, 18 nt, Human
caggccaaguuaaaggcu

SEQ ID NO: 3630038 - RNA, 16 nt, Human
caggccacacuucaaa

SEQ ID NO: 3630039 - RNA, 21 nt, Human
caggccacacuucaaacuacu

SEQ ID NO: 3630040 - RNA, 13 nt, Human
caggccaccagga

SEQ ID NO: 3630041 - RNA, 16 nt, Human
caggccaccaggaugg

SEQ ID NO: 3630042 - RNA, 16 nt, Human
caggccacccugugca

SEQ ID NO: 3630043 - RNA, 16 nt, Human
caggccaccuccagaa

SEQ ID NO: 3630044 - RNA, 19 nt, Human
caggccaccuccccagcau

SEQ ID NO: 3630045 - RNA, 20 nt, Human
caggccaccuccccagcauu

SEQ ID NO: 3630046 - RNA, 13 nt, Human
caggccaccugcc

SEQ ID NO: 3630047 - RNA, 15 nt, Human
caggccaccugcccc

SEQ ID NO: 3630048 - RNA, 15 nt, Human
caggccacuugauga

SEQ ID NO: 3630049 - RNA, 15 nt, Human
caggccagagggagu

SEQ ID NO: 3630050 - RNA, 16 nt, Human
caggccagagggagug

SEQ ID NO: 3630051 - RNA, 23 nt, Human
caggccagagggagugacagagg

SEQ ID NO: 3630052 - RNA, 12 nt, Human
caggccagccuc

SEQ ID NO: 3630053 - RNA, 19 nt, Human
caggccagccuccgagagg

SEQ ID NO: 3630054 - RNA, 15 nt, Human
caggccagcugcuug

SEQ ID NO: 3630055 - RNA, 23 nt, Human
caggccagcugcuugggcuucau

SEQ ID NO: 3630056 - RNA, 14 nt, Human
caggccaggacucu

SEQ ID NO: 3630057 - RNA, 18 nt, Human
caggccaggcccucugcc

SEQ ID NO: 3630058 - RNA, 22 nt, Human
caggccaggcccucugcccacu

SEQ ID NO: 3630059 - RNA, 21 nt, Human
caggccaggcuccuuccuguc

SEQ ID NO: 3630060 - RNA, 21 nt, Human
caggccaguaagggaaauaga

SEQ ID NO: 3630061 - RNA, 13 nt, Human
caggccaucuucc

SEQ ID NO: 3630062 - RNA, 15 nt, Human
caggccauggaggca

SEQ ID NO: 3630063 - RNA, 18 nt, Human
caggccauggaggcagaa

SEQ ID NO: 3630064 - RNA, 16 nt, Human
caggccauucugccgc

SEQ ID NO: 3630065 - RNA, 15 nt, Human
caggccauuuuuggu

SEQ ID NO: 3630066 - RNA, 15 nt, Human
caggcccaacuguga

SEQ ID NO: 3630067 - RNA, 18 nt, Human
caggcccaagagaugaag

SEQ ID NO: 3630068 - RNA, 15 nt, Human
caggcccacccugcu

SEQ ID NO: 3630069 - RNA, 15 nt, Human
caggcccacugugcc

SEQ ID NO: 3630070 - RNA, 17 nt, Human
caggcccacugugccuc

SEQ ID NO: 3630071 - RNA, 11 nt, Human
caggcccagca

SEQ ID NO: 3630072 - RNA, 19 nt, Human
caggcccagcauugcuggu

SEQ ID NO: 3630073 - RNA, 21 nt, Human
caggcccagcauugcugguuc

SEQ ID NO: 3630074 - RNA, 22 nt, Human
caggcccaugggaggcuggagu

SEQ ID NO: 3630075 - RNA, 17 nt, Human
caggccccaaaaccaca

SEQ ID NO: 3630076 - RNA, 19 nt, Human
caggccccaaaaccacagc

SEQ ID NO: 3630077 - RNA, 22 nt, Human
caggccccaaaaccacagcccu

SEQ ID NO: 3630078 - RNA, 13 nt, Human
caggccccagcaa

SEQ ID NO: 3630079 - RNA, 16 nt, Human
caggccccaugaccuc

SEQ ID NO: 3630080 - RNA, 22 nt, Human
caggccccaugaccuccagcuu

SEQ ID NO: 3630081 - RNA, 19 nt, Human
caggcccccaccacacauc

SEQ ID NO: 3630082 - RNA, 21 nt, Human
caggcccccaccacacauccc

SEQ ID NO: 3630083 - RNA, 14 nt, Human
caggcccccaggug

SEQ ID NO: 3630084 - RNA, 16 nt, Human
caggcccccgccuugg

SEQ ID NO: 3630085 - RNA, 21 nt, Human
caggcccccgccuuggccugu

SEQ ID NO: 3630086 - RNA, 18 nt, Human
caggccccgcuuguccag

SEQ ID NO: 3630087 - RNA, 23 nt, Human
caggccccucccucuccagcagg

SEQ ID NO: 3630088 - RNA, 13 nt, Human
caggccccugcca

SEQ ID NO: 3630089 - RNA, 19 nt, Human
caggccccugccacccugg

SEQ ID NO: 3630090 - RNA, 20 nt, Human
caggccccugccacccuggg

SEQ ID NO: 3630091 - RNA, 20 nt, Human
caggccccuggaggcugccu

SEQ ID NO: 3630092 - RNA, 18 nt, Human
caggcccgaaagaggcac

SEQ ID NO: 3630093 - RNA, 16 nt, Human
caggcccggcagggcg

SEQ ID NO: 3630094 - RNA, 18 nt, Human
caggcccggcgcgguggc

SEQ ID NO: 3630095 - RNA, 19 nt, Human
caggcccggcgcgguggcu

SEQ ID NO: 3630096 - RNA, 16 nt, Human
caggcccggcuccagg

SEQ ID NO: 3630097 - RNA, 17 nt, Human
caggcccggcuccaggc

SEQ ID NO: 3630098 - RNA, 20 nt, Human
caggcccggcuccaggcucc

SEQ ID NO: 3630099 - RNA, 22 nt, Human
caggcccggcuccaggcuccuu

SEQ ID NO: 3630100 - RNA, 14 nt, Human
caggcccggggcug

SEQ ID NO: 3630101 - RNA, 16 nt, Human
caggcccgucugucca

SEQ ID NO: 3630102 - RNA, 19 nt, Human
caggcccgucuguccaucu

SEQ ID NO: 3630103 - RNA, 20 nt, Human
caggcccgucuguccaucug

SEQ ID NO: 3630104 - RNA, 23 nt, Human
caggcccucccuguuccccagag

SEQ ID NO: 3630105 - RNA, 20 nt, Human
caggcccuccucccucccag

SEQ ID NO: 3630106 - RNA, 23 nt, Human
caggcccuccucccucccagcuc

SEQ ID NO: 3630107 - RNA, 14 nt, Human
caggcccucugccc

SEQ ID NO: 3630108 - RNA, 16 nt, Human
caggcccucugcccac

SEQ ID NO: 3630109 - RNA, 20 nt, Human
caggcccucugcccacuccc

SEQ ID NO: 3630110 - RNA, 21 nt, Human
caggcccucugcccacucccu

SEQ ID NO: 3630111 - RNA, 22 nt, Human
caggcccucugcccacucccug

SEQ ID NO: 3630112 - RNA, 13 nt, Human
caggcccugcacu

SEQ ID NO: 3630113 - RNA, 17 nt, Human
caggcccugcacugucc

SEQ ID NO: 3630114 - RNA, 18 nt, Human
caggcccugcacuguccu

SEQ ID NO: 3630115 - RNA, 23 nt, Human
caggcccugcacuguccugcucc

SEQ ID NO: 3630116 - RNA, 12 nt, Human
caggcccugcag

SEQ ID NO: 3630117 - RNA, 13 nt, Human
caggcccugcagu

SEQ ID NO: 3630118 - RNA, 15 nt, Human
caggcccugcagugu

SEQ ID NO: 3630119 - RNA, 20 nt, Human
caggcccugcuccugcagca

SEQ ID NO: 3630120 - RNA, 14 nt, Human
caggcccuggccuc

SEQ ID NO: 3630121 - RNA, 18 nt, Human
caggcccuggccuccccu

SEQ ID NO: 3630122 - RNA, 15 nt, Human
caggcccuuccucuc

SEQ ID NO: 3630123 - RNA, 16 nt, Human
caggcccuuccucucc

SEQ ID NO: 3630124 - RNA, 20 nt, Human
caggcccuugucggccccac

SEQ ID NO: 3630125 - RNA, 17 nt, Human
caggcccuuuccucagg

SEQ ID NO: 3630126 - RNA, 18 nt, Human
caggccgagaagccagug

SEQ ID NO: 3630127 - RNA, 18 nt, Human
caggccgcagcucuugcc

SEQ ID NO: 3630128 - RNA, 14 nt, Human
caggccgccccagc

SEQ ID NO: 3630129 - RNA, 18 nt, Human
caggccgccccagccucu

SEQ ID NO: 3630130 - RNA, 20 nt, Human
caggccggcagccccagccu

SEQ ID NO: 3630131 - RNA, 15 nt, Human
caggccggccagccu

SEQ ID NO: 3630132 - RNA, 21 nt, Human
caggccggccagccucacccu

SEQ ID NO: 3630133 - RNA, 19 nt, Human
caggccggcgagcccugug

SEQ ID NO: 3630134 - RNA, 17 nt, Human
caggccgggcagagcac

SEQ ID NO: 3630135 - RNA, 16 nt, Human
caggccgggccuguac

SEQ ID NO: 3630136 - RNA, 18 nt, Human
caggccgggccuguacag

SEQ ID NO: 3630137 - RNA, 21 nt, Human
caggccgggccuguacagucu

SEQ ID NO: 3630138 - RNA, 19 nt, Human
caggccggugugggcugug

SEQ ID NO: 3630139 - RNA, 17 nt, Human
caggccgugacgucugg

SEQ ID NO: 3630140 - RNA, 19 nt, Human
caggccguggcugcccaca

SEQ ID NO: 3630141 - RNA, 19 nt, Human
caggccuaaucucauaccu

SEQ ID NO: 3630142 - RNA, 18 nt, Human
caggccuacuccugucuu

SEQ ID NO: 3630143 - RNA, 22 nt, Human
caggccuauguugauccaucca

SEQ ID NO: 3630144 - RNA, 13 nt, Human
caggccucaccuc

SEQ ID NO: 3630145 - RNA, 13 nt, Human
caggccuccagcu

SEQ ID NO: 3630146 - RNA, 19 nt, Human
caggccuccagcucagcag

SEQ ID NO: 3630147 - RNA, 15 nt, Human
caggccucccucucu

SEQ ID NO: 3630148 - RNA, 23 nt, Human
caggccucccucucucuucugcu

SEQ ID NO: 3630149 - RNA, 13 nt, Human
caggccucccugc

SEQ ID NO: 3630150 - RNA, 17 nt, Human
caggccucccugccagu

SEQ ID NO: 3630151 - RNA, 14 nt, Human
cagggcccugcaga

SEQ ID NO: 3630152 - RNA, 15 nt, Human
cagggcccugcagag

SEQ ID NO: 3630153 - RNA, 22 nt, Human
cagggccgaggaggugccugga

SEQ ID NO: 3630154 - RNA, 23 nt, Human
cagggccgcccgggcccagagga

SEQ ID NO: 3630155 - RNA, 24 nt, Human
cagggccggggaacuggccaagcu

SEQ ID NO: 3630156 - RNA, 20 nt, Human
cagggccuagcugcuacaaa

SEQ ID NO: 3630157 - RNA, 23 nt, Human
cagggccucccgcaucaagguca

SEQ ID NO: 3630158 - RNA, 16 nt, Human
cagggccugagccugg

SEQ ID NO: 3630159 - RNA, 18 nt, Human
cagggccuggaagacaga

SEQ ID NO: 3630160 - RNA, 19 nt, Human
cagggccuggaagacagag

SEQ ID NO: 3630161 - RNA, 16 nt, Human
cagggccuggcccaug

SEQ ID NO: 3630162 - RNA, 18 nt, Human
cagggccuggcccaugua

SEQ ID NO: 3630163 - RNA, 15 nt, Human
cagggccuggcucag

SEQ ID NO: 3630164 - RNA, 16 nt, Human
cagggccuggcucagg

SEQ ID NO: 3630165 - RNA, 18 nt, Human
cagggccuggggccugag

SEQ ID NO: 3630166 - RNA, 11 nt, Human
cagggccuggu

SEQ ID NO: 3630167 - RNA, 13 nt, Human
cagggccugguug

SEQ ID NO: 3630168 - RNA, 13 nt, Human
cagggccuugccc

SEQ ID NO: 3630169 - RNA, 14 nt, Human
cagggccuugccca

SEQ ID NO: 3630170 - RNA, 24 nt, Human
cagggccuugcccagagaugccuc

SEQ ID NO: 3630171 - RNA, 11 nt, Human
cagggccuuuu

SEQ ID NO: 3630172 - RNA, 20 nt, Human
cagggccuuuucuggcaccg

SEQ ID NO: 3630173 - RNA, 19 nt, Human
cagggcgggcagagggcug

SEQ ID NO: 3630174 - RNA, 20 nt, Human
cagggcgggcagagggcugg

SEQ ID NO: 3630175 - RNA, 17 nt, Human
cagggcuaagagcuagc

SEQ ID NO: 3630176 - RNA, 15 nt, Human
cagggcuacccuccc

SEQ ID NO: 3630177 - RNA, 24 nt, Human
cagggcuacccugagcugaggcag

SEQ ID NO: 3630178 - RNA, 16 nt, Human
cagggcuccagccccu

SEQ ID NO: 3630179 - RNA, 14 nt, Human
cagggcucccaggg

SEQ ID NO: 3630180 - RNA, 15 nt, Human
cagggcuccucccag

SEQ ID NO: 3630181 - RNA, 17 nt, Human
cagggcuccucccagcu

SEQ ID NO: 3630182 - RNA, 20 nt, Human
cagggcuccucccagcuugu

SEQ ID NO: 3630183 - RNA, 22 nt, Human
cagggcuccugccuucuguccu

SEQ ID NO: 3630184 - RNA, 14 nt, Human
cagggcucuccugg

SEQ ID NO: 3630185 - RNA, 17 nt, Human
cagggcucuccuggcuu

SEQ ID NO: 3630186 - RNA, 18 nt, Human
cagggcucuccuggcuuc

SEQ ID NO: 3630187 - RNA, 24 nt, Human
cagggcucucuuuccuucuugccu

SEQ ID NO: 3630188 - RNA, 12 nt, Human
cagggcucugac

SEQ ID NO: 3630189 - RNA, 15 nt, Human
cagggcucugaccag

SEQ ID NO: 3630190 - RNA, 21 nt, Human
cagggcucugccccagaggcc

SEQ ID NO: 3630191 - RNA, 19 nt, Human
cagggcucugccccagucg

SEQ ID NO: 3630192 - RNA, 23 nt, Human
cagggcucugugaccaggaagga

SEQ ID NO: 3630193 - RNA, 21 nt, Human
cagggcugacacguccacccc

SEQ ID NO: 3630194 - RNA, 16 nt, Human
cagggcugaggccucu

SEQ ID NO: 3630195 - RNA, 22 nt, Human
cagggcugcccugagaagcugc

SEQ ID NO: 3630196 - RNA, 14 nt, Human
cagggcugcuagac

SEQ ID NO: 3630197 - RNA, 21 nt, Human
cagggcugcugggggcaacug

SEQ ID NO: 3630198 - RNA, 14 nt, Human
cagggcuggacuga

SEQ ID NO: 3630199 - RNA, 16 nt, Human
cagggcuggacugagg

SEQ ID NO: 3630200 - RNA, 17 nt, Human
cagggcuggacugaggc

SEQ ID NO: 3630201 - RNA, 16 nt, Human
cagggcuggcccagcc

SEQ ID NO: 3630202 - RNA, 18 nt, Human
cagggcuggcccagcccu

SEQ ID NO: 3630203 - RNA, 21 nt, Human
cagggcuggcccagcccugcu

SEQ ID NO: 3630204 - RNA, 22 nt, Human
cagggcuggcccagcccugcug

SEQ ID NO: 3630205 - RNA, 20 nt, Human
cagggcuggccccagggcac

SEQ ID NO: 3630206 - RNA, 23 nt, Human
cagggcuggccccagggcacccu

SEQ ID NO: 3630207 - RNA, 14 nt, Human
cagggcugggagga

SEQ ID NO: 3630208 - RNA, 16 nt, Human
cagggcugggaggaag

SEQ ID NO: 3630209 - RNA, 20 nt, Human
cagggcuggggcagccucug

SEQ ID NO: 3630210 - RNA, 18 nt, Human
cagggcuguaacugccag

SEQ ID NO: 3630211 - RNA, 13 nt, Human
cagggcugugcuu

SEQ ID NO: 3630212 - RNA, 14 nt, Human
cagggcugugcuug

SEQ ID NO: 3630213 - RNA, 20 nt, Human
cagggcuuacggcccuggcc

SEQ ID NO: 3630214 - RNA, 15 nt, Human
cagggcuucuaguuu

SEQ ID NO: 3630215 - RNA, 16 nt, Human
caggggaaaagaggag

SEQ ID NO: 3630216 - RNA, 17 nt, Human
caggggaaaaucagccu

SEQ ID NO: 3630217 - RNA, 14 nt, Human
caggggaaaaugaa

SEQ ID NO: 3630218 - RNA, 16 nt, Human
caggggaaaaugaagg

SEQ ID NO: 3630219 - RNA, 14 nt, Human
caggggaaccugcc

SEQ ID NO: 3630220 - RNA, 18 nt, Human
caggggaauauuuuauuc

SEQ ID NO: 3630221 - RNA, 16 nt, Human
caggggacacccagaa

SEQ ID NO: 3630222 - RNA, 11 nt, Human
caggggacagg

SEQ ID NO: 3630223 - RNA, 15 nt, Human
caggggacucagccc

SEQ ID NO: 3630224 - RNA, 21 nt, Human
caggggacucagcccugaggu

SEQ ID NO: 3630225 - RNA, 20 nt, Human
caggggagagggucuggaga

SEQ ID NO: 3630226 - RNA, 16 nt, Human
caggggagcagagggg

SEQ ID NO: 3630227 - RNA, 22 nt, Human
caggggagcagaggggcagagg

SEQ ID NO: 3630228 - RNA, 15 nt, Human
caggggagcccucca

SEQ ID NO: 3630229 - RNA, 16 nt, Human
caggggaggccaucug

SEQ ID NO: 3630230 - RNA, 17 nt, Human
caggggagggggcaaag

SEQ ID NO: 3630231 - RNA, 19 nt, Human
caggggaggguagagcgga

SEQ ID NO: 3630232 - RNA, 19 nt, Human
caggggagggucagccagg

SEQ ID NO: 3630233 - RNA, 16 nt, Human
caggggaggugauagc

SEQ ID NO: 3630234 - RNA, 22 nt, Human
caggggauggcguggucaagca

SEQ ID NO: 3630235 - RNA, 13 nt, Human
caggggcaggcac

SEQ ID NO: 3630236 - RNA, 15 nt, Human
caggggcaggcacag

SEQ ID NO: 3630237 - RNA, 22 nt, Human
caggggcauguauuggccugga

SEQ ID NO: 3630238 - RNA, 23 nt, Human
caggggcauguauuggccuggag

SEQ ID NO: 3630239 - RNA, 14 nt, Human
caggggccagaaga

SEQ ID NO: 3630240 - RNA, 15 nt, Human
caggggccagaggaa

SEQ ID NO: 3630241 - RNA, 13 nt, Human
caggggccccucc

SEQ ID NO: 3630242 - RNA, 18 nt, Human
caggggcccugcagcucu

SEQ ID NO: 3630243 - RNA, 17 nt, Human
caggggccggccagugg

SEQ ID NO: 3630244 - RNA, 12 nt, Human
caggggccugga

SEQ ID NO: 3630245 - RNA, 22 nt, Human
caggggccuuugggugcuguuu

SEQ ID NO: 3630246 - RNA, 18 nt, Human
caggggcucccuccgccc

SEQ ID NO: 3630247 - RNA, 13 nt, Human
caggggcucugga

SEQ ID NO: 3630248 - RNA, 15 nt, Human
caggggcucuggaga

SEQ ID NO: 3630249 - RNA, 13 nt, Human
caggggcugcccg

SEQ ID NO: 3630250 - RNA, 14 nt, Human
caggggcugcccgc

SEQ ID NO: 3630251 - RNA, 19 nt, Human
caggggcugcuuccuccug

SEQ ID NO: 3630252 - RNA, 12 nt, Human
caggggcuggcu

SEQ ID NO: 3630253 - RNA, 12 nt, Human
caggggcuguuu

SEQ ID NO: 3630254 - RNA, 20 nt, Human
cagggggaagaagcagagag

SEQ ID NO: 3630255 - RNA, 21 nt, Human
cagggggaagaagcagagaga

SEQ ID NO: 3630256 - RNA, 23 nt, Human
cagggggaaggccaaggggaguc

SEQ ID NO: 3630257 - RNA, 22 nt, Human
cagggggagcugggccuggucu

SEQ ID NO: 3630258 - RNA, 15 nt, Human
cagggggcaagagga

SEQ ID NO: 3630259 - RNA, 13 nt, Human
cagggggccaggu

SEQ ID NO: 3630260 - RNA, 19 nt, Human
cagggggccaggugcacag

SEQ ID NO: 3630261 - RNA, 23 nt, Human
cagggggccccuuugcugacccu

SEQ ID NO: 3630262 - RNA, 15 nt, Human
cagggggcugcugcu

SEQ ID NO: 3630263 - RNA, 22 nt, Human
cagggggcuuccugaggggaga

SEQ ID NO: 3630264 - RNA, 13 nt, Human
cagggggucuggc

SEQ ID NO: 3630265 - RNA, 14 nt, Human
cagggggucuggcu

SEQ ID NO: 3630266 - RNA, 19 nt, Human
cagggggucuggcuggugu

SEQ ID NO: 3630267 - RNA, 20 nt, Human
cagggggucuggcugguguu

SEQ ID NO: 3630268 - RNA, 18 nt, Human
caggggucccagccaccc

SEQ ID NO: 3630269 - RNA, 15 nt, Human
caggggucucccugg

SEQ ID NO: 3630270 - RNA, 19 nt, Human
caggggucugagcuccagc

SEQ ID NO: 3630271 - RNA, 23 nt, Human
caggggucugagcuccagcuccu

SEQ ID NO: 3630272 - RNA, 13 nt, Human
caggggugacaca

SEQ ID NO: 3630273 - RNA, 18 nt, Human
caggggugacacagacuc

SEQ ID NO: 3630274 - RNA, 16 nt, Human
caggggugcccccucc

SEQ ID NO: 3630275 - RNA, 20 nt, Human
caggggugggacacccugug

SEQ ID NO: 3630276 - RNA, 21 nt, Human
caggggugggacacccuguga

SEQ ID NO: 3630277 - RNA, 20 nt, Human
cagggguggggguggaggcu

SEQ ID NO: 3630278 - RNA, 22 nt, Human
cagggguggggguggaggcuuc

SEQ ID NO: 3630279 - RNA, 15 nt, Human
cagggguuagagcag

SEQ ID NO: 3630280 - RNA, 20 nt, Human
cagggguuauguggaagugu

SEQ ID NO: 3630281 - RNA, 12 nt, Human
cagggguuccuu

SEQ ID NO: 3630282 - RNA, 20 nt, Human
cagggguuccuucugggcau

SEQ ID NO: 3630283 - RNA, 21 nt, Human
cagggguuccuucugggcauu

SEQ ID NO: 3630284 - RNA, 13 nt, Human
cagggguucgaga

SEQ ID NO: 3630285 - RNA, 15 nt, Human
cagggguugcaguga

SEQ ID NO: 3630286 - RNA, 13 nt, Human
cagggguuucucg

SEQ ID NO: 3630287 - RNA, 14 nt, Human
caggguaaauuauu

SEQ ID NO: 3630288 - RNA, 15 nt, Human
caggguacaaaaaau

SEQ ID NO: 3630289 - RNA, 23 nt, Human
caggguagauaaccuguacuuca

SEQ ID NO: 3630290 - RNA, 13 nt, Human
caggguagcaggu

SEQ ID NO: 3630291 - RNA, 21 nt, Human
cagggucacugaaggccuggc

SEQ ID NO: 3630292 - RNA, 18 nt, Human
cagggucagaaacaggac

SEQ ID NO: 3630293 - RNA, 17 nt, Human
cagggucccacagccac

SEQ ID NO: 3630294 - RNA, 17 nt, Human
cagggucccauuucuca

SEQ ID NO: 3630295 - RNA, 13 nt, Human
cagggucccugcu

SEQ ID NO: 3630296 - RNA, 19 nt, Human
cauccacucuacccuccca

SEQ ID NO: 3630297 - RNA, 22 nt, Human
cauccacucuacccucccaccc

SEQ ID NO: 3630298 - RNA, 21 nt, Human
cauccacuuacauauauuuuu

SEQ ID NO: 3630299 - RNA, 13 nt, Human
cauccagaguccc

SEQ ID NO: 3630300 - RNA, 17 nt, Human
cauccagagucccugcc

SEQ ID NO: 3630301 - RNA, 18 nt, Human
cauccagagucccugccu

SEQ ID NO: 3630302 - RNA, 21 nt, Human
cauccagagucccugccugga

SEQ ID NO: 3630303 - RNA, 13 nt, Human
cauccagcaagaa

SEQ ID NO: 3630304 - RNA, 17 nt, Human
cauccagcagucucugc

SEQ ID NO: 3630305 - RNA, 21 nt, Human
cauccagcagucucugccuug

SEQ ID NO: 3630306 - RNA, 15 nt, Human
cauccagcucacuca

SEQ ID NO: 3630307 - RNA, 14 nt, Human
cauccagcuugcca

SEQ ID NO: 3630308 - RNA, 19 nt, Human
cauccagggcucugaccag

SEQ ID NO: 3630309 - RNA, 13 nt, Human
cauccagggggca

SEQ ID NO: 3630310 - RNA, 17 nt, Human
cauccagguucagcuug

SEQ ID NO: 3630311 - RNA, 23 nt, Human
cauccagucucccaacuuguauu

SEQ ID NO: 3630312 - RNA, 14 nt, Human
cauccauaaagaag

SEQ ID NO: 3630313 - RNA, 17 nt, Human
cauccauaccagcucgc

SEQ ID NO: 3630314 - RNA, 18 nt, Human
cauccauaguaguaugau

SEQ ID NO: 3630315 - RNA, 21 nt, Human
cauccauggccagcagcaccu

SEQ ID NO: 3630316 - RNA, 22 nt, Human
cauccauggggucucucacaga

SEQ ID NO: 3630317 - RNA, 18 nt, Human
cauccauguccaaccccc

SEQ ID NO: 3630318 - RNA, 16 nt, Human
cauccauguccuaugu

SEQ ID NO: 3630319 - RNA, 17 nt, Human
cauccauguguggacuc

SEQ ID NO: 3630320 - RNA, 19 nt, Human
cauccauguuccgagaaga

SEQ ID NO: 3630321 - RNA, 18 nt, Human
cauccauguuuguaaaac

SEQ ID NO: 3630322 - RNA, 13 nt, Human
cauccauuaggcc

SEQ ID NO: 3630323 - RNA, 17 nt, Human
cauccauuaggccagca

SEQ ID NO: 3630324 - RNA, 20 nt, Human
cauccauuaggccagcaacg

SEQ ID NO: 3630325 - RNA, 15 nt, Human
cauccauuccucagg

SEQ ID NO: 3630326 - RNA, 17 nt, Human
cauccauuccucaggga

SEQ ID NO: 3630327 - RNA, 20 nt, Human
cauccauuucaucuauuucu

SEQ ID NO: 3630328 - RNA, 23 nt, Human
caucccaaaaucauaagauauuu

SEQ ID NO: 3630329 - RNA, 19 nt, Human
caucccaaacccuucagug

SEQ ID NO: 3630330 - RNA, 18 nt, Human
caucccaaccagugccaa

SEQ ID NO: 3630331 - RNA, 22 nt, Human
caucccaaccagugccaaggac

SEQ ID NO: 3630332 - RNA, 16 nt, Human
caucccaccccauccu

SEQ ID NO: 3630333 - RNA, 19 nt, Human
caucccaccccauccucca

SEQ ID NO: 3630334 - RNA, 13 nt, Human
caucccacugcuc

SEQ ID NO: 3630335 - RNA, 16 nt, Human
caucccacugcugacu

SEQ ID NO: 3630336 - RNA, 17 nt, Human
caucccagacagguccc

SEQ ID NO: 3630337 - RNA, 21 nt, Human
caucccagacaggucccuccc

SEQ ID NO: 3630338 - RNA, 11 nt, Human
caucccagccc

SEQ ID NO: 3630339 - RNA, 19 nt, Human
caucccagcccaauccagg

SEQ ID NO: 3630340 - RNA, 21 nt, Human
caucccagcccaauccaggua

SEQ ID NO: 3630341 - RNA, 13 nt, Human
caucccagcccca

SEQ ID NO: 3630342 - RNA, 14 nt, Human
caucccagccuugg

SEQ ID NO: 3630343 - RNA, 13 nt, Human
caucccagcggcu

SEQ ID NO: 3630344 - RNA, 13 nt, Human
caucccaggacac

SEQ ID NO: 3630345 - RNA, 19 nt, Human
caucccaggacaccacacc

SEQ ID NO: 3630346 - RNA, 21 nt, Human
caucccaggacaccacaccca

SEQ ID NO: 3630347 - RNA, 23 nt, Human
caucccaggacaccacacccagc

SEQ ID NO: 3630348 - RNA, 19 nt, Human
caucccaggcuucacccug

SEQ ID NO: 3630349 - RNA, 13 nt, Human
caucccaucccau

SEQ ID NO: 3630350 - RNA, 14 nt, Human
caucccaucccauc

SEQ ID NO: 3630351 - RNA, 16 nt, Human
caucccaucccauccc

SEQ ID NO: 3630352 - RNA, 17 nt, Human
caucccaucccauccca

SEQ ID NO: 3630353 - RNA, 12 nt, Human
caucccaucccg

SEQ ID NO: 3630354 - RNA, 18 nt, Human
caucccaugauguagugc

SEQ ID NO: 3630355 - RNA, 20 nt, Human
caucccaugauguagugccu

SEQ ID NO: 3630356 - RNA, 16 nt, Human
caucccauguaacaga

SEQ ID NO: 3630357 - RNA, 19 nt, Human
caucccauguaacagaaag

SEQ ID NO: 3630358 - RNA, 12 nt, Human
caucccauugcc

SEQ ID NO: 3630359 - RNA, 16 nt, Human
caucccauugcccugg

SEQ ID NO: 3630360 - RNA, 12 nt, Human
cauccccaccuu

SEQ ID NO: 3630361 - RNA, 11 nt, Human
cauccccaggg

SEQ ID NO: 3630362 - RNA, 16 nt, Human
cauccccauccuccag

SEQ ID NO: 3630363 - RNA, 17 nt, Human
cauccccauccuccagc

SEQ ID NO: 3630364 - RNA, 12 nt, Human
caucccccaaag

SEQ ID NO: 3630365 - RNA, 11 nt, Human
caucccccugc

SEQ ID NO: 3630366 - RNA, 14 nt, Human
caucccccugcccu

SEQ ID NO: 3630367 - RNA, 19 nt, Human
cauccccgcagugugcacu

SEQ ID NO: 3630368 - RNA, 13 nt, Human
cauccccugccuc

SEQ ID NO: 3630369 - RNA, 15 nt, Human
cauccccugccucca

SEQ ID NO: 3630370 - RNA, 16 nt, Human
cauccccugccuccau

SEQ ID NO: 3630371 - RNA, 22 nt, Human
cauccccugccuccauccuagu

SEQ ID NO: 3630372 - RNA, 14 nt, Human
cauccccuguagag

SEQ ID NO: 3630373 - RNA, 21 nt, Human
cauccccuguagagugggagc

SEQ ID NO: 3630374 - RNA, 15 nt, Human
cauccccugugggaa

SEQ ID NO: 3630375 - RNA, 20 nt, Human
cauccccuuacccuuagaau

SEQ ID NO: 3630376 - RNA, 16 nt, Human
caucccgcucuuuucc

SEQ ID NO: 3630377 - RNA, 15 nt, Human
caucccggaggaaau

SEQ ID NO: 3630378 - RNA, 16 nt, Human
caucccgucuucucca

SEQ ID NO: 3630379 - RNA, 18 nt, Human
caucccgucuucuccaac

SEQ ID NO: 3630380 - RNA, 14 nt, Human
caucccguguucuc

SEQ ID NO: 3630381 - RNA, 16 nt, Human
caucccguguucuccu

SEQ ID NO: 3630382 - RNA, 14 nt, Human
caucccuacccccu

SEQ ID NO: 3630383 - RNA, 14 nt, Human
caucccucacccau

SEQ ID NO: 3630384 - RNA, 12 nt, Human
caucccucccuc

SEQ ID NO: 3630385 - RNA, 14 nt, Human
caucccucccucca

SEQ ID NO: 3630386 - RNA, 13 nt, Human
caucccuccuggg

SEQ ID NO: 3630387 - RNA, 18 nt, Human
caucccugaaggccccgc

SEQ ID NO: 3630388 - RNA, 22 nt, Human
caucccugaaggccccgcccag

SEQ ID NO: 3630389 - RNA, 24 nt, Human
caucccugagcaggaaaguuuacc

SEQ ID NO: 3630390 - RNA, 17 nt, Human
caucccugaggagccag

SEQ ID NO: 3630391 - RNA, 19 nt, Human
caucccugaggcuggacuc

SEQ ID NO: 3630392 - RNA, 19 nt, Human
caucccugauuccuguugu

SEQ ID NO: 3630393 - RNA, 15 nt, Human
caucccugccugguc

SEQ ID NO: 3630394 - RNA, 14 nt, Human
caucccuggaaggu

SEQ ID NO: 3630395 - RNA, 15 nt, Human
caucccuggaaggug

SEQ ID NO: 3630396 - RNA, 23 nt, Human
caucccuggcccccucccuggau

SEQ ID NO: 3630397 - RNA, 11 nt, Human
caucccugggc

SEQ ID NO: 3630398 - RNA, 13 nt, Human
caucccugggccu

SEQ ID NO: 3630399 - RNA, 16 nt, Human
caucccugggccugcu

SEQ ID NO: 3630400 - RNA, 18 nt, Human
caucccugggccugcugc

SEQ ID NO: 3630401 - RNA, 21 nt, Human
caucccugggccugcugcuga

SEQ ID NO: 3630402 - RNA, 22 nt, Human
caucccugggccugcugcugag

SEQ ID NO: 3630403 - RNA, 23 nt, Human
caucccugggccugcugcugaga

SEQ ID NO: 3630404 - RNA, 12 nt, Human
caucccugugag

SEQ ID NO: 3630405 - RNA, 15 nt, Human
caucccuucucuucc

SEQ ID NO: 3630406 - RNA, 22 nt, Human
caucccuucucuuccaggcagc

SEQ ID NO: 3630407 - RNA, 13 nt, Human
caucccuuuccag

SEQ ID NO: 3630408 - RNA, 16 nt, Human
caucccuuuuugaagu

SEQ ID NO: 3630409 - RNA, 17 nt, Human
caucccuuuuugaagug

SEQ ID NO: 3630410 - RNA, 20 nt, Human
cauccgaccagguugucacu

SEQ ID NO: 3630411 - RNA, 15 nt, Human
cauccgaggcagggu

SEQ ID NO: 3630412 - RNA, 23 nt, Human
cauccgaggcagggucaggagag

SEQ ID NO: 3630413 - RNA, 17 nt, Human
cauccgcgugugccugu

SEQ ID NO: 3630414 - RNA, 23 nt, Human
cauccggaggagaagaaggaaau

SEQ ID NO: 3630415 - RNA, 17 nt, Human
cauccguaguucccuga

SEQ ID NO: 3630416 - RNA, 18 nt, Human
cauccguaguucccugaa

SEQ ID NO: 3630417 - RNA, 14 nt, Human
cauccuaagaaaua

SEQ ID NO: 3630418 - RNA, 20 nt, Human
cauccuaaucauccaaugcu

SEQ ID NO: 3630419 - RNA, 17 nt, Human
cauccuacaagacacag

SEQ ID NO: 3630420 - RNA, 18 nt, Human
cauccuacaagacacagu

SEQ ID NO: 3630421 - RNA, 14 nt, Human
cauccuaccaaugc

SEQ ID NO: 3630422 - RNA, 18 nt, Human
cauccuaccaaugcaugc

SEQ ID NO: 3630423 - RNA, 23 nt, Human
cauccuaccacaaugcagugccu

SEQ ID NO: 3630424 - RNA, 13 nt, Human
cauccuacccucg

SEQ ID NO: 3630425 - RNA, 21 nt, Human
cauccuacccucgggcccacc

SEQ ID NO: 3630426 - RNA, 17 nt, Human
cauccuaggcugacacc

SEQ ID NO: 3630427 - RNA, 24 nt, Human
cauccuaucagccugucucuucca

SEQ ID NO: 3630428 - RNA, 15 nt, Human
cauccuaugcaauau

SEQ ID NO: 3630429 - RNA, 22 nt, Human
cauccucaaacacugcaggcau

SEQ ID NO: 3630430 - RNA, 14 nt, Human
cauccucaaagaaa

SEQ ID NO: 3630431 - RNA, 19 nt, Human
cauccucaagaucauucag

SEQ ID NO: 3630432 - RNA, 15 nt, Human
cauccucagaugcuc

SEQ ID NO: 3630433 - RNA, 16 nt, Human
cauccucauacccacc

SEQ ID NO: 3630434 - RNA, 17 nt, Human
cauccucauacccaccc

SEQ ID NO: 3630435 - RNA, 22 nt, Human
cauccucauacccacccccacc

SEQ ID NO: 3630436 - RNA, 17 nt, Human
cauccuccagauagugu

SEQ ID NO: 3630437 - RNA, 16 nt, Human
cauccuccagcaggga

SEQ ID NO: 3630438 - RNA, 13 nt, Human
cauccuccagccc

SEQ ID NO: 3630439 - RNA, 14 nt, Human
cauccuccagcccc

SEQ ID NO: 3630440 - RNA, 15 nt, Human
cauccuccagcuucu

SEQ ID NO: 3630441 - RNA, 17 nt, Human
cauccuccagcuucugg

SEQ ID NO: 3630442 - RNA, 19 nt, Human
caugagggaucacagggcc

SEQ ID NO: 3630443 - RNA, 16 nt, Human
caugaggggcccgagc

SEQ ID NO: 3630444 - RNA, 15 nt, Human
caugagucccagugg

SEQ ID NO: 3630445 - RNA, 14 nt, Human
caugaguccccugu

SEQ ID NO: 3630446 - RNA, 15 nt, Human
caugaguccccuguu

SEQ ID NO: 3630447 - RNA, 23 nt, Human
caugaguccccuguuuguuucug

SEQ ID NO: 3630448 - RNA, 19 nt, Human
caugaguuaucaugaauuu

SEQ ID NO: 3630449 - RNA, 23 nt, Human
caugaguuaucaugaauuuuaaa

SEQ ID NO: 3630450 - RNA, 16 nt, Human
caugaguucugcugaa

SEQ ID NO: 3630451 - RNA, 16 nt, Human
caugaguuugcccugg

SEQ ID NO: 3630452 - RNA, 13 nt, Human
caugauaaaugau

SEQ ID NO: 3630453 - RNA, 14 nt, Human
caugauauaacuuu

SEQ ID NO: 3630454 - RNA, 19 nt, Human
caugauauaacuuuagaaa

SEQ ID NO: 3630455 - RNA, 23 nt, Human
caugaugacuuaguacaaaguuu

SEQ ID NO: 3630456 - RNA, 14 nt, Human
caugaugcgggcca

SEQ ID NO: 3630457 - RNA, 16 nt, Human
caugaugcucuuuccc

SEQ ID NO: 3630458 - RNA, 15 nt, Human
caugaugcugggauu

SEQ ID NO: 3630459 - RNA, 18 nt, Human
caugauggagcgcaccug

SEQ ID NO: 3630460 - RNA, 12 nt, Human
caugauggaguc

SEQ ID NO: 3630461 - RNA, 15 nt, Human
caugauggcaacaga

SEQ ID NO: 3630462 - RNA, 20 nt, Human
caugauggugcugaccucug

SEQ ID NO: 3630463 - RNA, 22 nt, Human
caugaugguuauuuucuuuucu

SEQ ID NO: 3630464 - RNA, 12 nt, Human
caugauguggag

SEQ ID NO: 3630465 - RNA, 12 nt, Human
caugauguuugc

SEQ ID NO: 3630466 - RNA, 21 nt, Human
caugauguuugcccaaaauuu

SEQ ID NO: 3630467 - RNA, 24 nt, Human
caugauuaaccacuucagcugacu

SEQ ID NO: 3630468 - RNA, 15 nt, Human
caugauuccagccau

SEQ ID NO: 3630469 - RNA, 16 nt, Human
caugauuccuuccugu

SEQ ID NO: 3630470 - RNA, 13 nt, Human
caugauuccuuua

SEQ ID NO: 3630471 - RNA, 17 nt, Human
caugauuccuuuaacaa

SEQ ID NO: 3630472 - RNA, 22 nt, Human
caugauugcagaauuguuuaga

SEQ ID NO: 3630473 - RNA, 20 nt, Human
caugauuuacagagaaguga

SEQ ID NO: 3630474 - RNA, 17 nt, Human
caugauuucacaaauau

SEQ ID NO: 3630475 - RNA, 19 nt, Human
caugauuucacaaauauua

SEQ ID NO: 3630476 - RNA, 17 nt, Human
caugauuucauguacug

SEQ ID NO: 3630477 - RNA, 19 nt, Human
caugauuucauguacugca

SEQ ID NO: 3630478 - RNA, 16 nt, Human
caugauuuccuugaau

SEQ ID NO: 3630479 - RNA, 17 nt, Human
caugauuuccuugaaug

SEQ ID NO: 3630480 - RNA, 16 nt, Human
caugcaaaaagaaaug

SEQ ID NO: 3630481 - RNA, 12 nt, Human
caugcaaacucu

SEQ ID NO: 3630482 - RNA, 15 nt, Human
caugcaaaggcuggg

SEQ ID NO: 3630483 - RNA, 22 nt, Human
caugcaagaacucaucacugug

SEQ ID NO: 3630484 - RNA, 15 nt, Human
caugcaagcagagga

SEQ ID NO: 3630485 - RNA, 19 nt, Human
caugcaaggggaaaaucuc

SEQ ID NO: 3630486 - RNA, 17 nt, Human
caugcaaggucauuuuu

SEQ ID NO: 3630487 - RNA, 18 nt, Human
caugcaaggucauuuuuu

SEQ ID NO: 3630488 - RNA, 22 nt, Human
caugcaaggucauuuuuuuuaa

SEQ ID NO: 3630489 - RNA, 14 nt, Human
caugcaauaaaauu

SEQ ID NO: 3630490 - RNA, 18 nt, Human
caugcacaguauuuguaa

SEQ ID NO: 3630491 - RNA, 14 nt, Human
caugcaccacgggc

SEQ ID NO: 3630492 - RNA, 14 nt, Human
caugcacugacccu

SEQ ID NO: 3630493 - RNA, 18 nt, Human
caugcacugacccuucca

SEQ ID NO: 3630494 - RNA, 15 nt, Human
caugcacugauguug

SEQ ID NO: 3630495 - RNA, 20 nt, Human
caugcacugauguuguguuu

SEQ ID NO: 3630496 - RNA, 17 nt, Human
caugcacugugaaggac

SEQ ID NO: 3630497 - RNA, 23 nt, Human
caugcacuguucccccugugcag

SEQ ID NO: 3630498 - RNA, 14 nt, Human
caugcacuuaaaga

SEQ ID NO: 3630499 - RNA, 19 nt, Human
caugcagccacuuaggaca

SEQ ID NO: 3630500 - RNA, 22 nt, Human
caugcagcccaugcccaccugc

SEQ ID NO: 3630501 - RNA, 20 nt, Human
caugcagcucaacuuucugu

SEQ ID NO: 3630502 - RNA, 21 nt, Human
caugcagcugcacccucccuc

SEQ ID NO: 3630503 - RNA, 12 nt, Human
caugcaggcccu

SEQ ID NO: 3630504 - RNA, 10 nt, Human
caugcaguuu

SEQ ID NO: 3630505 - RNA, 16 nt, Human
caugcaguuugaaauu

SEQ ID NO: 3630506 - RNA, 22 nt, Human
caugcaguuugaaauucugaau

SEQ ID NO: 3630507 - RNA, 13 nt, Human
caugcauaaauau

SEQ ID NO: 3630508 - RNA, 19 nt, Human
caugcauaaauaugcagug

SEQ ID NO: 3630509 - RNA, 22 nt, Human
caugcauaaauaugcagugaua

SEQ ID NO: 3630510 - RNA, 11 nt, Human
caugcauacac

SEQ ID NO: 3630511 - RNA, 23 nt, Human
caugcauacacacacacacacag

SEQ ID NO: 3630512 - RNA, 17 nt, Human
caugcauacuucaaaag

SEQ ID NO: 3630513 - RNA, 17 nt, Human
caugcauagucccagcu

SEQ ID NO: 3630514 - RNA, 12 nt, Human
caugcauauaau

SEQ ID NO: 3630515 - RNA, 15 nt, Human
caugcaucuccaccu

SEQ ID NO: 3630516 - RNA, 18 nt, Human
caugcaucuccaccugcu

SEQ ID NO: 3630517 - RNA, 14 nt, Human
caugcaugcaaaug

SEQ ID NO: 3630518 - RNA, 18 nt, Human
caugcauguccuguaaag

SEQ ID NO: 3630519 - RNA, 21 nt, Human
caugcauguccuguaaagguu

SEQ ID NO: 3630520 - RNA, 15 nt, Human
caugcauuguccucu

SEQ ID NO: 3630521 - RNA, 20 nt, Human
caugcauuguugaggugguc

SEQ ID NO: 3630522 - RNA, 19 nt, Human
caugcauuuugcagcagug

SEQ ID NO: 3630523 - RNA, 17 nt, Human
caugccaacaagaaugc

SEQ ID NO: 3630524 - RNA, 20 nt, Human
caugccaacaagaaugcauu

SEQ ID NO: 3630525 - RNA, 17 nt, Human
caugccacguuccacag

SEQ ID NO: 3630526 - RNA, 19 nt, Human
caugccacuacacuccagc

SEQ ID NO: 3630527 - RNA, 14 nt, Human
caugccagcuggcc

SEQ ID NO: 3630528 - RNA, 22 nt, Human
caugccagcuggccuuuguaag

SEQ ID NO: 3630529 - RNA, 19 nt, Human
caugccagcuuaucucagg

SEQ ID NO: 3630530 - RNA, 20 nt, Human
caugccagcuuaucucaggg

SEQ ID NO: 3630531 - RNA, 13 nt, Human
caugccaggggcc

SEQ ID NO: 3630532 - RNA, 17 nt, Human
caugccaguaacaggcu

SEQ ID NO: 3630533 - RNA, 19 nt, Human
caugccauuuguacugacc

SEQ ID NO: 3630534 - RNA, 15 nt, Human
caugcccacccccug

SEQ ID NO: 3630535 - RNA, 22 nt, Human
caugcccacccccugcccugca

SEQ ID NO: 3630536 - RNA, 14 nt, Human
caugcccaccugcc

SEQ ID NO: 3630537 - RNA, 21 nt, Human
caugcccaccugcccaucaca

SEQ ID NO: 3630538 - RNA, 19 nt, Human
caugcccacguucuuuccc

SEQ ID NO: 3630539 - RNA, 14 nt, Human
caugcccagagacc

SEQ ID NO: 3630540 - RNA, 18 nt, Human
caugcccagagacccagc

SEQ ID NO: 3630541 - RNA, 18 nt, Human
caugccccaucccaugcu

SEQ ID NO: 3630542 - RNA, 16 nt, Human
caugcccccucgugcc

SEQ ID NO: 3630543 - RNA, 19 nt, Human
caugcccccucgugccagu

SEQ ID NO: 3630544 - RNA, 13 nt, Human
caugccccugaac

SEQ ID NO: 3630545 - RNA, 14 nt, Human
caugccccuggcug

SEQ ID NO: 3630546 - RNA, 15 nt, Human
caugcccucccuucu

SEQ ID NO: 3630547 - RNA, 21 nt, Human
caugcccucccuucucccugg

SEQ ID NO: 3630548 - RNA, 14 nt, Human
caugcccucucagg

SEQ ID NO: 3630549 - RNA, 20 nt, Human
caugcccuguucagcuacuc

SEQ ID NO: 3630550 - RNA, 21 nt, Human
caugccgcugcauccgugagc

SEQ ID NO: 3630551 - RNA, 19 nt, Human
caugccucagcccugaccc

SEQ ID NO: 3630552 - RNA, 14 nt, Human
caugccucucucag

SEQ ID NO: 3630553 - RNA, 16 nt, Human
caugccucucucaggc

SEQ ID NO: 3630554 - RNA, 14 nt, Human
caugccucugaggc

SEQ ID NO: 3630555 - RNA, 16 nt, Human
caugccucugaggcca

SEQ ID NO: 3630556 - RNA, 18 nt, Human
caugccucugaggccagc

SEQ ID NO: 3630557 - RNA, 20 nt, Human
caugccucugaggccagccu

SEQ ID NO: 3630558 - RNA, 21 nt, Human
caugccucugaggccagccug

SEQ ID NO: 3630559 - RNA, 22 nt, Human
caugccucugaggccagccugg

SEQ ID NO: 3630560 - RNA, 23 nt, Human
caugccucugaggccagccuggc

SEQ ID NO: 3630561 - RNA, 12 nt, Human
caugccucugau

SEQ ID NO: 3630562 - RNA, 21 nt, Human
caugccucugauaugggacug

SEQ ID NO: 3630563 - RNA, 16 nt, Human
caugccugcuuuagaa

SEQ ID NO: 3630564 - RNA, 19 nt, Human
caugccuggacaaacccuu

SEQ ID NO: 3630565 - RNA, 21 nt, Human
caugccuguccagccugggca

SEQ ID NO: 3630566 - RNA, 23 nt, Human
caugccuguccagccugggcagc

SEQ ID NO: 3630567 - RNA, 17 nt, Human
caugccuguggcugcgc

SEQ ID NO: 3630568 - RNA, 20 nt, Human
caugccuuaaaccuaccucc

SEQ ID NO: 3630569 - RNA, 21 nt, Human
caugccuuccagcacccugca

SEQ ID NO: 3630570 - RNA, 12 nt, Human
caugccuugugc

SEQ ID NO: 3630571 - RNA, 15 nt, Human
caugccuuuguaagu

SEQ ID NO: 3630572 - RNA, 23 nt, Human
caugcggagaacaaaugugaagg

SEQ ID NO: 3630573 - RNA, 14 nt, Human
caugcggcccagcc

SEQ ID NO: 3630574 - RNA, 22 nt, Human
caugcggcccagcccggcuccc

SEQ ID NO: 3630575 - RNA, 15 nt, Human
caugcgggcugggca

SEQ ID NO: 3630576 - RNA, 19 nt, Human
caugcgggcugggcagcug

SEQ ID NO: 3630577 - RNA, 20 nt, Human
caugcgggcugggcagcugu

SEQ ID NO: 3630578 - RNA, 17 nt, Human
caugcgggcuuccuccu

SEQ ID NO: 3630579 - RNA, 13 nt, Human
caugcgguagcca

SEQ ID NO: 3630580 - RNA, 22 nt, Human
caugcguggguggggagggagg

SEQ ID NO: 3630581 - RNA, 13 nt, Human
caugcuaagagaa

SEQ ID NO: 3630582 - RNA, 19 nt, Human
caugcuaagagaaguagaa

SEQ ID NO: 3630583 - RNA, 21 nt, Human
caugcuaagagaaguagaaau

SEQ ID NO: 3630584 - RNA, 16 nt, Human
caugcuaagcaagcua

SEQ ID NO: 3630585 - RNA, 14 nt, Human
caugcuaauuauau

SEQ ID NO: 3630586 - RNA, 18 nt, Human
ccaacccuguuuccugag

SEQ ID NO: 3630587 - RNA, 14 nt, Human
ccaacccuucccca

SEQ ID NO: 3630588 - RNA, 16 nt, Human
ccaacccuucuucaug

SEQ ID NO: 3630589 - RNA, 18 nt, Human
ccaaccgacaggcccugg

SEQ ID NO: 3630590 - RNA, 20 nt, Human
ccaaccucagggcucccagg

SEQ ID NO: 3630591 - RNA, 14 nt, Human
ccaaccuccugacc

SEQ ID NO: 3630592 - RNA, 14 nt, Human
ccaaccucgcucca

SEQ ID NO: 3630593 - RNA, 13 nt, Human
ccaaccugaccaa

SEQ ID NO: 3630594 - RNA, 12 nt, Human
ccaaccugcucu

SEQ ID NO: 3630595 - RNA, 13 nt, Human
ccaaccuggacaa

SEQ ID NO: 3630596 - RNA, 21 nt, Human
ccaaccuguaauaaauaugag

SEQ ID NO: 3630597 - RNA, 15 nt, Human
ccaaccuguuaccua

SEQ ID NO: 3630598 - RNA, 18 nt, Human
ccaaccuguucaagucua

SEQ ID NO: 3630599 - RNA, 17 nt, Human
ccaaccuuucccucacc

SEQ ID NO: 3630600 - RNA, 23 nt, Human
ccaaccuuucccucacccccucc

SEQ ID NO: 3630601 - RNA, 15 nt, Human
ccaacgaaaagcaca

SEQ ID NO: 3630602 - RNA, 22 nt, Human
ccaacgagcagugccgcguggc

SEQ ID NO: 3630603 - RNA, 13 nt, Human
ccaacgcacagga

SEQ ID NO: 3630604 - RNA, 18 nt, Human
ccaacguuacucagggcu

SEQ ID NO: 3630605 - RNA, 19 nt, Human
ccaacguuacucagggcuc

SEQ ID NO: 3630606 - RNA, 13 nt, Human
ccaacguuuggaa

SEQ ID NO: 3630607 - RNA, 20 nt, Human
ccaacguuuggaagauccug

SEQ ID NO: 3630608 - RNA, 19 nt, Human
ccaacuaacaagaaacuca

SEQ ID NO: 3630609 - RNA, 14 nt, Human
ccaacuacuaauag

SEQ ID NO: 3630610 - RNA, 22 nt, Human
ccaacuacuaauagaauaaagg

SEQ ID NO: 3630611 - RNA, 18 nt, Human
ccaacuagacauucuguc

SEQ ID NO: 3630612 - RNA, 17 nt, Human
ccaacuagccccugggg

SEQ ID NO: 3630613 - RNA, 13 nt, Human
ccaacucacccca

SEQ ID NO: 3630614 - RNA, 14 nt, Human
ccaacucaccugag

SEQ ID NO: 3630615 - RNA, 17 nt, Human
ccaacuccaacauccac

SEQ ID NO: 3630616 - RNA, 21 nt, Human
ccaacuccagcaacuucuucu

SEQ ID NO: 3630617 - RNA, 19 nt, Human
ccaacuccuggaagcugug

SEQ ID NO: 3630618 - RNA, 15 nt, Human
ccaacucugagccca

SEQ ID NO: 3630619 - RNA, 15 nt, Human
ccaacugaucuguua

SEQ ID NO: 3630620 - RNA, 16 nt, Human
ccaacuggcccucuuc

SEQ ID NO: 3630621 - RNA, 18 nt, Human
ccaacuggcccucuucuu

SEQ ID NO: 3630622 - RNA, 13 nt, Human
ccaacuguauaua

SEQ ID NO: 3630623 - RNA, 10 nt, Human
ccaacugugu

SEQ ID NO: 3630624 - RNA, 13 nt, Human
ccaacuguguugu

SEQ ID NO: 3630625 - RNA, 13 nt, Human
ccaacuucccagu

SEQ ID NO: 3630626 - RNA, 20 nt, Human
ccaacuugagggcccagagc

SEQ ID NO: 3630627 - RNA, 11 nt, Human
ccaacuuguaa

SEQ ID NO: 3630628 - RNA, 16 nt, Human
ccaacuuucaagaacu

SEQ ID NO: 3630629 - RNA, 14 nt, Human
ccaacuuucuguaa

SEQ ID NO: 3630630 - RNA, 11 nt, Human
ccaacuuuucu

SEQ ID NO: 3630631 - RNA, 14 nt, Human
ccaagaaacgucuu

SEQ ID NO: 3630632 - RNA, 15 nt, Human
ccaagaaagauguau

SEQ ID NO: 3630633 - RNA, 16 nt, Human
ccaagaacugaaaaca

SEQ ID NO: 3630634 - RNA, 13 nt, Human
ccaagaagcccag

SEQ ID NO: 3630635 - RNA, 19 nt, Human
ccaagaagcccaggaaagg

SEQ ID NO: 3630636 - RNA, 13 nt, Human
ccaagaaggcugg

SEQ ID NO: 3630637 - RNA, 20 nt, Human
ccaagaauagaugcugacug

SEQ ID NO: 3630638 - RNA, 16 nt, Human
ccaagaauauugcaaa

SEQ ID NO: 3630639 - RNA, 20 nt, Human
ccaagaaugcaagauuucag

SEQ ID NO: 3630640 - RNA, 18 nt, Human
ccaagaauguacguccag

SEQ ID NO: 3630641 - RNA, 16 nt, Human
ccaagacaaaucaaca

SEQ ID NO: 3630642 - RNA, 22 nt, Human
ccaagacaaaucaacagaagca

SEQ ID NO: 3630643 - RNA, 22 nt, Human
ccaagacagaugccccagagcu

SEQ ID NO: 3630644 - RNA, 24 nt, Human
ccaagacagaugccccagagcugu

SEQ ID NO: 3630645 - RNA, 21 nt, Human
ccaagacaugucuguucuaca

SEQ ID NO: 3630646 - RNA, 12 nt, Human
ccaagacauugu

SEQ ID NO: 3630647 - RNA, 17 nt, Human
ccaagacauugucaaua

SEQ ID NO: 3630648 - RNA, 17 nt, Human
ccaagaccucagggcac

SEQ ID NO: 3630649 - RNA, 15 nt, Human
ccaagaccugacuca

SEQ ID NO: 3630650 - RNA, 19 nt, Human
ccaagaccuguugguucca

SEQ ID NO: 3630651 - RNA, 23 nt, Human
ccaagacucccucgucgagcugg

SEQ ID NO: 3630652 - RNA, 13 nt, Human
ccaagacucuaga

SEQ ID NO: 3630653 - RNA, 21 nt, Human
ccaagacuuauuuucacaugu

SEQ ID NO: 3630654 - RNA, 19 nt, Human
ccaagacuugguguccuuu

SEQ ID NO: 3630655 - RNA, 22 nt, Human
ccaagacuugguguccuuuccc

SEQ ID NO: 3630656 - RNA, 15 nt, Human
ccaagagaaacuucc

SEQ ID NO: 3630657 - RNA, 12 nt, Human
ccaagagagaaa

SEQ ID NO: 3630658 - RNA, 12 nt, Human
ccaagagaugaa

SEQ ID NO: 3630659 - RNA, 22 nt, Human
ccaagagcaaggaagguaaaaa

SEQ ID NO: 3630660 - RNA, 16 nt, Human
ccaagagccugagagu

SEQ ID NO: 3630661 - RNA, 22 nt, Human
ccaagagcuacguauuuaauag

SEQ ID NO: 3630662 - RNA, 13 nt, Human
ccaagaggcuggu

SEQ ID NO: 3630663 - RNA, 14 nt, Human
ccaagaggcugguu

SEQ ID NO: 3630664 - RNA, 19 nt, Human
ccaagaggguccuuuagua

SEQ ID NO: 3630665 - RNA, 22 nt, Human
ccaagagguuuggcuccugccc

SEQ ID NO: 3630666 - RNA, 20 nt, Human
ccaagaguggccccaccugg

SEQ ID NO: 3630667 - RNA, 15 nt, Human
ccaagauaggaccuu

SEQ ID NO: 3630668 - RNA, 13 nt, Human
ccaagauuccgga

SEQ ID NO: 3630669 - RNA, 20 nt, Human
ccaagauuccggauccuaag

SEQ ID NO: 3630670 - RNA, 13 nt, Human
ccaagauucuaga

SEQ ID NO: 3630671 - RNA, 21 nt, Human
ccaagauugcgccauugcacu

SEQ ID NO: 3630672 - RNA, 16 nt, Human
ccaagauuuuccucuu

SEQ ID NO: 3630673 - RNA, 20 nt, Human
ccaagauuuuccucuuguga

SEQ ID NO: 3630674 - RNA, 15 nt, Human
ccaagcaagacugag

SEQ ID NO: 3630675 - RNA, 14 nt, Human
ccaagcaaguauua

SEQ ID NO: 3630676 - RNA, 12 nt, Human
ccaagcacagca

SEQ ID NO: 3630677 - RNA, 20 nt, Human
ccaagcacagugguggcagg

SEQ ID NO: 3630678 - RNA, 23 nt, Human
ccaagcagagaagcucucgggcu

SEQ ID NO: 3630679 - RNA, 23 nt, Human
ccaagcagagguugggaggccau

SEQ ID NO: 3630680 - RNA, 18 nt, Human
ccaagcaggaaaugaaaa

SEQ ID NO: 3630681 - RNA, 18 nt, Human
ccaagcaggacagugcuu

SEQ ID NO: 3630682 - RNA, 16 nt, Human
ccaagcaggacaugga

SEQ ID NO: 3630683 - RNA, 22 nt, Human
ccaagcaggagacgacaggcga

SEQ ID NO: 3630684 - RNA, 21 nt, Human
ccaagcauagagaagagucug

SEQ ID NO: 3630685 - RNA, 22 nt, Human
ccaagcaucuuggggggguggc

SEQ ID NO: 3630686 - RNA, 23 nt, Human
ccaagcauuuaauguagccaugg

SEQ ID NO: 3630687 - RNA, 17 nt, Human
ccaagcauuuagaugua

SEQ ID NO: 3630688 - RNA, 22 nt, Human
ccaagccaagggaaccuguguc

SEQ ID NO: 3630689 - RNA, 22 nt, Human
ccaagcccacagguguccccag

SEQ ID NO: 3630690 - RNA, 15 nt, Human
ccaagcccagcccau

SEQ ID NO: 3630691 - RNA, 17 nt, Human
ccaagcccgacuugcug

SEQ ID NO: 3630692 - RNA, 22 nt, Human
ccaagcccgacuugcuguuuug

SEQ ID NO: 3630693 - RNA, 14 nt, Human
ccaagccguggcuu

SEQ ID NO: 3630694 - RNA, 22 nt, Human
ccaagccuacuuuugccauuga

SEQ ID NO: 3630695 - RNA, 20 nt, Human
ccaagccuccacagcgaggg

SEQ ID NO: 3630696 - RNA, 20 nt, Human
ccaagcgaggucaacagaga

SEQ ID NO: 3630697 - RNA, 17 nt, Human
ccaagcggugucucucc

SEQ ID NO: 3630698 - RNA, 18 nt, Human
ccaagcuaucuaaaguuu

SEQ ID NO: 3630699 - RNA, 17 nt, Human
ccaagcucaaagcgugg

SEQ ID NO: 3630700 - RNA, 19 nt, Human
ccaagcucaggaccaggca

SEQ ID NO: 3630701 - RNA, 20 nt, Human
ccaagcucaggaccaggcaa

SEQ ID NO: 3630702 - RNA, 11 nt, Human
ccaagcucccu

SEQ ID NO: 3630703 - RNA, 19 nt, Human
ccaagcucccugccccaaa

SEQ ID NO: 3630704 - RNA, 21 nt, Human
ccaagcucccugccccaaaua

SEQ ID NO: 3630705 - RNA, 15 nt, Human
ccaagcuccuuggga

SEQ ID NO: 3630706 - RNA, 19 nt, Human
ccaagcuccuugggaggcc

SEQ ID NO: 3630707 - RNA, 14 nt, Human
ccaagcucucugca

SEQ ID NO: 3630708 - RNA, 15 nt, Human
ccaagcucucugcau

SEQ ID NO: 3630709 - RNA, 15 nt, Human
ccaagcucugcaguc

SEQ ID NO: 3630710 - RNA, 15 nt, Human
ccaagcucugcuccu

SEQ ID NO: 3630711 - RNA, 12 nt, Human
ccaagcugaggu

SEQ ID NO: 3630712 - RNA, 13 nt, Human
ccaagcugaggug

SEQ ID NO: 3630713 - RNA, 20 nt, Human
ccaagcugaggugcccagga

SEQ ID NO: 3630714 - RNA, 22 nt, Human
ccaagcugaggugcccaggaga

SEQ ID NO: 3630715 - RNA, 17 nt, Human
ccaagcugaguuuccua

SEQ ID NO: 3630716 - RNA, 18 nt, Human
ccaagcugaguuuccuau

SEQ ID NO: 3630717 - RNA, 13 nt, Human
ccaagcuggcugg

SEQ ID NO: 3630718 - RNA, 12 nt, Human
ccaagcugggcc

SEQ ID NO: 3630719 - RNA, 15 nt, Human
ccaagcugggcccca

SEQ ID NO: 3630720 - RNA, 19 nt, Human
ccaagcugggccccagccc

SEQ ID NO: 3630721 - RNA, 22 nt, Human
ccaagcugggccccagcccacc

SEQ ID NO: 3630722 - RNA, 20 nt, Human
ccaagcuggucccacucagu

SEQ ID NO: 3630723 - RNA, 17 nt, Human
ccaagcugugccacccu

SEQ ID NO: 3630724 - RNA, 22 nt, Human
ccaagcuuaggguauuuuuccu

SEQ ID NO: 3630725 - RNA, 21 nt, Human
ccaagcuuccauagcugcugc

SEQ ID NO: 3630726 - RNA, 12 nt, Human
ccaagcuucccu

SEQ ID NO: 3630727 - RNA, 13 nt, Human
ccaagcuucccuc

SEQ ID NO: 3630728 - RNA, 15 nt, Human
ccaagcuuggcagcc

SEQ ID NO: 3630729 - RNA, 17 nt, Human
ccaagcuuguuaucagc

SEQ ID NO: 3630730 - RNA, 16 nt, Human
ccaaggaaaacugcau

SEQ ID NO: 3630731 - RNA, 14 nt, Human
ccacccccucaagc

SEQ ID NO: 3630732 - RNA, 15 nt, Human
ccacccccucaagcc

SEQ ID NO: 3630733 - RNA, 22 nt, Human
ccacccccucccuggccuguuc

SEQ ID NO: 3630734 - RNA, 13 nt, Human
ccacccccugccc

SEQ ID NO: 3630735 - RNA, 14 nt, Human
ccacccccugcccu

SEQ ID NO: 3630736 - RNA, 17 nt, Human
ccacccccugcccugca

SEQ ID NO: 3630737 - RNA, 19 nt, Human
ccacccccuucucugcucc

SEQ ID NO: 3630738 - RNA, 20 nt, Human
ccacccccuucucugcucca

SEQ ID NO: 3630739 - RNA, 23 nt, Human
ccacccccuucucugcuccacca

SEQ ID NO: 3630740 - RNA, 22 nt, Human
ccaccccgcaccccgcgugucc

SEQ ID NO: 3630741 - RNA, 17 nt, Human
ccaccccgggcucucug

SEQ ID NO: 3630742 - RNA, 20 nt, Human
ccaccccggggacccuguga

SEQ ID NO: 3630743 - RNA, 14 nt, Human
ccaccccuccccau

SEQ ID NO: 3630744 - RNA, 15 nt, Human
ccaccccugccucca

SEQ ID NO: 3630745 - RNA, 16 nt, Human
ccaccccugccuccac

SEQ ID NO: 3630746 - RNA, 11 nt, Human
ccaccccugcu

SEQ ID NO: 3630747 - RNA, 14 nt, Human
ccaccccuggaaga

SEQ ID NO: 3630748 - RNA, 23 nt, Human
ccaccccuuagauugaaguaaac

SEQ ID NO: 3630749 - RNA, 13 nt, Human
ccaccccuucccc

SEQ ID NO: 3630750 - RNA, 15 nt, Human
ccaccccuuccccac

SEQ ID NO: 3630751 - RNA, 16 nt, Human
ccaccccuuccccacu

SEQ ID NO: 3630752 - RNA, 15 nt, Human
ccaccccuuccuguc

SEQ ID NO: 3630753 - RNA, 20 nt, Human
ccaccccuugcucucaaccc

SEQ ID NO: 3630754 - RNA, 17 nt, Human
ccacccgaugcugcuuu

SEQ ID NO: 3630755 - RNA, 19 nt, Human
ccacccguucugcuggccu

SEQ ID NO: 3630756 - RNA, 12 nt, Human
ccacccuaccug

SEQ ID NO: 3630757 - RNA, 21 nt, Human
ccacccuagccaaugucuccu

SEQ ID NO: 3630758 - RNA, 21 nt, Human
ccacccucacuggcucuccug

SEQ ID NO: 3630759 - RNA, 17 nt, Human
ccacccucagcaccccu

SEQ ID NO: 3630760 - RNA, 19 nt, Human
ccacccuccaccuuccauu

SEQ ID NO: 3630761 - RNA, 15 nt, Human
ccacccuccacucuc

SEQ ID NO: 3630762 - RNA, 22 nt, Human
ccacccucccagaccugccucu

SEQ ID NO: 3630763 - RNA, 15 nt, Human
ccacccuccccucuc

SEQ ID NO: 3630764 - RNA, 13 nt, Human
ccacccucccugg

SEQ ID NO: 3630765 - RNA, 15 nt, Human
ccacccucccuggag

SEQ ID NO: 3630766 - RNA, 13 nt, Human
ccacccuccuguc

SEQ ID NO: 3630767 - RNA, 14 nt, Human
ccacccuccugucu

SEQ ID NO: 3630768 - RNA, 15 nt, Human
ccacccuccugucuu

SEQ ID NO: 3630769 - RNA, 14 nt, Human
ccacccuccuuccc

SEQ ID NO: 3630770 - RNA, 18 nt, Human
ccacccugaaagcccuga

SEQ ID NO: 3630771 - RNA, 13 nt, Human
ccacccugagccg

SEQ ID NO: 3630772 - RNA, 23 nt, Human
ccacccugaggagucugaggucc

SEQ ID NO: 3630773 - RNA, 14 nt, Human
ccacccugcugcug

SEQ ID NO: 3630774 - RNA, 16 nt, Human
ccacccugcugcuggu

SEQ ID NO: 3630775 - RNA, 17 nt, Human
ccacccugcuuggccca

SEQ ID NO: 3630776 - RNA, 18 nt, Human
ccacccugcuuggcccag

SEQ ID NO: 3630777 - RNA, 20 nt, Human
ccacccuggccgaguccaag

SEQ ID NO: 3630778 - RNA, 21 nt, Human
ccacccuggccgaguccaagc

SEQ ID NO: 3630779 - RNA, 22 nt, Human
ccacccuggccgaguccaagcu

SEQ ID NO: 3630780 - RNA, 12 nt, Human
ccacccugggac

SEQ ID NO: 3630781 - RNA, 17 nt, Human
ccacccugggcccuggg

SEQ ID NO: 3630782 - RNA, 20 nt, Human
ccacccugggcccugggcug

SEQ ID NO: 3630783 - RNA, 18 nt, Human
ccacccugggcucugugg

SEQ ID NO: 3630784 - RNA, 19 nt, Human
ccacccugucccccagcuc

SEQ ID NO: 3630785 - RNA, 12 nt, Human
ccacccuguguu

SEQ ID NO: 3630786 - RNA, 16 nt, Human
ccacccuguuccugcu

SEQ ID NO: 3630787 - RNA, 16 nt, Human
ccacccuuggccuguc

SEQ ID NO: 3630788 - RNA, 12 nt, Human
ccacccuuucua

SEQ ID NO: 3630789 - RNA, 18 nt, Human
ccaccgaagccgccugug

SEQ ID NO: 3630790 - RNA, 22 nt, Human
ccaccgaaguggacuggccccu

SEQ ID NO: 3630791 - RNA, 23 nt, Human
ccaccgaaguggacuggccccug

SEQ ID NO: 3630792 - RNA, 15 nt, Human
ccaccgcagaaggaa

SEQ ID NO: 3630793 - RNA, 17 nt, Human
ccaccgcagacaggacc

SEQ ID NO: 3630794 - RNA, 18 nt, Human
ccaccgcagacaggacca

SEQ ID NO: 3630795 - RNA, 19 nt, Human
ccaccgcagacaggaccag

SEQ ID NO: 3630796 - RNA, 13 nt, Human
ccaccgcaugccc

SEQ ID NO: 3630797 - RNA, 16 nt, Human
ccaccgcaugcccccu

SEQ ID NO: 3630798 - RNA, 18 nt, Human
ccaccgcaugcccccucg

SEQ ID NO: 3630799 - RNA, 14 nt, Human
ccaccgccauggcu

SEQ ID NO: 3630800 - RNA, 17 nt, Human
ccaccgccuccuacagc

SEQ ID NO: 3630801 - RNA, 17 nt, Human
ccaccgccuugcccagc

SEQ ID NO: 3630802 - RNA, 19 nt, Human
ccaccgcugcuccacgcgc

SEQ ID NO: 3630803 - RNA, 19 nt, Human
ccaccgggccacuccuucc

SEQ ID NO: 3630804 - RNA, 19 nt, Human
ccaccgggcugggagcucu

SEQ ID NO: 3630805 - RNA, 22 nt, Human
ccaccgggcugggagcucugca

SEQ ID NO: 3630806 - RNA, 17 nt, Human
ccaccgguccagcuggc

SEQ ID NO: 3630807 - RNA, 17 nt, Human
ccaccgguugcuucugg

SEQ ID NO: 3630808 - RNA, 18 nt, Human
ccaccgguugcuucuggg

SEQ ID NO: 3630809 - RNA, 20 nt, Human
ccaccgguugcuucugggaa

SEQ ID NO: 3630810 - RNA, 14 nt, Human
ccaccguccgcccu

SEQ ID NO: 3630811 - RNA, 19 nt, Human
ccaccuaccuucaaagcug

SEQ ID NO: 3630812 - RNA, 23 nt, Human
ccaccuacuuuucuuuccucaga

SEQ ID NO: 3630813 - RNA, 13 nt, Human
ccaccuagcagca

SEQ ID NO: 3630814 - RNA, 14 nt, Human
ccaccuagcagcac

SEQ ID NO: 3630815 - RNA, 16 nt, Human
ccaccuaggccacucc

SEQ ID NO: 3630816 - RNA, 20 nt, Human
ccaccuaggccacuccucca

SEQ ID NO: 3630817 - RNA, 19 nt, Human
ccaccuaguggcuguccag

SEQ ID NO: 3630818 - RNA, 22 nt, Human
ccaccuaguggcuguccagugc

SEQ ID NO: 3630819 - RNA, 23 nt, Human
ccaccuaguggcuguccagugcc

SEQ ID NO: 3630820 - RNA, 14 nt, Human
ccaccucaaauuua

SEQ ID NO: 3630821 - RNA, 12 nt, Human
ccaccucacccc

SEQ ID NO: 3630822 - RNA, 15 nt, Human
ccaccucacuccugu

SEQ ID NO: 3630823 - RNA, 18 nt, Human
ccaccuccagcccgggag

SEQ ID NO: 3630824 - RNA, 20 nt, Human
ccaccuccaucuucuuugca

SEQ ID NO: 3630825 - RNA, 12 nt, Human
ccaccuccccac

SEQ ID NO: 3630826 - RNA, 16 nt, Human
ccaccuccccaggccg

SEQ ID NO: 3630827 - RNA, 14 nt, Human
ccaccuccccuugc

SEQ ID NO: 3630828 - RNA, 17 nt, Human
ccaccuccccuugccag

SEQ ID NO: 3630829 - RNA, 20 nt, Human
ccaccuccccuugccagcug

SEQ ID NO: 3630830 - RNA, 18 nt, Human
ccaccucccucaaccuca

SEQ ID NO: 3630831 - RNA, 15 nt, Human
ccaccucccugcaau

SEQ ID NO: 3630832 - RNA, 19 nt, Human
ccaccucccugcaauaaaa

SEQ ID NO: 3630833 - RNA, 21 nt, Human
ccaccucccugcaauaaaaug

SEQ ID NO: 3630834 - RNA, 13 nt, Human
ccaccucccugcc

SEQ ID NO: 3630835 - RNA, 19 nt, Human
ccaccuccuaaaaggccca

SEQ ID NO: 3630836 - RNA, 21 nt, Human
ccaccuccuaaaaggcccaga

SEQ ID NO: 3630837 - RNA, 14 nt, Human
ccaccuccugacac

SEQ ID NO: 3630838 - RNA, 21 nt, Human
ccaccuccugacacccuucuc

SEQ ID NO: 3630839 - RNA, 12 nt, Human
ccaccuccuucu

SEQ ID NO: 3630840 - RNA, 13 nt, Human
ccaccuccuucuc

SEQ ID NO: 3630841 - RNA, 18 nt, Human
ccaccuccuucucugucu

SEQ ID NO: 3630842 - RNA, 14 nt, Human
ccaccucuaacagc

SEQ ID NO: 3630843 - RNA, 18 nt, Human
ccaccucuaacagcacca

SEQ ID NO: 3630844 - RNA, 20 nt, Human
ccaccucuaacagcaccaaa

SEQ ID NO: 3630845 - RNA, 13 nt, Human
ccaccucucaaua

SEQ ID NO: 3630846 - RNA, 13 nt, Human
ccaccucuccaag

SEQ ID NO: 3630847 - RNA, 16 nt, Human
ccaccucucucacucc

SEQ ID NO: 3630848 - RNA, 19 nt, Human
ccaccucucucacuccuug

SEQ ID NO: 3630849 - RNA, 17 nt, Human
ccaccucucuccuuugc

SEQ ID NO: 3630850 - RNA, 18 nt, Human
ccaccucugucauuuguu

SEQ ID NO: 3630851 - RNA, 22 nt, Human
ccaccucugugaccucaggcac

SEQ ID NO: 3630852 - RNA, 13 nt, Human
ccaccucuuccug

SEQ ID NO: 3630853 - RNA, 19 nt, Human
ccaccucuucucuuccugu

SEQ ID NO: 3630854 - RNA, 17 nt, Human
ccaccugacacaccagg

SEQ ID NO: 3630855 - RNA, 20 nt, Human
ccaccugacacaccaggcgc

SEQ ID NO: 3630856 - RNA, 22 nt, Human
ccaccugaggugggcccaggac

SEQ ID NO: 3630857 - RNA, 15 nt, Human
ccaccugaguuccug

SEQ ID NO: 3630858 - RNA, 16 nt, Human
ccaccugaguuccuga

SEQ ID NO: 3630859 - RNA, 19 nt, Human
ccaccugcagggcugcccu

SEQ ID NO: 3630860 - RNA, 12 nt, Human
ccaccugccagg

SEQ ID NO: 3630861 - RNA, 13 nt, Human
ccaccugccaggg

SEQ ID NO: 3630862 - RNA, 14 nt, Human
ccaccugccaggga

SEQ ID NO: 3630863 - RNA, 15 nt, Human
ccaccugccagggac

SEQ ID NO: 3630864 - RNA, 14 nt, Human
ccaccugcccaacc

SEQ ID NO: 3630865 - RNA, 21 nt, Human
ccaccugcccccuucucccac

SEQ ID NO: 3630866 - RNA, 11 nt, Human
ccaccugccug

SEQ ID NO: 3630867 - RNA, 12 nt, Human
ccaccugccugc

SEQ ID NO: 3630868 - RNA, 15 nt, Human
ccaccugccuggccg

SEQ ID NO: 3630869 - RNA, 20 nt, Human
ccaccugccuggccggccag

SEQ ID NO: 3630870 - RNA, 22 nt, Human
ccaccugcuagugugaauuaaa

SEQ ID NO: 3630871 - RNA, 14 nt, Human
ccaccugcucccag

SEQ ID NO: 3630872 - RNA, 15 nt, Human
ccaccugcugagaga

SEQ ID NO: 3630873 - RNA, 23 nt, Human
ccaccugcugagagacccaagga

SEQ ID NO: 3630874 - RNA, 11 nt, Human
ccaccuggacc

SEQ ID NO: 3630875 - RNA, 18 nt, Human
ccaccuggaccccugcau

SEQ ID NO: 3630876 - RNA, 12 nt, Human
ccaccuggccac

SEQ ID NO: 3630877 - RNA, 22 nt, Human
ccauccacucuacccucccacc

SEQ ID NO: 3630878 - RNA, 18 nt, Human
ccauccacuuacauauau

SEQ ID NO: 3630879 - RNA, 15 nt, Human
ccauccauggccagc

SEQ ID NO: 3630880 - RNA, 18 nt, Human
ccauccauuaggccagca

SEQ ID NO: 3630881 - RNA, 22 nt, Human
ccaucccaaccagugccaagga

SEQ ID NO: 3630882 - RNA, 23 nt, Human
ccaucccaaccagugccaaggac

SEQ ID NO: 3630883 - RNA, 12 nt, Human
ccaucccacacc

SEQ ID NO: 3630884 - RNA, 14 nt, Human
ccaucccacacccu

SEQ ID NO: 3630885 - RNA, 14 nt, Human
ccaucccagccuug

SEQ ID NO: 3630886 - RNA, 23 nt, Human
ccaucccagccuuggcaucuaga

SEQ ID NO: 3630887 - RNA, 14 nt, Human
ccaucccaggacac

SEQ ID NO: 3630888 - RNA, 21 nt, Human
ccaucccaggacaccacaccc

SEQ ID NO: 3630889 - RNA, 24 nt, Human
ccaucccaggacaccacacccagc

SEQ ID NO: 3630890 - RNA, 19 nt, Human
ccaucccauaugccugggc

SEQ ID NO: 3630891 - RNA, 13 nt, Human
ccaucccauccca

SEQ ID NO: 3630892 - RNA, 15 nt, Human
ccaucccaucccauc

SEQ ID NO: 3630893 - RNA, 18 nt, Human
ccaucccaucccauccca

SEQ ID NO: 3630894 - RNA, 11 nt, Human
ccaucccauga

SEQ ID NO: 3630895 - RNA, 13 nt, Human
ccaucccaugcug

SEQ ID NO: 3630896 - RNA, 22 nt, Human
ccauccccauccuccagcuucu

SEQ ID NO: 3630897 - RNA, 15 nt, Human
ccaucccccugcccu

SEQ ID NO: 3630898 - RNA, 16 nt, Human
ccaucccgaaaaucuc

SEQ ID NO: 3630899 - RNA, 19 nt, Human
ccaucccgcucuuuuccua

SEQ ID NO: 3630900 - RNA, 14 nt, Human
ccaucccguuuaga

SEQ ID NO: 3630901 - RNA, 16 nt, Human
ccaucccuccccaguu

SEQ ID NO: 3630902 - RNA, 13 nt, Human
ccaucccucccuc

SEQ ID NO: 3630903 - RNA, 20 nt, Human
ccaucccugaaggccccgcc

SEQ ID NO: 3630904 - RNA, 12 nt, Human
ccaucccugccu

SEQ ID NO: 3630905 - RNA, 16 nt, Human
ccaucccugccugguc

SEQ ID NO: 3630906 - RNA, 17 nt, Human
ccaucccugccugguca

SEQ ID NO: 3630907 - RNA, 19 nt, Human
ccaucccuggcccccuccc

SEQ ID NO: 3630908 - RNA, 13 nt, Human
ccaucccugugag

SEQ ID NO: 3630909 - RNA, 19 nt, Human
ccaucccuuuuugaagugu

SEQ ID NO: 3630910 - RNA, 15 nt, Human
ccauccgccagggcc

SEQ ID NO: 3630911 - RNA, 20 nt, Human
ccauccgguuugccauguug

SEQ ID NO: 3630912 - RNA, 23 nt, Human
ccauccuaaucauccaaugcuca

SEQ ID NO: 3630913 - RNA, 18 nt, Human
ccauccuacccccugugc

SEQ ID NO: 3630914 - RNA, 22 nt, Human
ccauccuacccucgggcccacc

SEQ ID NO: 3630915 - RNA, 23 nt, Human
ccauccuacccucgggcccaccu

SEQ ID NO: 3630916 - RNA, 17 nt, Human
ccauccuaggcugacac

SEQ ID NO: 3630917 - RNA, 19 nt, Human
ccauccuauccacugggca

SEQ ID NO: 3630918 - RNA, 13 nt, Human
ccauccucaaaca

SEQ ID NO: 3630919 - RNA, 18 nt, Human
ccauccucaaacacugca

SEQ ID NO: 3630920 - RNA, 19 nt, Human
ccauccucaagaucauuca

SEQ ID NO: 3630921 - RNA, 14 nt, Human
ccauccuccagcag

SEQ ID NO: 3630922 - RNA, 15 nt, Human
ccauccuccagcuuc

SEQ ID NO: 3630923 - RNA, 13 nt, Human
ccauccuccccuu

SEQ ID NO: 3630924 - RNA, 15 nt, Human
ccauccuccccuucc

SEQ ID NO: 3630925 - RNA, 16 nt, Human
ccauccuccuccuucc

SEQ ID NO: 3630926 - RNA, 20 nt, Human
ccauccucuguacagagccc

SEQ ID NO: 3630927 - RNA, 16 nt, Human
ccauccugaggcucca

SEQ ID NO: 3630928 - RNA, 16 nt, Human
ccauccugcagccucc

SEQ ID NO: 3630929 - RNA, 13 nt, Human
ccauccuggccca

SEQ ID NO: 3630930 - RNA, 19 nt, Human
ccauccuggcccagggcau

SEQ ID NO: 3630931 - RNA, 14 nt, Human
ccauccuggcccau

SEQ ID NO: 3630932 - RNA, 16 nt, Human
ccauccuggcccauca

SEQ ID NO: 3630933 - RNA, 12 nt, Human
ccauccuggcua

SEQ ID NO: 3630934 - RNA, 13 nt, Human
ccauccuggcugc

SEQ ID NO: 3630935 - RNA, 17 nt, Human
ccauccugucccaccau

SEQ ID NO: 3630936 - RNA, 14 nt, Human
ccauccuguguguu

SEQ ID NO: 3630937 - RNA, 22 nt, Human
ccaucgccagcugaugacucaa

SEQ ID NO: 3630938 - RNA, 14 nt, Human
ccaucgcugugugu

SEQ ID NO: 3630939 - RNA, 23 nt, Human
ccaucgcuguguguuaguuccca

SEQ ID NO: 3630940 - RNA, 14 nt, Human
ccaucgucuucuug

SEQ ID NO: 3630941 - RNA, 16 nt, Human
ccaucuaaacugcccc

SEQ ID NO: 3630942 - RNA, 20 nt, Human
ccaucuaaauaccugcccug

SEQ ID NO: 3630943 - RNA, 14 nt, Human
ccaucuaccccugg

SEQ ID NO: 3630944 - RNA, 18 nt, Human
ccaucuaccccuggauga

SEQ ID NO: 3630945 - RNA, 13 nt, Human
ccaucuaccuucc

SEQ ID NO: 3630946 - RNA, 14 nt, Human
ccaucuaccuucca

SEQ ID NO: 3630947 - RNA, 14 nt, Human
ccaucuagccagcc

SEQ ID NO: 3630948 - RNA, 21 nt, Human
ccaucuaggggagccuugauu

SEQ ID NO: 3630949 - RNA, 18 nt, Human
ccaucucacacaugagca

SEQ ID NO: 3630950 - RNA, 17 nt, Human
ccaucucaccuccugcu

SEQ ID NO: 3630951 - RNA, 18 nt, Human
ccaucucaccuccugcug

SEQ ID NO: 3630952 - RNA, 19 nt, Human
ccaucucaccuccugcugg

SEQ ID NO: 3630953 - RNA, 21 nt, Human
ccaucucaggacacuuccgua

SEQ ID NO: 3630954 - RNA, 16 nt, Human
ccaucucaggccaccu

SEQ ID NO: 3630955 - RNA, 18 nt, Human
ccaucucaggccaccugc

SEQ ID NO: 3630956 - RNA, 20 nt, Human
ccaucucaugccccuggcug

SEQ ID NO: 3630957 - RNA, 16 nt, Human
ccaucuccaagaaugc

SEQ ID NO: 3630958 - RNA, 19 nt, Human
ccaucuccaagaaugcuga

SEQ ID NO: 3630959 - RNA, 21 nt, Human
ccaucuccaagaaugcugaaa

SEQ ID NO: 3630960 - RNA, 18 nt, Human
ccaucuccccucagcucg

SEQ ID NO: 3630961 - RNA, 23 nt, Human
ccaucuccccucagcucggcuca

SEQ ID NO: 3630962 - RNA, 24 nt, Human
ccaucucccucgaacccacacugc

SEQ ID NO: 3630963 - RNA, 13 nt, Human
ccaucucccugcc

SEQ ID NO: 3630964 - RNA, 16 nt, Human
ccaucucccugccugg

SEQ ID NO: 3630965 - RNA, 17 nt, Human
ccaucucccugccuggc

SEQ ID NO: 3630966 - RNA, 16 nt, Human
ccaucucccugcuuug

SEQ ID NO: 3630967 - RNA, 15 nt, Human
ccaucucccuggugc

SEQ ID NO: 3630968 - RNA, 20 nt, Human
ccaucuccuauaaucuguca

SEQ ID NO: 3630969 - RNA, 21 nt, Human
ccaucuccuauaaucugucaa

SEQ ID NO: 3630970 - RNA, 17 nt, Human
ccaucuccuuucaggga

SEQ ID NO: 3630971 - RNA, 18 nt, Human
ccaucuccuuucagggaa

SEQ ID NO: 3630972 - RNA, 19 nt, Human
ccaucuccuuucucuggua

SEQ ID NO: 3630973 - RNA, 14 nt, Human
ccaucucgccaccc

SEQ ID NO: 3630974 - RNA, 20 nt, Human
ccaucucgccaccccuccuu

SEQ ID NO: 3630975 - RNA, 22 nt, Human
ccaucucgccaccccuccuucc

SEQ ID NO: 3630976 - RNA, 23 nt, Human
ccaucucgccaccccuccuuccu

SEQ ID NO: 3630977 - RNA, 18 nt, Human
ccaucucgcucccuccca

SEQ ID NO: 3630978 - RNA, 13 nt, Human
ccaucucggagca

SEQ ID NO: 3630979 - RNA, 20 nt, Human
ccaucucggagcaucccgga

SEQ ID NO: 3630980 - RNA, 22 nt, Human
ccaucucggagcaucccggagg

SEQ ID NO: 3630981 - RNA, 20 nt, Human
ccaucucgggcacaggccca

SEQ ID NO: 3630982 - RNA, 18 nt, Human
ccaucucucauccuccag

SEQ ID NO: 3630983 - RNA, 14 nt, Human
ccaucucucccucc

SEQ ID NO: 3630984 - RNA, 16 nt, Human
ccaucucucuggcccu

SEQ ID NO: 3630985 - RNA, 14 nt, Human
ccaucucuuccuug

SEQ ID NO: 3630986 - RNA, 20 nt, Human
ccaucugcaccccuucucuc

SEQ ID NO: 3630987 - RNA, 15 nt, Human
ccaucugcauuccca

SEQ ID NO: 3630988 - RNA, 20 nt, Human
ccaucugcccaggggugccc

SEQ ID NO: 3630989 - RNA, 22 nt, Human
ccaucugcccaggggugccccc

SEQ ID NO: 3630990 - RNA, 17 nt, Human
ccaucugcccgccugcc

SEQ ID NO: 3630991 - RNA, 22 nt, Human
ccaucugcccgccugcccaccu

SEQ ID NO: 3630992 - RNA, 22 nt, Human
ccaucugcgugacaauaaaaca

SEQ ID NO: 3630993 - RNA, 22 nt, Human
ccaucugcugucuuuucuuugc

SEQ ID NO: 3630994 - RNA, 12 nt, Human
ccaucuggccug

SEQ ID NO: 3630995 - RNA, 16 nt, Human
ccaucugggagucccc

SEQ ID NO: 3630996 - RNA, 17 nt, Human
ccaucugggaguccccu

SEQ ID NO: 3630997 - RNA, 12 nt, Human
ccaucugggcuc

SEQ ID NO: 3630998 - RNA, 16 nt, Human
ccaucugggcuccucc

SEQ ID NO: 3630999 - RNA, 19 nt, Human
ccaucugucuaaagauaga

SEQ ID NO: 3631000 - RNA, 23 nt, Human
ccaucugugaaaggaaagaggga

SEQ ID NO: 3631001 - RNA, 12 nt, Human
ccaucugugaau

SEQ ID NO: 3631002 - RNA, 15 nt, Human
ccaucugugaauaag

SEQ ID NO: 3631003 - RNA, 12 nt, Human
ccaucugugcau

SEQ ID NO: 3631004 - RNA, 15 nt, Human
ccaucuucagcuucu

SEQ ID NO: 3631005 - RNA, 19 nt, Human
ccaucuugcccgcucaggc

SEQ ID NO: 3631006 - RNA, 21 nt, Human
ccaucuugcuucccuaaucua

SEQ ID NO: 3631007 - RNA, 14 nt, Human
ccaucuugguaaau

SEQ ID NO: 3631008 - RNA, 23 nt, Human
ccaugaaaacguuuuauuguguu

SEQ ID NO: 3631009 - RNA, 22 nt, Human
ccaugaaaaugcaacaacaugu

SEQ ID NO: 3631010 - RNA, 13 nt, Human
ccaugaaacaaag

SEQ ID NO: 3631011 - RNA, 16 nt, Human
ccaugaacacacugug

SEQ ID NO: 3631012 - RNA, 22 nt, Human
ccaugaacugucaagugugugu

SEQ ID NO: 3631013 - RNA, 14 nt, Human
ccaugaacuuuguc

SEQ ID NO: 3631014 - RNA, 17 nt, Human
ccaugaagacaggacag

SEQ ID NO: 3631015 - RNA, 19 nt, Human
ccaugaagacaggacagug

SEQ ID NO: 3631016 - RNA, 18 nt, Human
ccaugaagagauuuuuca

SEQ ID NO: 3631017 - RNA, 22 nt, Human
ccaugaagagauuuuucaugau

SEQ ID NO: 3631018 - RNA, 18 nt, Human
ccaugaagccacagccca

SEQ ID NO: 3631019 - RNA, 13 nt, Human
ccaugaagccuuu

SEQ ID NO: 3631020 - RNA, 20 nt, Human
ccaugacaauguuguagugu

SEQ ID NO: 3631021 - RNA, 12 nt, Human
ccaugacccacc

SEQ ID NO: 3631022 - RNA, 12 nt, Human
ccauuuugugaa

SEQ ID NO: 3631023 - RNA, 13 nt, Human
ccauuuugugaag

SEQ ID NO: 3631024 - RNA, 18 nt, Human
ccauuuugugaagcccug

SEQ ID NO: 3631025 - RNA, 15 nt, Human
ccauuuuucaaagca

SEQ ID NO: 3631026 - RNA, 23 nt, Human
ccauuuuucccaggcaaauaaaa

SEQ ID NO: 3631027 - RNA, 22 nt, Human
ccauuuuucuuccaggauggug

SEQ ID NO: 3631028 - RNA, 17 nt, Human
ccauuuuuuaaggaaac

SEQ ID NO: 3631029 - RNA, 14 nt, Human
ccauuuuuuauauu

SEQ ID NO: 3631030 - RNA, 16 nt, Human
ccauuuuuuauauuuc

SEQ ID NO: 3631031 - RNA, 17 nt, Human
ccauuuuuuauauuuca

SEQ ID NO: 3631032 - RNA, 20 nt, Human
cccaaaaacaaaucgcagcc

SEQ ID NO: 3631033 - RNA, 19 nt, Human
cccaaaacaccggguucca

SEQ ID NO: 3631034 - RNA, 21 nt, Human
cccaaaacaccggguuccagc

SEQ ID NO: 3631035 - RNA, 11 nt, Human
cccaaaaccaa

SEQ ID NO: 3631036 - RNA, 14 nt, Human
cccaaaagauugcu

SEQ ID NO: 3631037 - RNA, 22 nt, Human
cccaaaagucaaaaggugccug

SEQ ID NO: 3631038 - RNA, 23 nt, Human
cccaaaagucaaaaggugccugu

SEQ ID NO: 3631039 - RNA, 15 nt, Human
cccaaaaugaagauu

SEQ ID NO: 3631040 - RNA, 19 nt, Human
cccaaacaccuuccagcuc

SEQ ID NO: 3631041 - RNA, 19 nt, Human
cccaaacccaagugccuuc

SEQ ID NO: 3631042 - RNA, 15 nt, Human
cccaaaccuggagau

SEQ ID NO: 3631043 - RNA, 15 nt, Human
cccaaaccuuucccc

SEQ ID NO: 3631044 - RNA, 22 nt, Human
cccaaacgcccuuuccuccuca

SEQ ID NO: 3631045 - RNA, 21 nt, Human
cccaaagagcacaaacauuuu

SEQ ID NO: 3631046 - RNA, 15 nt, Human
cccaaagagcugccu

SEQ ID NO: 3631047 - RNA, 12 nt, Human
cccaaagaugca

SEQ ID NO: 3631048 - RNA, 15 nt, Human
cccaaagaugcagcc

SEQ ID NO: 3631049 - RNA, 13 nt, Human
cccaaagcaagca

SEQ ID NO: 3631050 - RNA, 16 nt, Human
cccaaagcagugcaug

SEQ ID NO: 3631051 - RNA, 14 nt, Human
cccaaagcuuuccu

SEQ ID NO: 3631052 - RNA, 23 nt, Human
cccaaaggaagcuuucucugcuu

SEQ ID NO: 3631053 - RNA, 18 nt, Human
cccaaaggacgcacugag

SEQ ID NO: 3631054 - RNA, 16 nt, Human
cccaaagucuguguga

SEQ ID NO: 3631055 - RNA, 20 nt, Human
cccaaagugcugagauuaca

SEQ ID NO: 3631056 - RNA, 15 nt, Human
cccaaagugcuggga

SEQ ID NO: 3631057 - RNA, 21 nt, Human
cccaaagugcuuccaaggcag

SEQ ID NO: 3631058 - RNA, 21 nt, Human
cccaaagugguauagaaaugc

SEQ ID NO: 3631059 - RNA, 17 nt, Human
cccaaaugugugcccag

SEQ ID NO: 3631060 - RNA, 16 nt, Human
cccaaauuugauugau

SEQ ID NO: 3631061 - RNA, 19 nt, Human
cccaaauuugauugauuug

SEQ ID NO: 3631062 - RNA, 15 nt, Human
cccaacaacauccau

SEQ ID NO: 3631063 - RNA, 13 nt, Human
cccaacacaaaga

SEQ ID NO: 3631064 - RNA, 17 nt, Human
cccaacaccagccccug

SEQ ID NO: 3631065 - RNA, 20 nt, Human
cccaacaccagccccugccc

SEQ ID NO: 3631066 - RNA, 15 nt, Human
cccaacacugccagc

SEQ ID NO: 3631067 - RNA, 16 nt, Human
cccaacacugccagca

SEQ ID NO: 3631068 - RNA, 15 nt, Human
cccaacacugugccc

SEQ ID NO: 3631069 - RNA, 16 nt, Human
cccaacacugugcccu

SEQ ID NO: 3631070 - RNA, 16 nt, Human
cccaacaggaggacaa

SEQ ID NO: 3631071 - RNA, 20 nt, Human
cccaacaggaggacaauuca

SEQ ID NO: 3631072 - RNA, 14 nt, Human
cccaacauauaaaa

SEQ ID NO: 3631073 - RNA, 18 nt, Human
cccaaccagugccaagga

SEQ ID NO: 3631074 - RNA, 12 nt, Human
cccaacccccag

SEQ ID NO: 3631075 - RNA, 16 nt, Human
cccaaccccugaggaa

SEQ ID NO: 3631076 - RNA, 19 nt, Human
cccaacccguggaggcugc

SEQ ID NO: 3631077 - RNA, 21 nt, Human
cccaacccguggaggcugcuc

SEQ ID NO: 3631078 - RNA, 15 nt, Human
cccaacccugccccu

SEQ ID NO: 3631079 - RNA, 14 nt, Human
cccaacccugucug

SEQ ID NO: 3631080 - RNA, 22 nt, Human
cccaaccggggagcccccgccc

SEQ ID NO: 3631081 - RNA, 19 nt, Human
cccaaccucagggcuccca

SEQ ID NO: 3631082 - RNA, 20 nt, Human
cccaaccucagggcucccag

SEQ ID NO: 3631083 - RNA, 16 nt, Human
cccaaccuccugaccu

SEQ ID NO: 3631084 - RNA, 23 nt, Human
cccaaccucuuccuccugacacc

SEQ ID NO: 3631085 - RNA, 13 nt, Human
cccaaccugcucu

SEQ ID NO: 3631086 - RNA, 21 nt, Human
cccaaccugcucuccucuucu

SEQ ID NO: 3631087 - RNA, 14 nt, Human
cccaaccugcugaa

SEQ ID NO: 3631088 - RNA, 17 nt, Human
cccaaccuuucccucac

SEQ ID NO: 3631089 - RNA, 16 nt, Human
cccaacgcacaggaaa

SEQ ID NO: 3631090 - RNA, 16 nt, Human
cccaacggcccugcag

SEQ ID NO: 3631091 - RNA, 22 nt, Human
cccaacggcccugcagccagcu

SEQ ID NO: 3631092 - RNA, 20 nt, Human
cccaacuaauuuuuguauuu

SEQ ID NO: 3631093 - RNA, 23 nt, Human
cccaacuacccccagcugugcuu

SEQ ID NO: 3631094 - RNA, 15 nt, Human
cccaacucaccccag

SEQ ID NO: 3631095 - RNA, 16 nt, Human
cccaacucuagcuggg

SEQ ID NO: 3631096 - RNA, 14 nt, Human
cccaacucugagcc

SEQ ID NO: 3631097 - RNA, 15 nt, Human
cccaacucugagccc

SEQ ID NO: 3631098 - RNA, 16 nt, Human
cccaacucugagccca

SEQ ID NO: 3631099 - RNA, 17 nt, Human
cccaacucugagcccau

SEQ ID NO: 3631100 - RNA, 23 nt, Human
cccaacucuugcacagucacugc

SEQ ID NO: 3631101 - RNA, 13 nt, Human
cccaacugucuuu

SEQ ID NO: 3631102 - RNA, 20 nt, Human
cccaacuuuguggaugucuu

SEQ ID NO: 3631103 - RNA, 19 nt, Human
cccaagaaaggaaaccuuu

SEQ ID NO: 3631104 - RNA, 21 nt, Human
cccaagaauagaugcugacug

SEQ ID NO: 3631105 - RNA, 20 nt, Human
cccaagaaugcaagauuuca

SEQ ID NO: 3631106 - RNA, 18 nt, Human
cccaagacagaugcccca

SEQ ID NO: 3631107 - RNA, 21 nt, Human
cccaagagaaggggaagcacu

SEQ ID NO: 3631108 - RNA, 15 nt, Human
cccaagagaugaaga

SEQ ID NO: 3631109 - RNA, 20 nt, Human
cccaagagcaucaugccucu

SEQ ID NO: 3631110 - RNA, 21 nt, Human
cccaagagcaucaugccucug

SEQ ID NO: 3631111 - RNA, 22 nt, Human
cccaagagcaucaugccucuga

SEQ ID NO: 3631112 - RNA, 23 nt, Human
cccaagauucacaccugacucug

SEQ ID NO: 3631113 - RNA, 17 nt, Human
cccaagauugagcucuc

SEQ ID NO: 3631114 - RNA, 16 nt, Human
cccaagcccaggccac

SEQ ID NO: 3631115 - RNA, 20 nt, Human
cccaagcccccuccuugucu

SEQ ID NO: 3631116 - RNA, 12 nt, Human
cccaagcucaga

SEQ ID NO: 3631117 - RNA, 12 nt, Human
cccaagcuccuc

SEQ ID NO: 3631118 - RNA, 14 nt, Human
cccaagcuccuccu

SEQ ID NO: 3631119 - RNA, 13 nt, Human
cccaagcugggcc

SEQ ID NO: 3631120 - RNA, 14 nt, Human
cccaagcugggccc

SEQ ID NO: 3631121 - RNA, 18 nt, Human
cccaagcugggccccagc

SEQ ID NO: 3631122 - RNA, 22 nt, Human
cccaagcuuggcagccgagcuc

SEQ ID NO: 3631123 - RNA, 14 nt, Human
cccaaggaaagccc

SEQ ID NO: 3631124 - RNA, 16 nt, Human
cccaaggacugaggga

SEQ ID NO: 3631125 - RNA, 15 nt, Human
cccaaggcggccccu

SEQ ID NO: 3631126 - RNA, 22 nt, Human
cccaaggcguccgcgcgccagc

SEQ ID NO: 3631127 - RNA, 19 nt, Human
cccaaggcugcgucuggag

SEQ ID NO: 3631128 - RNA, 16 nt, Human
cccaaggcuggcaggu

SEQ ID NO: 3631129 - RNA, 16 nt, Human
cccaagggaggcugcu

SEQ ID NO: 3631130 - RNA, 13 nt, Human
cccaagggaucug

SEQ ID NO: 3631131 - RNA, 22 nt, Human
cccaagggcaaaauucccaggg

SEQ ID NO: 3631132 - RNA, 16 nt, Human
cccaagggccuggccu

SEQ ID NO: 3631133 - RNA, 23 nt, Human
cccaagggccuggccugagcugg

SEQ ID NO: 3631134 - RNA, 18 nt, Human
cccaaggggccugagcag

SEQ ID NO: 3631135 - RNA, 17 nt, Human
cccaagggguuucuguu

SEQ ID NO: 3631136 - RNA, 22 nt, Human
cccaagguuacuuaauucaacu

SEQ ID NO: 3631137 - RNA, 19 nt, Human
cccaagguuggagcccagg

SEQ ID NO: 3631138 - RNA, 20 nt, Human
cccaaguagucugcucacag

SEQ ID NO: 3631139 - RNA, 13 nt, Human
cccaagugccaaa

SEQ ID NO: 3631140 - RNA, 15 nt, Human
cccaagugccagucu

SEQ ID NO: 3631141 - RNA, 14 nt, Human
cccaagugggggca

SEQ ID NO: 3631142 - RNA, 19 nt, Human
cccaagugggggcagaggg

SEQ ID NO: 3631143 - RNA, 18 nt, Human
cccaaguggugaaugaca

SEQ ID NO: 3631144 - RNA, 15 nt, Human
cccaaguggugccua

SEQ ID NO: 3631145 - RNA, 20 nt, Human
cccaagugguuuccacaugc

SEQ ID NO: 3631146 - RNA, 21 nt, Human
cccaagugguuuccacaugcu

SEQ ID NO: 3631147 - RNA, 15 nt, Human
cccaagugugaacaa

SEQ ID NO: 3631148 - RNA, 19 nt, Human
cccaaguucaugcagcugu

SEQ ID NO: 3631149 - RNA, 17 nt, Human
cccaaguuuugugaaau

SEQ ID NO: 3631150 - RNA, 19 nt, Human
cccaauaagauacaucaca

SEQ ID NO: 3631151 - RNA, 22 nt, Human
cccaauauccucgcucccggga

SEQ ID NO: 3631152 - RNA, 18 nt, Human
cccaauaucuugcuugaa

SEQ ID NO: 3631153 - RNA, 17 nt, Human
cccaauauuauaauuuu

SEQ ID NO: 3631154 - RNA, 15 nt, Human
cccaaucagcacuga

SEQ ID NO: 3631155 - RNA, 22 nt, Human
cccaauccagguacgcacagac

SEQ ID NO: 3631156 - RNA, 23 nt, Human
cccaauccagguacgcacagaca

SEQ ID NO: 3631157 - RNA, 24 nt, Human
cccaauccagguacgcacagacag

SEQ ID NO: 3631158 - RNA, 16 nt, Human
cccaauccaucagugc

SEQ ID NO: 3631159 - RNA, 19 nt, Human
cccaaucccagcuaccuca

SEQ ID NO: 3631160 - RNA, 12 nt, Human
cccaaucccuga

SEQ ID NO: 3631161 - RNA, 19 nt, Human
cccaaugagacuugccuuc

SEQ ID NO: 3631162 - RNA, 20 nt, Human
cccaaugcacuuuguucugg

SEQ ID NO: 3631163 - RNA, 15 nt, Human
cccaaugcugauguc

SEQ ID NO: 3631164 - RNA, 17 nt, Human
cccaaugguguuuuucu

SEQ ID NO: 3631165 - RNA, 11 nt, Human
cccaauuuccc

SEQ ID NO: 3631166 - RNA, 18 nt, Human
cccguggccaucccugug

SEQ ID NO: 3631167 - RNA, 19 nt, Human
cccguggccaucccuguga

SEQ ID NO: 3631168 - RNA, 13 nt, Human
cccguggccccag

SEQ ID NO: 3631169 - RNA, 18 nt, Human
cccguggccccagccugg

SEQ ID NO: 3631170 - RNA, 20 nt, Human
cccguggccccagccuggcc

SEQ ID NO: 3631171 - RNA, 23 nt, Human
cccguggccccagccuggcccag

SEQ ID NO: 3631172 - RNA, 14 nt, Human
cccguggggcaggg

SEQ ID NO: 3631173 - RNA, 15 nt, Human
cccgugggguuccuc

SEQ ID NO: 3631174 - RNA, 19 nt, Human
cccguguccccggccucag

SEQ ID NO: 3631175 - RNA, 17 nt, Human
cccguucugcuggccug

SEQ ID NO: 3631176 - RNA, 19 nt, Human
cccguucugcuggccugga

SEQ ID NO: 3631177 - RNA, 22 nt, Human
cccguugucucccuggcccuca

SEQ ID NO: 3631178 - RNA, 16 nt, Human
cccguuuuccccauga

SEQ ID NO: 3631179 - RNA, 18 nt, Human
cccguuuuccccaugaca

SEQ ID NO: 3631180 - RNA, 13 nt, Human
cccguuuugucac

SEQ ID NO: 3631181 - RNA, 14 nt, Human
cccuaaaagcacac

SEQ ID NO: 3631182 - RNA, 13 nt, Human
cccuaaagccuca

SEQ ID NO: 3631183 - RNA, 19 nt, Human
cccuaaauaauaaaaauaa

SEQ ID NO: 3631184 - RNA, 15 nt, Human
cccuaaaucugagga

SEQ ID NO: 3631185 - RNA, 19 nt, Human
cccuaagacuccucggccu

SEQ ID NO: 3631186 - RNA, 18 nt, Human
cccuaagagagcaccugg

SEQ ID NO: 3631187 - RNA, 15 nt, Human
cccuaagccagccug

SEQ ID NO: 3631188 - RNA, 16 nt, Human
cccuaagccagccugg

SEQ ID NO: 3631189 - RNA, 15 nt, Human
cccuaaucuaugguc

SEQ ID NO: 3631190 - RNA, 16 nt, Human
cccuaauucagccaug

SEQ ID NO: 3631191 - RNA, 19 nt, Human
cccuaauuuaacccagcuc

SEQ ID NO: 3631192 - RNA, 13 nt, Human
cccuacagagcug

SEQ ID NO: 3631193 - RNA, 19 nt, Human
cccuaccaccuccccagcc

SEQ ID NO: 3631194 - RNA, 23 nt, Human
cccuaccagcgcccgcugggcug

SEQ ID NO: 3631195 - RNA, 21 nt, Human
cccuaccccacaccaggccgu

SEQ ID NO: 3631196 - RNA, 23 nt, Human
cccuaccccuggcuguacugcuc

SEQ ID NO: 3631197 - RNA, 14 nt, Human
cccuacccucuaga

SEQ ID NO: 3631198 - RNA, 14 nt, Human
cccuacccuggacu

SEQ ID NO: 3631199 - RNA, 18 nt, Human
cccuaccgagucucuucu

SEQ ID NO: 3631200 - RNA, 14 nt, Human
cccuaccugcccca

SEQ ID NO: 3631201 - RNA, 14 nt, Human
cccuaccugugccu

SEQ ID NO: 3631202 - RNA, 18 nt, Human
cccuacucccugcagaug

SEQ ID NO: 3631203 - RNA, 19 nt, Human
cccuacucccugcagaugc

SEQ ID NO: 3631204 - RNA, 21 nt, Human
cccuacucccugcagaugcca

SEQ ID NO: 3631205 - RNA, 14 nt, Human
cccuacugcuguga

SEQ ID NO: 3631206 - RNA, 18 nt, Human
cccuacuucuuuugcucu

SEQ ID NO: 3631207 - RNA, 19 nt, Human
cccuacuucuuuugcucuu

SEQ ID NO: 3631208 - RNA, 18 nt, Human
cccuagaaacccaagcuc

SEQ ID NO: 3631209 - RNA, 17 nt, Human
cccuagaaacuuccaaa

SEQ ID NO: 3631210 - RNA, 19 nt, Human
cccuagaaucagccuaggg

SEQ ID NO: 3631211 - RNA, 20 nt, Human
cccuagagccugccuggagc

SEQ ID NO: 3631212 - RNA, 19 nt, Human
cccuagaggguuccuguag

SEQ ID NO: 3631213 - RNA, 14 nt, Human
cccuagagucccag

SEQ ID NO: 3631214 - RNA, 18 nt, Human
cccuagauaguuuauuau

SEQ ID NO: 3631215 - RNA, 20 nt, Human
cccuagcagcccacccugcu

SEQ ID NO: 3631216 - RNA, 20 nt, Human
cccuagccaaugucuccucc

SEQ ID NO: 3631217 - RNA, 17 nt, Human
cccuagccagcacuugu

SEQ ID NO: 3631218 - RNA, 20 nt, Human
cccuagcggcagaaaggaaa

SEQ ID NO: 3631219 - RNA, 21 nt, Human
cccuagcuuuauauauggaca

SEQ ID NO: 3631220 - RNA, 14 nt, Human
cccuaggagaccaa

SEQ ID NO: 3631221 - RNA, 20 nt, Human
cccuaggaguauauuuccgc

SEQ ID NO: 3631222 - RNA, 21 nt, Human
cccuaggaguauauuuccgca

SEQ ID NO: 3631223 - RNA, 13 nt, Human
cccuagggcuggg

SEQ ID NO: 3631224 - RNA, 17 nt, Human
cccuagggcugggugua

SEQ ID NO: 3631225 - RNA, 22 nt, Human
cccuaggucagcuugcugcccu

SEQ ID NO: 3631226 - RNA, 22 nt, Human
cccuagguguuuuguucaccau

SEQ ID NO: 3631227 - RNA, 15 nt, Human
cccuagguucccugu

SEQ ID NO: 3631228 - RNA, 18 nt, Human
cccuagguucccuguucu

SEQ ID NO: 3631229 - RNA, 19 nt, Human
cccuagguucccuguucuu

SEQ ID NO: 3631230 - RNA, 23 nt, Human
cccuagguucccuguucuuccuc

SEQ ID NO: 3631231 - RNA, 17 nt, Human
cccuaguaagugccuuc

SEQ ID NO: 3631232 - RNA, 19 nt, Human
cccuaguucuaccucaggc

SEQ ID NO: 3631233 - RNA, 14 nt, Human
cccuauccacccag

SEQ ID NO: 3631234 - RNA, 19 nt, Human
cccuauccacccagcccau

SEQ ID NO: 3631235 - RNA, 22 nt, Human
cccuauccuacuuccccuuccu

SEQ ID NO: 3631236 - RNA, 17 nt, Human
cccuaucuaacccuccc

SEQ ID NO: 3631237 - RNA, 14 nt, Human
cccuaucuccugac

SEQ ID NO: 3631238 - RNA, 22 nt, Human
cccuaucuccugacagaaggug

SEQ ID NO: 3631239 - RNA, 14 nt, Human
cccuaucuguauuc

SEQ ID NO: 3631240 - RNA, 22 nt, Human
cccuaugaaguaaagaacugca

SEQ ID NO: 3631241 - RNA, 16 nt, Human
cccuauggaugugggg

SEQ ID NO: 3631242 - RNA, 13 nt, Human
cccuauuaaccua

SEQ ID NO: 3631243 - RNA, 14 nt, Human
cccuauuuugccau

SEQ ID NO: 3631244 - RNA, 20 nt, Human
cccuauuuuucucuccuguc

SEQ ID NO: 3631245 - RNA, 18 nt, Human
cccucaaaugacccaaag

SEQ ID NO: 3631246 - RNA, 18 nt, Human
cccucaacaagggagaga

SEQ ID NO: 3631247 - RNA, 18 nt, Human
cccucaaccucauccucu

SEQ ID NO: 3631248 - RNA, 20 nt, Human
cccucaagccaauccccucc

SEQ ID NO: 3631249 - RNA, 21 nt, Human
cccucaagccaauccccuccu

SEQ ID NO: 3631250 - RNA, 22 nt, Human
cccucaaggacaaagucuccag

SEQ ID NO: 3631251 - RNA, 19 nt, Human
cccucaaggccucccacag

SEQ ID NO: 3631252 - RNA, 19 nt, Human
cccucaauucccccuggcc

SEQ ID NO: 3631253 - RNA, 15 nt, Human
cccucacacacccug

SEQ ID NO: 3631254 - RNA, 17 nt, Human
cccucacacauccagac

SEQ ID NO: 3631255 - RNA, 12 nt, Human
cccucacacugg

SEQ ID NO: 3631256 - RNA, 14 nt, Human
cccucacacuggga

SEQ ID NO: 3631257 - RNA, 13 nt, Human
cccucacauuccu

SEQ ID NO: 3631258 - RNA, 14 nt, Human
cccucaccaggggc

SEQ ID NO: 3631259 - RNA, 11 nt, Human
cccucacccau

SEQ ID NO: 3631260 - RNA, 18 nt, Human
cccucacccccucccacc

SEQ ID NO: 3631261 - RNA, 17 nt, Human
cccucacccccuccuuc

SEQ ID NO: 3631262 - RNA, 13 nt, Human
cccucaccccugc

SEQ ID NO: 3631263 - RNA, 16 nt, Human
cccucacccuggggcu

SEQ ID NO: 3631264 - RNA, 14 nt, Human
cccucaccuccucu

SEQ ID NO: 3631265 - RNA, 14 nt, Human
cccucaccugggca

SEQ ID NO: 3631266 - RNA, 21 nt, Human
cccucaccuuggcaccagaca

SEQ ID NO: 3631267 - RNA, 15 nt, Human
cccucacucucuaca

SEQ ID NO: 3631268 - RNA, 16 nt, Human
cccucacucugccagg

SEQ ID NO: 3631269 - RNA, 17 nt, Human
cccucacucugccaggg

SEQ ID NO: 3631270 - RNA, 18 nt, Human
cccucacucugccagggc

SEQ ID NO: 3631271 - RNA, 20 nt, Human
cccucacucugccagggcag

SEQ ID NO: 3631272 - RNA, 16 nt, Human
cccucacucuggccuc

SEQ ID NO: 3631273 - RNA, 17 nt, Human
cccucagaaacacuggg

SEQ ID NO: 3631274 - RNA, 22 nt, Human
cccucagaacccuuggcuugcc

SEQ ID NO: 3631275 - RNA, 21 nt, Human
cccucagaaggucuguuuuga

SEQ ID NO: 3631276 - RNA, 13 nt, Human
cccucagagccac

SEQ ID NO: 3631277 - RNA, 15 nt, Human
cccucagagugcaag

SEQ ID NO: 3631278 - RNA, 16 nt, Human
cccucagcaccccuuc

SEQ ID NO: 3631279 - RNA, 18 nt, Human
cccucagcaccccuucca

SEQ ID NO: 3631280 - RNA, 20 nt, Human
cccucagccccaccccaggu

SEQ ID NO: 3631281 - RNA, 17 nt, Human
cccucaggacugcaaca

SEQ ID NO: 3631282 - RNA, 20 nt, Human
cccucaggcauaggccuggg

SEQ ID NO: 3631283 - RNA, 23 nt, Human
cccucaggcauaggccugggugc

SEQ ID NO: 3631284 - RNA, 12 nt, Human
cccucagggauc

SEQ ID NO: 3631285 - RNA, 16 nt, Human
cccucagggcaaagcc

SEQ ID NO: 3631286 - RNA, 15 nt, Human
cccucaggggaaaac

SEQ ID NO: 3631287 - RNA, 15 nt, Human
cccucagggucccug

SEQ ID NO: 3631288 - RNA, 17 nt, Human
cccucagggucccuggu

SEQ ID NO: 3631289 - RNA, 19 nt, Human
cccucaggucccuugguca

SEQ ID NO: 3631290 - RNA, 19 nt, Human
cccucaguagucccugcac

SEQ ID NO: 3631291 - RNA, 18 nt, Human
cccucaguugugcagcuu

SEQ ID NO: 3631292 - RNA, 17 nt, Human
cccucaucuaugaggaa

SEQ ID NO: 3631293 - RNA, 13 nt, Human
cccucaucucucc

SEQ ID NO: 3631294 - RNA, 17 nt, Human
cccucaucucucugccc

SEQ ID NO: 3631295 - RNA, 21 nt, Human
cccucaucuugaagggcccag

SEQ ID NO: 3631296 - RNA, 21 nt, Human
cccucaucuuucaucaaucau

SEQ ID NO: 3631297 - RNA, 14 nt, Human
cccucaugcugcca

SEQ ID NO: 3631298 - RNA, 12 nt, Human
cccucaugcugu

SEQ ID NO: 3631299 - RNA, 17 nt, Human
cccucauucaggaaaac

SEQ ID NO: 3631300 - RNA, 22 nt, Human
cccucauuccaccuucccaugc

SEQ ID NO: 3631301 - RNA, 19 nt, Human
cccucauuggcucuugaac

SEQ ID NO: 3631302 - RNA, 11 nt, Human
cccucauuuuu

SEQ ID NO: 3631303 - RNA, 18 nt, Human
cccuccaaaagcacuuac

SEQ ID NO: 3631304 - RNA, 16 nt, Human
cccuccaaggccaggc

SEQ ID NO: 3631305 - RNA, 15 nt, Human
cccuccaauccugcc

SEQ ID NO: 3631306 - RNA, 13 nt, Human
cccuccacaccug

SEQ ID NO: 3631307 - RNA, 16 nt, Human
cccuccacagccgcag

SEQ ID NO: 3631308 - RNA, 15 nt, Human
cccuccaccccagga

SEQ ID NO: 3631309 - RNA, 16 nt, Human
cccuccacccuguccc

SEQ ID NO: 3631310 - RNA, 17 nt, Human
cccuccaccucccugca

SEQ ID NO: 3631311 - RNA, 16 nt, Human
cccugccaccugucug

SEQ ID NO: 3631312 - RNA, 17 nt, Human
cccugccaccugucugu

SEQ ID NO: 3631313 - RNA, 18 nt, Human
cccugccacucacuaggc

SEQ ID NO: 3631314 - RNA, 12 nt, Human
cccugccagcuc

SEQ ID NO: 3631315 - RNA, 19 nt, Human
cccugccaggcacaggcag

SEQ ID NO: 3631316 - RNA, 22 nt, Human
cccugccaggcacaggcagggc

SEQ ID NO: 3631317 - RNA, 14 nt, Human
cccugccagugccu

SEQ ID NO: 3631318 - RNA, 14 nt, Human
cccugccaucuucc

SEQ ID NO: 3631319 - RNA, 16 nt, Human
cccugccaucuuccca

SEQ ID NO: 3631320 - RNA, 19 nt, Human
cccugccaucuucccagca

SEQ ID NO: 3631321 - RNA, 18 nt, Human
cccugcccacaccuccug

SEQ ID NO: 3631322 - RNA, 19 nt, Human
cccugcccacaccuccugg

SEQ ID NO: 3631323 - RNA, 17 nt, Human
cccugcccaccuggccu

SEQ ID NO: 3631324 - RNA, 21 nt, Human
cccugcccagaucagccagaa

SEQ ID NO: 3631325 - RNA, 10 nt, Human
cccugcccau

SEQ ID NO: 3631326 - RNA, 12 nt, Human
cccugccccaaa

SEQ ID NO: 3631327 - RNA, 18 nt, Human
cccugccccacaccuccu

SEQ ID NO: 3631328 - RNA, 13 nt, Human
cccugccccagcc

SEQ ID NO: 3631329 - RNA, 15 nt, Human
cccugccccagccca

SEQ ID NO: 3631330 - RNA, 13 nt, Human
cccugcccccagg

SEQ ID NO: 3631331 - RNA, 18 nt, Human
cccugcccccaggacugg

SEQ ID NO: 3631332 - RNA, 20 nt, Human
cccugcccccaggacugggc

SEQ ID NO: 3631333 - RNA, 23 nt, Human
cccugcccccaggacugggccac

SEQ ID NO: 3631334 - RNA, 16 nt, Human
cccugccccccagccu

SEQ ID NO: 3631335 - RNA, 23 nt, Human
cccugcccccuccccuucacacc

SEQ ID NO: 3631336 - RNA, 14 nt, Human
cccugcccccugca

SEQ ID NO: 3631337 - RNA, 16 nt, Human
cccugcccccugcagg

SEQ ID NO: 3631338 - RNA, 19 nt, Human
cccugcccccugcaggaag

SEQ ID NO: 3631339 - RNA, 21 nt, Human
cccugccccgucaccaucuca

SEQ ID NO: 3631340 - RNA, 17 nt, Human
cccugccccugccccgu

SEQ ID NO: 3631341 - RNA, 14 nt, Human
cccugcccggcugc

SEQ ID NO: 3631342 - RNA, 17 nt, Human
cccugcccuagcuccac

SEQ ID NO: 3631343 - RNA, 10 nt, Human
cccugcccuc

SEQ ID NO: 3631344 - RNA, 18 nt, Human
cccugcccucaucucucu

SEQ ID NO: 3631345 - RNA, 20 nt, Human
cccugcccucguggccagcc

SEQ ID NO: 3631346 - RNA, 17 nt, Human
cccugcccugaggaagg

SEQ ID NO: 3631347 - RNA, 11 nt, Human
cccugcccugc

SEQ ID NO: 3631348 - RNA, 12 nt, Human
cccugcccugca

SEQ ID NO: 3631349 - RNA, 18 nt, Human
cccugcccugccaccugu

SEQ ID NO: 3631350 - RNA, 15 nt, Human
cccugcccugugggc

SEQ ID NO: 3631351 - RNA, 19 nt, Human
cccugcccuucagcauccu

SEQ ID NO: 3631352 - RNA, 15 nt, Human
cccugccgucaccac

SEQ ID NO: 3631353 - RNA, 17 nt, Human
cccugccgucaccacca

SEQ ID NO: 3631354 - RNA, 22 nt, Human
cccugccgucaccaccaccccu

SEQ ID NO: 3631355 - RNA, 15 nt, Human
cccugccucaccucu

SEQ ID NO: 3631356 - RNA, 19 nt, Human
cccugccuccacccucuga

SEQ ID NO: 3631357 - RNA, 20 nt, Human
cccugccuccacccucugag

SEQ ID NO: 3631358 - RNA, 12 nt, Human
cccugccuccau

SEQ ID NO: 3631359 - RNA, 11 nt, Human
cccugccuccu

SEQ ID NO: 3631360 - RNA, 14 nt, Human
cccugccuccuuug

SEQ ID NO: 3631361 - RNA, 11 nt, Human
cccugccucuc

SEQ ID NO: 3631362 - RNA, 12 nt, Human
cccugccucuca

SEQ ID NO: 3631363 - RNA, 22 nt, Human
cccugccucucaucaacugaau

SEQ ID NO: 3631364 - RNA, 19 nt, Human
cccugccucucccaggcag

SEQ ID NO: 3631365 - RNA, 14 nt, Human
cccugccucuccgc

SEQ ID NO: 3631366 - RNA, 16 nt, Human
cccugccucuccgccc

SEQ ID NO: 3631367 - RNA, 20 nt, Human
cccugccugagggccccucu

SEQ ID NO: 3631368 - RNA, 13 nt, Human
cccugccugcccu

SEQ ID NO: 3631369 - RNA, 23 nt, Human
cccugccugcccugucaggaggc

SEQ ID NO: 3631370 - RNA, 10 nt, Human
cccugccugg

SEQ ID NO: 3631371 - RNA, 12 nt, Human
cccugccuggac

SEQ ID NO: 3631372 - RNA, 13 nt, Human
cccugccuggacc

SEQ ID NO: 3631373 - RNA, 13 nt, Human
cccugccuggagg

SEQ ID NO: 3631374 - RNA, 23 nt, Human
cccugccuggaggaccugagccu

SEQ ID NO: 3631375 - RNA, 22 nt, Human
cccugccuuaucuugcacccca

SEQ ID NO: 3631376 - RNA, 19 nt, Human
cccugccuuugggagcagg

SEQ ID NO: 3631377 - RNA, 15 nt, Human
cccugcgccugugau

SEQ ID NO: 3631378 - RNA, 21 nt, Human
cccugcgggucacaggaggga

SEQ ID NO: 3631379 - RNA, 17 nt, Human
cccugcgguagauggga

SEQ ID NO: 3631380 - RNA, 15 nt, Human
cccugcguggggaca

SEQ ID NO: 3631381 - RNA, 13 nt, Human
cccugcuacaccu

SEQ ID NO: 3631382 - RNA, 16 nt, Human
cccugcuacaccuauu

SEQ ID NO: 3631383 - RNA, 10 nt, Human
cccugcuccc

SEQ ID NO: 3631384 - RNA, 13 nt, Human
cccugcuccuccc

SEQ ID NO: 3631385 - RNA, 20 nt, Human
cccugcuccucccuggcugc

SEQ ID NO: 3631386 - RNA, 12 nt, Human
cccugcuccugc

SEQ ID NO: 3631387 - RNA, 16 nt, Human
cccugcuccugcagca

SEQ ID NO: 3631388 - RNA, 23 nt, Human
cccugcugagucccaggcugagc

SEQ ID NO: 3631389 - RNA, 13 nt, Human
cccugcugcaggg

SEQ ID NO: 3631390 - RNA, 11 nt, Human
cccugcugccc

SEQ ID NO: 3631391 - RNA, 13 nt, Human
cccugcugcccuc

SEQ ID NO: 3631392 - RNA, 14 nt, Human
cccugcugccuccc

SEQ ID NO: 3631393 - RNA, 16 nt, Human
cccugcugccucccca

SEQ ID NO: 3631394 - RNA, 13 nt, Human
cccugcugccuuc

SEQ ID NO: 3631395 - RNA, 19 nt, Human
cccugcugccuucugacgg

SEQ ID NO: 3631396 - RNA, 17 nt, Human
cccugcugcugacccag

SEQ ID NO: 3631397 - RNA, 17 nt, Human
cccugcuggccgccuca

SEQ ID NO: 3631398 - RNA, 22 nt, Human
cccugcuggguguggcgcagca

SEQ ID NO: 3631399 - RNA, 10 nt, Human
cccugcuguc

SEQ ID NO: 3631400 - RNA, 19 nt, Human
cccugcugucauugcuucu

SEQ ID NO: 3631401 - RNA, 12 nt, Human
cccugcuguccc

SEQ ID NO: 3631402 - RNA, 16 nt, Human
cccugcuguccccucu

SEQ ID NO: 3631403 - RNA, 17 nt, Human
cccugcuguccccucuu

SEQ ID NO: 3631404 - RNA, 18 nt, Human
cccugcuguccccucuug

SEQ ID NO: 3631405 - RNA, 19 nt, Human
cccugcuguccccucuugc

SEQ ID NO: 3631406 - RNA, 14 nt, Human
cccugcuguuuauc

SEQ ID NO: 3631407 - RNA, 21 nt, Human
cccugcuucaauacccaaauc

SEQ ID NO: 3631408 - RNA, 23 nt, Human
cccugcuucagauguggagccag

SEQ ID NO: 3631409 - RNA, 18 nt, Human
cccugcuuccaccucacc

SEQ ID NO: 3631410 - RNA, 21 nt, Human
cccugcuuccaccucacccca

SEQ ID NO: 3631411 - RNA, 14 nt, Human
cccugcuuccagga

SEQ ID NO: 3631412 - RNA, 11 nt, Human
cccugcuucuc

SEQ ID NO: 3631413 - RNA, 14 nt, Human
cccugcuuucagau

SEQ ID NO: 3631414 - RNA, 17 nt, Human
cccugcuuucagauacu

SEQ ID NO: 3631415 - RNA, 16 nt, Human
cccuggaaaccuucca

SEQ ID NO: 3631416 - RNA, 20 nt, Human
cccuggaacucuaucugggc

SEQ ID NO: 3631417 - RNA, 15 nt, Human
cccuggaagcagugc

SEQ ID NO: 3631418 - RNA, 21 nt, Human
cccuggaaggacauccauguu

SEQ ID NO: 3631419 - RNA, 17 nt, Human
cccuggacaagcagagg

SEQ ID NO: 3631420 - RNA, 18 nt, Human
cccuggacccagccagaa

SEQ ID NO: 3631421 - RNA, 17 nt, Human
cccuggaccccagccuc

SEQ ID NO: 3631422 - RNA, 13 nt, Human
cccuggacuggga

SEQ ID NO: 3631423 - RNA, 15 nt, Human
cccuggacugugugc

SEQ ID NO: 3631424 - RNA, 21 nt, Human
cccuggagaggcccucuggag

SEQ ID NO: 3631425 - RNA, 22 nt, Human
cccuggagaguucaauggcugc

SEQ ID NO: 3631426 - RNA, 20 nt, Human
cccuggagcagccaccccau

SEQ ID NO: 3631427 - RNA, 12 nt, Human
cccuggagccag

SEQ ID NO: 3631428 - RNA, 19 nt, Human
cccuggaggcacugaagug

SEQ ID NO: 3631429 - RNA, 23 nt, Human
cccuggaggcggugcggcaggga

SEQ ID NO: 3631430 - RNA, 18 nt, Human
cccuggaggcugccuccc

SEQ ID NO: 3631431 - RNA, 15 nt, Human
cccuggaggugccag

SEQ ID NO: 3631432 - RNA, 18 nt, Human
cccuggaggugccagcaa

SEQ ID NO: 3631433 - RNA, 22 nt, Human
cccuggaggugccagcaaagcc

SEQ ID NO: 3631434 - RNA, 15 nt, Human
cccuggagugcaguu

SEQ ID NO: 3631435 - RNA, 23 nt, Human
cccuggaguguggcugaggaggc

SEQ ID NO: 3631436 - RNA, 23 nt, Human
cccuggaucacgacgcugcagag

SEQ ID NO: 3631437 - RNA, 20 nt, Human
cccuggaucagcguggccuu

SEQ ID NO: 3631438 - RNA, 21 nt, Human
cccuggaucuaccuggaggga

SEQ ID NO: 3631439 - RNA, 20 nt, Human
cccuggcaugucaacagcgu

SEQ ID NO: 3631440 - RNA, 20 nt, Human
cccuggccaccaccccccac

SEQ ID NO: 3631441 - RNA, 13 nt, Human
cccuggccagagg

SEQ ID NO: 3631442 - RNA, 13 nt, Human
cccuggccaucuc

SEQ ID NO: 3631443 - RNA, 21 nt, Human
cccuggcccagcggccccucc

SEQ ID NO: 3631444 - RNA, 12 nt, Human
cccuggccccca

SEQ ID NO: 3631445 - RNA, 11 nt, Human
cccuggccccu

SEQ ID NO: 3631446 - RNA, 17 nt, Human
cccuggcccugaggugu

SEQ ID NO: 3631447 - RNA, 20 nt, Human
cccuggccgaguccaagcug

SEQ ID NO: 3631448 - RNA, 15 nt, Human
cccuggccgcccccu

SEQ ID NO: 3631449 - RNA, 14 nt, Human
cccuggccuccccu

SEQ ID NO: 3631450 - RNA, 20 nt, Human
cccuggccuccccugccacc

SEQ ID NO: 3631451 - RNA, 19 nt, Human
cccuggccucugugccuuc

SEQ ID NO: 3631452 - RNA, 13 nt, Human
cccuggccugcug

SEQ ID NO: 3631453 - RNA, 21 nt, Human
cccuggccugcugggcucucc

SEQ ID NO: 3631454 - RNA, 22 nt, Human
cccuggccuugggcccucuggu

SEQ ID NO: 3631455 - RNA, 17 nt, Human
cccuggccuuucauauu

SEQ ID NO: 3631456 - RNA, 22 nt, Human
cccuggcggccccaacucgggc

SEQ ID NO: 3631457 - RNA, 19 nt, Human
ccuccggcgucagccucca

SEQ ID NO: 3631458 - RNA, 20 nt, Human
ccuccggcgucagccuccag

SEQ ID NO: 3631459 - RNA, 18 nt, Human
ccuccgggaccuggugcu

SEQ ID NO: 3631460 - RNA, 14 nt, Human
ccuccgucacuacc

SEQ ID NO: 3631461 - RNA, 14 nt, Human
ccuccuaaaacaac

SEQ ID NO: 3631462 - RNA, 16 nt, Human
ccuccuaccccuccca

SEQ ID NO: 3631463 - RNA, 19 nt, Human
ccuccuaccccucccagcu

SEQ ID NO: 3631464 - RNA, 20 nt, Human
ccuccuaccccucccagcug

SEQ ID NO: 3631465 - RNA, 19 nt, Human
ccuccuaucaccuccccuc

SEQ ID NO: 3631466 - RNA, 13 nt, Human
ccuccucaccccg

SEQ ID NO: 3631467 - RNA, 15 nt, Human
ccuccucaccucaug

SEQ ID NO: 3631468 - RNA, 14 nt, Human
ccuccucaccucug

SEQ ID NO: 3631469 - RNA, 15 nt, Human
ccuccucaccucugg

SEQ ID NO: 3631470 - RNA, 14 nt, Human
ccuccucacuggcc

SEQ ID NO: 3631471 - RNA, 19 nt, Human
ccuccucacuggccauccc

SEQ ID NO: 3631472 - RNA, 21 nt, Human
ccuccucaggcacacagcuac

SEQ ID NO: 3631473 - RNA, 13 nt, Human
ccuccucagggau

SEQ ID NO: 3631474 - RNA, 12 nt, Human
ccuccucaugua

SEQ ID NO: 3631475 - RNA, 21 nt, Human
ccuccucauguacauacccug

SEQ ID NO: 3631476 - RNA, 15 nt, Human
ccuccuccacaccag

SEQ ID NO: 3631477 - RNA, 12 nt, Human
ccuccuccagcc

SEQ ID NO: 3631478 - RNA, 20 nt, Human
ccuccuccagccccuguccc

SEQ ID NO: 3631479 - RNA, 20 nt, Human
ccuccuccagggugauuuua

SEQ ID NO: 3631480 - RNA, 16 nt, Human
ccuccucccacccggc

SEQ ID NO: 3631481 - RNA, 19 nt, Human
ccuccucccacccggcugc

SEQ ID NO: 3631482 - RNA, 14 nt, Human
ccuccucccacugc

SEQ ID NO: 3631483 - RNA, 14 nt, Human
ccuccucccauguc

SEQ ID NO: 3631484 - RNA, 19 nt, Human
ccuccucccucccagcucc

SEQ ID NO: 3631485 - RNA, 14 nt, Human
ccuccucccugcau

SEQ ID NO: 3631486 - RNA, 16 nt, Human
ccuccucccugcaucu

SEQ ID NO: 3631487 - RNA, 14 nt, Human
ccuccucccuuuuu

SEQ ID NO: 3631488 - RNA, 17 nt, Human
ccuccucccuuuuuccu

SEQ ID NO: 3631489 - RNA, 24 nt, Human
ccuccucggaaccgcucaccuaga

SEQ ID NO: 3631490 - RNA, 18 nt, Human
ccuccucguuccuuucuc

SEQ ID NO: 3631491 - RNA, 19 nt, Human
ccuccucuaagguugggca

SEQ ID NO: 3631492 - RNA, 13 nt, Human
ccuccucucacuc

SEQ ID NO: 3631493 - RNA, 14 nt, Human
ccuccucuccacca

SEQ ID NO: 3631494 - RNA, 19 nt, Human
ccuccucucccauccuuga

SEQ ID NO: 3631495 - RNA, 10 nt, Human
ccuccucuga

SEQ ID NO: 3631496 - RNA, 17 nt, Human
ccuccucugaaacagcu

SEQ ID NO: 3631497 - RNA, 15 nt, Human
ccuccucugccaccu

SEQ ID NO: 3631498 - RNA, 18 nt, Human
ccuccucugccaccuccc

SEQ ID NO: 3631499 - RNA, 13 nt, Human
ccuccucugcuug

SEQ ID NO: 3631500 - RNA, 20 nt, Human
ccuccucuggacggcaggcu

SEQ ID NO: 3631501 - RNA, 18 nt, Human
ccuccucuguccagggcc

SEQ ID NO: 3631502 - RNA, 14 nt, Human
ccuccucugucccu

SEQ ID NO: 3631503 - RNA, 14 nt, Human
ccuccucugucugc

SEQ ID NO: 3631504 - RNA, 16 nt, Human
ccuccucugucugccc

SEQ ID NO: 3631505 - RNA, 22 nt, Human
ccuccucugugaccaaugucuu

SEQ ID NO: 3631506 - RNA, 17 nt, Human
ccuccucuucugacgug

SEQ ID NO: 3631507 - RNA, 14 nt, Human
ccuccucuuucucu

SEQ ID NO: 3631508 - RNA, 15 nt, Human
ccuccucuuucucuc

SEQ ID NO: 3631509 - RNA, 20 nt, Human
ccuccugaaccgcacagcuc

SEQ ID NO: 3631510 - RNA, 20 nt, Human
ccuccugacacaccugcagc

SEQ ID NO: 3631511 - RNA, 18 nt, Human
ccuccugacacccuucuc

SEQ ID NO: 3631512 - RNA, 22 nt, Human
ccuccugacacccuucucccac

SEQ ID NO: 3631513 - RNA, 20 nt, Human
ccuccugacccauugcuguu

SEQ ID NO: 3631514 - RNA, 12 nt, Human
ccuccugcccag

SEQ ID NO: 3631515 - RNA, 15 nt, Human
ccuccugcccagucc

SEQ ID NO: 3631516 - RNA, 18 nt, Human
ccuccugccgacuccugg

SEQ ID NO: 3631517 - RNA, 19 nt, Human
ccuccugccgacuccuggg

SEQ ID NO: 3631518 - RNA, 23 nt, Human
ccuccugccucgaacuggcugca

SEQ ID NO: 3631519 - RNA, 23 nt, Human
ccuccugcgcgcaugugcgcaca

SEQ ID NO: 3631520 - RNA, 20 nt, Human
ccuccugcugcagaggggca

SEQ ID NO: 3631521 - RNA, 23 nt, Human
ccuccugcuugcgggggccgccu

SEQ ID NO: 3631522 - RNA, 17 nt, Human
ccuccuggaaccuugcu

SEQ ID NO: 3631523 - RNA, 19 nt, Human
ccuccuggaaccuugcugu

SEQ ID NO: 3631524 - RNA, 14 nt, Human
ccuccugggcuaag

SEQ ID NO: 3631525 - RNA, 16 nt, Human
ccuccuggggccaggc

SEQ ID NO: 3631526 - RNA, 17 nt, Human
ccuccuggggccaggcc

SEQ ID NO: 3631527 - RNA, 21 nt, Human
ccuccuggggcgcgugaggcc

SEQ ID NO: 3631528 - RNA, 19 nt, Human
ccuccugguggguccaggg

SEQ ID NO: 3631529 - RNA, 21 nt, Human
ccuccuggugucaccccagag

SEQ ID NO: 3631530 - RNA, 11 nt, Human
ccuccugugga

SEQ ID NO: 3631531 - RNA, 17 nt, Human
ccuccuguguacugugu

SEQ ID NO: 3631532 - RNA, 15 nt, Human
ccuccugugugugcg

SEQ ID NO: 3631533 - RNA, 18 nt, Human
ccuccuguugcacccagc

SEQ ID NO: 3631534 - RNA, 23 nt, Human
ccuccuguugcacccagcccugg

SEQ ID NO: 3631535 - RNA, 13 nt, Human
ccuccuucccucu

SEQ ID NO: 3631536 - RNA, 15 nt, Human
ccuccuucccucucu

SEQ ID NO: 3631537 - RNA, 13 nt, Human
ccuccuuccuaaa

SEQ ID NO: 3631538 - RNA, 13 nt, Human
ccuccuuccucuu

SEQ ID NO: 3631539 - RNA, 20 nt, Human
ccuccuuccuugcuguccua

SEQ ID NO: 3631540 - RNA, 14 nt, Human
ccuccuucucuguc

SEQ ID NO: 3631541 - RNA, 15 nt, Human
ccuccuucucugucu

SEQ ID NO: 3631542 - RNA, 21 nt, Human
ccuccuucugagcuccugucc

SEQ ID NO: 3631543 - RNA, 18 nt, Human
ccuccuucuucagggacu

SEQ ID NO: 3631544 - RNA, 18 nt, Human
ccuccuugccuccugugu

SEQ ID NO: 3631545 - RNA, 19 nt, Human
ccuccuugccuccugugua

SEQ ID NO: 3631546 - RNA, 22 nt, Human
ccuccuugcucugcaggcaccu

SEQ ID NO: 3631547 - RNA, 20 nt, Human
ccuccuugggcacuuuuuaa

SEQ ID NO: 3631548 - RNA, 13 nt, Human
ccuccuuuaucac

SEQ ID NO: 3631549 - RNA, 12 nt, Human
ccuccuuuccca

SEQ ID NO: 3631550 - RNA, 18 nt, Human
ccuccuuuccuccucuga

SEQ ID NO: 3631551 - RNA, 21 nt, Human
ccuccuuuccuccucugacuu

SEQ ID NO: 3631552 - RNA, 16 nt, Human
ccuccuuucucuucuc

SEQ ID NO: 3631553 - RNA, 14 nt, Human
ccuccuuucugugc

SEQ ID NO: 3631554 - RNA, 18 nt, Human
ccuccuuugugaggaagc

SEQ ID NO: 3631555 - RNA, 19 nt, Human
ccuccuuugugaggaagcc

SEQ ID NO: 3631556 - RNA, 13 nt, Human
ccuccuuuuucca

SEQ ID NO: 3631557 - RNA, 21 nt, Human
ccuccuuuuuccaugcccuaa

SEQ ID NO: 3631558 - RNA, 23 nt, Human
ccucgaacccacacugcaacagg

SEQ ID NO: 3631559 - RNA, 19 nt, Human
ccucgaagcgcgccacucg

SEQ ID NO: 3631560 - RNA, 21 nt, Human
ccucgagguuucucaaagaaa

SEQ ID NO: 3631561 - RNA, 18 nt, Human
ccucgcacggccccgaag

SEQ ID NO: 3631562 - RNA, 15 nt, Human
ccucgcaggaagacc

SEQ ID NO: 3631563 - RNA, 19 nt, Human
ccucgcaggccucccugcc

SEQ ID NO: 3631564 - RNA, 20 nt, Human
ccucgcccagcggcaucagg

SEQ ID NO: 3631565 - RNA, 12 nt, Human
ccucgcccaguc

SEQ ID NO: 3631566 - RNA, 17 nt, Human
ccucgcccagucccagc

SEQ ID NO: 3631567 - RNA, 18 nt, Human
ccucgcccagucccagca

SEQ ID NO: 3631568 - RNA, 23 nt, Human
ccucgcccagucccagcagccag

SEQ ID NO: 3631569 - RNA, 16 nt, Human
ccucgccccuggcaga

SEQ ID NO: 3631570 - RNA, 22 nt, Human
ccucgccggacccucuaaccuc

SEQ ID NO: 3631571 - RNA, 12 nt, Human
ccucgccuggcc

SEQ ID NO: 3631572 - RNA, 14 nt, Human
ccucgccuggccug

SEQ ID NO: 3631573 - RNA, 15 nt, Human
ccucgccuggccuga

SEQ ID NO: 3631574 - RNA, 15 nt, Human
ccucgccuguggagc

SEQ ID NO: 3631575 - RNA, 21 nt, Human
ccucgccuguggagcucagcc

SEQ ID NO: 3631576 - RNA, 21 nt, Human
ccucgcuccccacucugcucu

SEQ ID NO: 3631577 - RNA, 20 nt, Human
ccucgcugccagcucuguau

SEQ ID NO: 3631578 - RNA, 18 nt, Human
ccucgcuggacucucagu

SEQ ID NO: 3631579 - RNA, 17 nt, Human
ccucgcuggcccccacu

SEQ ID NO: 3631580 - RNA, 20 nt, Human
ccucggaccccacuccggcc

SEQ ID NO: 3631581 - RNA, 12 nt, Human
ccucggagaaga

SEQ ID NO: 3631582 - RNA, 23 nt, Human
ccucggagccucauccgaggcag

SEQ ID NO: 3631583 - RNA, 15 nt, Human
ccucggaucaccgag

SEQ ID NO: 3631584 - RNA, 15 nt, Human
ccucggaucagcuga

SEQ ID NO: 3631585 - RNA, 17 nt, Human
ccucggaucagcugagc

SEQ ID NO: 3631586 - RNA, 17 nt, Human
ccucggauccccuuccu

SEQ ID NO: 3631587 - RNA, 12 nt, Human
ccucggcuccug

SEQ ID NO: 3631588 - RNA, 18 nt, Human
ccucggcuccugcugcac

SEQ ID NO: 3631589 - RNA, 19 nt, Human
ccucggcuccuggacucau

SEQ ID NO: 3631590 - RNA, 18 nt, Human
ccucggcuggcuccccug

SEQ ID NO: 3631591 - RNA, 19 nt, Human
ccucggcuuuucucagcug

SEQ ID NO: 3631592 - RNA, 14 nt, Human
ccucgggcccaccu

SEQ ID NO: 3631593 - RNA, 16 nt, Human
ccucgggcccaccugg

SEQ ID NO: 3631594 - RNA, 19 nt, Human
ccucgggcccaccuggcca

SEQ ID NO: 3631595 - RNA, 22 nt, Human
ccucgggcccaccuggccaccu

SEQ ID NO: 3631596 - RNA, 15 nt, Human
ccucgggucuccuca

SEQ ID NO: 3631597 - RNA, 14 nt, Human
ccucgguguggaga

SEQ ID NO: 3631598 - RNA, 15 nt, Human
ccucguccucccccu

SEQ ID NO: 3631599 - RNA, 17 nt, Human
ccucguggacaccugcc

SEQ ID NO: 3631600 - RNA, 21 nt, Human
ccucguggacaccugcccugc

SEQ ID NO: 3631601 - RNA, 16 nt, Human
ccucguggccagcccg

SEQ ID NO: 3631602 - RNA, 13 nt, Human
ccugacuggugcu

SEQ ID NO: 3631603 - RNA, 19 nt, Human
ccugacuucaggggcugcc

SEQ ID NO: 3631604 - RNA, 14 nt, Human
ccugagaaagcuca

SEQ ID NO: 3631605 - RNA, 17 nt, Human
ccugagaaagcucaaag

SEQ ID NO: 3631606 - RNA, 12 nt, Human
ccugagaagaga

SEQ ID NO: 3631607 - RNA, 13 nt, Human
ccugagaagagag

SEQ ID NO: 3631608 - RNA, 16 nt, Human
ccugagaagcugcucc

SEQ ID NO: 3631609 - RNA, 19 nt, Human
ccugagacaaauggaggcc

SEQ ID NO: 3631610 - RNA, 21 nt, Human
ccugagacaaauggaggccug

SEQ ID NO: 3631611 - RNA, 21 nt, Human
ccugagaccaguugggagcac

SEQ ID NO: 3631612 - RNA, 22 nt, Human
ccugagaccaguugggagcacu

SEQ ID NO: 3631613 - RNA, 18 nt, Human
ccugagaccauuuaacau

SEQ ID NO: 3631614 - RNA, 14 nt, Human
ccugagacccagga

SEQ ID NO: 3631615 - RNA, 15 nt, Human
ccugagacccaggac

SEQ ID NO: 3631616 - RNA, 15 nt, Human
ccugagaccccuggc

SEQ ID NO: 3631617 - RNA, 16 nt, Human
ccugagaccccuggcc

SEQ ID NO: 3631618 - RNA, 17 nt, Human
ccugagaccccuggccu

SEQ ID NO: 3631619 - RNA, 20 nt, Human
ccugagaccccuggccuccg

SEQ ID NO: 3631620 - RNA, 18 nt, Human
ccugagagcugcaugugu

SEQ ID NO: 3631621 - RNA, 20 nt, Human
ccugagaggggaagcggccc

SEQ ID NO: 3631622 - RNA, 15 nt, Human
ccugagagucagcuc

SEQ ID NO: 3631623 - RNA, 15 nt, Human
ccugagaucagaguc

SEQ ID NO: 3631624 - RNA, 15 nt, Human
ccugagauuuauuaa

SEQ ID NO: 3631625 - RNA, 22 nt, Human
ccugagauuuauuaaagaaaaa

SEQ ID NO: 3631626 - RNA, 15 nt, Human
ccugagauuucaucu

SEQ ID NO: 3631627 - RNA, 16 nt, Human
ccugagauuucaucug

SEQ ID NO: 3631628 - RNA, 15 nt, Human
ccugagcaacucuug

SEQ ID NO: 3631629 - RNA, 18 nt, Human
ccugagcaccucccagcc

SEQ ID NO: 3631630 - RNA, 19 nt, Human
ccugagcaccucccagccc

SEQ ID NO: 3631631 - RNA, 23 nt, Human
ccugagcaccucccagccccugc

SEQ ID NO: 3631632 - RNA, 12 nt, Human
ccugagcacugc

SEQ ID NO: 3631633 - RNA, 14 nt, Human
ccugagcacugcca

SEQ ID NO: 3631634 - RNA, 18 nt, Human
ccugagcacugccaggag

SEQ ID NO: 3631635 - RNA, 19 nt, Human
ccugagcacugccaggagg

SEQ ID NO: 3631636 - RNA, 16 nt, Human
ccugagccagauuuca

SEQ ID NO: 3631637 - RNA, 18 nt, Human
ccugagccagggucucca

SEQ ID NO: 3631638 - RNA, 11 nt, Human
ccugagcccac

SEQ ID NO: 3631639 - RNA, 13 nt, Human
ccugagcccacug

SEQ ID NO: 3631640 - RNA, 13 nt, Human
ccugagcccaggg

SEQ ID NO: 3631641 - RNA, 16 nt, Human
ccugagcccagggagg

SEQ ID NO: 3631642 - RNA, 17 nt, Human
ccugagcccagggaggc

SEQ ID NO: 3631643 - RNA, 14 nt, Human
ccugagcccccagc

SEQ ID NO: 3631644 - RNA, 18 nt, Human
ccugagcccccagcuucc

SEQ ID NO: 3631645 - RNA, 20 nt, Human
ccugagccccgcccucuucc

SEQ ID NO: 3631646 - RNA, 15 nt, Human
ccugagccccuuccu

SEQ ID NO: 3631647 - RNA, 19 nt, Human
ccugagcccuacucccugc

SEQ ID NO: 3631648 - RNA, 17 nt, Human
ccugagccggccccagg

SEQ ID NO: 3631649 - RNA, 23 nt, Human
ccugagccugccgagcaaccgug

SEQ ID NO: 3631650 - RNA, 15 nt, Human
ccugagccuggccag

SEQ ID NO: 3631651 - RNA, 16 nt, Human
ccugagccuggccagc

SEQ ID NO: 3631652 - RNA, 21 nt, Human
ccugagcgaguggagucugcc

SEQ ID NO: 3631653 - RNA, 16 nt, Human
ccugagcgcuccugcc

SEQ ID NO: 3631654 - RNA, 12 nt, Human
ccugagcucagc

SEQ ID NO: 3631655 - RNA, 16 nt, Human
ccugagcucgguggac

SEQ ID NO: 3631656 - RNA, 18 nt, Human
ccugagcucgguggaccc

SEQ ID NO: 3631657 - RNA, 20 nt, Human
ccugagcucgguggacccag

SEQ ID NO: 3631658 - RNA, 21 nt, Human
ccugagcucgguggacccagg

SEQ ID NO: 3631659 - RNA, 17 nt, Human
ccugagcugaccagccg

SEQ ID NO: 3631660 - RNA, 18 nt, Human
ccugagcugaggcagcag

SEQ ID NO: 3631661 - RNA, 18 nt, Human
ccugagcuuggccagaag

SEQ ID NO: 3631662 - RNA, 21 nt, Human
ccugagcuuggccagaagggg

SEQ ID NO: 3631663 - RNA, 14 nt, Human
ccugagcuuucugc

SEQ ID NO: 3631664 - RNA, 15 nt, Human
ccugagcuuuggaca

SEQ ID NO: 3631665 - RNA, 22 nt, Human
ccugagcuuuggacacacacag

SEQ ID NO: 3631666 - RNA, 12 nt, Human
ccugaggaagcg

SEQ ID NO: 3631667 - RNA, 21 nt, Human
ccugaggaaggaggggaagcu

SEQ ID NO: 3631668 - RNA, 20 nt, Human
ccugaggacauggcuucuga

SEQ ID NO: 3631669 - RNA, 19 nt, Human
ccugaggacugauuucaga

SEQ ID NO: 3631670 - RNA, 23 nt, Human
ccugaggacugauuucagaguga

SEQ ID NO: 3631671 - RNA, 17 nt, Human
ccugaggagucugaggu

SEQ ID NO: 3631672 - RNA, 21 nt, Human
ccugaggagucugagguccug

SEQ ID NO: 3631673 - RNA, 15 nt, Human
ccugaggaucagaaa

SEQ ID NO: 3631674 - RNA, 17 nt, Human
ccugaggaucagaaagu

SEQ ID NO: 3631675 - RNA, 13 nt, Human
ccugaggaugagc

SEQ ID NO: 3631676 - RNA, 12 nt, Human
ccugaggcccuu

SEQ ID NO: 3631677 - RNA, 14 nt, Human
ccugaggcccuucu

SEQ ID NO: 3631678 - RNA, 21 nt, Human
ccugaggccucuggaaagcaa

SEQ ID NO: 3631679 - RNA, 13 nt, Human
ccugaggcuccac

SEQ ID NO: 3631680 - RNA, 17 nt, Human
ccugaggcuccugugcu

SEQ ID NO: 3631681 - RNA, 19 nt, Human
ccugaggcugggcucccuu

SEQ ID NO: 3631682 - RNA, 17 nt, Human
ccugaggcuguggucac

SEQ ID NO: 3631683 - RNA, 20 nt, Human
ccugagggaaaggccagcac

SEQ ID NO: 3631684 - RNA, 22 nt, Human
ccugagggaaaggccagcacuc

SEQ ID NO: 3631685 - RNA, 15 nt, Human
ccugagggagcucca

SEQ ID NO: 3631686 - RNA, 17 nt, Human
ccugagggaggaccugg

SEQ ID NO: 3631687 - RNA, 14 nt, Human
ccugagggccccuc

SEQ ID NO: 3631688 - RNA, 16 nt, Human
ccugagggccccucug

SEQ ID NO: 3631689 - RNA, 21 nt, Human
ccugagggccccucugcccag

SEQ ID NO: 3631690 - RNA, 15 nt, Human
ccugaggggcagccu

SEQ ID NO: 3631691 - RNA, 17 nt, Human
ccugaggggcagccugc

SEQ ID NO: 3631692 - RNA, 18 nt, Human
ccugaggggcaucugccc

SEQ ID NO: 3631693 - RNA, 19 nt, Human
ccugaggguccccaccugg

SEQ ID NO: 3631694 - RNA, 13 nt, Human
ccugaggguggag

SEQ ID NO: 3631695 - RNA, 14 nt, Human
ccugaggucaggga

SEQ ID NO: 3631696 - RNA, 16 nt, Human
ccugaggugggcccag

SEQ ID NO: 3631697 - RNA, 17 nt, Human
ccugaggugggcccagg

SEQ ID NO: 3631698 - RNA, 19 nt, Human
ccugaggugggcccaggac

SEQ ID NO: 3631699 - RNA, 14 nt, Human
ccugaguagaaagg

SEQ ID NO: 3631700 - RNA, 20 nt, Human
ccugagucagggcccagagg

SEQ ID NO: 3631701 - RNA, 23 nt, Human
ccugaguccaagaggguccuuua

SEQ ID NO: 3631702 - RNA, 19 nt, Human
ccugagugaucccauuucu

SEQ ID NO: 3631703 - RNA, 15 nt, Human
ccugagugcuugcuu

SEQ ID NO: 3631704 - RNA, 13 nt, Human
ccugaguggaucu

SEQ ID NO: 3631705 - RNA, 20 nt, Human
ccugaguggaucuccaagga

SEQ ID NO: 3631706 - RNA, 21 nt, Human
ccugaguggccagggaaucua

SEQ ID NO: 3631707 - RNA, 14 nt, Human
ccugaguucaucca

SEQ ID NO: 3631708 - RNA, 22 nt, Human
ccugaguuccugaggugaugaa

SEQ ID NO: 3631709 - RNA, 15 nt, Human
ccugaguugaagagg

SEQ ID NO: 3631710 - RNA, 23 nt, Human
ccugaguuuccuuuucugucucu

SEQ ID NO: 3631711 - RNA, 19 nt, Human
ccugauaagcuucaaagcu

SEQ ID NO: 3631712 - RNA, 17 nt, Human
ccugauaauaauugauc

SEQ ID NO: 3631713 - RNA, 19 nt, Human
ccugauaugauuuaaaaca

SEQ ID NO: 3631714 - RNA, 15 nt, Human
ccugaucaaugacag

SEQ ID NO: 3631715 - RNA, 13 nt, Human
ccugaucagagcc

SEQ ID NO: 3631716 - RNA, 18 nt, Human
ccugaucccacuccuagg

SEQ ID NO: 3631717 - RNA, 19 nt, Human
ccugaucccacuccuagga

SEQ ID NO: 3631718 - RNA, 19 nt, Human
ccugaucccagagagcccg

SEQ ID NO: 3631719 - RNA, 21 nt, Human
ccugaucccugaucccuucca

SEQ ID NO: 3631720 - RNA, 20 nt, Human
ccugauccuggaggcccagu

SEQ ID NO: 3631721 - RNA, 20 nt, Human
ccugaucucuuccuguuuug

SEQ ID NO: 3631722 - RNA, 14 nt, Human
ccugaucugugaua

SEQ ID NO: 3631723 - RNA, 17 nt, Human
ccugaugaaaauaaaga

SEQ ID NO: 3631724 - RNA, 21 nt, Human
ccugaugacccaggcugccug

SEQ ID NO: 3631725 - RNA, 16 nt, Human
ccugaugcagucacgu

SEQ ID NO: 3631726 - RNA, 13 nt, Human
ccugaugcucccu

SEQ ID NO: 3631727 - RNA, 23 nt, Human
ccugaugcucccuccccugcccu

SEQ ID NO: 3631728 - RNA, 18 nt, Human
ccugaugcuucuucagag

SEQ ID NO: 3631729 - RNA, 20 nt, Human
ccugaugcuucuucagagac

SEQ ID NO: 3631730 - RNA, 22 nt, Human
ccugaugcuucuucagagacuc

SEQ ID NO: 3631731 - RNA, 17 nt, Human
ccugauggaccugucac

SEQ ID NO: 3631732 - RNA, 21 nt, Human
ccugauggcacuuagcuauca

SEQ ID NO: 3631733 - RNA, 18 nt, Human
ccugaugguacaggaaag

SEQ ID NO: 3631734 - RNA, 17 nt, Human
ccugauggucagcuccc

SEQ ID NO: 3631735 - RNA, 20 nt, Human
ccugauggucagcucccuuc

SEQ ID NO: 3631736 - RNA, 17 nt, Human
ccugauguuaaaauucc

SEQ ID NO: 3631737 - RNA, 12 nt, Human
ccugauuaaaga

SEQ ID NO: 3631738 - RNA, 16 nt, Human
ccugauucaacuaaaa

SEQ ID NO: 3631739 - RNA, 16 nt, Human
ccugauugaccugcuc

SEQ ID NO: 3631740 - RNA, 20 nt, Human
ccugauugguuucucuucuc

SEQ ID NO: 3631741 - RNA, 20 nt, Human
ccugauuguguauauucaua

SEQ ID NO: 3631742 - RNA, 23 nt, Human
ccugauuuaauaugcaaagucua

SEQ ID NO: 3631743 - RNA, 20 nt, Human
ccugauuuacaguuucaaaa

SEQ ID NO: 3631744 - RNA, 18 nt, Human
ccugauuuuaauugugaa

SEQ ID NO: 3631745 - RNA, 14 nt, Human
ccugcaaaaaauac

SEQ ID NO: 3631746 - RNA, 19 nt, Human
ccugcaaaaucuguucuaa

SEQ ID NO: 3631747 - RNA, 15 nt, Human
ccugcgaaaaccccc

SEQ ID NO: 3631748 - RNA, 17 nt, Human
ccugcgacccugggggc

SEQ ID NO: 3631749 - RNA, 13 nt, Human
ccugcgaggcuau

SEQ ID NO: 3631750 - RNA, 17 nt, Human
ccugcgaggcuaugagu

SEQ ID NO: 3631751 - RNA, 17 nt, Human
ccugcgccaguccugcu

SEQ ID NO: 3631752 - RNA, 14 nt, Human
ccugcgccugcugc

SEQ ID NO: 3631753 - RNA, 19 nt, Human
ccugcggagugaagagggg

SEQ ID NO: 3631754 - RNA, 20 nt, Human
ccugcggcccaauccaaggu

SEQ ID NO: 3631755 - RNA, 18 nt, Human
ccugcgggucacaggagg

SEQ ID NO: 3631756 - RNA, 21 nt, Human
ccugcggguggggcuuggggc

SEQ ID NO: 3631757 - RNA, 16 nt, Human
ccugcggugcuaucuc

SEQ ID NO: 3631758 - RNA, 17 nt, Human
ccugcggugcuaucucc

SEQ ID NO: 3631759 - RNA, 22 nt, Human
ccugcggugcuaucucccccag

SEQ ID NO: 3631760 - RNA, 19 nt, Human
ccugcguccuccucaccuc

SEQ ID NO: 3631761 - RNA, 22 nt, Human
ccugcguccuccucaccucaug

SEQ ID NO: 3631762 - RNA, 23 nt, Human
ccugcgucgaagcuuugaaggcc

SEQ ID NO: 3631763 - RNA, 13 nt, Human
ccugcguggcuga

SEQ ID NO: 3631764 - RNA, 16 nt, Human
ccugcguggggacagg

SEQ ID NO: 3631765 - RNA, 17 nt, Human
ccugcguggggacaggg

SEQ ID NO: 3631766 - RNA, 22 nt, Human
ccugcguuuuggaagcucugaa

SEQ ID NO: 3631767 - RNA, 17 nt, Human
ccugcuaaggucuugga

SEQ ID NO: 3631768 - RNA, 21 nt, Human
ccugcuacaccuauuauccca

SEQ ID NO: 3631769 - RNA, 13 nt, Human
ccugcuacucugu

SEQ ID NO: 3631770 - RNA, 16 nt, Human
ccugcuacucuguucc

SEQ ID NO: 3631771 - RNA, 21 nt, Human
ccugcuacugccaaccucgcu

SEQ ID NO: 3631772 - RNA, 15 nt, Human
ccugcuagcuagcuc

SEQ ID NO: 3631773 - RNA, 23 nt, Human
ccugcuagcuagcucaacuagug

SEQ ID NO: 3631774 - RNA, 21 nt, Human
ccugcuaggccagagcccacu

SEQ ID NO: 3631775 - RNA, 22 nt, Human
ccugcuauuacuaaggaguaau

SEQ ID NO: 3631776 - RNA, 14 nt, Human
ccugcuauuuccca

SEQ ID NO: 3631777 - RNA, 15 nt, Human
ccugcuauuugaagu

SEQ ID NO: 3631778 - RNA, 17 nt, Human
ccugcucauccacucua

SEQ ID NO: 3631779 - RNA, 11 nt, Human
ccugcuccaga

SEQ ID NO: 3631780 - RNA, 22 nt, Human
ccugcuccagaauuuggaaauc

SEQ ID NO: 3631781 - RNA, 14 nt, Human
ccugcuccagcugu

SEQ ID NO: 3631782 - RNA, 22 nt, Human
ccugcuccagcuguucagcugg

SEQ ID NO: 3631783 - RNA, 15 nt, Human
ccugcucccagcagc

SEQ ID NO: 3631784 - RNA, 23 nt, Human
ccugcucccagcagcccuaagga

SEQ ID NO: 3631785 - RNA, 16 nt, Human
ccugcucccaggccag

SEQ ID NO: 3631786 - RNA, 16 nt, Human
ccugcucccccacccc

SEQ ID NO: 3631787 - RNA, 18 nt, Human
ccugcucccccacccccu

SEQ ID NO: 3631788 - RNA, 15 nt, Human
ccugcuccgcugcuc

SEQ ID NO: 3631789 - RNA, 20 nt, Human
ccugcuccgcugcuccuugg

SEQ ID NO: 3631790 - RNA, 15 nt, Human
ccugcuccugcagca

SEQ ID NO: 3631791 - RNA, 13 nt, Human
ccugcuccuuccc

SEQ ID NO: 3631792 - RNA, 21 nt, Human
ccugcucgaugcucacagggc

SEQ ID NO: 3631793 - RNA, 16 nt, Human
ccugcucuccucuucu

SEQ ID NO: 3631794 - RNA, 15 nt, Human
ccugcucuuuggccu

SEQ ID NO: 3631795 - RNA, 15 nt, Human
ccugcugaccugugc

SEQ ID NO: 3631796 - RNA, 17 nt, Human
ccugcugagagacccaa

SEQ ID NO: 3631797 - RNA, 21 nt, Human
ccugcugagagacccaaggag

SEQ ID NO: 3631798 - RNA, 14 nt, Human
ccugcugagcucug

SEQ ID NO: 3631799 - RNA, 17 nt, Human
ccugcugagcucugaga

SEQ ID NO: 3631800 - RNA, 19 nt, Human
ccugcugagcucugagagg

SEQ ID NO: 3631801 - RNA, 21 nt, Human
ccugcugagcucugagaggcc

SEQ ID NO: 3631802 - RNA, 18 nt, Human
ccugcugcagaggggcag

SEQ ID NO: 3631803 - RNA, 13 nt, Human
ccugcugcagggg

SEQ ID NO: 3631804 - RNA, 22 nt, Human
ccugcugcaggggcucuggaga

SEQ ID NO: 3631805 - RNA, 23 nt, Human
ccugcugcaggggcucuggagag

SEQ ID NO: 3631806 - RNA, 13 nt, Human
ccugcugcaugcc

SEQ ID NO: 3631807 - RNA, 19 nt, Human
ccugcugccaguaccagcc

SEQ ID NO: 3631808 - RNA, 17 nt, Human
ccugcugcccaggcugu

SEQ ID NO: 3631809 - RNA, 11 nt, Human
ccugcugcccu

SEQ ID NO: 3631810 - RNA, 14 nt, Human
ccugcugccgccuc

SEQ ID NO: 3631811 - RNA, 15 nt, Human
ccugcugccgccucc

SEQ ID NO: 3631812 - RNA, 21 nt, Human
ccugcugccgccucccagccu

SEQ ID NO: 3631813 - RNA, 15 nt, Human
ccugcugccucccca

SEQ ID NO: 3631814 - RNA, 17 nt, Human
ccugcugccuccccaac

SEQ ID NO: 3631815 - RNA, 19 nt, Human
ccugcugccuccccaaccc

SEQ ID NO: 3631816 - RNA, 14 nt, Human
ccugcugcgcaguu

SEQ ID NO: 3631817 - RNA, 13 nt, Human
ccugcugcucccu

SEQ ID NO: 3631818 - RNA, 15 nt, Human
ccugcugcucccuca

SEQ ID NO: 3631819 - RNA, 19 nt, Human
ccugcugcugagaaccugg

SEQ ID NO: 3631820 - RNA, 20 nt, Human
ccugcugcugagaaccuggc

SEQ ID NO: 3631821 - RNA, 21 nt, Human
ccugcugcugagaaccuggcc

SEQ ID NO: 3631822 - RNA, 17 nt, Human
ccugcugcugccugccu

SEQ ID NO: 3631823 - RNA, 14 nt, Human
ccugcugcuggugc

SEQ ID NO: 3631824 - RNA, 16 nt, Human
ccugcugcugucaccu

SEQ ID NO: 3631825 - RNA, 18 nt, Human
ccugcugcugucaccucu

SEQ ID NO: 3631826 - RNA, 19 nt, Human
ccugcugcugucaccucuc

SEQ ID NO: 3631827 - RNA, 23 nt, Human
ccugcugcugucaccucucccac

SEQ ID NO: 3631828 - RNA, 20 nt, Human
ccugcugcugucugggugcu

SEQ ID NO: 3631829 - RNA, 20 nt, Human
ccugcugcuguguuuuugcu

SEQ ID NO: 3631830 - RNA, 16 nt, Human
ccugcuggaggccuca

SEQ ID NO: 3631831 - RNA, 17 nt, Human
ccugcuggaucucccag

SEQ ID NO: 3631832 - RNA, 11 nt, Human
ccugcuggccc

SEQ ID NO: 3631833 - RNA, 12 nt, Human
ccugcuggcccc

SEQ ID NO: 3631834 - RNA, 13 nt, Human
ccugcuggccccu

SEQ ID NO: 3631835 - RNA, 18 nt, Human
ccugcuggccccucaccu

SEQ ID NO: 3631836 - RNA, 21 nt, Human
ccugcuggccccucaccuggg

SEQ ID NO: 3631837 - RNA, 17 nt, Human
ccugcuggccgccucac

SEQ ID NO: 3631838 - RNA, 12 nt, Human
ccugcuggcucu

SEQ ID NO: 3631839 - RNA, 19 nt, Human
ccugcugggcucuccaccu

SEQ ID NO: 3631840 - RNA, 22 nt, Human
ccugcugggcucuccaccucag

SEQ ID NO: 3631841 - RNA, 23 nt, Human
ccugcuggggauccccgccuggc

SEQ ID NO: 3631842 - RNA, 15 nt, Human
ccugcuggguaaacu

SEQ ID NO: 3631843 - RNA, 19 nt, Human
ccugcugguucaggguugg

SEQ ID NO: 3631844 - RNA, 13 nt, Human
ccugcugguuuua

SEQ ID NO: 3631845 - RNA, 15 nt, Human
ccugcugucauugcu

SEQ ID NO: 3631846 - RNA, 15 nt, Human
ccugcuguccccucu

SEQ ID NO: 3631847 - RNA, 19 nt, Human
ccugcuguccccucuugcc

SEQ ID NO: 3631848 - RNA, 22 nt, Human
ccugcuguccccucuugcccca

SEQ ID NO: 3631849 - RNA, 20 nt, Human
ccugcugugauuccacuaca

SEQ ID NO: 3631850 - RNA, 18 nt, Human
ccugcuuccaccucaccc

SEQ ID NO: 3631851 - RNA, 21 nt, Human
ccugcuuccaggaaacuccac

SEQ ID NO: 3631852 - RNA, 24 nt, Human
ccugcuucccaccucccugcccag

SEQ ID NO: 3631853 - RNA, 15 nt, Human
ccugcuuccugucuu

SEQ ID NO: 3631854 - RNA, 14 nt, Human
ccugcuucuccagc

SEQ ID NO: 3631855 - RNA, 20 nt, Human
ccugcuucuccagccuggac

SEQ ID NO: 3631856 - RNA, 22 nt, Human
ccugcuucuccagccuggaccc

SEQ ID NO: 3631857 - RNA, 14 nt, Human
ccugcuucucugcc

SEQ ID NO: 3631858 - RNA, 18 nt, Human
ccugcuugaguucccaga

SEQ ID NO: 3631859 - RNA, 21 nt, Human
ccugcuugccaaggcagaggc

SEQ ID NO: 3631860 - RNA, 22 nt, Human
ccugcuugccaaggcagaggcc

SEQ ID NO: 3631861 - RNA, 21 nt, Human
ccugcuuggguggagaagcca

SEQ ID NO: 3631862 - RNA, 17 nt, Human
ccugcuuuaaccacccc

SEQ ID NO: 3631863 - RNA, 21 nt, Human
ccugcuuuaaccaccccaucu

SEQ ID NO: 3631864 - RNA, 17 nt, Human
ccugcuuuagagcuagg

SEQ ID NO: 3631865 - RNA, 20 nt, Human
ccugcuuugcgugcccgggg

SEQ ID NO: 3631866 - RNA, 19 nt, Human
ccugcuuugggcugcccug

SEQ ID NO: 3631867 - RNA, 18 nt, Human
ccugcuuugggcuugggc

SEQ ID NO: 3631868 - RNA, 12 nt, Human
ccugcuuuucaa

SEQ ID NO: 3631869 - RNA, 20 nt, Human
ccugcuuuuuggaaagucag

SEQ ID NO: 3631870 - RNA, 21 nt, Human
ccuggaaaaaaacaucagaaa

SEQ ID NO: 3631871 - RNA, 17 nt, Human
ccuggaaaccacagucc

SEQ ID NO: 3631872 - RNA, 17 nt, Human
ccuggaaaggcucaguc

SEQ ID NO: 3631873 - RNA, 21 nt, Human
ccuggaaaggcucagucucag

SEQ ID NO: 3631874 - RNA, 22 nt, Human
ccuggaaaggcucagucucagg

SEQ ID NO: 3631875 - RNA, 16 nt, Human
ccuggaaccuugcugu

SEQ ID NO: 3631876 - RNA, 13 nt, Human
ccuggaacuuggg

SEQ ID NO: 3631877 - RNA, 16 nt, Human
ccuggaacuuggggag

SEQ ID NO: 3631878 - RNA, 17 nt, Human
ccuggaacuuggggagu

SEQ ID NO: 3631879 - RNA, 18 nt, Human
ccuggaagaacaggccuc

SEQ ID NO: 3631880 - RNA, 20 nt, Human
ccuggaagaacaggccucuc

SEQ ID NO: 3631881 - RNA, 13 nt, Human
ccuggaagacaga

SEQ ID NO: 3631882 - RNA, 16 nt, Human
ccuggaagagcccagu

SEQ ID NO: 3631883 - RNA, 16 nt, Human
ccuggaagcagugccc

SEQ ID NO: 3631884 - RNA, 13 nt, Human
ccuggacacaggc

SEQ ID NO: 3631885 - RNA, 17 nt, Human
ccuggacacucagaccu

SEQ ID NO: 3631886 - RNA, 20 nt, Human
ccuggacagcugugccucgc

SEQ ID NO: 3631887 - RNA, 14 nt, Human
ccuggacaggccag

SEQ ID NO: 3631888 - RNA, 24 nt, Human
ccuggacaugaagauucuuuccca

SEQ ID NO: 3631889 - RNA, 20 nt, Human
ccuggacauuuuuucaguca

SEQ ID NO: 3631890 - RNA, 14 nt, Human
ccuggaccaaagcu

SEQ ID NO: 3631891 - RNA, 18 nt, Human
cgagaucacgccacugca

SEQ ID NO: 3631892 - RNA, 17 nt, Human
cgagaucaguauuuaac

SEQ ID NO: 3631893 - RNA, 15 nt, Human
cgagaucccaacacu

SEQ ID NO: 3631894 - RNA, 20 nt, Human
cgagauugcaccacugcacu

SEQ ID NO: 3631895 - RNA, 22 nt, Human
cgagcaaccguggcccuuccug

SEQ ID NO: 3631896 - RNA, 13 nt, Human
cgagcaccuccac

SEQ ID NO: 3631897 - RNA, 14 nt, Human
cgagcagcugagca

SEQ ID NO: 3631898 - RNA, 13 nt, Human
cgagcaggaggcc

SEQ ID NO: 3631899 - RNA, 15 nt, Human
cgagcaguccugccu

SEQ ID NO: 3631900 - RNA, 23 nt, Human
cgagcaguccugccucagccucc

SEQ ID NO: 3631901 - RNA, 14 nt, Human
cgagcaugccugga

SEQ ID NO: 3631902 - RNA, 18 nt, Human
cgagcaugccuggauggg

SEQ ID NO: 3631903 - RNA, 21 nt, Human
cgagccauuugucccaagugc

SEQ ID NO: 3631904 - RNA, 23 nt, Human
cgagccauuugucccaagugcca

SEQ ID NO: 3631905 - RNA, 15 nt, Human
cgagcccugguggca

SEQ ID NO: 3631906 - RNA, 18 nt, Human
cgagcccugguggcagug

SEQ ID NO: 3631907 - RNA, 19 nt, Human
cgagcccugguggcagugg

SEQ ID NO: 3631908 - RNA, 24 nt, Human
cgagcccugguggcagugggagcu

SEQ ID NO: 3631909 - RNA, 17 nt, Human
cgagccgggccuggggc

SEQ ID NO: 3631910 - RNA, 20 nt, Human
cgagccucugucacugcagg

SEQ ID NO: 3631911 - RNA, 13 nt, Human
cgagccuggcucc

SEQ ID NO: 3631912 - RNA, 21 nt, Human
cgagcgcccugcagacccugc

SEQ ID NO: 3631913 - RNA, 10 nt, Human
cgagcuccuc

SEQ ID NO: 3631914 - RNA, 19 nt, Human
cgagcucguguauccuggg

SEQ ID NO: 3631915 - RNA, 22 nt, Human
cgagcucguguauccuggggcu

SEQ ID NO: 3631916 - RNA, 15 nt, Human
cgagcuggauguccc

SEQ ID NO: 3631917 - RNA, 14 nt, Human
cgagcuggugcauu

SEQ ID NO: 3631918 - RNA, 22 nt, Human
cgagcuggugcauuacagagag

SEQ ID NO: 3631919 - RNA, 14 nt, Human
cgagcuuuucuaaa

SEQ ID NO: 3631920 - RNA, 20 nt, Human
cgaggaaacgaaacccacuc

SEQ ID NO: 3631921 - RNA, 15 nt, Human
cgaggaaccagagcc

SEQ ID NO: 3631922 - RNA, 22 nt, Human
cgaggaaucugugggucuggga

SEQ ID NO: 3631923 - RNA, 14 nt, Human
cgaggacagggagg

SEQ ID NO: 3631924 - RNA, 17 nt, Human
cgaggacccagacccag

SEQ ID NO: 3631925 - RNA, 21 nt, Human
cgaggacuguauuugugacua

SEQ ID NO: 3631926 - RNA, 19 nt, Human
cgaggaggcuccagagggc

SEQ ID NO: 3631927 - RNA, 20 nt, Human
cgaggaggcuccagagggca

SEQ ID NO: 3631928 - RNA, 14 nt, Human
cgaggaggggagaa

SEQ ID NO: 3631929 - RNA, 13 nt, Human
cgaggaguaacaa

SEQ ID NO: 3631930 - RNA, 23 nt, Human
cgaggauuuuaauuuuuuuuagu

SEQ ID NO: 3631931 - RNA, 13 nt, Human
cgaggcaggcaga

SEQ ID NO: 3631932 - RNA, 14 nt, Human
cgaggcagggucag

SEQ ID NO: 3631933 - RNA, 11 nt, Human
cgaggcccugc

SEQ ID NO: 3631934 - RNA, 12 nt, Human
cgaggcccugca

SEQ ID NO: 3631935 - RNA, 14 nt, Human
cgaggcccugcaug

SEQ ID NO: 3631936 - RNA, 19 nt, Human
cgaggccuucucugaagga

SEQ ID NO: 3631937 - RNA, 12 nt, Human
cgaggcugagaa

SEQ ID NO: 3631938 - RNA, 13 nt, Human
cgaggcugagaau

SEQ ID NO: 3631939 - RNA, 13 nt, Human
cgaggcugggcca

SEQ ID NO: 3631940 - RNA, 19 nt, Human
cgaggggaggguggcaggu

SEQ ID NO: 3631941 - RNA, 16 nt, Human
cgaggggcucaggaaa

SEQ ID NO: 3631942 - RNA, 23 nt, Human
cgaggguccuggcuccugagggg

SEQ ID NO: 3631943 - RNA, 16 nt, Human
cgagguaugaggucua

SEQ ID NO: 3631944 - RNA, 17 nt, Human
cgaggucaacagagaag

SEQ ID NO: 3631945 - RNA, 23 nt, Human
cgaggucaacagagaaggcagga

SEQ ID NO: 3631946 - RNA, 14 nt, Human
cgaggucaggagau

SEQ ID NO: 3631947 - RNA, 20 nt, Human
cgaguaauugcauuugcuuu

SEQ ID NO: 3631948 - RNA, 20 nt, Human
cgaguagaaaaugugacccu

SEQ ID NO: 3631949 - RNA, 15 nt, Human
cgagucaccuuccag

SEQ ID NO: 3631950 - RNA, 12 nt, Human
cgagucacugcc

SEQ ID NO: 3631951 - RNA, 14 nt, Human
cgagucacugccuc

SEQ ID NO: 3631952 - RNA, 19 nt, Human
cgagucauucguucugugg

SEQ ID NO: 3631953 - RNA, 20 nt, Human
cgagucauucguucugugga

SEQ ID NO: 3631954 - RNA, 18 nt, Human
cgagucucuucuccacug

SEQ ID NO: 3631955 - RNA, 20 nt, Human
cgagucucuucuccacugga

SEQ ID NO: 3631956 - RNA, 13 nt, Human
cgagucugaggcc

SEQ ID NO: 3631957 - RNA, 17 nt, Human
cgagugagacaaaauuu

SEQ ID NO: 3631958 - RNA, 16 nt, Human
cgagugcuaaguguag

SEQ ID NO: 3631959 - RNA, 15 nt, Human
cgagugcucauuuca

SEQ ID NO: 3631960 - RNA, 21 nt, Human
cgaguggauagaugcccugcu

SEQ ID NO: 3631961 - RNA, 13 nt, Human
cgagugggaagga

SEQ ID NO: 3631962 - RNA, 20 nt, Human
cgaguggugacaggacgcug

SEQ ID NO: 3631963 - RNA, 11 nt, Human
cgagugugugc

SEQ ID NO: 3631964 - RNA, 18 nt, Human
cgagugugugcaugugug

SEQ ID NO: 3631965 - RNA, 17 nt, Human
cgaguguguuucauccu

SEQ ID NO: 3631966 - RNA, 17 nt, Human
cgaguuuggucccuggg

SEQ ID NO: 3631967 - RNA, 13 nt, Human
cgauaaggaagaa

SEQ ID NO: 3631968 - RNA, 20 nt, Human
cgauacaccgggccuggaga

SEQ ID NO: 3631969 - RNA, 19 nt, Human
cgauacugcgacuuucugc

SEQ ID NO: 3631970 - RNA, 15 nt, Human
cgauaguggugguga

SEQ ID NO: 3631971 - RNA, 22 nt, Human
cgauccaccugucucagccucc

SEQ ID NO: 3631972 - RNA, 17 nt, Human
cgauccugccacccugu

SEQ ID NO: 3631973 - RNA, 13 nt, Human
cgauccuuccucc

SEQ ID NO: 3631974 - RNA, 13 nt, Human
cgaucucagcuca

SEQ ID NO: 3631975 - RNA, 13 nt, Human
cgaucucuccugg

SEQ ID NO: 3631976 - RNA, 17 nt, Human
cgaucucuuauuuuaca

SEQ ID NO: 3631977 - RNA, 20 nt, Human
cgaugauucaggugcagagg

SEQ ID NO: 3631978 - RNA, 21 nt, Human
cgaugauucaggugcagagga

SEQ ID NO: 3631979 - RNA, 13 nt, Human
cgaugccagccaa

SEQ ID NO: 3631980 - RNA, 18 nt, Human
cgaugcuccagccaaccc

SEQ ID NO: 3631981 - RNA, 23 nt, Human
cgaugcuccagccaaccccugug

SEQ ID NO: 3631982 - RNA, 20 nt, Human
cgaugcugcuuuccccugug

SEQ ID NO: 3631983 - RNA, 21 nt, Human
cgaugcugcuuuccccugugg

SEQ ID NO: 3631984 - RNA, 22 nt, Human
cgaugcugcuuuccccuguggg

SEQ ID NO: 3631985 - RNA, 23 nt, Human
cgauggaggacuccaggcagcag

SEQ ID NO: 3631986 - RNA, 18 nt, Human
cgauggcuuugccagcuu

SEQ ID NO: 3631987 - RNA, 12 nt, Human
cgaugggucagg

SEQ ID NO: 3631988 - RNA, 18 nt, Human
cgaugguacgugacccuc

SEQ ID NO: 3631989 - RNA, 11 nt, Human
cgauguggccc

SEQ ID NO: 3631990 - RNA, 18 nt, Human
cgauguggcccuggccug

SEQ ID NO: 3631991 - RNA, 17 nt, Human
cgauuauuaucuaaagu

SEQ ID NO: 3631992 - RNA, 16 nt, Human
cgauucacccugucca

SEQ ID NO: 3631993 - RNA, 18 nt, Human
cgauucccucucccaggc

SEQ ID NO: 3631994 - RNA, 13 nt, Human
cgauuccuucucu

SEQ ID NO: 3631995 - RNA, 16 nt, Human
cgauucucuugccuca

SEQ ID NO: 3631996 - RNA, 13 nt, Human
cgauucuucugcu

SEQ ID NO: 3631997 - RNA, 19 nt, Human
cgauucuucugcuucagcc

SEQ ID NO: 3631998 - RNA, 14 nt, Human
cgauuuaauucucu

SEQ ID NO: 3631999 - RNA, 21 nt, Human
cgauuucccugguuuuagucu

SEQ ID NO: 3632000 - RNA, 20 nt, Human
cgauuucuguuuagauaaua

SEQ ID NO: 3632001 - RNA, 14 nt, Human
cgauuugucccagg

SEQ ID NO: 3632002 - RNA, 17 nt, Human
cgauuuuguaucugcag

SEQ ID NO: 3632003 - RNA, 15 nt, Human
cgcaaagagagauuu

SEQ ID NO: 3632004 - RNA, 14 nt, Human
cgcaacccgugcca

SEQ ID NO: 3632005 - RNA, 19 nt, Human
cgcaacccgugccaagucc

SEQ ID NO: 3632006 - RNA, 22 nt, Human
cgcaagagccauguagaagcug

SEQ ID NO: 3632007 - RNA, 19 nt, Human
cgcaagcaccauccccucc

SEQ ID NO: 3632008 - RNA, 22 nt, Human
cgcaaugaaaagucguuuucca

SEQ ID NO: 3632009 - RNA, 11 nt, Human
cgcaaugugac

SEQ ID NO: 3632010 - RNA, 15 nt, Human
cgcacacacacacac

SEQ ID NO: 3632011 - RNA, 12 nt, Human
cgcacagagcug

SEQ ID NO: 3632012 - RNA, 17 nt, Human
cgcacagagcuggggcu

SEQ ID NO: 3632013 - RNA, 15 nt, Human
cgcacagcagccugc

SEQ ID NO: 3632014 - RNA, 13 nt, Human
cgcacagcugcuc

SEQ ID NO: 3632015 - RNA, 12 nt, Human
cgcacauauaca

SEQ ID NO: 3632016 - RNA, 16 nt, Human
cgcacauauacacaca

SEQ ID NO: 3632017 - RNA, 17 nt, Human
cgcaccccccaagcugu

SEQ ID NO: 3632018 - RNA, 23 nt, Human
cgcaccgaaaaacuaaaaauaau

SEQ ID NO: 3632019 - RNA, 18 nt, Human
cgcaccucccauccuaau

SEQ ID NO: 3632020 - RNA, 13 nt, Human
cgcacgcacacac

SEQ ID NO: 3632021 - RNA, 15 nt, Human
cgcacgcacacacac

SEQ ID NO: 3632022 - RNA, 20 nt, Human
cgcacggccccgaagggccc

SEQ ID NO: 3632023 - RNA, 12 nt, Human
cgcacugccucu

SEQ ID NO: 3632024 - RNA, 17 nt, Human
cgcacugugacccccag

SEQ ID NO: 3632025 - RNA, 22 nt, Human
cgcacugugacccccagcuccg

SEQ ID NO: 3632026 - RNA, 23 nt, Human
cgcacuucgggaggucgaggcag

SEQ ID NO: 3632027 - RNA, 14 nt, Human
cgcacuuuccacuu

SEQ ID NO: 3632028 - RNA, 19 nt, Human
cgcacuuuccacuucuucc

SEQ ID NO: 3632029 - RNA, 20 nt, Human
cgcagaacgaaccuuggccu

SEQ ID NO: 3632030 - RNA, 13 nt, Human
cgcagaagcagac

SEQ ID NO: 3632031 - RNA, 17 nt, Human
cgcagacaccuuggaca

SEQ ID NO: 3632032 - RNA, 13 nt, Human
cgcagacaggacc

SEQ ID NO: 3632033 - RNA, 12 nt, Human
cgcagaccuccc

SEQ ID NO: 3632034 - RNA, 17 nt, Human
cgcagaccuccccagcc

SEQ ID NO: 3632035 - RNA, 20 nt, Human
cgcagaccuccccagccccu

SEQ ID NO: 3632036 - RNA, 15 nt, Human
cgcagaccucuggau

SEQ ID NO: 3632037 - RNA, 19 nt, Human
cgcugauaagcguucaugg

SEQ ID NO: 3632038 - RNA, 13 nt, Human
cgcugauauaugu

SEQ ID NO: 3632039 - RNA, 21 nt, Human
cgcugaugcugggcugggugc

SEQ ID NO: 3632040 - RNA, 23 nt, Human
cgcugccagccuugagcccuggc

SEQ ID NO: 3632041 - RNA, 19 nt, Human
cgcugccagcucuguauca

SEQ ID NO: 3632042 - RNA, 18 nt, Human
cgcugcccaccugccggc

SEQ ID NO: 3632043 - RNA, 19 nt, Human
cgcugcccaccugccggcc

SEQ ID NO: 3632044 - RNA, 24 nt, Human
cgcugccccaucuccccucagcuc

SEQ ID NO: 3632045 - RNA, 19 nt, Human
cgcugccccuggcagcccc

SEQ ID NO: 3632046 - RNA, 22 nt, Human
cgcugcccggcgcccucugucc

SEQ ID NO: 3632047 - RNA, 13 nt, Human
cgcugccgcaccc

SEQ ID NO: 3632048 - RNA, 20 nt, Human
cgcugccgcaccccagagug

SEQ ID NO: 3632049 - RNA, 17 nt, Human
cgcugccuaaguggcug

SEQ ID NO: 3632050 - RNA, 20 nt, Human
cgcugccuaaguggcugcug

SEQ ID NO: 3632051 - RNA, 15 nt, Human
cgcugcuccuuggcu

SEQ ID NO: 3632052 - RNA, 19 nt, Human
cgcugcugcgcccugggcu

SEQ ID NO: 3632053 - RNA, 15 nt, Human
cgcugcugcugcugc

SEQ ID NO: 3632054 - RNA, 23 nt, Human
cgcuggaccuugaacuggguacu

SEQ ID NO: 3632055 - RNA, 20 nt, Human
cgcuggacucucagucucug

SEQ ID NO: 3632056 - RNA, 10 nt, Human
cgcuggccca

SEQ ID NO: 3632057 - RNA, 13 nt, Human
cgcuggcccagcc

SEQ ID NO: 3632058 - RNA, 15 nt, Human
cgcuggcccagccgg

SEQ ID NO: 3632059 - RNA, 24 nt, Human
cgcuggcccagccggccucucugg

SEQ ID NO: 3632060 - RNA, 10 nt, Human
cgcuggcccc

SEQ ID NO: 3632061 - RNA, 17 nt, Human
cgcuggcccccacuggc

SEQ ID NO: 3632062 - RNA, 20 nt, Human
cgcuggcccccacuggcugu

SEQ ID NO: 3632063 - RNA, 23 nt, Human
cgcuggccccuuugggcccugca

SEQ ID NO: 3632064 - RNA, 16 nt, Human
cgcuggcuccccaaag

SEQ ID NO: 3632065 - RNA, 16 nt, Human
cgcugggcacuucccu

SEQ ID NO: 3632066 - RNA, 15 nt, Human
cgcugguagagaugg

SEQ ID NO: 3632067 - RNA, 18 nt, Human
cgcugguccuuucuuccg

SEQ ID NO: 3632068 - RNA, 13 nt, Human
cgcugucacaggc

SEQ ID NO: 3632069 - RNA, 18 nt, Human
cgcugucaggauugcgag

SEQ ID NO: 3632070 - RNA, 22 nt, Human
cgcugucuccagacccccaccc

SEQ ID NO: 3632071 - RNA, 15 nt, Human
cgcugugccacaggc

SEQ ID NO: 3632072 - RNA, 16 nt, Human
cgcugugcugcccugc

SEQ ID NO: 3632073 - RNA, 23 nt, Human
cgcugugcugcccugcccaccug

SEQ ID NO: 3632074 - RNA, 20 nt, Human
cgcuguguguuaguucccaa

SEQ ID NO: 3632075 - RNA, 14 nt, Human
cgcuguucacccac

SEQ ID NO: 3632076 - RNA, 17 nt, Human
cgcuguugcugaauagg

SEQ ID NO: 3632077 - RNA, 11 nt, Human
cgcuucacagg

SEQ ID NO: 3632078 - RNA, 16 nt, Human
cgcuucccccauagcc

SEQ ID NO: 3632079 - RNA, 20 nt, Human
cgcuucccccauagccaccc

SEQ ID NO: 3632080 - RNA, 20 nt, Human
cgcuucccugguucaagcga

SEQ ID NO: 3632081 - RNA, 16 nt, Human
cgcuucgacuuuucuu

SEQ ID NO: 3632082 - RNA, 16 nt, Human
cgcuugaagccugaac

SEQ ID NO: 3632083 - RNA, 13 nt, Human
cgcuugagaaaaa

SEQ ID NO: 3632084 - RNA, 17 nt, Human
cgcuugccacuagggcu

SEQ ID NO: 3632085 - RNA, 16 nt, Human
cgcuugccucggcucc

SEQ ID NO: 3632086 - RNA, 20 nt, Human
cgcuugccucggcuccugcu

SEQ ID NO: 3632087 - RNA, 23 nt, Human
cgcuugccucggcuccugcugca

SEQ ID NO: 3632088 - RNA, 20 nt, Human
cgcuuggcgaugccagccaa

SEQ ID NO: 3632089 - RNA, 22 nt, Human
cgcuuggcgaugccagccaagc

SEQ ID NO: 3632090 - RNA, 18 nt, Human
cgcuuguaaauaccagga

SEQ ID NO: 3632091 - RNA, 12 nt, Human
cgcuuguagaac

SEQ ID NO: 3632092 - RNA, 21 nt, Human
cgcuuguagaacucacucugg

SEQ ID NO: 3632093 - RNA, 22 nt, Human
cgcuuguagaacucacucuggg

SEQ ID NO: 3632094 - RNA, 23 nt, Human
cgcuuguagaacucacucugggc

SEQ ID NO: 3632095 - RNA, 18 nt, Human
cgcuuguggggacccagg

SEQ ID NO: 3632096 - RNA, 19 nt, Human
cgcuuguggggacccaggc

SEQ ID NO: 3632097 - RNA, 20 nt, Human
cgcuuguggggacccaggcu

SEQ ID NO: 3632098 - RNA, 14 nt, Human
cgcuuucuacccag

SEQ ID NO: 3632099 - RNA, 15 nt, Human
cgcuuuggccugagu

SEQ ID NO: 3632100 - RNA, 12 nt, Human
cgcuuugucaca

SEQ ID NO: 3632101 - RNA, 17 nt, Human
cgcuuuuccuuggcauu

SEQ ID NO: 3632102 - RNA, 23 nt, Human
cgcuuuugccauuagccaaggau

SEQ ID NO: 3632103 - RNA, 19 nt, Human
cgcuuuugcuggucacugc

SEQ ID NO: 3632104 - RNA, 20 nt, Human
cggaaaacaugcuacacacu

SEQ ID NO: 3632105 - RNA, 18 nt, Human
cggaaaaugccaaucucu

SEQ ID NO: 3632106 - RNA, 16 nt, Human
cggaaagaagaaggug

SEQ ID NO: 3632107 - RNA, 12 nt, Human
cggaaagaagag

SEQ ID NO: 3632108 - RNA, 12 nt, Human
cggaaagcagcu

SEQ ID NO: 3632109 - RNA, 12 nt, Human
cggaaagguauu

SEQ ID NO: 3632110 - RNA, 13 nt, Human
cggaaauuaaagu

SEQ ID NO: 3632111 - RNA, 13 nt, Human
cggaacagcagau

SEQ ID NO: 3632112 - RNA, 16 nt, Human
cggaacugcaugcugc

SEQ ID NO: 3632113 - RNA, 21 nt, Human
cggaagaagagaucaggaaga

SEQ ID NO: 3632114 - RNA, 12 nt, Human
cggaaguuuuca

SEQ ID NO: 3632115 - RNA, 13 nt, Human
cggaauauauuuu

SEQ ID NO: 3632116 - RNA, 21 nt, Human
cggaauccugucgauuagacu

SEQ ID NO: 3632117 - RNA, 20 nt, Human
cggaaugaaccacaucuugc

SEQ ID NO: 3632118 - RNA, 22 nt, Human
cggacaaaaccccccagauauc

SEQ ID NO: 3632119 - RNA, 22 nt, Human
cggacaauaaaccuccgccaau

SEQ ID NO: 3632120 - RNA, 16 nt, Human
cggacacuccuagaga

SEQ ID NO: 3632121 - RNA, 13 nt, Human
cggacaguggcag

SEQ ID NO: 3632122 - RNA, 21 nt, Human
cggaccacccucacuggcucu

SEQ ID NO: 3632123 - RNA, 12 nt, Human
cggaccagccug

SEQ ID NO: 3632124 - RNA, 14 nt, Human
cggaccagccuggc

SEQ ID NO: 3632125 - RNA, 21 nt, Human
cggaccccacuccggcccucc

SEQ ID NO: 3632126 - RNA, 12 nt, Human
cggaccccagcu

SEQ ID NO: 3632127 - RNA, 13 nt, Human
cggaccccagcug

SEQ ID NO: 3632128 - RNA, 20 nt, Human
cggaccccagcugugagccu

SEQ ID NO: 3632129 - RNA, 22 nt, Human
cggaccccagcugugagccuug

SEQ ID NO: 3632130 - RNA, 14 nt, Human
cggaccuuucagcu

SEQ ID NO: 3632131 - RNA, 16 nt, Human
cggacgcccaggaccc

SEQ ID NO: 3632132 - RNA, 23 nt, Human
cggacuuagaaaaccagcucagc

SEQ ID NO: 3632133 - RNA, 15 nt, Human
cggacuuuucugcaa

SEQ ID NO: 3632134 - RNA, 16 nt, Human
cggacuuuucugcaaa

SEQ ID NO: 3632135 - RNA, 17 nt, Human
cggagaagagcgcagug

SEQ ID NO: 3632136 - RNA, 23 nt, Human
cggagaagagcuguucacagcca

SEQ ID NO: 3632137 - RNA, 23 nt, Human
cggagaagugugccuucucucuc

SEQ ID NO: 3632138 - RNA, 15 nt, Human
cggagacgggaccgg

SEQ ID NO: 3632139 - RNA, 18 nt, Human
cggagaguacagugagcc

SEQ ID NO: 3632140 - RNA, 14 nt, Human
cggagagugggggu

SEQ ID NO: 3632141 - RNA, 18 nt, Human
cggagauaugaagagcaa

SEQ ID NO: 3632142 - RNA, 16 nt, Human
cggagcaaacucugcu

SEQ ID NO: 3632143 - RNA, 14 nt, Human
cggagcaagaggag

SEQ ID NO: 3632144 - RNA, 11 nt, Human
cggagccacuc

SEQ ID NO: 3632145 - RNA, 14 nt, Human
cggagccccaggcc

SEQ ID NO: 3632146 - RNA, 20 nt, Human
cggagcggauugcaaagcaa

SEQ ID NO: 3632147 - RNA, 20 nt, Human
cggagcuaacacuggccccu

SEQ ID NO: 3632148 - RNA, 19 nt, Human
cggagcugccccucucugg

SEQ ID NO: 3632149 - RNA, 23 nt, Human
cggagcugccccucucugggccu

SEQ ID NO: 3632150 - RNA, 16 nt, Human
cggagcuggccccgcc

SEQ ID NO: 3632151 - RNA, 21 nt, Human
cggagcuggccccgccgccug

SEQ ID NO: 3632152 - RNA, 20 nt, Human
cggaggaaggaggacccagg

SEQ ID NO: 3632153 - RNA, 23 nt, Human
cggaggaaggaggacccaggaca

SEQ ID NO: 3632154 - RNA, 11 nt, Human
cggaggagaag

SEQ ID NO: 3632155 - RNA, 12 nt, Human
cggaggcaaaag

SEQ ID NO: 3632156 - RNA, 22 nt, Human
cggaggcauccuacccuuuucu

SEQ ID NO: 3632157 - RNA, 19 nt, Human
cggaggccacaugaguccc

SEQ ID NO: 3632158 - RNA, 21 nt, Human
cggaggccacaugagucccag

SEQ ID NO: 3632159 - RNA, 14 nt, Human
cggaggcggugggc

SEQ ID NO: 3632160 - RNA, 16 nt, Human
cggaggcugcccccgg

SEQ ID NO: 3632161 - RNA, 15 nt, Human
cggaggcuugggacc

SEQ ID NO: 3632162 - RNA, 16 nt, Human
cggaggcuugggaccg

SEQ ID NO: 3632163 - RNA, 18 nt, Human
cggaggcuugucagagcu

SEQ ID NO: 3632164 - RNA, 19 nt, Human
cggaggcuugucagagcug

SEQ ID NO: 3632165 - RNA, 14 nt, Human
cggaggggaguaga

SEQ ID NO: 3632166 - RNA, 15 nt, Human
cggaggggccuggca

SEQ ID NO: 3632167 - RNA, 16 nt, Human
cggaggggccuggcag

SEQ ID NO: 3632168 - RNA, 21 nt, Human
cggagggugggggccaccugc

SEQ ID NO: 3632169 - RNA, 22 nt, Human
cggagggugggggccaccugcc

SEQ ID NO: 3632170 - RNA, 16 nt, Human
cggagguguggagccg

SEQ ID NO: 3632171 - RNA, 22 nt, Human
cggagguugggugggccggcuu

SEQ ID NO: 3632172 - RNA, 17 nt, Human
cggagucaaaaauuaaa

SEQ ID NO: 3632173 - RNA, 15 nt, Human
cggagucagugccag

SEQ ID NO: 3632174 - RNA, 16 nt, Human
cggaguccacucccag

SEQ ID NO: 3632175 - RNA, 23 nt, Human
cggaguccuguguuugugagucg

SEQ ID NO: 3632176 - RNA, 23 nt, Human
cggagucguggggugugcuggga

SEQ ID NO: 3632177 - RNA, 14 nt, Human
cggagugaagaggg

SEQ ID NO: 3632178 - RNA, 18 nt, Human
cggagugaagaggggcag

SEQ ID NO: 3632179 - RNA, 14 nt, Human
cggagugcggacca

SEQ ID NO: 3632180 - RNA, 23 nt, Human
cggaguucggaaaccguccugug

SEQ ID NO: 3632181 - RNA, 17 nt, Human
cuagauggugcugagaa

SEQ ID NO: 3632182 - RNA, 19 nt, Human
cuagauggugcugagaagc

SEQ ID NO: 3632183 - RNA, 21 nt, Human
cuagauguauaacuaggagcu

SEQ ID NO: 3632184 - RNA, 21 nt, Human
cuagauguuuauucuucuaga

SEQ ID NO: 3632185 - RNA, 21 nt, Human
cuagauuacccccucauuguu

SEQ ID NO: 3632186 - RNA, 16 nt, Human
cuagauuauaucaaag

SEQ ID NO: 3632187 - RNA, 20 nt, Human
cuagauucaaagguucuagg

SEQ ID NO: 3632188 - RNA, 24 nt, Human
cuagauugagagaagagacaaaca

SEQ ID NO: 3632189 - RNA, 12 nt, Human
cuagauuuaaua

SEQ ID NO: 3632190 - RNA, 18 nt, Human
cuagauuuaauauaaagu

SEQ ID NO: 3632191 - RNA, 19 nt, Human
cuagauuuucacuuaugaa

SEQ ID NO: 3632192 - RNA, 20 nt, Human
cuagauuuuguuuugcuuuu

SEQ ID NO: 3632193 - RNA, 15 nt, Human
cuagcaaaagaagua

SEQ ID NO: 3632194 - RNA, 15 nt, Human
cuagcaaaauaaaac

SEQ ID NO: 3632195 - RNA, 21 nt, Human
cuagcaaccgccucaaaaugu

SEQ ID NO: 3632196 - RNA, 21 nt, Human
cuagcaagcugccgaaccaaa

SEQ ID NO: 3632197 - RNA, 19 nt, Human
cuagcaagugagagagaug

SEQ ID NO: 3632198 - RNA, 17 nt, Human
cuagcacagcucccuuc

SEQ ID NO: 3632199 - RNA, 20 nt, Human
cuagcacaugcuucaauagu

SEQ ID NO: 3632200 - RNA, 15 nt, Human
cuagcaccagggacu

SEQ ID NO: 3632201 - RNA, 19 nt, Human
cuagcacucauuuucuaua

SEQ ID NO: 3632202 - RNA, 14 nt, Human
cuagcacuggccug

SEQ ID NO: 3632203 - RNA, 16 nt, Human
cuagcacuuggagcca

SEQ ID NO: 3632204 - RNA, 11 nt, Human
cuagcagagag

SEQ ID NO: 3632205 - RNA, 23 nt, Human
cuagcagagcaggggcaggguga

SEQ ID NO: 3632206 - RNA, 19 nt, Human
cuagcagcaccguucugug

SEQ ID NO: 3632207 - RNA, 19 nt, Human
cuagcagcccacccugcug

SEQ ID NO: 3632208 - RNA, 16 nt, Human
cuagcauacguacaca

SEQ ID NO: 3632209 - RNA, 20 nt, Human
cuagcauacguacacauuuu

SEQ ID NO: 3632210 - RNA, 15 nt, Human
cuagcauaucugccu

SEQ ID NO: 3632211 - RNA, 21 nt, Human
cuagcauaugaguuucauagc

SEQ ID NO: 3632212 - RNA, 20 nt, Human
cuagccaaaccaggacccug

SEQ ID NO: 3632213 - RNA, 13 nt, Human
cuagccaaaccuc

SEQ ID NO: 3632214 - RNA, 22 nt, Human
cuagccaccaacucuugcaggu

SEQ ID NO: 3632215 - RNA, 19 nt, Human
cuagccaccgccuccuaca

SEQ ID NO: 3632216 - RNA, 15 nt, Human
cuagccagaggagag

SEQ ID NO: 3632217 - RNA, 23 nt, Human
cuagccaggaaguacuuccaccu

SEQ ID NO: 3632218 - RNA, 14 nt, Human
cuagccauuccugg

SEQ ID NO: 3632219 - RNA, 17 nt, Human
cuagccauuccugguac

SEQ ID NO: 3632220 - RNA, 18 nt, Human
cuagcccaaugaaaugaa

SEQ ID NO: 3632221 - RNA, 14 nt, Human
cuagcccacccugc

SEQ ID NO: 3632222 - RNA, 15 nt, Human
cuagcccaggagaga

SEQ ID NO: 3632223 - RNA, 16 nt, Human
cuagcccaggagagag

SEQ ID NO: 3632224 - RNA, 20 nt, Human
cuagcccaggagagagaaag

SEQ ID NO: 3632225 - RNA, 22 nt, Human
cuagcccaggagagagaaagcc

SEQ ID NO: 3632226 - RNA, 13 nt, Human
cuagccccugugg

SEQ ID NO: 3632227 - RNA, 20 nt, Human
cuagccccuguggagacugg

SEQ ID NO: 3632228 - RNA, 21 nt, Human
cuagccccuguggagacuggg

SEQ ID NO: 3632229 - RNA, 18 nt, Human
cuagcccuccuuuuucca

SEQ ID NO: 3632230 - RNA, 13 nt, Human
cuagcccucucac

SEQ ID NO: 3632231 - RNA, 19 nt, Human
cuagcccucucacauuuau

SEQ ID NO: 3632232 - RNA, 21 nt, Human
cuagcccucucccucuaggcu

SEQ ID NO: 3632233 - RNA, 20 nt, Human
cuagccuaggucauaaagag

SEQ ID NO: 3632234 - RNA, 21 nt, Human
cuagccuauuuaccugcaggc

SEQ ID NO: 3632235 - RNA, 13 nt, Human
cuagccucuccag

SEQ ID NO: 3632236 - RNA, 19 nt, Human
cuagccugugccucuggga

SEQ ID NO: 3632237 - RNA, 16 nt, Human
cuagccuguuucuucc

SEQ ID NO: 3632238 - RNA, 21 nt, Human
cuagccuuagaagucacacag

SEQ ID NO: 3632239 - RNA, 22 nt, Human
cuagccuuauccucugaucucc

SEQ ID NO: 3632240 - RNA, 11 nt, Human
cuagccuugcu

SEQ ID NO: 3632241 - RNA, 14 nt, Human
cuagccuugcuugu

SEQ ID NO: 3632242 - RNA, 15 nt, Human
cuagccuugcuuguu

SEQ ID NO: 3632243 - RNA, 19 nt, Human
cuagccuuuggcucuggag

SEQ ID NO: 3632244 - RNA, 17 nt, Human
cuagcgaucucuccugg

SEQ ID NO: 3632245 - RNA, 22 nt, Human
cuagcggaguuccagcaaacaa

SEQ ID NO: 3632246 - RNA, 19 nt, Human
cuagcgggauggggcuccc

SEQ ID NO: 3632247 - RNA, 22 nt, Human
cuagcguagugcagcagggcag

SEQ ID NO: 3632248 - RNA, 14 nt, Human
cuagcuagaaauau

SEQ ID NO: 3632249 - RNA, 16 nt, Human
cuagcuagaaauauga

SEQ ID NO: 3632250 - RNA, 21 nt, Human
cuagcuagaaauaugauuuua

SEQ ID NO: 3632251 - RNA, 23 nt, Human
cuagcuagaagugggccaggaca

SEQ ID NO: 3632252 - RNA, 16 nt, Human
cuagcuagcucaacua

SEQ ID NO: 3632253 - RNA, 19 nt, Human
cuagcuaugcuguaucugu

SEQ ID NO: 3632254 - RNA, 19 nt, Human
cuagcuccccuccucuccc

SEQ ID NO: 3632255 - RNA, 21 nt, Human
cuagcuccccuccucuccccu

SEQ ID NO: 3632256 - RNA, 23 nt, Human
cuagcuccccuccucuccccuac

SEQ ID NO: 3632257 - RNA, 20 nt, Human
cuagcucuauguuuacaaau

SEQ ID NO: 3632258 - RNA, 15 nt, Human
cuagcucucuaggcc

SEQ ID NO: 3632259 - RNA, 22 nt, Human
cuagcucucuaggccucuccag

SEQ ID NO: 3632260 - RNA, 10 nt, Human
cuagcugaau

SEQ ID NO: 3632261 - RNA, 19 nt, Human
cuagcugaauguuuuucua

SEQ ID NO: 3632262 - RNA, 20 nt, Human
cuagcugaauguuuuucuaa

SEQ ID NO: 3632263 - RNA, 17 nt, Human
cuagcugcacagggcag

SEQ ID NO: 3632264 - RNA, 21 nt, Human
cuagcugcacagggcagcugg

SEQ ID NO: 3632265 - RNA, 22 nt, Human
cuagcugccuagcaagcuggcc

SEQ ID NO: 3632266 - RNA, 15 nt, Human
cuagcugcuacaaag

SEQ ID NO: 3632267 - RNA, 23 nt, Human
cuagcuguccuuuuuccucucca

SEQ ID NO: 3632268 - RNA, 13 nt, Human
cuagcuucugcuu

SEQ ID NO: 3632269 - RNA, 15 nt, Human
cuagcuucugcuuuu

SEQ ID NO: 3632270 - RNA, 16 nt, Human
cuagcuucugcuuuuc

SEQ ID NO: 3632271 - RNA, 20 nt, Human
cuagcuuuauauauggacau

SEQ ID NO: 3632272 - RNA, 14 nt, Human
cuagcuuuuaggaa

SEQ ID NO: 3632273 - RNA, 19 nt, Human
cuaggaaaagaaaucuaua

SEQ ID NO: 3632274 - RNA, 12 nt, Human
cuaggaaaauac

SEQ ID NO: 3632275 - RNA, 17 nt, Human
cuaggaaauccagggug

SEQ ID NO: 3632276 - RNA, 15 nt, Human
cuaggaacacuccuu

SEQ ID NO: 3632277 - RNA, 11 nt, Human
cuaggaagaau

SEQ ID NO: 3632278 - RNA, 17 nt, Human
cuaggaagacuuuggaa

SEQ ID NO: 3632279 - RNA, 23 nt, Human
cuaggaagaucucugcagggccg

SEQ ID NO: 3632280 - RNA, 20 nt, Human
cuaggacacaguuccuggga

SEQ ID NO: 3632281 - RNA, 17 nt, Human
cuaggaccacucagccc

SEQ ID NO: 3632282 - RNA, 22 nt, Human
cuaggaccccuccaugugggcu

SEQ ID NO: 3632283 - RNA, 18 nt, Human
cuaggacgccacccagca

SEQ ID NO: 3632284 - RNA, 14 nt, Human
cuaggacucugagg

SEQ ID NO: 3632285 - RNA, 15 nt, Human
cuaggacucugaggc

SEQ ID NO: 3632286 - RNA, 17 nt, Human
cuaggacuucaaauugg

SEQ ID NO: 3632287 - RNA, 16 nt, Human
cuaggagaccaaggcg

SEQ ID NO: 3632288 - RNA, 19 nt, Human
cuaggagauaucugaggga

SEQ ID NO: 3632289 - RNA, 15 nt, Human
cuaggagcaaagccu

SEQ ID NO: 3632290 - RNA, 18 nt, Human
cuaggagcaaagccuguu

SEQ ID NO: 3632291 - RNA, 22 nt, Human
cuaggagcuuugacucaggagc

SEQ ID NO: 3632292 - RNA, 16 nt, Human
cuaggaggguccucug

SEQ ID NO: 3632293 - RNA, 14 nt, Human
cuaggagguaauga

SEQ ID NO: 3632294 - RNA, 17 nt, Human
cuaggaggucucuaaga

SEQ ID NO: 3632295 - RNA, 14 nt, Human
cuaggauacugcug

SEQ ID NO: 3632296 - RNA, 15 nt, Human
cuaggauacugcugc

SEQ ID NO: 3632297 - RNA, 22 nt, Human
cuaggauagcuaacuguaaauc

SEQ ID NO: 3632298 - RNA, 15 nt, Human
cuaggauaucuucuc

SEQ ID NO: 3632299 - RNA, 23 nt, Human
cuaggauguauauuuuauauaaa

SEQ ID NO: 3632300 - RNA, 20 nt, Human
cuaggauguugcucagaagu

SEQ ID NO: 3632301 - RNA, 19 nt, Human
cuaggauucacaccccacc

SEQ ID NO: 3632302 - RNA, 23 nt, Human
cuaggauucacaccccaccugcg

SEQ ID NO: 3632303 - RNA, 20 nt, Human
cuaggcacuguaguucuaag

SEQ ID NO: 3632304 - RNA, 13 nt, Human
cuaggcaggacau

SEQ ID NO: 3632305 - RNA, 22 nt, Human
cuaggcaggacaugcugaagcc

SEQ ID NO: 3632306 - RNA, 18 nt, Human
cuaggcagggugucugcc

SEQ ID NO: 3632307 - RNA, 22 nt, Human
cuaggcaguuagagaugccucc

SEQ ID NO: 3632308 - RNA, 17 nt, Human
cuaggcauucuggaccu

SEQ ID NO: 3632309 - RNA, 20 nt, Human
cuaggcauucuggaccucug

SEQ ID NO: 3632310 - RNA, 21 nt, Human
cuaggcauuuguaaauauuaa

SEQ ID NO: 3632311 - RNA, 22 nt, Human
cuaggcauuuguaaauauuaaa

SEQ ID NO: 3632312 - RNA, 17 nt, Human
cuaggccacuccuccaa

SEQ ID NO: 3632313 - RNA, 20 nt, Human
cuaggccaggugcaaccagg

SEQ ID NO: 3632314 - RNA, 20 nt, Human
cuaggcccccacuugccucu

SEQ ID NO: 3632315 - RNA, 13 nt, Human
cuaggccucagcc

SEQ ID NO: 3632316 - RNA, 16 nt, Human
cuaggccucagccaga

SEQ ID NO: 3632317 - RNA, 19 nt, Human
cuaggccuccuggcccagg

SEQ ID NO: 3632318 - RNA, 16 nt, Human
cuaggccucuccaguu

SEQ ID NO: 3632319 - RNA, 18 nt, Human
cuaggccuggccagaugc

SEQ ID NO: 3632320 - RNA, 18 nt, Human
cuaggcgagugccaggac

SEQ ID NO: 3632321 - RNA, 19 nt, Human
cuaggcgagugccaggacu

SEQ ID NO: 3632322 - RNA, 20 nt, Human
cuaggcuacaauuuucuccc

SEQ ID NO: 3632323 - RNA, 15 nt, Human
cuaggcuaggguggg

SEQ ID NO: 3632324 - RNA, 15 nt, Human
cuauccugcuguucu

SEQ ID NO: 3632325 - RNA, 19 nt, Human
cuauccuggcucuuuggag

SEQ ID NO: 3632326 - RNA, 12 nt, Human
cuauccuggcuu

SEQ ID NO: 3632327 - RNA, 13 nt, Human
cuauccuggcuuu

SEQ ID NO: 3632328 - RNA, 18 nt, Human
cuauccuggcuuugccca

SEQ ID NO: 3632329 - RNA, 12 nt, Human
cuauccuucgug

SEQ ID NO: 3632330 - RNA, 12 nt, Human
cuauccuuggca

SEQ ID NO: 3632331 - RNA, 20 nt, Human
cuauccuuggcaccaaagau

SEQ ID NO: 3632332 - RNA, 15 nt, Human
cuaucguaaaauuaa

SEQ ID NO: 3632333 - RNA, 18 nt, Human
cuaucguaaaauuaagaa

SEQ ID NO: 3632334 - RNA, 20 nt, Human
cuaucguucucucuuugcau

SEQ ID NO: 3632335 - RNA, 13 nt, Human
cuaucuaaaguuu

SEQ ID NO: 3632336 - RNA, 14 nt, Human
cuaucuaaaguuug

SEQ ID NO: 3632337 - RNA, 15 nt, Human
cuaucuacucuccuc

SEQ ID NO: 3632338 - RNA, 16 nt, Human
cuaucuacucuccuca

SEQ ID NO: 3632339 - RNA, 15 nt, Human
cuaucuaucuuccaa

SEQ ID NO: 3632340 - RNA, 14 nt, Human
cuaucucacagcac

SEQ ID NO: 3632341 - RNA, 19 nt, Human
cuaucuccagcggcccugu

SEQ ID NO: 3632342 - RNA, 15 nt, Human
cuaucuccugacaga

SEQ ID NO: 3632343 - RNA, 19 nt, Human
cuaucuccugacagaaggu

SEQ ID NO: 3632344 - RNA, 17 nt, Human
cuaucucucaaaacuug

SEQ ID NO: 3632345 - RNA, 17 nt, Human
cuaucugauuuugugca

SEQ ID NO: 3632346 - RNA, 18 nt, Human
cuaucugauuuugugcaa

SEQ ID NO: 3632347 - RNA, 18 nt, Human
cuaucugcuuaugcaguu

SEQ ID NO: 3632348 - RNA, 16 nt, Human
cuaucugggaagcuau

SEQ ID NO: 3632349 - RNA, 12 nt, Human
cuaucugggccu

SEQ ID NO: 3632350 - RNA, 15 nt, Human
cuaucugggccuggg

SEQ ID NO: 3632351 - RNA, 16 nt, Human
cuaucugggccugggc

SEQ ID NO: 3632352 - RNA, 14 nt, Human
cuaucugggcuucc

SEQ ID NO: 3632353 - RNA, 15 nt, Human
cuaucugggcuuccu

SEQ ID NO: 3632354 - RNA, 17 nt, Human
cuaucugggcuuccugg

SEQ ID NO: 3632355 - RNA, 21 nt, Human
cuaucugggcuuccuggagca

SEQ ID NO: 3632356 - RNA, 16 nt, Human
cuaucugguauuaaau

SEQ ID NO: 3632357 - RNA, 17 nt, Human
cuaucugucugguggcc

SEQ ID NO: 3632358 - RNA, 14 nt, Human
cuaucuguguuuug

SEQ ID NO: 3632359 - RNA, 21 nt, Human
cuaucuguuuacaguguuccg

SEQ ID NO: 3632360 - RNA, 15 nt, Human
cuaucuuaauuuugg

SEQ ID NO: 3632361 - RNA, 13 nt, Human
cuaucuuggagag

SEQ ID NO: 3632362 - RNA, 21 nt, Human
cuaugaaaagcuagaauugag

SEQ ID NO: 3632363 - RNA, 19 nt, Human
cuaugaaauauuauguuaa

SEQ ID NO: 3632364 - RNA, 19 nt, Human
cuaugaacucuguuuucuu

SEQ ID NO: 3632365 - RNA, 23 nt, Human
cuaugaaguauauaaugguuuca

SEQ ID NO: 3632366 - RNA, 20 nt, Human
cuaugaaucuauuauacugu

SEQ ID NO: 3632367 - RNA, 14 nt, Human
cuaugaaugggcaa

SEQ ID NO: 3632368 - RNA, 14 nt, Human
cuaugacacaugca

SEQ ID NO: 3632369 - RNA, 16 nt, Human
cuaugacugcucccca

SEQ ID NO: 3632370 - RNA, 20 nt, Human
cuaugacuugggcaccccca

SEQ ID NO: 3632371 - RNA, 12 nt, Human
cuaugaggaaag

SEQ ID NO: 3632372 - RNA, 13 nt, Human
cuaugaggaaagg

SEQ ID NO: 3632373 - RNA, 14 nt, Human
cuaugaggaaaggu

SEQ ID NO: 3632374 - RNA, 23 nt, Human
cuaugaggaauaauuauuuauuu

SEQ ID NO: 3632375 - RNA, 15 nt, Human
cuaugagggccuuga

SEQ ID NO: 3632376 - RNA, 14 nt, Human
cuaugagucuagau

SEQ ID NO: 3632377 - RNA, 20 nt, Human
cuaugaguggaaaaagccaa

SEQ ID NO: 3632378 - RNA, 22 nt, Human
cuaugaucccagcacuuuggga

SEQ ID NO: 3632379 - RNA, 16 nt, Human
cuaugauuuggaaaau

SEQ ID NO: 3632380 - RNA, 19 nt, Human
cuaugauuuggaaaauaaa

SEQ ID NO: 3632381 - RNA, 22 nt, Human
cuaugcaauauaucuaaauuga

SEQ ID NO: 3632382 - RNA, 20 nt, Human
cuaugcauaucaguugagcu

SEQ ID NO: 3632383 - RNA, 13 nt, Human
cuaugcauggugc

SEQ ID NO: 3632384 - RNA, 20 nt, Human
cuaugcauggugccccagga

SEQ ID NO: 3632385 - RNA, 20 nt, Human
cuaugcaugguuucagcacu

SEQ ID NO: 3632386 - RNA, 20 nt, Human
cuaugccagcucagucccau

SEQ ID NO: 3632387 - RNA, 13 nt, Human
cuaugcugcuuuu

SEQ ID NO: 3632388 - RNA, 21 nt, Human
cuaugcugguaggcuccugcc

SEQ ID NO: 3632389 - RNA, 18 nt, Human
cuaugcuguuuguaguga

SEQ ID NO: 3632390 - RNA, 15 nt, Human
cuaugcuuugaaaca

SEQ ID NO: 3632391 - RNA, 14 nt, Human
cuauggaauuuaua

SEQ ID NO: 3632392 - RNA, 12 nt, Human
cuauggacacag

SEQ ID NO: 3632393 - RNA, 14 nt, Human
cuauggagagcccu

SEQ ID NO: 3632394 - RNA, 17 nt, Human
cuauggagagcccuggg

SEQ ID NO: 3632395 - RNA, 16 nt, Human
cuauggauggcuucua

SEQ ID NO: 3632396 - RNA, 24 nt, Human
cuauggaugugggguccccaucau

SEQ ID NO: 3632397 - RNA, 22 nt, Human
cuauggcagaaaaaaugucugu

SEQ ID NO: 3632398 - RNA, 14 nt, Human
cuauggccugugcg

SEQ ID NO: 3632399 - RNA, 17 nt, Human
cuauggcuggccacugc

SEQ ID NO: 3632400 - RNA, 23 nt, Human
cuauggcuggccacugcacagag

SEQ ID NO: 3632401 - RNA, 19 nt, Human
cuaugggagagugucaacc

SEQ ID NO: 3632402 - RNA, 15 nt, Human
cuaugggagccccag

SEQ ID NO: 3632403 - RNA, 16 nt, Human
cuaugggagccccagg

SEQ ID NO: 3632404 - RNA, 16 nt, Human
cuauggggacauucca

SEQ ID NO: 3632405 - RNA, 21 nt, Human
cuauggggagaaaagacauga

SEQ ID NO: 3632406 - RNA, 19 nt, Human
cuaugggggcacugaggac

SEQ ID NO: 3632407 - RNA, 23 nt, Human
cuauggguaucaaacagcucagg

SEQ ID NO: 3632408 - RNA, 20 nt, Human
cuauggguguuaucaccuag

SEQ ID NO: 3632409 - RNA, 12 nt, Human
cuaugguaaaga

SEQ ID NO: 3632410 - RNA, 21 nt, Human
cuaugguaaagauauuauuca

SEQ ID NO: 3632411 - RNA, 22 nt, Human
cuaugguaaagauauuauucac

SEQ ID NO: 3632412 - RNA, 17 nt, Human
cuauggucuuauauuua

SEQ ID NO: 3632413 - RNA, 21 nt, Human
cuauggugccaauggaaccuc

SEQ ID NO: 3632414 - RNA, 16 nt, Human
cuauggugcucugucu

SEQ ID NO: 3632415 - RNA, 23 nt, Human
cuauggugcucugucuacuugcu

SEQ ID NO: 3632416 - RNA, 13 nt, Human
cuauguaaacuac

SEQ ID NO: 3632417 - RNA, 18 nt, Human
cuauguaacaaaccugca

SEQ ID NO: 3632418 - RNA, 15 nt, Human
cuauguaacugcauu

SEQ ID NO: 3632419 - RNA, 21 nt, Human
cuauguaacugcauugagaac

SEQ ID NO: 3632420 - RNA, 15 nt, Human
cuauguacaauauuu

SEQ ID NO: 3632421 - RNA, 14 nt, Human
cuauguaggaaaaa

SEQ ID NO: 3632422 - RNA, 19 nt, Human
cuauguaggaaaaaaauag

SEQ ID NO: 3632423 - RNA, 15 nt, Human
cuauguauaaaauac

SEQ ID NO: 3632424 - RNA, 18 nt, Human
cuauguauaaaauacaua

SEQ ID NO: 3632425 - RNA, 24 nt, Human
cuauguauaaaauacauagugaaa

SEQ ID NO: 3632426 - RNA, 13 nt, Human
cuauguauuugca

SEQ ID NO: 3632427 - RNA, 15 nt, Human
cuaugucccaggaau

SEQ ID NO: 3632428 - RNA, 16 nt, Human
cuaugucccuugcugu

SEQ ID NO: 3632429 - RNA, 15 nt, Human
cuauguccuaaggac

SEQ ID NO: 3632430 - RNA, 20 nt, Human
cuaugugacuugcaucgugg

SEQ ID NO: 3632431 - RNA, 18 nt, Human
cuaugugauuuuaacucu

SEQ ID NO: 3632432 - RNA, 23 nt, Human
cuauguggaaguggggcgggcuu

SEQ ID NO: 3632433 - RNA, 17 nt, Human
cuauguggcuguaucuu

SEQ ID NO: 3632434 - RNA, 15 nt, Human
cuauguuaauauuuu

SEQ ID NO: 3632435 - RNA, 15 nt, Human
cuauguuacuauuuu

SEQ ID NO: 3632436 - RNA, 14 nt, Human
cuauguugcccagg

SEQ ID NO: 3632437 - RNA, 14 nt, Human
cuauguuugcacuu

SEQ ID NO: 3632438 - RNA, 11 nt, Human
cuauguuugcu

SEQ ID NO: 3632439 - RNA, 19 nt, Human
cuauguuuugacauuuuua

SEQ ID NO: 3632440 - RNA, 14 nt, Human
cuauguuuuuaaug

SEQ ID NO: 3632441 - RNA, 15 nt, Human
cuauguuuuuaaugu

SEQ ID NO: 3632442 - RNA, 16 nt, Human
cuauguuuuuaaugua

SEQ ID NO: 3632443 - RNA, 11 nt, Human
cuauuaaaaga

SEQ ID NO: 3632444 - RNA, 12 nt, Human
cuauuaaaagac

SEQ ID NO: 3632445 - RNA, 20 nt, Human
cuauuaaagugcuaagguuc

SEQ ID NO: 3632446 - RNA, 22 nt, Human
cuauuaaaguggagaagcacac

SEQ ID NO: 3632447 - RNA, 16 nt, Human
cuauuaagauuuccaa

SEQ ID NO: 3632448 - RNA, 19 nt, Human
cuauuaaggauguagcuuu

SEQ ID NO: 3632449 - RNA, 22 nt, Human
cuauuaaggauguagcuuuuca

SEQ ID NO: 3632450 - RNA, 19 nt, Human
cuauuaaggugauauauuu

SEQ ID NO: 3632451 - RNA, 20 nt, Human
cuauuaccacugaagauaga

SEQ ID NO: 3632452 - RNA, 21 nt, Human
cuauuaccacugaagauagaa

SEQ ID NO: 3632453 - RNA, 14 nt, Human
cuauuagacuguag

SEQ ID NO: 3632454 - RNA, 12 nt, Human
cuauuagacuuu

SEQ ID NO: 3632455 - RNA, 18 nt, Human
cuauuagacuuuagaaau

SEQ ID NO: 3632456 - RNA, 21 nt, Human
cuauuagacuuuagaaauaaa

SEQ ID NO: 3632457 - RNA, 16 nt, Human
cuauuagccacaaaau

SEQ ID NO: 3632458 - RNA, 13 nt, Human
cuauuagccaguc

SEQ ID NO: 3632459 - RNA, 21 nt, Human
cuauuaggugcaauuucaagg

SEQ ID NO: 3632460 - RNA, 19 nt, Human
cuauuaguguuauaugaac

SEQ ID NO: 3632461 - RNA, 14 nt, Human
cuauuauagccaca

SEQ ID NO: 3632462 - RNA, 14 nt, Human
cuauuauauuaaaa

SEQ ID NO: 3632463 - RNA, 19 nt, Human
cuauuaucccagcugccua

SEQ ID NO: 3632464 - RNA, 23 nt, Human
cuauuaugaaugugaagccuucc

SEQ ID NO: 3632465 - RNA, 16 nt, Human
cuauuauggaaaacug

SEQ ID NO: 3632466 - RNA, 17 nt, Human
cuauuauggaaaacugu

SEQ ID NO: 3632467 - RNA, 18 nt, Human
cuauuauguuguuagaga

SEQ ID NO: 3632468 - RNA, 20 nt, Human
cuauuauuuucacuguagaa

SEQ ID NO: 3632469 - RNA, 18 nt, Human
cuccgccagccuccucug

SEQ ID NO: 3632470 - RNA, 23 nt, Human
cuccgccaggcgagauggggugg

SEQ ID NO: 3632471 - RNA, 23 nt, Human
cuccgccauucucaagcccugca

SEQ ID NO: 3632472 - RNA, 16 nt, Human
cuccgcccccagccua

SEQ ID NO: 3632473 - RNA, 17 nt, Human
cuccgcccccagccuau

SEQ ID NO: 3632474 - RNA, 20 nt, Human
cuccgcccccagccuaugag

SEQ ID NO: 3632475 - RNA, 21 nt, Human
cuccgcccccagccuaugagc

SEQ ID NO: 3632476 - RNA, 15 nt, Human
cuccgcccccaggua

SEQ ID NO: 3632477 - RNA, 16 nt, Human
cuccgccccugagccc

SEQ ID NO: 3632478 - RNA, 18 nt, Human
cuccgccccugagcccac

SEQ ID NO: 3632479 - RNA, 20 nt, Human
cuccgccccugagcccacug

SEQ ID NO: 3632480 - RNA, 14 nt, Human
cuccgcccuuaguc

SEQ ID NO: 3632481 - RNA, 15 nt, Human
cuccgccucccgggu

SEQ ID NO: 3632482 - RNA, 16 nt, Human
cuccgccuggccuggc

SEQ ID NO: 3632483 - RNA, 12 nt, Human
cuccgccuucac

SEQ ID NO: 3632484 - RNA, 19 nt, Human
cuccgccuucacuccggug

SEQ ID NO: 3632485 - RNA, 23 nt, Human
cuccgcggcgggcccugcccaca

SEQ ID NO: 3632486 - RNA, 12 nt, Human
cuccgcugugug

SEQ ID NO: 3632487 - RNA, 18 nt, Human
cuccgcuguguggauggg

SEQ ID NO: 3632488 - RNA, 19 nt, Human
cuccgcuuucuacccagcg

SEQ ID NO: 3632489 - RNA, 23 nt, Human
cuccgcuuucuacccagcgagcc

SEQ ID NO: 3632490 - RNA, 14 nt, Human
cuccggacuggugc

SEQ ID NO: 3632491 - RNA, 22 nt, Human
cuccggaggcugaggcaggaga

SEQ ID NO: 3632492 - RNA, 23 nt, Human
cuccggaggcugaggcaggagaa

SEQ ID NO: 3632493 - RNA, 21 nt, Human
cuccggcccuccuacccugcg

SEQ ID NO: 3632494 - RNA, 14 nt, Human
cuccggccuccccu

SEQ ID NO: 3632495 - RNA, 14 nt, Human
cuccggccucucca

SEQ ID NO: 3632496 - RNA, 22 nt, Human
cuccggccugaugacagagcga

SEQ ID NO: 3632497 - RNA, 20 nt, Human
cuccggcgucagccuccagc

SEQ ID NO: 3632498 - RNA, 15 nt, Human
cuccggcucccagcc

SEQ ID NO: 3632499 - RNA, 17 nt, Human
cuccggcucccagccuc

SEQ ID NO: 3632500 - RNA, 19 nt, Human
cuccggcucccagccucag

SEQ ID NO: 3632501 - RNA, 14 nt, Human
cuccggcugugcug

SEQ ID NO: 3632502 - RNA, 14 nt, Human
cuccgggaccccca

SEQ ID NO: 3632503 - RNA, 17 nt, Human
cuccgucacuaccuggc

SEQ ID NO: 3632504 - RNA, 19 nt, Human
cuccgucacuaccuggcug

SEQ ID NO: 3632505 - RNA, 22 nt, Human
cuccguccaggagccugugccu

SEQ ID NO: 3632506 - RNA, 15 nt, Human
cuccgugccuccacc

SEQ ID NO: 3632507 - RNA, 16 nt, Human
cuccgugccuccacca

SEQ ID NO: 3632508 - RNA, 21 nt, Human
cuccgugccuccaccaccacu

SEQ ID NO: 3632509 - RNA, 16 nt, Human
cuccgugcuuccucag

SEQ ID NO: 3632510 - RNA, 19 nt, Human
cuccgugcuuccucaguua

SEQ ID NO: 3632511 - RNA, 22 nt, Human
cuccguuagcuccuguggcccc

SEQ ID NO: 3632512 - RNA, 20 nt, Human
cuccuaaaacaacagaugua

SEQ ID NO: 3632513 - RNA, 12 nt, Human
cuccuaagagag

SEQ ID NO: 3632514 - RNA, 14 nt, Human
cuccuaagcaccug

SEQ ID NO: 3632515 - RNA, 23 nt, Human
cuccuaccccucccagcugacag

SEQ ID NO: 3632516 - RNA, 12 nt, Human
cuccuaccucag

SEQ ID NO: 3632517 - RNA, 13 nt, Human
cuccuaccucagc

SEQ ID NO: 3632518 - RNA, 15 nt, Human
cuccuaccucagccu

SEQ ID NO: 3632519 - RNA, 18 nt, Human
cuccuaccucagccuaga

SEQ ID NO: 3632520 - RNA, 18 nt, Human
cuccuaccugcccuggaa

SEQ ID NO: 3632521 - RNA, 13 nt, Human
cuccuacuccuga

SEQ ID NO: 3632522 - RNA, 15 nt, Human
cuccuagagaacgca

SEQ ID NO: 3632523 - RNA, 18 nt, Human
cuccuagagaacgcagcc

SEQ ID NO: 3632524 - RNA, 21 nt, Human
cuccuagagaacgcagcccua

SEQ ID NO: 3632525 - RNA, 17 nt, Human
cuccuagagacagaagc

SEQ ID NO: 3632526 - RNA, 23 nt, Human
cuccuagagacagaagcaggcug

SEQ ID NO: 3632527 - RNA, 13 nt, Human
cuccuagagggag

SEQ ID NO: 3632528 - RNA, 16 nt, Human
cuccuagccacccacc

SEQ ID NO: 3632529 - RNA, 14 nt, Human
cuccuagcuguccu

SEQ ID NO: 3632530 - RNA, 15 nt, Human
cuccuaggaaaauac

SEQ ID NO: 3632531 - RNA, 19 nt, Human
cuccuaggcauucuggacc

SEQ ID NO: 3632532 - RNA, 17 nt, Human
cuccuauaaucugucaa

SEQ ID NO: 3632533 - RNA, 18 nt, Human
cuccuauaaucugucaaa

SEQ ID NO: 3632534 - RNA, 22 nt, Human
cuccuauaaucugucaaaacac

SEQ ID NO: 3632535 - RNA, 14 nt, Human
cuccuauauauuuc

SEQ ID NO: 3632536 - RNA, 18 nt, Human
cuccuauauauuucuauu

SEQ ID NO: 3632537 - RNA, 19 nt, Human
cuccuaucaccuccccucc

SEQ ID NO: 3632538 - RNA, 22 nt, Human
cuccuaucagaaguuucucagc

SEQ ID NO: 3632539 - RNA, 13 nt, Human
cuccuaucugugu

SEQ ID NO: 3632540 - RNA, 14 nt, Human
cuccuaucuguguu

SEQ ID NO: 3632541 - RNA, 15 nt, Human
cuccuaucuguguuu

SEQ ID NO: 3632542 - RNA, 17 nt, Human
cuccuaugaucucaggu

SEQ ID NO: 3632543 - RNA, 12 nt, Human
cuccuaugugua

SEQ ID NO: 3632544 - RNA, 13 nt, Human
cuccuauguguaa

SEQ ID NO: 3632545 - RNA, 16 nt, Human
cuccuauucuauaaaa

SEQ ID NO: 3632546 - RNA, 16 nt, Human
cuccuauuuuuguaaa

SEQ ID NO: 3632547 - RNA, 18 nt, Human
cuccuauuuuuuuaaaau

SEQ ID NO: 3632548 - RNA, 15 nt, Human
cuccucaaccccucc

SEQ ID NO: 3632549 - RNA, 20 nt, Human
cuccucaauuuuugucucag

SEQ ID NO: 3632550 - RNA, 17 nt, Human
cuccucaccucaugccc

SEQ ID NO: 3632551 - RNA, 13 nt, Human
cuccucaccucug

SEQ ID NO: 3632552 - RNA, 22 nt, Human
cuccucaccucuggacuggcua

SEQ ID NO: 3632553 - RNA, 21 nt, Human
cuccucacucccuucccauaa

SEQ ID NO: 3632554 - RNA, 18 nt, Human
cuccucacugcccgcaca

SEQ ID NO: 3632555 - RNA, 18 nt, Human
cuccucacuggccauccc

SEQ ID NO: 3632556 - RNA, 20 nt, Human
cuccucacuggccaucccuc

SEQ ID NO: 3632557 - RNA, 14 nt, Human
cuccucacuguauc

SEQ ID NO: 3632558 - RNA, 19 nt, Human
cuccucacuguauccaggu

SEQ ID NO: 3632559 - RNA, 12 nt, Human
cuccucagaucu

SEQ ID NO: 3632560 - RNA, 18 nt, Human
cuccucagaucuucugug

SEQ ID NO: 3632561 - RNA, 11 nt, Human
cuccucagccu

SEQ ID NO: 3632562 - RNA, 12 nt, Human
cuccucaggacc

SEQ ID NO: 3632563 - RNA, 12 nt, Human
cuccucaggagc

SEQ ID NO: 3632564 - RNA, 13 nt, Human
cuccucaggagcc

SEQ ID NO: 3632565 - RNA, 19 nt, Human
cuccucaggcacacagcua

SEQ ID NO: 3632566 - RNA, 21 nt, Human
cuccucaggcacacagcuacu

SEQ ID NO: 3632567 - RNA, 22 nt, Human
cuccucagggauggccguuggc

SEQ ID NO: 3632568 - RNA, 18 nt, Human
cuccucaggguugagguc

SEQ ID NO: 3632569 - RNA, 16 nt, Human
cuccucauccagggcu

SEQ ID NO: 3632570 - RNA, 20 nt, Human
cuccucauguacauacccug

SEQ ID NO: 3632571 - RNA, 23 nt, Human
cuccuccaaaggaagucuaggag

SEQ ID NO: 3632572 - RNA, 21 nt, Human
cuccuccaagacacuguggac

SEQ ID NO: 3632573 - RNA, 21 nt, Human
cuccuccaccaccgcccgucu

SEQ ID NO: 3632574 - RNA, 18 nt, Human
cuccuccaccgccauggc

SEQ ID NO: 3632575 - RNA, 19 nt, Human
cuccuccaccgccauggcu

SEQ ID NO: 3632576 - RNA, 15 nt, Human
cuccuccagccccug

SEQ ID NO: 3632577 - RNA, 16 nt, Human
cuccuccagccccugu

SEQ ID NO: 3632578 - RNA, 21 nt, Human
cuccuccaggccugccuccca

SEQ ID NO: 3632579 - RNA, 19 nt, Human
cuccuccagggccacgugc

SEQ ID NO: 3632580 - RNA, 20 nt, Human
cuccuccagggccacgugcc

SEQ ID NO: 3632581 - RNA, 21 nt, Human
cuccuccagggugauuuuaug

SEQ ID NO: 3632582 - RNA, 23 nt, Human
cuccuccagugugggcuugacca

SEQ ID NO: 3632583 - RNA, 15 nt, Human
cuccucccacccggc

SEQ ID NO: 3632584 - RNA, 12 nt, Human
cuccucccacug

SEQ ID NO: 3632585 - RNA, 17 nt, Human
cuccucccacugcccac

SEQ ID NO: 3632586 - RNA, 14 nt, Human
cuccucccagccca

SEQ ID NO: 3632587 - RNA, 14 nt, Human
cuccucccagcuug

SEQ ID NO: 3632588 - RNA, 11 nt, Human
cuccucccagg

SEQ ID NO: 3632589 - RNA, 12 nt, Human
cuccucccagga

SEQ ID NO: 3632590 - RNA, 22 nt, Human
cuccucccaggcgccccuuccc

SEQ ID NO: 3632591 - RNA, 23 nt, Human
cuccucccaggcgccccuucccc

SEQ ID NO: 3632592 - RNA, 14 nt, Human
cuccucccaggguu

SEQ ID NO: 3632593 - RNA, 22 nt, Human
cuccucccaggguuuuaacuuu

SEQ ID NO: 3632594 - RNA, 14 nt, Human
cuccucccauguca

SEQ ID NO: 3632595 - RNA, 19 nt, Human
cuccuccccacccuccugg

SEQ ID NO: 3632596 - RNA, 21 nt, Human
cuccuccccccuccucugaaa

SEQ ID NO: 3632597 - RNA, 10 nt, Human
cuccucccuc

SEQ ID NO: 3632598 - RNA, 19 nt, Human
cuccucccugauguacagu

SEQ ID NO: 3632599 - RNA, 15 nt, Human
cuccucccugcaucu

SEQ ID NO: 3632600 - RNA, 18 nt, Human
cuccucccugcaucugac

SEQ ID NO: 3632601 - RNA, 17 nt, Human
cuccucccuggcugccc

SEQ ID NO: 3632602 - RNA, 19 nt, Human
cuccucccuggcugcccug

SEQ ID NO: 3632603 - RNA, 22 nt, Human
cuccucccuggcugcccuggcc

SEQ ID NO: 3632604 - RNA, 13 nt, Human
cuccucccuguua

SEQ ID NO: 3632605 - RNA, 20 nt, Human
cuccucccuguuauuuucaa

SEQ ID NO: 3632606 - RNA, 20 nt, Human
cuccucccuuagcucccugu

SEQ ID NO: 3632607 - RNA, 19 nt, Human
cuccucccuuuuuccuugu

SEQ ID NO: 3632608 - RNA, 15 nt, Human
cuccuccucccugca

SEQ ID NO: 3632609 - RNA, 17 nt, Human
cuccuccucuuucucuc

SEQ ID NO: 3632610 - RNA, 16 nt, Human
cuccuccuucccaaag

SEQ ID NO: 3632611 - RNA, 14 nt, Human
cuccuccuuccuag

SEQ ID NO: 3632612 - RNA, 24 nt, Human
cuccucgagaucccaacacugcca

SEQ ID NO: 3632613 - RNA, 15 nt, Human
cuccucgagggcagg

SEQ ID NO: 3632614 - RNA, 12 nt, Human
cucgcaacccgu

SEQ ID NO: 3632615 - RNA, 21 nt, Human
cucgcaacccgugccaagucc

SEQ ID NO: 3632616 - RNA, 22 nt, Human
cucgcaacccgugccaagucca

SEQ ID NO: 3632617 - RNA, 23 nt, Human
cucgcaacccgugccaaguccag

SEQ ID NO: 3632618 - RNA, 17 nt, Human
cucgcaccccccuguuc

SEQ ID NO: 3632619 - RNA, 23 nt, Human
cucgcaccccccuguucuaaggg

SEQ ID NO: 3632620 - RNA, 20 nt, Human
cucgcagagaggccaggugc

SEQ ID NO: 3632621 - RNA, 18 nt, Human
cucgcagccucucagugc

SEQ ID NO: 3632622 - RNA, 22 nt, Human
cucgcauaggaccuuuccacca

SEQ ID NO: 3632623 - RNA, 15 nt, Human
cucgcaucuucccaa

SEQ ID NO: 3632624 - RNA, 12 nt, Human
cucgccaugccg

SEQ ID NO: 3632625 - RNA, 14 nt, Human
cucgcccaguccca

SEQ ID NO: 3632626 - RNA, 19 nt, Human
cucgcccagucccagcagc

SEQ ID NO: 3632627 - RNA, 17 nt, Human
cucgccccaccggcgcg

SEQ ID NO: 3632628 - RNA, 14 nt, Human
cucgccccagcagg

SEQ ID NO: 3632629 - RNA, 15 nt, Human
cucgccccuggcaga

SEQ ID NO: 3632630 - RNA, 21 nt, Human
cucgcccgcccacuguccugg

SEQ ID NO: 3632631 - RNA, 18 nt, Human
cucgccggaucugaggga

SEQ ID NO: 3632632 - RNA, 14 nt, Human
cucgccucucccac

SEQ ID NO: 3632633 - RNA, 17 nt, Human
cucgccuggccugaggu

SEQ ID NO: 3632634 - RNA, 15 nt, Human
cucgccuucccuccu

SEQ ID NO: 3632635 - RNA, 16 nt, Human
cucgcgcucaguaaac

SEQ ID NO: 3632636 - RNA, 15 nt, Human
cucgcggcccucagu

SEQ ID NO: 3632637 - RNA, 19 nt, Human
cucgcuacauuuccgccac

SEQ ID NO: 3632638 - RNA, 22 nt, Human
cucgcuauugucaccagggcug

SEQ ID NO: 3632639 - RNA, 16 nt, Human
cucgcuccaacuccaa

SEQ ID NO: 3632640 - RNA, 23 nt, Human
cucgcuccccacucugcucugau

SEQ ID NO: 3632641 - RNA, 18 nt, Human
cucgcucccucccaggac

SEQ ID NO: 3632642 - RNA, 13 nt, Human
cucgcucugucac

SEQ ID NO: 3632643 - RNA, 23 nt, Human
cucgcucugucgcccaggcugga

SEQ ID NO: 3632644 - RNA, 16 nt, Human
cucgcucuguugccca

SEQ ID NO: 3632645 - RNA, 16 nt, Human
cucgcugaugcugggc

SEQ ID NO: 3632646 - RNA, 22 nt, Human
cucgcugaugcugggcugggug

SEQ ID NO: 3632647 - RNA, 18 nt, Human
cucgcugcacaaauacuc

SEQ ID NO: 3632648 - RNA, 15 nt, Human
cucgcugcuucugug

SEQ ID NO: 3632649 - RNA, 16 nt, Human
cucgcuggacucucag

SEQ ID NO: 3632650 - RNA, 14 nt, Human
cucgcuucccccau

SEQ ID NO: 3632651 - RNA, 18 nt, Human
cucgcuucccccauagcc

SEQ ID NO: 3632652 - RNA, 22 nt, Human
cucgcuuggacggcugggcaca

SEQ ID NO: 3632653 - RNA, 21 nt, Human
cucgcuuguaaauaccaggau

SEQ ID NO: 3632654 - RNA, 18 nt, Human
cucggaaccgcucaccua

SEQ ID NO: 3632655 - RNA, 14 nt, Human
cucggaaucuauuu

SEQ ID NO: 3632656 - RNA, 20 nt, Human
cucggaaucuauuuucucau

SEQ ID NO: 3632657 - RNA, 18 nt, Human
cucggacuaagccuaccu

SEQ ID NO: 3632658 - RNA, 22 nt, Human
cucggacuaagccuaccugcuc

SEQ ID NO: 3632659 - RNA, 13 nt, Human
cucggacucugcu

SEQ ID NO: 3632660 - RNA, 12 nt, Human
cucggagaagag

SEQ ID NO: 3632661 - RNA, 13 nt, Human
cucggagaagagc

SEQ ID NO: 3632662 - RNA, 22 nt, Human
cucggagccucauccgaggcag

SEQ ID NO: 3632663 - RNA, 23 nt, Human
cucggagccucauccgaggcagg

SEQ ID NO: 3632664 - RNA, 20 nt, Human
cucggaguaucugggaacug

SEQ ID NO: 3632665 - RNA, 21 nt, Human
cucggaguaucugggaacugu

SEQ ID NO: 3632666 - RNA, 21 nt, Human
cucggaguguguaugccaaga

SEQ ID NO: 3632667 - RNA, 23 nt, Human
cucggauccccuuccuaccaccc

SEQ ID NO: 3632668 - RNA, 23 nt, Human
cucggccucccaaagugcuggga

SEQ ID NO: 3632669 - RNA, 22 nt, Human
cucggccuccuaaagugcuggg

SEQ ID NO: 3632670 - RNA, 18 nt, Human
cucggcucacugcauccu

SEQ ID NO: 3632671 - RNA, 19 nt, Human
cucggcuccccaugugucc

SEQ ID NO: 3632672 - RNA, 22 nt, Human
cucggcuccccauguguccugg

SEQ ID NO: 3632673 - RNA, 13 nt, Human
cucggcucugcag

SEQ ID NO: 3632674 - RNA, 19 nt, Human
cucggcuuuucucagcugg

SEQ ID NO: 3632675 - RNA, 19 nt, Human
cucgggaggcugagacagg

SEQ ID NO: 3632676 - RNA, 20 nt, Human
cucgggaggcugaggcacaa

SEQ ID NO: 3632677 - RNA, 20 nt, Human
cucgggcccaccuggccacc

SEQ ID NO: 3632678 - RNA, 19 nt, Human
cucggggauguguccugac

SEQ ID NO: 3632679 - RNA, 15 nt, Human
cucggggugcacagg

SEQ ID NO: 3632680 - RNA, 18 nt, Human
cucggggugcacaggagg

SEQ ID NO: 3632681 - RNA, 21 nt, Human
cucggguggcuagucagagag

SEQ ID NO: 3632682 - RNA, 18 nt, Human
cucgguacccggggccca

SEQ ID NO: 3632683 - RNA, 22 nt, Human
cucgguacccggggcccagggc

SEQ ID NO: 3632684 - RNA, 11 nt, Human
cucggugccuu

SEQ ID NO: 3632685 - RNA, 11 nt, Human
cucggugguac

SEQ ID NO: 3632686 - RNA, 21 nt, Human
cucgguguccccaccaucugc

SEQ ID NO: 3632687 - RNA, 22 nt, Human
cucgguguccccaccaucugcu

SEQ ID NO: 3632688 - RNA, 17 nt, Human
cucgguguggagaagcg

SEQ ID NO: 3632689 - RNA, 14 nt, Human
cucgguugaaaccu

SEQ ID NO: 3632690 - RNA, 13 nt, Human
cucgguuucucca

SEQ ID NO: 3632691 - RNA, 22 nt, Human
cucgguuugccaaaauucauuu

SEQ ID NO: 3632692 - RNA, 14 nt, Human
cucguaacugguuu

SEQ ID NO: 3632693 - RNA, 18 nt, Human
cucguauaugucucaggu

SEQ ID NO: 3632694 - RNA, 22 nt, Human
cucgucaucauuuuuccuuccc

SEQ ID NO: 3632695 - RNA, 22 nt, Human
cucguccucccccugccagugc

SEQ ID NO: 3632696 - RNA, 23 nt, Human
cucgucucuuuuacccuggcccc

SEQ ID NO: 3632697 - RNA, 13 nt, Human
cucgucuuuccca

SEQ ID NO: 3632698 - RNA, 19 nt, Human
cucgugcaucccugagaca

SEQ ID NO: 3632699 - RNA, 21 nt, Human
cucgugccagucgcgcugccu

SEQ ID NO: 3632700 - RNA, 22 nt, Human
cucgugccagucgcgcugccug

SEQ ID NO: 3632701 - RNA, 20 nt, Human
cucguggacaccugcccugc

SEQ ID NO: 3632702 - RNA, 21 nt, Human
cucguggacaccugcccugcc

SEQ ID NO: 3632703 - RNA, 18 nt, Human
cucguggccagcccggcu

SEQ ID NO: 3632704 - RNA, 20 nt, Human
cucguggccuuccccagccu

SEQ ID NO: 3632705 - RNA, 21 nt, Human
cucguggccuuccccagccuc

SEQ ID NO: 3632706 - RNA, 14 nt, Human
cucguggcugucaa

SEQ ID NO: 3632707 - RNA, 16 nt, Human
cucgugguccccaaca

SEQ ID NO: 3632708 - RNA, 23 nt, Human
cucguguuauuuuaaucucagaa

SEQ ID NO: 3632709 - RNA, 17 nt, Human
cucguuccuuucuccug

SEQ ID NO: 3632710 - RNA, 23 nt, Human
cucguugacuggcuguguguugg

SEQ ID NO: 3632711 - RNA, 18 nt, Human
cucguuggaagaggaaca

SEQ ID NO: 3632712 - RNA, 13 nt, Human
cucguuugugauu

SEQ ID NO: 3632713 - RNA, 21 nt, Human
cucguuuuucuucuuaagacu

SEQ ID NO: 3632714 - RNA, 13 nt, Human
cucuaaaagaucc

SEQ ID NO: 3632715 - RNA, 22 nt, Human
cucuaaaagguaauguguggau

SEQ ID NO: 3632716 - RNA, 17 nt, Human
cucuaaaagguucaggg

SEQ ID NO: 3632717 - RNA, 21 nt, Human
cucuaaagaguuuauuuuaag

SEQ ID NO: 3632718 - RNA, 12 nt, Human
cucuaaagcaaa

SEQ ID NO: 3632719 - RNA, 16 nt, Human
cucuaaagcaaauuua

SEQ ID NO: 3632720 - RNA, 11 nt, Human
cucuaaagcac

SEQ ID NO: 3632721 - RNA, 23 nt, Human
cucuaaauacugagaaaaccugu

SEQ ID NO: 3632722 - RNA, 22 nt, Human
cucuaaaugaggggccucaggu

SEQ ID NO: 3632723 - RNA, 14 nt, Human
cucuaacagcucag

SEQ ID NO: 3632724 - RNA, 16 nt, Human
cucuaacagcucagga

SEQ ID NO: 3632725 - RNA, 18 nt, Human
cucuaacagcucaggauc

SEQ ID NO: 3632726 - RNA, 13 nt, Human
cucuaacauuucc

SEQ ID NO: 3632727 - RNA, 18 nt, Human
cucuaaccccaggccccg

SEQ ID NO: 3632728 - RNA, 17 nt, Human
cucuaaccucgcccucu

SEQ ID NO: 3632729 - RNA, 20 nt, Human
cucuaaccucgcccucuccu

SEQ ID NO: 3632730 - RNA, 21 nt, Human
cucuaacgccugagcccaggg

SEQ ID NO: 3632731 - RNA, 22 nt, Human
cucuaacgccugagcccaggga

SEQ ID NO: 3632732 - RNA, 20 nt, Human
cucuaacuuggcucacacuc

SEQ ID NO: 3632733 - RNA, 22 nt, Human
cucuaagaucuuagauucucug

SEQ ID NO: 3632734 - RNA, 19 nt, Human
cucuaagauguuauauuuu

SEQ ID NO: 3632735 - RNA, 16 nt, Human
cucuaaggcaggaugu

SEQ ID NO: 3632736 - RNA, 23 nt, Human
cucuaaggccgaagaaggguccu

SEQ ID NO: 3632737 - RNA, 14 nt, Human
cucuaagguugggc

SEQ ID NO: 3632738 - RNA, 22 nt, Human
cucuaagucauguauguuucuc

SEQ ID NO: 3632739 - RNA, 18 nt, Human
cucuaagugggcauugcc

SEQ ID NO: 3632740 - RNA, 19 nt, Human
cucuaagugggcauugcca

SEQ ID NO: 3632741 - RNA, 20 nt, Human
cucuaagugggcauugccau

SEQ ID NO: 3632742 - RNA, 18 nt, Human
cucuaaguguuugcugca

SEQ ID NO: 3632743 - RNA, 21 nt, Human
cucuaaguuccacugagcucc

SEQ ID NO: 3632744 - RNA, 13 nt, Human
cucuaauaaaaca

SEQ ID NO: 3632745 - RNA, 12 nt, Human
cucuaauaagaa

SEQ ID NO: 3632746 - RNA, 12 nt, Human
cucuaauaauaa

SEQ ID NO: 3632747 - RNA, 15 nt, Human
cucuaauaucagcaa

SEQ ID NO: 3632748 - RNA, 18 nt, Human
cucuaaugcucacgcucc

SEQ ID NO: 3632749 - RNA, 15 nt, Human
cucuaauucacagug

SEQ ID NO: 3632750 - RNA, 20 nt, Human
cucuaauucacagugcucuu

SEQ ID NO: 3632751 - RNA, 20 nt, Human
cucuaauucccauuuugcaa

SEQ ID NO: 3632752 - RNA, 13 nt, Human
cucuaauucuaac

SEQ ID NO: 3632753 - RNA, 17 nt, Human
cucuacaaacucccacu

SEQ ID NO: 3632754 - RNA, 17 nt, Human
cucuacaacugaguccu

SEQ ID NO: 3632755 - RNA, 17 nt, Human
cucuacaauuggaagau

SEQ ID NO: 3632756 - RNA, 14 nt, Human
cucuacacugugaa

SEQ ID NO: 3632757 - RNA, 20 nt, Human
cugagcagugaaugauucag

SEQ ID NO: 3632758 - RNA, 18 nt, Human
cugagccacagcagcauu

SEQ ID NO: 3632759 - RNA, 20 nt, Human
cugagccacagcagcauuuu

SEQ ID NO: 3632760 - RNA, 13 nt, Human
cugagccacagug

SEQ ID NO: 3632761 - RNA, 12 nt, Human
cugagccaccug

SEQ ID NO: 3632762 - RNA, 15 nt, Human
cugagccacucucuu

SEQ ID NO: 3632763 - RNA, 13 nt, Human
cugagccagauuu

SEQ ID NO: 3632764 - RNA, 15 nt, Human
cugagccagauuuca

SEQ ID NO: 3632765 - RNA, 19 nt, Human
cugagccagauuucacucu

SEQ ID NO: 3632766 - RNA, 20 nt, Human
cugagccagauuucacucuc

SEQ ID NO: 3632767 - RNA, 21 nt, Human
cugagccagauuucacucucc

SEQ ID NO: 3632768 - RNA, 19 nt, Human
cugagccagggucuccaga

SEQ ID NO: 3632769 - RNA, 22 nt, Human
cugagccagggucuccagaaag

SEQ ID NO: 3632770 - RNA, 18 nt, Human
cugagccagucccagggg

SEQ ID NO: 3632771 - RNA, 11 nt, Human
cugagcccacu

SEQ ID NO: 3632772 - RNA, 15 nt, Human
cugagcccagggagg

SEQ ID NO: 3632773 - RNA, 19 nt, Human
cugagcccagggaggccga

SEQ ID NO: 3632774 - RNA, 22 nt, Human
cugagcccagggaggccgaagc

SEQ ID NO: 3632775 - RNA, 19 nt, Human
cugagcccauguucugccc

SEQ ID NO: 3632776 - RNA, 19 nt, Human
cugagccccagggugccca

SEQ ID NO: 3632777 - RNA, 14 nt, Human
cugagcccccagcu

SEQ ID NO: 3632778 - RNA, 22 nt, Human
cugagcccccccaacacugugc

SEQ ID NO: 3632779 - RNA, 18 nt, Human
cugagccccgcagaccuc

SEQ ID NO: 3632780 - RNA, 21 nt, Human
cugagccccgcccucuuccug

SEQ ID NO: 3632781 - RNA, 13 nt, Human
cugagccccuacc

SEQ ID NO: 3632782 - RNA, 14 nt, Human
cugagccccuaccc

SEQ ID NO: 3632783 - RNA, 19 nt, Human
cugagccccugggacugcu

SEQ ID NO: 3632784 - RNA, 15 nt, Human
cugagccccugucua

SEQ ID NO: 3632785 - RNA, 20 nt, Human
cugagcccgggcugccuggg

SEQ ID NO: 3632786 - RNA, 16 nt, Human
cugagcccucaaagug

SEQ ID NO: 3632787 - RNA, 17 nt, Human
cugagcccucaaaguga

SEQ ID NO: 3632788 - RNA, 13 nt, Human
cugagcccuggca

SEQ ID NO: 3632789 - RNA, 15 nt, Human
cugagccgcagagaa

SEQ ID NO: 3632790 - RNA, 14 nt, Human
cugagccugcaggg

SEQ ID NO: 3632791 - RNA, 14 nt, Human
cugagccugccgag

SEQ ID NO: 3632792 - RNA, 17 nt, Human
cugagccuggccagccu

SEQ ID NO: 3632793 - RNA, 19 nt, Human
cugagccuggcccauagaa

SEQ ID NO: 3632794 - RNA, 17 nt, Human
cugagccuucagucuug

SEQ ID NO: 3632795 - RNA, 17 nt, Human
cugagccuucugagcug

SEQ ID NO: 3632796 - RNA, 21 nt, Human
cugagccuuguaauucuaaau

SEQ ID NO: 3632797 - RNA, 20 nt, Human
cugagcgacagugagacucu

SEQ ID NO: 3632798 - RNA, 18 nt, Human
cugagcgaguggagucug

SEQ ID NO: 3632799 - RNA, 21 nt, Human
cugagcgaguggagucugcca

SEQ ID NO: 3632800 - RNA, 17 nt, Human
cugagcgauuauuaucu

SEQ ID NO: 3632801 - RNA, 19 nt, Human
cugagcgccuggauuucug

SEQ ID NO: 3632802 - RNA, 16 nt, Human
cugagcgggaggcaga

SEQ ID NO: 3632803 - RNA, 19 nt, Human
cugagcuagaagcuggagg

SEQ ID NO: 3632804 - RNA, 13 nt, Human
cugagcucacucg

SEQ ID NO: 3632805 - RNA, 15 nt, Human
cugagcucagcgugg

SEQ ID NO: 3632806 - RNA, 20 nt, Human
cugagcuccccaccacccca

SEQ ID NO: 3632807 - RNA, 15 nt, Human
cugagcuccucuggg

SEQ ID NO: 3632808 - RNA, 23 nt, Human
cugagcuccucugggcaggaccu

SEQ ID NO: 3632809 - RNA, 22 nt, Human
cugagcuccuguccccugcuac

SEQ ID NO: 3632810 - RNA, 20 nt, Human
cugagcucgguggacccagg

SEQ ID NO: 3632811 - RNA, 22 nt, Human
cugagcucgguggacccaggga

SEQ ID NO: 3632812 - RNA, 16 nt, Human
cugagcucugagaggc

SEQ ID NO: 3632813 - RNA, 19 nt, Human
cugagcucugagaggcccu

SEQ ID NO: 3632814 - RNA, 20 nt, Human
cugagcucugagaggcccug

SEQ ID NO: 3632815 - RNA, 21 nt, Human
cugagcucugagaggcccugg

SEQ ID NO: 3632816 - RNA, 22 nt, Human
cugagcucugagaggcccugga

SEQ ID NO: 3632817 - RNA, 23 nt, Human
cugagcucugagaggcccuggau

SEQ ID NO: 3632818 - RNA, 19 nt, Human
cugagcucugcauuugucu

SEQ ID NO: 3632819 - RNA, 12 nt, Human
cugagcugaggc

SEQ ID NO: 3632820 - RNA, 15 nt, Human
cugagcugaggcagc

SEQ ID NO: 3632821 - RNA, 16 nt, Human
cugagcugccauccag

SEQ ID NO: 3632822 - RNA, 22 nt, Human
cugagcugggaugauuggaggg

SEQ ID NO: 3632823 - RNA, 15 nt, Human
cugagcugugcaggu

SEQ ID NO: 3632824 - RNA, 22 nt, Human
cugagcuucccccccaccacag

SEQ ID NO: 3632825 - RNA, 22 nt, Human
cugagcuugcagagaugaggcc

SEQ ID NO: 3632826 - RNA, 12 nt, Human
cugagcuuggaa

SEQ ID NO: 3632827 - RNA, 17 nt, Human
cugagcuuggccagaag

SEQ ID NO: 3632828 - RNA, 12 nt, Human
cugagcuuugca

SEQ ID NO: 3632829 - RNA, 23 nt, Human
cugagcuuuggacacacacagcu

SEQ ID NO: 3632830 - RNA, 22 nt, Human
cugaggaaaggccagcuggcag

SEQ ID NO: 3632831 - RNA, 16 nt, Human
cugaggaacugucucg

SEQ ID NO: 3632832 - RNA, 18 nt, Human
cugaggaagaacggggcu

SEQ ID NO: 3632833 - RNA, 18 nt, Human
cugaggaagagggacugu

SEQ ID NO: 3632834 - RNA, 17 nt, Human
cugaggaauccagaccc

SEQ ID NO: 3632835 - RNA, 15 nt, Human
cugaggaauucugua

SEQ ID NO: 3632836 - RNA, 16 nt, Human
cugaggaauucuguau

SEQ ID NO: 3632837 - RNA, 18 nt, Human
cugaggaauucuguauag

SEQ ID NO: 3632838 - RNA, 15 nt, Human
cugaggacaaagugg

SEQ ID NO: 3632839 - RNA, 23 nt, Human
cugaggacacuaaccacgcugga

SEQ ID NO: 3632840 - RNA, 14 nt, Human
cugaggacagaugc

SEQ ID NO: 3632841 - RNA, 14 nt, Human
cugaggacagcugu

SEQ ID NO: 3632842 - RNA, 11 nt, Human
cugaggagaaa

SEQ ID NO: 3632843 - RNA, 19 nt, Human
cugaggaggccuccaucuc

SEQ ID NO: 3632844 - RNA, 15 nt, Human
cugaggagucugagg

SEQ ID NO: 3632845 - RNA, 19 nt, Human
cugaggagucugagguccu

SEQ ID NO: 3632846 - RNA, 22 nt, Human
cugaggauauucagauguaugu

SEQ ID NO: 3632847 - RNA, 19 nt, Human
cugaggaucagaaaguaau

SEQ ID NO: 3632848 - RNA, 16 nt, Human
cugaggcaagagaauu

SEQ ID NO: 3632849 - RNA, 20 nt, Human
cugaggcacaagaaucacuu

SEQ ID NO: 3632850 - RNA, 14 nt, Human
cugaggcagacagc

SEQ ID NO: 3632851 - RNA, 17 nt, Human
cugaggcagacagcagc

SEQ ID NO: 3632852 - RNA, 23 nt, Human
cugaggcagcagugugaggccag

SEQ ID NO: 3632853 - RNA, 14 nt, Human
cugaggcaggagaa

SEQ ID NO: 3632854 - RNA, 16 nt, Human
cugaggcaggagaauc

SEQ ID NO: 3632855 - RNA, 17 nt, Human
cugaggcaggagacugg

SEQ ID NO: 3632856 - RNA, 18 nt, Human
cugaggcaggagacuggc

SEQ ID NO: 3632857 - RNA, 16 nt, Human
cugaggcagggaaguc

SEQ ID NO: 3632858 - RNA, 20 nt, Human
cugaggcagggaagucccca

SEQ ID NO: 3632859 - RNA, 22 nt, Human
cugaggcagggaaguccccagg

SEQ ID NO: 3632860 - RNA, 20 nt, Human
cugaggcauccagcagucuc

SEQ ID NO: 3632861 - RNA, 21 nt, Human
cugaggccacacucagcacaa

SEQ ID NO: 3632862 - RNA, 16 nt, Human
cugaggccagccuggc

SEQ ID NO: 3632863 - RNA, 19 nt, Human
cugaggccagccuggccuc

SEQ ID NO: 3632864 - RNA, 22 nt, Human
cugaggccagccuggccuccug

SEQ ID NO: 3632865 - RNA, 12 nt, Human
cugaggcccaga

SEQ ID NO: 3632866 - RNA, 16 nt, Human
cugaggcccugcccaa

SEQ ID NO: 3632867 - RNA, 19 nt, Human
cugaggcccuucucuccag

SEQ ID NO: 3632868 - RNA, 23 nt, Human
cugaggcccuucucuccagcccc

SEQ ID NO: 3632869 - RNA, 15 nt, Human
cugaggccuccagcu

SEQ ID NO: 3632870 - RNA, 14 nt, Human
cugaggccugagac

SEQ ID NO: 3632871 - RNA, 18 nt, Human
cugaggccugagacccag

SEQ ID NO: 3632872 - RNA, 20 nt, Human
cugaggccugagacccagga

SEQ ID NO: 3632873 - RNA, 12 nt, Human
cugaggccugga

SEQ ID NO: 3632874 - RNA, 15 nt, Human
cugaggccuggacuu

SEQ ID NO: 3632875 - RNA, 22 nt, Human
cugaggccuggacuuuccugca

SEQ ID NO: 3632876 - RNA, 16 nt, Human
cugaggcucagggaaa

SEQ ID NO: 3632877 - RNA, 23 nt, Human
cugaggcucugacccagugagau

SEQ ID NO: 3632878 - RNA, 20 nt, Human
cugaggcucuuucugggcca

SEQ ID NO: 3632879 - RNA, 12 nt, Human
cugaggcugagg

SEQ ID NO: 3632880 - RNA, 14 nt, Human
cugaggcuggacuc

SEQ ID NO: 3632881 - RNA, 17 nt, Human
cugaggcuggacuccag

SEQ ID NO: 3632882 - RNA, 18 nt, Human
cugaggcuggacuccaga

SEQ ID NO: 3632883 - RNA, 15 nt, Human
cugaggcuggauccu

SEQ ID NO: 3632884 - RNA, 17 nt, Human
cugaggcuggcacagga

SEQ ID NO: 3632885 - RNA, 16 nt, Human
cugaggcugggcuccc

SEQ ID NO: 3632886 - RNA, 11 nt, Human
cugaggcugua

SEQ ID NO: 3632887 - RNA, 14 nt, Human
cugaggcugugguc

SEQ ID NO: 3632888 - RNA, 20 nt, Human
cugaggcuguggucacagcg

SEQ ID NO: 3632889 - RNA, 14 nt, Human
cugaggcuuccaga

SEQ ID NO: 3632890 - RNA, 14 nt, Human
cugaggcuuuggau

SEQ ID NO: 3632891 - RNA, 17 nt, Human
cugagggaaaggccagc

SEQ ID NO: 3632892 - RNA, 16 nt, Human
cugagggaaauguuuu

SEQ ID NO: 3632893 - RNA, 17 nt, Human
cugagggaaauguuuug

SEQ ID NO: 3632894 - RNA, 19 nt, Human
cugagggaccaacugggcc

SEQ ID NO: 3632895 - RNA, 18 nt, Human
cugagggaccagccaaga

SEQ ID NO: 3632896 - RNA, 20 nt, Human
cugagggacucugaagccuc

SEQ ID NO: 3632897 - RNA, 12 nt, Human
cugagggagccu

SEQ ID NO: 3632898 - RNA, 16 nt, Human
cugagggauggacuga

SEQ ID NO: 3632899 - RNA, 19 nt, Human
cugagggcaaauccagucc

SEQ ID NO: 3632900 - RNA, 19 nt, Human
cugagggcagacuggggca

SEQ ID NO: 3632901 - RNA, 22 nt, Human
cugcaagguuuaggcugguggc

SEQ ID NO: 3632902 - RNA, 16 nt, Human
cugcaagucagaggau

SEQ ID NO: 3632903 - RNA, 21 nt, Human
cugcaagucagaggauggcca

SEQ ID NO: 3632904 - RNA, 19 nt, Human
cugcaagucaguccaggau

SEQ ID NO: 3632905 - RNA, 21 nt, Human
cugcaaguccuuuuguaaagu

SEQ ID NO: 3632906 - RNA, 19 nt, Human
cugcaagugagcaaaccug

SEQ ID NO: 3632907 - RNA, 22 nt, Human
cugcaauaaaauggguuuuacu

SEQ ID NO: 3632908 - RNA, 18 nt, Human
cugcaauacaaguuucau

SEQ ID NO: 3632909 - RNA, 12 nt, Human
cugcaauagaga

SEQ ID NO: 3632910 - RNA, 16 nt, Human
cugcaauagagacugu

SEQ ID NO: 3632911 - RNA, 18 nt, Human
cugcaauagagacuguag

SEQ ID NO: 3632912 - RNA, 19 nt, Human
cugcaauauuugaauuuua

SEQ ID NO: 3632913 - RNA, 18 nt, Human
cugcaaucauaugugauc

SEQ ID NO: 3632914 - RNA, 22 nt, Human
cugcaaucuucucagaaggcaa

SEQ ID NO: 3632915 - RNA, 21 nt, Human
cugcaaugaagucucugaagu

SEQ ID NO: 3632916 - RNA, 18 nt, Human
cugcaaugugggcagaga

SEQ ID NO: 3632917 - RNA, 15 nt, Human
cugcaauguuuuccu

SEQ ID NO: 3632918 - RNA, 14 nt, Human
cugcaauucaaaag

SEQ ID NO: 3632919 - RNA, 21 nt, Human
cugcaauucaaaaguuccaag

SEQ ID NO: 3632920 - RNA, 17 nt, Human
cugcaauuccccucugc

SEQ ID NO: 3632921 - RNA, 14 nt, Human
cugcaauuuucuaa

SEQ ID NO: 3632922 - RNA, 16 nt, Human
cugcacaaacucacca

SEQ ID NO: 3632923 - RNA, 16 nt, Human
cugcacaagcugcacc

SEQ ID NO: 3632924 - RNA, 18 nt, Human
cugcacaauaaaaauguu

SEQ ID NO: 3632925 - RNA, 17 nt, Human
cugcacacaagcccaca

SEQ ID NO: 3632926 - RNA, 23 nt, Human
cugcacacaagcccacagcacag

SEQ ID NO: 3632927 - RNA, 20 nt, Human
cugcacagagcucuccagcu

SEQ ID NO: 3632928 - RNA, 12 nt, Human
cugcacagaugg

SEQ ID NO: 3632929 - RNA, 23 nt, Human
cugcacagauggauuugccugug

SEQ ID NO: 3632930 - RNA, 18 nt, Human
cugcacagcaggcugcca

SEQ ID NO: 3632931 - RNA, 19 nt, Human
cugcacagcggccccugca

SEQ ID NO: 3632932 - RNA, 16 nt, Human
cugcacagggcagcug

SEQ ID NO: 3632933 - RNA, 21 nt, Human
cugcacagugcaucucagccc

SEQ ID NO: 3632934 - RNA, 22 nt, Human
cugcacagugcaucucagccca

SEQ ID NO: 3632935 - RNA, 18 nt, Human
cugcacaucuguaaaucu

SEQ ID NO: 3632936 - RNA, 23 nt, Human
cugcacaugacucgggggugggg

SEQ ID NO: 3632937 - RNA, 16 nt, Human
cugcacaugauuucac

SEQ ID NO: 3632938 - RNA, 22 nt, Human
cugcacaugauuucacaaauau

SEQ ID NO: 3632939 - RNA, 21 nt, Human
cugcacaugcagcugcacccu

SEQ ID NO: 3632940 - RNA, 23 nt, Human
cugcacaugucuuguacaugugu

SEQ ID NO: 3632941 - RNA, 21 nt, Human
cugcaccaacccagccgcugc

SEQ ID NO: 3632942 - RNA, 20 nt, Human
cugcaccagagcaaccucuc

SEQ ID NO: 3632943 - RNA, 11 nt, Human
cugcaccagga

SEQ ID NO: 3632944 - RNA, 14 nt, Human
cugcaccaggagac

SEQ ID NO: 3632945 - RNA, 17 nt, Human
cugcaccaggagacaga

SEQ ID NO: 3632946 - RNA, 20 nt, Human
cugcaccaugcugcugggga

SEQ ID NO: 3632947 - RNA, 23 nt, Human
cugcaccaugcugcuggggaaga

SEQ ID NO: 3632948 - RNA, 14 nt, Human
cugcacccaggagg

SEQ ID NO: 3632949 - RNA, 16 nt, Human
cugcacccccuccugc

SEQ ID NO: 3632950 - RNA, 19 nt, Human
cugcacccccuccugcugc

SEQ ID NO: 3632951 - RNA, 16 nt, Human
cugcaccccuuccugg

SEQ ID NO: 3632952 - RNA, 17 nt, Human
cugcaccccuuccuggg

SEQ ID NO: 3632953 - RNA, 18 nt, Human
cugcacccucaggcaggu

SEQ ID NO: 3632954 - RNA, 16 nt, Human
cugcacccuccacccu

SEQ ID NO: 3632955 - RNA, 17 nt, Human
cugcacccuccacccug

SEQ ID NO: 3632956 - RNA, 21 nt, Human
cugcacccuccacccuguccc

SEQ ID NO: 3632957 - RNA, 17 nt, Human
cugcacccucccuccga

SEQ ID NO: 3632958 - RNA, 22 nt, Human
cugcacccuggggccuggaccu

SEQ ID NO: 3632959 - RNA, 23 nt, Human
cugcacccuggggccuggaccug

SEQ ID NO: 3632960 - RNA, 14 nt, Human
cugcacccuucuuu

SEQ ID NO: 3632961 - RNA, 18 nt, Human
cugcaccggcuggccugg

SEQ ID NO: 3632962 - RNA, 19 nt, Human
cugcaccggcuggccuggc

SEQ ID NO: 3632963 - RNA, 11 nt, Human
cugcaccuccc

SEQ ID NO: 3632964 - RNA, 17 nt, Human
cugcaccuccccccacu

SEQ ID NO: 3632965 - RNA, 18 nt, Human
cugcaccuccccccacug

SEQ ID NO: 3632966 - RNA, 19 nt, Human
cugcaccuccccccacugc

SEQ ID NO: 3632967 - RNA, 22 nt, Human
cugcaccuccccccacugcagg

SEQ ID NO: 3632968 - RNA, 13 nt, Human
cugcaccugccag

SEQ ID NO: 3632969 - RNA, 17 nt, Human
cugcaccugccagccug

SEQ ID NO: 3632970 - RNA, 20 nt, Human
cugcaccugccagccuggcu

SEQ ID NO: 3632971 - RNA, 14 nt, Human
cugcaccugugcag

SEQ ID NO: 3632972 - RNA, 14 nt, Human
cugcacggugaaug

SEQ ID NO: 3632973 - RNA, 20 nt, Human
cugcacggugggccuugcug

SEQ ID NO: 3632974 - RNA, 12 nt, Human
cugcacgucaug

SEQ ID NO: 3632975 - RNA, 19 nt, Human
cugcacguggcuucugaug

SEQ ID NO: 3632976 - RNA, 20 nt, Human
cugcacuaaagccagccuga

SEQ ID NO: 3632977 - RNA, 16 nt, Human
cugcacuaauuugaug

SEQ ID NO: 3632978 - RNA, 16 nt, Human
cugcacuacugacaug

SEQ ID NO: 3632979 - RNA, 15 nt, Human
cugcacuccagccug

SEQ ID NO: 3632980 - RNA, 16 nt, Human
cugcacuccagccugg

SEQ ID NO: 3632981 - RNA, 17 nt, Human
cugcacuccagccuggg

SEQ ID NO: 3632982 - RNA, 18 nt, Human
cugcacuccagccugggc

SEQ ID NO: 3632983 - RNA, 20 nt, Human
cugcacuccagccuggggga

SEQ ID NO: 3632984 - RNA, 22 nt, Human
cugcacucccaccugacacacc

SEQ ID NO: 3632985 - RNA, 20 nt, Human
cugcacuccccugcugggug

SEQ ID NO: 3632986 - RNA, 15 nt, Human
cugcacucugugccc

SEQ ID NO: 3632987 - RNA, 21 nt, Human
cugcacucugugcccaugggc

SEQ ID NO: 3632988 - RNA, 19 nt, Human
cugcacucuuaagcuuccg

SEQ ID NO: 3632989 - RNA, 12 nt, Human
cugcacugaaaa

SEQ ID NO: 3632990 - RNA, 18 nt, Human
cugcacugaaaagguucu

SEQ ID NO: 3632991 - RNA, 18 nt, Human
cugcacugacucuggaaa

SEQ ID NO: 3632992 - RNA, 14 nt, Human
cugcacugagcaga

SEQ ID NO: 3632993 - RNA, 19 nt, Human
cugcacugaugcugccccu

SEQ ID NO: 3632994 - RNA, 16 nt, Human
cugcacuggaguccag

SEQ ID NO: 3632995 - RNA, 21 nt, Human
cugcacuggaguccagucucu

SEQ ID NO: 3632996 - RNA, 11 nt, Human
cugcacugucc

SEQ ID NO: 3632997 - RNA, 15 nt, Human
cugcacuguccugcu

SEQ ID NO: 3632998 - RNA, 19 nt, Human
cugcacuguccugcuccac

SEQ ID NO: 3632999 - RNA, 15 nt, Human
cugcacuuacuugcu

SEQ ID NO: 3633000 - RNA, 14 nt, Human
cugcacuuccuguu

SEQ ID NO: 3633001 - RNA, 17 nt, Human
cugcacuugcagacucu

SEQ ID NO: 3633002 - RNA, 18 nt, Human
cugcacuuugaugucaug

SEQ ID NO: 3633003 - RNA, 19 nt, Human
cugcacuuugaugucaugu

SEQ ID NO: 3633004 - RNA, 17 nt, Human
cugcagaacagcuucau

SEQ ID NO: 3633005 - RNA, 20 nt, Human
cugcagaacagcuucauguu

SEQ ID NO: 3633006 - RNA, 20 nt, Human
cugcagaacguauuggucca

SEQ ID NO: 3633007 - RNA, 13 nt, Human
cugcagaagacag

SEQ ID NO: 3633008 - RNA, 23 nt, Human
cugcagaagacaguauggcagcu

SEQ ID NO: 3633009 - RNA, 20 nt, Human
cugcagaaggaaaaaugugu

SEQ ID NO: 3633010 - RNA, 22 nt, Human
cugcagaaggaaaaauguguaa

SEQ ID NO: 3633011 - RNA, 14 nt, Human
cugcagaaggccaa

SEQ ID NO: 3633012 - RNA, 15 nt, Human
cugcagaaggccaag

SEQ ID NO: 3633013 - RNA, 22 nt, Human
cugcagaauuuggguucugccu

SEQ ID NO: 3633014 - RNA, 14 nt, Human
cugcagacacgccu

SEQ ID NO: 3633015 - RNA, 17 nt, Human
cugcagacccugcccuu

SEQ ID NO: 3633016 - RNA, 11 nt, Human
cugcagaccug

SEQ ID NO: 3633017 - RNA, 16 nt, Human
cugcagaccuguccuc

SEQ ID NO: 3633018 - RNA, 18 nt, Human
cugcagaccuguccuccu

SEQ ID NO: 3633019 - RNA, 18 nt, Human
cugcagacuucccagcua

SEQ ID NO: 3633020 - RNA, 21 nt, Human
cugcagagaaacuuaagcaaa

SEQ ID NO: 3633021 - RNA, 22 nt, Human
cugcagagaaacuuaagcaaag

SEQ ID NO: 3633022 - RNA, 23 nt, Human
cugcagagaaacuuaagcaaagg

SEQ ID NO: 3633023 - RNA, 17 nt, Human
cugcagagacagagagg

SEQ ID NO: 3633024 - RNA, 23 nt, Human
cugcagagauuucucauugacuu

SEQ ID NO: 3633025 - RNA, 14 nt, Human
cugcagaggggcag

SEQ ID NO: 3633026 - RNA, 15 nt, Human
cugcagaggggcagg

SEQ ID NO: 3633027 - RNA, 17 nt, Human
cugcagaggggcaggcc

SEQ ID NO: 3633028 - RNA, 19 nt, Human
cugcagaggggcaggcccu

SEQ ID NO: 3633029 - RNA, 22 nt, Human
cugcagaggggcaggcccugca

SEQ ID NO: 3633030 - RNA, 19 nt, Human
cugcagaggggcuuucugg

SEQ ID NO: 3633031 - RNA, 18 nt, Human
cugcagaggucugugcug

SEQ ID NO: 3633032 - RNA, 21 nt, Human
cugcagaggucugugcugagg

SEQ ID NO: 3633033 - RNA, 21 nt, Human
cugcagauacuacugaccaga

SEQ ID NO: 3633034 - RNA, 19 nt, Human
cugcagaugccacccuagc

SEQ ID NO: 3633035 - RNA, 22 nt, Human
cugcagaugccacccuagccaa

SEQ ID NO: 3633036 - RNA, 17 nt, Human
cugcagauuugggcugg

SEQ ID NO: 3633037 - RNA, 19 nt, Human
cugcagcaccuccaggccu

SEQ ID NO: 3633038 - RNA, 13 nt, Human
cugcagcagagcc

SEQ ID NO: 3633039 - RNA, 20 nt, Human
cugcagcaggaguggugcag

SEQ ID NO: 3633040 - RNA, 11 nt, Human
cugcagcauga

SEQ ID NO: 3633041 - RNA, 20 nt, Human
cugcagcauggucccugccu

SEQ ID NO: 3633042 - RNA, 23 nt, Human
cugcagccagcccagcccagcug

SEQ ID NO: 3633043 - RNA, 12 nt, Human
cugcagccagcu

SEQ ID NO: 3633044 - RNA, 19 nt, Human
cugcccugguuuccugccc

SEQ ID NO: 3633045 - RNA, 23 nt, Human
cugcccugguuuccugcccuggg

SEQ ID NO: 3633046 - RNA, 20 nt, Human
cugcccugucaggaggcaga

SEQ ID NO: 3633047 - RNA, 22 nt, Human
cugcccugugggaccccaggcc

SEQ ID NO: 3633048 - RNA, 19 nt, Human
cugcccugugggcccccaa

SEQ ID NO: 3633049 - RNA, 21 nt, Human
cugcccuguuguguauagaug

SEQ ID NO: 3633050 - RNA, 22 nt, Human
cugcccuuaccugccaggaagc

SEQ ID NO: 3633051 - RNA, 17 nt, Human
cugcccuucaccccagu

SEQ ID NO: 3633052 - RNA, 16 nt, Human
cugcccuucagcaucc

SEQ ID NO: 3633053 - RNA, 21 nt, Human
cugcccuucagcauccucagu

SEQ ID NO: 3633054 - RNA, 15 nt, Human
cugcccuuccgcagu

SEQ ID NO: 3633055 - RNA, 18 nt, Human
cugcccuuccgcagugug

SEQ ID NO: 3633056 - RNA, 12 nt, Human
cugcccuuccuc

SEQ ID NO: 3633057 - RNA, 21 nt, Human
cugcccuuguuuggggcagga

SEQ ID NO: 3633058 - RNA, 23 nt, Human
cugcccuuguuuggggcaggagu

SEQ ID NO: 3633059 - RNA, 21 nt, Human
cugccgaccgaggcuggagcu

SEQ ID NO: 3633060 - RNA, 22 nt, Human
cugccgaccgaggcuggagcug

SEQ ID NO: 3633061 - RNA, 23 nt, Human
cugccgaccgaggcuggagcugg

SEQ ID NO: 3633062 - RNA, 17 nt, Human
cugccgcaauacaggaa

SEQ ID NO: 3633063 - RNA, 16 nt, Human
cugccgcaccccagag

SEQ ID NO: 3633064 - RNA, 13 nt, Human
cugccgcagagcu

SEQ ID NO: 3633065 - RNA, 12 nt, Human
cugccgcagccc

SEQ ID NO: 3633066 - RNA, 15 nt, Human
cugccgcagcccugc

SEQ ID NO: 3633067 - RNA, 21 nt, Human
cugccgcagcccugcagaggg

SEQ ID NO: 3633068 - RNA, 18 nt, Human
cugccgcccccuccugaa

SEQ ID NO: 3633069 - RNA, 19 nt, Human
cugccgcccccuccugaac

SEQ ID NO: 3633070 - RNA, 13 nt, Human
cugccgcuaccuc

SEQ ID NO: 3633071 - RNA, 16 nt, Human
cugccggcccuggggc

SEQ ID NO: 3633072 - RNA, 21 nt, Human
cugccggcccuggggcuaggc

SEQ ID NO: 3633073 - RNA, 22 nt, Human
cugccggcucuuuccuugcuca

SEQ ID NO: 3633074 - RNA, 19 nt, Human
cugccgggcugagggccug

SEQ ID NO: 3633075 - RNA, 13 nt, Human
cugccggggcagc

SEQ ID NO: 3633076 - RNA, 19 nt, Human
cugccggguucuagucucc

SEQ ID NO: 3633077 - RNA, 15 nt, Human
cugccguaauuuaac

SEQ ID NO: 3633078 - RNA, 19 nt, Human
cugccgucaccaccacccc

SEQ ID NO: 3633079 - RNA, 20 nt, Human
cugccgucaccaccaccccu

SEQ ID NO: 3633080 - RNA, 13 nt, Human
cugccuaagcccu

SEQ ID NO: 3633081 - RNA, 12 nt, Human
cugccuaaggac

SEQ ID NO: 3633082 - RNA, 13 nt, Human
cugccuaaggacu

SEQ ID NO: 3633083 - RNA, 15 nt, Human
cugccuaaggacuuc

SEQ ID NO: 3633084 - RNA, 19 nt, Human
cugccuaaggacuucuuua

SEQ ID NO: 3633085 - RNA, 18 nt, Human
cugccuaaguggcugcug

SEQ ID NO: 3633086 - RNA, 13 nt, Human
cugccuacucacg

SEQ ID NO: 3633087 - RNA, 19 nt, Human
cugccuagauucagggaaa

SEQ ID NO: 3633088 - RNA, 17 nt, Human
cugccuagcaagcuggc

SEQ ID NO: 3633089 - RNA, 18 nt, Human
cugccuagcaagcuggcc

SEQ ID NO: 3633090 - RNA, 22 nt, Human
cugccuagcacucacaugcugg

SEQ ID NO: 3633091 - RNA, 18 nt, Human
cugccuagcugccuagca

SEQ ID NO: 3633092 - RNA, 21 nt, Human
cugccucaaugugaaucagac

SEQ ID NO: 3633093 - RNA, 16 nt, Human
cugccucaccgcuucc

SEQ ID NO: 3633094 - RNA, 23 nt, Human
cugccucacuuccuacaagagca

SEQ ID NO: 3633095 - RNA, 14 nt, Human
cugccucagcccgc

SEQ ID NO: 3633096 - RNA, 12 nt, Human
cugccucagccu

SEQ ID NO: 3633097 - RNA, 13 nt, Human
cugccucagccuc

SEQ ID NO: 3633098 - RNA, 13 nt, Human
cugccucaggacu

SEQ ID NO: 3633099 - RNA, 16 nt, Human
cugccucaggccucug

SEQ ID NO: 3633100 - RNA, 13 nt, Human
cugccucagguuc

SEQ ID NO: 3633101 - RNA, 18 nt, Human
cugccucagguuccuaug

SEQ ID NO: 3633102 - RNA, 13 nt, Human
cugccucauuuag

SEQ ID NO: 3633103 - RNA, 18 nt, Human
cugccuccacccucugag

SEQ ID NO: 3633104 - RNA, 21 nt, Human
cugccuccacccucugagcuu

SEQ ID NO: 3633105 - RNA, 14 nt, Human
cugccuccagaaug

SEQ ID NO: 3633106 - RNA, 14 nt, Human
cugccuccagggcu

SEQ ID NO: 3633107 - RNA, 16 nt, Human
cugccuccagggcugg

SEQ ID NO: 3633108 - RNA, 17 nt, Human
cugccuccagggcugga

SEQ ID NO: 3633109 - RNA, 18 nt, Human
cugccuccagggcuggac

SEQ ID NO: 3633110 - RNA, 18 nt, Human
cugccuccauucugacca

SEQ ID NO: 3633111 - RNA, 11 nt, Human
cugccucccaa

SEQ ID NO: 3633112 - RNA, 12 nt, Human
cugccucccacu

SEQ ID NO: 3633113 - RNA, 15 nt, Human
cugccucccacuuca

SEQ ID NO: 3633114 - RNA, 16 nt, Human
cugccucccaucaccc

SEQ ID NO: 3633115 - RNA, 13 nt, Human
cugccucccaugc

SEQ ID NO: 3633116 - RNA, 12 nt, Human
cugccuccccaa

SEQ ID NO: 3633117 - RNA, 14 nt, Human
cugccuccccaacc

SEQ ID NO: 3633118 - RNA, 18 nt, Human
cugccuccccuccucugc

SEQ ID NO: 3633119 - RNA, 19 nt, Human
cugccuccccuccucugcu

SEQ ID NO: 3633120 - RNA, 22 nt, Human
cugccuccccuuaaaggggaga

SEQ ID NO: 3633121 - RNA, 21 nt, Human
cugccucccucacccugagcc

SEQ ID NO: 3633122 - RNA, 15 nt, Human
cugccucccugucca

SEQ ID NO: 3633123 - RNA, 16 nt, Human
cugccucccuuguggc

SEQ ID NO: 3633124 - RNA, 19 nt, Human
cugccuccucguuccuuuc

SEQ ID NO: 3633125 - RNA, 24 nt, Human
cugccuccucuucaacugaccagc

SEQ ID NO: 3633126 - RNA, 15 nt, Human
cugccuccugccggc

SEQ ID NO: 3633127 - RNA, 22 nt, Human
cugccuccugccggcuccuugg

SEQ ID NO: 3633128 - RNA, 15 nt, Human
cugccuccugccugc

SEQ ID NO: 3633129 - RNA, 19 nt, Human
cugccuccuugauauuugu

SEQ ID NO: 3633130 - RNA, 12 nt, Human
cugccuccuuua

SEQ ID NO: 3633131 - RNA, 15 nt, Human
cugccucgaaacaca

SEQ ID NO: 3633132 - RNA, 20 nt, Human
cugccucgaacuggcugcaa

SEQ ID NO: 3633133 - RNA, 18 nt, Human
cugccucuacugggaagg

SEQ ID NO: 3633134 - RNA, 14 nt, Human
cugccucucacagc

SEQ ID NO: 3633135 - RNA, 21 nt, Human
cugccucucacagcugaguug

SEQ ID NO: 3633136 - RNA, 11 nt, Human
cugccucuccc

SEQ ID NO: 3633137 - RNA, 13 nt, Human
cugccucucccag

SEQ ID NO: 3633138 - RNA, 18 nt, Human
cugccucucccaggcagg

SEQ ID NO: 3633139 - RNA, 22 nt, Human
cugccucucccaucacuucccu

SEQ ID NO: 3633140 - RNA, 23 nt, Human
cugccucucccaucacuucccua

SEQ ID NO: 3633141 - RNA, 16 nt, Human
cugccucucccucugg

SEQ ID NO: 3633142 - RNA, 21 nt, Human
cugccucuccgccccugagcc

SEQ ID NO: 3633143 - RNA, 23 nt, Human
cugccucuccgccccugagccca

SEQ ID NO: 3633144 - RNA, 12 nt, Human
cugccucucugc

SEQ ID NO: 3633145 - RNA, 14 nt, Human
cugccucucugcag

SEQ ID NO: 3633146 - RNA, 17 nt, Human
cugccucucugcagguc

SEQ ID NO: 3633147 - RNA, 18 nt, Human
cugccucugacacacagc

SEQ ID NO: 3633148 - RNA, 21 nt, Human
cugccucugacacacagcucu

SEQ ID NO: 3633149 - RNA, 23 nt, Human
cugccucugacacacagcucugu

SEQ ID NO: 3633150 - RNA, 14 nt, Human
cugccucugaggga

SEQ ID NO: 3633151 - RNA, 14 nt, Human
cugccucugccaca

SEQ ID NO: 3633152 - RNA, 17 nt, Human
cugccucugccugcauu

SEQ ID NO: 3633153 - RNA, 15 nt, Human
cugccucugccuuag

SEQ ID NO: 3633154 - RNA, 19 nt, Human
cugccucuuaaauaaaccu

SEQ ID NO: 3633155 - RNA, 15 nt, Human
cugccucuucccccu

SEQ ID NO: 3633156 - RNA, 22 nt, Human
cugccucuucccccugcuucca

SEQ ID NO: 3633157 - RNA, 19 nt, Human
cugccucuuucccuaggaa

SEQ ID NO: 3633158 - RNA, 17 nt, Human
cugccugaaccuuccau

SEQ ID NO: 3633159 - RNA, 18 nt, Human
cugccugaagucacacag

SEQ ID NO: 3633160 - RNA, 23 nt, Human
cugccugaagucacacagugagu

SEQ ID NO: 3633161 - RNA, 18 nt, Human
cugccugaauaaagagcc

SEQ ID NO: 3633162 - RNA, 23 nt, Human
cugccugacauuuggaguguucc

SEQ ID NO: 3633163 - RNA, 21 nt, Human
cugccugagcaccucccagcc

SEQ ID NO: 3633164 - RNA, 15 nt, Human
cugccugagggcccc

SEQ ID NO: 3633165 - RNA, 17 nt, Human
cugccugagggccccuc

SEQ ID NO: 3633166 - RNA, 21 nt, Human
cugccugagggccccucugcc

SEQ ID NO: 3633167 - RNA, 20 nt, Human
cugccugaggggcagccugc

SEQ ID NO: 3633168 - RNA, 22 nt, Human
cugccugaggggcagccugccu

SEQ ID NO: 3633169 - RNA, 23 nt, Human
cugccugaggggcagccugccuu

SEQ ID NO: 3633170 - RNA, 21 nt, Human
cugccugagucgugaccugcu

SEQ ID NO: 3633171 - RNA, 19 nt, Human
cugccugcagaggucugug

SEQ ID NO: 3633172 - RNA, 22 nt, Human
cugccugcagaggucugugcug

SEQ ID NO: 3633173 - RNA, 21 nt, Human
cugccugcaguacuuuaccuc

SEQ ID NO: 3633174 - RNA, 16 nt, Human
cugccugccagcugca

SEQ ID NO: 3633175 - RNA, 20 nt, Human
cugccugccagcugcacuga

SEQ ID NO: 3633176 - RNA, 12 nt, Human
cugccugcccac

SEQ ID NO: 3633177 - RNA, 16 nt, Human
cugccugcccacccgu

SEQ ID NO: 3633178 - RNA, 17 nt, Human
cugccugcccaggcccc

SEQ ID NO: 3633179 - RNA, 18 nt, Human
cugccugccccgccccca

SEQ ID NO: 3633180 - RNA, 19 nt, Human
cugccugccccgcccccag

SEQ ID NO: 3633181 - RNA, 19 nt, Human
cugccugcccgcacagcag

SEQ ID NO: 3633182 - RNA, 23 nt, Human
cugccugcccgcacagcagccug

SEQ ID NO: 3633183 - RNA, 18 nt, Human
cugccugcgcccaccccg

SEQ ID NO: 3633184 - RNA, 13 nt, Human
cugccugcuccca

SEQ ID NO: 3633185 - RNA, 13 nt, Human
cugccugcuuugg

SEQ ID NO: 3633186 - RNA, 19 nt, Human
cugccuggaagagcagccc

SEQ ID NO: 3633187 - RNA, 22 nt, Human
cugccuggacuuggccccugcc

SEQ ID NO: 3633188 - RNA, 12 nt, Human
cuggggcucccu

SEQ ID NO: 3633189 - RNA, 14 nt, Human
cuggggcucccuuc

SEQ ID NO: 3633190 - RNA, 19 nt, Human
cuggggcucuaacgccuga

SEQ ID NO: 3633191 - RNA, 20 nt, Human
cuggggcucuaacgccugag

SEQ ID NO: 3633192 - RNA, 22 nt, Human
cuggggcucuaacgccugagcc

SEQ ID NO: 3633193 - RNA, 23 nt, Human
cuggggcucuaacgccugagccc

SEQ ID NO: 3633194 - RNA, 19 nt, Human
cuggggcucugugcaggga

SEQ ID NO: 3633195 - RNA, 18 nt, Human
cuggggcugaccuuccuc

SEQ ID NO: 3633196 - RNA, 21 nt, Human
cuggggcugaucucagggaag

SEQ ID NO: 3633197 - RNA, 22 nt, Human
cuggggcugaucucagggaagc

SEQ ID NO: 3633198 - RNA, 15 nt, Human
cuggggcuggcacaa

SEQ ID NO: 3633199 - RNA, 15 nt, Human
cuggggcuggccucc

SEQ ID NO: 3633200 - RNA, 13 nt, Human
cuggggcugggcc

SEQ ID NO: 3633201 - RNA, 14 nt, Human
cugggggaagcccu

SEQ ID NO: 3633202 - RNA, 17 nt, Human
cugggggaagcccugga

SEQ ID NO: 3633203 - RNA, 21 nt, Human
cugggggaaugagcccagaga

SEQ ID NO: 3633204 - RNA, 18 nt, Human
cugggggaguuuuccucu

SEQ ID NO: 3633205 - RNA, 18 nt, Human
cugggggaugggccugag

SEQ ID NO: 3633206 - RNA, 16 nt, Human
cugggggccaugagcu

SEQ ID NO: 3633207 - RNA, 12 nt, Human
cugggggccuca

SEQ ID NO: 3633208 - RNA, 16 nt, Human
cugggggccucuucug

SEQ ID NO: 3633209 - RNA, 15 nt, Human
cugggggccugaccu

SEQ ID NO: 3633210 - RNA, 15 nt, Human
cugggggccuggcug

SEQ ID NO: 3633211 - RNA, 18 nt, Human
cugggggccuggcuggcu

SEQ ID NO: 3633212 - RNA, 14 nt, Human
cugggggcugggca

SEQ ID NO: 3633213 - RNA, 18 nt, Human
cugggggcugggcagagg

SEQ ID NO: 3633214 - RNA, 16 nt, Human
cuggggggcaguggug

SEQ ID NO: 3633215 - RNA, 16 nt, Human
cugggggguggccagg

SEQ ID NO: 3633216 - RNA, 15 nt, Human
cugggggugccagga

SEQ ID NO: 3633217 - RNA, 14 nt, Human
cugggggugggcca

SEQ ID NO: 3633218 - RNA, 21 nt, Human
cuggggucaggccgggcagag

SEQ ID NO: 3633219 - RNA, 24 nt, Human
cuggggucaggccgggcagagcac

SEQ ID NO: 3633220 - RNA, 16 nt, Human
cugggguccagggagc

SEQ ID NO: 3633221 - RNA, 15 nt, Human
cuggggucccagcag

SEQ ID NO: 3633222 - RNA, 18 nt, Human
cuggggucccagcagcug

SEQ ID NO: 3633223 - RNA, 16 nt, Human
cugggguccccagggc

SEQ ID NO: 3633224 - RNA, 13 nt, Human
cugggguccccca

SEQ ID NO: 3633225 - RNA, 13 nt, Human
cuggggucuggag

SEQ ID NO: 3633226 - RNA, 22 nt, Human
cuggggucuggaguugaucugg

SEQ ID NO: 3633227 - RNA, 12 nt, Human
cuggggugcagg

SEQ ID NO: 3633228 - RNA, 21 nt, Human
cuggggugcagggaugugggu

SEQ ID NO: 3633229 - RNA, 18 nt, Human
cuggggugccgccugccc

SEQ ID NO: 3633230 - RNA, 20 nt, Human
cuggggugcugccugaaucc

SEQ ID NO: 3633231 - RNA, 15 nt, Human
cugggguggccacca

SEQ ID NO: 3633232 - RNA, 17 nt, Human
cugggguggccugugug

SEQ ID NO: 3633233 - RNA, 21 nt, Human
cugggguggccuguguggcca

SEQ ID NO: 3633234 - RNA, 14 nt, Human
cuggggugggaggu

SEQ ID NO: 3633235 - RNA, 17 nt, Human
cugggguggggaccuca

SEQ ID NO: 3633236 - RNA, 18 nt, Human
cugggguggggaccucag

SEQ ID NO: 3633237 - RNA, 21 nt, Human
cugggguggggaccucaggcc

SEQ ID NO: 3633238 - RNA, 20 nt, Human
cugggguggggauagggagc

SEQ ID NO: 3633239 - RNA, 14 nt, Human
cugggguuaucuga

SEQ ID NO: 3633240 - RNA, 20 nt, Human
cugggguucagccccuccuc

SEQ ID NO: 3633241 - RNA, 22 nt, Human
cugggguucagccccuccucug

SEQ ID NO: 3633242 - RNA, 18 nt, Human
cugggguugucagcucuc

SEQ ID NO: 3633243 - RNA, 22 nt, Human
cuggguaacuagggaagauaau

SEQ ID NO: 3633244 - RNA, 17 nt, Human
cuggguacuucuugaag

SEQ ID NO: 3633245 - RNA, 23 nt, Human
cuggguacuucuugaaggugcug

SEQ ID NO: 3633246 - RNA, 21 nt, Human
cuggguacuuguggacacagc

SEQ ID NO: 3633247 - RNA, 14 nt, Human
cuggguagcuguaa

SEQ ID NO: 3633248 - RNA, 15 nt, Human
cuggguagcuguaag

SEQ ID NO: 3633249 - RNA, 15 nt, Human
cuggguaggaaagag

SEQ ID NO: 3633250 - RNA, 15 nt, Human
cuggguccaaauaaa

SEQ ID NO: 3633251 - RNA, 20 nt, Human
cuggguccaaauaaaaacua

SEQ ID NO: 3633252 - RNA, 23 nt, Human
cuggguccaauuguggcacuugg

SEQ ID NO: 3633253 - RNA, 22 nt, Human
cuggguccaggggaugggaggu

SEQ ID NO: 3633254 - RNA, 13 nt, Human
cuggguccauauc

SEQ ID NO: 3633255 - RNA, 15 nt, Human
cuggguccauaucac

SEQ ID NO: 3633256 - RNA, 17 nt, Human
cuggguccauaucacac

SEQ ID NO: 3633257 - RNA, 14 nt, Human
cuggguccuuccug

SEQ ID NO: 3633258 - RNA, 13 nt, Human
cugggucucuaau

SEQ ID NO: 3633259 - RNA, 17 nt, Human
cugggucugugucucuu

SEQ ID NO: 3633260 - RNA, 17 nt, Human
cugggucuuuugcuacu

SEQ ID NO: 3633261 - RNA, 17 nt, Human
cugggugacagagugag

SEQ ID NO: 3633262 - RNA, 14 nt, Human
cugggugagugggg

SEQ ID NO: 3633263 - RNA, 18 nt, Human
cugggugaguggggagac

SEQ ID NO: 3633264 - RNA, 22 nt, Human
cugggugcaggagcgcucccuu

SEQ ID NO: 3633265 - RNA, 13 nt, Human
cugggugcccaca

SEQ ID NO: 3633266 - RNA, 23 nt, Human
cugggugcgaccccaucugccca

SEQ ID NO: 3633267 - RNA, 14 nt, Human
cugggugcuacugg

SEQ ID NO: 3633268 - RNA, 16 nt, Human
cugggugcugauccuu

SEQ ID NO: 3633269 - RNA, 20 nt, Human
cuggguggaucggccuccuc

SEQ ID NO: 3633270 - RNA, 20 nt, Human
cuggguggcaccagcagccu

SEQ ID NO: 3633271 - RNA, 14 nt, Human
cuggguggcccauc

SEQ ID NO: 3633272 - RNA, 15 nt, Human
cuggguggcccaucc

SEQ ID NO: 3633273 - RNA, 17 nt, Human
cuggguggcucacucag

SEQ ID NO: 3633274 - RNA, 17 nt, Human
cuggguggggcugcucc

SEQ ID NO: 3633275 - RNA, 21 nt, Human
cuggguggggcugcuccucca

SEQ ID NO: 3633276 - RNA, 22 nt, Human
cuggguggggcugcuccuccag

SEQ ID NO: 3633277 - RNA, 21 nt, Human
cuggguggggugaggaccacu

SEQ ID NO: 3633278 - RNA, 18 nt, Human
cuggguggguggugggga

SEQ ID NO: 3633279 - RNA, 19 nt, Human
cuggguggucugcaggcag

SEQ ID NO: 3633280 - RNA, 14 nt, Human
cugggugguggccu

SEQ ID NO: 3633281 - RNA, 17 nt, Human
cugggugguggccuggu

SEQ ID NO: 3633282 - RNA, 16 nt, Human
cugggugguugcccuu

SEQ ID NO: 3633283 - RNA, 18 nt, Human
cugggugguugcccuuca

SEQ ID NO: 3633284 - RNA, 20 nt, Human
cugggugucauuucauucca

SEQ ID NO: 3633285 - RNA, 16 nt, Human
cuggguuagacugcca

SEQ ID NO: 3633286 - RNA, 18 nt, Human
cuggguuagacugccagc

SEQ ID NO: 3633287 - RNA, 22 nt, Human
cuggguucagaaaugcugccug

SEQ ID NO: 3633288 - RNA, 23 nt, Human
cuggguucagaaaugcugccugc

SEQ ID NO: 3633289 - RNA, 20 nt, Human
cuggguucccuuuccuucca

SEQ ID NO: 3633290 - RNA, 18 nt, Human
cuggguuccuuccucuga

SEQ ID NO: 3633291 - RNA, 22 nt, Human
cuggguuccuuccucugagccu

SEQ ID NO: 3633292 - RNA, 23 nt, Human
cuggguuccuuccucugagccuu

SEQ ID NO: 3633293 - RNA, 14 nt, Human
cuggguucuaccca

SEQ ID NO: 3633294 - RNA, 13 nt, Human
cuggguuggaggg

SEQ ID NO: 3633295 - RNA, 23 nt, Human
cuggguugggaucagggguagga

SEQ ID NO: 3633296 - RNA, 23 nt, Human
cuggguugggggcuagggagacg

SEQ ID NO: 3633297 - RNA, 16 nt, Human
cuggguuggugcacag

SEQ ID NO: 3633298 - RNA, 16 nt, Human
cuggguuuggacccca

SEQ ID NO: 3633299 - RNA, 20 nt, Human
cuggguuuucuuaaccaucu

SEQ ID NO: 3633300 - RNA, 19 nt, Human
cugguaaaaugaagaauuu

SEQ ID NO: 3633301 - RNA, 23 nt, Human
cugguaagaaaaagcaaaaggca

SEQ ID NO: 3633302 - RNA, 17 nt, Human
cugguaagauuguuauu

SEQ ID NO: 3633303 - RNA, 15 nt, Human
cugguaagggccaag

SEQ ID NO: 3633304 - RNA, 14 nt, Human
cugguaauagcugu

SEQ ID NO: 3633305 - RNA, 19 nt, Human
cugguacaacggaggccug

SEQ ID NO: 3633306 - RNA, 20 nt, Human
cugguacaauuucuuuuggu

SEQ ID NO: 3633307 - RNA, 13 nt, Human
cugguacccagcc

SEQ ID NO: 3633308 - RNA, 16 nt, Human
cugguacccagccauc

SEQ ID NO: 3633309 - RNA, 18 nt, Human
cugguacccagccaucug

SEQ ID NO: 3633310 - RNA, 21 nt, Human
cugguacccagccaucugccc

SEQ ID NO: 3633311 - RNA, 14 nt, Human
cugguacccuccug

SEQ ID NO: 3633312 - RNA, 15 nt, Human
cugguacccuccugg

SEQ ID NO: 3633313 - RNA, 16 nt, Human
cugguacccuccuggc

SEQ ID NO: 3633314 - RNA, 20 nt, Human
cugguacucccucucaggau

SEQ ID NO: 3633315 - RNA, 21 nt, Human
cugguacucugccacuuuauu

SEQ ID NO: 3633316 - RNA, 20 nt, Human
cugguagacacaggauagau

SEQ ID NO: 3633317 - RNA, 14 nt, Human
cugguagagaugga

SEQ ID NO: 3633318 - RNA, 14 nt, Human
cugguagauagaaa

SEQ ID NO: 3633319 - RNA, 13 nt, Human
cugguagcucagg

SEQ ID NO: 3633320 - RNA, 22 nt, Human
cugguaggaauagcaugucacu

SEQ ID NO: 3633321 - RNA, 12 nt, Human
cugguagggcag

SEQ ID NO: 3633322 - RNA, 16 nt, Human
cugguagguugggaca

SEQ ID NO: 3633323 - RNA, 20 nt, Human
cugguagguugggacaccag

SEQ ID NO: 3633324 - RNA, 21 nt, Human
cugguaguuaguagcauguug

SEQ ID NO: 3633325 - RNA, 17 nt, Human
cugguaucucagaaagu

SEQ ID NO: 3633326 - RNA, 23 nt, Human
cugguaucucagaaagugccuga

SEQ ID NO: 3633327 - RNA, 18 nt, Human
cugguaugaacuugagga

SEQ ID NO: 3633328 - RNA, 20 nt, Human
cugguaugaacuugaggaca

SEQ ID NO: 3633329 - RNA, 21 nt, Human
cugguaugaacuugaggacac

SEQ ID NO: 3633330 - RNA, 19 nt, Human
cugguauggguuucuccca

SEQ ID NO: 3633331 - RNA, 23 nt, Human
cugguauggguuucucccaguuc

SEQ ID NO: 3633332 - RNA, 14 nt, Human
cuguagacaucugu

SEQ ID NO: 3633333 - RNA, 22 nt, Human
cuguagagcagggcaaguaaca

SEQ ID NO: 3633334 - RNA, 21 nt, Human
cuguagagcuagaacauggag

SEQ ID NO: 3633335 - RNA, 17 nt, Human
cuguagagggcccuggu

SEQ ID NO: 3633336 - RNA, 17 nt, Human
cuguagaguugcugaga

SEQ ID NO: 3633337 - RNA, 23 nt, Human
cuguagaguugcugagagggcuc

SEQ ID NO: 3633338 - RNA, 14 nt, Human
cuguagauauguau

SEQ ID NO: 3633339 - RNA, 13 nt, Human
cuguagaugaugu

SEQ ID NO: 3633340 - RNA, 13 nt, Human
cuguagauucugu

SEQ ID NO: 3633341 - RNA, 18 nt, Human
cuguagauugcuucugua

SEQ ID NO: 3633342 - RNA, 16 nt, Human
cuguagcacuuacugg

SEQ ID NO: 3633343 - RNA, 20 nt, Human
cuguagcagugagaaaaagc

SEQ ID NO: 3633344 - RNA, 21 nt, Human
cuguagcagugagaaaaagcu

SEQ ID NO: 3633345 - RNA, 16 nt, Human
cuguagcuuuuaggaa

SEQ ID NO: 3633346 - RNA, 14 nt, Human
cuguaggaaaccca

SEQ ID NO: 3633347 - RNA, 17 nt, Human
cuguaggaagguacugu

SEQ ID NO: 3633348 - RNA, 21 nt, Human
cuguaggaagguacuguauga

SEQ ID NO: 3633349 - RNA, 13 nt, Human
cuguaggccucag

SEQ ID NO: 3633350 - RNA, 21 nt, Human
cuguagggagggcggcagggg

SEQ ID NO: 3633351 - RNA, 14 nt, Human
cuguagggcuggac

SEQ ID NO: 3633352 - RNA, 17 nt, Human
cuguagggcuggaccua

SEQ ID NO: 3633353 - RNA, 18 nt, Human
cuguagggcuggaccuau

SEQ ID NO: 3633354 - RNA, 17 nt, Human
cuguaggguccaaccag

SEQ ID NO: 3633355 - RNA, 23 nt, Human
cuguaggguccaaccagaccugg

SEQ ID NO: 3633356 - RNA, 20 nt, Human
cuguagguucaugcccaagc

SEQ ID NO: 3633357 - RNA, 17 nt, Human
cuguagguugcacacuu

SEQ ID NO: 3633358 - RNA, 19 nt, Human
cuguagguugcacacuuug

SEQ ID NO: 3633359 - RNA, 22 nt, Human
cuguagguugcacacuuuggua

SEQ ID NO: 3633360 - RNA, 18 nt, Human
cuguaguaaacuauuuau

SEQ ID NO: 3633361 - RNA, 21 nt, Human
cuguaguacuccuuaagaaca

SEQ ID NO: 3633362 - RNA, 21 nt, Human
cuguaguagcccuuucugugu

SEQ ID NO: 3633363 - RNA, 22 nt, Human
cuguagucauuuacuaaacaua

SEQ ID NO: 3633364 - RNA, 17 nt, Human
cuguagucccagccacu

SEQ ID NO: 3633365 - RNA, 18 nt, Human
cuguagucccagcuacuc

SEQ ID NO: 3633366 - RNA, 22 nt, Human
cuguagucccagcuacucagga

SEQ ID NO: 3633367 - RNA, 23 nt, Human
cuguagucccagcuacucaggag

SEQ ID NO: 3633368 - RNA, 23 nt, Human
cuguaguccuagccacucaggag

SEQ ID NO: 3633369 - RNA, 20 nt, Human
cuguagucucaggaccuagg

SEQ ID NO: 3633370 - RNA, 18 nt, Human
cuguagugagauagcauu

SEQ ID NO: 3633371 - RNA, 20 nt, Human
cuguagugagauagcauugu

SEQ ID NO: 3633372 - RNA, 13 nt, Human
cuguaguuaggaa

SEQ ID NO: 3633373 - RNA, 18 nt, Human
cuguaguuaggaaauaaa

SEQ ID NO: 3633374 - RNA, 21 nt, Human
cuguaguuaggaaauaaaacc

SEQ ID NO: 3633375 - RNA, 13 nt, Human
cuguaguucuaag

SEQ ID NO: 3633376 - RNA, 20 nt, Human
cuguaguuuuauuuuauguu

SEQ ID NO: 3633377 - RNA, 22 nt, Human
cuguaguuuuauuuuauguuua

SEQ ID NO: 3633378 - RNA, 24 nt, Human
cuguaguuuuauuuuauguuuaga

SEQ ID NO: 3633379 - RNA, 17 nt, Human
cuguauaaaaucagcca

SEQ ID NO: 3633380 - RNA, 20 nt, Human
cuguauaaacauuaaauguc

SEQ ID NO: 3633381 - RNA, 20 nt, Human
cuguauaaaggugugcugug

SEQ ID NO: 3633382 - RNA, 13 nt, Human
cuguauaaauagg

SEQ ID NO: 3633383 - RNA, 15 nt, Human
cuguauaaauaggag

SEQ ID NO: 3633384 - RNA, 20 nt, Human
cuguauaaauaggagaggau

SEQ ID NO: 3633385 - RNA, 21 nt, Human
cuguauaaauaggagaggaug

SEQ ID NO: 3633386 - RNA, 15 nt, Human
cuguauaagcacuga

SEQ ID NO: 3633387 - RNA, 18 nt, Human
cuguauaaguaagaaaau

SEQ ID NO: 3633388 - RNA, 19 nt, Human
cuguauaaguaagaaaaua

SEQ ID NO: 3633389 - RNA, 21 nt, Human
cuguauaaguaagaaaauauu

SEQ ID NO: 3633390 - RNA, 21 nt, Human
cuguauaauacuuuguauaca

SEQ ID NO: 3633391 - RNA, 19 nt, Human
cuguauacaacccuggcau

SEQ ID NO: 3633392 - RNA, 21 nt, Human
cuguauaccccgugaagcauc

SEQ ID NO: 3633393 - RNA, 16 nt, Human
cuguauacuuuaguau

SEQ ID NO: 3633394 - RNA, 21 nt, Human
cuguauagacaggagaagaaa

SEQ ID NO: 3633395 - RNA, 22 nt, Human
cuguauagacaguuuguaaaug

SEQ ID NO: 3633396 - RNA, 23 nt, Human
cuguauagacaguuuguaaaugu

SEQ ID NO: 3633397 - RNA, 20 nt, Human
cuguauagauuagaauucug

SEQ ID NO: 3633398 - RNA, 14 nt, Human
cuguauagcuccuu

SEQ ID NO: 3633399 - RNA, 19 nt, Human
cuguauagcucuuuuccua

SEQ ID NO: 3633400 - RNA, 15 nt, Human
cuguauaguacuggc

SEQ ID NO: 3633401 - RNA, 21 nt, Human
cuguauaguuaggauagcauu

SEQ ID NO: 3633402 - RNA, 15 nt, Human
cuguauauaaaggug

SEQ ID NO: 3633403 - RNA, 13 nt, Human
cuguauauaaaug

SEQ ID NO: 3633404 - RNA, 22 nt, Human
cuguauauaaaugggaacauuu

SEQ ID NO: 3633405 - RNA, 18 nt, Human
cuguauauacaauaacau

SEQ ID NO: 3633406 - RNA, 16 nt, Human
cuguauauagcccagc

SEQ ID NO: 3633407 - RNA, 21 nt, Human
cuguauaucaggguacaaaaa

SEQ ID NO: 3633408 - RNA, 22 nt, Human
cuguauauuacagauauuuguc

SEQ ID NO: 3633409 - RNA, 12 nt, Human
cuguauauuugu

SEQ ID NO: 3633410 - RNA, 19 nt, Human
cuguauauuuguaugauau

SEQ ID NO: 3633411 - RNA, 23 nt, Human
cuguaucaggacccagaggaagg

SEQ ID NO: 3633412 - RNA, 23 nt, Human
cuguauccagguucccucccaga

SEQ ID NO: 3633413 - RNA, 19 nt, Human
cuguaucccaugagccuca

SEQ ID NO: 3633414 - RNA, 23 nt, Human
cuguaucccaugagccucagcau

SEQ ID NO: 3633415 - RNA, 23 nt, Human
cuguaucuguagugagauagcau

SEQ ID NO: 3633416 - RNA, 13 nt, Human
cuguaucugugcu

SEQ ID NO: 3633417 - RNA, 13 nt, Human
cuguaucugugua

SEQ ID NO: 3633418 - RNA, 20 nt, Human
cuguaugaaaaauuggggag

SEQ ID NO: 3633419 - RNA, 19 nt, Human
cuguaugaucaaauguuua

SEQ ID NO: 3633420 - RNA, 15 nt, Human
cuguaugcugaucau

SEQ ID NO: 3633421 - RNA, 16 nt, Human
cuguaugucuuaaaac

SEQ ID NO: 3633422 - RNA, 13 nt, Human
cuguauguugucc

SEQ ID NO: 3633423 - RNA, 19 nt, Human
cuguauuaagagugaaaau

SEQ ID NO: 3633424 - RNA, 12 nt, Human
cuguauugaauc

SEQ ID NO: 3633425 - RNA, 13 nt, Human
cuguauugucuga

SEQ ID NO: 3633426 - RNA, 17 nt, Human
cuguauugucugaacuu

SEQ ID NO: 3633427 - RNA, 21 nt, Human
cuguauugugcugauugugga

SEQ ID NO: 3633428 - RNA, 16 nt, Human
cuguauuuaagcaaau

SEQ ID NO: 3633429 - RNA, 14 nt, Human
cuguauuugaaagu

SEQ ID NO: 3633430 - RNA, 20 nt, Human
cuguauuugaaagugccuuu

SEQ ID NO: 3633431 - RNA, 16 nt, Human
cuguauuugagaauau

SEQ ID NO: 3633432 - RNA, 14 nt, Human
cuguauuuguaucu

SEQ ID NO: 3633433 - RNA, 12 nt, Human
cuguauuuguga

SEQ ID NO: 3633434 - RNA, 19 nt, Human
cuguauuugugacuaauug

SEQ ID NO: 3633435 - RNA, 16 nt, Human
cuguauuuguucccaa

SEQ ID NO: 3633436 - RNA, 16 nt, Human
cuguauuuuaaaagaa

SEQ ID NO: 3633437 - RNA, 19 nt, Human
cuguauuuuaaaagaauga

SEQ ID NO: 3633438 - RNA, 22 nt, Human
cuguauuuuaaaagaaugauua

SEQ ID NO: 3633439 - RNA, 23 nt, Human
cuguauuuuauuuagacaagaga

SEQ ID NO: 3633440 - RNA, 16 nt, Human
cuguauuuucuuuuua

SEQ ID NO: 3633441 - RNA, 20 nt, Human
cuguauuuugaaaaugcuuu

SEQ ID NO: 3633442 - RNA, 20 nt, Human
cuguauuuuuucuugcauug

SEQ ID NO: 3633443 - RNA, 22 nt, Human
cuguauuuuuucuugcauugac

SEQ ID NO: 3633444 - RNA, 23 nt, Human
cuguauuuuuucuugcauugaca

SEQ ID NO: 3633445 - RNA, 19 nt, Human
cugucaaaacaaguuuuuc

SEQ ID NO: 3633446 - RNA, 14 nt, Human
cugucaaaacacug

SEQ ID NO: 3633447 - RNA, 18 nt, Human
cugucaaaacacugugga

SEQ ID NO: 3633448 - RNA, 19 nt, Human
cugucaaaacacuguggaa

SEQ ID NO: 3633449 - RNA, 16 nt, Human
cugucaaaauaauuuu

SEQ ID NO: 3633450 - RNA, 14 nt, Human
cugucaaacaaagc

SEQ ID NO: 3633451 - RNA, 19 nt, Human
cugucaagaguaguuauau

SEQ ID NO: 3633452 - RNA, 19 nt, Human
cugucaaggcugcuuagaa

SEQ ID NO: 3633453 - RNA, 16 nt, Human
cugucaaugagagcau

SEQ ID NO: 3633454 - RNA, 19 nt, Human
cugucaaugauuauuuuca

SEQ ID NO: 3633455 - RNA, 16 nt, Human
cugucaauuacaggaa

SEQ ID NO: 3633456 - RNA, 23 nt, Human
cugucaauuacaggaaguacugg

SEQ ID NO: 3633457 - RNA, 16 nt, Human
cugucacaaccaagaa

SEQ ID NO: 3633458 - RNA, 13 nt, Human
cugucacaccagc

SEQ ID NO: 3633459 - RNA, 22 nt, Human
cugucacaguaaaaauaaaaua

SEQ ID NO: 3633460 - RNA, 15 nt, Human
cugucacauugcauu

SEQ ID NO: 3633461 - RNA, 18 nt, Human
cugucaccacccugcuca

SEQ ID NO: 3633462 - RNA, 23 nt, Human
cugucaccacccugcucauccac

SEQ ID NO: 3633463 - RNA, 20 nt, Human
cugucacccaggcuggagua

SEQ ID NO: 3633464 - RNA, 19 nt, Human
cugucacccgaucgccagc

SEQ ID NO: 3633465 - RNA, 18 nt, Human
cugucacccuccaccucu

SEQ ID NO: 3633466 - RNA, 21 nt, Human
cugucacucauugcugagccu

SEQ ID NO: 3633467 - RNA, 22 nt, Human
cugucacucauugcugagccuc

SEQ ID NO: 3633468 - RNA, 15 nt, Human
cugucacugcugcuu

SEQ ID NO: 3633469 - RNA, 11 nt, Human
cugucacuguu

SEQ ID NO: 3633470 - RNA, 21 nt, Human
cugucacuguuggacgucagc

SEQ ID NO: 3633471 - RNA, 14 nt, Human
cugucacuguuucu

SEQ ID NO: 3633472 - RNA, 19 nt, Human
cugucacuguuucucugcu

SEQ ID NO: 3633473 - RNA, 14 nt, Human
cugucacuuugcuc

SEQ ID NO: 3633474 - RNA, 17 nt, Human
cuucaucccacaaucuu

SEQ ID NO: 3633475 - RNA, 17 nt, Human
cuucaucccauuccagg

SEQ ID NO: 3633476 - RNA, 13 nt, Human
cuucaucccucug

SEQ ID NO: 3633477 - RNA, 16 nt, Human
cuucauccuccucaga

SEQ ID NO: 3633478 - RNA, 11 nt, Human
cuucauccucu

SEQ ID NO: 3633479 - RNA, 15 nt, Human
cuucaucgaaucuac

SEQ ID NO: 3633480 - RNA, 17 nt, Human
cuucaucgaaucuacua

SEQ ID NO: 3633481 - RNA, 17 nt, Human
cuucaucuccagggagu

SEQ ID NO: 3633482 - RNA, 13 nt, Human
cuucaucucccac

SEQ ID NO: 3633483 - RNA, 13 nt, Human
cuucaucuggaac

SEQ ID NO: 3633484 - RNA, 15 nt, Human
cuucaucuggaacca

SEQ ID NO: 3633485 - RNA, 13 nt, Human
cuucaucuggcaa

SEQ ID NO: 3633486 - RNA, 13 nt, Human
cuucaucuuccug

SEQ ID NO: 3633487 - RNA, 16 nt, Human
cuucaucuuccugugu

SEQ ID NO: 3633488 - RNA, 12 nt, Human
cuucaucuuuua

SEQ ID NO: 3633489 - RNA, 12 nt, Human
cuucaugaaaug

SEQ ID NO: 3633490 - RNA, 14 nt, Human
cuucaugaaaugcu

SEQ ID NO: 3633491 - RNA, 23 nt, Human
cuucaugaaaugcuaugucauuu

SEQ ID NO: 3633492 - RNA, 12 nt, Human
cuucaugacauu

SEQ ID NO: 3633493 - RNA, 22 nt, Human
cuucaugcaaugacaucuucaa

SEQ ID NO: 3633494 - RNA, 13 nt, Human
cuucaugcacuua

SEQ ID NO: 3633495 - RNA, 22 nt, Human
cuucaugcaggugaaacccagu

SEQ ID NO: 3633496 - RNA, 15 nt, Human
cuucaugcauggaaa

SEQ ID NO: 3633497 - RNA, 15 nt, Human
cuucaugccagcuac

SEQ ID NO: 3633498 - RNA, 15 nt, Human
cuucaugccuuugua

SEQ ID NO: 3633499 - RNA, 16 nt, Human
cuucaugccuuuguaa

SEQ ID NO: 3633500 - RNA, 15 nt, Human
cuucaugcucagccc

SEQ ID NO: 3633501 - RNA, 17 nt, Human
cuucaugcucagcccug

SEQ ID NO: 3633502 - RNA, 13 nt, Human
cuucauggaucag

SEQ ID NO: 3633503 - RNA, 15 nt, Human
cuucauggcagaagg

SEQ ID NO: 3633504 - RNA, 19 nt, Human
cuucauggccauagcuuuu

SEQ ID NO: 3633505 - RNA, 13 nt, Human
cuucauguaaauu

SEQ ID NO: 3633506 - RNA, 22 nt, Human
cuucauguaaauugacuguacu

SEQ ID NO: 3633507 - RNA, 21 nt, Human
cuucauguaauuuuauuuuaa

SEQ ID NO: 3633508 - RNA, 20 nt, Human
cuucaugucaacuucuggcu

SEQ ID NO: 3633509 - RNA, 16 nt, Human
cuucauguggcuuccc

SEQ ID NO: 3633510 - RNA, 13 nt, Human
cuucauguguccc

SEQ ID NO: 3633511 - RNA, 14 nt, Human
cuucauguguccca

SEQ ID NO: 3633512 - RNA, 20 nt, Human
cuucaugugucccagaagau

SEQ ID NO: 3633513 - RNA, 20 nt, Human
cuucauuaagcccucuucca

SEQ ID NO: 3633514 - RNA, 17 nt, Human
cuucauuaauaauaaau

SEQ ID NO: 3633515 - RNA, 21 nt, Human
cuucauucaagucagcucuuc

SEQ ID NO: 3633516 - RNA, 15 nt, Human
cuucauucugcaggg

SEQ ID NO: 3633517 - RNA, 18 nt, Human
cuucauugauuuccugug

SEQ ID NO: 3633518 - RNA, 21 nt, Human
cuucauugauuuccuguguca

SEQ ID NO: 3633519 - RNA, 17 nt, Human
cuucauugucccucuuc

SEQ ID NO: 3633520 - RNA, 20 nt, Human
cuucauugucccucuucacu

SEQ ID NO: 3633521 - RNA, 19 nt, Human
cuucauuuaaaaaaaucac

SEQ ID NO: 3633522 - RNA, 12 nt, Human
cuucauuucaga

SEQ ID NO: 3633523 - RNA, 17 nt, Human
cuucauuucauuguaug

SEQ ID NO: 3633524 - RNA, 14 nt, Human
cuucauuuccuccg

SEQ ID NO: 3633525 - RNA, 21 nt, Human
cuucauuucugauauagaauu

SEQ ID NO: 3633526 - RNA, 14 nt, Human
cuucauuuggagau

SEQ ID NO: 3633527 - RNA, 24 nt, Human
cuucauuugggaugcuacucuagu

SEQ ID NO: 3633528 - RNA, 14 nt, Human
cuucauuuguguca

SEQ ID NO: 3633529 - RNA, 16 nt, Human
cuucauuuuuccuaac

SEQ ID NO: 3633530 - RNA, 17 nt, Human
cuucauuuuuccuaaca

SEQ ID NO: 3633531 - RNA, 15 nt, Human
cuuccaaaauucuua

SEQ ID NO: 3633532 - RNA, 17 nt, Human
cuuccaaaauucuuauu

SEQ ID NO: 3633533 - RNA, 16 nt, Human
cuuccaaacuaauuuu

SEQ ID NO: 3633534 - RNA, 13 nt, Human
cuuccaaagcaca

SEQ ID NO: 3633535 - RNA, 14 nt, Human
cuuccaaauaaaua

SEQ ID NO: 3633536 - RNA, 20 nt, Human
cuuccaaauccccuaagcag

SEQ ID NO: 3633537 - RNA, 15 nt, Human
cuuccaacugcugcc

SEQ ID NO: 3633538 - RNA, 18 nt, Human
cuuccaacugcugcccca

SEQ ID NO: 3633539 - RNA, 19 nt, Human
cuuccaagacuccagcccu

SEQ ID NO: 3633540 - RNA, 21 nt, Human
cuuccaagguggucugcucgg

SEQ ID NO: 3633541 - RNA, 15 nt, Human
cuuccaaugucugga

SEQ ID NO: 3633542 - RNA, 17 nt, Human
cuuccaaugucuggaga

SEQ ID NO: 3633543 - RNA, 19 nt, Human
cuuccaaugucuggagacc

SEQ ID NO: 3633544 - RNA, 16 nt, Human
cuuccacaaagaaaau

SEQ ID NO: 3633545 - RNA, 17 nt, Human
cuuccacaaagaaaauu

SEQ ID NO: 3633546 - RNA, 23 nt, Human
cuuccacaaagaaaauuccuaua

SEQ ID NO: 3633547 - RNA, 16 nt, Human
cuuccacaagagccca

SEQ ID NO: 3633548 - RNA, 22 nt, Human
cuuccacagggucccacagcca

SEQ ID NO: 3633549 - RNA, 23 nt, Human
cuuccacagggucccacagccac

SEQ ID NO: 3633550 - RNA, 17 nt, Human
cuuccacaggucucaga

SEQ ID NO: 3633551 - RNA, 15 nt, Human
cuuccacauuuuccc

SEQ ID NO: 3633552 - RNA, 12 nt, Human
cuuccaccagcc

SEQ ID NO: 3633553 - RNA, 17 nt, Human
cuuccaccagccugcac

SEQ ID NO: 3633554 - RNA, 14 nt, Human
cuuccacccagugc

SEQ ID NO: 3633555 - RNA, 14 nt, Human
cuuccaccucaccc

SEQ ID NO: 3633556 - RNA, 18 nt, Human
cuuccaccucaccccacu

SEQ ID NO: 3633557 - RNA, 20 nt, Human
cuuccaccucaccccacuua

SEQ ID NO: 3633558 - RNA, 16 nt, Human
cuuccaccugcucugc

SEQ ID NO: 3633559 - RNA, 17 nt, Human
cuuccaccugcucugcu

SEQ ID NO: 3633560 - RNA, 13 nt, Human
cuuccaccuggaa

SEQ ID NO: 3633561 - RNA, 17 nt, Human
cuuccacgcugucucca

SEQ ID NO: 3633562 - RNA, 19 nt, Human
cuuccacggacucaaguuu

SEQ ID NO: 3633563 - RNA, 19 nt, Human
cuuccacguacugcagccu

SEQ ID NO: 3633564 - RNA, 15 nt, Human
cuuccacugagggca

SEQ ID NO: 3633565 - RNA, 17 nt, Human
cuuccacugauggaaac

SEQ ID NO: 3633566 - RNA, 16 nt, Human
cuuccacugccucugc

SEQ ID NO: 3633567 - RNA, 18 nt, Human
cuuccacugccucugccu

SEQ ID NO: 3633568 - RNA, 20 nt, Human
cuuccacuuuuuuuuguaug

SEQ ID NO: 3633569 - RNA, 15 nt, Human
cuuccagaaguguga

SEQ ID NO: 3633570 - RNA, 17 nt, Human
cuuccagaagugugauu

SEQ ID NO: 3633571 - RNA, 13 nt, Human
cuuccagaucacu

SEQ ID NO: 3633572 - RNA, 21 nt, Human
cuuccagauccucucuggggc

SEQ ID NO: 3633573 - RNA, 20 nt, Human
cuuccagauggucauccaga

SEQ ID NO: 3633574 - RNA, 14 nt, Human
cuuccagcacccug

SEQ ID NO: 3633575 - RNA, 21 nt, Human
cuuccagcauuuagcuggcca

SEQ ID NO: 3633576 - RNA, 22 nt, Human
cuuccagcuagugacccacaug

SEQ ID NO: 3633577 - RNA, 13 nt, Human
cuuccagcugcug

SEQ ID NO: 3633578 - RNA, 16 nt, Human
cuuccagcugcugucu

SEQ ID NO: 3633579 - RNA, 15 nt, Human
cuuccaggaccccug

SEQ ID NO: 3633580 - RNA, 17 nt, Human
cuuccaggaccccuggg

SEQ ID NO: 3633581 - RNA, 12 nt, Human
cuuccaggcagc

SEQ ID NO: 3633582 - RNA, 13 nt, Human
cuuccaggcagcc

SEQ ID NO: 3633583 - RNA, 20 nt, Human
cuuccaggccaucagaggcc

SEQ ID NO: 3633584 - RNA, 19 nt, Human
cuuccaggcccccaccacu

SEQ ID NO: 3633585 - RNA, 14 nt, Human
cuuccaggcuggga

SEQ ID NO: 3633586 - RNA, 19 nt, Human
cuuccagggacgaagaaga

SEQ ID NO: 3633587 - RNA, 15 nt, Human
cuuccaggggaaccu

SEQ ID NO: 3633588 - RNA, 19 nt, Human
cuuccaggggaaccugcca

SEQ ID NO: 3633589 - RNA, 14 nt, Human
cuuccagggguggg

SEQ ID NO: 3633590 - RNA, 19 nt, Human
cuuccagguaucuccagga

SEQ ID NO: 3633591 - RNA, 17 nt, Human
cuuccagugaggcucug

SEQ ID NO: 3633592 - RNA, 19 nt, Human
cuuccagugaggcucugcc

SEQ ID NO: 3633593 - RNA, 22 nt, Human
cuuccagugaggcucugcccuu

SEQ ID NO: 3633594 - RNA, 18 nt, Human
cuuccaguguccuuagaa

SEQ ID NO: 3633595 - RNA, 19 nt, Human
cuuccaguguccuuagaac

SEQ ID NO: 3633596 - RNA, 19 nt, Human
cuuccaguuacuuuccaau

SEQ ID NO: 3633597 - RNA, 19 nt, Human
cuuccaguuuauuccagag

SEQ ID NO: 3633598 - RNA, 20 nt, Human
cuuccaguuuauuccagagc

SEQ ID NO: 3633599 - RNA, 21 nt, Human
cuuccaguuuauuccagagcu

SEQ ID NO: 3633600 - RNA, 23 nt, Human
cuuccaguuuauuccagagcugc

SEQ ID NO: 3633601 - RNA, 21 nt, Human
cuuccaguuugcuuugcccuu

SEQ ID NO: 3633602 - RNA, 11 nt, Human
cuuccauaaug

SEQ ID NO: 3633603 - RNA, 18 nt, Human
cuuccauaaugcuacugu

SEQ ID NO: 3633604 - RNA, 23 nt, Human
cuuccauaauguauaaagaacaa

SEQ ID NO: 3633605 - RNA, 11 nt, Human
cuuccauaauu

SEQ ID NO: 3633606 - RNA, 14 nt, Human
cuuccauacagcuc

SEQ ID NO: 3633607 - RNA, 22 nt, Human
cuuccauagccuaaucccuggg

SEQ ID NO: 3633608 - RNA, 19 nt, Human
cuuccauauuuggaagaaa

SEQ ID NO: 3633609 - RNA, 13 nt, Human
cuuccaucauguc

SEQ ID NO: 3633610 - RNA, 14 nt, Human
cuuccaucaugucc

SEQ ID NO: 3633611 - RNA, 17 nt, Human
cuuccaucaugucccca

SEQ ID NO: 3633612 - RNA, 12 nt, Human
cuuccaucccua

SEQ ID NO: 3633613 - RNA, 19 nt, Human
cuuccaucccuacccccua

SEQ ID NO: 3633614 - RNA, 15 nt, Human
cuuccaucucgccac

SEQ ID NO: 3633615 - RNA, 21 nt, Human
cuuccaucugauuccagcaca

SEQ ID NO: 3633616 - RNA, 17 nt, Human
cuuccaugagaacagca

SEQ ID NO: 3633617 - RNA, 14 nt, Human
cuuccaugauuuua

SEQ ID NO: 3633618 - RNA, 15 nt, Human
cuuccaugcugugcg

SEQ ID NO: 3633619 - RNA, 17 nt, Human
cuuccauggacuuuguu

SEQ ID NO: 3633620 - RNA, 16 nt, Human
cuucuauauauuguau

SEQ ID NO: 3633621 - RNA, 20 nt, Human
cuucuaugacccagcauggg

SEQ ID NO: 3633622 - RNA, 22 nt, Human
cuucuauguaggaaaaaaauag

SEQ ID NO: 3633623 - RNA, 21 nt, Human
cuucuauucuagccugcauug

SEQ ID NO: 3633624 - RNA, 14 nt, Human
cuucuauugccucu

SEQ ID NO: 3633625 - RNA, 14 nt, Human
cuucuauuggucuc

SEQ ID NO: 3633626 - RNA, 22 nt, Human
cuucuauuuauuuauuuauuca

SEQ ID NO: 3633627 - RNA, 15 nt, Human
cuucucaaguucuaa

SEQ ID NO: 3633628 - RNA, 18 nt, Human
cuucucaaguucuaagau

SEQ ID NO: 3633629 - RNA, 21 nt, Human
cuucucaaguucuaagauucu

SEQ ID NO: 3633630 - RNA, 15 nt, Human
cuucucacagcacau

SEQ ID NO: 3633631 - RNA, 20 nt, Human
cuucucacauuuauauuuuu

SEQ ID NO: 3633632 - RNA, 20 nt, Human
cuucucacucccuucuccuu

SEQ ID NO: 3633633 - RNA, 16 nt, Human
cuucucacugccaugc

SEQ ID NO: 3633634 - RNA, 17 nt, Human
cuucucagaagcacaga

SEQ ID NO: 3633635 - RNA, 18 nt, Human
cuucucagaaucuaccca

SEQ ID NO: 3633636 - RNA, 22 nt, Human
cuucucagauuucugaggaaau

SEQ ID NO: 3633637 - RNA, 21 nt, Human
cuucucaggacacaggccugu

SEQ ID NO: 3633638 - RNA, 13 nt, Human
cuucucaggcucu

SEQ ID NO: 3633639 - RNA, 16 nt, Human
cuucucauacguccac

SEQ ID NO: 3633640 - RNA, 20 nt, Human
cuucucaucuugacagagcc

SEQ ID NO: 3633641 - RNA, 23 nt, Human
cuucucaucuugacagagccugc

SEQ ID NO: 3633642 - RNA, 14 nt, Human
cuucucauuacuug

SEQ ID NO: 3633643 - RNA, 14 nt, Human
cuucucauuucacc

SEQ ID NO: 3633644 - RNA, 15 nt, Human
cuucucauuucaccc

SEQ ID NO: 3633645 - RNA, 19 nt, Human
cuucuccaaaaaucugccu

SEQ ID NO: 3633646 - RNA, 20 nt, Human
cuucuccaaaaaucugccug

SEQ ID NO: 3633647 - RNA, 15 nt, Human
cuucuccacccugcu

SEQ ID NO: 3633648 - RNA, 16 nt, Human
cuucuccacccugcuc

SEQ ID NO: 3633649 - RNA, 15 nt, Human
cuucuccacuggaug

SEQ ID NO: 3633650 - RNA, 20 nt, Human
cuucuccacuuucuagccag

SEQ ID NO: 3633651 - RNA, 17 nt, Human
cuucuccagacaaacca

SEQ ID NO: 3633652 - RNA, 13 nt, Human
cuucuccagauuu

SEQ ID NO: 3633653 - RNA, 12 nt, Human
cuucuccaggcu

SEQ ID NO: 3633654 - RNA, 13 nt, Human
cuucuccaggguc

SEQ ID NO: 3633655 - RNA, 18 nt, Human
cuucuccaucucucuggc

SEQ ID NO: 3633656 - RNA, 17 nt, Human
cuucuccaucuggcagg

SEQ ID NO: 3633657 - RNA, 15 nt, Human
cuucucccaauucau

SEQ ID NO: 3633658 - RNA, 14 nt, Human
cuucucccacacug

SEQ ID NO: 3633659 - RNA, 16 nt, Human
cuucucccacacugcu

SEQ ID NO: 3633660 - RNA, 19 nt, Human
cuucucccacucuccuagg

SEQ ID NO: 3633661 - RNA, 12 nt, Human
cuucucccagaa

SEQ ID NO: 3633662 - RNA, 16 nt, Human
cuucucccagaauccc

SEQ ID NO: 3633663 - RNA, 18 nt, Human
cuucucccaucucuuccu

SEQ ID NO: 3633664 - RNA, 18 nt, Human
cuucucccccccggggcu

SEQ ID NO: 3633665 - RNA, 19 nt, Human
cuucuccccugcacuguaa

SEQ ID NO: 3633666 - RNA, 20 nt, Human
cuucuccccugcacuguaaa

SEQ ID NO: 3633667 - RNA, 23 nt, Human
cuucuccccugcacuguaaaaug

SEQ ID NO: 3633668 - RNA, 15 nt, Human
cuucuccccuuccau

SEQ ID NO: 3633669 - RNA, 16 nt, Human
cuucuccgccagccuc

SEQ ID NO: 3633670 - RNA, 22 nt, Human
cuucuccuauguguaaggugaa

SEQ ID NO: 3633671 - RNA, 18 nt, Human
cuucuccuccccacccgc

SEQ ID NO: 3633672 - RNA, 14 nt, Human
cuucuccucuugua

SEQ ID NO: 3633673 - RNA, 17 nt, Human
cuucuccucuuguaaau

SEQ ID NO: 3633674 - RNA, 20 nt, Human
cuucuccuuccaacugcugc

SEQ ID NO: 3633675 - RNA, 20 nt, Human
cuucuccuuucacaaccuuc

SEQ ID NO: 3633676 - RNA, 15 nt, Human
cuucucuacagacuu

SEQ ID NO: 3633677 - RNA, 15 nt, Human
cuucucuagcuggug

SEQ ID NO: 3633678 - RNA, 12 nt, Human
cuucucuauaaa

SEQ ID NO: 3633679 - RNA, 16 nt, Human
cuucucuccagcugac

SEQ ID NO: 3633680 - RNA, 19 nt, Human
cuucucuccagcugacuaa

SEQ ID NO: 3633681 - RNA, 14 nt, Human
cuucucuccagugc

SEQ ID NO: 3633682 - RNA, 13 nt, Human
cuucucuccuccc

SEQ ID NO: 3633683 - RNA, 15 nt, Human
cuucucuccucccca

SEQ ID NO: 3633684 - RNA, 13 nt, Human
cuucucucugugg

SEQ ID NO: 3633685 - RNA, 16 nt, Human
cuucucucugugggau

SEQ ID NO: 3633686 - RNA, 12 nt, Human
cuucucugaaca

SEQ ID NO: 3633687 - RNA, 13 nt, Human
cuucucugaacac

SEQ ID NO: 3633688 - RNA, 15 nt, Human
cuucucugaacacag

SEQ ID NO: 3633689 - RNA, 21 nt, Human
cuucucugaacacaggcagcu

SEQ ID NO: 3633690 - RNA, 11 nt, Human
cuucucugaag

SEQ ID NO: 3633691 - RNA, 16 nt, Human
cuucucugaagggagg

SEQ ID NO: 3633692 - RNA, 12 nt, Human
cuucucugacuu

SEQ ID NO: 3633693 - RNA, 16 nt, Human
cuucucugacuucugc

SEQ ID NO: 3633694 - RNA, 12 nt, Human
cuucucugccca

SEQ ID NO: 3633695 - RNA, 15 nt, Human
cuucucugcccauuc

SEQ ID NO: 3633696 - RNA, 16 nt, Human
cuucucugcccauucc

SEQ ID NO: 3633697 - RNA, 23 nt, Human
cuucucugcccauuccccagccu

SEQ ID NO: 3633698 - RNA, 19 nt, Human
cuucucugccuuugacauu

SEQ ID NO: 3633699 - RNA, 13 nt, Human
cuucucugcucca

SEQ ID NO: 3633700 - RNA, 14 nt, Human
cuucucugcuccac

SEQ ID NO: 3633701 - RNA, 19 nt, Human
cuucucuggaaagggggga

SEQ ID NO: 3633702 - RNA, 15 nt, Human
cuucucugugagaag

SEQ ID NO: 3633703 - RNA, 17 nt, Human
cuucucuguucauuucc

SEQ ID NO: 3633704 - RNA, 13 nt, Human
cuucucuuagauu

SEQ ID NO: 3633705 - RNA, 13 nt, Human
cuucucuuccugu

SEQ ID NO: 3633706 - RNA, 22 nt, Human
cuucucuuccuuuuaucaguag

SEQ ID NO: 3633707 - RNA, 13 nt, Human
cuucucuugcuuu

SEQ ID NO: 3633708 - RNA, 20 nt, Human
cuucucuuuaacucaggacu

SEQ ID NO: 3633709 - RNA, 22 nt, Human
cuucucuuuaacucaggacucc

SEQ ID NO: 3633710 - RNA, 13 nt, Human
cuucucuuugccu

SEQ ID NO: 3633711 - RNA, 16 nt, Human
cuucucuuugccucaa

SEQ ID NO: 3633712 - RNA, 23 nt, Human
cuucugaaaugaaacaaauaauc

SEQ ID NO: 3633713 - RNA, 22 nt, Human
cuucugaacucaaacugaggaa

SEQ ID NO: 3633714 - RNA, 19 nt, Human
cuucugaacuuggcgcugc

SEQ ID NO: 3633715 - RNA, 23 nt, Human
cuucugaacuuggcgcugccccu

SEQ ID NO: 3633716 - RNA, 15 nt, Human
cuucugaauaaagca

SEQ ID NO: 3633717 - RNA, 18 nt, Human
cuucugaauaaagcaauu

SEQ ID NO: 3633718 - RNA, 15 nt, Human
cuucugaauauuuua

SEQ ID NO: 3633719 - RNA, 16 nt, Human
cuucugaaugcugcua

SEQ ID NO: 3633720 - RNA, 19 nt, Human
cuucugaaugcugcuacuu

SEQ ID NO: 3633721 - RNA, 20 nt, Human
cuucugaaugugcugaucau

SEQ ID NO: 3633722 - RNA, 21 nt, Human
cuucugaaugugcugaucauu

SEQ ID NO: 3633723 - RNA, 16 nt, Human
cuucugacaaacugug

SEQ ID NO: 3633724 - RNA, 17 nt, Human
cuucugaccacacuucc

SEQ ID NO: 3633725 - RNA, 19 nt, Human
cuucugaccacacuuccug

SEQ ID NO: 3633726 - RNA, 21 nt, Human
cuucugaccacagcaucauuu

SEQ ID NO: 3633727 - RNA, 15 nt, Human
cuucugacccaugcu

SEQ ID NO: 3633728 - RNA, 16 nt, Human
cuucugacccaugcug

SEQ ID NO: 3633729 - RNA, 17 nt, Human
cuucugacccaugcugc

SEQ ID NO: 3633730 - RNA, 22 nt, Human
cuucugacgugccuuuugcacc

SEQ ID NO: 3633731 - RNA, 16 nt, Human
cuucugacucuucccc

SEQ ID NO: 3633732 - RNA, 23 nt, Human
cuucugagcacuguuuauacacu

SEQ ID NO: 3633733 - RNA, 20 nt, Human
cuucugagcagcgagccugc

SEQ ID NO: 3633734 - RNA, 21 nt, Human
cuucugagcagcgagccugcu

SEQ ID NO: 3633735 - RNA, 16 nt, Human
cuucugagcuauuuca

SEQ ID NO: 3633736 - RNA, 17 nt, Human
cuucugagcuauuucau

SEQ ID NO: 3633737 - RNA, 14 nt, Human
cuucugagcuccug

SEQ ID NO: 3633738 - RNA, 15 nt, Human
cuucugagcuccugu

SEQ ID NO: 3633739 - RNA, 19 nt, Human
cuucugagcuccugucccc

SEQ ID NO: 3633740 - RNA, 22 nt, Human
cuucugagcuccuguccccugc

SEQ ID NO: 3633741 - RNA, 17 nt, Human
cuucugagcuggccucu

SEQ ID NO: 3633742 - RNA, 18 nt, Human
cuucugaugaaucuugcg

SEQ ID NO: 3633743 - RNA, 19 nt, Human
cuucugcaauugcuuagga

SEQ ID NO: 3633744 - RNA, 13 nt, Human
cuucugcacccuc

SEQ ID NO: 3633745 - RNA, 15 nt, Human
cuucugcacccucca

SEQ ID NO: 3633746 - RNA, 18 nt, Human
cuucugcacccuccaccc

SEQ ID NO: 3633747 - RNA, 16 nt, Human
cuucugcaccuuaucu

SEQ ID NO: 3633748 - RNA, 18 nt, Human
cuucugcaccuuaucuua

SEQ ID NO: 3633749 - RNA, 11 nt, Human
cuucugccacu

SEQ ID NO: 3633750 - RNA, 17 nt, Human
cuucugcccccugcaga

SEQ ID NO: 3633751 - RNA, 18 nt, Human
cuucugcccucccuggag

SEQ ID NO: 3633752 - RNA, 15 nt, Human
cuucugcccuugcca

SEQ ID NO: 3633753 - RNA, 17 nt, Human
cuucugccggcccuggg

SEQ ID NO: 3633754 - RNA, 18 nt, Human
cuucugccggcccugggg

SEQ ID NO: 3633755 - RNA, 15 nt, Human
cuucugccugagcuu

SEQ ID NO: 3633756 - RNA, 14 nt, Human
cuucugccuggaga

SEQ ID NO: 3633757 - RNA, 16 nt, Human
cuucugccuggagacu

SEQ ID NO: 3633758 - RNA, 13 nt, Human
cuucugccuuuuc

SEQ ID NO: 3633759 - RNA, 15 nt, Human
cuucugcucagcucu

SEQ ID NO: 3633760 - RNA, 21 nt, Human
cuucugcuccacccuuggccu

SEQ ID NO: 3633761 - RNA, 17 nt, Human
cuucugcuggauaaaau

SEQ ID NO: 3633762 - RNA, 13 nt, Human
cuucugcuggggc

SEQ ID NO: 3633763 - RNA, 16 nt, Human
cuucugcuucagccuc

SEQ ID NO: 3633764 - RNA, 22 nt, Human
cuucugcuuuguugugugccuc

SEQ ID NO: 3633765 - RNA, 18 nt, Human
cuucugcuuuucugcccu

SEQ ID NO: 3633766 - RNA, 16 nt, Human
cuugaugguuuauguu

SEQ ID NO: 3633767 - RNA, 13 nt, Human
cuugauguaaaau

SEQ ID NO: 3633768 - RNA, 21 nt, Human
cuugauguaaaaucuugucau

SEQ ID NO: 3633769 - RNA, 22 nt, Human
cuugauguaaaaucuugucaug

SEQ ID NO: 3633770 - RNA, 23 nt, Human
cuugauguaaaaucuugucaugu

SEQ ID NO: 3633771 - RNA, 20 nt, Human
cuugaugucuuuguuaagac

SEQ ID NO: 3633772 - RNA, 15 nt, Human
cuugaugugccauuu

SEQ ID NO: 3633773 - RNA, 12 nt, Human
cuugauguguua

SEQ ID NO: 3633774 - RNA, 20 nt, Human
cuugauuaagaucucagugg

SEQ ID NO: 3633775 - RNA, 15 nt, Human
cuugauuaagauuuu

SEQ ID NO: 3633776 - RNA, 20 nt, Human
cuugauuaagauuuuacaaa

SEQ ID NO: 3633777 - RNA, 21 nt, Human
cuugauuaagauuuuacaaaa

SEQ ID NO: 3633778 - RNA, 16 nt, Human
cuugauuauccauauu

SEQ ID NO: 3633779 - RNA, 22 nt, Human
cuugauucguagauuuaauaac

SEQ ID NO: 3633780 - RNA, 21 nt, Human
cuugauucugcaguaaaucuu

SEQ ID NO: 3633781 - RNA, 18 nt, Human
cuugauuuaaacacacag

SEQ ID NO: 3633782 - RNA, 22 nt, Human
cuugauuuaucacacaaagcag

SEQ ID NO: 3633783 - RNA, 18 nt, Human
cuugauuuauuugcuucu

SEQ ID NO: 3633784 - RNA, 19 nt, Human
cuugauuucaaaguuuugu

SEQ ID NO: 3633785 - RNA, 21 nt, Human
cuugauuuguuuuagaaugau

SEQ ID NO: 3633786 - RNA, 19 nt, Human
cuugauuuuagccuucucu

SEQ ID NO: 3633787 - RNA, 20 nt, Human
cuugauuuuagccuucucug

SEQ ID NO: 3633788 - RNA, 14 nt, Human
cuugauuuuccauc

SEQ ID NO: 3633789 - RNA, 22 nt, Human
cuugauuuuccaucuaaaaaua

SEQ ID NO: 3633790 - RNA, 14 nt, Human
cuugauuuugcaaa

SEQ ID NO: 3633791 - RNA, 16 nt, Human
cuugcaaaaucaguuu

SEQ ID NO: 3633792 - RNA, 17 nt, Human
cuugcaaaaucaguuuu

SEQ ID NO: 3633793 - RNA, 14 nt, Human
cuugcaagaaucag

SEQ ID NO: 3633794 - RNA, 16 nt, Human
cuugcaagcaugcuug

SEQ ID NO: 3633795 - RNA, 18 nt, Human
cuugcaagcaugcuugug

SEQ ID NO: 3633796 - RNA, 14 nt, Human
cuugcaauggcagc

SEQ ID NO: 3633797 - RNA, 16 nt, Human
cuugcaauggcagccu

SEQ ID NO: 3633798 - RNA, 17 nt, Human
cuugcaauuucuaccua

SEQ ID NO: 3633799 - RNA, 18 nt, Human
cuugcacacaucaucugu

SEQ ID NO: 3633800 - RNA, 23 nt, Human
cuugcacagucacugcucuucag

SEQ ID NO: 3633801 - RNA, 12 nt, Human
cuugcacauuug

SEQ ID NO: 3633802 - RNA, 15 nt, Human
cuugcaccaaauuau

SEQ ID NO: 3633803 - RNA, 14 nt, Human
cuugcaccccucac

SEQ ID NO: 3633804 - RNA, 16 nt, Human
cuugcaccucugaccu

SEQ ID NO: 3633805 - RNA, 20 nt, Human
cuugcacgaccgccccaguu

SEQ ID NO: 3633806 - RNA, 22 nt, Human
cuugcacgcgcccuuucuacca

SEQ ID NO: 3633807 - RNA, 17 nt, Human
cuugcacucucuuggcu

SEQ ID NO: 3633808 - RNA, 18 nt, Human
cuugcacucucuuggcug

SEQ ID NO: 3633809 - RNA, 13 nt, Human
cuugcagaacugc

SEQ ID NO: 3633810 - RNA, 12 nt, Human
cuugcagaagcu

SEQ ID NO: 3633811 - RNA, 20 nt, Human
cuugcagacucuacagaggc

SEQ ID NO: 3633812 - RNA, 13 nt, Human
cuugcagagaagc

SEQ ID NO: 3633813 - RNA, 23 nt, Human
cuugcagcacucacacaggaccc

SEQ ID NO: 3633814 - RNA, 12 nt, Human
cuugcagcagga

SEQ ID NO: 3633815 - RNA, 14 nt, Human
cuugcaguucuuga

SEQ ID NO: 3633816 - RNA, 20 nt, Human
cuugcauccuuccuauaacu

SEQ ID NO: 3633817 - RNA, 20 nt, Human
cuugcaucguggagacaggg

SEQ ID NO: 3633818 - RNA, 13 nt, Human
cuugcaugaggcu

SEQ ID NO: 3633819 - RNA, 21 nt, Human
cuugcaugaggcuaguguggu

SEQ ID NO: 3633820 - RNA, 19 nt, Human
cuugcaugguuuggagcug

SEQ ID NO: 3633821 - RNA, 13 nt, Human
cuugcauguaacg

SEQ ID NO: 3633822 - RNA, 12 nt, Human
cuugcauguggu

SEQ ID NO: 3633823 - RNA, 16 nt, Human
cuugcauucccagugg

SEQ ID NO: 3633824 - RNA, 11 nt, Human
cuugcauugac

SEQ ID NO: 3633825 - RNA, 22 nt, Human
cuugcauuucacuugaguggag

SEQ ID NO: 3633826 - RNA, 21 nt, Human
cuugcauuuuugcaggagcag

SEQ ID NO: 3633827 - RNA, 17 nt, Human
cuugccaaauauaaaua

SEQ ID NO: 3633828 - RNA, 20 nt, Human
cuugccaaccuguaauaaau

SEQ ID NO: 3633829 - RNA, 23 nt, Human
cuugccaaccuguaauaaauaug

SEQ ID NO: 3633830 - RNA, 19 nt, Human
cuugccaaggcagaggccu

SEQ ID NO: 3633831 - RNA, 22 nt, Human
cuugccaaugaggucugaaaug

SEQ ID NO: 3633832 - RNA, 13 nt, Human
cuugccacacucu

SEQ ID NO: 3633833 - RNA, 15 nt, Human
cuugccacugcacuc

SEQ ID NO: 3633834 - RNA, 13 nt, Human
cuugccacugccu

SEQ ID NO: 3633835 - RNA, 15 nt, Human
cuugccacugccucu

SEQ ID NO: 3633836 - RNA, 17 nt, Human
cuugccacuuugcacga

SEQ ID NO: 3633837 - RNA, 21 nt, Human
cuugccagaaccaaauuaacu

SEQ ID NO: 3633838 - RNA, 20 nt, Human
cuugccagaaguuguggauu

SEQ ID NO: 3633839 - RNA, 16 nt, Human
cuugccagacaugugg

SEQ ID NO: 3633840 - RNA, 11 nt, Human
cuugccagaga

SEQ ID NO: 3633841 - RNA, 20 nt, Human
cuugccagagccgggcacau

SEQ ID NO: 3633842 - RNA, 21 nt, Human
cuugccagcugcugagccgca

SEQ ID NO: 3633843 - RNA, 19 nt, Human
cuugccaucccucccucca

SEQ ID NO: 3633844 - RNA, 21 nt, Human
cuugccaugugacucuggcuu

SEQ ID NO: 3633845 - RNA, 14 nt, Human
cuugcccacaccga

SEQ ID NO: 3633846 - RNA, 15 nt, Human
cuugcccacuccugc

SEQ ID NO: 3633847 - RNA, 22 nt, Human
cuugcccacuccugcucugcuc

SEQ ID NO: 3633848 - RNA, 13 nt, Human
cuugcccagagau

SEQ ID NO: 3633849 - RNA, 21 nt, Human
cuugcccagagaugccuccac

SEQ ID NO: 3633850 - RNA, 13 nt, Human
cuugcccagccug

SEQ ID NO: 3633851 - RNA, 13 nt, Human
cuugcccagggcu

SEQ ID NO: 3633852 - RNA, 14 nt, Human
cuugcccagggcuc

SEQ ID NO: 3633853 - RNA, 20 nt, Human
cuugcccagggcucagccug

SEQ ID NO: 3633854 - RNA, 23 nt, Human
cuugcccagggcucagccuggug

SEQ ID NO: 3633855 - RNA, 14 nt, Human
cuugcccaguuuca

SEQ ID NO: 3633856 - RNA, 18 nt, Human
cuugcccauccugacuga

SEQ ID NO: 3633857 - RNA, 21 nt, Human
cuugcccaugcugggcucccg

SEQ ID NO: 3633858 - RNA, 13 nt, Human
cuugccccaaccc

SEQ ID NO: 3633859 - RNA, 20 nt, Human
cuugccccaacccccagcac

SEQ ID NO: 3633860 - RNA, 16 nt, Human
cuugccccaacccuuc

SEQ ID NO: 3633861 - RNA, 18 nt, Human
cuugccccaacccuucuu

SEQ ID NO: 3633862 - RNA, 13 nt, Human
cuugccccccacc

SEQ ID NO: 3633863 - RNA, 16 nt, Human
cuugccccccacccca

SEQ ID NO: 3633864 - RNA, 21 nt, Human
cuugccccccuggccuccccc

SEQ ID NO: 3633865 - RNA, 17 nt, Human
cuugcccgcucaggcug

SEQ ID NO: 3633866 - RNA, 18 nt, Human
cuugcccggauucuggga

SEQ ID NO: 3633867 - RNA, 16 nt, Human
cuugcccuaagcagaa

SEQ ID NO: 3633868 - RNA, 17 nt, Human
cuugcccugaccuccca

SEQ ID NO: 3633869 - RNA, 12 nt, Human
cuugcccugcuc

SEQ ID NO: 3633870 - RNA, 15 nt, Human
cuugcccugcucccu

SEQ ID NO: 3633871 - RNA, 18 nt, Human
cuugcccuggugccucac

SEQ ID NO: 3633872 - RNA, 22 nt, Human
cuugcccuguuaaaagaugaaa

SEQ ID NO: 3633873 - RNA, 14 nt, Human
cuugcccuucccug

SEQ ID NO: 3633874 - RNA, 16 nt, Human
cuugcccuucccuguc

SEQ ID NO: 3633875 - RNA, 17 nt, Human
cuugcccuugcccugac

SEQ ID NO: 3633876 - RNA, 20 nt, Human
cuugccgaaacuggaaguua

SEQ ID NO: 3633877 - RNA, 23 nt, Human
cuugccgaaccaggagcugcuca

SEQ ID NO: 3633878 - RNA, 15 nt, Human
cuugccgaggagcca

SEQ ID NO: 3633879 - RNA, 20 nt, Human
cuugccgaggagccaggcaa

SEQ ID NO: 3633880 - RNA, 21 nt, Human
cuugccuaaauuuaaugcugc

SEQ ID NO: 3633881 - RNA, 22 nt, Human
cuugccuaaauuuaaugcugcc

SEQ ID NO: 3633882 - RNA, 23 nt, Human
cuugccuaaauuuaaugcugccu

SEQ ID NO: 3633883 - RNA, 15 nt, Human
cuugccucaaugcca

SEQ ID NO: 3633884 - RNA, 23 nt, Human
cuugccucauuuuuuuccuugca

SEQ ID NO: 3633885 - RNA, 20 nt, Human
cuugccuccccauuucccau

SEQ ID NO: 3633886 - RNA, 17 nt, Human
cuugccucggcuccugc

SEQ ID NO: 3633887 - RNA, 19 nt, Human
cuugccucuguccccuucu

SEQ ID NO: 3633888 - RNA, 13 nt, Human
cuugccucuuccu

SEQ ID NO: 3633889 - RNA, 18 nt, Human
cuugccucuuccuugaag

SEQ ID NO: 3633890 - RNA, 21 nt, Human
cuugccucuuuuaccugcugc

SEQ ID NO: 3633891 - RNA, 17 nt, Human
cuugccugaacauccuu

SEQ ID NO: 3633892 - RNA, 14 nt, Human
cuugccugcagggc

SEQ ID NO: 3633893 - RNA, 16 nt, Human
cuugccugcagggcca

SEQ ID NO: 3633894 - RNA, 20 nt, Human
cuugccugcagggccauggc

SEQ ID NO: 3633895 - RNA, 13 nt, Human
cuugccugccuuu

SEQ ID NO: 3633896 - RNA, 10 nt, Human
cuugccuggg

SEQ ID NO: 3633897 - RNA, 16 nt, Human
cuugccugggucacac

SEQ ID NO: 3633898 - RNA, 15 nt, Human
cuugccugugccagg

SEQ ID NO: 3633899 - RNA, 16 nt, Human
cuugccugugccaggu

SEQ ID NO: 3633900 - RNA, 22 nt, Human
cuugccuguuucccaggcccac

SEQ ID NO: 3633901 - RNA, 23 nt, Human
cuugccuuaaacacucaccuucu

SEQ ID NO: 3633902 - RNA, 23 nt, Human
cuugccuuccuaagccuguggcu

SEQ ID NO: 3633903 - RNA, 20 nt, Human
cuugccuucuucacccagcu

SEQ ID NO: 3633904 - RNA, 20 nt, Human
cuugccuuucgaggccugaa

SEQ ID NO: 3633905 - RNA, 20 nt, Human
cuugccuuuuucauuauuuu

SEQ ID NO: 3633906 - RNA, 23 nt, Human
cuugccuuuuucauuauuuuauu

SEQ ID NO: 3633907 - RNA, 19 nt, Human
cuugcgaacuagagaugug

SEQ ID NO: 3633908 - RNA, 22 nt, Human
cuugcgguauccgcccccaaua

SEQ ID NO: 3633909 - RNA, 17 nt, Human
cuugcuaaucagugucu

SEQ ID NO: 3633910 - RNA, 19 nt, Human
gaaaacguggcugcuucaa

SEQ ID NO: 3633911 - RNA, 17 nt, Human
gaaaacguuuuguuuga

SEQ ID NO: 3633912 - RNA, 20 nt, Human
gaaaacuacauuuuaacaug

SEQ ID NO: 3633913 - RNA, 13 nt, Human
gaaaacuauacaa

SEQ ID NO: 3633914 - RNA, 17 nt, Human
gaaaacucauuacuuuu

SEQ ID NO: 3633915 - RNA, 20 nt, Human
gaaaacuccuuuagcaggug

SEQ ID NO: 3633916 - RNA, 18 nt, Human
gaaaacugaaaaucuaau

SEQ ID NO: 3633917 - RNA, 15 nt, Human
gaaaacugugauuuc

SEQ ID NO: 3633918 - RNA, 12 nt, Human
gaaaacuguguu

SEQ ID NO: 3633919 - RNA, 13 nt, Human
gaaaacuguguug

SEQ ID NO: 3633920 - RNA, 19 nt, Human
gaaaacuguguugccacag

SEQ ID NO: 3633921 - RNA, 23 nt, Human
gaaaacuguuaccuaaaguauuu

SEQ ID NO: 3633922 - RNA, 16 nt, Human
gaaaacuuauuugagu

SEQ ID NO: 3633923 - RNA, 16 nt, Human
gaaaacuucuuuuaaa

SEQ ID NO: 3633924 - RNA, 20 nt, Human
gaaaacuuuaaaaaauauuu

SEQ ID NO: 3633925 - RNA, 22 nt, Human
gaaaacuuuaaaaaauauuuau

SEQ ID NO: 3633926 - RNA, 21 nt, Human
gaaaacuuuaugcuaagugaa

SEQ ID NO: 3633927 - RNA, 11 nt, Human
gaaaacuuugu

SEQ ID NO: 3633928 - RNA, 16 nt, Human
gaaaacuuuguuaggc

SEQ ID NO: 3633929 - RNA, 23 nt, Human
gaaaagaaaaaaaaaagaagaag

SEQ ID NO: 3633930 - RNA, 15 nt, Human
gaaaagaaaacaaaa

SEQ ID NO: 3633931 - RNA, 16 nt, Human
gaaaagaaaacaaaaa

SEQ ID NO: 3633932 - RNA, 15 nt, Human
gaaaagaaagaaguu

SEQ ID NO: 3633933 - RNA, 15 nt, Human
gaaaagaaauaauaa

SEQ ID NO: 3633934 - RNA, 13 nt, Human
gaaaagaaaucua

SEQ ID NO: 3633935 - RNA, 23 nt, Human
gaaaagaaaucuauagaaagugu

SEQ ID NO: 3633936 - RNA, 24 nt, Human
gaaaagaaaucuauagaaaguguu

SEQ ID NO: 3633937 - RNA, 19 nt, Human
gaaaagaacguauuuuaaa

SEQ ID NO: 3633938 - RNA, 19 nt, Human
gaaaagaacuguuuacugc

SEQ ID NO: 3633939 - RNA, 15 nt, Human
gaaaagaaggaaaga

SEQ ID NO: 3633940 - RNA, 14 nt, Human
gaaaagaauuuuuu

SEQ ID NO: 3633941 - RNA, 21 nt, Human
gaaaagacacauuuuuuagga

SEQ ID NO: 3633942 - RNA, 17 nt, Human
gaaaagacuaagaucgg

SEQ ID NO: 3633943 - RNA, 18 nt, Human
gaaaagacuuguaauauu

SEQ ID NO: 3633944 - RNA, 21 nt, Human
gaaaagagauauuuuaaaaug

SEQ ID NO: 3633945 - RNA, 14 nt, Human
gaaaagauguagau

SEQ ID NO: 3633946 - RNA, 17 nt, Human
gaaaagauguagauuua

SEQ ID NO: 3633947 - RNA, 18 nt, Human
gaaaagauguagauuuau

SEQ ID NO: 3633948 - RNA, 15 nt, Human
gaaaagauucuucug

SEQ ID NO: 3633949 - RNA, 20 nt, Human
gaaaagcaacauucauaguc

SEQ ID NO: 3633950 - RNA, 14 nt, Human
gaaaagcaccugcc

SEQ ID NO: 3633951 - RNA, 19 nt, Human
gaaaagcauacaugcaaaa

SEQ ID NO: 3633952 - RNA, 17 nt, Human
gaaaagccauguuuaag

SEQ ID NO: 3633953 - RNA, 20 nt, Human
gaaaagccauguuuaagauu

SEQ ID NO: 3633954 - RNA, 15 nt, Human
gaaaagccucugugu

SEQ ID NO: 3633955 - RNA, 24 nt, Human
gaaaagcuaguguaccuccucuca

SEQ ID NO: 3633956 - RNA, 20 nt, Human
gaaaagcuauuagccaggau

SEQ ID NO: 3633957 - RNA, 22 nt, Human
gaaaagcuauuagccaggauca

SEQ ID NO: 3633958 - RNA, 17 nt, Human
gaaaagcugcugacagu

SEQ ID NO: 3633959 - RNA, 15 nt, Human
gaaaaggaagacuag

SEQ ID NO: 3633960 - RNA, 20 nt, Human
gaaaaggaagacuagaggcu

SEQ ID NO: 3633961 - RNA, 19 nt, Human
gaaaaggaagguaguucaa

SEQ ID NO: 3633962 - RNA, 12 nt, Human
gaaaaggaauca

SEQ ID NO: 3633963 - RNA, 12 nt, Human
gaaaaggcaaaa

SEQ ID NO: 3633964 - RNA, 16 nt, Human
gaaaaggccuggggug

SEQ ID NO: 3633965 - RNA, 22 nt, Human
gaaaagggaguuuaaaaauggu

SEQ ID NO: 3633966 - RNA, 18 nt, Human
gaaaaggugauaaaauca

SEQ ID NO: 3633967 - RNA, 19 nt, Human
gaaaaggugauaaaaucau

SEQ ID NO: 3633968 - RNA, 16 nt, Human
gaaaagguugaauaau

SEQ ID NO: 3633969 - RNA, 16 nt, Human
gaaaaguacauuuaau

SEQ ID NO: 3633970 - RNA, 14 nt, Human
gaaaaguauguuag

SEQ ID NO: 3633971 - RNA, 19 nt, Human
gaaaaguauguucuaaccu

SEQ ID NO: 3633972 - RNA, 12 nt, Human
gaaaaguauuuu

SEQ ID NO: 3633973 - RNA, 18 nt, Human
gaaaaguauuuugaaguu

SEQ ID NO: 3633974 - RNA, 23 nt, Human
gaaaaguauuuugaaguuuacau

SEQ ID NO: 3633975 - RNA, 18 nt, Human
gaaaagucacuuacuauu

SEQ ID NO: 3633976 - RNA, 16 nt, Human
gaaaagugaaugcuca

SEQ ID NO: 3633977 - RNA, 23 nt, Human
gaaaaguggcgugggagccagcc

SEQ ID NO: 3633978 - RNA, 10 nt, Human
gaaaaguuau

SEQ ID NO: 3633979 - RNA, 15 nt, Human
gaaaaguugaauuuu

SEQ ID NO: 3633980 - RNA, 15 nt, Human
gaaaaguuuaauauu

SEQ ID NO: 3633981 - RNA, 21 nt, Human
gaaaaguuuaauauuaaagcc

SEQ ID NO: 3633982 - RNA, 13 nt, Human
gaaaaguuuauaa

SEQ ID NO: 3633983 - RNA, 19 nt, Human
gaaaaguuuuguaaauuuc

SEQ ID NO: 3633984 - RNA, 11 nt, Human
gaaaauaaaaa

SEQ ID NO: 3633985 - RNA, 16 nt, Human
gaaaauaaaaaaaaga

SEQ ID NO: 3633986 - RNA, 21 nt, Human
gaaaauaaaaaaaagaaaaaa

SEQ ID NO: 3633987 - RNA, 22 nt, Human
gaaaauaaaaaaaagaaaaaag

SEQ ID NO: 3633988 - RNA, 12 nt, Human
gaaaauaaaaag

SEQ ID NO: 3633989 - RNA, 13 nt, Human
gaaaauaaaauua

SEQ ID NO: 3633990 - RNA, 13 nt, Human
gaaaauaaagaau

SEQ ID NO: 3633991 - RNA, 15 nt, Human
gaaaauaaagaaugg

SEQ ID NO: 3633992 - RNA, 16 nt, Human
gaaaauaaagaaugga

SEQ ID NO: 3633993 - RNA, 20 nt, Human
gaaaauaaagacaaccauau

SEQ ID NO: 3633994 - RNA, 22 nt, Human
gaaaauaaagacaaccauauuu

SEQ ID NO: 3633995 - RNA, 23 nt, Human
gaaaauaaagacaaccauauuua

SEQ ID NO: 3633996 - RNA, 23 nt, Human
gaaaauaaaucaaugcuauaacu

SEQ ID NO: 3633997 - RNA, 19 nt, Human
gaaaauaacaauaaaagac

SEQ ID NO: 3633998 - RNA, 13 nt, Human
gaaaauaacugaa

SEQ ID NO: 3633999 - RNA, 21 nt, Human
gaaaauaaggcacccaucugu

SEQ ID NO: 3634000 - RNA, 19 nt, Human
gaaaauaauguaauuguaa

SEQ ID NO: 3634001 - RNA, 13 nt, Human
gaaaauaauuguu

SEQ ID NO: 3634002 - RNA, 17 nt, Human
gaaaauaauuguuccaa

SEQ ID NO: 3634003 - RNA, 13 nt, Human
gaaaauacaauaa

SEQ ID NO: 3634004 - RNA, 15 nt, Human
gaaaauacaauaaac

SEQ ID NO: 3634005 - RNA, 16 nt, Human
gaaaauacaauaaacu

SEQ ID NO: 3634006 - RNA, 19 nt, Human
gaaaauaggcaggaagccc

SEQ ID NO: 3634007 - RNA, 13 nt, Human
gaaaauaguuuau

SEQ ID NO: 3634008 - RNA, 20 nt, Human
gaaaauaguuuauuuuaaaa

SEQ ID NO: 3634009 - RNA, 12 nt, Human
gaaaauauacug

SEQ ID NO: 3634010 - RNA, 14 nt, Human
gaaaauauacugua

SEQ ID NO: 3634011 - RNA, 15 nt, Human
gaaaauauacuguaa

SEQ ID NO: 3634012 - RNA, 18 nt, Human
gaaaauauacuguaaaga

SEQ ID NO: 3634013 - RNA, 20 nt, Human
gaaaauauacuguaaagaaa

SEQ ID NO: 3634014 - RNA, 21 nt, Human
gaaaauauacuguaaagaaag

SEQ ID NO: 3634015 - RNA, 23 nt, Human
gaaaauauacuguaaagaaagag

SEQ ID NO: 3634016 - RNA, 15 nt, Human
gaaaauauauguauu

SEQ ID NO: 3634017 - RNA, 17 nt, Human
gaaaauauauguauuuu

SEQ ID NO: 3634018 - RNA, 20 nt, Human
gaaaauauauguauuuuuau

SEQ ID NO: 3634019 - RNA, 12 nt, Human
gaaaauaucacu

SEQ ID NO: 3634020 - RNA, 15 nt, Human
gaaaauaugcaucua

SEQ ID NO: 3634021 - RNA, 19 nt, Human
gaaaauauguauuaacacu

SEQ ID NO: 3634022 - RNA, 23 nt, Human
gaaaauauguccauaucuaacca

SEQ ID NO: 3634023 - RNA, 21 nt, Human
gaaaauauuaucuuuguaauu

SEQ ID NO: 3634024 - RNA, 19 nt, Human
gaaaauauucucuauuuga

SEQ ID NO: 3634025 - RNA, 15 nt, Human
gaaaauauuguuuua

SEQ ID NO: 3634026 - RNA, 18 nt, Human
gaaaauauuuugucuaaa

SEQ ID NO: 3634027 - RNA, 20 nt, Human
gaaaauauuuugucuaaaau

SEQ ID NO: 3634028 - RNA, 19 nt, Human
gaaaaucaaauacauacuu

SEQ ID NO: 3634029 - RNA, 22 nt, Human
gaaaaucagccugcuccagcug

SEQ ID NO: 3634030 - RNA, 13 nt, Human
gaaaauccuacca

SEQ ID NO: 3634031 - RNA, 15 nt, Human
gaaaauccucuggcu

SEQ ID NO: 3634032 - RNA, 14 nt, Human
gaaaaucuaauauu

SEQ ID NO: 3634033 - RNA, 23 nt, Human
gaaaaucuaauauuaaaaauaug

SEQ ID NO: 3634034 - RNA, 21 nt, Human
gaaaaucuagaggaaaagaaa

SEQ ID NO: 3634035 - RNA, 22 nt, Human
gaaaaucuagaggaaaagaaag

SEQ ID NO: 3634036 - RNA, 17 nt, Human
gaaaaucugaauuggaa

SEQ ID NO: 3634037 - RNA, 19 nt, Human
gaaaaucuuauaauuuaaa

SEQ ID NO: 3634038 - RNA, 14 nt, Human
gaaaaugaaaugca

SEQ ID NO: 3634039 - RNA, 17 nt, Human
gaaaaugaaaugcauau

SEQ ID NO: 3634040 - RNA, 18 nt, Human
gaaaaugaaaugcauauu

SEQ ID NO: 3634041 - RNA, 22 nt, Human
gaaaaugcagcagggaugcccu

SEQ ID NO: 3634042 - RNA, 21 nt, Human
gaaaaugcauuguaucgaugu

SEQ ID NO: 3634043 - RNA, 11 nt, Human
gaaaaugcuga

SEQ ID NO: 3634044 - RNA, 19 nt, Human
gaaaauggaaguggcaaua

SEQ ID NO: 3634045 - RNA, 23 nt, Human
gaaaaugguccaauuaguuuccu

SEQ ID NO: 3634046 - RNA, 18 nt, Human
gaaaauguaagcuguuua

SEQ ID NO: 3634047 - RNA, 19 nt, Human
gaaaauguacugagauuuu

SEQ ID NO: 3634048 - RNA, 15 nt, Human
gaaaauguccaggaa

SEQ ID NO: 3634049 - RNA, 17 nt, Human
gaaaauguccuugugau

SEQ ID NO: 3634050 - RNA, 19 nt, Human
gaaaauguguccuaucuau

SEQ ID NO: 3634051 - RNA, 12 nt, Human
gaaaaugugugu

SEQ ID NO: 3634052 - RNA, 15 nt, Human
gaaaauguuauuuaa

SEQ ID NO: 3634053 - RNA, 16 nt, Human
gaaaauguuauuuaac

SEQ ID NO: 3634054 - RNA, 16 nt, Human
gaaagugccuuucagg

SEQ ID NO: 3634055 - RNA, 16 nt, Human
gaaaguggugcucagu

SEQ ID NO: 3634056 - RNA, 11 nt, Human
gaaaguguauu

SEQ ID NO: 3634057 - RNA, 23 nt, Human
gaaaguguuauuuuucaaggaag

SEQ ID NO: 3634058 - RNA, 14 nt, Human
gaaaguguucuguu

SEQ ID NO: 3634059 - RNA, 16 nt, Human
gaaaguguucuguuac

SEQ ID NO: 3634060 - RNA, 17 nt, Human
gaaaguuacaaauugcu

SEQ ID NO: 3634061 - RNA, 17 nt, Human
gaaaguuccuuauguau

SEQ ID NO: 3634062 - RNA, 18 nt, Human
gaaaguuguacaugaaau

SEQ ID NO: 3634063 - RNA, 20 nt, Human
gaaaguuuacccaugaagau

SEQ ID NO: 3634064 - RNA, 11 nt, Human
gaaaguuuccc

SEQ ID NO: 3634065 - RNA, 20 nt, Human
gaaaguuuccccaccaguga

SEQ ID NO: 3634066 - RNA, 18 nt, Human
gaaaguuuuguaaaagaa

SEQ ID NO: 3634067 - RNA, 20 nt, Human
gaaaguuuuguaaaagaaau

SEQ ID NO: 3634068 - RNA, 18 nt, Human
gaaaguuuuuuuuuauua

SEQ ID NO: 3634069 - RNA, 15 nt, Human
gaaauaaaaccuuuc

SEQ ID NO: 3634070 - RNA, 16 nt, Human
gaaauaaaaggaagcc

SEQ ID NO: 3634071 - RNA, 17 nt, Human
gaaauaaaaggaagcca

SEQ ID NO: 3634072 - RNA, 19 nt, Human
gaaauaaaccaaaggaaaa

SEQ ID NO: 3634073 - RNA, 16 nt, Human
gaaauaaacgucuuaa

SEQ ID NO: 3634074 - RNA, 17 nt, Human
gaaauaaacuucacuga

SEQ ID NO: 3634075 - RNA, 17 nt, Human
gaaauaaauagcuauau

SEQ ID NO: 3634076 - RNA, 12 nt, Human
gaaauaaaugua

SEQ ID NO: 3634077 - RNA, 15 nt, Human
gaaauaacaaaaugg

SEQ ID NO: 3634078 - RNA, 18 nt, Human
gaaauaacaaaauggaca

SEQ ID NO: 3634079 - RNA, 19 nt, Human
gaaauaacaaaauggacau

SEQ ID NO: 3634080 - RNA, 18 nt, Human
gaaauaacaagucgauga

SEQ ID NO: 3634081 - RNA, 15 nt, Human
gaaauaacaauguua

SEQ ID NO: 3634082 - RNA, 20 nt, Human
gaaauaacagaagaaaauag

SEQ ID NO: 3634083 - RNA, 14 nt, Human
gaaauaagaaaaau

SEQ ID NO: 3634084 - RNA, 21 nt, Human
gaaauaaguuuuuguuucaca

SEQ ID NO: 3634085 - RNA, 15 nt, Human
gaaauaauaaaaaau

SEQ ID NO: 3634086 - RNA, 16 nt, Human
gaaauaauaauaucca

SEQ ID NO: 3634087 - RNA, 13 nt, Human
gaaauaauaugca

SEQ ID NO: 3634088 - RNA, 15 nt, Human
gaaauaauaugcauu

SEQ ID NO: 3634089 - RNA, 19 nt, Human
gaaauaauguacaucuggc

SEQ ID NO: 3634090 - RNA, 22 nt, Human
gaaauaauguguaguucaugua

SEQ ID NO: 3634091 - RNA, 13 nt, Human
gaaauaauuguug

SEQ ID NO: 3634092 - RNA, 21 nt, Human
gaaauaauuguuguucuguua

SEQ ID NO: 3634093 - RNA, 22 nt, Human
gaaauaauuguuguucuguuaa

SEQ ID NO: 3634094 - RNA, 13 nt, Human
gaaauacaaaaau

SEQ ID NO: 3634095 - RNA, 18 nt, Human
gaaauacacaaguaaaca

SEQ ID NO: 3634096 - RNA, 17 nt, Human
gaaauacagauuuugau

SEQ ID NO: 3634097 - RNA, 19 nt, Human
gaaauacaguucugcucug

SEQ ID NO: 3634098 - RNA, 22 nt, Human
gaaauacccuucuuuuaugagc

SEQ ID NO: 3634099 - RNA, 12 nt, Human
gaaauaccucau

SEQ ID NO: 3634100 - RNA, 19 nt, Human
gaaauacgccagaacugcu

SEQ ID NO: 3634101 - RNA, 16 nt, Human
gaaauacuacuuacca

SEQ ID NO: 3634102 - RNA, 15 nt, Human
gaaauacuauuuaaa

SEQ ID NO: 3634103 - RNA, 21 nt, Human
gaaauacuguaugguuuuguu

SEQ ID NO: 3634104 - RNA, 16 nt, Human
gaaauagaauuauaac

SEQ ID NO: 3634105 - RNA, 21 nt, Human
gaaauagacaaaaaguauauu

SEQ ID NO: 3634106 - RNA, 18 nt, Human
gaaauagacaguauauuu

SEQ ID NO: 3634107 - RNA, 15 nt, Human
gaaauagucugugug

SEQ ID NO: 3634108 - RNA, 17 nt, Human
gaaauauaacacauuuu

SEQ ID NO: 3634109 - RNA, 18 nt, Human
gaaauauaacacauuuuu

SEQ ID NO: 3634110 - RNA, 15 nt, Human
gaaauauacacacag

SEQ ID NO: 3634111 - RNA, 17 nt, Human
gaaauauaggaacuuaa

SEQ ID NO: 3634112 - RNA, 16 nt, Human
gaaauauauacgaaca

SEQ ID NO: 3634113 - RNA, 18 nt, Human
gaaauauauacgaacaaa

SEQ ID NO: 3634114 - RNA, 19 nt, Human
gaaauauauacgaacaaaa

SEQ ID NO: 3634115 - RNA, 16 nt, Human
gaaauauauauacaua

SEQ ID NO: 3634116 - RNA, 14 nt, Human
gaaauauauaugug

SEQ ID NO: 3634117 - RNA, 22 nt, Human
gaaauauauauuauacuuguaa

SEQ ID NO: 3634118 - RNA, 22 nt, Human
gaaauaucaguuacucagcccu

SEQ ID NO: 3634119 - RNA, 19 nt, Human
gaaauaucugaaaauguau

SEQ ID NO: 3634120 - RNA, 15 nt, Human
gaaauaucugugaaa

SEQ ID NO: 3634121 - RNA, 19 nt, Human
gaaauaucuucacuuguca

SEQ ID NO: 3634122 - RNA, 14 nt, Human
gaaauaugauuuua

SEQ ID NO: 3634123 - RNA, 15 nt, Human
gaaauaugauuuuau

SEQ ID NO: 3634124 - RNA, 22 nt, Human
gaaauaugauuuuauuugacaa

SEQ ID NO: 3634125 - RNA, 18 nt, Human
gaaauaugcacaauagca

SEQ ID NO: 3634126 - RNA, 13 nt, Human
gaaauaugcaucu

SEQ ID NO: 3634127 - RNA, 16 nt, Human
gaaauauguauucugu

SEQ ID NO: 3634128 - RNA, 20 nt, Human
gaaauauguauucuguaaaa

SEQ ID NO: 3634129 - RNA, 14 nt, Human
gaaauaugugagau

SEQ ID NO: 3634130 - RNA, 15 nt, Human
gaaauauuaaaagaa

SEQ ID NO: 3634131 - RNA, 16 nt, Human
gaaauauuaugcaaau

SEQ ID NO: 3634132 - RNA, 17 nt, Human
gaaauauuaugcaaauu

SEQ ID NO: 3634133 - RNA, 21 nt, Human
gaaauauuaugcaaauuccca

SEQ ID NO: 3634134 - RNA, 16 nt, Human
gaaauauugcuggggu

SEQ ID NO: 3634135 - RNA, 14 nt, Human
gaaauauugcugua

SEQ ID NO: 3634136 - RNA, 18 nt, Human
gaaauauugcuguauagc

SEQ ID NO: 3634137 - RNA, 13 nt, Human
gaaauauuuuaaa

SEQ ID NO: 3634138 - RNA, 13 nt, Human
gaaauauuuuaau

SEQ ID NO: 3634139 - RNA, 23 nt, Human
gaaauauuuuaauuuuuaaaugc

SEQ ID NO: 3634140 - RNA, 21 nt, Human
gaaauauuuuuuaauuuaaag

SEQ ID NO: 3634141 - RNA, 21 nt, Human
gaaaucaaauaugcaaagcac

SEQ ID NO: 3634142 - RNA, 15 nt, Human
gaaaucaacuugcuu

SEQ ID NO: 3634143 - RNA, 16 nt, Human
gaaaucaaugcaagag

SEQ ID NO: 3634144 - RNA, 15 nt, Human
gaaaucacagaauca

SEQ ID NO: 3634145 - RNA, 19 nt, Human
gaaaucaccgaaaacgugg

SEQ ID NO: 3634146 - RNA, 15 nt, Human
gaaaucagccaaguu

SEQ ID NO: 3634147 - RNA, 18 nt, Human
gaaaucaguaauauuuau

SEQ ID NO: 3634148 - RNA, 16 nt, Human
gaaaucauauuuggaa

SEQ ID NO: 3634149 - RNA, 18 nt, Human
gaaaucaucgaaaauuca

SEQ ID NO: 3634150 - RNA, 14 nt, Human
gaaauccaaucaga

SEQ ID NO: 3634151 - RNA, 13 nt, Human
gaaauccagggug

SEQ ID NO: 3634152 - RNA, 17 nt, Human
gaaauccauccagaggc

SEQ ID NO: 3634153 - RNA, 18 nt, Human
gaaaucccccuuucucua

SEQ ID NO: 3634154 - RNA, 19 nt, Human
gaaaucccugcucacugca

SEQ ID NO: 3634155 - RNA, 15 nt, Human
gaaaucccuucauac

SEQ ID NO: 3634156 - RNA, 20 nt, Human
gaaaucccuucauacuugaa

SEQ ID NO: 3634157 - RNA, 20 nt, Human
gaaauccuaguuuccucucc

SEQ ID NO: 3634158 - RNA, 21 nt, Human
gaaaucuaguuauuuacagga

SEQ ID NO: 3634159 - RNA, 18 nt, Human
gaaaucuaugauuccagg

SEQ ID NO: 3634160 - RNA, 18 nt, Human
gaaaucucccaugugcau

SEQ ID NO: 3634161 - RNA, 14 nt, Human
gaaaucugaacauu

SEQ ID NO: 3634162 - RNA, 23 nt, Human
gaaaucugaggaauggacauuuc

SEQ ID NO: 3634163 - RNA, 20 nt, Human
gaaaucuggcuucuggccag

SEQ ID NO: 3634164 - RNA, 22 nt, Human
gaaaucuggcuucuggccagga

SEQ ID NO: 3634165 - RNA, 20 nt, Human
gaaaucugugccugagaaca

SEQ ID NO: 3634166 - RNA, 23 nt, Human
gaaaugaaaacaguguguaaaca

SEQ ID NO: 3634167 - RNA, 13 nt, Human
gaaaugaaagaaa

SEQ ID NO: 3634168 - RNA, 18 nt, Human
gaaaugaaagcagggacu

SEQ ID NO: 3634169 - RNA, 17 nt, Human
gaaaugaaauuuaaaca

SEQ ID NO: 3634170 - RNA, 19 nt, Human
gaaaugaaauuuaaacauu

SEQ ID NO: 3634171 - RNA, 15 nt, Human
gaaaugaacacaaau

SEQ ID NO: 3634172 - RNA, 17 nt, Human
gaaaugaacacaaauua

SEQ ID NO: 3634173 - RNA, 13 nt, Human
gaaaugaagagcu

SEQ ID NO: 3634174 - RNA, 13 nt, Human
gaaaugaauaauu

SEQ ID NO: 3634175 - RNA, 19 nt, Human
gaaaugaauaauuucccaa

SEQ ID NO: 3634176 - RNA, 20 nt, Human
gaaaugaaugugugugguuu

SEQ ID NO: 3634177 - RNA, 14 nt, Human
gaaaugaccaauau

SEQ ID NO: 3634178 - RNA, 13 nt, Human
gaaaugacuaauu

SEQ ID NO: 3634179 - RNA, 20 nt, Human
gaaaugagaggcauuucccc

SEQ ID NO: 3634180 - RNA, 11 nt, Human
gaaaugagcug

SEQ ID NO: 3634181 - RNA, 16 nt, Human
gaaaugaggucuguuu

SEQ ID NO: 3634182 - RNA, 21 nt, Human
gaaaugaggucuguuuaaagu

SEQ ID NO: 3634183 - RNA, 17 nt, Human
gaaaugauagauuugac

SEQ ID NO: 3634184 - RNA, 21 nt, Human
gaaaugauagauuugaccucc

SEQ ID NO: 3634185 - RNA, 11 nt, Human
gaaaugauguu

SEQ ID NO: 3634186 - RNA, 14 nt, Human
gaaaugcaaaaauc

SEQ ID NO: 3634187 - RNA, 17 nt, Human
gaaaugcaaaaaucucu

SEQ ID NO: 3634188 - RNA, 17 nt, Human
gaaaugcacaaugucuu

SEQ ID NO: 3634189 - RNA, 22 nt, Human
gaaaugcauugcucuggaucug

SEQ ID NO: 3634190 - RNA, 17 nt, Human
gaaaugccuaagaagau

SEQ ID NO: 3634191 - RNA, 21 nt, Human
gaaaugccuuacuuuguauga

SEQ ID NO: 3634192 - RNA, 22 nt, Human
gaaaugcuaugucauuucaugu

SEQ ID NO: 3634193 - RNA, 14 nt, Human
gaaaugcugaaaau

SEQ ID NO: 3634194 - RNA, 22 nt, Human
gaaaugcugauuuaaacuucuu

SEQ ID NO: 3634195 - RNA, 14 nt, Human
gaaaugcugccugc

SEQ ID NO: 3634196 - RNA, 13 nt, Human
gaaaugcugcugg

SEQ ID NO: 3634197 - RNA, 23 nt, Human
gaaaugcugguuuuucaguuuuc

SEQ ID NO: 3634198 - RNA, 22 nt, Human
gaaaugcuuguggauugagggu

SEQ ID NO: 3634199 - RNA, 15 nt, Human
gaauugauaauaaac

SEQ ID NO: 3634200 - RNA, 23 nt, Human
gaauugauaauaaacuguccucu

SEQ ID NO: 3634201 - RNA, 14 nt, Human
gaauugauuugcau

SEQ ID NO: 3634202 - RNA, 17 nt, Human
gaauugauuugcauuga

SEQ ID NO: 3634203 - RNA, 16 nt, Human
gaauugcaauuuuaac

SEQ ID NO: 3634204 - RNA, 20 nt, Human
gaauugcccauuguuuuucu

SEQ ID NO: 3634205 - RNA, 21 nt, Human
gaauugcccauuguuuuucug

SEQ ID NO: 3634206 - RNA, 21 nt, Human
gaauugccugcagagagaagc

SEQ ID NO: 3634207 - RNA, 15 nt, Human
gaauugcguuggucu

SEQ ID NO: 3634208 - RNA, 17 nt, Human
gaauugcuugaaccugg

SEQ ID NO: 3634209 - RNA, 16 nt, Human
gaauugggagcuuggg

SEQ ID NO: 3634210 - RNA, 22 nt, Human
gaauuggguggggggcuucaua

SEQ ID NO: 3634211 - RNA, 16 nt, Human
gaauuguaacuguucu

SEQ ID NO: 3634212 - RNA, 15 nt, Human
gaauuguaaggaaug

SEQ ID NO: 3634213 - RNA, 18 nt, Human
gaauugugaccaaguuau

SEQ ID NO: 3634214 - RNA, 12 nt, Human
gaauuguggcua

SEQ ID NO: 3634215 - RNA, 16 nt, Human
gaauugugugauguuu

SEQ ID NO: 3634216 - RNA, 12 nt, Human
gaauuguuacau

SEQ ID NO: 3634217 - RNA, 14 nt, Human
gaauuuaaauauaa

SEQ ID NO: 3634218 - RNA, 16 nt, Human
gaauuuacuuccuugc

SEQ ID NO: 3634219 - RNA, 21 nt, Human
gaauuuagggagaaauguugu

SEQ ID NO: 3634220 - RNA, 19 nt, Human
gaauuuagguuuuuauuag

SEQ ID NO: 3634221 - RNA, 16 nt, Human
gaauuuauaauucagu

SEQ ID NO: 3634222 - RNA, 23 nt, Human
gaauuuauaccuaccuguguggu

SEQ ID NO: 3634223 - RNA, 22 nt, Human
gaauuuaucacacuucugugag

SEQ ID NO: 3634224 - RNA, 19 nt, Human
gaauuuauugcacauuguu

SEQ ID NO: 3634225 - RNA, 14 nt, Human
gaauuuauuggcuu

SEQ ID NO: 3634226 - RNA, 21 nt, Human
gaauuuauuuuuaagaaagaa

SEQ ID NO: 3634227 - RNA, 12 nt, Human
gaauuucacaag

SEQ ID NO: 3634228 - RNA, 16 nt, Human
gaauuucccaaagcag

SEQ ID NO: 3634229 - RNA, 12 nt, Human
gaauuucuaaaa

SEQ ID NO: 3634230 - RNA, 19 nt, Human
gaauuucuaggacugaauu

SEQ ID NO: 3634231 - RNA, 19 nt, Human
gaauuucuaucuaaaugau

SEQ ID NO: 3634232 - RNA, 19 nt, Human
gaauuucugugcccuccug

SEQ ID NO: 3634233 - RNA, 14 nt, Human
gaauuucuuaacuu

SEQ ID NO: 3634234 - RNA, 16 nt, Human
gaauuucuuaacuucu

SEQ ID NO: 3634235 - RNA, 19 nt, Human
gaauuugaaugaaaaauuu

SEQ ID NO: 3634236 - RNA, 23 nt, Human
gaauuugaucguuccaguuccca

SEQ ID NO: 3634237 - RNA, 11 nt, Human
gaauuugcaaa

SEQ ID NO: 3634238 - RNA, 19 nt, Human
gaauuugcaagucauggcu

SEQ ID NO: 3634239 - RNA, 20 nt, Human
gaauuugccugcugggauuc

SEQ ID NO: 3634240 - RNA, 13 nt, Human
gaauuugcugggg

SEQ ID NO: 3634241 - RNA, 19 nt, Human
gaauuugggacccugcuuu

SEQ ID NO: 3634242 - RNA, 18 nt, Human
gaauuuguaaccucagcu

SEQ ID NO: 3634243 - RNA, 14 nt, Human
gaauuuguaaguuu

SEQ ID NO: 3634244 - RNA, 15 nt, Human
gaauuuuaaaaauga

SEQ ID NO: 3634245 - RNA, 16 nt, Human
gaauuuuagcuuuugu

SEQ ID NO: 3634246 - RNA, 18 nt, Human
gaauuuuauacuuucccu

SEQ ID NO: 3634247 - RNA, 20 nt, Human
gaauuuuauacuuucccuac

SEQ ID NO: 3634248 - RNA, 21 nt, Human
gaauuuuauacuuucccuacc

SEQ ID NO: 3634249 - RNA, 18 nt, Human
gaauuuuauugacacagu

SEQ ID NO: 3634250 - RNA, 21 nt, Human
gaauuuuauuuuuugggaaaa

SEQ ID NO: 3634251 - RNA, 17 nt, Human
gaauuuucaagcaucuc

SEQ ID NO: 3634252 - RNA, 23 nt, Human
gaauuuucuuuguguagcuuugc

SEQ ID NO: 3634253 - RNA, 22 nt, Human
gaauuuucuuuuuaauaaaaag

SEQ ID NO: 3634254 - RNA, 23 nt, Human
gaauuuuggcugugucucccuuc

SEQ ID NO: 3634255 - RNA, 20 nt, Human
gaauuuuggggauuuucaaa

SEQ ID NO: 3634256 - RNA, 20 nt, Human
gaauuuugugcccccaugua

SEQ ID NO: 3634257 - RNA, 17 nt, Human
gaauuuuuaaacaagua

SEQ ID NO: 3634258 - RNA, 12 nt, Human
gaauuuuuaagc

SEQ ID NO: 3634259 - RNA, 14 nt, Human
gaauuuuuauuauu

SEQ ID NO: 3634260 - RNA, 14 nt, Human
gaauuuuuccuaug

SEQ ID NO: 3634261 - RNA, 17 nt, Human
gaauuuuugcaauaaug

SEQ ID NO: 3634262 - RNA, 19 nt, Human
gaauuuuugcaauaaugca

SEQ ID NO: 3634263 - RNA, 21 nt, Human
gaauuuuugcaauaaugcagu

SEQ ID NO: 3634264 - RNA, 15 nt, Human
gaauuuuuuuuaaca

SEQ ID NO: 3634265 - RNA, 21 nt, Human
gaauuuuuuuuaacauuccuc

SEQ ID NO: 3634266 - RNA, 17 nt, Human
gacaaaaacagccucac

SEQ ID NO: 3634267 - RNA, 22 nt, Human
gacaaaaaguauauuaaacaaa

SEQ ID NO: 3634268 - RNA, 18 nt, Human
gacaaaaaguuuccauau

SEQ ID NO: 3634269 - RNA, 17 nt, Human
gacaaaaauacucuaau

SEQ ID NO: 3634270 - RNA, 23 nt, Human
gacaaaaccccccagauaucauc

SEQ ID NO: 3634271 - RNA, 14 nt, Human
gacaaaacuucuug

SEQ ID NO: 3634272 - RNA, 16 nt, Human
gacaaaauauuuccca

SEQ ID NO: 3634273 - RNA, 22 nt, Human
gacaaaauuuuaguccaaauaa

SEQ ID NO: 3634274 - RNA, 18 nt, Human
gacaaaauuuuauaagca

SEQ ID NO: 3634275 - RNA, 17 nt, Human
gacaaacuggagucugg

SEQ ID NO: 3634276 - RNA, 16 nt, Human
gacaaagaauuccaaa

SEQ ID NO: 3634277 - RNA, 17 nt, Human
gacaaaggacauuuguu

SEQ ID NO: 3634278 - RNA, 16 nt, Human
gacaaaggagccugug

SEQ ID NO: 3634279 - RNA, 14 nt, Human
gacaaagucuccag

SEQ ID NO: 3634280 - RNA, 16 nt, Human
gacaaagugccaaaga

SEQ ID NO: 3634281 - RNA, 18 nt, Human
gacaaagugccaaagaaa

SEQ ID NO: 3634282 - RNA, 19 nt, Human
gacaaagugccaaagaaag

SEQ ID NO: 3634283 - RNA, 19 nt, Human
gacaaaguggaggagggcc

SEQ ID NO: 3634284 - RNA, 18 nt, Human
gacaaaguuccaaaaugc

SEQ ID NO: 3634285 - RNA, 20 nt, Human
gacaaaguuccaaaaugcca

SEQ ID NO: 3634286 - RNA, 15 nt, Human
gacaaaucaaagcag

SEQ ID NO: 3634287 - RNA, 12 nt, Human
gacaaaucuaag

SEQ ID NO: 3634288 - RNA, 14 nt, Human
gacaaaucugucug

SEQ ID NO: 3634289 - RNA, 22 nt, Human
gacaaaugcugcgcccuucccc

SEQ ID NO: 3634290 - RNA, 18 nt, Human
gacaaaugugaagaugca

SEQ ID NO: 3634291 - RNA, 22 nt, Human
gacaaauguguaucggaugcuu

SEQ ID NO: 3634292 - RNA, 12 nt, Human
gacaaauucugu

SEQ ID NO: 3634293 - RNA, 14 nt, Human
gacaaauucuguuu

SEQ ID NO: 3634294 - RNA, 15 nt, Human
gacaaauucuguuuc

SEQ ID NO: 3634295 - RNA, 20 nt, Human
gacaaauucuguuucuugag

SEQ ID NO: 3634296 - RNA, 15 nt, Human
gacaaauugcacaga

SEQ ID NO: 3634297 - RNA, 20 nt, Human
gacaaauuuaaaacaaacaa

SEQ ID NO: 3634298 - RNA, 14 nt, Human
gacaaauuuuaauu

SEQ ID NO: 3634299 - RNA, 22 nt, Human
gacaacacucauugaccugagg

SEQ ID NO: 3634300 - RNA, 23 nt, Human
gacaacacucauugaccugaggc

SEQ ID NO: 3634301 - RNA, 12 nt, Human
gacaacagaagc

SEQ ID NO: 3634302 - RNA, 20 nt, Human
gacaacauguuuaauaaaua

SEQ ID NO: 3634303 - RNA, 19 nt, Human
gacaaccaccgcuccccag

SEQ ID NO: 3634304 - RNA, 15 nt, Human
gacaaccauuaaagu

SEQ ID NO: 3634305 - RNA, 19 nt, Human
gacaaccauuaaagucaga

SEQ ID NO: 3634306 - RNA, 19 nt, Human
gacaaccgaugcuccagcc

SEQ ID NO: 3634307 - RNA, 21 nt, Human
gacaaccgaugcuccagccaa

SEQ ID NO: 3634308 - RNA, 20 nt, Human
gacaaccuuggcuuggcccu

SEQ ID NO: 3634309 - RNA, 15 nt, Human
gacaacgugcucuuu

SEQ ID NO: 3634310 - RNA, 17 nt, Human
gacaacguuucagcgac

SEQ ID NO: 3634311 - RNA, 12 nt, Human
gacaacuggcag

SEQ ID NO: 3634312 - RNA, 16 nt, Human
gacaacuggcaggcag

SEQ ID NO: 3634313 - RNA, 13 nt, Human
gacaacugugacu

SEQ ID NO: 3634314 - RNA, 15 nt, Human
gacaagaaaucccug

SEQ ID NO: 3634315 - RNA, 16 nt, Human
gacaagaaaucccugu

SEQ ID NO: 3634316 - RNA, 13 nt, Human
gacaagaagcaaa

SEQ ID NO: 3634317 - RNA, 19 nt, Human
gacaagaagcaaauuuuuu

SEQ ID NO: 3634318 - RNA, 21 nt, Human
gacaagacaaaccaagucgga

SEQ ID NO: 3634319 - RNA, 15 nt, Human
gacaagacuucagua

SEQ ID NO: 3634320 - RNA, 23 nt, Human
gacaagagccugaucucuuccug

SEQ ID NO: 3634321 - RNA, 19 nt, Human
gacaagagguacaggguuu

SEQ ID NO: 3634322 - RNA, 19 nt, Human
gacaagauauuguacauaa

SEQ ID NO: 3634323 - RNA, 19 nt, Human
gacaagcaauuagacaaga

SEQ ID NO: 3634324 - RNA, 12 nt, Human
gacaagcacagu

SEQ ID NO: 3634325 - RNA, 16 nt, Human
gacaagcacugcuagg

SEQ ID NO: 3634326 - RNA, 12 nt, Human
gacaagcagagg

SEQ ID NO: 3634327 - RNA, 21 nt, Human
gacaagcagauacugcugugu

SEQ ID NO: 3634328 - RNA, 15 nt, Human
gacaagccccaggca

SEQ ID NO: 3634329 - RNA, 21 nt, Human
gacaagcuguugaccaggcac

SEQ ID NO: 3634330 - RNA, 12 nt, Human
gacaagcuucug

SEQ ID NO: 3634331 - RNA, 16 nt, Human
gacaaggaaaaaauaa

SEQ ID NO: 3634332 - RNA, 22 nt, Human
gacaaggauugcuacuguccua

SEQ ID NO: 3634333 - RNA, 13 nt, Human
gacaaggccccag

SEQ ID NO: 3634334 - RNA, 17 nt, Human
gacaaggccccagagac

SEQ ID NO: 3634335 - RNA, 22 nt, Human
gacaagggaaaauaaaaaaaga

SEQ ID NO: 3634336 - RNA, 15 nt, Human
gacaagggcugaccu

SEQ ID NO: 3634337 - RNA, 22 nt, Human
gacaagggcugaccugccucuc

SEQ ID NO: 3634338 - RNA, 17 nt, Human
gacaaggugcaggcagg

SEQ ID NO: 3634339 - RNA, 20 nt, Human
gacaagugacuguaucugug

SEQ ID NO: 3634340 - RNA, 22 nt, Human
gacaagugaugcuaaaaccuga

SEQ ID NO: 3634341 - RNA, 16 nt, Human
gacaauaaacccucag

SEQ ID NO: 3634342 - RNA, 21 nt, Human
gacaauaaaccuccgccaaug

SEQ ID NO: 3634343 - RNA, 13 nt, Human
gaccaauuuuaac

SEQ ID NO: 3634344 - RNA, 21 nt, Human
gaccacacauuuguguaaaca

SEQ ID NO: 3634345 - RNA, 12 nt, Human
gaccacaccugc

SEQ ID NO: 3634346 - RNA, 22 nt, Human
gaccacacuccagcugggauca

SEQ ID NO: 3634347 - RNA, 20 nt, Human
gaccacacuuccuguccaga

SEQ ID NO: 3634348 - RNA, 20 nt, Human
gaccacagcaaggcaccugc

SEQ ID NO: 3634349 - RNA, 14 nt, Human
gaccacagcacagc

SEQ ID NO: 3634350 - RNA, 16 nt, Human
gaccacagcacagcca

SEQ ID NO: 3634351 - RNA, 23 nt, Human
gaccacagcaucauuuugcauuc

SEQ ID NO: 3634352 - RNA, 16 nt, Human
gaccacaggcucaggc

SEQ ID NO: 3634353 - RNA, 18 nt, Human
gaccacaggcucaggcag

SEQ ID NO: 3634354 - RNA, 23 nt, Human
gaccacaggguucaaaaugucug

SEQ ID NO: 3634355 - RNA, 23 nt, Human
gaccacaggugcccgccaccaca

SEQ ID NO: 3634356 - RNA, 23 nt, Human
gaccacaucuuuaucuguucuug

SEQ ID NO: 3634357 - RNA, 13 nt, Human
gaccacaugcccc

SEQ ID NO: 3634358 - RNA, 22 nt, Human
gaccaccaccccaacaaaccau

SEQ ID NO: 3634359 - RNA, 20 nt, Human
gaccaccagggcaucucugg

SEQ ID NO: 3634360 - RNA, 21 nt, Human
gaccaccagggcaucucuggg

SEQ ID NO: 3634361 - RNA, 16 nt, Human
gaccacccauaucaug

SEQ ID NO: 3634362 - RNA, 17 nt, Human
gaccaccccugccucca

SEQ ID NO: 3634363 - RNA, 18 nt, Human
gaccacccuccccucucu

SEQ ID NO: 3634364 - RNA, 18 nt, Human
gaccaccucaaauuuaaa

SEQ ID NO: 3634365 - RNA, 13 nt, Human
gaccaccugccca

SEQ ID NO: 3634366 - RNA, 22 nt, Human
gaccaccuuuguuucuccccca

SEQ ID NO: 3634367 - RNA, 19 nt, Human
gaccacgcccguccugccu

SEQ ID NO: 3634368 - RNA, 22 nt, Human
gaccacgcccguccugccugug

SEQ ID NO: 3634369 - RNA, 14 nt, Human
gaccacgcuuucua

SEQ ID NO: 3634370 - RNA, 17 nt, Human
gaccacgggaagcaucu

SEQ ID NO: 3634371 - RNA, 16 nt, Human
gaccacguuucuaaag

SEQ ID NO: 3634372 - RNA, 17 nt, Human
gaccacucagccccuag

SEQ ID NO: 3634373 - RNA, 16 nt, Human
gaccacugcagaagac

SEQ ID NO: 3634374 - RNA, 21 nt, Human
gaccacugcagaagacaguau

SEQ ID NO: 3634375 - RNA, 16 nt, Human
gaccacuguuucuugc

SEQ ID NO: 3634376 - RNA, 15 nt, Human
gaccacuuccagggg

SEQ ID NO: 3634377 - RNA, 15 nt, Human
gaccacuugaggccu

SEQ ID NO: 3634378 - RNA, 17 nt, Human
gaccagaagcuccccca

SEQ ID NO: 3634379 - RNA, 21 nt, Human
gaccagacaccuugacagggc

SEQ ID NO: 3634380 - RNA, 24 nt, Human
gaccagacaccuugacagggcaca

SEQ ID NO: 3634381 - RNA, 11 nt, Human
gaccagacuaa

SEQ ID NO: 3634382 - RNA, 11 nt, Human
gaccagagcuc

SEQ ID NO: 3634383 - RNA, 13 nt, Human
gaccagagcugcc

SEQ ID NO: 3634384 - RNA, 16 nt, Human
gaccagagcugccacc

SEQ ID NO: 3634385 - RNA, 18 nt, Human
gaccagagcugccaccug

SEQ ID NO: 3634386 - RNA, 15 nt, Human
gaccagaggagccuu

SEQ ID NO: 3634387 - RNA, 20 nt, Human
gaccagcaacuugucuuuuu

SEQ ID NO: 3634388 - RNA, 13 nt, Human
gaccagcacacuc

SEQ ID NO: 3634389 - RNA, 14 nt, Human
gaccagcacacucc

SEQ ID NO: 3634390 - RNA, 18 nt, Human
gaccagcacacucccgag

SEQ ID NO: 3634391 - RNA, 19 nt, Human
gaccagcagacagagccag

SEQ ID NO: 3634392 - RNA, 22 nt, Human
gaccagcagacagagccaggag

SEQ ID NO: 3634393 - RNA, 17 nt, Human
gaccagcagaucccagc

SEQ ID NO: 3634394 - RNA, 20 nt, Human
gaccagcagaucccagcuca

SEQ ID NO: 3634395 - RNA, 20 nt, Human
gaccagcagcgccuuuccca

SEQ ID NO: 3634396 - RNA, 17 nt, Human
gaccagcagucugccug

SEQ ID NO: 3634397 - RNA, 16 nt, Human
gaccagccagcagcag

SEQ ID NO: 3634398 - RNA, 20 nt, Human
gaccagccuccaugcugccu

SEQ ID NO: 3634399 - RNA, 21 nt, Human
gaccagccuccaugcugccuc

SEQ ID NO: 3634400 - RNA, 14 nt, Human
gaccagccucucca

SEQ ID NO: 3634401 - RNA, 15 nt, Human
gaccagccuggccca

SEQ ID NO: 3634402 - RNA, 12 nt, Human
gaccagccuggg

SEQ ID NO: 3634403 - RNA, 13 nt, Human
gaccagcucagga

SEQ ID NO: 3634404 - RNA, 22 nt, Human
gaccagcucaggacagaugcca

SEQ ID NO: 3634405 - RNA, 19 nt, Human
gaccagcucccccucccuc

SEQ ID NO: 3634406 - RNA, 20 nt, Human
gaccagcucccccucccucc

SEQ ID NO: 3634407 - RNA, 21 nt, Human
gaccagcugcuccgaggaccc

SEQ ID NO: 3634408 - RNA, 11 nt, Human
gaccagcuggg

SEQ ID NO: 3634409 - RNA, 13 nt, Human
gaccagcuggggc

SEQ ID NO: 3634410 - RNA, 17 nt, Human
gaccagcuuggcucagg

SEQ ID NO: 3634411 - RNA, 14 nt, Human
gaccaggacuauag

SEQ ID NO: 3634412 - RNA, 23 nt, Human
gaccaggacucccuccucaccuc

SEQ ID NO: 3634413 - RNA, 23 nt, Human
gaccaggagggcacuggagcugu

SEQ ID NO: 3634414 - RNA, 11 nt, Human
gaccaggagug

SEQ ID NO: 3634415 - RNA, 15 nt, Human
gaccaggauccagcc

SEQ ID NO: 3634416 - RNA, 21 nt, Human
gaccaggaucccaagccuccu

SEQ ID NO: 3634417 - RNA, 15 nt, Human
gaccaggauuucuaa

SEQ ID NO: 3634418 - RNA, 13 nt, Human
gaccaggccuggg

SEQ ID NO: 3634419 - RNA, 14 nt, Human
gaccaggcuguguc

SEQ ID NO: 3634420 - RNA, 15 nt, Human
gaccagggagccuuu

SEQ ID NO: 3634421 - RNA, 20 nt, Human
gaccagggauuuccaugaug

SEQ ID NO: 3634422 - RNA, 14 nt, Human
gaccagggcagggc

SEQ ID NO: 3634423 - RNA, 15 nt, Human
gaccagggccgagga

SEQ ID NO: 3634424 - RNA, 19 nt, Human
gaccagggccgaggaggug

SEQ ID NO: 3634425 - RNA, 11 nt, Human
gaccagggccu

SEQ ID NO: 3634426 - RNA, 14 nt, Human
gaccagggccuuuu

SEQ ID NO: 3634427 - RNA, 23 nt, Human
gaccaggucuuggagcugagccu

SEQ ID NO: 3634428 - RNA, 17 nt, Human
gaccagucaaccugggc

SEQ ID NO: 3634429 - RNA, 17 nt, Human
gaccagucccagagcag

SEQ ID NO: 3634430 - RNA, 15 nt, Human
gaccaguggugccuu

SEQ ID NO: 3634431 - RNA, 22 nt, Human
gaccaguugaauaaaagugcac

SEQ ID NO: 3634432 - RNA, 14 nt, Human
gaccaguugggagc

SEQ ID NO: 3634433 - RNA, 16 nt, Human
gaccauaacagccaac

SEQ ID NO: 3634434 - RNA, 20 nt, Human
gaccauaauguuacauuauu

SEQ ID NO: 3634435 - RNA, 14 nt, Human
gaccauagugacca

SEQ ID NO: 3634436 - RNA, 21 nt, Human
gaccauccacucuacccuccc

SEQ ID NO: 3634437 - RNA, 13 nt, Human
gaccaucccugaa

SEQ ID NO: 3634438 - RNA, 15 nt, Human
gaccaucccugaagg

SEQ ID NO: 3634439 - RNA, 13 nt, Human
gaccauccuauuu

SEQ ID NO: 3634440 - RNA, 12 nt, Human
gaccauccuggc

SEQ ID NO: 3634441 - RNA, 15 nt, Human
gaccaucugcuuuua

SEQ ID NO: 3634442 - RNA, 17 nt, Human
gaccaucugcuuuuauu

SEQ ID NO: 3634443 - RNA, 24 nt, Human
gaccaugcgacacugggaggccag

SEQ ID NO: 3634444 - RNA, 23 nt, Human
gaccauggacacuacacccagca

SEQ ID NO: 3634445 - RNA, 21 nt, Human
gaccauggaguggcagcccag

SEQ ID NO: 3634446 - RNA, 14 nt, Human
gaccauguggccac

SEQ ID NO: 3634447 - RNA, 20 nt, Human
gaccaugugucacuugugcu

SEQ ID NO: 3634448 - RNA, 21 nt, Human
gaccaugugucacuugugcuu

SEQ ID NO: 3634449 - RNA, 17 nt, Human
gaccauucuccaccugc

SEQ ID NO: 3634450 - RNA, 13 nt, Human
gaccauuuaacau

SEQ ID NO: 3634451 - RNA, 15 nt, Human
gaccauuucaggggu

SEQ ID NO: 3634452 - RNA, 13 nt, Human
gacccaaggagga

SEQ ID NO: 3634453 - RNA, 14 nt, Human
gacccaaggaggaa

SEQ ID NO: 3634454 - RNA, 18 nt, Human
gacccaauguaggagcug

SEQ ID NO: 3634455 - RNA, 12 nt, Human
gacccacaugcu

SEQ ID NO: 3634456 - RNA, 13 nt, Human
gacccacauguaa

SEQ ID NO: 3634457 - RNA, 15 nt, Human
gacccaccccaccug

SEQ ID NO: 3634458 - RNA, 15 nt, Human
gacccaccccugugc

SEQ ID NO: 3634459 - RNA, 16 nt, Human
gacccaccucaccccg

SEQ ID NO: 3634460 - RNA, 11 nt, Human
gacccacugcu

SEQ ID NO: 3634461 - RNA, 22 nt, Human
gacccacuucucaucacacaca

SEQ ID NO: 3634462 - RNA, 17 nt, Human
gacccagacacaucgca

SEQ ID NO: 3634463 - RNA, 14 nt, Human
gacccagccaggcc

SEQ ID NO: 3634464 - RNA, 19 nt, Human
gacccagccaggcccagcc

SEQ ID NO: 3634465 - RNA, 16 nt, Human
gacccagcggacacac

SEQ ID NO: 3634466 - RNA, 13 nt, Human
gacccaggacagg

SEQ ID NO: 3634467 - RNA, 13 nt, Human
gacccaggacucc

SEQ ID NO: 3634468 - RNA, 13 nt, Human
gacccaggccgca

SEQ ID NO: 3634469 - RNA, 15 nt, Human
gacccaggccgcagc

SEQ ID NO: 3634470 - RNA, 17 nt, Human
gacccaggccgcagcuc

SEQ ID NO: 3634471 - RNA, 16 nt, Human
gacccaggcuccgccc

SEQ ID NO: 3634472 - RNA, 18 nt, Human
gacccaggcuccgcccuu

SEQ ID NO: 3634473 - RNA, 18 nt, Human
gacccaggcugccugagc

SEQ ID NO: 3634474 - RNA, 14 nt, Human
gacccaggcugggc

SEQ ID NO: 3634475 - RNA, 15 nt, Human
gacccaggcugggca

SEQ ID NO: 3634476 - RNA, 15 nt, Human
gacccagggaacagc

SEQ ID NO: 3634477 - RNA, 13 nt, Human
gacccagggggag

SEQ ID NO: 3634478 - RNA, 14 nt, Human
gacccagucccugg

SEQ ID NO: 3634479 - RNA, 13 nt, Human
gacccagugcaga

SEQ ID NO: 3634480 - RNA, 15 nt, Human
gacccagugccccca

SEQ ID NO: 3634481 - RNA, 12 nt, Human
gacccaguggca

SEQ ID NO: 3634482 - RNA, 14 nt, Human
gacccaguggcagg

SEQ ID NO: 3634483 - RNA, 15 nt, Human
gacccaguggcaggg

SEQ ID NO: 3634484 - RNA, 16 nt, Human
gacccaguggcagggc

SEQ ID NO: 3634485 - RNA, 23 nt, Human
gacccaugaguuggggucuggca

SEQ ID NO: 3634486 - RNA, 13 nt, Human
gacccaugcugcc

SEQ ID NO: 3634487 - RNA, 15 nt, Human
gacccaugcugcccu

SEQ ID NO: 3634488 - RNA, 15 nt, Human
gacccaugggcagga

SEQ ID NO: 3634489 - RNA, 14 nt, Human
gagccgugaugccu

SEQ ID NO: 3634490 - RNA, 20 nt, Human
gagccguggucccugaggau

SEQ ID NO: 3634491 - RNA, 17 nt, Human
gagccuaaaaauaaagc

SEQ ID NO: 3634492 - RNA, 19 nt, Human
gagccuaaaaauaaagcac

SEQ ID NO: 3634493 - RNA, 20 nt, Human
gagccuaccuguaugucaau

SEQ ID NO: 3634494 - RNA, 21 nt, Human
gagccuaggaccacucagccc

SEQ ID NO: 3634495 - RNA, 14 nt, Human
gagccuaggccagg

SEQ ID NO: 3634496 - RNA, 15 nt, Human
gagccuaggccaggu

SEQ ID NO: 3634497 - RNA, 16 nt, Human
gagccuaggccaggug

SEQ ID NO: 3634498 - RNA, 13 nt, Human
gagccucacagca

SEQ ID NO: 3634499 - RNA, 14 nt, Human
gagccucacagcag

SEQ ID NO: 3634500 - RNA, 18 nt, Human
gagccucacagcagugag

SEQ ID NO: 3634501 - RNA, 14 nt, Human
gagccucacugggg

SEQ ID NO: 3634502 - RNA, 15 nt, Human
gagccucagcauccu

SEQ ID NO: 3634503 - RNA, 20 nt, Human
gagccucccaaggagaacaa

SEQ ID NO: 3634504 - RNA, 22 nt, Human
gagccucccaaggagaacaaau

SEQ ID NO: 3634505 - RNA, 14 nt, Human
gagccucccugccu

SEQ ID NO: 3634506 - RNA, 19 nt, Human
gagccucccugccucaggc

SEQ ID NO: 3634507 - RNA, 19 nt, Human
gagccuccugcccaguccc

SEQ ID NO: 3634508 - RNA, 14 nt, Human
gagccuccugcccu

SEQ ID NO: 3634509 - RNA, 20 nt, Human
gagccuccugcccuuaccug

SEQ ID NO: 3634510 - RNA, 14 nt, Human
gagccucgcucugu

SEQ ID NO: 3634511 - RNA, 12 nt, Human
gagccucugggg

SEQ ID NO: 3634512 - RNA, 12 nt, Human
gagccucuguca

SEQ ID NO: 3634513 - RNA, 18 nt, Human
gagccucugucacugcag

SEQ ID NO: 3634514 - RNA, 20 nt, Human
gagccucugucacugcaggc

SEQ ID NO: 3634515 - RNA, 21 nt, Human
gagccucugucacugcaggca

SEQ ID NO: 3634516 - RNA, 22 nt, Human
gagccucugucacugcaggcac

SEQ ID NO: 3634517 - RNA, 24 nt, Human
gagccucugucacugcaggcacuc

SEQ ID NO: 3634518 - RNA, 20 nt, Human
gagccucuucugccaagaga

SEQ ID NO: 3634519 - RNA, 18 nt, Human
gagccugaaauagugguu

SEQ ID NO: 3634520 - RNA, 15 nt, Human
gagccugacagccag

SEQ ID NO: 3634521 - RNA, 17 nt, Human
gagccugagucagggcc

SEQ ID NO: 3634522 - RNA, 17 nt, Human
gagccugaucucuuccu

SEQ ID NO: 3634523 - RNA, 19 nt, Human
gagccugaucucuuccugu

SEQ ID NO: 3634524 - RNA, 15 nt, Human
gagccugcaacaugc

SEQ ID NO: 3634525 - RNA, 13 nt, Human
gagccugcaggau

SEQ ID NO: 3634526 - RNA, 13 nt, Human
gagccugcccagc

SEQ ID NO: 3634527 - RNA, 14 nt, Human
gagccugccgagca

SEQ ID NO: 3634528 - RNA, 15 nt, Human
gagccugccuggagc

SEQ ID NO: 3634529 - RNA, 13 nt, Human
gagccugcucccc

SEQ ID NO: 3634530 - RNA, 17 nt, Human
gagccugcucccccacc

SEQ ID NO: 3634531 - RNA, 15 nt, Human
gagccugcuggcacc

SEQ ID NO: 3634532 - RNA, 10 nt, Human
gagccuggca

SEQ ID NO: 3634533 - RNA, 15 nt, Human
gagccuggcaagaau

SEQ ID NO: 3634534 - RNA, 21 nt, Human
gagccuggcucuugugcugga

SEQ ID NO: 3634535 - RNA, 23 nt, Human
gagccuggcucuugugcuggaug

SEQ ID NO: 3634536 - RNA, 21 nt, Human
gagccugggaggucaaggcug

SEQ ID NO: 3634537 - RNA, 15 nt, Human
gagccuggggcucua

SEQ ID NO: 3634538 - RNA, 19 nt, Human
gagccuggucccacgaggg

SEQ ID NO: 3634539 - RNA, 18 nt, Human
gagccuguccugccugug

SEQ ID NO: 3634540 - RNA, 19 nt, Human
gagccuguccugccugugg

SEQ ID NO: 3634541 - RNA, 18 nt, Human
gagccugugaacccagga

SEQ ID NO: 3634542 - RNA, 23 nt, Human
gagccugugacauacccccuccc

SEQ ID NO: 3634543 - RNA, 15 nt, Human
gagccuguguaacag

SEQ ID NO: 3634544 - RNA, 20 nt, Human
gagccuguguaacagcuccu

SEQ ID NO: 3634545 - RNA, 22 nt, Human
gagccuguguaacagcuccuug

SEQ ID NO: 3634546 - RNA, 14 nt, Human
gagccuuaaaacau

SEQ ID NO: 3634547 - RNA, 13 nt, Human
gagccuucagccu

SEQ ID NO: 3634548 - RNA, 14 nt, Human
gagccuuccaccca

SEQ ID NO: 3634549 - RNA, 17 nt, Human
gagccuuccaggggugg

SEQ ID NO: 3634550 - RNA, 17 nt, Human
gagccuucucagaagca

SEQ ID NO: 3634551 - RNA, 16 nt, Human
gagccuugggaccccu

SEQ ID NO: 3634552 - RNA, 19 nt, Human
gagccuugguguccaccug

SEQ ID NO: 3634553 - RNA, 23 nt, Human
gagccuuuucccucuuuggcucc

SEQ ID NO: 3634554 - RNA, 13 nt, Human
gagcgaaacuccg

SEQ ID NO: 3634555 - RNA, 13 nt, Human
gagcgacagugag

SEQ ID NO: 3634556 - RNA, 16 nt, Human
gagcgagcauccccca

SEQ ID NO: 3634557 - RNA, 16 nt, Human
gagcgagcgcuaccca

SEQ ID NO: 3634558 - RNA, 14 nt, Human
gagcgcagccgccu

SEQ ID NO: 3634559 - RNA, 19 nt, Human
gagcgcaguguuuugcaag

SEQ ID NO: 3634560 - RNA, 21 nt, Human
gagcgcccacuagacccacug

SEQ ID NO: 3634561 - RNA, 13 nt, Human
gagcgcccugcag

SEQ ID NO: 3634562 - RNA, 19 nt, Human
gagcgcccugcagacccug

SEQ ID NO: 3634563 - RNA, 21 nt, Human
gagcgcccugcagacccugcc

SEQ ID NO: 3634564 - RNA, 19 nt, Human
gagcgccuccauccaaggc

SEQ ID NO: 3634565 - RNA, 17 nt, Human
gagcgcgccccuagccg

SEQ ID NO: 3634566 - RNA, 15 nt, Human
gagcgcuugggcgcc

SEQ ID NO: 3634567 - RNA, 13 nt, Human
gagcggagguugc

SEQ ID NO: 3634568 - RNA, 14 nt, Human
gagcggucucaggc

SEQ ID NO: 3634569 - RNA, 16 nt, Human
gagcggucucaggcug

SEQ ID NO: 3634570 - RNA, 19 nt, Human
gagcggugcuguccucagg

SEQ ID NO: 3634571 - RNA, 16 nt, Human
gagcgugagcugagca

SEQ ID NO: 3634572 - RNA, 20 nt, Human
gagcgugcuccagccuggcu

SEQ ID NO: 3634573 - RNA, 21 nt, Human
gagcgugcuccagccuggcuc

SEQ ID NO: 3634574 - RNA, 19 nt, Human
gagcuaaacuccuuccugg

SEQ ID NO: 3634575 - RNA, 19 nt, Human
gagcuaaauuacaauuguc

SEQ ID NO: 3634576 - RNA, 11 nt, Human
gagcuaaggcu

SEQ ID NO: 3634577 - RNA, 18 nt, Human
gagcuaagggugggugcu

SEQ ID NO: 3634578 - RNA, 23 nt, Human
gagcuaagggugggugcucagaa

SEQ ID NO: 3634579 - RNA, 12 nt, Human
gagcuacaaaug

SEQ ID NO: 3634580 - RNA, 14 nt, Human
gagcuacaaaugca

SEQ ID NO: 3634581 - RNA, 23 nt, Human
gagcuacacaggggaaaagagga

SEQ ID NO: 3634582 - RNA, 14 nt, Human
gagcuaccugugug

SEQ ID NO: 3634583 - RNA, 19 nt, Human
gagcuaccuguguggacag

SEQ ID NO: 3634584 - RNA, 20 nt, Human
gagcuaccuguguggacagg

SEQ ID NO: 3634585 - RNA, 17 nt, Human
gagcuacgccugccucc

SEQ ID NO: 3634586 - RNA, 23 nt, Human
gagcuacgccugccuccccugug

SEQ ID NO: 3634587 - RNA, 20 nt, Human
gagcuacguauuuaauagca

SEQ ID NO: 3634588 - RNA, 22 nt, Human
gagcuagaaccuagaagggcua

SEQ ID NO: 3634589 - RNA, 17 nt, Human
gagcuagaaccuggaga

SEQ ID NO: 3634590 - RNA, 21 nt, Human
gagcuagaaccuggagggcua

SEQ ID NO: 3634591 - RNA, 17 nt, Human
gagcuagcagcagggag

SEQ ID NO: 3634592 - RNA, 12 nt, Human
gagcuagccaga

SEQ ID NO: 3634593 - RNA, 18 nt, Human
gagcuagccagaggacug

SEQ ID NO: 3634594 - RNA, 19 nt, Human
gagcuagcgcugccgcacc

SEQ ID NO: 3634595 - RNA, 23 nt, Human
gagcuagcgcugccgcaccccag

SEQ ID NO: 3634596 - RNA, 12 nt, Human
gagcuaggagca

SEQ ID NO: 3634597 - RNA, 21 nt, Human
gagcuaggagcaaagccuguu

SEQ ID NO: 3634598 - RNA, 13 nt, Human
gagcuaggcaggg

SEQ ID NO: 3634599 - RNA, 22 nt, Human
gagcuauuaaaacucagccugg

SEQ ID NO: 3634600 - RNA, 18 nt, Human
gagcuauuuccauuccag

SEQ ID NO: 3634601 - RNA, 19 nt, Human
gagcuauuuccauuccaga

SEQ ID NO: 3634602 - RNA, 14 nt, Human
gagcucacaaggca

SEQ ID NO: 3634603 - RNA, 21 nt, Human
gagcucacaaggcagcaaggc

SEQ ID NO: 3634604 - RNA, 23 nt, Human
gagcucacaaggcagcaaggccc

SEQ ID NO: 3634605 - RNA, 20 nt, Human
gagcucagaaaauaucccuc

SEQ ID NO: 3634606 - RNA, 18 nt, Human
gagcucagacccccacuc

SEQ ID NO: 3634607 - RNA, 20 nt, Human
gagcucagacccccacucuc

SEQ ID NO: 3634608 - RNA, 20 nt, Human
gagcucagagagggcaggca

SEQ ID NO: 3634609 - RNA, 22 nt, Human
gagcucaggaaccgaggcaggg

SEQ ID NO: 3634610 - RNA, 14 nt, Human
gagcucaggacacu

SEQ ID NO: 3634611 - RNA, 13 nt, Human
gagcuccacucug

SEQ ID NO: 3634612 - RNA, 13 nt, Human
gagcuccagaccc

SEQ ID NO: 3634613 - RNA, 15 nt, Human
gagcuccagaccccc

SEQ ID NO: 3634614 - RNA, 19 nt, Human
gagcuccagacccccagca

SEQ ID NO: 3634615 - RNA, 22 nt, Human
gagcuccagagcaacgaccagg

SEQ ID NO: 3634616 - RNA, 14 nt, Human
gagcuccagccuga

SEQ ID NO: 3634617 - RNA, 14 nt, Human
gagcuccaguggaa

SEQ ID NO: 3634618 - RNA, 14 nt, Human
gagcuccagugucc

SEQ ID NO: 3634619 - RNA, 18 nt, Human
gagcuccaguguccugag

SEQ ID NO: 3634620 - RNA, 17 nt, Human
gagcucccacaagccug

SEQ ID NO: 3634621 - RNA, 19 nt, Human
gagcucccacuucugccag

SEQ ID NO: 3634622 - RNA, 18 nt, Human
gagcuccucuccuggagg

SEQ ID NO: 3634623 - RNA, 19 nt, Human
gagcuccucuccuggagga

SEQ ID NO: 3634624 - RNA, 15 nt, Human
gagcuccucugggca

SEQ ID NO: 3634625 - RNA, 21 nt, Human
gagcuccucuguccugcuucu

SEQ ID NO: 3634626 - RNA, 14 nt, Human
gagcuccucuucca

SEQ ID NO: 3634627 - RNA, 13 nt, Human
gagcuccugggaa

SEQ ID NO: 3634628 - RNA, 19 nt, Human
gagcucguguauccugggg

SEQ ID NO: 3634629 - RNA, 20 nt, Human
gagcucguguauccuggggc

SEQ ID NO: 3634630 - RNA, 15 nt, Human
gagcucuacccaggg

SEQ ID NO: 3634631 - RNA, 23 nt, Human
gagcucuacccagggccugcagg

SEQ ID NO: 3634632 - RNA, 16 nt, Human
gagcucugaaaucuuc

SEQ ID NO: 3634633 - RNA, 11 nt, Human
gagcucugaga

SEQ ID NO: 3634634 - RNA, 16 nt, Human
gagggaaaagggaagu

SEQ ID NO: 3634635 - RNA, 13 nt, Human
gagggaaaccuuu

SEQ ID NO: 3634636 - RNA, 22 nt, Human
gagggaaagccuuaagcugcag

SEQ ID NO: 3634637 - RNA, 15 nt, Human
gagggaagggagcca

SEQ ID NO: 3634638 - RNA, 16 nt, Human
gagggaagggagccaa

SEQ ID NO: 3634639 - RNA, 20 nt, Human
gagggaagggagccaaggga

SEQ ID NO: 3634640 - RNA, 19 nt, Human
gagggaaggguuucucuau

SEQ ID NO: 3634641 - RNA, 17 nt, Human
gagggacaaaggagccu

SEQ ID NO: 3634642 - RNA, 20 nt, Human
gagggacaaaggagccugug

SEQ ID NO: 3634643 - RNA, 18 nt, Human
gagggaccaacugggccc

SEQ ID NO: 3634644 - RNA, 15 nt, Human
gagggaccauguguc

SEQ ID NO: 3634645 - RNA, 21 nt, Human
gagggaccaugugucacuugu

SEQ ID NO: 3634646 - RNA, 19 nt, Human
gagggacccuccaccaccu

SEQ ID NO: 3634647 - RNA, 17 nt, Human
gagggaccucucccagg

SEQ ID NO: 3634648 - RNA, 18 nt, Human
gagggaccucucccaggg

SEQ ID NO: 3634649 - RNA, 18 nt, Human
gagggacucugaagccuc

SEQ ID NO: 3634650 - RNA, 22 nt, Human
gagggacucugaagccucuggg

SEQ ID NO: 3634651 - RNA, 23 nt, Human
gagggacucugaagccucuggga

SEQ ID NO: 3634652 - RNA, 16 nt, Human
gagggacugccucugc

SEQ ID NO: 3634653 - RNA, 21 nt, Human
gagggacuuugcugauuuccc

SEQ ID NO: 3634654 - RNA, 13 nt, Human
gagggagaagaag

SEQ ID NO: 3634655 - RNA, 16 nt, Human
gagggagagagagaga

SEQ ID NO: 3634656 - RNA, 22 nt, Human
gagggagagagagagagagagg

SEQ ID NO: 3634657 - RNA, 13 nt, Human
gagggagagggag

SEQ ID NO: 3634658 - RNA, 22 nt, Human
gagggagcaaguccuucccuuu

SEQ ID NO: 3634659 - RNA, 20 nt, Human
gagggagcagacaggaggaa

SEQ ID NO: 3634660 - RNA, 20 nt, Human
gagggagcauagaaggcagg

SEQ ID NO: 3634661 - RNA, 24 nt, Human
gagggagcauagaaggcaggugag

SEQ ID NO: 3634662 - RNA, 12 nt, Human
gagggagcugag

SEQ ID NO: 3634663 - RNA, 15 nt, Human
gagggagcuuagcca

SEQ ID NO: 3634664 - RNA, 13 nt, Human
gagggaggaaucg

SEQ ID NO: 3634665 - RNA, 12 nt, Human
gagggaggaggc

SEQ ID NO: 3634666 - RNA, 17 nt, Human
gagggaggcaagcccug

SEQ ID NO: 3634667 - RNA, 12 nt, Human
gagggaggcccc

SEQ ID NO: 3634668 - RNA, 14 nt, Human
gagggagggagggc

SEQ ID NO: 3634669 - RNA, 15 nt, Human
gagggagggagggcu

SEQ ID NO: 3634670 - RNA, 19 nt, Human
gagggagggcuccagacac

SEQ ID NO: 3634671 - RNA, 21 nt, Human
gagggaggggaagcuucuguc

SEQ ID NO: 3634672 - RNA, 20 nt, Human
gagggagggggaaggcaggg

SEQ ID NO: 3634673 - RNA, 23 nt, Human
gagggagguguuuaaagagaggu

SEQ ID NO: 3634674 - RNA, 21 nt, Human
gagggagugacagaggcagcc

SEQ ID NO: 3634675 - RNA, 16 nt, Human
gagggauaagcaaaag

SEQ ID NO: 3634676 - RNA, 14 nt, Human
gagggaucacaggg

SEQ ID NO: 3634677 - RNA, 22 nt, Human
gagggaugaggugcugggaggg

SEQ ID NO: 3634678 - RNA, 15 nt, Human
gagggaugcugccug

SEQ ID NO: 3634679 - RNA, 17 nt, Human
gagggaugcugccugag

SEQ ID NO: 3634680 - RNA, 20 nt, Human
gagggaugcugccugaguca

SEQ ID NO: 3634681 - RNA, 18 nt, Human
gagggauggcgggugggg

SEQ ID NO: 3634682 - RNA, 14 nt, Human
gagggaugggccug

SEQ ID NO: 3634683 - RNA, 19 nt, Human
gagggauuucuuugcugua

SEQ ID NO: 3634684 - RNA, 16 nt, Human
gagggcacugguggcc

SEQ ID NO: 3634685 - RNA, 21 nt, Human
gagggcagaaagguucugccc

SEQ ID NO: 3634686 - RNA, 22 nt, Human
gagggcagaaagguucugcccg

SEQ ID NO: 3634687 - RNA, 18 nt, Human
gagggcagacuggggcau

SEQ ID NO: 3634688 - RNA, 14 nt, Human
gagggcagaggcug

SEQ ID NO: 3634689 - RNA, 17 nt, Human
gagggcagcagccagcc

SEQ ID NO: 3634690 - RNA, 12 nt, Human
gagggcagcagg

SEQ ID NO: 3634691 - RNA, 13 nt, Human
gagggcagcugcu

SEQ ID NO: 3634692 - RNA, 14 nt, Human
gagggcagcugcua

SEQ ID NO: 3634693 - RNA, 11 nt, Human
gagggcaggga

SEQ ID NO: 3634694 - RNA, 16 nt, Human
gagggcaguguuuccu

SEQ ID NO: 3634695 - RNA, 19 nt, Human
gagggcaguucgcagccac

SEQ ID NO: 3634696 - RNA, 20 nt, Human
gagggcaguucgcagccacc

SEQ ID NO: 3634697 - RNA, 23 nt, Human
gagggcaguucgcagccacccug

SEQ ID NO: 3634698 - RNA, 18 nt, Human
gagggcauccauaccagc

SEQ ID NO: 3634699 - RNA, 16 nt, Human
gagggccacgggucug

SEQ ID NO: 3634700 - RNA, 14 nt, Human
gagggcccagagca

SEQ ID NO: 3634701 - RNA, 18 nt, Human
gagggcccagagcaggaa

SEQ ID NO: 3634702 - RNA, 13 nt, Human
gagggcccaggca

SEQ ID NO: 3634703 - RNA, 16 nt, Human
gagggccccucugccc

SEQ ID NO: 3634704 - RNA, 22 nt, Human
gagggccccucugcccagcuug

SEQ ID NO: 3634705 - RNA, 18 nt, Human
gagggccguaccccaccc

SEQ ID NO: 3634706 - RNA, 22 nt, Human
gagggccucaaaggcccgcucu

SEQ ID NO: 3634707 - RNA, 15 nt, Human
gagggccugaggucu

SEQ ID NO: 3634708 - RNA, 21 nt, Human
gagggccugcaagggagugag

SEQ ID NO: 3634709 - RNA, 20 nt, Human
gagggccugcuggaggccuc

SEQ ID NO: 3634710 - RNA, 13 nt, Human
gagggccugggcc

SEQ ID NO: 3634711 - RNA, 15 nt, Human
gagggccugggccug

SEQ ID NO: 3634712 - RNA, 13 nt, Human
gagggcggcaggg

SEQ ID NO: 3634713 - RNA, 23 nt, Human
gagggcggcaggggccuggagau

SEQ ID NO: 3634714 - RNA, 20 nt, Human
gagggcgugacucacccaag

SEQ ID NO: 3634715 - RNA, 20 nt, Human
gagggcuagaaccuggaagg

SEQ ID NO: 3634716 - RNA, 19 nt, Human
gagggcuagaaucuggaga

SEQ ID NO: 3634717 - RNA, 17 nt, Human
gagggcucacucagcca

SEQ ID NO: 3634718 - RNA, 13 nt, Human
gagggcuccagac

SEQ ID NO: 3634719 - RNA, 14 nt, Human
gagggcuccagaca

SEQ ID NO: 3634720 - RNA, 19 nt, Human
gagggcucgaggggugggc

SEQ ID NO: 3634721 - RNA, 14 nt, Human
gagggcucugaggc

SEQ ID NO: 3634722 - RNA, 16 nt, Human
gagggcugccuuugga

SEQ ID NO: 3634723 - RNA, 10 nt, Human
gagggcugga

SEQ ID NO: 3634724 - RNA, 13 nt, Human
gagggcuggaauc

SEQ ID NO: 3634725 - RNA, 19 nt, Human
gagggcuggaaucuggaga

SEQ ID NO: 3634726 - RNA, 20 nt, Human
gagggcuggaaucuggagag

SEQ ID NO: 3634727 - RNA, 21 nt, Human
gagggcuggaaucuggagagc

SEQ ID NO: 3634728 - RNA, 19 nt, Human
gagggcuggaggcccaggc

SEQ ID NO: 3634729 - RNA, 23 nt, Human
gagggcuggaggcccaggcuggg

SEQ ID NO: 3634730 - RNA, 14 nt, Human
gagggcuggcuggc

SEQ ID NO: 3634731 - RNA, 18 nt, Human
gaggggaaaggggagagg

SEQ ID NO: 3634732 - RNA, 16 nt, Human
gaggggaacacugccc

SEQ ID NO: 3634733 - RNA, 17 nt, Human
gaggggaacacugcccu

SEQ ID NO: 3634734 - RNA, 12 nt, Human
gaggggaacaga

SEQ ID NO: 3634735 - RNA, 23 nt, Human
gaggggaagaaacacuuucucuu

SEQ ID NO: 3634736 - RNA, 15 nt, Human
gaggggaagaggccu

SEQ ID NO: 3634737 - RNA, 16 nt, Human
gaggggaagcugcagc

SEQ ID NO: 3634738 - RNA, 19 nt, Human
gaggggaagcugcagcuug

SEQ ID NO: 3634739 - RNA, 15 nt, Human
gaggggaagggccag

SEQ ID NO: 3634740 - RNA, 16 nt, Human
gaggggaaggggcggu

SEQ ID NO: 3634741 - RNA, 18 nt, Human
gaggggaauaauagaaga

SEQ ID NO: 3634742 - RNA, 19 nt, Human
gaggggaauaauagaagaa

SEQ ID NO: 3634743 - RNA, 15 nt, Human
gaggggaccaggagu

SEQ ID NO: 3634744 - RNA, 17 nt, Human
gaggggaccaggagugg

SEQ ID NO: 3634745 - RNA, 12 nt, Human
gaggggacucug

SEQ ID NO: 3634746 - RNA, 12 nt, Human
gaggggagaagc

SEQ ID NO: 3634747 - RNA, 11 nt, Human
gaggggagagg

SEQ ID NO: 3634748 - RNA, 18 nt, Human
gaggggcaacgaagaaaa

SEQ ID NO: 3634749 - RNA, 16 nt, Human
gaggggcagagccagg

SEQ ID NO: 3634750 - RNA, 20 nt, Human
gaggggcagagccaggaaga

SEQ ID NO: 3634751 - RNA, 23 nt, Human
gaggggcagauggaaaggagccu

SEQ ID NO: 3634752 - RNA, 17 nt, Human
gaggggcaggcccugca

SEQ ID NO: 3634753 - RNA, 23 nt, Human
gaggggcaggcccugcacugucc

SEQ ID NO: 3634754 - RNA, 15 nt, Human
gaggggcagguaaac

SEQ ID NO: 3634755 - RNA, 19 nt, Human
gaggggcauggccagcagc

SEQ ID NO: 3634756 - RNA, 23 nt, Human
gaggggccuaggccucagccaga

SEQ ID NO: 3634757 - RNA, 22 nt, Human
gaggggccugccaccuggaccc

SEQ ID NO: 3634758 - RNA, 14 nt, Human
gaggggccuggcag

SEQ ID NO: 3634759 - RNA, 18 nt, Human
gaggggccuggcagccgu

SEQ ID NO: 3634760 - RNA, 20 nt, Human
gaggggccuggcagccgugc

SEQ ID NO: 3634761 - RNA, 17 nt, Human
gaggggcgcuggcccag

SEQ ID NO: 3634762 - RNA, 21 nt, Human
gaggggcggcaggagggaggu

SEQ ID NO: 3634763 - RNA, 15 nt, Human
gaggggcucaggaaa

SEQ ID NO: 3634764 - RNA, 15 nt, Human
gaggggcuccuggaa

SEQ ID NO: 3634765 - RNA, 12 nt, Human
gaggggcucuca

SEQ ID NO: 3634766 - RNA, 19 nt, Human
gaggggcucucagcucagc

SEQ ID NO: 3634767 - RNA, 20 nt, Human
gagggggacugcugcugccu

SEQ ID NO: 3634768 - RNA, 13 nt, Human
gagggggcaaagg

SEQ ID NO: 3634769 - RNA, 14 nt, Human
gagggggccgggcg

SEQ ID NO: 3634770 - RNA, 21 nt, Human
gagggggcuugaagccaaaga

SEQ ID NO: 3634771 - RNA, 22 nt, Human
gaggggggaggugggauccucc

SEQ ID NO: 3634772 - RNA, 19 nt, Human
gaggggggauuuccagcca

SEQ ID NO: 3634773 - RNA, 18 nt, Human
gagggggucguggagagc

SEQ ID NO: 3634774 - RNA, 21 nt, Human
gagggggugaccuccggccag

SEQ ID NO: 3634775 - RNA, 14 nt, Human
gaggggguggaggg

SEQ ID NO: 3634776 - RNA, 15 nt, Human
gaggggguggccucc

SEQ ID NO: 3634777 - RNA, 17 nt, Human
gaggggguggccuccca

SEQ ID NO: 3634778 - RNA, 20 nt, Human
gaggggguuacaaacugcaa

SEQ ID NO: 3634779 - RNA, 20 nt, Human
gaguggaggugggcugggcc

SEQ ID NO: 3634780 - RNA, 19 nt, Human
gaguggagucugccaccca

SEQ ID NO: 3634781 - RNA, 21 nt, Human
gaguggagucugccacccagg

SEQ ID NO: 3634782 - RNA, 17 nt, Human
gaguggaguuacugaac

SEQ ID NO: 3634783 - RNA, 17 nt, Human
gaguggaucuccaagga

SEQ ID NO: 3634784 - RNA, 22 nt, Human
gaguggcagcccagccagcguc

SEQ ID NO: 3634785 - RNA, 19 nt, Human
gaguggcaggggacaggag

SEQ ID NO: 3634786 - RNA, 23 nt, Human
gaguggcaggggacaggagucca

SEQ ID NO: 3634787 - RNA, 20 nt, Human
gaguggcauggccaccacca

SEQ ID NO: 3634788 - RNA, 18 nt, Human
gaguggcauuggcagcag

SEQ ID NO: 3634789 - RNA, 11 nt, Human
gaguggccacu

SEQ ID NO: 3634790 - RNA, 20 nt, Human
gaguggccccaccuggcccu

SEQ ID NO: 3634791 - RNA, 10 nt, Human
gaguggccug

SEQ ID NO: 3634792 - RNA, 15 nt, Human
gaguggccuggccag

SEQ ID NO: 3634793 - RNA, 20 nt, Human
gaguggccuggccaggagcu

SEQ ID NO: 3634794 - RNA, 13 nt, Human
gaguggcuggggc

SEQ ID NO: 3634795 - RNA, 14 nt, Human
gaguggcuggggca

SEQ ID NO: 3634796 - RNA, 17 nt, Human
gagugggaaggacuugg

SEQ ID NO: 3634797 - RNA, 17 nt, Human
gagugggacagagucug

SEQ ID NO: 3634798 - RNA, 18 nt, Human
gagugggacagagucugg

SEQ ID NO: 3634799 - RNA, 19 nt, Human
gagugggagaaggcaguga

SEQ ID NO: 3634800 - RNA, 13 nt, Human
gagugggcagagc

SEQ ID NO: 3634801 - RNA, 12 nt, Human
gagugggcccaa

SEQ ID NO: 3634802 - RNA, 14 nt, Human
gaguggggcaguag

SEQ ID NO: 3634803 - RNA, 22 nt, Human
gagugggggagagcaggcuggc

SEQ ID NO: 3634804 - RNA, 21 nt, Human
gagugggugacaagagccuga

SEQ ID NO: 3634805 - RNA, 15 nt, Human
gaguggguggaggca

SEQ ID NO: 3634806 - RNA, 14 nt, Human
gaguggguggggag

SEQ ID NO: 3634807 - RNA, 15 nt, Human
gaguggguugauuuc

SEQ ID NO: 3634808 - RNA, 15 nt, Human
gaguggugcagacag

SEQ ID NO: 3634809 - RNA, 21 nt, Human
gagugguuuuucuuuucuugg

SEQ ID NO: 3634810 - RNA, 14 nt, Human
gaguguaaguguga

SEQ ID NO: 3634811 - RNA, 11 nt, Human
gaguguagaag

SEQ ID NO: 3634812 - RNA, 14 nt, Human
gaguguagaagcau

SEQ ID NO: 3634813 - RNA, 16 nt, Human
gaguguagaagcauuc

SEQ ID NO: 3634814 - RNA, 23 nt, Human
gaguguccuaggaguauccucau

SEQ ID NO: 3634815 - RNA, 15 nt, Human
gagugucuuuccacg

SEQ ID NO: 3634816 - RNA, 17 nt, Human
gagugugacagggccag

SEQ ID NO: 3634817 - RNA, 12 nt, Human
gagugugaccaa

SEQ ID NO: 3634818 - RNA, 20 nt, Human
gagugugcauggaggcccuc

SEQ ID NO: 3634819 - RNA, 23 nt, Human
gagugugcgugguggucccuggg

SEQ ID NO: 3634820 - RNA, 12 nt, Human
gagugugcugcu

SEQ ID NO: 3634821 - RNA, 14 nt, Human
gagugugcuggagg

SEQ ID NO: 3634822 - RNA, 18 nt, Human
gagugugcuggaggacug

SEQ ID NO: 3634823 - RNA, 17 nt, Human
gaguguggcuccccucu

SEQ ID NO: 3634824 - RNA, 12 nt, Human
gagugugggaag

SEQ ID NO: 3634825 - RNA, 15 nt, Human
gagugugguuucuuu

SEQ ID NO: 3634826 - RNA, 16 nt, Human
gaguguguauuguucc

SEQ ID NO: 3634827 - RNA, 11 nt, Human
gagugugugca

SEQ ID NO: 3634828 - RNA, 10 nt, Human
gagugugugu

SEQ ID NO: 3634829 - RNA, 17 nt, Human
gaguguguuugucaccg

SEQ ID NO: 3634830 - RNA, 12 nt, Human
gaguguugaaac

SEQ ID NO: 3634831 - RNA, 22 nt, Human
gaguguugggcaugugaucacg

SEQ ID NO: 3634832 - RNA, 22 nt, Human
gaguguuucuaauaaacuugga

SEQ ID NO: 3634833 - RNA, 14 nt, Human
gaguuaagaagcug

SEQ ID NO: 3634834 - RNA, 13 nt, Human
gaguuaagaccug

SEQ ID NO: 3634835 - RNA, 13 nt, Human
gaguuaagguggg

SEQ ID NO: 3634836 - RNA, 13 nt, Human
gaguuaagucuau

SEQ ID NO: 3634837 - RNA, 15 nt, Human
gaguuacagccuggg

SEQ ID NO: 3634838 - RNA, 20 nt, Human
gaguuacagcgagaggcaga

SEQ ID NO: 3634839 - RNA, 14 nt, Human
gaguuacaguucug

SEQ ID NO: 3634840 - RNA, 16 nt, Human
gaguuagaauaauaaa

SEQ ID NO: 3634841 - RNA, 22 nt, Human
gaguuagaauaauaaauauuua

SEQ ID NO: 3634842 - RNA, 14 nt, Human
gaguuagacuguug

SEQ ID NO: 3634843 - RNA, 18 nt, Human
gaguuagaggccagccug

SEQ ID NO: 3634844 - RNA, 18 nt, Human
gaguuaggcuauucacaa

SEQ ID NO: 3634845 - RNA, 19 nt, Human
gaguuagggacugaccagc

SEQ ID NO: 3634846 - RNA, 19 nt, Human
gaguuagguuuaacauaaa

SEQ ID NO: 3634847 - RNA, 18 nt, Human
gaguuaguuucuuuggga

SEQ ID NO: 3634848 - RNA, 18 nt, Human
gaguuauauguucacugu

SEQ ID NO: 3634849 - RNA, 18 nt, Human
gaguuaucaugaauuuua

SEQ ID NO: 3634850 - RNA, 18 nt, Human
gaguuaucuaaaagaaau

SEQ ID NO: 3634851 - RNA, 22 nt, Human
gaguuaucuaagaauacagcuu

SEQ ID NO: 3634852 - RNA, 17 nt, Human
gaguuauugaagcagag

SEQ ID NO: 3634853 - RNA, 14 nt, Human
gaguuauugagauu

SEQ ID NO: 3634854 - RNA, 19 nt, Human
gaguucaaugaucuagguu

SEQ ID NO: 3634855 - RNA, 21 nt, Human
gaguucaaugaucuagguuua

SEQ ID NO: 3634856 - RNA, 16 nt, Human
gaguucaauggcugcu

SEQ ID NO: 3634857 - RNA, 22 nt, Human
gaguucacuucaucuucucagc

SEQ ID NO: 3634858 - RNA, 13 nt, Human
gaguucaucccag

SEQ ID NO: 3634859 - RNA, 23 nt, Human
gaguucaucuugaauuguaagga

SEQ ID NO: 3634860 - RNA, 16 nt, Human
gaguucauucauauua

SEQ ID NO: 3634861 - RNA, 16 nt, Human
gaguuccacagauugu

SEQ ID NO: 3634862 - RNA, 22 nt, Human
gaguucccuugaaacuuuggga

SEQ ID NO: 3634863 - RNA, 17 nt, Human
gaguucgagaccagccu

SEQ ID NO: 3634864 - RNA, 18 nt, Human
gaguucggcucugggugg

SEQ ID NO: 3634865 - RNA, 14 nt, Human
gaguucucagggcu

SEQ ID NO: 3634866 - RNA, 15 nt, Human
gaguucucagggcuc

SEQ ID NO: 3634867 - RNA, 21 nt, Human
gaguucugcucauucuaauga

SEQ ID NO: 3634868 - RNA, 12 nt, Human
gaguucugcuga

SEQ ID NO: 3634869 - RNA, 13 nt, Human
gaguucugguucc

SEQ ID NO: 3634870 - RNA, 21 nt, Human
gaguucuuaaggauugugaua

SEQ ID NO: 3634871 - RNA, 21 nt, Human
gaguucuuccuguaaucuugu

SEQ ID NO: 3634872 - RNA, 14 nt, Human
gaguugaagacaga

SEQ ID NO: 3634873 - RNA, 23 nt, Human
gaguugacuugacagaacacugu

SEQ ID NO: 3634874 - RNA, 12 nt, Human
gaguugaggcca

SEQ ID NO: 3634875 - RNA, 21 nt, Human
gaguugauagcacagacccug

SEQ ID NO: 3634876 - RNA, 22 nt, Human
gaguugauagcacagacccugc

SEQ ID NO: 3634877 - RNA, 14 nt, Human
gaguugaucuggaa

SEQ ID NO: 3634878 - RNA, 17 nt, Human
gaguugaucuggaaccc

SEQ ID NO: 3634879 - RNA, 17 nt, Human
gaguugauucagcucug

SEQ ID NO: 3634880 - RNA, 17 nt, Human
gaguuggaguagaaugu

SEQ ID NO: 3634881 - RNA, 13 nt, Human
gaguuggcuggga

SEQ ID NO: 3634882 - RNA, 16 nt, Human
gaguuguuacauuuuu

SEQ ID NO: 3634883 - RNA, 20 nt, Human
gaguuguuacauuuuuaagu

SEQ ID NO: 3634884 - RNA, 15 nt, Human
gaguuguugcccugg

SEQ ID NO: 3634885 - RNA, 22 nt, Human
gaguuguuuucagacucagacu

SEQ ID NO: 3634886 - RNA, 21 nt, Human
gaguuuaaaaaugguaucaaa

SEQ ID NO: 3634887 - RNA, 17 nt, Human
gaguuuaagaccagccu

SEQ ID NO: 3634888 - RNA, 16 nt, Human
gaguuuagcuggaaaa

SEQ ID NO: 3634889 - RNA, 15 nt, Human
gaguuuagggugggg

SEQ ID NO: 3634890 - RNA, 18 nt, Human
gaguuucauguacaagau

SEQ ID NO: 3634891 - RNA, 15 nt, Human
gaguuuccucaggcu

SEQ ID NO: 3634892 - RNA, 16 nt, Human
gaguuuccucaggcug

SEQ ID NO: 3634893 - RNA, 14 nt, Human
gaguuuccuuuucu

SEQ ID NO: 3634894 - RNA, 12 nt, Human
gaguuucuguuu

SEQ ID NO: 3634895 - RNA, 14 nt, Human
gaguuugccuuccu

SEQ ID NO: 3634896 - RNA, 13 nt, Human
gaguuuggccaga

SEQ ID NO: 3634897 - RNA, 23 nt, Human
gaguuuguagguaaaauguauuu

SEQ ID NO: 3634898 - RNA, 14 nt, Human
gaguuuguuucuuu

SEQ ID NO: 3634899 - RNA, 18 nt, Human
gaguuuguuucuuugaau

SEQ ID NO: 3634900 - RNA, 16 nt, Human
gaguuuucauuaaauc

SEQ ID NO: 3634901 - RNA, 13 nt, Human
gaguuuuccccac

SEQ ID NO: 3634902 - RNA, 14 nt, Human
gaguuuucuuccuu

SEQ ID NO: 3634903 - RNA, 22 nt, Human
gaguuuuguguuuguuguagau

SEQ ID NO: 3634904 - RNA, 13 nt, Human
gaguuuuguuuua

SEQ ID NO: 3634905 - RNA, 19 nt, Human
gaguuuuguuuuaaaauua

SEQ ID NO: 3634906 - RNA, 16 nt, Human
gaguuuuuaauagaac

SEQ ID NO: 3634907 - RNA, 22 nt, Human
gaguuuuucccagcuacaccuu

SEQ ID NO: 3634908 - RNA, 19 nt, Human
gaguuuuuguuuggagagc

SEQ ID NO: 3634909 - RNA, 16 nt, Human
gaguuuuuuguaccaa

SEQ ID NO: 3634910 - RNA, 14 nt, Human
gauaaaaaauuuug

SEQ ID NO: 3634911 - RNA, 19 nt, Human
gauaaaaaauuuuguaauu

SEQ ID NO: 3634912 - RNA, 14 nt, Human
gauaaaaagauggc

SEQ ID NO: 3634913 - RNA, 21 nt, Human
gauaaaacaucuuugaaauua

SEQ ID NO: 3634914 - RNA, 13 nt, Human
gauaaaagauggc

SEQ ID NO: 3634915 - RNA, 21 nt, Human
gauaaaauaaugcugcaaacu

SEQ ID NO: 3634916 - RNA, 19 nt, Human
gauaaaaucauaaguauuu

SEQ ID NO: 3634917 - RNA, 13 nt, Human
gauaaagauugug

SEQ ID NO: 3634918 - RNA, 17 nt, Human
gauaaagauuuuuuaau

SEQ ID NO: 3634919 - RNA, 21 nt, Human
gauaaagcugccccaucuggg

SEQ ID NO: 3634920 - RNA, 15 nt, Human
gauaaaguuucucag

SEQ ID NO: 3634921 - RNA, 16 nt, Human
gauaaauaacuuuuuu

SEQ ID NO: 3634922 - RNA, 21 nt, Human
gauaaauaacuuuuuuuuaag

SEQ ID NO: 3634923 - RNA, 16 nt, Human
gauaaauacaaggccc

SEQ ID NO: 3634924 - RNA, 12 nt, Human
gauaaauauuca

SEQ ID NO: 3634925 - RNA, 23 nt, Human
gcaauuuaauauuuugcacaguu

SEQ ID NO: 3634926 - RNA, 16 nt, Human
gcaauuuauacaauau

SEQ ID NO: 3634927 - RNA, 23 nt, Human
gcaauuucaaauuacucuuucuc

SEQ ID NO: 3634928 - RNA, 16 nt, Human
gcaauuucccccuaaa

SEQ ID NO: 3634929 - RNA, 17 nt, Human
gcaauuucuaauuuuua

SEQ ID NO: 3634930 - RNA, 19 nt, Human
gcaauuucuaauuuuuaag

SEQ ID NO: 3634931 - RNA, 22 nt, Human
gcaauuucuaauuuuuaagaau

SEQ ID NO: 3634932 - RNA, 23 nt, Human
gcaauuuuaacacacauaaagga

SEQ ID NO: 3634933 - RNA, 19 nt, Human
gcaauuuuaauugauuauu

SEQ ID NO: 3634934 - RNA, 11 nt, Human
gcaauuuuccu

SEQ ID NO: 3634935 - RNA, 14 nt, Human
gcaauuuuccuuga

SEQ ID NO: 3634936 - RNA, 20 nt, Human
gcaauuuuccuugaagccga

SEQ ID NO: 3634937 - RNA, 12 nt, Human
gcaauuuugugg

SEQ ID NO: 3634938 - RNA, 13 nt, Human
gcacaaaacccag

SEQ ID NO: 3634939 - RNA, 23 nt, Human
gcacaaaacccagaccuguuagc

SEQ ID NO: 3634940 - RNA, 21 nt, Human
gcacaaaauauaaagcaucua

SEQ ID NO: 3634941 - RNA, 11 nt, Human
gcacaaaauga

SEQ ID NO: 3634942 - RNA, 23 nt, Human
gcacaaaaugauggacccaaugc

SEQ ID NO: 3634943 - RNA, 14 nt, Human
gcacaaacacaagg

SEQ ID NO: 3634944 - RNA, 16 nt, Human
gcacaaacacaagguc

SEQ ID NO: 3634945 - RNA, 14 nt, Human
gcacaaacauuuuu

SEQ ID NO: 3634946 - RNA, 16 nt, Human
gcacaaacauuuuuca

SEQ ID NO: 3634947 - RNA, 15 nt, Human
gcacaaauauuuauu

SEQ ID NO: 3634948 - RNA, 23 nt, Human
gcacaaauucugucucuggauua

SEQ ID NO: 3634949 - RNA, 19 nt, Human
gcacaaccuucaagcugcu

SEQ ID NO: 3634950 - RNA, 22 nt, Human
gcacaacugcaauaacuucuga

SEQ ID NO: 3634951 - RNA, 17 nt, Human
gcacaagaaucacuuga

SEQ ID NO: 3634952 - RNA, 19 nt, Human
gcacaagaaucacuugaac

SEQ ID NO: 3634953 - RNA, 15 nt, Human
gcacaagaauggauc

SEQ ID NO: 3634954 - RNA, 14 nt, Human
gcacaagcagagug

SEQ ID NO: 3634955 - RNA, 22 nt, Human
gcacaagcagagugcacagcug

SEQ ID NO: 3634956 - RNA, 23 nt, Human
gcacaagcagagugcacagcugu

SEQ ID NO: 3634957 - RNA, 17 nt, Human
gcacaagcuccaagcuc

SEQ ID NO: 3634958 - RNA, 21 nt, Human
gcacaagcuccaagcucccag

SEQ ID NO: 3634959 - RNA, 14 nt, Human
gcacaagcugcacc

SEQ ID NO: 3634960 - RNA, 18 nt, Human
gcacaaggauugaaaauu

SEQ ID NO: 3634961 - RNA, 19 nt, Human
gcacaaggcugaccaagag

SEQ ID NO: 3634962 - RNA, 14 nt, Human
gcacaaguguaaug

SEQ ID NO: 3634963 - RNA, 19 nt, Human
gcacaauaaauggcuguaa

SEQ ID NO: 3634964 - RNA, 20 nt, Human
gcacaauaacuccucccagg

SEQ ID NO: 3634965 - RNA, 22 nt, Human
gcacaauaacuccucccagggu

SEQ ID NO: 3634966 - RNA, 19 nt, Human
gcacaauguagauaagugu

SEQ ID NO: 3634967 - RNA, 14 nt, Human
gcacaauucuguuu

SEQ ID NO: 3634968 - RNA, 12 nt, Human
gcacaauuugca

SEQ ID NO: 3634969 - RNA, 14 nt, Human
gcacacaaauauua

SEQ ID NO: 3634970 - RNA, 21 nt, Human
gcacacaaggggcccuuggag

SEQ ID NO: 3634971 - RNA, 18 nt, Human
gcacacaauuagauuucu

SEQ ID NO: 3634972 - RNA, 14 nt, Human
gcacacacacacau

SEQ ID NO: 3634973 - RNA, 22 nt, Human
gcacacaccaccacgccuggcu

SEQ ID NO: 3634974 - RNA, 14 nt, Human
gcacacaccagagc

SEQ ID NO: 3634975 - RNA, 16 nt, Human
gcacacaccagagccc

SEQ ID NO: 3634976 - RNA, 18 nt, Human
gcacacaccagagcccac

SEQ ID NO: 3634977 - RNA, 19 nt, Human
gcacacaccagagcccacc

SEQ ID NO: 3634978 - RNA, 20 nt, Human
gcacacaccagagcccaccu

SEQ ID NO: 3634979 - RNA, 12 nt, Human
gcacacacugug

SEQ ID NO: 3634980 - RNA, 18 nt, Human
gcacacagaaauauauau

SEQ ID NO: 3634981 - RNA, 20 nt, Human
gcacacagaaauauauauac

SEQ ID NO: 3634982 - RNA, 11 nt, Human
gcacacagcac

SEQ ID NO: 3634983 - RNA, 23 nt, Human
gcacacagcacgggggccaagga

SEQ ID NO: 3634984 - RNA, 13 nt, Human
gcacacagggcag

SEQ ID NO: 3634985 - RNA, 15 nt, Human
gcacacaucaucugu

SEQ ID NO: 3634986 - RNA, 17 nt, Human
gcacacaucaucuguaa

SEQ ID NO: 3634987 - RNA, 20 nt, Human
gcacacaucaucuguaagcu

SEQ ID NO: 3634988 - RNA, 17 nt, Human
gcacaccaaucuuacuu

SEQ ID NO: 3634989 - RNA, 17 nt, Human
gcacacccacucagcuc

SEQ ID NO: 3634990 - RNA, 18 nt, Human
gcacacccacucagcucc

SEQ ID NO: 3634991 - RNA, 17 nt, Human
gcacacccucacucugc

SEQ ID NO: 3634992 - RNA, 23 nt, Human
gcacacccucacucugccagggc

SEQ ID NO: 3634993 - RNA, 20 nt, Human
gcacaccgggcacucagaag

SEQ ID NO: 3634994 - RNA, 12 nt, Human
gcacacgcugcu

SEQ ID NO: 3634995 - RNA, 13 nt, Human
gcacacgcugcuc

SEQ ID NO: 3634996 - RNA, 17 nt, Human
gcacacgcugcucugcc

SEQ ID NO: 3634997 - RNA, 15 nt, Human
gcacacuccccugca

SEQ ID NO: 3634998 - RNA, 19 nt, Human
gcacacucugccagcaaag

SEQ ID NO: 3634999 - RNA, 20 nt, Human
gcacacucugccagcaaaga

SEQ ID NO: 3635000 - RNA, 13 nt, Human
gcacacuggcuca

SEQ ID NO: 3635001 - RNA, 22 nt, Human
gcacacuggcucacccaguccu

SEQ ID NO: 3635002 - RNA, 14 nt, Human
gcacacuuggccca

SEQ ID NO: 3635003 - RNA, 20 nt, Human
gcacacuuugcacugauaua

SEQ ID NO: 3635004 - RNA, 13 nt, Human
gcacacuuugcca

SEQ ID NO: 3635005 - RNA, 22 nt, Human
gcacacuuugccauauuuucac

SEQ ID NO: 3635006 - RNA, 16 nt, Human
gcacacuuuggcccag

SEQ ID NO: 3635007 - RNA, 21 nt, Human
gcacacuuugguaccagauaa

SEQ ID NO: 3635008 - RNA, 13 nt, Human
gcacagaaaacua

SEQ ID NO: 3635009 - RNA, 21 nt, Human
gcacagaaaauggaagacagc

SEQ ID NO: 3635010 - RNA, 16 nt, Human
gcacagaaguccugua

SEQ ID NO: 3635011 - RNA, 14 nt, Human
gcacagaauauuuu

SEQ ID NO: 3635012 - RNA, 22 nt, Human
gcacagacagguuuucacauaa

SEQ ID NO: 3635013 - RNA, 14 nt, Human
gcacagacccugcc

SEQ ID NO: 3635014 - RNA, 17 nt, Human
gcacagacccugcccug

SEQ ID NO: 3635015 - RNA, 22 nt, Human
gcacagacccugcccugugggc

SEQ ID NO: 3635016 - RNA, 23 nt, Human
gcacagagagggggccaccuccc

SEQ ID NO: 3635017 - RNA, 17 nt, Human
gcacagagcucuccagc

SEQ ID NO: 3635018 - RNA, 15 nt, Human
gcacagaguuguuac

SEQ ID NO: 3635019 - RNA, 19 nt, Human
gcacagaguuguuacauuu

SEQ ID NO: 3635020 - RNA, 19 nt, Human
gcacagauaaaaaguggaa

SEQ ID NO: 3635021 - RNA, 19 nt, Human
gcacagauauacuuugugg

SEQ ID NO: 3635022 - RNA, 17 nt, Human
gcacagaugcuccaggg

SEQ ID NO: 3635023 - RNA, 22 nt, Human
gcacagauggauuugccugugc

SEQ ID NO: 3635024 - RNA, 23 nt, Human
gcacagauggauuuguuuggacc

SEQ ID NO: 3635025 - RNA, 19 nt, Human
gcacagauggccagccccu

SEQ ID NO: 3635026 - RNA, 23 nt, Human
gcacagauggccagccccuuaga

SEQ ID NO: 3635027 - RNA, 23 nt, Human
gcacagcaaggaggcuggcuggg

SEQ ID NO: 3635028 - RNA, 22 nt, Human
gcacagcacaaauuaguuauau

SEQ ID NO: 3635029 - RNA, 12 nt, Human
gcacagcagccu

SEQ ID NO: 3635030 - RNA, 13 nt, Human
gcacagcaguucc

SEQ ID NO: 3635031 - RNA, 16 nt, Human
gcacagcaguuccgga

SEQ ID NO: 3635032 - RNA, 18 nt, Human
gcacagcaucucagcuca

SEQ ID NO: 3635033 - RNA, 22 nt, Human
gcacagcaugagaggcucugug

SEQ ID NO: 3635034 - RNA, 13 nt, Human
gcacagcccuccc

SEQ ID NO: 3635035 - RNA, 19 nt, Human
gcacagcccucccgccccu

SEQ ID NO: 3635036 - RNA, 23 nt, Human
gcacagccggggccugccuagca

SEQ ID NO: 3635037 - RNA, 15 nt, Human
gcacagccucuuaga

SEQ ID NO: 3635038 - RNA, 20 nt, Human
gcacagccucuuagaugcag

SEQ ID NO: 3635039 - RNA, 12 nt, Human
gcacagccuggc

SEQ ID NO: 3635040 - RNA, 19 nt, Human
gcacagccuggcuguggcc

SEQ ID NO: 3635041 - RNA, 13 nt, Human
gcacagcuaugaa

SEQ ID NO: 3635042 - RNA, 16 nt, Human
gcacagcuaugaaggc

SEQ ID NO: 3635043 - RNA, 15 nt, Human
gcacagcucaggagg

SEQ ID NO: 3635044 - RNA, 23 nt, Human
gcacagcucccugccaaacugaa

SEQ ID NO: 3635045 - RNA, 20 nt, Human
gcacagcucccuucuguuga

SEQ ID NO: 3635046 - RNA, 14 nt, Human
gcacagcugcucug

SEQ ID NO: 3635047 - RNA, 14 nt, Human
gcacagcuguggug

SEQ ID NO: 3635048 - RNA, 16 nt, Human
gcacagcuucauuucc

SEQ ID NO: 3635049 - RNA, 18 nt, Human
gcacagcuugaccugagg

SEQ ID NO: 3635050 - RNA, 22 nt, Human
gcacagcuugaccugaggcugu

SEQ ID NO: 3635051 - RNA, 15 nt, Human
gcacaggaaaaggua

SEQ ID NO: 3635052 - RNA, 18 nt, Human
gcacaggaaaagguagcu

SEQ ID NO: 3635053 - RNA, 21 nt, Human
gcacaggacugauucugggau

SEQ ID NO: 3635054 - RNA, 15 nt, Human
gcacaggagcuaccu

SEQ ID NO: 3635055 - RNA, 20 nt, Human
gcacaggagcuaccugugug

SEQ ID NO: 3635056 - RNA, 20 nt, Human
gcacaggaguguccucuucc

SEQ ID NO: 3635057 - RNA, 17 nt, Human
gcacaggaugcuggccu

SEQ ID NO: 3635058 - RNA, 14 nt, Human
gcacaggcagcugg

SEQ ID NO: 3635059 - RNA, 13 nt, Human
gcacaggcagggc

SEQ ID NO: 3635060 - RNA, 21 nt, Human
gcacaggcagggcaggaccag

SEQ ID NO: 3635061 - RNA, 13 nt, Human
gcacaggcugagu

SEQ ID NO: 3635062 - RNA, 21 nt, Human
gcacaggcugagugcaggccc

SEQ ID NO: 3635063 - RNA, 22 nt, Human
gcacaggcugagugcaggccca

SEQ ID NO: 3635064 - RNA, 23 nt, Human
gcacaggcugagugcaggcccac

SEQ ID NO: 3635065 - RNA, 22 nt, Human
gcacagggagugcacauaucca

SEQ ID NO: 3635066 - RNA, 16 nt, Human
gcacagggcagcuggg

SEQ ID NO: 3635067 - RNA, 16 nt, Human
gcacagggcaugaaau

SEQ ID NO: 3635068 - RNA, 21 nt, Human
gcacaggucaggggugacaca

SEQ ID NO: 3635069 - RNA, 21 nt, Human
gcacugccugcucccauccug

SEQ ID NO: 3635070 - RNA, 22 nt, Human
gcacugcuaggcgagugccagg

SEQ ID NO: 3635071 - RNA, 15 nt, Human
gcacugcucucaccu

SEQ ID NO: 3635072 - RNA, 15 nt, Human
gcacugcugcccagc

SEQ ID NO: 3635073 - RNA, 13 nt, Human
gcacugcugggug

SEQ ID NO: 3635074 - RNA, 14 nt, Human
gcacugcugggugg

SEQ ID NO: 3635075 - RNA, 22 nt, Human
gcacugcuggguggcccauccc

SEQ ID NO: 3635076 - RNA, 22 nt, Human
gcacugcugugcugugcccaag

SEQ ID NO: 3635077 - RNA, 14 nt, Human
gcacugcuuccagu

SEQ ID NO: 3635078 - RNA, 15 nt, Human
gcacugcuuccagug

SEQ ID NO: 3635079 - RNA, 17 nt, Human
gcacugcuugaggaaaa

SEQ ID NO: 3635080 - RNA, 15 nt, Human
gcacuggagugcagg

SEQ ID NO: 3635081 - RNA, 19 nt, Human
gcacuggcauugucccugu

SEQ ID NO: 3635082 - RNA, 15 nt, Human
gcacuggcgaggaga

SEQ ID NO: 3635083 - RNA, 15 nt, Human
gcacugggaucacag

SEQ ID NO: 3635084 - RNA, 22 nt, Human
gcacugggcuuggggaccagag

SEQ ID NO: 3635085 - RNA, 23 nt, Human
gcacugggcuuggggaccagagc

SEQ ID NO: 3635086 - RNA, 18 nt, Human
gcacuggggagcccgucu

SEQ ID NO: 3635087 - RNA, 22 nt, Human
gcacuggggagcccgucucagu

SEQ ID NO: 3635088 - RNA, 23 nt, Human
gcacuggggagcccgucucagug

SEQ ID NO: 3635089 - RNA, 23 nt, Human
gcacugguagguugggacaccag

SEQ ID NO: 3635090 - RNA, 17 nt, Human
gcacugguuuguucccu

SEQ ID NO: 3635091 - RNA, 9 nt, Human
gcacuguaa

SEQ ID NO: 3635092 - RNA, 13 nt, Human
gcacuguaaaaug

SEQ ID NO: 3635093 - RNA, 16 nt, Human
gcacuguaaaaugugg

SEQ ID NO: 3635094 - RNA, 23 nt, Human
gcacuguaaaaugugggauuaug

SEQ ID NO: 3635095 - RNA, 21 nt, Human
gcacuguacaaaaaaaucuuc

SEQ ID NO: 3635096 - RNA, 18 nt, Human
gcacuguaguucuaagac

SEQ ID NO: 3635097 - RNA, 19 nt, Human
gcacuguaguucuaagacu

SEQ ID NO: 3635098 - RNA, 15 nt, Human
gcacugucaagauga

SEQ ID NO: 3635099 - RNA, 21 nt, Human
gcacugucacuuugcucuggg

SEQ ID NO: 3635100 - RNA, 15 nt, Human
gcacuguccugcucc

SEQ ID NO: 3635101 - RNA, 19 nt, Human
gcacuguccugcuccacag

SEQ ID NO: 3635102 - RNA, 19 nt, Human
gcacugucucaguuucacu

SEQ ID NO: 3635103 - RNA, 16 nt, Human
gcacugucuuaaggca

SEQ ID NO: 3635104 - RNA, 16 nt, Human
gcacugugaaggaccc

SEQ ID NO: 3635105 - RNA, 14 nt, Human
gcacugugcuaaua

SEQ ID NO: 3635106 - RNA, 18 nt, Human
gcacugugcucagggcua

SEQ ID NO: 3635107 - RNA, 18 nt, Human
gcacuguggauuauuuca

SEQ ID NO: 3635108 - RNA, 13 nt, Human
gcacuguggccuu

SEQ ID NO: 3635109 - RNA, 19 nt, Human
gcacuguggguagacacac

SEQ ID NO: 3635110 - RNA, 21 nt, Human
gcacuguuccagccugcccuc

SEQ ID NO: 3635111 - RNA, 23 nt, Human
gcacuguuuucuaguguaucaaa

SEQ ID NO: 3635112 - RNA, 14 nt, Human
gcacuguuuuucca

SEQ ID NO: 3635113 - RNA, 22 nt, Human
gcacuuaaauaucaaucauuuu

SEQ ID NO: 3635114 - RNA, 22 nt, Human
gcacuuaagcacaagcagagug

SEQ ID NO: 3635115 - RNA, 18 nt, Human
gcacuuauuuaaugccga

SEQ ID NO: 3635116 - RNA, 13 nt, Human
gcacuucacagag

SEQ ID NO: 3635117 - RNA, 17 nt, Human
gcacuucaucuggcugc

SEQ ID NO: 3635118 - RNA, 12 nt, Human
gcacuucccugc

SEQ ID NO: 3635119 - RNA, 22 nt, Human
gcacuuccucucgcggcccuca

SEQ ID NO: 3635120 - RNA, 22 nt, Human
gcacuucgggaggucgaggcag

SEQ ID NO: 3635121 - RNA, 14 nt, Human
gcacuucugccuga

SEQ ID NO: 3635122 - RNA, 23 nt, Human
gcacuucuuuuucucgcuguccu

SEQ ID NO: 3635123 - RNA, 22 nt, Human
gcacuugcacgcccauguguga

SEQ ID NO: 3635124 - RNA, 15 nt, Human
gcacuugccuggguc

SEQ ID NO: 3635125 - RNA, 15 nt, Human
gcacuugcuggaaga

SEQ ID NO: 3635126 - RNA, 18 nt, Human
gcacuuggagacuuguau

SEQ ID NO: 3635127 - RNA, 13 nt, Human
gcacuuggagcca

SEQ ID NO: 3635128 - RNA, 13 nt, Human
gcacuuggcagcc

SEQ ID NO: 3635129 - RNA, 15 nt, Human
gcacuuggcugcaua

SEQ ID NO: 3635130 - RNA, 21 nt, Human
gcacuuggggcaccuugcucc

SEQ ID NO: 3635131 - RNA, 19 nt, Human
gcacuugggggcucagcaa

SEQ ID NO: 3635132 - RNA, 22 nt, Human
gcacuuggggguucaggcccgg

SEQ ID NO: 3635133 - RNA, 21 nt, Human
gcacuugucucauuuuaaugu

SEQ ID NO: 3635134 - RNA, 13 nt, Human
gcacuuuaaaaca

SEQ ID NO: 3635135 - RNA, 20 nt, Human
gcacuuuagggcuguaaaau

SEQ ID NO: 3635136 - RNA, 12 nt, Human
gcacuuuauccu

SEQ ID NO: 3635137 - RNA, 22 nt, Human
gcacuuucauugccagugucuu

SEQ ID NO: 3635138 - RNA, 23 nt, Human
gcacuuuccacuucuuccuuucu

SEQ ID NO: 3635139 - RNA, 23 nt, Human
gcacuuuccgucaacguuguacu

SEQ ID NO: 3635140 - RNA, 16 nt, Human
gcacuuucuaauguuu

SEQ ID NO: 3635141 - RNA, 17 nt, Human
gcacuuucuaauguuuc

SEQ ID NO: 3635142 - RNA, 18 nt, Human
gcacuuugaaauaccuca

SEQ ID NO: 3635143 - RNA, 23 nt, Human
gcacuuugacagcgcacagcugc

SEQ ID NO: 3635144 - RNA, 21 nt, Human
gcacuuugcuuuaauauaaau

SEQ ID NO: 3635145 - RNA, 17 nt, Human
gcacuuuggcuuauaau

SEQ ID NO: 3635146 - RNA, 22 nt, Human
gcacuuugggaggccgaggcgg

SEQ ID NO: 3635147 - RNA, 16 nt, Human
gcacuuugggaggcug

SEQ ID NO: 3635148 - RNA, 21 nt, Human
gcacuuugggaggcugaggcg

SEQ ID NO: 3635149 - RNA, 21 nt, Human
gcacuuugggaggcugaggug

SEQ ID NO: 3635150 - RNA, 11 nt, Human
gcacuuugggg

SEQ ID NO: 3635151 - RNA, 14 nt, Human
gcacuuuguaaauu

SEQ ID NO: 3635152 - RNA, 15 nt, Human
gcacuuuguaaauuc

SEQ ID NO: 3635153 - RNA, 18 nt, Human
gcacuuuguucuggcucu

SEQ ID NO: 3635154 - RNA, 19 nt, Human
gcacuuuguucuggcucuu

SEQ ID NO: 3635155 - RNA, 22 nt, Human
gcacuuuguucuggcucuucca

SEQ ID NO: 3635156 - RNA, 23 nt, Human
gcacuuuucuaaacuaggcuccu

SEQ ID NO: 3635157 - RNA, 16 nt, Human
gcacuuuuuaaaaaac

SEQ ID NO: 3635158 - RNA, 20 nt, Human
gcacuuuuucauuugccuau

SEQ ID NO: 3635159 - RNA, 12 nt, Human
gcagaaaacauu

SEQ ID NO: 3635160 - RNA, 21 nt, Human
gcagaaaacccuugggccaga

SEQ ID NO: 3635161 - RNA, 22 nt, Human
gcagaaaacccuugggccagaa

SEQ ID NO: 3635162 - RNA, 15 nt, Human
gcagaaaagcaccug

SEQ ID NO: 3635163 - RNA, 20 nt, Human
gcagaaaagcaccugccgac

SEQ ID NO: 3635164 - RNA, 14 nt, Human
gcagaaaauugcac

SEQ ID NO: 3635165 - RNA, 16 nt, Human
gcagaaagcagaggcu

SEQ ID NO: 3635166 - RNA, 21 nt, Human
gcagaaagcugugaacaggcu

SEQ ID NO: 3635167 - RNA, 17 nt, Human
gcagaaagggagcagag

SEQ ID NO: 3635168 - RNA, 18 nt, Human
gcagaaagguucugcccg

SEQ ID NO: 3635169 - RNA, 19 nt, Human
gcagaaagugccuuucagg

SEQ ID NO: 3635170 - RNA, 20 nt, Human
gcagaaagugccuuucagga

SEQ ID NO: 3635171 - RNA, 18 nt, Human
gcagaaauagguuagagu

SEQ ID NO: 3635172 - RNA, 15 nt, Human
gcagaaauucuguuu

SEQ ID NO: 3635173 - RNA, 13 nt, Human
gcagaacacuaac

SEQ ID NO: 3635174 - RNA, 15 nt, Human
gcagaacacuaaccu

SEQ ID NO: 3635175 - RNA, 22 nt, Human
gcagaacagugauuaccaggga

SEQ ID NO: 3635176 - RNA, 22 nt, Human
gcagaacgaaccuuggccuggg

SEQ ID NO: 3635177 - RNA, 13 nt, Human
gcagaacggagcc

SEQ ID NO: 3635178 - RNA, 24 nt, Human
gcagaacggagccccaggccucug

SEQ ID NO: 3635179 - RNA, 19 nt, Human
gcagaacuaaacucauuua

SEQ ID NO: 3635180 - RNA, 21 nt, Human
gcagaacugccauuauuuucu

SEQ ID NO: 3635181 - RNA, 23 nt, Human
gcagaacugccauuauuuucugu

SEQ ID NO: 3635182 - RNA, 16 nt, Human
gcagaagaaaggaaca

SEQ ID NO: 3635183 - RNA, 21 nt, Human
gcagaagaauugaacccagga

SEQ ID NO: 3635184 - RNA, 16 nt, Human
gcagaagacaaaaaga

SEQ ID NO: 3635185 - RNA, 15 nt, Human
gcagaagacaccaga

SEQ ID NO: 3635186 - RNA, 18 nt, Human
gcagaagacaccagagca

SEQ ID NO: 3635187 - RNA, 23 nt, Human
gcagaagacaguauggcagcuuu

SEQ ID NO: 3635188 - RNA, 14 nt, Human
gcagaagagggugu

SEQ ID NO: 3635189 - RNA, 13 nt, Human
gcagaagcauuaa

SEQ ID NO: 3635190 - RNA, 15 nt, Human
gcagaagcccugaug

SEQ ID NO: 3635191 - RNA, 13 nt, Human
gcagaagcucucg

SEQ ID NO: 3635192 - RNA, 15 nt, Human
gcagaaggaaaaaug

SEQ ID NO: 3635193 - RNA, 12 nt, Human
gcagaaggaaac

SEQ ID NO: 3635194 - RNA, 13 nt, Human
gcagaaggaagac

SEQ ID NO: 3635195 - RNA, 12 nt, Human
gcagaaggaagg

SEQ ID NO: 3635196 - RNA, 13 nt, Human
gcagaaggaaggc

SEQ ID NO: 3635197 - RNA, 15 nt, Human
gcagaaggaaggcag

SEQ ID NO: 3635198 - RNA, 22 nt, Human
gcagaaggaaggcagggaggag

SEQ ID NO: 3635199 - RNA, 20 nt, Human
gcagaagggagcuggcucca

SEQ ID NO: 3635200 - RNA, 14 nt, Human
gcagaagggggugg

SEQ ID NO: 3635201 - RNA, 15 nt, Human
gcagaaggggguggu

SEQ ID NO: 3635202 - RNA, 13 nt, Human
gcagaauaaagca

SEQ ID NO: 3635203 - RNA, 20 nt, Human
gcagaauaaagcaauuuucc

SEQ ID NO: 3635204 - RNA, 17 nt, Human
gcagaauccuggcccuc

SEQ ID NO: 3635205 - RNA, 19 nt, Human
gcagaauguaagugggccc

SEQ ID NO: 3635206 - RNA, 13 nt, Human
gcagaauucauuc

SEQ ID NO: 3635207 - RNA, 14 nt, Human
gcagaauucauuca

SEQ ID NO: 3635208 - RNA, 20 nt, Human
gcagaauuggaaaagacuaa

SEQ ID NO: 3635209 - RNA, 20 nt, Human
gcagacaauaaacccucaga

SEQ ID NO: 3635210 - RNA, 23 nt, Human
gcagacacagggacuugaaguug

SEQ ID NO: 3635211 - RNA, 19 nt, Human
gcagacacccuuggagcuc

SEQ ID NO: 3635212 - RNA, 15 nt, Human
gcagacaccuuggac

SEQ ID NO: 3635213 - RNA, 17 nt, Human
gccagauucuuuccuga

SEQ ID NO: 3635214 - RNA, 19 nt, Human
gccagauucuuuccugagg

SEQ ID NO: 3635215 - RNA, 14 nt, Human
gccagauuugucuu

SEQ ID NO: 3635216 - RNA, 22 nt, Human
gccagcaaagccccaugcugga

SEQ ID NO: 3635217 - RNA, 16 nt, Human
gccagcaacacagagc

SEQ ID NO: 3635218 - RNA, 12 nt, Human
gccagcaacgcu

SEQ ID NO: 3635219 - RNA, 15 nt, Human
gccagcaagguggag

SEQ ID NO: 3635220 - RNA, 18 nt, Human
gccagcaagguggagugg

SEQ ID NO: 3635221 - RNA, 23 nt, Human
gccagcaaugacaucucaggggc

SEQ ID NO: 3635222 - RNA, 17 nt, Human
gccagcacacagggcag

SEQ ID NO: 3635223 - RNA, 18 nt, Human
gccagcacacagggcagu

SEQ ID NO: 3635224 - RNA, 22 nt, Human
gccagcacacagggcagugagg

SEQ ID NO: 3635225 - RNA, 18 nt, Human
gccagcaccacuuccuuu

SEQ ID NO: 3635226 - RNA, 21 nt, Human
gccagcacccccacgcccuca

SEQ ID NO: 3635227 - RNA, 18 nt, Human
gccagcaccggaccagcc

SEQ ID NO: 3635228 - RNA, 20 nt, Human
gccagcaccggaccagccug

SEQ ID NO: 3635229 - RNA, 15 nt, Human
gccagcacuuguaua

SEQ ID NO: 3635230 - RNA, 16 nt, Human
gccagcacuuguauau

SEQ ID NO: 3635231 - RNA, 19 nt, Human
gccagcacuuguccagcug

SEQ ID NO: 3635232 - RNA, 16 nt, Human
gccagcagcaccugcc

SEQ ID NO: 3635233 - RNA, 15 nt, Human
gccagcagccagcuc

SEQ ID NO: 3635234 - RNA, 20 nt, Human
gccagcagccagcucucagc

SEQ ID NO: 3635235 - RNA, 22 nt, Human
gccagcagccagcucucagcca

SEQ ID NO: 3635236 - RNA, 23 nt, Human
gccagcagccagcucucagccaa

SEQ ID NO: 3635237 - RNA, 16 nt, Human
gccagcaggcucucag

SEQ ID NO: 3635238 - RNA, 15 nt, Human
gccagcaucugggcc

SEQ ID NO: 3635239 - RNA, 12 nt, Human
gccagccagcag

SEQ ID NO: 3635240 - RNA, 16 nt, Human
gccagccagcagccag

SEQ ID NO: 3635241 - RNA, 22 nt, Human
gccagccagugaccugaggaag

SEQ ID NO: 3635242 - RNA, 18 nt, Human
gccagccccacacagcua

SEQ ID NO: 3635243 - RNA, 14 nt, Human
gccagccccacagc

SEQ ID NO: 3635244 - RNA, 15 nt, Human
gccagccccacagcc

SEQ ID NO: 3635245 - RNA, 16 nt, Human
gccagccccacagccc

SEQ ID NO: 3635246 - RNA, 19 nt, Human
gccagccccacagcccacg

SEQ ID NO: 3635247 - RNA, 14 nt, Human
gccagccccaccca

SEQ ID NO: 3635248 - RNA, 15 nt, Human
gccagccccacccag

SEQ ID NO: 3635249 - RNA, 11 nt, Human
gccagccccuc

SEQ ID NO: 3635250 - RNA, 22 nt, Human
gccagccccuuagacagaggcc

SEQ ID NO: 3635251 - RNA, 15 nt, Human
gccagcccggcuggu

SEQ ID NO: 3635252 - RNA, 13 nt, Human
gccagcccucccu

SEQ ID NO: 3635253 - RNA, 23 nt, Human
gccagcccucccuguccuccucg

SEQ ID NO: 3635254 - RNA, 19 nt, Human
gccagcccugccuggagga

SEQ ID NO: 3635255 - RNA, 23 nt, Human
gccagcccugccuggaggaccug

SEQ ID NO: 3635256 - RNA, 21 nt, Human
gccagccgagcaggaggccua

SEQ ID NO: 3635257 - RNA, 20 nt, Human
gccagccgcgcaucagacug

SEQ ID NO: 3635258 - RNA, 20 nt, Human
gccagccgcucuccugccac

SEQ ID NO: 3635259 - RNA, 23 nt, Human
gccagccggggcgaguggcacgu

SEQ ID NO: 3635260 - RNA, 15 nt, Human
gccagccucagacug

SEQ ID NO: 3635261 - RNA, 21 nt, Human
gccagccuccgagagggagag

SEQ ID NO: 3635262 - RNA, 14 nt, Human
gccagccuccucug

SEQ ID NO: 3635263 - RNA, 15 nt, Human
gccagccuccucugg

SEQ ID NO: 3635264 - RNA, 17 nt, Human
gccagccuccucuggac

SEQ ID NO: 3635265 - RNA, 14 nt, Human
gccagccucgccca

SEQ ID NO: 3635266 - RNA, 13 nt, Human
gccagccugaccu

SEQ ID NO: 3635267 - RNA, 22 nt, Human
gccagccuggccuccugccucu

SEQ ID NO: 3635268 - RNA, 23 nt, Human
gccagccuggccuccugccucua

SEQ ID NO: 3635269 - RNA, 19 nt, Human
gccagccuggcuucuggag

SEQ ID NO: 3635270 - RNA, 14 nt, Human
gccagccuggggcc

SEQ ID NO: 3635271 - RNA, 18 nt, Human
gccagccuggggccuggc

SEQ ID NO: 3635272 - RNA, 19 nt, Human
gccagccuggggccuggca

SEQ ID NO: 3635273 - RNA, 21 nt, Human
gccagccugguccaugcaggg

SEQ ID NO: 3635274 - RNA, 16 nt, Human
gccagccuuccucugc

SEQ ID NO: 3635275 - RNA, 22 nt, Human
gccagccuuccucugcagcuga

SEQ ID NO: 3635276 - RNA, 22 nt, Human
gccagcgagcgcccagcuccug

SEQ ID NO: 3635277 - RNA, 15 nt, Human
gccagcgccucccuc

SEQ ID NO: 3635278 - RNA, 20 nt, Human
gccagcgccucccuccaccc

SEQ ID NO: 3635279 - RNA, 23 nt, Human
gccagcuacuuccuccuccccac

SEQ ID NO: 3635280 - RNA, 16 nt, Human
gccagcucagucccau

SEQ ID NO: 3635281 - RNA, 13 nt, Human
gccagcucccucu

SEQ ID NO: 3635282 - RNA, 14 nt, Human
gccagcucucagcc

SEQ ID NO: 3635283 - RNA, 23 nt, Human
gccagcucuguaucaggacccag

SEQ ID NO: 3635284 - RNA, 18 nt, Human
gccagcucuguucuuccu

SEQ ID NO: 3635285 - RNA, 13 nt, Human
gccagcucuuccu

SEQ ID NO: 3635286 - RNA, 18 nt, Human
gccagcugacaucuugaa

SEQ ID NO: 3635287 - RNA, 14 nt, Human
gccagcugcacuga

SEQ ID NO: 3635288 - RNA, 19 nt, Human
gccagcugcagcugggcug

SEQ ID NO: 3635289 - RNA, 19 nt, Human
gccagcugcccccagagcc

SEQ ID NO: 3635290 - RNA, 20 nt, Human
gccagcugccgaccagagcc

SEQ ID NO: 3635291 - RNA, 16 nt, Human
gccagcugcuccccag

SEQ ID NO: 3635292 - RNA, 16 nt, Human
gccagcugcugagccg

SEQ ID NO: 3635293 - RNA, 22 nt, Human
gccagcugcugagccgcagaga

SEQ ID NO: 3635294 - RNA, 14 nt, Human
gccagcugcuuggg

SEQ ID NO: 3635295 - RNA, 16 nt, Human
gccagcugcuugggcu

SEQ ID NO: 3635296 - RNA, 16 nt, Human
gccagcuggccuuugu

SEQ ID NO: 3635297 - RNA, 16 nt, Human
gccagcugggaucuga

SEQ ID NO: 3635298 - RNA, 21 nt, Human
gccagcugggaucugacugca

SEQ ID NO: 3635299 - RNA, 20 nt, Human
gccagcugugguuuucuuuu

SEQ ID NO: 3635300 - RNA, 18 nt, Human
gccagcuuggggccacca

SEQ ID NO: 3635301 - RNA, 18 nt, Human
gccagcuuguuauuuaua

SEQ ID NO: 3635302 - RNA, 16 nt, Human
gccagcuuguuuacau

SEQ ID NO: 3635303 - RNA, 15 nt, Human
gccagcuuucccugc

SEQ ID NO: 3635304 - RNA, 14 nt, Human
gccagcuuuucaaa

SEQ ID NO: 3635305 - RNA, 13 nt, Human
gccaggaagccag

SEQ ID NO: 3635306 - RNA, 17 nt, Human
gccaggaagccagcagg

SEQ ID NO: 3635307 - RNA, 19 nt, Human
gccaggaagccagcaggcu

SEQ ID NO: 3635308 - RNA, 20 nt, Human
gccaggaagccagcaggcuc

SEQ ID NO: 3635309 - RNA, 17 nt, Human
gccaggaaguagcacag

SEQ ID NO: 3635310 - RNA, 20 nt, Human
gccaggaaguagcacaggcu

SEQ ID NO: 3635311 - RNA, 15 nt, Human
gccaggacaccgggc

SEQ ID NO: 3635312 - RNA, 20 nt, Human
gccaggacaccgggcagggc

SEQ ID NO: 3635313 - RNA, 23 nt, Human
gccaggaccagucccagagcagg

SEQ ID NO: 3635314 - RNA, 17 nt, Human
gccaggaccgccaaaga

SEQ ID NO: 3635315 - RNA, 18 nt, Human
gccaggacucugcagccu

SEQ ID NO: 3635316 - RNA, 19 nt, Human
gccaggacucugcagccuc

SEQ ID NO: 3635317 - RNA, 20 nt, Human
gccaggacucugcagccuca

SEQ ID NO: 3635318 - RNA, 21 nt, Human
gccaggacucugcagccucag

SEQ ID NO: 3635319 - RNA, 19 nt, Human
gccaggacugagccccgca

SEQ ID NO: 3635320 - RNA, 14 nt, Human
gccaggagaagcuc

SEQ ID NO: 3635321 - RNA, 20 nt, Human
gccaggagcaaauguuucug

SEQ ID NO: 3635322 - RNA, 16 nt, Human
gccaggagccuccugc

SEQ ID NO: 3635323 - RNA, 20 nt, Human
gccaggagccuccugcccuu

SEQ ID NO: 3635324 - RNA, 22 nt, Human
gccaggagcugggcagaaggcc

SEQ ID NO: 3635325 - RNA, 19 nt, Human
gccaggaggacccagggcu

SEQ ID NO: 3635326 - RNA, 22 nt, Human
gccaggaggacccagggcucug

SEQ ID NO: 3635327 - RNA, 23 nt, Human
gccaggagggacaaaggagccug

SEQ ID NO: 3635328 - RNA, 17 nt, Human
gccaggaucauggugua

SEQ ID NO: 3635329 - RNA, 20 nt, Human
gccaggauggaacacggcca

SEQ ID NO: 3635330 - RNA, 16 nt, Human
gccaggauggcgcagg

SEQ ID NO: 3635331 - RNA, 17 nt, Human
gccaggcacacacugug

SEQ ID NO: 3635332 - RNA, 17 nt, Human
gccaggcacaggcaggg

SEQ ID NO: 3635333 - RNA, 19 nt, Human
gccaggcacaggcagggca

SEQ ID NO: 3635334 - RNA, 19 nt, Human
gccaggcacccccuggaga

SEQ ID NO: 3635335 - RNA, 19 nt, Human
gccaggcaggcgggcgcca

SEQ ID NO: 3635336 - RNA, 16 nt, Human
gccaggcagggguggg

SEQ ID NO: 3635337 - RNA, 14 nt, Human
gccaggcauguggc

SEQ ID NO: 3635338 - RNA, 13 nt, Human
gccaggccacaag

SEQ ID NO: 3635339 - RNA, 23 nt, Human
gccaggccacaagacccuugugg

SEQ ID NO: 3635340 - RNA, 16 nt, Human
gccaggccaccaggau

SEQ ID NO: 3635341 - RNA, 15 nt, Human
gccaggccagaggga

SEQ ID NO: 3635342 - RNA, 22 nt, Human
gccaggccagagggagugacag

SEQ ID NO: 3635343 - RNA, 12 nt, Human
gccaggccagcu

SEQ ID NO: 3635344 - RNA, 20 nt, Human
gccaggcccccaccacacau

SEQ ID NO: 3635345 - RNA, 22 nt, Human
gccaggcccccaccacacaucc

SEQ ID NO: 3635346 - RNA, 16 nt, Human
gccaggcccggggcug

SEQ ID NO: 3635347 - RNA, 17 nt, Human
gccaggcccggggcugg

SEQ ID NO: 3635348 - RNA, 14 nt, Human
gccaggcccucugc

SEQ ID NO: 3635349 - RNA, 20 nt, Human
gccaggcccucugcccacuc

SEQ ID NO: 3635350 - RNA, 21 nt, Human
gccaggcccucugcccacucc

SEQ ID NO: 3635351 - RNA, 21 nt, Human
gccaggcccuugucggcccca

SEQ ID NO: 3635352 - RNA, 23 nt, Human
gccaggccggcgagcccugugga

SEQ ID NO: 3635353 - RNA, 13 nt, Human
gccaggccgggaa

SEQ ID NO: 3635354 - RNA, 13 nt, Human
gccaggccgggcc

SEQ ID NO: 3635355 - RNA, 21 nt, Human
gccaggccgggccuguacagu

SEQ ID NO: 3635356 - RNA, 15 nt, Human
gcccaggccaggacu

SEQ ID NO: 3635357 - RNA, 20 nt, Human
gcccaggccaggacucugca

SEQ ID NO: 3635358 - RNA, 21 nt, Human
gcccaggccaggacucugcag

SEQ ID NO: 3635359 - RNA, 24 nt, Human
gcccaggccaggacucugcagccu

SEQ ID NO: 3635360 - RNA, 12 nt, Human
gcccaggccccu

SEQ ID NO: 3635361 - RNA, 18 nt, Human
gcccaggccccugccacc

SEQ ID NO: 3635362 - RNA, 23 nt, Human
gcccaggccccugccacccuggg

SEQ ID NO: 3635363 - RNA, 14 nt, Human
gcccaggccucacc

SEQ ID NO: 3635364 - RNA, 15 nt, Human
gcccaggccuccagc

SEQ ID NO: 3635365 - RNA, 17 nt, Human
gcccaggccuccuacag

SEQ ID NO: 3635366 - RNA, 12 nt, Human
gcccaggcucca

SEQ ID NO: 3635367 - RNA, 19 nt, Human
gcccaggcucggccugccc

SEQ ID NO: 3635368 - RNA, 13 nt, Human
gcccaggcugccg

SEQ ID NO: 3635369 - RNA, 16 nt, Human
gcccaggcugccgucc

SEQ ID NO: 3635370 - RNA, 14 nt, Human
gcccaggcuggcca

SEQ ID NO: 3635371 - RNA, 15 nt, Human
gcccaggcuggccag

SEQ ID NO: 3635372 - RNA, 17 nt, Human
gcccaggcuggccagcc

SEQ ID NO: 3635373 - RNA, 18 nt, Human
gcccaggcuggccagccc

SEQ ID NO: 3635374 - RNA, 13 nt, Human
gcccaggcuggga

SEQ ID NO: 3635375 - RNA, 19 nt, Human
gcccaggcuuagucacuga

SEQ ID NO: 3635376 - RNA, 21 nt, Human
gcccaggcuuagucacugaga

SEQ ID NO: 3635377 - RNA, 23 nt, Human
gcccaggcuuagucacugagaca

SEQ ID NO: 3635378 - RNA, 18 nt, Human
gcccagggacaccagcca

SEQ ID NO: 3635379 - RNA, 19 nt, Human
gcccagggacaccagccag

SEQ ID NO: 3635380 - RNA, 22 nt, Human
gcccagggacaccagccaggcu

SEQ ID NO: 3635381 - RNA, 23 nt, Human
gcccagggacaccagccaggcuc

SEQ ID NO: 3635382 - RNA, 16 nt, Human
gcccagggagcggaaa

SEQ ID NO: 3635383 - RNA, 23 nt, Human
gcccagggagcggaaagcagcuc

SEQ ID NO: 3635384 - RNA, 13 nt, Human
gcccagggaggcc

SEQ ID NO: 3635385 - RNA, 18 nt, Human
gcccagggcaagcuccgc

SEQ ID NO: 3635386 - RNA, 19 nt, Human
gcccagggcaagcuccgca

SEQ ID NO: 3635387 - RNA, 14 nt, Human
gcccagggcaucug

SEQ ID NO: 3635388 - RNA, 18 nt, Human
gcccagggccacucugcc

SEQ ID NO: 3635389 - RNA, 19 nt, Human
gcccagggccacucugccu

SEQ ID NO: 3635390 - RNA, 22 nt, Human
gcccagggccacucugccucug

SEQ ID NO: 3635391 - RNA, 21 nt, Human
gcccagggcccagagcccagc

SEQ ID NO: 3635392 - RNA, 23 nt, Human
gcccagggcccagagcccagcuc

SEQ ID NO: 3635393 - RNA, 14 nt, Human
gcccagggcucagc

SEQ ID NO: 3635394 - RNA, 18 nt, Human
gcccagggcucagccugg

SEQ ID NO: 3635395 - RNA, 12 nt, Human
gcccagggcucc

SEQ ID NO: 3635396 - RNA, 14 nt, Human
gcccagggcuccug

SEQ ID NO: 3635397 - RNA, 16 nt, Human
gcccagggcuccugca

SEQ ID NO: 3635398 - RNA, 16 nt, Human
gcccaggggagcccuc

SEQ ID NO: 3635399 - RNA, 20 nt, Human
gcccagggggcuuccugagg

SEQ ID NO: 3635400 - RNA, 14 nt, Human
gcccaggggugccc

SEQ ID NO: 3635401 - RNA, 20 nt, Human
gcccaggggugcccccuccu

SEQ ID NO: 3635402 - RNA, 17 nt, Human
gcccaggguucccccag

SEQ ID NO: 3635403 - RNA, 15 nt, Human
gcccagguccucuga

SEQ ID NO: 3635404 - RNA, 14 nt, Human
gcccaguacauuua

SEQ ID NO: 3635405 - RNA, 17 nt, Human
gcccaguagaccuuguu

SEQ ID NO: 3635406 - RNA, 17 nt, Human
gcccagucccccaaccc

SEQ ID NO: 3635407 - RNA, 18 nt, Human
gcccaguccuggccuggc

SEQ ID NO: 3635408 - RNA, 18 nt, Human
gcccagucuuucaugugu

SEQ ID NO: 3635409 - RNA, 22 nt, Human
gcccagugcacuugcuggaaga

SEQ ID NO: 3635410 - RNA, 18 nt, Human
gcccaguguuguuuguaa

SEQ ID NO: 3635411 - RNA, 15 nt, Human
gcccaguuaaucuug

SEQ ID NO: 3635412 - RNA, 21 nt, Human
gcccaguuucugccucugagg

SEQ ID NO: 3635413 - RNA, 15 nt, Human
gcccauacucagccu

SEQ ID NO: 3635414 - RNA, 22 nt, Human
gcccauagaaacaugacacuga

SEQ ID NO: 3635415 - RNA, 23 nt, Human
gcccauagaaacaugacacugac

SEQ ID NO: 3635416 - RNA, 22 nt, Human
gcccauaugcuaccaccagcug

SEQ ID NO: 3635417 - RNA, 23 nt, Human
gcccauaugcuaccaccagcugu

SEQ ID NO: 3635418 - RNA, 15 nt, Human
gcccauauuuuacuu

SEQ ID NO: 3635419 - RNA, 22 nt, Human
gcccauauuuuacuuggaaaua

SEQ ID NO: 3635420 - RNA, 21 nt, Human
gcccaucaggguaggcuggag

SEQ ID NO: 3635421 - RNA, 21 nt, Human
gcccaucaguguacccccgcc

SEQ ID NO: 3635422 - RNA, 12 nt, Human
gcccaucccccc

SEQ ID NO: 3635423 - RNA, 14 nt, Human
gcccauccccuuga

SEQ ID NO: 3635424 - RNA, 14 nt, Human
gcccaucccugccu

SEQ ID NO: 3635425 - RNA, 18 nt, Human
gcccaucccugccugguc

SEQ ID NO: 3635426 - RNA, 19 nt, Human
gcccauccuguggucacug

SEQ ID NO: 3635427 - RNA, 12 nt, Human
gcccauccuucc

SEQ ID NO: 3635428 - RNA, 13 nt, Human
gcccauccuuccc

SEQ ID NO: 3635429 - RNA, 17 nt, Human
gcccaucgugaagaagc

SEQ ID NO: 3635430 - RNA, 19 nt, Human
gcccaucgugaagaagccu

SEQ ID NO: 3635431 - RNA, 17 nt, Human
gcccaucucccugcuuu

SEQ ID NO: 3635432 - RNA, 18 nt, Human
gcccaucucccugcuuug

SEQ ID NO: 3635433 - RNA, 16 nt, Human
gcccaucuugccucca

SEQ ID NO: 3635434 - RNA, 19 nt, Human
gcccaugagagcgcagccc

SEQ ID NO: 3635435 - RNA, 17 nt, Human
gcccaugaguccuugaa

SEQ ID NO: 3635436 - RNA, 16 nt, Human
gcccaugccaccgcuu

SEQ ID NO: 3635437 - RNA, 13 nt, Human
gcccaugcccacc

SEQ ID NO: 3635438 - RNA, 14 nt, Human
gcccaugcccaccu

SEQ ID NO: 3635439 - RNA, 19 nt, Human
gcccaugcccaccugccca

SEQ ID NO: 3635440 - RNA, 19 nt, Human
gcccauggacaggcuggcu

SEQ ID NO: 3635441 - RNA, 13 nt, Human
gcccauggagauu

SEQ ID NO: 3635442 - RNA, 21 nt, Human
gcccauggagauugaccugga

SEQ ID NO: 3635443 - RNA, 22 nt, Human
gcccauggcccucccaguaccu

SEQ ID NO: 3635444 - RNA, 20 nt, Human
gcccaugggagcugguuaga

SEQ ID NO: 3635445 - RNA, 22 nt, Human
gcccaugggcacugcugggugg

SEQ ID NO: 3635446 - RNA, 21 nt, Human
gcccaugguugagaaaugaau

SEQ ID NO: 3635447 - RNA, 20 nt, Human
gcccaugucgcgcucagcau

SEQ ID NO: 3635448 - RNA, 23 nt, Human
gcccauguuaaguccucccugac

SEQ ID NO: 3635449 - RNA, 19 nt, Human
gcccauguucugcccccag

SEQ ID NO: 3635450 - RNA, 23 nt, Human
gcccauguucugcccccagccca

SEQ ID NO: 3635451 - RNA, 19 nt, Human
gcccauucauuccauucug

SEQ ID NO: 3635452 - RNA, 17 nt, Human
gcccauucuacuugcuc

SEQ ID NO: 3635453 - RNA, 19 nt, Human
gcccauucuacuugcucug

SEQ ID NO: 3635454 - RNA, 20 nt, Human
gcccauucuacuugcucugg

SEQ ID NO: 3635455 - RNA, 21 nt, Human
gcccauucuacuugcucugga

SEQ ID NO: 3635456 - RNA, 22 nt, Human
gcccauucuacuugcucuggac

SEQ ID NO: 3635457 - RNA, 19 nt, Human
gcccauucucucuccuguc

SEQ ID NO: 3635458 - RNA, 20 nt, Human
gcccauucucucuccugucc

SEQ ID NO: 3635459 - RNA, 21 nt, Human
gcccauucucucuccugucca

SEQ ID NO: 3635460 - RNA, 20 nt, Human
gcccauuucaauucucaaaa

SEQ ID NO: 3635461 - RNA, 11 nt, Human
gcccauuucau

SEQ ID NO: 3635462 - RNA, 18 nt, Human
gcccauuucuccagaacc

SEQ ID NO: 3635463 - RNA, 18 nt, Human
gcccauuuggagggccug

SEQ ID NO: 3635464 - RNA, 19 nt, Human
gcccauuugggcagagagg

SEQ ID NO: 3635465 - RNA, 21 nt, Human
gccccaaaaccacagcccugu

SEQ ID NO: 3635466 - RNA, 22 nt, Human
gccccaaaaccacagcccuguc

SEQ ID NO: 3635467 - RNA, 17 nt, Human
gccccaaacaaauaugc

SEQ ID NO: 3635468 - RNA, 20 nt, Human
gccccaaauaacuucagucc

SEQ ID NO: 3635469 - RNA, 12 nt, Human
gccccaaauaua

SEQ ID NO: 3635470 - RNA, 16 nt, Human
gccccaacccccagca

SEQ ID NO: 3635471 - RNA, 17 nt, Human
gccccaacccccagcac

SEQ ID NO: 3635472 - RNA, 17 nt, Human
gccccaacccguggagg

SEQ ID NO: 3635473 - RNA, 17 nt, Human
gccccaacccuucuuca

SEQ ID NO: 3635474 - RNA, 14 nt, Human
gccccaacuccugg

SEQ ID NO: 3635475 - RNA, 16 nt, Human
gccccaacuccuggaa

SEQ ID NO: 3635476 - RNA, 18 nt, Human
gccccaacuccuggaagc

SEQ ID NO: 3635477 - RNA, 22 nt, Human
gccccaacuccuggaagcugug

SEQ ID NO: 3635478 - RNA, 14 nt, Human
gccccaacuccuuc

SEQ ID NO: 3635479 - RNA, 21 nt, Human
gccccaacucuccccugaccu

SEQ ID NO: 3635480 - RNA, 19 nt, Human
gccccaagggguuucuguu

SEQ ID NO: 3635481 - RNA, 19 nt, Human
gccccaagguuuacauagu

SEQ ID NO: 3635482 - RNA, 13 nt, Human
gccccaaguccug

SEQ ID NO: 3635483 - RNA, 15 nt, Human
gccccaaguccugaa

SEQ ID NO: 3635484 - RNA, 13 nt, Human
gccccaauuuucu

SEQ ID NO: 3635485 - RNA, 20 nt, Human
gccccacacggaggcaucug

SEQ ID NO: 3635486 - RNA, 18 nt, Human
gccccacagcccacgucc

SEQ ID NO: 3635487 - RNA, 18 nt, Human
gccccacagccccaucug

SEQ ID NO: 3635488 - RNA, 23 nt, Human
gccccacagucuccggccucucc

SEQ ID NO: 3635489 - RNA, 13 nt, Human
gccccaccaccua

SEQ ID NO: 3635490 - RNA, 15 nt, Human
gccccaccaccuagg

SEQ ID NO: 3635491 - RNA, 15 nt, Human
gccccaccagugccu

SEQ ID NO: 3635492 - RNA, 22 nt, Human
gccccaccagugccucucccug

SEQ ID NO: 3635493 - RNA, 22 nt, Human
gccccacccagaugggggaaag

SEQ ID NO: 3635494 - RNA, 21 nt, Human
gccccaccccagggcagccag

SEQ ID NO: 3635495 - RNA, 17 nt, Human
gccccaccccagguccu

SEQ ID NO: 3635496 - RNA, 20 nt, Human
gccccacccucguggacacc

SEQ ID NO: 3635497 - RNA, 22 nt, Human
gccccacccucguggacaccug

SEQ ID NO: 3635498 - RNA, 15 nt, Human
gccccacccugggcc

SEQ ID NO: 3635499 - RNA, 19 nt, Human
gccuuggauaaugcuguug

SEQ ID NO: 3635500 - RNA, 11 nt, Human
gccuuggccug

SEQ ID NO: 3635501 - RNA, 15 nt, Human
gccuuggccuggagc

SEQ ID NO: 3635502 - RNA, 16 nt, Human
gccuuggccuggagca

SEQ ID NO: 3635503 - RNA, 22 nt, Human
gccuugggauccaggccccucc

SEQ ID NO: 3635504 - RNA, 17 nt, Human
gccuugggcccucuggu

SEQ ID NO: 3635505 - RNA, 22 nt, Human
gccuugggcuccgugugggaga

SEQ ID NO: 3635506 - RNA, 16 nt, Human
gccuugggcucugcug

SEQ ID NO: 3635507 - RNA, 18 nt, Human
gccuugguguccaccugg

SEQ ID NO: 3635508 - RNA, 21 nt, Human
gccuugguguccaccuggccc

SEQ ID NO: 3635509 - RNA, 18 nt, Human
gccuugguucccuugugu

SEQ ID NO: 3635510 - RNA, 17 nt, Human
gccuugguuuuuacugc

SEQ ID NO: 3635511 - RNA, 23 nt, Human
gccuugguuuuuacugcucugag

SEQ ID NO: 3635512 - RNA, 19 nt, Human
gccuuguauaauauugaaa

SEQ ID NO: 3635513 - RNA, 16 nt, Human
gccuugucacgccaga

SEQ ID NO: 3635514 - RNA, 18 nt, Human
gccuuguccccugccugu

SEQ ID NO: 3635515 - RNA, 19 nt, Human
gccuugucuccuacuccug

SEQ ID NO: 3635516 - RNA, 12 nt, Human
gccuuguguaca

SEQ ID NO: 3635517 - RNA, 15 nt, Human
gccuugugucuacag

SEQ ID NO: 3635518 - RNA, 12 nt, Human
gccuuguucugu

SEQ ID NO: 3635519 - RNA, 15 nt, Human
gccuuguugaugugg

SEQ ID NO: 3635520 - RNA, 17 nt, Human
gccuuuaaaucugugau

SEQ ID NO: 3635521 - RNA, 16 nt, Human
gccuuuacugacccug

SEQ ID NO: 3635522 - RNA, 14 nt, Human
gccuuuagaaaaua

SEQ ID NO: 3635523 - RNA, 21 nt, Human
gccuuuagugaucacagcagc

SEQ ID NO: 3635524 - RNA, 23 nt, Human
gccuuuauuuuuggcguggcuga

SEQ ID NO: 3635525 - RNA, 15 nt, Human
gccuuucaaauuuag

SEQ ID NO: 3635526 - RNA, 18 nt, Human
gccuuucagcaggcagcc

SEQ ID NO: 3635527 - RNA, 22 nt, Human
gccuuucauuuugcuuuaauuu

SEQ ID NO: 3635528 - RNA, 21 nt, Human
gccuuuccauccauggccagc

SEQ ID NO: 3635529 - RNA, 21 nt, Human
gccuuucccaccgcccucccu

SEQ ID NO: 3635530 - RNA, 17 nt, Human
gccuuuccuguagccuu

SEQ ID NO: 3635531 - RNA, 15 nt, Human
gccuuucgaggccug

SEQ ID NO: 3635532 - RNA, 16 nt, Human
gccuuucgaggccuga

SEQ ID NO: 3635533 - RNA, 19 nt, Human
gccuuucgaggccugaagc

SEQ ID NO: 3635534 - RNA, 18 nt, Human
gccuuucucccaggccag

SEQ ID NO: 3635535 - RNA, 23 nt, Human
gccuuucucccaggccaggcucc

SEQ ID NO: 3635536 - RNA, 19 nt, Human
gccuuucucgauuuuaucu

SEQ ID NO: 3635537 - RNA, 14 nt, Human
gccuuucugcaguu

SEQ ID NO: 3635538 - RNA, 15 nt, Human
gccuuugaauguuaa

SEQ ID NO: 3635539 - RNA, 20 nt, Human
gccuuugaauguuaauuuuu

SEQ ID NO: 3635540 - RNA, 12 nt, Human
gccuuugacauu

SEQ ID NO: 3635541 - RNA, 13 nt, Human
gccuuugacauuu

SEQ ID NO: 3635542 - RNA, 16 nt, Human
gccuuugaccugccuc

SEQ ID NO: 3635543 - RNA, 14 nt, Human
gccuuugagacagu

SEQ ID NO: 3635544 - RNA, 23 nt, Human
gccuuugagcccacaaagccuua

SEQ ID NO: 3635545 - RNA, 22 nt, Human
gccuuugaguuuccucaggcug

SEQ ID NO: 3635546 - RNA, 23 nt, Human
gccuuugccaccaacuggcccuc

SEQ ID NO: 3635547 - RNA, 18 nt, Human
gccuuugcgcuccuggcc

SEQ ID NO: 3635548 - RNA, 23 nt, Human
gccuuugcgcuccuggcccagcc

SEQ ID NO: 3635549 - RNA, 22 nt, Human
gccuuuggaaacagcucgacuu

SEQ ID NO: 3635550 - RNA, 20 nt, Human
gccuuuggaugaccagaaca

SEQ ID NO: 3635551 - RNA, 15 nt, Human
gccuuuggcaggugc

SEQ ID NO: 3635552 - RNA, 15 nt, Human
gccuuuggcucugga

SEQ ID NO: 3635553 - RNA, 13 nt, Human
gccuuuggcuuca

SEQ ID NO: 3635554 - RNA, 13 nt, Human
gccuuugggaaau

SEQ ID NO: 3635555 - RNA, 15 nt, Human
gccuuugggagcagg

SEQ ID NO: 3635556 - RNA, 17 nt, Human
gccuuugggugcuguuu

SEQ ID NO: 3635557 - RNA, 11 nt, Human
gccuuuguaac

SEQ ID NO: 3635558 - RNA, 17 nt, Human
gccuuuguaagugcagg

SEQ ID NO: 3635559 - RNA, 19 nt, Human
gccuuuguuccccacugga

SEQ ID NO: 3635560 - RNA, 20 nt, Human
gccuuuguuccccacuggag

SEQ ID NO: 3635561 - RNA, 18 nt, Human
gccuuuuauaaaccucua

SEQ ID NO: 3635562 - RNA, 13 nt, Human
gccuuuucccucu

SEQ ID NO: 3635563 - RNA, 16 nt, Human
gccuuuugacuuucau

SEQ ID NO: 3635564 - RNA, 17 nt, Human
gccuuuugcaccccucc

SEQ ID NO: 3635565 - RNA, 14 nt, Human
gccuuuuucauuua

SEQ ID NO: 3635566 - RNA, 17 nt, Human
gccuuuuuguuucaaug

SEQ ID NO: 3635567 - RNA, 19 nt, Human
gccuuuuuucacggaaguu

SEQ ID NO: 3635568 - RNA, 13 nt, Human
gccuuuuuucccc

SEQ ID NO: 3635569 - RNA, 17 nt, Human
gcgaaaucccugcucac

SEQ ID NO: 3635570 - RNA, 18 nt, Human
gcgaaaucccugcucacu

SEQ ID NO: 3635571 - RNA, 16 nt, Human
gcgaaggggcccuggu

SEQ ID NO: 3635572 - RNA, 14 nt, Human
gcgaaucauuuguu

SEQ ID NO: 3635573 - RNA, 13 nt, Human
gcgaauccaagcu

SEQ ID NO: 3635574 - RNA, 18 nt, Human
gcgaauccaagcucccug

SEQ ID NO: 3635575 - RNA, 15 nt, Human
gcgaauuuuaaaaga

SEQ ID NO: 3635576 - RNA, 20 nt, Human
gcgacaaugcaaaccaucau

SEQ ID NO: 3635577 - RNA, 22 nt, Human
gcgacagugagacucugucuca

SEQ ID NO: 3635578 - RNA, 18 nt, Human
gcgacaucucugacuuuc

SEQ ID NO: 3635579 - RNA, 18 nt, Human
gcgacauuagcauaaaca

SEQ ID NO: 3635580 - RNA, 15 nt, Human
gcgaccaccccugcc

SEQ ID NO: 3635581 - RNA, 20 nt, Human
gcgaccccaucugcccagga

SEQ ID NO: 3635582 - RNA, 23 nt, Human
gcgaccucuccaucuucagcuuc

SEQ ID NO: 3635583 - RNA, 15 nt, Human
gcgaccuuccucauc

SEQ ID NO: 3635584 - RNA, 13 nt, Human
gcgacuaauuuca

SEQ ID NO: 3635585 - RNA, 21 nt, Human
gcgacuaauuucaaaaugcuu

SEQ ID NO: 3635586 - RNA, 17 nt, Human
gcgacuuucugccugga

SEQ ID NO: 3635587 - RNA, 16 nt, Human
gcgagacucugucuca

SEQ ID NO: 3635588 - RNA, 16 nt, Human
gcgagaggaggggccc

SEQ ID NO: 3635589 - RNA, 19 nt, Human
gcgagauaccccaccuccc

SEQ ID NO: 3635590 - RNA, 16 nt, Human
gcgagcauccuggcca

SEQ ID NO: 3635591 - RNA, 18 nt, Human
gcgagcaugucguggaca

SEQ ID NO: 3635592 - RNA, 15 nt, Human
gcgagcccugguggc

SEQ ID NO: 3635593 - RNA, 17 nt, Human
gcgaggaggcuccagag

SEQ ID NO: 3635594 - RNA, 12 nt, Human
gcgaggcagagg

SEQ ID NO: 3635595 - RNA, 14 nt, Human
gcgaggcagaggac

SEQ ID NO: 3635596 - RNA, 13 nt, Human
gcgagggcagcug

SEQ ID NO: 3635597 - RNA, 14 nt, Human
gcgagggcagcugc

SEQ ID NO: 3635598 - RNA, 18 nt, Human
gcgaggucaacagagaag

SEQ ID NO: 3635599 - RNA, 22 nt, Human
gcgaguauguguuugugugugu

SEQ ID NO: 3635600 - RNA, 15 nt, Human
gcgagucacugccuc

SEQ ID NO: 3635601 - RNA, 21 nt, Human
gcgagugccaggacuccccag

SEQ ID NO: 3635602 - RNA, 13 nt, Human
gcgauagagucuc

SEQ ID NO: 3635603 - RNA, 18 nt, Human
gcgaucauggcucacugc

SEQ ID NO: 3635604 - RNA, 16 nt, Human
gcgauccaccugucuc

SEQ ID NO: 3635605 - RNA, 17 nt, Human
gcgauccaccugucuca

SEQ ID NO: 3635606 - RNA, 21 nt, Human
gcgauccaccugucucagccu

SEQ ID NO: 3635607 - RNA, 20 nt, Human
gcgaucccacacaggcuggc

SEQ ID NO: 3635608 - RNA, 17 nt, Human
gcgaucucggcucacug

SEQ ID NO: 3635609 - RNA, 12 nt, Human
gcgaugggucag

SEQ ID NO: 3635610 - RNA, 15 nt, Human
gcgauggucucagaa

SEQ ID NO: 3635611 - RNA, 13 nt, Human
gcgauguggaacu

SEQ ID NO: 3635612 - RNA, 19 nt, Human
gcgauguggaacugcugcc

SEQ ID NO: 3635613 - RNA, 14 nt, Human
gcgauucccucucc

SEQ ID NO: 3635614 - RNA, 13 nt, Human
gcgauucuccugc

SEQ ID NO: 3635615 - RNA, 23 nt, Human
gcgauucuccugccucagccucc

SEQ ID NO: 3635616 - RNA, 14 nt, Human
gcgauucuucugcu

SEQ ID NO: 3635617 - RNA, 18 nt, Human
gcgcaagggaggcccagc

SEQ ID NO: 3635618 - RNA, 20 nt, Human
gcgcacaauaguaaccuggg

SEQ ID NO: 3635619 - RNA, 19 nt, Human
gcgcacacacacacauaca

SEQ ID NO: 3635620 - RNA, 21 nt, Human
gcgcacccuccccucccgucu

SEQ ID NO: 3635621 - RNA, 18 nt, Human
gcgcaccugcccccuggu

SEQ ID NO: 3635622 - RNA, 14 nt, Human
gcgcagccccaucu

SEQ ID NO: 3635623 - RNA, 15 nt, Human
gcgcagccccaucug

SEQ ID NO: 3635624 - RNA, 19 nt, Human
gcgcagccccaucugugca

SEQ ID NO: 3635625 - RNA, 16 nt, Human
gcgcaggcuggcccug

SEQ ID NO: 3635626 - RNA, 22 nt, Human
gcgcaggcuggcccugcccugg

SEQ ID NO: 3635627 - RNA, 18 nt, Human
gcgcaggugggcuggacu

SEQ ID NO: 3635628 - RNA, 22 nt, Human
gcgcagugcuucucuacagacu

SEQ ID NO: 3635629 - RNA, 15 nt, Human
gcgcaguggcccuga

SEQ ID NO: 3635630 - RNA, 18 nt, Human
gcgcaguggcccugagca

SEQ ID NO: 3635631 - RNA, 18 nt, Human
gcgcaguguggaggccac

SEQ ID NO: 3635632 - RNA, 20 nt, Human
gcgcauccaaucucaaggaa

SEQ ID NO: 3635633 - RNA, 21 nt, Human
gcgcauccaaucucaaggaau

SEQ ID NO: 3635634 - RNA, 22 nt, Human
gcgcaugucacggagggugacg

SEQ ID NO: 3635635 - RNA, 19 nt, Human
gcgcauucuaaccuggagg

SEQ ID NO: 3635636 - RNA, 14 nt, Human
gcgccaagcaaccu

SEQ ID NO: 3635637 - RNA, 15 nt, Human
gcgccaccagcucug

SEQ ID NO: 3635638 - RNA, 14 nt, Human
gcgccaccauccug

SEQ ID NO: 3635639 - RNA, 21 nt, Human
gcgccacuacacuccagccug

SEQ ID NO: 3635640 - RNA, 16 nt, Human
gcgccacucgcuuccc

SEQ ID NO: 3635641 - RNA, 18 nt, Human
gcgccacucgcuuccccc

SEQ ID NO: 3635642 - RNA, 18 nt, Human
gcgccacugcuccgugga

SEQ ID NO: 3635643 - RNA, 21 nt, Human
gcgccaggauggaacacggcc

SEQ ID NO: 3635644 - RNA, 22 nt, Human
gcuaagggugggugcucagaau

SEQ ID NO: 3635645 - RNA, 14 nt, Human
gcuaagguucuaag

SEQ ID NO: 3635646 - RNA, 17 nt, Human
gcuaagguucuaaggcc

SEQ ID NO: 3635647 - RNA, 19 nt, Human
gcuaaguaaaucucuucug

SEQ ID NO: 3635648 - RNA, 14 nt, Human
gcuaagugcuuauu

SEQ ID NO: 3635649 - RNA, 14 nt, Human
gcuaauaaaauauc

SEQ ID NO: 3635650 - RNA, 19 nt, Human
gcuaauaaaauaucauuca

SEQ ID NO: 3635651 - RNA, 20 nt, Human
gcuaauaaugagcuauuaaa

SEQ ID NO: 3635652 - RNA, 23 nt, Human
gcuaauauuuuccuccugagugc

SEQ ID NO: 3635653 - RNA, 19 nt, Human
gcuaaucaaagccaggguc

SEQ ID NO: 3635654 - RNA, 20 nt, Human
gcuaaucaaagccagggucu

SEQ ID NO: 3635655 - RNA, 17 nt, Human
gcuaaucagugucucac

SEQ ID NO: 3635656 - RNA, 17 nt, Human
gcuaauucaaggaauuu

SEQ ID NO: 3635657 - RNA, 20 nt, Human
gcuaauucccagagugugaa

SEQ ID NO: 3635658 - RNA, 22 nt, Human
gcuaauucuuugaccuguuggg

SEQ ID NO: 3635659 - RNA, 18 nt, Human
gcuaauugcuguugaaag

SEQ ID NO: 3635660 - RNA, 20 nt, Human
gcuaauugggaguccaggca

SEQ ID NO: 3635661 - RNA, 12 nt, Human
gcuaauuguacc

SEQ ID NO: 3635662 - RNA, 15 nt, Human
gcuaauuuaaagaga

SEQ ID NO: 3635663 - RNA, 20 nt, Human
gcuaauuuauccugaaauuu

SEQ ID NO: 3635664 - RNA, 13 nt, Human
gcuaauuuucuca

SEQ ID NO: 3635665 - RNA, 18 nt, Human
gcuaauuuugaaaaacug

SEQ ID NO: 3635666 - RNA, 16 nt, Human
gcuaauuuuucauuuu

SEQ ID NO: 3635667 - RNA, 15 nt, Human
gcuaauuuuuguaau

SEQ ID NO: 3635668 - RNA, 17 nt, Human
gcuaauuuuuguaauuu

SEQ ID NO: 3635669 - RNA, 20 nt, Human
gcuaauuuuuguauuuuuag

SEQ ID NO: 3635670 - RNA, 20 nt, Human
gcuaauuuuuuguuguuucu

SEQ ID NO: 3635671 - RNA, 19 nt, Human
gcuaauuuuuuuguauuuu

SEQ ID NO: 3635672 - RNA, 14 nt, Human
gcuacaaagaagac

SEQ ID NO: 3635673 - RNA, 20 nt, Human
gcuacaaagaagacauguuu

SEQ ID NO: 3635674 - RNA, 12 nt, Human
gcuacaacagcc

SEQ ID NO: 3635675 - RNA, 13 nt, Human
gcuacaauuuuaa

SEQ ID NO: 3635676 - RNA, 13 nt, Human
gcuacacacugca

SEQ ID NO: 3635677 - RNA, 14 nt, Human
gcuacacagggaug

SEQ ID NO: 3635678 - RNA, 18 nt, Human
gcuacaccacucuggcag

SEQ ID NO: 3635679 - RNA, 17 nt, Human
gcuacacccuuuuccag

SEQ ID NO: 3635680 - RNA, 23 nt, Human
gcuacaccuauuaucccagcugc

SEQ ID NO: 3635681 - RNA, 13 nt, Human
gcuacaccuuucu

SEQ ID NO: 3635682 - RNA, 15 nt, Human
gcuacaccuuucucc

SEQ ID NO: 3635683 - RNA, 12 nt, Human
gcuacagagaaa

SEQ ID NO: 3635684 - RNA, 13 nt, Human
gcuacagagaaac

SEQ ID NO: 3635685 - RNA, 15 nt, Human
gcuacagagaagccu

SEQ ID NO: 3635686 - RNA, 23 nt, Human
gcuacagagaagccuucaagcuc

SEQ ID NO: 3635687 - RNA, 23 nt, Human
gcuacagggcgagacucugucuc

SEQ ID NO: 3635688 - RNA, 23 nt, Human
gcuacaggggaagguggccucug

SEQ ID NO: 3635689 - RNA, 14 nt, Human
gcuacagguuacaa

SEQ ID NO: 3635690 - RNA, 13 nt, Human
gcuacaguaauaa

SEQ ID NO: 3635691 - RNA, 23 nt, Human
gcuacauaaauuggccugguaug

SEQ ID NO: 3635692 - RNA, 15 nt, Human
gcuacauuuccgcca

SEQ ID NO: 3635693 - RNA, 16 nt, Human
gcuaccaccagcugug

SEQ ID NO: 3635694 - RNA, 21 nt, Human
gcuaccaccagcuguguccaa

SEQ ID NO: 3635695 - RNA, 13 nt, Human
gcuaccaggaaag

SEQ ID NO: 3635696 - RNA, 22 nt, Human
gcuaccaguauuuagaagccaa

SEQ ID NO: 3635697 - RNA, 19 nt, Human
gcuacccaaaagagaaaaa

SEQ ID NO: 3635698 - RNA, 21 nt, Human
gcuacccaggaggcugaggug

SEQ ID NO: 3635699 - RNA, 16 nt, Human
gcuacccgcagaguuc

SEQ ID NO: 3635700 - RNA, 13 nt, Human
gcuacccucccug

SEQ ID NO: 3635701 - RNA, 14 nt, Human
gcuacccucccugc

SEQ ID NO: 3635702 - RNA, 17 nt, Human
gcuacccucccugcugu

SEQ ID NO: 3635703 - RNA, 19 nt, Human
gcuacccugagcugaggca

SEQ ID NO: 3635704 - RNA, 19 nt, Human
gcuacccuuuuccuuugug

SEQ ID NO: 3635705 - RNA, 18 nt, Human
gcuacccuuuuucuccag

SEQ ID NO: 3635706 - RNA, 20 nt, Human
gcuacccuuuuucuccagcu

SEQ ID NO: 3635707 - RNA, 14 nt, Human
gcuaccguugacuu

SEQ ID NO: 3635708 - RNA, 13 nt, Human
gcuaccucccucc

SEQ ID NO: 3635709 - RNA, 23 nt, Human
gcuaccugaacacuuauugcuuu

SEQ ID NO: 3635710 - RNA, 19 nt, Human
gcuaccuguguggacagga

SEQ ID NO: 3635711 - RNA, 22 nt, Human
gcuaccuguguggacaggacua

SEQ ID NO: 3635712 - RNA, 15 nt, Human
gcuaccuuauuguac

SEQ ID NO: 3635713 - RNA, 17 nt, Human
gcuaccuuauuguacgu

SEQ ID NO: 3635714 - RNA, 15 nt, Human
gcuaccuugccccaa

SEQ ID NO: 3635715 - RNA, 20 nt, Human
gcuaccuugugacccagcac

SEQ ID NO: 3635716 - RNA, 14 nt, Human
gcuacgaaucuucc

SEQ ID NO: 3635717 - RNA, 12 nt, Human
gcuacgccucuu

SEQ ID NO: 3635718 - RNA, 18 nt, Human
gcuacguacaugugaggc

SEQ ID NO: 3635719 - RNA, 15 nt, Human
gcuacgugugauuuu

SEQ ID NO: 3635720 - RNA, 19 nt, Human
gcuacgugugauuuuucug

SEQ ID NO: 3635721 - RNA, 16 nt, Human
gcuacguuuacucaca

SEQ ID NO: 3635722 - RNA, 22 nt, Human
gcuacuaaguucacauuagaau

SEQ ID NO: 3635723 - RNA, 15 nt, Human
gcuacuauaaagaga

SEQ ID NO: 3635724 - RNA, 19 nt, Human
gcuacucagaagccugagg

SEQ ID NO: 3635725 - RNA, 21 nt, Human
gcuacucagaagccugaggcu

SEQ ID NO: 3635726 - RNA, 21 nt, Human
gcuacucagcagcccuccuca

SEQ ID NO: 3635727 - RNA, 22 nt, Human
gcuacucagcagcccuccucac

SEQ ID NO: 3635728 - RNA, 14 nt, Human
gcuacuccggaggc

SEQ ID NO: 3635729 - RNA, 21 nt, Human
gcuacucuaguauuccagacc

SEQ ID NO: 3635730 - RNA, 23 nt, Human
gcuacucugugccagagccuggg

SEQ ID NO: 3635731 - RNA, 18 nt, Human
gcuacucuguuccuucac

SEQ ID NO: 3635732 - RNA, 19 nt, Human
gcuacugaaaggcaguagu

SEQ ID NO: 3635733 - RNA, 17 nt, Human
gcuacugauuuuuguga

SEQ ID NO: 3635734 - RNA, 21 nt, Human
gcuacugcacuccagccuggg

SEQ ID NO: 3635735 - RNA, 20 nt, Human
gcuacugccaaccucgcucc

SEQ ID NO: 3635736 - RNA, 12 nt, Human
gcuacugcuuca

SEQ ID NO: 3635737 - RNA, 20 nt, Human
gcuacuggcauaguuucaua

SEQ ID NO: 3635738 - RNA, 16 nt, Human
gcuacuggggaaacug

SEQ ID NO: 3635739 - RNA, 21 nt, Human
gcuacuggggaaacuggccau

SEQ ID NO: 3635740 - RNA, 23 nt, Human
gcuacuggggaaacuggccaugg

SEQ ID NO: 3635741 - RNA, 18 nt, Human
gcuacuguaaggcaauca

SEQ ID NO: 3635742 - RNA, 12 nt, Human
gcuacugucuca

SEQ ID NO: 3635743 - RNA, 16 nt, Human
gcuacugucucacuga

SEQ ID NO: 3635744 - RNA, 18 nt, Human
gcuacugugugugugaau

SEQ ID NO: 3635745 - RNA, 21 nt, Human
gcuacugugugugugaaugaa

SEQ ID NO: 3635746 - RNA, 18 nt, Human
gcuacuucggggcuggga

SEQ ID NO: 3635747 - RNA, 16 nt, Human
gcuacuugggaggcug

SEQ ID NO: 3635748 - RNA, 16 nt, Human
gcuacuuugccuuuug

SEQ ID NO: 3635749 - RNA, 18 nt, Human
gcuacuuugguuucuguc

SEQ ID NO: 3635750 - RNA, 12 nt, Human
gcuacuuuguuu

SEQ ID NO: 3635751 - RNA, 18 nt, Human
gcuagaaauaugauuuua

SEQ ID NO: 3635752 - RNA, 19 nt, Human
gcuagaaccaagaagggcu

SEQ ID NO: 3635753 - RNA, 19 nt, Human
gcuagaaccuagaagggcu

SEQ ID NO: 3635754 - RNA, 18 nt, Human
gcuagaaccuggaagggc

SEQ ID NO: 3635755 - RNA, 19 nt, Human
gcuagaaccuggagagcua

SEQ ID NO: 3635756 - RNA, 15 nt, Human
gcuagaaccuggagg

SEQ ID NO: 3635757 - RNA, 13 nt, Human
gcuagaacuuuuu

SEQ ID NO: 3635758 - RNA, 21 nt, Human
gcuagaacuuuuuuaaauaaa

SEQ ID NO: 3635759 - RNA, 23 nt, Human
gcuagaacuuuuuuaaauaaacu

SEQ ID NO: 3635760 - RNA, 19 nt, Human
gcuagaaucuggagagcua

SEQ ID NO: 3635761 - RNA, 18 nt, Human
gcuagagaaauucuuguu

SEQ ID NO: 3635762 - RNA, 19 nt, Human
gcuagagcuccucccucuc

SEQ ID NO: 3635763 - RNA, 20 nt, Human
gcuagaggaaccaaccccca

SEQ ID NO: 3635764 - RNA, 17 nt, Human
gcuagaggauuaguaag

SEQ ID NO: 3635765 - RNA, 16 nt, Human
gcuagaggccugagga

SEQ ID NO: 3635766 - RNA, 16 nt, Human
gcuagaguccucacuc

SEQ ID NO: 3635767 - RNA, 14 nt, Human
gcuagauguaugua

SEQ ID NO: 3635768 - RNA, 23 nt, Human
gcuagcagaaaucuagaagacug

SEQ ID NO: 3635769 - RNA, 22 nt, Human
gcuagcagcagggagggcuucu

SEQ ID NO: 3635770 - RNA, 12 nt, Human
gcuagccagagg

SEQ ID NO: 3635771 - RNA, 15 nt, Human
gcuagccagaggacu

SEQ ID NO: 3635772 - RNA, 18 nt, Human
gcuagccagaggacugug

SEQ ID NO: 3635773 - RNA, 14 nt, Human
gcuagcgcugccgc

SEQ ID NO: 3635774 - RNA, 20 nt, Human
gcuagcgcugccgcacccca

SEQ ID NO: 3635775 - RNA, 22 nt, Human
gcuagcgcugccgcaccccaga

SEQ ID NO: 3635776 - RNA, 23 nt, Human
gcuagcgcugccgcaccccagag

SEQ ID NO: 3635777 - RNA, 21 nt, Human
gcuagcuccccuccucucccc

SEQ ID NO: 3635778 - RNA, 14 nt, Human
gcuagcuggagccu

SEQ ID NO: 3635779 - RNA, 12 nt, Human
gcuagcuucugc

SEQ ID NO: 3635780 - RNA, 22 nt, Human
gcuagcuucugcuuuucugccc

SEQ ID NO: 3635781 - RNA, 19 nt, Human
gcuaggaaauccagggugg

SEQ ID NO: 3635782 - RNA, 16 nt, Human
gcuaggaacacuccuu

SEQ ID NO: 3635783 - RNA, 16 nt, Human
gcuaggaaugaaaucu

SEQ ID NO: 3635784 - RNA, 15 nt, Human
gcuaggagcaaagcc

SEQ ID NO: 3635785 - RNA, 19 nt, Human
gcuaggccagagcccacuc

SEQ ID NO: 3635786 - RNA, 15 nt, Human
gcuaggccuggccag

SEQ ID NO: 3635787 - RNA, 18 nt, Human
gcuaggcgagugccagga

SEQ ID NO: 3635788 - RNA, 16 nt, Human
gcuuagagaggacaau

SEQ ID NO: 3635789 - RNA, 12 nt, Human
gcuuagaggcau

SEQ ID NO: 3635790 - RNA, 13 nt, Human
gcuuagauuucau

SEQ ID NO: 3635791 - RNA, 15 nt, Human
gcuuagauuucauag

SEQ ID NO: 3635792 - RNA, 23 nt, Human
gcuuagggacaggaccccagcuc

SEQ ID NO: 3635793 - RNA, 17 nt, Human
gcuuagggcccuggagg

SEQ ID NO: 3635794 - RNA, 16 nt, Human
gcuuagggucucaggg

SEQ ID NO: 3635795 - RNA, 15 nt, Human
gcuuagucacugaga

SEQ ID NO: 3635796 - RNA, 19 nt, Human
gcuuagucacugagacagc

SEQ ID NO: 3635797 - RNA, 21 nt, Human
gcuuagucacugagacagccc

SEQ ID NO: 3635798 - RNA, 19 nt, Human
gcuuauaaaacagaguaau

SEQ ID NO: 3635799 - RNA, 22 nt, Human
gcuuauacgaaauaauuguugu

SEQ ID NO: 3635800 - RNA, 17 nt, Human
gcuuauagguggccucu

SEQ ID NO: 3635801 - RNA, 15 nt, Human
gcuuauaucuggccu

SEQ ID NO: 3635802 - RNA, 22 nt, Human
gcuuauauucaaccauggacuu

SEQ ID NO: 3635803 - RNA, 18 nt, Human
gcuuaucaacuaaugauu

SEQ ID NO: 3635804 - RNA, 23 nt, Human
gcuuaucaauuugucauuuugaa

SEQ ID NO: 3635805 - RNA, 23 nt, Human
gcuuaugacaucacuuguacaaa

SEQ ID NO: 3635806 - RNA, 20 nt, Human
gcuuaugguaccagaugcag

SEQ ID NO: 3635807 - RNA, 20 nt, Human
gcuuauuaaugcuaagggca

SEQ ID NO: 3635808 - RNA, 15 nt, Human
gcuuauuccaugacu

SEQ ID NO: 3635809 - RNA, 18 nt, Human
gcuuauugcuuaguaaaa

SEQ ID NO: 3635810 - RNA, 13 nt, Human
gcuuauuguucca

SEQ ID NO: 3635811 - RNA, 21 nt, Human
gcuuauuguuccaagacauug

SEQ ID NO: 3635812 - RNA, 16 nt, Human
gcuuauuuaauaaaga

SEQ ID NO: 3635813 - RNA, 17 nt, Human
gcuuauuuaauaugcuu

SEQ ID NO: 3635814 - RNA, 19 nt, Human
gcuuauuuauuaacaggau

SEQ ID NO: 3635815 - RNA, 17 nt, Human
gcuuauuuccucauuuu

SEQ ID NO: 3635816 - RNA, 13 nt, Human
gcuuauuuuaaug

SEQ ID NO: 3635817 - RNA, 16 nt, Human
gcuucaaauuguaagc

SEQ ID NO: 3635818 - RNA, 19 nt, Human
gcuucaaggauccugagcc

SEQ ID NO: 3635819 - RNA, 20 nt, Human
gcuucaaggauccugagcca

SEQ ID NO: 3635820 - RNA, 22 nt, Human
gcuucaaggauccugagccaga

SEQ ID NO: 3635821 - RNA, 14 nt, Human
gcuucacaggacag

SEQ ID NO: 3635822 - RNA, 22 nt, Human
gcuucacaggacaggaaagugg

SEQ ID NO: 3635823 - RNA, 13 nt, Human
gcuucacagugau

SEQ ID NO: 3635824 - RNA, 17 nt, Human
gcuucacggaagagccu

SEQ ID NO: 3635825 - RNA, 15 nt, Human
gcuucacuccugcug

SEQ ID NO: 3635826 - RNA, 18 nt, Human
gcuucacuccugcuguaa

SEQ ID NO: 3635827 - RNA, 16 nt, Human
gcuucacuguauaaau

SEQ ID NO: 3635828 - RNA, 20 nt, Human
gcuucagauguggagccagg

SEQ ID NO: 3635829 - RNA, 19 nt, Human
gcuucagcauauuuauagc

SEQ ID NO: 3635830 - RNA, 22 nt, Human
gcuucagccacaguuuccucau

SEQ ID NO: 3635831 - RNA, 18 nt, Human
gcuucagccucccacagu

SEQ ID NO: 3635832 - RNA, 17 nt, Human
gcuucagccuccccacc

SEQ ID NO: 3635833 - RNA, 23 nt, Human
gcuucagccugaggcugagacug

SEQ ID NO: 3635834 - RNA, 16 nt, Human
gcuucagcuccagccc

SEQ ID NO: 3635835 - RNA, 18 nt, Human
gcuucagcuccagccccu

SEQ ID NO: 3635836 - RNA, 22 nt, Human
gcuucaggaaccucgaguacug

SEQ ID NO: 3635837 - RNA, 13 nt, Human
gcuucaggaggga

SEQ ID NO: 3635838 - RNA, 21 nt, Human
gcuucagguccaggcuguguu

SEQ ID NO: 3635839 - RNA, 22 nt, Human
gcuucagguuaucgaaauaaca

SEQ ID NO: 3635840 - RNA, 23 nt, Human
gcuucaguacuugugaaacacag

SEQ ID NO: 3635841 - RNA, 17 nt, Human
gcuucaguggcagcugc

SEQ ID NO: 3635842 - RNA, 18 nt, Human
gcuucaguggcagcugcu

SEQ ID NO: 3635843 - RNA, 22 nt, Human
gcuucauacagggaugguguuc

SEQ ID NO: 3635844 - RNA, 19 nt, Human
gcuucaucauucccucuca

SEQ ID NO: 3635845 - RNA, 21 nt, Human
gcuucauccuccucagaucuu

SEQ ID NO: 3635846 - RNA, 18 nt, Human
gcuucaucugucaagugg

SEQ ID NO: 3635847 - RNA, 18 nt, Human
gcuucaugaaaauccuac

SEQ ID NO: 3635848 - RNA, 19 nt, Human
gcuucaugcacuuaaagaa

SEQ ID NO: 3635849 - RNA, 20 nt, Human
gcuucaugcacuuaaagaag

SEQ ID NO: 3635850 - RNA, 17 nt, Human
gcuucaugccuuuguaa

SEQ ID NO: 3635851 - RNA, 14 nt, Human
gcuucaugcucagc

SEQ ID NO: 3635852 - RNA, 17 nt, Human
gcuucauguggcuuccc

SEQ ID NO: 3635853 - RNA, 18 nt, Human
gcuucaugugucccagaa

SEQ ID NO: 3635854 - RNA, 18 nt, Human
gcuucauuagagcaggcg

SEQ ID NO: 3635855 - RNA, 17 nt, Human
gcuucauucaauauuga

SEQ ID NO: 3635856 - RNA, 17 nt, Human
gcuucauuuccuguguc

SEQ ID NO: 3635857 - RNA, 18 nt, Human
gcuucauuuccugugucu

SEQ ID NO: 3635858 - RNA, 18 nt, Human
gcuuccaagguggucugc

SEQ ID NO: 3635859 - RNA, 16 nt, Human
gcuuccaauuuuccuu

SEQ ID NO: 3635860 - RNA, 15 nt, Human
gcuuccaccucaccc

SEQ ID NO: 3635861 - RNA, 19 nt, Human
gcuuccagaaaaccccagc

SEQ ID NO: 3635862 - RNA, 12 nt, Human
gcuuccagcagg

SEQ ID NO: 3635863 - RNA, 13 nt, Human
gcuuccagcagga

SEQ ID NO: 3635864 - RNA, 17 nt, Human
gcuuccagcaggaggga

SEQ ID NO: 3635865 - RNA, 20 nt, Human
gcuuccagcaggagggacag

SEQ ID NO: 3635866 - RNA, 21 nt, Human
gcuuccaggaaacuccacauc

SEQ ID NO: 3635867 - RNA, 19 nt, Human
gcuuccagguaucuccagg

SEQ ID NO: 3635868 - RNA, 22 nt, Human
gcuuccagguaucuccaggauu

SEQ ID NO: 3635869 - RNA, 15 nt, Human
gcuuccagugaggcu

SEQ ID NO: 3635870 - RNA, 18 nt, Human
gcuuccagugaggcucug

SEQ ID NO: 3635871 - RNA, 20 nt, Human
gcuuccagugaggcucugcc

SEQ ID NO: 3635872 - RNA, 21 nt, Human
gcuuccagugaggcucugccc

SEQ ID NO: 3635873 - RNA, 22 nt, Human
gcuuccagugaggcucugcccu

SEQ ID NO: 3635874 - RNA, 18 nt, Human
gcuuccauagcugcugcc

SEQ ID NO: 3635875 - RNA, 22 nt, Human
gcuuccaucccaaccagugcca

SEQ ID NO: 3635876 - RNA, 14 nt, Human
gcuuccaugauucu

SEQ ID NO: 3635877 - RNA, 19 nt, Human
gcuuccauuuuaauuuuaa

SEQ ID NO: 3635878 - RNA, 14 nt, Human
gcuucccaccuccc

SEQ ID NO: 3635879 - RNA, 15 nt, Human
gcuucccaccucccu

SEQ ID NO: 3635880 - RNA, 18 nt, Human
gcuucccaccucccugcc

SEQ ID NO: 3635881 - RNA, 13 nt, Human
gcuucccaucccc

SEQ ID NO: 3635882 - RNA, 17 nt, Human
gcuucccauccccagcg

SEQ ID NO: 3635883 - RNA, 17 nt, Human
gcuucccauccuacccu

SEQ ID NO: 3635884 - RNA, 15 nt, Human
gcuucccccauagcc

SEQ ID NO: 3635885 - RNA, 18 nt, Human
gcuucccccauagccacc

SEQ ID NO: 3635886 - RNA, 18 nt, Human
gcuuccccuuuugccaau

SEQ ID NO: 3635887 - RNA, 15 nt, Human
gcuucccgcucagcc

SEQ ID NO: 3635888 - RNA, 16 nt, Human
gcuucccgcucagccc

SEQ ID NO: 3635889 - RNA, 20 nt, Human
gcuucccuccccucuaguuu

SEQ ID NO: 3635890 - RNA, 16 nt, Human
gcuucccuccugcccg

SEQ ID NO: 3635891 - RNA, 15 nt, Human
gcuucccucugccug

SEQ ID NO: 3635892 - RNA, 14 nt, Human
gcuucccuuuccug

SEQ ID NO: 3635893 - RNA, 16 nt, Human
gcuucccuuuuuuccu

SEQ ID NO: 3635894 - RNA, 17 nt, Human
gcuuccgguagggaggc

SEQ ID NO: 3635895 - RNA, 21 nt, Human
gcuuccuagaaguuacugaau

SEQ ID NO: 3635896 - RNA, 17 nt, Human
gcuuccuauaauuuuga

SEQ ID NO: 3635897 - RNA, 18 nt, Human
gcuuccuauaauuuugau

SEQ ID NO: 3635898 - RNA, 23 nt, Human
gcuuccuauaauuuugauagugg

SEQ ID NO: 3635899 - RNA, 23 nt, Human
gcuuccuauuucuagggcuggga

SEQ ID NO: 3635900 - RNA, 22 nt, Human
gcuuccucauaguaugguggcu

SEQ ID NO: 3635901 - RNA, 18 nt, Human
gcuuccugacaaucaacu

SEQ ID NO: 3635902 - RNA, 13 nt, Human
gcuuccugcuugc

SEQ ID NO: 3635903 - RNA, 15 nt, Human
gcuuccuggagcaga

SEQ ID NO: 3635904 - RNA, 19 nt, Human
gcuuccuggcaauagucaa

SEQ ID NO: 3635905 - RNA, 14 nt, Human
gcuuccuggugcug

SEQ ID NO: 3635906 - RNA, 21 nt, Human
gcuuccuguccucccagcucc

SEQ ID NO: 3635907 - RNA, 22 nt, Human
gcuuccuucagagagcagugcu

SEQ ID NO: 3635908 - RNA, 14 nt, Human
gcuuccuucauuuc

SEQ ID NO: 3635909 - RNA, 21 nt, Human
gcuucgaggcccagcgaccuc

SEQ ID NO: 3635910 - RNA, 18 nt, Human
gcuucuaaguaaauacaa

SEQ ID NO: 3635911 - RNA, 16 nt, Human
gcuucuaauaaauuau

SEQ ID NO: 3635912 - RNA, 15 nt, Human
gcuucuaauauuuau

SEQ ID NO: 3635913 - RNA, 18 nt, Human
gcuucuaccaacuggaag

SEQ ID NO: 3635914 - RNA, 16 nt, Human
gcuucuaguucugcca

SEQ ID NO: 3635915 - RNA, 21 nt, Human
gcuucuaguucugccaggaga

SEQ ID NO: 3635916 - RNA, 12 nt, Human
gcuucuauccca

SEQ ID NO: 3635917 - RNA, 16 nt, Human
gcuucuaugaaagacu

SEQ ID NO: 3635918 - RNA, 21 nt, Human
gcuucucagauuucugaggaa

SEQ ID NO: 3635919 - RNA, 22 nt, Human
gcuucucauccugcaggcagcu

SEQ ID NO: 3635920 - RNA, 22 nt, Human
gcuucuccaaaaaucugccugg

SEQ ID NO: 3635921 - RNA, 23 nt, Human
gcuucuccaaaaaucugccuggg

SEQ ID NO: 3635922 - RNA, 17 nt, Human
gcuucuccagccuggac

SEQ ID NO: 3635923 - RNA, 19 nt, Human
gcuucucccacuuggccaa

SEQ ID NO: 3635924 - RNA, 20 nt, Human
gcuucucccaggcaaggcug

SEQ ID NO: 3635925 - RNA, 22 nt, Human
gcuucucccaggcaaggcugug

SEQ ID NO: 3635926 - RNA, 14 nt, Human
gcuucuccgccagc

SEQ ID NO: 3635927 - RNA, 24 nt, Human
gcuucuccgccagccuccucugga

SEQ ID NO: 3635928 - RNA, 12 nt, Human
gcuucuccugac

SEQ ID NO: 3635929 - RNA, 14 nt, Human
gcuucucucucacc

SEQ ID NO: 3635930 - RNA, 19 nt, Human
gcuucucugugaacgauuu

SEQ ID NO: 3635931 - RNA, 17 nt, Human
gcuuuuuauuucugcau

SEQ ID NO: 3635932 - RNA, 12 nt, Human
gcuuuuugaaau

SEQ ID NO: 3635933 - RNA, 21 nt, Human
gcuuuuugagguggcacuuuu

SEQ ID NO: 3635934 - RNA, 23 nt, Human
gcuuuuugugauaugcacaaugu

SEQ ID NO: 3635935 - RNA, 20 nt, Human
gcuuuuuuaucaugugaaau

SEQ ID NO: 3635936 - RNA, 17 nt, Human
gcuuuuuuguuuuggcu

SEQ ID NO: 3635937 - RNA, 15 nt, Human
gcuuuuuuuuucucu

SEQ ID NO: 3635938 - RNA, 24 nt, Human
gcuuuuuuuuucucuuucucuccu

SEQ ID NO: 3635939 - RNA, 15 nt, Human
gcuuuuuuuuuucca

SEQ ID NO: 3635940 - RNA, 18 nt, Human
ggaaaaaaaaaaaagagg

SEQ ID NO: 3635941 - RNA, 13 nt, Human
ggaaaaaaacuuu

SEQ ID NO: 3635942 - RNA, 14 nt, Human
ggaaaaaaacuuuu

SEQ ID NO: 3635943 - RNA, 17 nt, Human
ggaaaaaaagacucuuu

SEQ ID NO: 3635944 - RNA, 13 nt, Human
ggaaaaaaauguu

SEQ ID NO: 3635945 - RNA, 15 nt, Human
ggaaaaaagagaagu

SEQ ID NO: 3635946 - RNA, 20 nt, Human
ggaaaaaauaacaaugaaag

SEQ ID NO: 3635947 - RNA, 13 nt, Human
ggaaaaacacaag

SEQ ID NO: 3635948 - RNA, 14 nt, Human
ggaaaaagaaaaua

SEQ ID NO: 3635949 - RNA, 22 nt, Human
ggaaaaaggacaggcagaaaga

SEQ ID NO: 3635950 - RNA, 22 nt, Human
ggaaaaaguauuaauucucuuu

SEQ ID NO: 3635951 - RNA, 19 nt, Human
ggaaaaaguggguuuuuua

SEQ ID NO: 3635952 - RNA, 13 nt, Human
ggaaaaauaugug

SEQ ID NO: 3635953 - RNA, 13 nt, Human
ggaaaaauauuua

SEQ ID NO: 3635954 - RNA, 15 nt, Human
ggaaaaaugaguaau

SEQ ID NO: 3635955 - RNA, 12 nt, Human
ggaaaaaugugu

SEQ ID NO: 3635956 - RNA, 11 nt, Human
ggaaaaauuca

SEQ ID NO: 3635957 - RNA, 22 nt, Human
ggaaaacagaacaucauuagaa

SEQ ID NO: 3635958 - RNA, 13 nt, Human
ggaaaacauuugc

SEQ ID NO: 3635959 - RNA, 14 nt, Human
ggaaaacauuugcu

SEQ ID NO: 3635960 - RNA, 22 nt, Human
ggaaaaccaagccguggcuucc

SEQ ID NO: 3635961 - RNA, 22 nt, Human
ggaaaaccagacuacuugggag

SEQ ID NO: 3635962 - RNA, 20 nt, Human
ggaaaacuccaccuucccac

SEQ ID NO: 3635963 - RNA, 21 nt, Human
ggaaaacugagacucagacag

SEQ ID NO: 3635964 - RNA, 13 nt, Human
ggaaaacuuauuu

SEQ ID NO: 3635965 - RNA, 9 nt, Human
ggaaaagaa

SEQ ID NO: 3635966 - RNA, 12 nt, Human
ggaaaagaaaaa

SEQ ID NO: 3635967 - RNA, 13 nt, Human
ggaaaagaaaaaa

SEQ ID NO: 3635968 - RNA, 14 nt, Human
ggaaaagaaaaaaa

SEQ ID NO: 3635969 - RNA, 14 nt, Human
ggaaaagaaaucua

SEQ ID NO: 3635970 - RNA, 21 nt, Human
ggaaaagagauggccugagaa

SEQ ID NO: 3635971 - RNA, 18 nt, Human
ggaaaagauaaagaccag

SEQ ID NO: 3635972 - RNA, 14 nt, Human
ggaaaagcagcucu

SEQ ID NO: 3635973 - RNA, 14 nt, Human
ggaaaagccucugu

SEQ ID NO: 3635974 - RNA, 11 nt, Human
ggaaaagcuga

SEQ ID NO: 3635975 - RNA, 18 nt, Human
ggaaaagcugcugacagu

SEQ ID NO: 3635976 - RNA, 16 nt, Human
ggaaaaggccuggggu

SEQ ID NO: 3635977 - RNA, 20 nt, Human
ggaaaagggucuugggaaau

SEQ ID NO: 3635978 - RNA, 19 nt, Human
ggaaaaguuuaauauuaaa

SEQ ID NO: 3635979 - RNA, 19 nt, Human
ggaaaauaaaaaaagaaaa

SEQ ID NO: 3635980 - RNA, 20 nt, Human
ggaaaauaaaaaaagaaaaa

SEQ ID NO: 3635981 - RNA, 16 nt, Human
ggaaaauaauacugcu

SEQ ID NO: 3635982 - RNA, 19 nt, Human
ggaaaauaggcuuuuuaau

SEQ ID NO: 3635983 - RNA, 14 nt, Human
ggaaaauauuuuga

SEQ ID NO: 3635984 - RNA, 23 nt, Human
ggaaaaucagccugcuccagcug

SEQ ID NO: 3635985 - RNA, 19 nt, Human
ggaaaaucucuuuuugacu

SEQ ID NO: 3635986 - RNA, 14 nt, Human
ggaaaaugcauugu

SEQ ID NO: 3635987 - RNA, 16 nt, Human
ggaaaaugcauuguau

SEQ ID NO: 3635988 - RNA, 17 nt, Human
ggaaaaugccaaucucu

SEQ ID NO: 3635989 - RNA, 21 nt, Human
ggaaaauguuuuguaagaaac

SEQ ID NO: 3635990 - RNA, 22 nt, Human
ggaaaauuaguucccauucuuu

SEQ ID NO: 3635991 - RNA, 15 nt, Human
ggaaaauucauuuuu

SEQ ID NO: 3635992 - RNA, 23 nt, Human
ggaaacaaagcuuagcaggagag

SEQ ID NO: 3635993 - RNA, 13 nt, Human
ggaaacaaagugg

SEQ ID NO: 3635994 - RNA, 22 nt, Human
ggaaacaaaguggaaggaaaga

SEQ ID NO: 3635995 - RNA, 13 nt, Human
ggaaacaacagcu

SEQ ID NO: 3635996 - RNA, 12 nt, Human
ggaaacaauaua

SEQ ID NO: 3635997 - RNA, 16 nt, Human
ggaaacacuaaauguu

SEQ ID NO: 3635998 - RNA, 15 nt, Human
ggaaacagaggacca

SEQ ID NO: 3635999 - RNA, 13 nt, Human
ggaaacagaggcu

SEQ ID NO: 3636000 - RNA, 15 nt, Human
ggaaacaggaccaca

SEQ ID NO: 3636001 - RNA, 16 nt, Human
ggaaacccagcucugg

SEQ ID NO: 3636002 - RNA, 19 nt, Human
ggaaacccauaggcccaca

SEQ ID NO: 3636003 - RNA, 22 nt, Human
ggaaaccgaguagaaaauguga

SEQ ID NO: 3636004 - RNA, 19 nt, Human
ggaaaccugcccugccuga

SEQ ID NO: 3636005 - RNA, 14 nt, Human
ggaaaccugucuga

SEQ ID NO: 3636006 - RNA, 18 nt, Human
ggaaacgaaacccacucu

SEQ ID NO: 3636007 - RNA, 15 nt, Human
ggaaacgagacuuuc

SEQ ID NO: 3636008 - RNA, 14 nt, Human
ggaaacuaaaacuu

SEQ ID NO: 3636009 - RNA, 19 nt, Human
ggaaacuaagauucuuuua

SEQ ID NO: 3636010 - RNA, 13 nt, Human
ggaaacuaauaaa

SEQ ID NO: 3636011 - RNA, 18 nt, Human
ggaaacuaauaaaauauu

SEQ ID NO: 3636012 - RNA, 21 nt, Human
ggaaacuaauaaaauauuuuc

SEQ ID NO: 3636013 - RNA, 16 nt, Human
ggaaacuacugccuuu

SEQ ID NO: 3636014 - RNA, 19 nt, Human
ggaaacuauguguuuuucu

SEQ ID NO: 3636015 - RNA, 23 nt, Human
ggaaacuauguguuuuucucaua

SEQ ID NO: 3636016 - RNA, 18 nt, Human
ggaaacuccacaucugcc

SEQ ID NO: 3636017 - RNA, 17 nt, Human
ggaaacucuuaucucag

SEQ ID NO: 3636018 - RNA, 17 nt, Human
ggaaacuguugccagag

SEQ ID NO: 3636019 - RNA, 21 nt, Human
ggaaacuugauuugagauuuu

SEQ ID NO: 3636020 - RNA, 20 nt, Human
ggaaacuugucacuugcaug

SEQ ID NO: 3636021 - RNA, 16 nt, Human
ggaaagaaagaaggaa

SEQ ID NO: 3636022 - RNA, 14 nt, Human
ggaaagacacugcc

SEQ ID NO: 3636023 - RNA, 16 nt, Human
ggaaagacacugccug

SEQ ID NO: 3636024 - RNA, 22 nt, Human
ggaaagacauccauaaagaagc

SEQ ID NO: 3636025 - RNA, 14 nt, Human
ggaaagaggcucug

SEQ ID NO: 3636026 - RNA, 16 nt, Human
ggaaagcaaagcacag

SEQ ID NO: 3636027 - RNA, 21 nt, Human
ggaaagcacagaggccuccug

SEQ ID NO: 3636028 - RNA, 16 nt, Human
ggaaagcacagguggg

SEQ ID NO: 3636029 - RNA, 11 nt, Human
ggaaagcaggu

SEQ ID NO: 3636030 - RNA, 19 nt, Human
ggaaagcagguggcaucuc

SEQ ID NO: 3636031 - RNA, 18 nt, Human
ggaaagcaucaccucagg

SEQ ID NO: 3636032 - RNA, 19 nt, Human
ggaaagcaucaccucaggc

SEQ ID NO: 3636033 - RNA, 14 nt, Human
ggaaagcauuuaaa

SEQ ID NO: 3636034 - RNA, 20 nt, Human
ggaaagccaccucucccuca

SEQ ID NO: 3636035 - RNA, 16 nt, Human
ggaaagccccugcccc

SEQ ID NO: 3636036 - RNA, 18 nt, Human
ggaaagcuccuagcagag

SEQ ID NO: 3636037 - RNA, 12 nt, Human
ggaaaggaauug

SEQ ID NO: 3636038 - RNA, 16 nt, Human
ggaaaggauauuuucu

SEQ ID NO: 3636039 - RNA, 12 nt, Human
ggaaaggccagc

SEQ ID NO: 3636040 - RNA, 16 nt, Human
ggaaaggccagcacuc

SEQ ID NO: 3636041 - RNA, 22 nt, Human
ggaaaggccagcuggcagcaga

SEQ ID NO: 3636042 - RNA, 12 nt, Human
ggaaaggcucag

SEQ ID NO: 3636043 - RNA, 21 nt, Human
ggaaaggcuccaggagcagcc

SEQ ID NO: 3636044 - RNA, 22 nt, Human
ggaaaggcuccaggagcagcca

SEQ ID NO: 3636045 - RNA, 20 nt, Human
ggaaaggcucugaaagccag

SEQ ID NO: 3636046 - RNA, 19 nt, Human
ggaaaggggagagccugcu

SEQ ID NO: 3636047 - RNA, 22 nt, Human
ggaaagggguuggggugacagu

SEQ ID NO: 3636048 - RNA, 16 nt, Human
ggaaaggugguguuuc

SEQ ID NO: 3636049 - RNA, 22 nt, Human
ggaaaguacauuuuuugaaaug

SEQ ID NO: 3636050 - RNA, 21 nt, Human
ggaaagucauuggcuuuaucc

SEQ ID NO: 3636051 - RNA, 13 nt, Human
ggaaagugaauuu

SEQ ID NO: 3636052 - RNA, 13 nt, Human
ggaaaguguaaag

SEQ ID NO: 3636053 - RNA, 15 nt, Human
ggaaaguguaaagca

SEQ ID NO: 3636054 - RNA, 19 nt, Human
ggaaaguucagaguuuucu

SEQ ID NO: 3636055 - RNA, 17 nt, Human
ggaaaguuucuuugaaa

SEQ ID NO: 3636056 - RNA, 14 nt, Human
ggaaauaaaaaagu

SEQ ID NO: 3636057 - RNA, 19 nt, Human
ggaaauaaaaaagucucua

SEQ ID NO: 3636058 - RNA, 22 nt, Human
ggaaauaaaaccuuucaaauuu

SEQ ID NO: 3636059 - RNA, 18 nt, Human
ggaaauacaguucugcuc

SEQ ID NO: 3636060 - RNA, 19 nt, Human
ggaaauacaguucugcucu

SEQ ID NO: 3636061 - RNA, 14 nt, Human
ggaaauauauaugu

SEQ ID NO: 3636062 - RNA, 16 nt, Human
ggaaauauauauuaua

SEQ ID NO: 3636063 - RNA, 14 nt, Human
ggaaauaugaaugc

SEQ ID NO: 3636064 - RNA, 15 nt, Human
ggaaauauuaaaaga

SEQ ID NO: 3636065 - RNA, 22 nt, Human
ggaaauauuaugcaaauuccca

SEQ ID NO: 3636066 - RNA, 17 nt, Human
ggaaauauuuagcaaau

SEQ ID NO: 3636067 - RNA, 12 nt, Human
ggaaauauuuau

SEQ ID NO: 3636068 - RNA, 17 nt, Human
ggaaaucaaauaugcaa

SEQ ID NO: 3636069 - RNA, 16 nt, Human
ggaaaucaacuugcuu

SEQ ID NO: 3636070 - RNA, 19 nt, Human
ggaaaucaucgaaaauuca

SEQ ID NO: 3636071 - RNA, 18 nt, Human
ggaaaucuguaacaggua

SEQ ID NO: 3636072 - RNA, 13 nt, Human
ggaaaucuuuaaa

SEQ ID NO: 3636073 - RNA, 15 nt, Human
ggaaaugaaagaaag

SEQ ID NO: 3636074 - RNA, 13 nt, Human
ggaaaugagcagg

SEQ ID NO: 3636075 - RNA, 16 nt, Human
ggaaaugggcagagca

SEQ ID NO: 3636076 - RNA, 18 nt, Human
ggaaaugggcagagcaga

SEQ ID NO: 3636077 - RNA, 14 nt, Human
ggaauugugugaug

SEQ ID NO: 3636078 - RNA, 13 nt, Human
ggaauuuauaauu

SEQ ID NO: 3636079 - RNA, 14 nt, Human
ggaauuucccagga

SEQ ID NO: 3636080 - RNA, 19 nt, Human
ggaauuucccaggacccug

SEQ ID NO: 3636081 - RNA, 16 nt, Human
ggaauuugccugcugg

SEQ ID NO: 3636082 - RNA, 21 nt, Human
ggaauuuguucaaguuuuggg

SEQ ID NO: 3636083 - RNA, 14 nt, Human
ggacaaaacuucuu

SEQ ID NO: 3636084 - RNA, 15 nt, Human
ggacaaacagcucag

SEQ ID NO: 3636085 - RNA, 14 nt, Human
ggacaaagaaccuu

SEQ ID NO: 3636086 - RNA, 13 nt, Human
ggacaaaggagcc

SEQ ID NO: 3636087 - RNA, 16 nt, Human
ggacaaaggagccugu

SEQ ID NO: 3636088 - RNA, 16 nt, Human
ggacaaagucuccagc

SEQ ID NO: 3636089 - RNA, 17 nt, Human
ggacaaagucuccagcc

SEQ ID NO: 3636090 - RNA, 20 nt, Human
ggacaaagucuccagcccac

SEQ ID NO: 3636091 - RNA, 24 nt, Human
ggacaaagucuccagcccacguuc

SEQ ID NO: 3636092 - RNA, 15 nt, Human
ggacaacgaggaagc

SEQ ID NO: 3636093 - RNA, 22 nt, Human
ggacaacugcucccaccuccug

SEQ ID NO: 3636094 - RNA, 23 nt, Human
ggacaacugcucccaccuccuga

SEQ ID NO: 3636095 - RNA, 16 nt, Human
ggacaagacccccagc

SEQ ID NO: 3636096 - RNA, 15 nt, Human
ggacaagagguacag

SEQ ID NO: 3636097 - RNA, 23 nt, Human
ggacaaggaugaucuaggaagac

SEQ ID NO: 3636098 - RNA, 18 nt, Human
ggacaaggugcaggcagg

SEQ ID NO: 3636099 - RNA, 13 nt, Human
ggacaauaaaccu

SEQ ID NO: 3636100 - RNA, 17 nt, Human
ggacaaucaguccccuc

SEQ ID NO: 3636101 - RNA, 20 nt, Human
ggacaaucaguccccuccca

SEQ ID NO: 3636102 - RNA, 16 nt, Human
ggacaauucaugaacu

SEQ ID NO: 3636103 - RNA, 16 nt, Human
ggacacagaugaaaca

SEQ ID NO: 3636104 - RNA, 13 nt, Human
ggacacagcucuu

SEQ ID NO: 3636105 - RNA, 14 nt, Human
ggacacaggccugu

SEQ ID NO: 3636106 - RNA, 18 nt, Human
ggacacaguuccugggaa

SEQ ID NO: 3636107 - RNA, 21 nt, Human
ggacacaguuccugggaacau

SEQ ID NO: 3636108 - RNA, 21 nt, Human
ggacacauucaacccuggaga

SEQ ID NO: 3636109 - RNA, 22 nt, Human
ggacacauucaacccuggagag

SEQ ID NO: 3636110 - RNA, 17 nt, Human
ggacaccacacccagcc

SEQ ID NO: 3636111 - RNA, 18 nt, Human
ggacaccacacccagccu

SEQ ID NO: 3636112 - RNA, 21 nt, Human
ggacaccacacccagccucag

SEQ ID NO: 3636113 - RNA, 17 nt, Human
ggacaccagccaggcuc

SEQ ID NO: 3636114 - RNA, 20 nt, Human
ggacaccagccaggcucugu

SEQ ID NO: 3636115 - RNA, 12 nt, Human
ggacacccugug

SEQ ID NO: 3636116 - RNA, 11 nt, Human
ggacaccugcc

SEQ ID NO: 3636117 - RNA, 12 nt, Human
ggacaccugccc

SEQ ID NO: 3636118 - RNA, 19 nt, Human
ggacaccugggagaaaucu

SEQ ID NO: 3636119 - RNA, 18 nt, Human
ggacaccuguacuggaga

SEQ ID NO: 3636120 - RNA, 21 nt, Human
ggacaccuguacuggagagca

SEQ ID NO: 3636121 - RNA, 16 nt, Human
ggacacgcucaguggg

SEQ ID NO: 3636122 - RNA, 22 nt, Human
ggacacgcucaguggggcagag

SEQ ID NO: 3636123 - RNA, 21 nt, Human
ggacacgggcagccuggcucc

SEQ ID NO: 3636124 - RNA, 22 nt, Human
ggacacucaaaagcugggcagg

SEQ ID NO: 3636125 - RNA, 14 nt, Human
ggacacuccuagag

SEQ ID NO: 3636126 - RNA, 16 nt, Human
ggacacuuaauacuac

SEQ ID NO: 3636127 - RNA, 18 nt, Human
ggacacuucccucuguuu

SEQ ID NO: 3636128 - RNA, 14 nt, Human
ggacagaagaaggc

SEQ ID NO: 3636129 - RNA, 14 nt, Human
ggacagaagcagcu

SEQ ID NO: 3636130 - RNA, 16 nt, Human
ggacagaagcagcucu

SEQ ID NO: 3636131 - RNA, 18 nt, Human
ggacagaaggcuccugcc

SEQ ID NO: 3636132 - RNA, 14 nt, Human
ggacagagacaccu

SEQ ID NO: 3636133 - RNA, 19 nt, Human
ggacagagacaccugcacc

SEQ ID NO: 3636134 - RNA, 20 nt, Human
ggacagagacaccugcaccu

SEQ ID NO: 3636135 - RNA, 14 nt, Human
ggacagagccaugc

SEQ ID NO: 3636136 - RNA, 17 nt, Human
ggacagaggccccagcc

SEQ ID NO: 3636137 - RNA, 18 nt, Human
ggacagaggccccagccu

SEQ ID NO: 3636138 - RNA, 19 nt, Human
ggacagaggggacucuggg

SEQ ID NO: 3636139 - RNA, 21 nt, Human
ggacagagguuaucuguccca

SEQ ID NO: 3636140 - RNA, 19 nt, Human
ggacagaucaauggcgcag

SEQ ID NO: 3636141 - RNA, 20 nt, Human
ggacagaugccuccuuccuc

SEQ ID NO: 3636142 - RNA, 16 nt, Human
ggacagauucagucuu

SEQ ID NO: 3636143 - RNA, 20 nt, Human
ggacagauucagucuugccu

SEQ ID NO: 3636144 - RNA, 20 nt, Human
ggacagcaaaaccauugcuu

SEQ ID NO: 3636145 - RNA, 22 nt, Human
ggacagcaaaaccauugcuuca

SEQ ID NO: 3636146 - RNA, 19 nt, Human
ggacagcauggugcaugcc

SEQ ID NO: 3636147 - RNA, 19 nt, Human
ggacagccacggccaggcc

SEQ ID NO: 3636148 - RNA, 14 nt, Human
ggacagcccacuga

SEQ ID NO: 3636149 - RNA, 15 nt, Human
ggacagcuccuucug

SEQ ID NO: 3636150 - RNA, 19 nt, Human
ggacagcuccuucuguccu

SEQ ID NO: 3636151 - RNA, 20 nt, Human
ggacagcuccuucuguccua

SEQ ID NO: 3636152 - RNA, 11 nt, Human
ggacagcuguc

SEQ ID NO: 3636153 - RNA, 11 nt, Human
ggacagcugug

SEQ ID NO: 3636154 - RNA, 15 nt, Human
ggacagcugugccuc

SEQ ID NO: 3636155 - RNA, 17 nt, Human
ggacagcugugccucgc

SEQ ID NO: 3636156 - RNA, 12 nt, Human
ggacagcuugug

SEQ ID NO: 3636157 - RNA, 15 nt, Human
ggacaggaccccagc

SEQ ID NO: 3636158 - RNA, 18 nt, Human
ggacaggaccccagcucu

SEQ ID NO: 3636159 - RNA, 16 nt, Human
ggacaggcagaaagag

SEQ ID NO: 3636160 - RNA, 16 nt, Human
ggacaggccucaccuc

SEQ ID NO: 3636161 - RNA, 14 nt, Human
ggacaggcucugcu

SEQ ID NO: 3636162 - RNA, 21 nt, Human
ggacaggcugcggccccuccc

SEQ ID NO: 3636163 - RNA, 15 nt, Human
ggacagggguuccuu

SEQ ID NO: 3636164 - RNA, 18 nt, Human
ggacaguauuugugggga

SEQ ID NO: 3636165 - RNA, 18 nt, Human
ggacagucaccucaugga

SEQ ID NO: 3636166 - RNA, 21 nt, Human
ggacagucaccucauggaauu

SEQ ID NO: 3636167 - RNA, 14 nt, Human
ggacaguccuggga

SEQ ID NO: 3636168 - RNA, 19 nt, Human
ggacagucugcucuagaug

SEQ ID NO: 3636169 - RNA, 16 nt, Human
ggacagugcuucagcc

SEQ ID NO: 3636170 - RNA, 17 nt, Human
ggacagugcuucagccu

SEQ ID NO: 3636171 - RNA, 18 nt, Human
ggacagugcuucagccug

SEQ ID NO: 3636172 - RNA, 23 nt, Human
ggacagugcuugauacaggaaca

SEQ ID NO: 3636173 - RNA, 12 nt, Human
ggacaguggcag

SEQ ID NO: 3636174 - RNA, 13 nt, Human
ggacaguggcagg

SEQ ID NO: 3636175 - RNA, 15 nt, Human
ggacaguucacaccc

SEQ ID NO: 3636176 - RNA, 17 nt, Human
ggacaguucacacccug

SEQ ID NO: 3636177 - RNA, 19 nt, Human
ggacauaacugacuuaguu

SEQ ID NO: 3636178 - RNA, 23 nt, Human
ggacauaaugggguccuggccau

SEQ ID NO: 3636179 - RNA, 22 nt, Human
ggacauagagagggagaagaag

SEQ ID NO: 3636180 - RNA, 16 nt, Human
ggacaugcaauaaaau

SEQ ID NO: 3636181 - RNA, 19 nt, Human
ggacaugcaauaaaauuua

SEQ ID NO: 3636182 - RNA, 16 nt, Human
ggacaugcugaagcca

SEQ ID NO: 3636183 - RNA, 18 nt, Human
ggacauggccccugugag

SEQ ID NO: 3636184 - RNA, 16 nt, Human
ggacauuccaagacag

SEQ ID NO: 3636185 - RNA, 17 nt, Human
ggacauuugcucaugga

SEQ ID NO: 3636186 - RNA, 23 nt, Human
ggaccaaaaaccaguauuguaca

SEQ ID NO: 3636187 - RNA, 20 nt, Human
ggaccaacccuguuuccuga

SEQ ID NO: 3636188 - RNA, 11 nt, Human
ggaccaaggca

SEQ ID NO: 3636189 - RNA, 17 nt, Human
ggaccaaggcaaggcag

SEQ ID NO: 3636190 - RNA, 23 nt, Human
ggaccaaggcaaggcaggugccu

SEQ ID NO: 3636191 - RNA, 21 nt, Human
ggaccacaccucccugaacca

SEQ ID NO: 3636192 - RNA, 20 nt, Human
ggaccacagcaaggcaccug

SEQ ID NO: 3636193 - RNA, 14 nt, Human
ggaccacaggcuca

SEQ ID NO: 3636194 - RNA, 14 nt, Human
ggaccacauuuuau

SEQ ID NO: 3636195 - RNA, 16 nt, Human
ggaccacccugagccg

SEQ ID NO: 3636196 - RNA, 18 nt, Human
ggaccacccugagccggc

SEQ ID NO: 3636197 - RNA, 23 nt, Human
ggaccacgucuauuucaucagaa

SEQ ID NO: 3636198 - RNA, 21 nt, Human
ggaccacucagccccuaggag

SEQ ID NO: 3636199 - RNA, 18 nt, Human
ggaccacuguuucuugcu

SEQ ID NO: 3636200 - RNA, 18 nt, Human
ggaccagaagcuccccca

SEQ ID NO: 3636201 - RNA, 15 nt, Human
ggaccagcacacucc

SEQ ID NO: 3636202 - RNA, 15 nt, Human
ggaccagccagcagc

SEQ ID NO: 3636203 - RNA, 13 nt, Human
ggaccagcccacg

SEQ ID NO: 3636204 - RNA, 16 nt, Human
ggaccagcccacgcug

SEQ ID NO: 3636205 - RNA, 12 nt, Human
ggaccagccugg

SEQ ID NO: 3636206 - RNA, 19 nt, Human
ggaccagcucaggacagau

SEQ ID NO: 3636207 - RNA, 12 nt, Human
ggaccagcuggg

SEQ ID NO: 3636208 - RNA, 22 nt, Human
ggaccagcuggggcguggggag

SEQ ID NO: 3636209 - RNA, 17 nt, Human
ggaccagcuuggcucag

SEQ ID NO: 3636210 - RNA, 18 nt, Human
ggaccagcuuggcucagg

SEQ ID NO: 3636211 - RNA, 15 nt, Human
ggaccaggacucccu

SEQ ID NO: 3636212 - RNA, 20 nt, Human
ggaccaggagugggugggga

SEQ ID NO: 3636213 - RNA, 18 nt, Human
ggaccaggcaccaggcag

SEQ ID NO: 3636214 - RNA, 12 nt, Human
ggaccagggccu

SEQ ID NO: 3636215 - RNA, 17 nt, Human
ggaccaggguuggcacc

SEQ ID NO: 3636216 - RNA, 20 nt, Human
ggaccagugguuuccaguca

SEQ ID NO: 3636217 - RNA, 17 nt, Human
ggaccaucauccuacug

SEQ ID NO: 3636218 - RNA, 14 nt, Human
ggaccauccuauuu

SEQ ID NO: 3636219 - RNA, 21 nt, Human
ggaccauggaguggcagccca

SEQ ID NO: 3636220 - RNA, 16 nt, Human
ggacccaaugcacaca

SEQ ID NO: 3636221 - RNA, 19 nt, Human
ggacccaauguaggagcug

SEQ ID NO: 3636222 - RNA, 22 nt, Human
ggccauccggcccccagagcgc

SEQ ID NO: 3636223 - RNA, 16 nt, Human
ggccaucugcuccugg

SEQ ID NO: 3636224 - RNA, 21 nt, Human
ggccaucugguuaggauggca

SEQ ID NO: 3636225 - RNA, 19 nt, Human
ggccaucuuccaggugggg

SEQ ID NO: 3636226 - RNA, 18 nt, Human
ggccaugacccugccucu

SEQ ID NO: 3636227 - RNA, 20 nt, Human
ggccaugacccugccucucc

SEQ ID NO: 3636228 - RNA, 17 nt, Human
ggccaugagcuccagac

SEQ ID NO: 3636229 - RNA, 14 nt, Human
ggccaugccugccc

SEQ ID NO: 3636230 - RNA, 18 nt, Human
ggccaugcuccucuuccc

SEQ ID NO: 3636231 - RNA, 16 nt, Human
ggccaugcugaaggga

SEQ ID NO: 3636232 - RNA, 14 nt, Human
ggccauggacucug

SEQ ID NO: 3636233 - RNA, 15 nt, Human
ggccauggaggcagu

SEQ ID NO: 3636234 - RNA, 13 nt, Human
ggccauggccugc

SEQ ID NO: 3636235 - RNA, 15 nt, Human
ggccauggccugcaa

SEQ ID NO: 3636236 - RNA, 14 nt, Human
ggccauggcucagg

SEQ ID NO: 3636237 - RNA, 21 nt, Human
ggccaugggaggccuuucccu

SEQ ID NO: 3636238 - RNA, 13 nt, Human
ggccaugggccuc

SEQ ID NO: 3636239 - RNA, 16 nt, Human
ggccaugucagacaca

SEQ ID NO: 3636240 - RNA, 17 nt, Human
ggccaugucagacacag

SEQ ID NO: 3636241 - RNA, 15 nt, Human
ggccauguccaaaga

SEQ ID NO: 3636242 - RNA, 12 nt, Human
ggccauucagca

SEQ ID NO: 3636243 - RNA, 17 nt, Human
ggccauugugaaccaau

SEQ ID NO: 3636244 - RNA, 18 nt, Human
ggccauuugcaauaacag

SEQ ID NO: 3636245 - RNA, 21 nt, Human
ggccauuugcaauaacagcug

SEQ ID NO: 3636246 - RNA, 21 nt, Human
ggcccaaauuaucaagcuaau

SEQ ID NO: 3636247 - RNA, 23 nt, Human
ggcccaaauuaucaagcuaauaa

SEQ ID NO: 3636248 - RNA, 14 nt, Human
ggcccaacauuaaa

SEQ ID NO: 3636249 - RNA, 13 nt, Human
ggcccaacccugu

SEQ ID NO: 3636250 - RNA, 19 nt, Human
ggcccaagagaugaagagu

SEQ ID NO: 3636251 - RNA, 14 nt, Human
ggcccaaggcggcc

SEQ ID NO: 3636252 - RNA, 21 nt, Human
ggcccaaggcggccccucccg

SEQ ID NO: 3636253 - RNA, 14 nt, Human
ggcccaagucccug

SEQ ID NO: 3636254 - RNA, 15 nt, Human
ggcccaagucccugu

SEQ ID NO: 3636255 - RNA, 15 nt, Human
ggcccacacacaggu

SEQ ID NO: 3636256 - RNA, 19 nt, Human
ggcccacagcaggugcuga

SEQ ID NO: 3636257 - RNA, 18 nt, Human
ggcccacauuggaagagc

SEQ ID NO: 3636258 - RNA, 15 nt, Human
ggcccaccagagcug

SEQ ID NO: 3636259 - RNA, 15 nt, Human
ggcccaccagggucc

SEQ ID NO: 3636260 - RNA, 21 nt, Human
ggcccaccuaccuucaaagcu

SEQ ID NO: 3636261 - RNA, 17 nt, Human
ggcccaccuggccaccu

SEQ ID NO: 3636262 - RNA, 18 nt, Human
ggcccaccuggccaccug

SEQ ID NO: 3636263 - RNA, 21 nt, Human
ggcccaccuuccccagaacca

SEQ ID NO: 3636264 - RNA, 23 nt, Human
ggcccacucaggggucacugagg

SEQ ID NO: 3636265 - RNA, 21 nt, Human
ggcccacugugccucagagac

SEQ ID NO: 3636266 - RNA, 12 nt, Human
ggcccagaggca

SEQ ID NO: 3636267 - RNA, 16 nt, Human
ggcccagaggcacagc

SEQ ID NO: 3636268 - RNA, 17 nt, Human
ggcccagagggccugca

SEQ ID NO: 3636269 - RNA, 20 nt, Human
ggcccagcaccacccuccuu

SEQ ID NO: 3636270 - RNA, 17 nt, Human
ggcccagcccccacagu

SEQ ID NO: 3636271 - RNA, 19 nt, Human
ggcccagcccccacagugc

SEQ ID NO: 3636272 - RNA, 12 nt, Human
ggcccagccccu

SEQ ID NO: 3636273 - RNA, 13 nt, Human
ggcccagccccua

SEQ ID NO: 3636274 - RNA, 14 nt, Human
ggcccagcccggcu

SEQ ID NO: 3636275 - RNA, 15 nt, Human
ggcccagcccggcuc

SEQ ID NO: 3636276 - RNA, 19 nt, Human
ggcccagcccggcucccac

SEQ ID NO: 3636277 - RNA, 13 nt, Human
ggcccagcccugc

SEQ ID NO: 3636278 - RNA, 15 nt, Human
ggcccagcccugcug

SEQ ID NO: 3636279 - RNA, 16 nt, Human
ggcccagcccugcugg

SEQ ID NO: 3636280 - RNA, 18 nt, Human
ggcccagccgacccccuc

SEQ ID NO: 3636281 - RNA, 12 nt, Human
ggcccagccggc

SEQ ID NO: 3636282 - RNA, 11 nt, Human
ggcccagccuu

SEQ ID NO: 3636283 - RNA, 12 nt, Human
ggcccagccuuu

SEQ ID NO: 3636284 - RNA, 16 nt, Human
ggcccagcgaccucgg

SEQ ID NO: 3636285 - RNA, 24 nt, Human
ggcccagcgcggacauccccugcu

SEQ ID NO: 3636286 - RNA, 23 nt, Human
ggcccagcggccccucccacaca

SEQ ID NO: 3636287 - RNA, 12 nt, Human
ggcccagcuccc

SEQ ID NO: 3636288 - RNA, 15 nt, Human
ggcccagcugggcuc

SEQ ID NO: 3636289 - RNA, 21 nt, Human
ggcccagcugggcucugccac

SEQ ID NO: 3636290 - RNA, 11 nt, Human
ggcccaggagu

SEQ ID NO: 3636291 - RNA, 13 nt, Human
ggcccaggaguuu

SEQ ID NO: 3636292 - RNA, 19 nt, Human
ggcccaggaguuuggccag

SEQ ID NO: 3636293 - RNA, 20 nt, Human
ggcccaggaguuuggccaga

SEQ ID NO: 3636294 - RNA, 22 nt, Human
ggcccaggaguuuggccagaag

SEQ ID NO: 3636295 - RNA, 15 nt, Human
ggcccaggcaggcca

SEQ ID NO: 3636296 - RNA, 11 nt, Human
ggcccaggcug

SEQ ID NO: 3636297 - RNA, 14 nt, Human
ggcccaggcuggga

SEQ ID NO: 3636298 - RNA, 10 nt, Human
ggcccaggga

SEQ ID NO: 3636299 - RNA, 17 nt, Human
ggcccagggacaccagc

SEQ ID NO: 3636300 - RNA, 19 nt, Human
ggcccagggacaccagcca

SEQ ID NO: 3636301 - RNA, 23 nt, Human
ggcccagggacaccagccaggcu

SEQ ID NO: 3636302 - RNA, 19 nt, Human
ggcccagggcaagcuccgc

SEQ ID NO: 3636303 - RNA, 22 nt, Human
ggcccagggcaagcuccgcagg

SEQ ID NO: 3636304 - RNA, 12 nt, Human
ggcccagggcau

SEQ ID NO: 3636305 - RNA, 16 nt, Human
ggcccagggcccagag

SEQ ID NO: 3636306 - RNA, 21 nt, Human
ggcccagggcccagagcccag

SEQ ID NO: 3636307 - RNA, 18 nt, Human
ggcccaggggaggcggca

SEQ ID NO: 3636308 - RNA, 19 nt, Human
ggcccaggguggccacacc

SEQ ID NO: 3636309 - RNA, 18 nt, Human
ggcccaggucagccacug

SEQ ID NO: 3636310 - RNA, 20 nt, Human
ggcccaggucagccacuguu

SEQ ID NO: 3636311 - RNA, 22 nt, Human
ggcccaguaugagcccuagaag

SEQ ID NO: 3636312 - RNA, 16 nt, Human
ggcccaguccuggccu

SEQ ID NO: 3636313 - RNA, 21 nt, Human
ggcccaguccuggccuggcuu

SEQ ID NO: 3636314 - RNA, 18 nt, Human
ggcccagugcaugguggc

SEQ ID NO: 3636315 - RNA, 22 nt, Human
ggcccagugcaugguggccaga

SEQ ID NO: 3636316 - RNA, 19 nt, Human
ggcccagugucaaguugug

SEQ ID NO: 3636317 - RNA, 18 nt, Human
ggcccauagcagccaguu

SEQ ID NO: 3636318 - RNA, 16 nt, Human
ggcccaucaguguacc

SEQ ID NO: 3636319 - RNA, 19 nt, Human
ggcccaucauggggggagc

SEQ ID NO: 3636320 - RNA, 13 nt, Human
ggcccaucucccu

SEQ ID NO: 3636321 - RNA, 23 nt, Human
ggcccauggcuguuggugggacc

SEQ ID NO: 3636322 - RNA, 16 nt, Human
ggcccaugggagggag

SEQ ID NO: 3636323 - RNA, 17 nt, Human
ggcccaugggagggagc

SEQ ID NO: 3636324 - RNA, 17 nt, Human
ggcccauggggaggacg

SEQ ID NO: 3636325 - RNA, 19 nt, Human
ggcccauguauggccagga

SEQ ID NO: 3636326 - RNA, 14 nt, Human
ggcccauucuacuu

SEQ ID NO: 3636327 - RNA, 18 nt, Human
ggcccauucuacuugcuc

SEQ ID NO: 3636328 - RNA, 21 nt, Human
ggcccauucuacuugcucugg

SEQ ID NO: 3636329 - RNA, 18 nt, Human
ggccccaacccuguccuc

SEQ ID NO: 3636330 - RNA, 23 nt, Human
ggccccacucccuugcuggcccc

SEQ ID NO: 3636331 - RNA, 18 nt, Human
ggccccagcacagcuuga

SEQ ID NO: 3636332 - RNA, 17 nt, Human
ggccccagcaccucagc

SEQ ID NO: 3636333 - RNA, 20 nt, Human
ggccccagcaccucagccug

SEQ ID NO: 3636334 - RNA, 21 nt, Human
ggccccagcacuaaagcagug

SEQ ID NO: 3636335 - RNA, 21 nt, Human
ggccccagccagaguuccugc

SEQ ID NO: 3636336 - RNA, 13 nt, Human
ggccccagcccac

SEQ ID NO: 3636337 - RNA, 15 nt, Human
ggccccagcccugcu

SEQ ID NO: 3636338 - RNA, 17 nt, Human
ggccccagccuggccca

SEQ ID NO: 3636339 - RNA, 22 nt, Human
ggccccagccuggcccagcucc

SEQ ID NO: 3636340 - RNA, 13 nt, Human
ggccccaggaagc

SEQ ID NO: 3636341 - RNA, 16 nt, Human
ggccccaggaccuggc

SEQ ID NO: 3636342 - RNA, 21 nt, Human
ggccccaggaccuggcugcca

SEQ ID NO: 3636343 - RNA, 13 nt, Human
ggccccagggcac

SEQ ID NO: 3636344 - RNA, 18 nt, Human
ggccccagggcuacccuc

SEQ ID NO: 3636345 - RNA, 17 nt, Human
ggccccagucagccucu

SEQ ID NO: 3636346 - RNA, 23 nt, Human
ggccccagucagccucucuccca

SEQ ID NO: 3636347 - RNA, 16 nt, Human
ggcccccaaccucagg

SEQ ID NO: 3636348 - RNA, 20 nt, Human
ggcccccaaccucagggcuc

SEQ ID NO: 3636349 - RNA, 21 nt, Human
ggcccccaaccucagggcucc

SEQ ID NO: 3636350 - RNA, 23 nt, Human
ggcccccaaccucagggcuccca

SEQ ID NO: 3636351 - RNA, 24 nt, Human
ggcccccacauuugugccgacacu

SEQ ID NO: 3636352 - RNA, 21 nt, Human
ggcccccaccacacaucccag

SEQ ID NO: 3636353 - RNA, 18 nt, Human
ggcccccacuggcugugg

SEQ ID NO: 3636354 - RNA, 15 nt, Human
ggcccccacuugccu

SEQ ID NO: 3636355 - RNA, 16 nt, Human
ggcccccacuugccuc

SEQ ID NO: 3636356 - RNA, 17 nt, Human
ggcccccaggugccagu

SEQ ID NO: 3636357 - RNA, 15 nt, Human
ggcccccaucucaug

SEQ ID NO: 3636358 - RNA, 19 nt, Human
ggccccccagcucaggggc

SEQ ID NO: 3636359 - RNA, 14 nt, Human
ggcccccccagcug

SEQ ID NO: 3636360 - RNA, 14 nt, Human
ggccccccugcccu

SEQ ID NO: 3636361 - RNA, 16 nt, Human
ggccccccugcccugu

SEQ ID NO: 3636362 - RNA, 15 nt, Human
ggccccccugguccc

SEQ ID NO: 3636363 - RNA, 15 nt, Human
ggcccccuccaucgg

SEQ ID NO: 3636364 - RNA, 14 nt, Human
ggcccccuguccuc

SEQ ID NO: 3636365 - RNA, 18 nt, Human
ggcccccuuucccgggcu

SEQ ID NO: 3636366 - RNA, 19 nt, Human
ggcccccuuucccgggcug

SEQ ID NO: 3636367 - RNA, 15 nt, Human
ggccugaugcucccu

SEQ ID NO: 3636368 - RNA, 20 nt, Human
ggccugaugcucccuccccu

SEQ ID NO: 3636369 - RNA, 23 nt, Human
ggccugaugcucccuccccugcc

SEQ ID NO: 3636370 - RNA, 16 nt, Human
ggccugcaaacuggga

SEQ ID NO: 3636371 - RNA, 16 nt, Human
ggccugcaagggagug

SEQ ID NO: 3636372 - RNA, 12 nt, Human
ggccugcacaca

SEQ ID NO: 3636373 - RNA, 14 nt, Human
ggccugcacaguga

SEQ ID NO: 3636374 - RNA, 21 nt, Human
ggccugcacggugggccuugc

SEQ ID NO: 3636375 - RNA, 20 nt, Human
ggccugcagcaggaguggug

SEQ ID NO: 3636376 - RNA, 21 nt, Human
ggccugcaggaccugccugua

SEQ ID NO: 3636377 - RNA, 13 nt, Human
ggccugccagacg

SEQ ID NO: 3636378 - RNA, 12 nt, Human
ggccugccagga

SEQ ID NO: 3636379 - RNA, 14 nt, Human
ggccugccaggagg

SEQ ID NO: 3636380 - RNA, 16 nt, Human
ggccugcccucaggga

SEQ ID NO: 3636381 - RNA, 21 nt, Human
ggccugccgggcugagggccu

SEQ ID NO: 3636382 - RNA, 18 nt, Human
ggccugccuccagggcug

SEQ ID NO: 3636383 - RNA, 19 nt, Human
ggccugccuccagggcugg

SEQ ID NO: 3636384 - RNA, 11 nt, Human
ggccugccugu

SEQ ID NO: 3636385 - RNA, 18 nt, Human
ggccugccuugaagccac

SEQ ID NO: 3636386 - RNA, 18 nt, Human
ggccugcgacccuggggg

SEQ ID NO: 3636387 - RNA, 23 nt, Human
ggccugcgacccugggggcacag

SEQ ID NO: 3636388 - RNA, 14 nt, Human
ggccugcuccagac

SEQ ID NO: 3636389 - RNA, 14 nt, Human
ggccugcugcugag

SEQ ID NO: 3636390 - RNA, 15 nt, Human
ggccugcugcugaga

SEQ ID NO: 3636391 - RNA, 22 nt, Human
ggccugcugcugagaaccuggc

SEQ ID NO: 3636392 - RNA, 23 nt, Human
ggccugcugcugagaaccuggcc

SEQ ID NO: 3636393 - RNA, 20 nt, Human
ggccugcuggaggccucagg

SEQ ID NO: 3636394 - RNA, 19 nt, Human
ggccugcugugauuccacu

SEQ ID NO: 3636395 - RNA, 16 nt, Human
ggccuggaccugccuc

SEQ ID NO: 3636396 - RNA, 11 nt, Human
ggccuggagau

SEQ ID NO: 3636397 - RNA, 21 nt, Human
ggccuggagcaggccuugcgc

SEQ ID NO: 3636398 - RNA, 21 nt, Human
ggccuggaucuccccacucua

SEQ ID NO: 3636399 - RNA, 11 nt, Human
ggccuggaugc

SEQ ID NO: 3636400 - RNA, 19 nt, Human
ggccuggauucauuuccug

SEQ ID NO: 3636401 - RNA, 17 nt, Human
ggccuggcacaucagaa

SEQ ID NO: 3636402 - RNA, 14 nt, Human
ggccuggcagcuca

SEQ ID NO: 3636403 - RNA, 19 nt, Human
ggccuggcauggcaccugu

SEQ ID NO: 3636404 - RNA, 13 nt, Human
ggccuggcauucu

SEQ ID NO: 3636405 - RNA, 14 nt, Human
ggccuggccaccuc

SEQ ID NO: 3636406 - RNA, 16 nt, Human
ggccuggccaccucuc

SEQ ID NO: 3636407 - RNA, 12 nt, Human
ggccuggccaga

SEQ ID NO: 3636408 - RNA, 18 nt, Human
ggccuggccagggccugg

SEQ ID NO: 3636409 - RNA, 23 nt, Human
ggccuggcccacagcaggugcug

SEQ ID NO: 3636410 - RNA, 12 nt, Human
ggccuggcccau

SEQ ID NO: 3636411 - RNA, 15 nt, Human
ggccuggccccucag

SEQ ID NO: 3636412 - RNA, 23 nt, Human
ggccuggccccucagggucccug

SEQ ID NO: 3636413 - RNA, 13 nt, Human
ggccuggccugag

SEQ ID NO: 3636414 - RNA, 16 nt, Human
ggccuggccugagcug

SEQ ID NO: 3636415 - RNA, 11 nt, Human
ggccuggcugg

SEQ ID NO: 3636416 - RNA, 12 nt, Human
ggccuggcuggc

SEQ ID NO: 3636417 - RNA, 19 nt, Human
ggccuggcuggcugagggc

SEQ ID NO: 3636418 - RNA, 21 nt, Human
ggccugggacaacugcuccca

SEQ ID NO: 3636419 - RNA, 11 nt, Human
ggccugggagg

SEQ ID NO: 3636420 - RNA, 14 nt, Human
ggccugggcaggag

SEQ ID NO: 3636421 - RNA, 19 nt, Human
ggccugggcaggagggagg

SEQ ID NO: 3636422 - RNA, 14 nt, Human
ggccugggccagag

SEQ ID NO: 3636423 - RNA, 12 nt, Human
ggccugggccug

SEQ ID NO: 3636424 - RNA, 17 nt, Human
ggccugggcuaggggac

SEQ ID NO: 3636425 - RNA, 18 nt, Human
ggccugggcuccuggacc

SEQ ID NO: 3636426 - RNA, 16 nt, Human
ggccuggggcuccuuu

SEQ ID NO: 3636427 - RNA, 18 nt, Human
ggccugggggcagggaga

SEQ ID NO: 3636428 - RNA, 11 nt, Human
ggccuggggug

SEQ ID NO: 3636429 - RNA, 18 nt, Human
ggccuggggugacccggc

SEQ ID NO: 3636430 - RNA, 11 nt, Human
ggccuggguuu

SEQ ID NO: 3636431 - RNA, 22 nt, Human
ggccugguuaaauaaggcaggg

SEQ ID NO: 3636432 - RNA, 23 nt, Human
ggccugguuaaauaaggcagggu

SEQ ID NO: 3636433 - RNA, 15 nt, Human
ggccuguccacaggc

SEQ ID NO: 3636434 - RNA, 21 nt, Human
ggccugucccuggccaucucu

SEQ ID NO: 3636435 - RNA, 22 nt, Human
ggccugucucaagcucuuccuu

SEQ ID NO: 3636436 - RNA, 20 nt, Human
ggccugucucauccccaggg

SEQ ID NO: 3636437 - RNA, 19 nt, Human
ggccugucucggaaccugu

SEQ ID NO: 3636438 - RNA, 13 nt, Human
ggccugucuguga

SEQ ID NO: 3636439 - RNA, 22 nt, Human
ggccugucugugaagagcaaga

SEQ ID NO: 3636440 - RNA, 11 nt, Human
ggccugugagc

SEQ ID NO: 3636441 - RNA, 22 nt, Human
ggccuguggaaugagugugcau

SEQ ID NO: 3636442 - RNA, 19 nt, Human
ggccuguguagcugugacc

SEQ ID NO: 3636443 - RNA, 22 nt, Human
ggccuguguagcugugaccugc

SEQ ID NO: 3636444 - RNA, 23 nt, Human
ggccuguguagcugugaccugcu

SEQ ID NO: 3636445 - RNA, 20 nt, Human
ggccugugucccaugaccca

SEQ ID NO: 3636446 - RNA, 21 nt, Human
ggccugugucuaguuguuuga

SEQ ID NO: 3636447 - RNA, 18 nt, Human
ggccuguguggccacuuc

SEQ ID NO: 3636448 - RNA, 16 nt, Human
ggccuguguucuuccu

SEQ ID NO: 3636449 - RNA, 22 nt, Human
ggccuguguucuuccuggccgc

SEQ ID NO: 3636450 - RNA, 15 nt, Human
ggccuguugcuauag

SEQ ID NO: 3636451 - RNA, 16 nt, Human
ggccuuaauuuccuuu

SEQ ID NO: 3636452 - RNA, 20 nt, Human
ggccuuaauuuccuuuuuga

SEQ ID NO: 3636453 - RNA, 15 nt, Human
ggccuuagggcacug

SEQ ID NO: 3636454 - RNA, 22 nt, Human
ggccuuagugggccagggcugc

SEQ ID NO: 3636455 - RNA, 20 nt, Human
ggccuucacaaucugucagu

SEQ ID NO: 3636456 - RNA, 17 nt, Human
ggccuucagggagugag

SEQ ID NO: 3636457 - RNA, 13 nt, Human
ggccuuccccagc

SEQ ID NO: 3636458 - RNA, 14 nt, Human
ggccuuccugcccu

SEQ ID NO: 3636459 - RNA, 12 nt, Human
ggccuucucuga

SEQ ID NO: 3636460 - RNA, 16 nt, Human
ggccuugaguccccca

SEQ ID NO: 3636461 - RNA, 13 nt, Human
ggccuugcccaga

SEQ ID NO: 3636462 - RNA, 16 nt, Human
ggccuugcccagagau

SEQ ID NO: 3636463 - RNA, 17 nt, Human
ggccuugcggcuccuca

SEQ ID NO: 3636464 - RNA, 11 nt, Human
ggccuugcuga

SEQ ID NO: 3636465 - RNA, 19 nt, Human
ggccuugggcccucugguu

SEQ ID NO: 3636466 - RNA, 13 nt, Human
ggccuugggcucc

SEQ ID NO: 3636467 - RNA, 14 nt, Human
ggccuuguggucca

SEQ ID NO: 3636468 - RNA, 22 nt, Human
ggccuuuaaaauuuuuuuagaa

SEQ ID NO: 3636469 - RNA, 12 nt, Human
ggccuuucccac

SEQ ID NO: 3636470 - RNA, 15 nt, Human
ggccuuucccuaagc

SEQ ID NO: 3636471 - RNA, 16 nt, Human
ggccuuucugugugug

SEQ ID NO: 3636472 - RNA, 14 nt, Human
ggccuuugcgcucc

SEQ ID NO: 3636473 - RNA, 16 nt, Human
ggccuuugcuuaugaa

SEQ ID NO: 3636474 - RNA, 13 nt, Human
ggccuuuggcuuc

SEQ ID NO: 3636475 - RNA, 12 nt, Human
ggccuuuuccua

SEQ ID NO: 3636476 - RNA, 16 nt, Human
ggccuuuucuggcacc

SEQ ID NO: 3636477 - RNA, 15 nt, Human
ggccuuuuucauuua

SEQ ID NO: 3636478 - RNA, 20 nt, Human
ggcgacagagcgagacuccg

SEQ ID NO: 3636479 - RNA, 17 nt, Human
ggcgaccaccgccccug

SEQ ID NO: 3636480 - RNA, 19 nt, Human
ggcgaccccgucacagccu

SEQ ID NO: 3636481 - RNA, 18 nt, Human
ggcgagaagggcugcuuc

SEQ ID NO: 3636482 - RNA, 18 nt, Human
ggcgagagaggagccaga

SEQ ID NO: 3636483 - RNA, 21 nt, Human
ggcgaggggaggguggcaggu

SEQ ID NO: 3636484 - RNA, 18 nt, Human
ggcgaucacaacgugcau

SEQ ID NO: 3636485 - RNA, 22 nt, Human
ggcgcaagccuguaaucccagc

SEQ ID NO: 3636486 - RNA, 18 nt, Human
ggcgcaagggaggcccag

SEQ ID NO: 3636487 - RNA, 20 nt, Human
ggcgcaagggaggcccagcg

SEQ ID NO: 3636488 - RNA, 12 nt, Human
ggcgcacuguga

SEQ ID NO: 3636489 - RNA, 22 nt, Human
ggcgcacuuuccuccuggcaga

SEQ ID NO: 3636490 - RNA, 23 nt, Human
ggcgcagcauauucaggaagcuc

SEQ ID NO: 3636491 - RNA, 16 nt, Human
ggcgcaggugggcugg

SEQ ID NO: 3636492 - RNA, 17 nt, Human
ggcgcagugccucuggu

SEQ ID NO: 3636493 - RNA, 18 nt, Human
ggcgccaccagcucugcc

SEQ ID NO: 3636494 - RNA, 15 nt, Human
ggcgccaccauccug

SEQ ID NO: 3636495 - RNA, 19 nt, Human
ggcgccccaacccguggag

SEQ ID NO: 3636496 - RNA, 18 nt, Human
ggcgccccccccucccca

SEQ ID NO: 3636497 - RNA, 11 nt, Human
ggcgcccucug

SEQ ID NO: 3636498 - RNA, 12 nt, Human
ggcgcccuggaa

SEQ ID NO: 3636499 - RNA, 16 nt, Human
ggcgcccuggaagccg

SEQ ID NO: 3636500 - RNA, 18 nt, Human
ggcgccgugcugggcagc

SEQ ID NO: 3636501 - RNA, 19 nt, Human
ggcgccgugcugggcagcc

SEQ ID NO: 3636502 - RNA, 22 nt, Human
ggcgccucaacucugcugaggg

SEQ ID NO: 3636503 - RNA, 18 nt, Human
ggcgccuguagucccagc

SEQ ID NO: 3636504 - RNA, 16 nt, Human
ggcgcuauuacaaaua

SEQ ID NO: 3636505 - RNA, 12 nt, Human
ggcgcuggccca

SEQ ID NO: 3636506 - RNA, 14 nt, Human
ggcgcuggcccagc

SEQ ID NO: 3636507 - RNA, 20 nt, Human
ggcggaccuuguagugagcc

SEQ ID NO: 3636508 - RNA, 21 nt, Human
ggcggaccuuguagugagccg

SEQ ID NO: 3636509 - RNA, 17 nt, Human
ggcggacguuccagccg

SEQ ID NO: 3636510 - RNA, 13 nt, Human
ggcggagccggcc

SEQ ID NO: 3636511 - RNA, 14 nt, Human
ggcggagcuggccc

SEQ ID NO: 3636512 - RNA, 17 nt, Human
ggcggagcuggccccgc

SEQ ID NO: 3636513 - RNA, 23 nt, Human
gggguucccuuuuuuggcugcug

SEQ ID NO: 3636514 - RNA, 18 nt, Human
gggguuccucaaauuuuu

SEQ ID NO: 3636515 - RNA, 18 nt, Human
gggguuccuucugggcau

SEQ ID NO: 3636516 - RNA, 20 nt, Human
gggguucuuucuuccucugc

SEQ ID NO: 3636517 - RNA, 20 nt, Human
gggguugccacaggccuccc

SEQ ID NO: 3636518 - RNA, 19 nt, Human
gggguuucgcagccugagu

SEQ ID NO: 3636519 - RNA, 22 nt, Human
ggguaaaauuccuuagcuuaga

SEQ ID NO: 3636520 - RNA, 11 nt, Human
ggguaaacaau

SEQ ID NO: 3636521 - RNA, 21 nt, Human
ggguaaacccucacaucagag

SEQ ID NO: 3636522 - RNA, 19 nt, Human
ggguaacuaacuaaaacaa

SEQ ID NO: 3636523 - RNA, 13 nt, Human
ggguaagagagga

SEQ ID NO: 3636524 - RNA, 16 nt, Human
ggguaaggcccccucu

SEQ ID NO: 3636525 - RNA, 20 nt, Human
ggguaagggauuucuuaggg

SEQ ID NO: 3636526 - RNA, 16 nt, Human
ggguaaugagaggugg

SEQ ID NO: 3636527 - RNA, 20 nt, Human
ggguaauuuagauuguaaac

SEQ ID NO: 3636528 - RNA, 15 nt, Human
ggguacagcugggcu

SEQ ID NO: 3636529 - RNA, 18 nt, Human
ggguacccacugcucugg

SEQ ID NO: 3636530 - RNA, 23 nt, Human
ggguaccuugaacacugggggag

SEQ ID NO: 3636531 - RNA, 12 nt, Human
ggguacuaaauu

SEQ ID NO: 3636532 - RNA, 19 nt, Human
ggguacuuguggacacagc

SEQ ID NO: 3636533 - RNA, 22 nt, Human
ggguacuuguggacacagcucu

SEQ ID NO: 3636534 - RNA, 23 nt, Human
ggguacuuguggacacagcucuu

SEQ ID NO: 3636535 - RNA, 17 nt, Human
ggguagcagcuggacua

SEQ ID NO: 3636536 - RNA, 22 nt, Human
ggguagcagguaccacugauuu

SEQ ID NO: 3636537 - RNA, 21 nt, Human
ggguagccacuggacugacga

SEQ ID NO: 3636538 - RNA, 22 nt, Human
ggguagcccgccugccaguccu

SEQ ID NO: 3636539 - RNA, 20 nt, Human
ggguagcugccacuugaaca

SEQ ID NO: 3636540 - RNA, 21 nt, Human
ggguagcuucugaccucagca

SEQ ID NO: 3636541 - RNA, 19 nt, Human
ggguaggagggugggaagg

SEQ ID NO: 3636542 - RNA, 12 nt, Human
ggguaggcagga

SEQ ID NO: 3636543 - RNA, 16 nt, Human
ggguaggcgggaagga

SEQ ID NO: 3636544 - RNA, 14 nt, Human
ggguaggcuggagu

SEQ ID NO: 3636545 - RNA, 15 nt, Human
ggguagggaauaaaa

SEQ ID NO: 3636546 - RNA, 16 nt, Human
ggguauaucugggcug

SEQ ID NO: 3636547 - RNA, 23 nt, Human
ggguauauuuuuguuuguuuugu

SEQ ID NO: 3636548 - RNA, 22 nt, Human
ggguauggcguaaguacagaga

SEQ ID NO: 3636549 - RNA, 16 nt, Human
ggguauugcuugccac

SEQ ID NO: 3636550 - RNA, 12 nt, Human
ggguauuggaaa

SEQ ID NO: 3636551 - RNA, 12 nt, Human
gggucaaggaau

SEQ ID NO: 3636552 - RNA, 12 nt, Human
gggucacaggaa

SEQ ID NO: 3636553 - RNA, 22 nt, Human
gggucacucuggcagcucagag

SEQ ID NO: 3636554 - RNA, 16 nt, Human
gggucagaaacaggac

SEQ ID NO: 3636555 - RNA, 20 nt, Human
gggucagaggaccuguauuu

SEQ ID NO: 3636556 - RNA, 17 nt, Human
gggucagccagggccag

SEQ ID NO: 3636557 - RNA, 21 nt, Human
gggucaggccuuugagcucag

SEQ ID NO: 3636558 - RNA, 19 nt, Human
gggucagguugacaggagg

SEQ ID NO: 3636559 - RNA, 13 nt, Human
gggucagugcugc

SEQ ID NO: 3636560 - RNA, 18 nt, Human
gggucauagauguuuccu

SEQ ID NO: 3636561 - RNA, 14 nt, Human
gggucaugcccucc

SEQ ID NO: 3636562 - RNA, 13 nt, Human
ggguccagaagga

SEQ ID NO: 3636563 - RNA, 11 nt, Human
ggguccaggag

SEQ ID NO: 3636564 - RNA, 18 nt, Human
ggguccaggauuccucuu

SEQ ID NO: 3636565 - RNA, 20 nt, Human
ggguccaggccuacuccugu

SEQ ID NO: 3636566 - RNA, 16 nt, Human
ggguccagggagcagg

SEQ ID NO: 3636567 - RNA, 19 nt, Human
ggguccaguggaugccaca

SEQ ID NO: 3636568 - RNA, 22 nt, Human
gggucccaagcugggccccagc

SEQ ID NO: 3636569 - RNA, 16 nt, Human
gggucccagugggagg

SEQ ID NO: 3636570 - RNA, 17 nt, Human
gggucccagugggaggg

SEQ ID NO: 3636571 - RNA, 17 nt, Human
ggguccccaucauccca

SEQ ID NO: 3636572 - RNA, 22 nt, Human
ggguccccaucaucccagcugc

SEQ ID NO: 3636573 - RNA, 15 nt, Human
ggguccggcagcuuc

SEQ ID NO: 3636574 - RNA, 20 nt, Human
ggguccuaauuaccagucuu

SEQ ID NO: 3636575 - RNA, 15 nt, Human
ggguccuccuccagg

SEQ ID NO: 3636576 - RNA, 19 nt, Human
ggguccucugagacuccag

SEQ ID NO: 3636577 - RNA, 23 nt, Human
ggguccugcagccugcaggaccu

SEQ ID NO: 3636578 - RNA, 15 nt, Human
ggguccuggccaucc

SEQ ID NO: 3636579 - RNA, 18 nt, Human
ggguccuucccucucccc

SEQ ID NO: 3636580 - RNA, 12 nt, Human
ggguccuuccug

SEQ ID NO: 3636581 - RNA, 13 nt, Human
ggguccuuccuga

SEQ ID NO: 3636582 - RNA, 14 nt, Human
gggucgaaagcucu

SEQ ID NO: 3636583 - RNA, 13 nt, Human
gggucgcccugga

SEQ ID NO: 3636584 - RNA, 14 nt, Human
gggucgcccuggac

SEQ ID NO: 3636585 - RNA, 14 nt, Human
gggucggcugacca

SEQ ID NO: 3636586 - RNA, 19 nt, Human
gggucgggggcaggugcug

SEQ ID NO: 3636587 - RNA, 18 nt, Human
gggucguggagagcuagg

SEQ ID NO: 3636588 - RNA, 17 nt, Human
gggucuauuccagcuca

SEQ ID NO: 3636589 - RNA, 19 nt, Human
gggucuccaggaggagacu

SEQ ID NO: 3636590 - RNA, 16 nt, Human
gggucucccucuccug

SEQ ID NO: 3636591 - RNA, 18 nt, Human
gggucucccucuccugcc

SEQ ID NO: 3636592 - RNA, 19 nt, Human
gggucucccucuccugccu

SEQ ID NO: 3636593 - RNA, 20 nt, Human
gggucucuagugcugugaaa

SEQ ID NO: 3636594 - RNA, 18 nt, Human
gggucucucacagacagg

SEQ ID NO: 3636595 - RNA, 18 nt, Human
gggucucucccucaggug

SEQ ID NO: 3636596 - RNA, 12 nt, Human
gggucucugcug

SEQ ID NO: 3636597 - RNA, 21 nt, Human
gggucucuuuuguaaauuaaa

SEQ ID NO: 3636598 - RNA, 21 nt, Human
gggucugagucauggccgggu

SEQ ID NO: 3636599 - RNA, 23 nt, Human
gggucugcucccaaggggccuga

SEQ ID NO: 3636600 - RNA, 19 nt, Human
gggucugcucuuucucugc

SEQ ID NO: 3636601 - RNA, 22 nt, Human
gggucuggaguugaucuggaac

SEQ ID NO: 3636602 - RNA, 15 nt, Human
gggucuggcugagcu

SEQ ID NO: 3636603 - RNA, 13 nt, Human
gggucuggcuggu

SEQ ID NO: 3636604 - RNA, 15 nt, Human
gggucuggcuggugu

SEQ ID NO: 3636605 - RNA, 16 nt, Human
gggucuguaaaaucuu

SEQ ID NO: 3636606 - RNA, 21 nt, Human
gggucuguaaaaucuuucuuu

SEQ ID NO: 3636607 - RNA, 17 nt, Human
gggucugugugaaugug

SEQ ID NO: 3636608 - RNA, 22 nt, Human
gggucuugcaaaauuccugacg

SEQ ID NO: 3636609 - RNA, 14 nt, Human
gggugaaagaaauc

SEQ ID NO: 3636610 - RNA, 15 nt, Human
gggugaacuugguuc

SEQ ID NO: 3636611 - RNA, 14 nt, Human
gggugaaggcuggc

SEQ ID NO: 3636612 - RNA, 15 nt, Human
gggugaaggcuggca

SEQ ID NO: 3636613 - RNA, 17 nt, Human
gggugaagugaagacaa

SEQ ID NO: 3636614 - RNA, 18 nt, Human
gggugacagucaucauca

SEQ ID NO: 3636615 - RNA, 20 nt, Human
gggugacccggcacccccug

SEQ ID NO: 3636616 - RNA, 15 nt, Human
gggugaccuccggcc

SEQ ID NO: 3636617 - RNA, 18 nt, Human
gggugacgggacucaggc

SEQ ID NO: 3636618 - RNA, 22 nt, Human
gggugacgggacucaggcggga

SEQ ID NO: 3636619 - RNA, 19 nt, Human
gggugaguccauucuccca

SEQ ID NO: 3636620 - RNA, 18 nt, Human
gggugaguccuccagaac

SEQ ID NO: 3636621 - RNA, 17 nt, Human
gggugaugagggcagca

SEQ ID NO: 3636622 - RNA, 16 nt, Human
gggugaugccagguuc

SEQ ID NO: 3636623 - RNA, 16 nt, Human
gggugauuucagagag

SEQ ID NO: 3636624 - RNA, 14 nt, Human
gggugcacaggagg

SEQ ID NO: 3636625 - RNA, 19 nt, Human
gggugcacaggaggggguc

SEQ ID NO: 3636626 - RNA, 14 nt, Human
gggugccgccugcc

SEQ ID NO: 3636627 - RNA, 24 nt, Human
gggugccuaggccugggcagugga

SEQ ID NO: 3636628 - RNA, 19 nt, Human
gggugcuacuggggaaacu

SEQ ID NO: 3636629 - RNA, 12 nt, Human
gggugcucagaa

SEQ ID NO: 3636630 - RNA, 23 nt, Human
gggugcugcuucccucugccugu

SEQ ID NO: 3636631 - RNA, 19 nt, Human
gggugcuggcugcccagac

SEQ ID NO: 3636632 - RNA, 17 nt, Human
gggugcugggccccugc

SEQ ID NO: 3636633 - RNA, 18 nt, Human
gggugcugggccccugcc

SEQ ID NO: 3636634 - RNA, 20 nt, Human
ggguggagaacuccuagggu

SEQ ID NO: 3636635 - RNA, 15 nt, Human
ggguggaggagagcc

SEQ ID NO: 3636636 - RNA, 14 nt, Human
ggguggaggggugu

SEQ ID NO: 3636637 - RNA, 17 nt, Human
ggguggaucacgagguc

SEQ ID NO: 3636638 - RNA, 13 nt, Human
ggguggaugccug

SEQ ID NO: 3636639 - RNA, 17 nt, Human
ggguggaugccuggugg

SEQ ID NO: 3636640 - RNA, 19 nt, Human
ggguggcaccagcagccug

SEQ ID NO: 3636641 - RNA, 13 nt, Human
ggguggccaggcc

SEQ ID NO: 3636642 - RNA, 18 nt, Human
ggguggccaggccgggaa

SEQ ID NO: 3636643 - RNA, 13 nt, Human
ggguggcccaucc

SEQ ID NO: 3636644 - RNA, 21 nt, Human
ggguggccgcugaguggcagg

SEQ ID NO: 3636645 - RNA, 22 nt, Human
ggguggccuaagaguugagcuc

SEQ ID NO: 3636646 - RNA, 14 nt, Human
ggguggccucccaa

SEQ ID NO: 3636647 - RNA, 11 nt, Human
ggguggccucg

SEQ ID NO: 3636648 - RNA, 19 nt, Human
ggguggcuacucugugcca

SEQ ID NO: 3636649 - RNA, 23 nt, Human
ggguggcuacucugugccagagc

SEQ ID NO: 3636650 - RNA, 18 nt, Human
gggugggacacccuguga

SEQ ID NO: 3636651 - RNA, 14 nt, Human
gggugggagagccc

SEQ ID NO: 3636652 - RNA, 17 nt, Human
gggugggauggaggaga

SEQ ID NO: 3636653 - RNA, 13 nt, Human
gggugggccucug

SEQ ID NO: 3636654 - RNA, 13 nt, Human
ggguggggagaga

SEQ ID NO: 3636655 - RNA, 14 nt, Human
ggguggggagagac

SEQ ID NO: 3636656 - RNA, 17 nt, Human
ggguggggggcuucaua

SEQ ID NO: 3636657 - RNA, 11 nt, Human
gggugggggug

SEQ ID NO: 3636658 - RNA, 11 nt, Human
gguccugcugc

SEQ ID NO: 3636659 - RNA, 15 nt, Human
gguccugggaggaga

SEQ ID NO: 3636660 - RNA, 22 nt, Human
gguccuggggcucugugcaggg

SEQ ID NO: 3636661 - RNA, 21 nt, Human
gguccugggggccugaccucc

SEQ ID NO: 3636662 - RNA, 24 nt, Human
gguccuggugcccuggaugcccag

SEQ ID NO: 3636663 - RNA, 17 nt, Human
gguccugguggggcagc

SEQ ID NO: 3636664 - RNA, 12 nt, Human
gguccugucccc

SEQ ID NO: 3636665 - RNA, 21 nt, Human
gguccugucuccccucugcug

SEQ ID NO: 3636666 - RNA, 19 nt, Human
gguccugugaucuuauuuu

SEQ ID NO: 3636667 - RNA, 11 nt, Human
gguccuuccug

SEQ ID NO: 3636668 - RNA, 22 nt, Human
gguccuuggcccccuuucccgg

SEQ ID NO: 3636669 - RNA, 16 nt, Human
ggucgaggaguaacaa

SEQ ID NO: 3636670 - RNA, 13 nt, Human
ggucgaggcagga

SEQ ID NO: 3636671 - RNA, 14 nt, Human
ggucgcccaugaga

SEQ ID NO: 3636672 - RNA, 18 nt, Human
ggucgcccaugagagcgc

SEQ ID NO: 3636673 - RNA, 19 nt, Human
ggucgcccuuugcugcaug

SEQ ID NO: 3636674 - RNA, 12 nt, Human
ggucgcuccugc

SEQ ID NO: 3636675 - RNA, 14 nt, Human
ggucgggcucagcu

SEQ ID NO: 3636676 - RNA, 14 nt, Human
ggucggggcaucug

SEQ ID NO: 3636677 - RNA, 20 nt, Human
ggucggggcaucuggccugg

SEQ ID NO: 3636678 - RNA, 15 nt, Human
ggucggugccuucaa

SEQ ID NO: 3636679 - RNA, 14 nt, Human
ggucguggagagcu

SEQ ID NO: 3636680 - RNA, 21 nt, Human
ggucguuuuaaaaacaaaaau

SEQ ID NO: 3636681 - RNA, 18 nt, Human
ggucuaaagugagcucua

SEQ ID NO: 3636682 - RNA, 18 nt, Human
ggucuacacugugcugag

SEQ ID NO: 3636683 - RNA, 17 nt, Human
ggucuauuccagcucau

SEQ ID NO: 3636684 - RNA, 20 nt, Human
ggucuauuccagcucauuca

SEQ ID NO: 3636685 - RNA, 15 nt, Human
ggucuauugucugua

SEQ ID NO: 3636686 - RNA, 18 nt, Human
ggucucacaguguugccc

SEQ ID NO: 3636687 - RNA, 20 nt, Human
ggucucacaguguugcccag

SEQ ID NO: 3636688 - RNA, 21 nt, Human
ggucucacaguguugcccagg

SEQ ID NO: 3636689 - RNA, 23 nt, Human
ggucucacccaugcaagcagagg

SEQ ID NO: 3636690 - RNA, 21 nt, Human
ggucucacuauguugcccagg

SEQ ID NO: 3636691 - RNA, 16 nt, Human
ggucucacucugucgc

SEQ ID NO: 3636692 - RNA, 21 nt, Human
ggucucacucugucgcccagu

SEQ ID NO: 3636693 - RNA, 18 nt, Human
ggucucagaaucuuuccu

SEQ ID NO: 3636694 - RNA, 22 nt, Human
ggucucaggauauccuuaucag

SEQ ID NO: 3636695 - RNA, 18 nt, Human
ggucucaggcugguggga

SEQ ID NO: 3636696 - RNA, 22 nt, Human
ggucucccgggaagccacccuc

SEQ ID NO: 3636697 - RNA, 17 nt, Human
ggucucccucuccugcc

SEQ ID NO: 3636698 - RNA, 12 nt, Human
ggucucccuggc

SEQ ID NO: 3636699 - RNA, 15 nt, Human
ggucucccuggcucc

SEQ ID NO: 3636700 - RNA, 24 nt, Human
ggucucccuggcucccuccuccag

SEQ ID NO: 3636701 - RNA, 15 nt, Human
ggucuccucaggacc

SEQ ID NO: 3636702 - RNA, 22 nt, Human
ggucuccuccaccgccauggcu

SEQ ID NO: 3636703 - RNA, 23 nt, Human
ggucuccugacuggugcugcagc

SEQ ID NO: 3636704 - RNA, 19 nt, Human
ggucucgaacuccugaccu

SEQ ID NO: 3636705 - RNA, 19 nt, Human
ggucucgcugaugcugggc

SEQ ID NO: 3636706 - RNA, 19 nt, Human
ggucucgcuuuguugccca

SEQ ID NO: 3636707 - RNA, 16 nt, Human
ggucucuaggcugggg

SEQ ID NO: 3636708 - RNA, 18 nt, Human
ggucucuaggcuggggaa

SEQ ID NO: 3636709 - RNA, 14 nt, Human
ggucucuauuucau

SEQ ID NO: 3636710 - RNA, 23 nt, Human
ggucucucacagacaggaccccu

SEQ ID NO: 3636711 - RNA, 17 nt, Human
ggucucucccucaggug

SEQ ID NO: 3636712 - RNA, 23 nt, Human
ggucucugcauuuuucugcagaa

SEQ ID NO: 3636713 - RNA, 19 nt, Human
ggucucugccggcucuuuc

SEQ ID NO: 3636714 - RNA, 12 nt, Human
ggucucugcugc

SEQ ID NO: 3636715 - RNA, 10 nt, Human
ggucucuggu

SEQ ID NO: 3636716 - RNA, 19 nt, Human
ggucucuguugacuggcug

SEQ ID NO: 3636717 - RNA, 15 nt, Human
ggucucuucucccag

SEQ ID NO: 3636718 - RNA, 17 nt, Human
ggucucuucucccagaa

SEQ ID NO: 3636719 - RNA, 20 nt, Human
ggucucuucuuggggcccag

SEQ ID NO: 3636720 - RNA, 15 nt, Human
ggucucuugagggag

SEQ ID NO: 3636721 - RNA, 10 nt, Human
ggucucuuuu

SEQ ID NO: 3636722 - RNA, 12 nt, Human
ggucugaauguu

SEQ ID NO: 3636723 - RNA, 17 nt, Human
ggucugaauguucugac

SEQ ID NO: 3636724 - RNA, 16 nt, Human
ggucugacccacugcu

SEQ ID NO: 3636725 - RNA, 19 nt, Human
ggucugaggaauccagacc

SEQ ID NO: 3636726 - RNA, 13 nt, Human
ggucugccaggcc

SEQ ID NO: 3636727 - RNA, 15 nt, Human
ggucugccaggcccc

SEQ ID NO: 3636728 - RNA, 23 nt, Human
ggucugcccucugcauccucugg

SEQ ID NO: 3636729 - RNA, 16 nt, Human
ggucugcucgggccca

SEQ ID NO: 3636730 - RNA, 17 nt, Human
ggucugcucgggcccag

SEQ ID NO: 3636731 - RNA, 18 nt, Human
ggucugcucgggcccagg

SEQ ID NO: 3636732 - RNA, 20 nt, Human
ggucugcucuuucucugcca

SEQ ID NO: 3636733 - RNA, 23 nt, Human
ggucuggagaagcucccaggaac

SEQ ID NO: 3636734 - RNA, 19 nt, Human
ggucuggccguacuuguga

SEQ ID NO: 3636735 - RNA, 14 nt, Human
ggucuggccucagg

SEQ ID NO: 3636736 - RNA, 15 nt, Human
ggucuggcugagcug

SEQ ID NO: 3636737 - RNA, 14 nt, Human
ggucuggcuggugu

SEQ ID NO: 3636738 - RNA, 15 nt, Human
ggucuggcugguguu

SEQ ID NO: 3636739 - RNA, 17 nt, Human
ggucugggacuuccuug

SEQ ID NO: 3636740 - RNA, 20 nt, Human
ggucugggagaggcagagug

SEQ ID NO: 3636741 - RNA, 20 nt, Human
ggucugggagucacacagug

SEQ ID NO: 3636742 - RNA, 22 nt, Human
ggucugggggucaggaggcagg

SEQ ID NO: 3636743 - RNA, 15 nt, Human
ggucuguagguugca

SEQ ID NO: 3636744 - RNA, 20 nt, Human
ggucuguagguugcacacuu

SEQ ID NO: 3636745 - RNA, 14 nt, Human
ggucugugagaugc

SEQ ID NO: 3636746 - RNA, 24 nt, Human
ggucugugagaugcuagaacuccc

SEQ ID NO: 3636747 - RNA, 16 nt, Human
ggucugugcauuucug

SEQ ID NO: 3636748 - RNA, 18 nt, Human
ggucugugucucuuuucu

SEQ ID NO: 3636749 - RNA, 16 nt, Human
ggucugugugaaugug

SEQ ID NO: 3636750 - RNA, 20 nt, Human
ggucuguguguguguaugug

SEQ ID NO: 3636751 - RNA, 17 nt, Human
ggucuguuuuccuuucu

SEQ ID NO: 3636752 - RNA, 21 nt, Human
ggucuguuuuguguacuuuua

SEQ ID NO: 3636753 - RNA, 18 nt, Human
ggucuucagccucuuucu

SEQ ID NO: 3636754 - RNA, 12 nt, Human
ggucuuccaggg

SEQ ID NO: 3636755 - RNA, 13 nt, Human
ggucuucccaggc

SEQ ID NO: 3636756 - RNA, 20 nt, Human
ggucuucccaggcuggggcu

SEQ ID NO: 3636757 - RNA, 17 nt, Human
ggucuuccuacucuucu

SEQ ID NO: 3636758 - RNA, 19 nt, Human
ggucuuccuacucuucucu

SEQ ID NO: 3636759 - RNA, 21 nt, Human
ggucuuccuacucuucucucu

SEQ ID NO: 3636760 - RNA, 22 nt, Human
ggucuugaaguccuggcuucag

SEQ ID NO: 3636761 - RNA, 19 nt, Human
ggucuugauucagucacau

SEQ ID NO: 3636762 - RNA, 14 nt, Human
ggucuugccccauc

SEQ ID NO: 3636763 - RNA, 20 nt, Human
ggucuugggaaauaugaaug

SEQ ID NO: 3636764 - RNA, 19 nt, Human
ggucuugguuccagccugc

SEQ ID NO: 3636765 - RNA, 18 nt, Human
ggucuuuaaaauauuguu

SEQ ID NO: 3636766 - RNA, 20 nt, Human
ggucuuucaguacuuuuuua

SEQ ID NO: 3636767 - RNA, 16 nt, Human
ggucuuucauggggug

SEQ ID NO: 3636768 - RNA, 10 nt, Human
ggucuuugag

SEQ ID NO: 3636769 - RNA, 13 nt, Human
ggucuuuguaaga

SEQ ID NO: 3636770 - RNA, 15 nt, Human
ggucuuuguaagagu

SEQ ID NO: 3636771 - RNA, 19 nt, Human
ggucuuuucaucugggaaa

SEQ ID NO: 3636772 - RNA, 20 nt, Human
ggucuuuucaucugggaaag

SEQ ID NO: 3636773 - RNA, 17 nt, Human
ggucuuuugacaugugg

SEQ ID NO: 3636774 - RNA, 15 nt, Human
ggucuuuuuaaacca

SEQ ID NO: 3636775 - RNA, 22 nt, Human
ggugaaaauuauuuuguucaua

SEQ ID NO: 3636776 - RNA, 14 nt, Human
ggugaaagggagcu

SEQ ID NO: 3636777 - RNA, 23 nt, Human
ggugaaauuuauuaguuaauaua

SEQ ID NO: 3636778 - RNA, 20 nt, Human
ggugaagagaaccgagcaaa

SEQ ID NO: 3636779 - RNA, 14 nt, Human
ggugaaggaggcuc

SEQ ID NO: 3636780 - RNA, 23 nt, Human
ggugaaggaggcuccaggcagca

SEQ ID NO: 3636781 - RNA, 13 nt, Human
ggugaauauuuuc

SEQ ID NO: 3636782 - RNA, 13 nt, Human
ggugacaagagcc

SEQ ID NO: 3636783 - RNA, 14 nt, Human
ggugacaagagccu

SEQ ID NO: 3636784 - RNA, 13 nt, Human
ggugacacagacu

SEQ ID NO: 3636785 - RNA, 20 nt, Human
ggugacacagacucauccug

SEQ ID NO: 3636786 - RNA, 13 nt, Human
ggugacaccagcc

SEQ ID NO: 3636787 - RNA, 13 nt, Human
ggugacagagcga

SEQ ID NO: 3636788 - RNA, 21 nt, Human
ggugacagagugagacucugu

SEQ ID NO: 3636789 - RNA, 21 nt, Human
ggugacagucaucaucagggc

SEQ ID NO: 3636790 - RNA, 17 nt, Human
ggugacaucggaaaaau

SEQ ID NO: 3636791 - RNA, 18 nt, Human
ggugacaucggaaaaaua

SEQ ID NO: 3636792 - RNA, 13 nt, Human
ggugaccccaggg

SEQ ID NO: 3636793 - RNA, 16 nt, Human
ggugaccccagggcac

SEQ ID NO: 3636794 - RNA, 21 nt, Human
ggugaccccagggcacaggag

SEQ ID NO: 3636795 - RNA, 23 nt, Human
ggugaccccagggcacaggagcu

SEQ ID NO: 3636796 - RNA, 21 nt, Human
ggugacccggcacccccugca

SEQ ID NO: 3636797 - RNA, 21 nt, Human
ggugaccucuagcccugcccg

SEQ ID NO: 3636798 - RNA, 16 nt, Human
ggugaccucugccuga

SEQ ID NO: 3636799 - RNA, 20 nt, Human
ggugaccuuccaagagccug

SEQ ID NO: 3636800 - RNA, 18 nt, Human
ggugacgccugcccuccc

SEQ ID NO: 3636801 - RNA, 19 nt, Human
ggugacggcccucaucuau

SEQ ID NO: 3636802 - RNA, 21 nt, Human
gucaaggccugucccuggcca

SEQ ID NO: 3636803 - RNA, 18 nt, Human
gucaaggcugcuuagaau

SEQ ID NO: 3636804 - RNA, 19 nt, Human
gucaagugaaaaaggagga

SEQ ID NO: 3636805 - RNA, 20 nt, Human
gucaaguuauuaauuucuuc

SEQ ID NO: 3636806 - RNA, 15 nt, Human
gucaaguugucaggu

SEQ ID NO: 3636807 - RNA, 18 nt, Human
gucaaguugugcuuguuu

SEQ ID NO: 3636808 - RNA, 22 nt, Human
gucaauaaacaacagcugaagc

SEQ ID NO: 3636809 - RNA, 15 nt, Human
gucaauauuaaauac

SEQ ID NO: 3636810 - RNA, 16 nt, Human
gucaauauuaaauaca

SEQ ID NO: 3636811 - RNA, 23 nt, Human
gucaauauuaaauacagacacua

SEQ ID NO: 3636812 - RNA, 13 nt, Human
gucaauauuuaaa

SEQ ID NO: 3636813 - RNA, 16 nt, Human
gucaaucauuucucac

SEQ ID NO: 3636814 - RNA, 22 nt, Human
gucaauccccucauucaggaaa

SEQ ID NO: 3636815 - RNA, 16 nt, Human
gucaaugcaguugucu

SEQ ID NO: 3636816 - RNA, 22 nt, Human
gucaaugcuauuuuuguuuuua

SEQ ID NO: 3636817 - RNA, 19 nt, Human
gucaaugggaccuguggcu

SEQ ID NO: 3636818 - RNA, 14 nt, Human
gucaaugugcagug

SEQ ID NO: 3636819 - RNA, 18 nt, Human
gucaaugugcaguguagc

SEQ ID NO: 3636820 - RNA, 13 nt, Human
gucaauuacagga

SEQ ID NO: 3636821 - RNA, 15 nt, Human
gucaauuacaggaag

SEQ ID NO: 3636822 - RNA, 13 nt, Human
gucaauuuauaau

SEQ ID NO: 3636823 - RNA, 18 nt, Human
gucaauuuaugaauauaa

SEQ ID NO: 3636824 - RNA, 21 nt, Human
gucaauuuuguuauguauauu

SEQ ID NO: 3636825 - RNA, 14 nt, Human
gucacaaccaagaa

SEQ ID NO: 3636826 - RNA, 12 nt, Human
gucacaauaaau

SEQ ID NO: 3636827 - RNA, 20 nt, Human
gucacaaugagauugaauuu

SEQ ID NO: 3636828 - RNA, 18 nt, Human
gucacaauguucuuuaua

SEQ ID NO: 3636829 - RNA, 21 nt, Human
gucacaauguucuuuauauac

SEQ ID NO: 3636830 - RNA, 12 nt, Human
gucacagagaac

SEQ ID NO: 3636831 - RNA, 19 nt, Human
gucacagagaacuaguggu

SEQ ID NO: 3636832 - RNA, 12 nt, Human
gucacagccacc

SEQ ID NO: 3636833 - RNA, 12 nt, Human
gucacagccuca

SEQ ID NO: 3636834 - RNA, 23 nt, Human
gucacagccuccucugucugccc

SEQ ID NO: 3636835 - RNA, 16 nt, Human
gucacaggcaggucca

SEQ ID NO: 3636836 - RNA, 12 nt, Human
gucacagggcag

SEQ ID NO: 3636837 - RNA, 13 nt, Human
gucacagggcagu

SEQ ID NO: 3636838 - RNA, 20 nt, Human
gucacagggcaugccccggc

SEQ ID NO: 3636839 - RNA, 12 nt, Human
gucacagggcca

SEQ ID NO: 3636840 - RNA, 18 nt, Human
gucacagggccuggggag

SEQ ID NO: 3636841 - RNA, 16 nt, Human
gucacaguaaaaauaa

SEQ ID NO: 3636842 - RNA, 20 nt, Human
gucacaguaaaaauaaaaua

SEQ ID NO: 3636843 - RNA, 22 nt, Human
gucacaguaaaaauaaaauacu

SEQ ID NO: 3636844 - RNA, 22 nt, Human
gucacaucccaccccauccucc

SEQ ID NO: 3636845 - RNA, 13 nt, Human
gucacaugaaaca

SEQ ID NO: 3636846 - RNA, 12 nt, Human
gucacaugcuug

SEQ ID NO: 3636847 - RNA, 16 nt, Human
gucacauucaggaaga

SEQ ID NO: 3636848 - RNA, 18 nt, Human
gucacauuccugaacagg

SEQ ID NO: 3636849 - RNA, 22 nt, Human
gucaccaauguacccaccgggc

SEQ ID NO: 3636850 - RNA, 19 nt, Human
gucaccaccaccccuacca

SEQ ID NO: 3636851 - RNA, 13 nt, Human
gucaccaccucuc

SEQ ID NO: 3636852 - RNA, 17 nt, Human
gucaccaccuucccagc

SEQ ID NO: 3636853 - RNA, 16 nt, Human
gucaccagacggggcu

SEQ ID NO: 3636854 - RNA, 16 nt, Human
gucaccagagacuuua

SEQ ID NO: 3636855 - RNA, 12 nt, Human
gucaccaguggc

SEQ ID NO: 3636856 - RNA, 21 nt, Human
gucaccaucucaggccaccug

SEQ ID NO: 3636857 - RNA, 20 nt, Human
gucacccaggcuggagugca

SEQ ID NO: 3636858 - RNA, 15 nt, Human
gucaccccagagcca

SEQ ID NO: 3636859 - RNA, 17 nt, Human
gucaccccagagccaca

SEQ ID NO: 3636860 - RNA, 18 nt, Human
gucaccccagagccacac

SEQ ID NO: 3636861 - RNA, 19 nt, Human
gucaccccagagccacaca

SEQ ID NO: 3636862 - RNA, 15 nt, Human
gucaccccuccagga

SEQ ID NO: 3636863 - RNA, 22 nt, Human
gucacccuagcccucucccucu

SEQ ID NO: 3636864 - RNA, 17 nt, Human
gucaccggauccugggu

SEQ ID NO: 3636865 - RNA, 19 nt, Human
gucaccggauccugggugg

SEQ ID NO: 3636866 - RNA, 19 nt, Human
gucaccuaggaagccucag

SEQ ID NO: 3636867 - RNA, 13 nt, Human
gucaccucacuca

SEQ ID NO: 3636868 - RNA, 15 nt, Human
gucaccucacucagc

SEQ ID NO: 3636869 - RNA, 16 nt, Human
gucaccugcuucucug

SEQ ID NO: 3636870 - RNA, 17 nt, Human
gucaccugcuucucugc

SEQ ID NO: 3636871 - RNA, 22 nt, Human
gucaccugggcgucaucugguc

SEQ ID NO: 3636872 - RNA, 13 nt, Human
gucaccuucccuu

SEQ ID NO: 3636873 - RNA, 14 nt, Human
gucacgccagacuu

SEQ ID NO: 3636874 - RNA, 18 nt, Human
gucacggauuugugucug

SEQ ID NO: 3636875 - RNA, 22 nt, Human
gucacuaaagcaggccuuuuga

SEQ ID NO: 3636876 - RNA, 17 nt, Human
gucacuaccuggcugcg

SEQ ID NO: 3636877 - RNA, 14 nt, Human
gucacucaggcugg

SEQ ID NO: 3636878 - RNA, 12 nt, Human
gucacuccuggg

SEQ ID NO: 3636879 - RNA, 13 nt, Human
gucacuccugggg

SEQ ID NO: 3636880 - RNA, 23 nt, Human
gucacucuggcagcucagagagg

SEQ ID NO: 3636881 - RNA, 15 nt, Human
gucacugaaggccug

SEQ ID NO: 3636882 - RNA, 21 nt, Human
gucacugaaggccuggcccac

SEQ ID NO: 3636883 - RNA, 14 nt, Human
gucacugacacaaa

SEQ ID NO: 3636884 - RNA, 16 nt, Human
gucacugacacacacg

SEQ ID NO: 3636885 - RNA, 14 nt, Human
gucacugagacagc

SEQ ID NO: 3636886 - RNA, 15 nt, Human
gucacugagacagcc

SEQ ID NO: 3636887 - RNA, 17 nt, Human
gucacugagacagcccg

SEQ ID NO: 3636888 - RNA, 21 nt, Human
gucacugagacagcccgggcu

SEQ ID NO: 3636889 - RNA, 23 nt, Human
gucacugagacagcccgggcucu

SEQ ID NO: 3636890 - RNA, 12 nt, Human
gucacugcacgu

SEQ ID NO: 3636891 - RNA, 12 nt, Human
gucacugccucu

SEQ ID NO: 3636892 - RNA, 22 nt, Human
gucacugccucucccuggcccu

SEQ ID NO: 3636893 - RNA, 11 nt, Human
gucacugcugu

SEQ ID NO: 3636894 - RNA, 18 nt, Human
gucacuggaaaggggaga

SEQ ID NO: 3636895 - RNA, 23 nt, Human
gucacuggaaaggggagagccug

SEQ ID NO: 3636896 - RNA, 14 nt, Human
gucacuggcucucc

SEQ ID NO: 3636897 - RNA, 15 nt, Human
gucacuggcucucca

SEQ ID NO: 3636898 - RNA, 18 nt, Human
gucacuggcucuccaagu

SEQ ID NO: 3636899 - RNA, 20 nt, Human
gucacuggcugccuccacuc

SEQ ID NO: 3636900 - RNA, 21 nt, Human
gucacuggcugccuccacucc

SEQ ID NO: 3636901 - RNA, 20 nt, Human
gucacuguacugacuugagg

SEQ ID NO: 3636902 - RNA, 15 nt, Human
gucacugucccuccu

SEQ ID NO: 3636903 - RNA, 18 nt, Human
gucacugucccuccuggu

SEQ ID NO: 3636904 - RNA, 21 nt, Human
gucacugucccuccugguguc

SEQ ID NO: 3636905 - RNA, 17 nt, Human
gucacuguuccuuguca

SEQ ID NO: 3636906 - RNA, 19 nt, Human
gucacuguuuauuuuuuua

SEQ ID NO: 3636907 - RNA, 14 nt, Human
gucacuguuuccug

SEQ ID NO: 3636908 - RNA, 15 nt, Human
gucacuguuucucug

SEQ ID NO: 3636909 - RNA, 18 nt, Human
gucacuuaaaaugugcag

SEQ ID NO: 3636910 - RNA, 20 nt, Human
gucacuuaccuagauuuaca

SEQ ID NO: 3636911 - RNA, 16 nt, Human
gucacuuacuguuucu

SEQ ID NO: 3636912 - RNA, 15 nt, Human
gucacuuauuucaua

SEQ ID NO: 3636913 - RNA, 16 nt, Human
gucacuuauuucauaa

SEQ ID NO: 3636914 - RNA, 19 nt, Human
gucacuucuucuguccaag

SEQ ID NO: 3636915 - RNA, 23 nt, Human
gucacuuugcucuggguggaagu

SEQ ID NO: 3636916 - RNA, 14 nt, Human
gucacuuuuucuga

SEQ ID NO: 3636917 - RNA, 22 nt, Human
gucagaagagagggugaguccu

SEQ ID NO: 3636918 - RNA, 13 nt, Human
gucagaaucagaa

SEQ ID NO: 3636919 - RNA, 15 nt, Human
gucagaaugcuauug

SEQ ID NO: 3636920 - RNA, 18 nt, Human
gucagacacagauuggcc

SEQ ID NO: 3636921 - RNA, 18 nt, Human
gucagacagaacuugaau

SEQ ID NO: 3636922 - RNA, 17 nt, Human
gucagacgccugaggaa

SEQ ID NO: 3636923 - RNA, 15 nt, Human
gucagacuaagaaau

SEQ ID NO: 3636924 - RNA, 14 nt, Human
gucagacuggcugg

SEQ ID NO: 3636925 - RNA, 12 nt, Human
gucagagcuggg

SEQ ID NO: 3636926 - RNA, 22 nt, Human
gucagaggagagauagccugug

SEQ ID NO: 3636927 - RNA, 13 nt, Human
gucagaggauggc

SEQ ID NO: 3636928 - RNA, 15 nt, Human
gucagaggauggcca

SEQ ID NO: 3636929 - RNA, 21 nt, Human
gucagaggauggccagugucu

SEQ ID NO: 3636930 - RNA, 21 nt, Human
gucagaggcuaauucugcaga

SEQ ID NO: 3636931 - RNA, 18 nt, Human
gucagauccaggagcucc

SEQ ID NO: 3636932 - RNA, 20 nt, Human
gucagauccaggagcuccag

SEQ ID NO: 3636933 - RNA, 14 nt, Human
gucagaugagaaca

SEQ ID NO: 3636934 - RNA, 18 nt, Human
gucagaugagaacaaagc

SEQ ID NO: 3636935 - RNA, 12 nt, Human
gucagauguuug

SEQ ID NO: 3636936 - RNA, 12 nt, Human
gucagauuccuu

SEQ ID NO: 3636937 - RNA, 13 nt, Human
gucagauuccuuu

SEQ ID NO: 3636938 - RNA, 16 nt, Human
gucagauucuugcauc

SEQ ID NO: 3636939 - RNA, 16 nt, Human
gucagcaaaaagcaaa

SEQ ID NO: 3636940 - RNA, 22 nt, Human
gucagcaaaaagcaaaaucauu

SEQ ID NO: 3636941 - RNA, 16 nt, Human
gucagcaauuuaacua

SEQ ID NO: 3636942 - RNA, 23 nt, Human
gucagcagccucccugaagacca

SEQ ID NO: 3636943 - RNA, 13 nt, Human
gucagcaggaagc

SEQ ID NO: 3636944 - RNA, 14 nt, Human
gucagcaugaauuu

SEQ ID NO: 3636945 - RNA, 11 nt, Human
gucagccaggg

SEQ ID NO: 3636946 - RNA, 13 nt, Human
gucagccagggcc

SEQ ID NO: 3636947 - RNA, 14 nt, Human
gucagccagggcca

SEQ ID NO: 3636948 - RNA, 15 nt, Human
guccccaucauccca

SEQ ID NO: 3636949 - RNA, 19 nt, Human
guccccaucaucccagcug

SEQ ID NO: 3636950 - RNA, 14 nt, Human
guccccaucugucg

SEQ ID NO: 3636951 - RNA, 20 nt, Human
gucccccaaccccagccgcu

SEQ ID NO: 3636952 - RNA, 20 nt, Human
gucccccaacucugagccca

SEQ ID NO: 3636953 - RNA, 20 nt, Human
gucccccacucuaaagcaaa

SEQ ID NO: 3636954 - RNA, 16 nt, Human
gucccccagcucuggu

SEQ ID NO: 3636955 - RNA, 22 nt, Human
gucccccauccccauccuccag

SEQ ID NO: 3636956 - RNA, 14 nt, Human
gucccccucuggcu

SEQ ID NO: 3636957 - RNA, 21 nt, Human
gucccccucuguccaggcacu

SEQ ID NO: 3636958 - RNA, 18 nt, Human
gucccccugacaacacuc

SEQ ID NO: 3636959 - RNA, 13 nt, Human
gucccccugcagc

SEQ ID NO: 3636960 - RNA, 16 nt, Human
gucccccuuccaugga

SEQ ID NO: 3636961 - RNA, 16 nt, Human
guccccgcacugggcu

SEQ ID NO: 3636962 - RNA, 14 nt, Human
guccccgcugcugu

SEQ ID NO: 3636963 - RNA, 18 nt, Human
guccccucagcuccagac

SEQ ID NO: 3636964 - RNA, 12 nt, Human
guccccucccag

SEQ ID NO: 3636965 - RNA, 16 nt, Human
guccccucccaucugg

SEQ ID NO: 3636966 - RNA, 17 nt, Human
guccccucccaucuggg

SEQ ID NO: 3636967 - RNA, 19 nt, Human
guccccucccaucugggag

SEQ ID NO: 3636968 - RNA, 15 nt, Human
guccccuccuuccca

SEQ ID NO: 3636969 - RNA, 15 nt, Human
guccccucuugcccc

SEQ ID NO: 3636970 - RNA, 21 nt, Human
guccccucuugccccaacccc

SEQ ID NO: 3636971 - RNA, 14 nt, Human
guccccugacaggg

SEQ ID NO: 3636972 - RNA, 13 nt, Human
guccccugcuaca

SEQ ID NO: 3636973 - RNA, 11 nt, Human
guccccugcuu

SEQ ID NO: 3636974 - RNA, 17 nt, Human
guccccuucucucaucu

SEQ ID NO: 3636975 - RNA, 19 nt, Human
guccccuucucucaucucu

SEQ ID NO: 3636976 - RNA, 20 nt, Human
guccccuucucucaucucuu

SEQ ID NO: 3636977 - RNA, 15 nt, Human
gucccgaauccacag

SEQ ID NO: 3636978 - RNA, 18 nt, Human
gucccggaggcggugggc

SEQ ID NO: 3636979 - RNA, 14 nt, Human
gucccggcucugug

SEQ ID NO: 3636980 - RNA, 16 nt, Human
gucccggcucuguggg

SEQ ID NO: 3636981 - RNA, 22 nt, Human
gucccgggacaccuaggcuagg

SEQ ID NO: 3636982 - RNA, 17 nt, Human
gucccggggccagcacu

SEQ ID NO: 3636983 - RNA, 21 nt, Human
gucccggggccagcacuucca

SEQ ID NO: 3636984 - RNA, 14 nt, Human
gucccgggguccug

SEQ ID NO: 3636985 - RNA, 23 nt, Human
gucccgggguccuguggcaggca

SEQ ID NO: 3636986 - RNA, 15 nt, Human
gucccuaaagaaaaa

SEQ ID NO: 3636987 - RNA, 18 nt, Human
gucccuaauaaagcugug

SEQ ID NO: 3636988 - RNA, 20 nt, Human
gucccuaauaaagcugugug

SEQ ID NO: 3636989 - RNA, 16 nt, Human
gucccuacaccccucc

SEQ ID NO: 3636990 - RNA, 21 nt, Human
gucccuaccgagucucuucuc

SEQ ID NO: 3636991 - RNA, 18 nt, Human
gucccuagcagcccaccc

SEQ ID NO: 3636992 - RNA, 15 nt, Human
gucccuaugcauauc

SEQ ID NO: 3636993 - RNA, 21 nt, Human
gucccuccacguucaccccuc

SEQ ID NO: 3636994 - RNA, 13 nt, Human
gucccucccaccu

SEQ ID NO: 3636995 - RNA, 15 nt, Human
gucccucccaccucu

SEQ ID NO: 3636996 - RNA, 12 nt, Human
gucccuccuggg

SEQ ID NO: 3636997 - RNA, 21 nt, Human
gucccuccugggaucugcucg

SEQ ID NO: 3636998 - RNA, 21 nt, Human
gucccuccuggugucacccca

SEQ ID NO: 3636999 - RNA, 13 nt, Human
gucccucucaggc

SEQ ID NO: 3637000 - RNA, 14 nt, Human
gucccucucaggca

SEQ ID NO: 3637001 - RNA, 21 nt, Human
gucccucucggaaggcuggcu

SEQ ID NO: 3637002 - RNA, 13 nt, Human
gucccucucucug

SEQ ID NO: 3637003 - RNA, 14 nt, Human
gucccucugcccca

SEQ ID NO: 3637004 - RNA, 20 nt, Human
gucccucugccccauccucc

SEQ ID NO: 3637005 - RNA, 21 nt, Human
gucccucugccccauccucca

SEQ ID NO: 3637006 - RNA, 14 nt, Human
gucccucuguguau

SEQ ID NO: 3637007 - RNA, 17 nt, Human
gucccugaaaccuagua

SEQ ID NO: 3637008 - RNA, 16 nt, Human
gucccugaagagaagg

SEQ ID NO: 3637009 - RNA, 22 nt, Human
gucccugaggaugggucagagc

SEQ ID NO: 3637010 - RNA, 18 nt, Human
gucccugaggcagguccc

SEQ ID NO: 3637011 - RNA, 22 nt, Human
gucccugaggcagguccccaga

SEQ ID NO: 3637012 - RNA, 21 nt, Human
gucccugcacagugacuucug

SEQ ID NO: 3637013 - RNA, 23 nt, Human
gucccugcacagugacuucugag

SEQ ID NO: 3637014 - RNA, 16 nt, Human
gucccugcacuugcag

SEQ ID NO: 3637015 - RNA, 21 nt, Human
gucccugcacuugcagacucu

SEQ ID NO: 3637016 - RNA, 11 nt, Human
gucccugccaa

SEQ ID NO: 3637017 - RNA, 22 nt, Human
gucccugccacgaauuucugug

SEQ ID NO: 3637018 - RNA, 21 nt, Human
gucccugccuggaccagccuc

SEQ ID NO: 3637019 - RNA, 22 nt, Human
gucccugccuggaccagccucu

SEQ ID NO: 3637020 - RNA, 21 nt, Human
gucccugcgccuuuccuuuuc

SEQ ID NO: 3637021 - RNA, 17 nt, Human
gucccuggcgcaggugg

SEQ ID NO: 3637022 - RNA, 15 nt, Human
gucccuggcuuccuu

SEQ ID NO: 3637023 - RNA, 16 nt, Human
gucccuggcuuccuua

SEQ ID NO: 3637024 - RNA, 17 nt, Human
gucccugggccaggguc

SEQ ID NO: 3637025 - RNA, 18 nt, Human
gucccugggccagggucu

SEQ ID NO: 3637026 - RNA, 15 nt, Human
gucccugguaauaag

SEQ ID NO: 3637027 - RNA, 16 nt, Human
gucccugguggcagcu

SEQ ID NO: 3637028 - RNA, 18 nt, Human
gucccugguggcagcuca

SEQ ID NO: 3637029 - RNA, 15 nt, Human
gucccuguuuucuga

SEQ ID NO: 3637030 - RNA, 17 nt, Human
gucccuucacauaguuu

SEQ ID NO: 3637031 - RNA, 22 nt, Human
gucccuuccacacccccacccc

SEQ ID NO: 3637032 - RNA, 16 nt, Human
gucccuuccaggccau

SEQ ID NO: 3637033 - RNA, 17 nt, Human
gucccuuccccaugcuu

SEQ ID NO: 3637034 - RNA, 12 nt, Human
gucccuuccccu

SEQ ID NO: 3637035 - RNA, 22 nt, Human
gucccuuccccucccuggcucc

SEQ ID NO: 3637036 - RNA, 20 nt, Human
gucccuugaacuacugggug

SEQ ID NO: 3637037 - RNA, 17 nt, Human
gucccuugaugcacaga

SEQ ID NO: 3637038 - RNA, 22 nt, Human
gucccuugaugcacagagaagc

SEQ ID NO: 3637039 - RNA, 23 nt, Human
gucccuugaugcacagagaagcu

SEQ ID NO: 3637040 - RNA, 13 nt, Human
gucccuugcagcu

SEQ ID NO: 3637041 - RNA, 20 nt, Human
gucccuugccccccuggccu

SEQ ID NO: 3637042 - RNA, 19 nt, Human
gucccuugccucaaugcca

SEQ ID NO: 3637043 - RNA, 20 nt, Human
gucccuuguuuccagcuaga

SEQ ID NO: 3637044 - RNA, 15 nt, Human
guccgaucuuugacu

SEQ ID NO: 3637045 - RNA, 12 nt, Human
guccgcccugcu

SEQ ID NO: 3637046 - RNA, 23 nt, Human
guccgcccugcuccucccuggcu

SEQ ID NO: 3637047 - RNA, 22 nt, Human
guccgcugggugguacccucug

SEQ ID NO: 3637048 - RNA, 21 nt, Human
guccgguggaaggccuucuuu

SEQ ID NO: 3637049 - RNA, 16 nt, Human
guccgguguucuaaga

SEQ ID NO: 3637050 - RNA, 20 nt, Human
guccgugcugacagcugcuc

SEQ ID NO: 3637051 - RNA, 22 nt, Human
guccguggguugcuaacugaac

SEQ ID NO: 3637052 - RNA, 22 nt, Human
guccuaagaaagaggagugcuu

SEQ ID NO: 3637053 - RNA, 19 nt, Human
guccuaaggacacacuaau

SEQ ID NO: 3637054 - RNA, 17 nt, Human
guccuacaguggcuguc

SEQ ID NO: 3637055 - RNA, 16 nt, Human
guccuaccaauagauu

SEQ ID NO: 3637056 - RNA, 18 nt, Human
guccuacccauccccgca

SEQ ID NO: 3637057 - RNA, 20 nt, Human
guccuacuaucacugaacaa

SEQ ID NO: 3637058 - RNA, 13 nt, Human
guccuacucugug

SEQ ID NO: 3637059 - RNA, 21 nt, Human
guccuacucugugucaggugg

SEQ ID NO: 3637060 - RNA, 23 nt, Human
guccuagaaauuccccacccuga

SEQ ID NO: 3637061 - RNA, 23 nt, Human
guccuagcuugggaggcuucccc

SEQ ID NO: 3637062 - RNA, 17 nt, Human
guccuaguaagaagaca

SEQ ID NO: 3637063 - RNA, 16 nt, Human
guccuaguuguucagc

SEQ ID NO: 3637064 - RNA, 17 nt, Human
guccuaucugggcuucc

SEQ ID NO: 3637065 - RNA, 13 nt, Human
guccuaugcaaua

SEQ ID NO: 3637066 - RNA, 15 nt, Human
guccuaugcaauaaa

SEQ ID NO: 3637067 - RNA, 16 nt, Human
guccuaugcaauaaaa

SEQ ID NO: 3637068 - RNA, 21 nt, Human
guccuaugcaauaaaauuauu

SEQ ID NO: 3637069 - RNA, 13 nt, Human
guccuauggaaac

SEQ ID NO: 3637070 - RNA, 17 nt, Human
guccuauuaguguuaua

SEQ ID NO: 3637071 - RNA, 21 nt, Human
guccuauuaguguuauaugaa

SEQ ID NO: 3637072 - RNA, 13 nt, Human
guccucacacuca

SEQ ID NO: 3637073 - RNA, 14 nt, Human
guccucaccccugu

SEQ ID NO: 3637074 - RNA, 18 nt, Human
guccucacggugccuuuu

SEQ ID NO: 3637075 - RNA, 14 nt, Human
guccucacucccag

SEQ ID NO: 3637076 - RNA, 18 nt, Human
guccucacucccagucca

SEQ ID NO: 3637077 - RNA, 19 nt, Human
guccucacugcucccugaa

SEQ ID NO: 3637078 - RNA, 20 nt, Human
guccucagccuugccagaga

SEQ ID NO: 3637079 - RNA, 21 nt, Human
guccucagccuugccagagau

SEQ ID NO: 3637080 - RNA, 13 nt, Human
guccucagggagc

SEQ ID NO: 3637081 - RNA, 15 nt, Human
guccucagguggcca

SEQ ID NO: 3637082 - RNA, 18 nt, Human
guccucaguccauuuaua

SEQ ID NO: 3637083 - RNA, 17 nt, Human
guccucauuucuccaga

SEQ ID NO: 3637084 - RNA, 22 nt, Human
guccuccaacaccaagcacagc

SEQ ID NO: 3637085 - RNA, 14 nt, Human
guccuccaagccag

SEQ ID NO: 3637086 - RNA, 13 nt, Human
guccuccagaacu

SEQ ID NO: 3637087 - RNA, 14 nt, Human
guccuccaggagcu

SEQ ID NO: 3637088 - RNA, 16 nt, Human
guccucccauccccug

SEQ ID NO: 3637089 - RNA, 18 nt, Human
guccucccauccccugga

SEQ ID NO: 3637090 - RNA, 19 nt, Human
guccucccauccccuggac

SEQ ID NO: 3637091 - RNA, 13 nt, Human
guccucccaucuc

SEQ ID NO: 3637092 - RNA, 20 nt, Human
gucuggauaacuuccacagg

SEQ ID NO: 3637093 - RNA, 21 nt, Human
gucuggauaacuuccacaggg

SEQ ID NO: 3637094 - RNA, 15 nt, Human
gucuggcaaugccac

SEQ ID NO: 3637095 - RNA, 16 nt, Human
gucuggcacagccugc

SEQ ID NO: 3637096 - RNA, 17 nt, Human
gucuggccccccugguc

SEQ ID NO: 3637097 - RNA, 15 nt, Human
gucuggcugguguua

SEQ ID NO: 3637098 - RNA, 21 nt, Human
gucuggcugguguuaacagaa

SEQ ID NO: 3637099 - RNA, 18 nt, Human
gucugggacuuccuugcu

SEQ ID NO: 3637100 - RNA, 20 nt, Human
gucugggacuuccuugcucu

SEQ ID NO: 3637101 - RNA, 16 nt, Human
gucugggagaggcaga

SEQ ID NO: 3637102 - RNA, 20 nt, Human
gucugggaggaauggacaga

SEQ ID NO: 3637103 - RNA, 17 nt, Human
gucugggcuagguagaa

SEQ ID NO: 3637104 - RNA, 15 nt, Human
gucuggggaccagcu

SEQ ID NO: 3637105 - RNA, 20 nt, Human
gucugggguucagccccucc

SEQ ID NO: 3637106 - RNA, 14 nt, Human
gucugggugcuacu

SEQ ID NO: 3637107 - RNA, 14 nt, Human
gucuggguggcuca

SEQ ID NO: 3637108 - RNA, 15 nt, Human
gucuggguggcucac

SEQ ID NO: 3637109 - RNA, 14 nt, Human
gucuggucuauguu

SEQ ID NO: 3637110 - RNA, 15 nt, Human
gucuggugaagcuca

SEQ ID NO: 3637111 - RNA, 16 nt, Human
gucugguuuuaacaau

SEQ ID NO: 3637112 - RNA, 15 nt, Human
gucuguaaaaucuuu

SEQ ID NO: 3637113 - RNA, 19 nt, Human
gucuguaaaucuaacauua

SEQ ID NO: 3637114 - RNA, 14 nt, Human
gucuguacacgugu

SEQ ID NO: 3637115 - RNA, 17 nt, Human
gucuguagagggcccug

SEQ ID NO: 3637116 - RNA, 18 nt, Human
gucuguagagggcccugg

SEQ ID NO: 3637117 - RNA, 17 nt, Human
gucuguagguugcacac

SEQ ID NO: 3637118 - RNA, 20 nt, Human
gucuguagguugcacacuuu

SEQ ID NO: 3637119 - RNA, 22 nt, Human
gucuguagugucacucaaggcg

SEQ ID NO: 3637120 - RNA, 23 nt, Human
gucuguauuuaugugugaggagc

SEQ ID NO: 3637121 - RNA, 12 nt, Human
gucuguauuuca

SEQ ID NO: 3637122 - RNA, 17 nt, Human
gucuguauuucaugugg

SEQ ID NO: 3637123 - RNA, 18 nt, Human
gucuguauuucauguggc

SEQ ID NO: 3637124 - RNA, 20 nt, Human
gucuguauuucauguggcug

SEQ ID NO: 3637125 - RNA, 20 nt, Human
gucugucccgggguccugug

SEQ ID NO: 3637126 - RNA, 22 nt, Human
gucugucucuccaucuguuugg

SEQ ID NO: 3637127 - RNA, 14 nt, Human
gucugucugucugu

SEQ ID NO: 3637128 - RNA, 16 nt, Human
gucugucuucacagcu

SEQ ID NO: 3637129 - RNA, 22 nt, Human
gucugucuucacagcucugugu

SEQ ID NO: 3637130 - RNA, 16 nt, Human
gucugucuucuguaua

SEQ ID NO: 3637131 - RNA, 23 nt, Human
gucugucuucuguauauaaaugg

SEQ ID NO: 3637132 - RNA, 21 nt, Human
gucugugaacagagagacccu

SEQ ID NO: 3637133 - RNA, 17 nt, Human
gucugugagaugcuaga

SEQ ID NO: 3637134 - RNA, 18 nt, Human
gucugugccauuuuguau

SEQ ID NO: 3637135 - RNA, 13 nt, Human
gucugugcugagg

SEQ ID NO: 3637136 - RNA, 13 nt, Human
gucuguggauuuu

SEQ ID NO: 3637137 - RNA, 20 nt, Human
gucuguggcuuucagccucu

SEQ ID NO: 3637138 - RNA, 15 nt, Human
gucugugugaaugug

SEQ ID NO: 3637139 - RNA, 18 nt, Human
gucugugugggacuguac

SEQ ID NO: 3637140 - RNA, 20 nt, Human
gucugugugugaccccuccu

SEQ ID NO: 3637141 - RNA, 12 nt, Human
gucugugugugu

SEQ ID NO: 3637142 - RNA, 21 nt, Human
gucuguguguuuaugugugug

SEQ ID NO: 3637143 - RNA, 22 nt, Human
gucuguguguuuaugugugugu

SEQ ID NO: 3637144 - RNA, 20 nt, Human
gucuguguuuuuuuggcagu

SEQ ID NO: 3637145 - RNA, 12 nt, Human
gucuguuagcca

SEQ ID NO: 3637146 - RNA, 13 nt, Human
gucuguugauuaa

SEQ ID NO: 3637147 - RNA, 19 nt, Human
gucuguuggcaggcuggcc

SEQ ID NO: 3637148 - RNA, 18 nt, Human
gucuguugugugucaugc

SEQ ID NO: 3637149 - RNA, 20 nt, Human
gucuguugugugucaugcca

SEQ ID NO: 3637150 - RNA, 17 nt, Human
gucuguuuaaaguggca

SEQ ID NO: 3637151 - RNA, 15 nt, Human
gucuguuuaagaaaa

SEQ ID NO: 3637152 - RNA, 18 nt, Human
gucuguuuaagaaaagua

SEQ ID NO: 3637153 - RNA, 21 nt, Human
gucuguuugcugauggucugg

SEQ ID NO: 3637154 - RNA, 15 nt, Human
gucuguuuuaugacu

SEQ ID NO: 3637155 - RNA, 12 nt, Human
gucuguuuuccu

SEQ ID NO: 3637156 - RNA, 14 nt, Human
gucuguuuuccuuu

SEQ ID NO: 3637157 - RNA, 16 nt, Human
gucuguuuuccuuucu

SEQ ID NO: 3637158 - RNA, 20 nt, Human
gucuguuuuccuuucucacc

SEQ ID NO: 3637159 - RNA, 14 nt, Human
gucuguuuuguaaa

SEQ ID NO: 3637160 - RNA, 15 nt, Human
gucuguuuuguaaag

SEQ ID NO: 3637161 - RNA, 20 nt, Human
gucuuaaaaccugcuuuuca

SEQ ID NO: 3637162 - RNA, 12 nt, Human
gucuuaaaauaa

SEQ ID NO: 3637163 - RNA, 22 nt, Human
gucuuaaaauaacuuauaucau

SEQ ID NO: 3637164 - RNA, 14 nt, Human
gucuuaaugaaguu

SEQ ID NO: 3637165 - RNA, 18 nt, Human
gucuuaaugaaguuugaa

SEQ ID NO: 3637166 - RNA, 22 nt, Human
gucuuaaugaaguuugaauguu

SEQ ID NO: 3637167 - RNA, 17 nt, Human
gucuuaauggaugaaau

SEQ ID NO: 3637168 - RNA, 19 nt, Human
gucuuaauuaaaagaauau

SEQ ID NO: 3637169 - RNA, 22 nt, Human
gucuuaauuaaaagaauauuuu

SEQ ID NO: 3637170 - RNA, 15 nt, Human
gucuuaauuaaguaa

SEQ ID NO: 3637171 - RNA, 13 nt, Human
gucuuaauuauua

SEQ ID NO: 3637172 - RNA, 23 nt, Human
gucuuagaaguggaccaggacag

SEQ ID NO: 3637173 - RNA, 18 nt, Human
gucuuagaucauaguuuu

SEQ ID NO: 3637174 - RNA, 16 nt, Human
gucuuagcagugauuu

SEQ ID NO: 3637175 - RNA, 15 nt, Human
gucuuaguuguacaa

SEQ ID NO: 3637176 - RNA, 17 nt, Human
gucuuauauagcagcaa

SEQ ID NO: 3637177 - RNA, 15 nt, Human
gucuuaucaagcagc

SEQ ID NO: 3637178 - RNA, 23 nt, Human
gucuuaucugagcugagccaggc

SEQ ID NO: 3637179 - RNA, 21 nt, Human
gucuuaugcuuccagaaacac

SEQ ID NO: 3637180 - RNA, 19 nt, Human
gucuucaacagcuccccau

SEQ ID NO: 3637181 - RNA, 22 nt, Human
gucuucaacauaacccacuugu

SEQ ID NO: 3637182 - RNA, 16 nt, Human
gucuucaacauccugc

SEQ ID NO: 3637183 - RNA, 19 nt, Human
gucuucaacauccugccag

SEQ ID NO: 3637184 - RNA, 15 nt, Human
gucuucaagggcugc

SEQ ID NO: 3637185 - RNA, 16 nt, Human
gucuucacagcucugu

SEQ ID NO: 3637186 - RNA, 17 nt, Human
gucuucacagcucugug

SEQ ID NO: 3637187 - RNA, 12 nt, Human
gucuucagccua

SEQ ID NO: 3637188 - RNA, 23 nt, Human
gucuucagccuagccgaccucag

SEQ ID NO: 3637189 - RNA, 18 nt, Human
gucuucagggggccaggu

SEQ ID NO: 3637190 - RNA, 11 nt, Human
gucuucauaaa

SEQ ID NO: 3637191 - RNA, 23 nt, Human
gucuucauaccuacauguauuug

SEQ ID NO: 3637192 - RNA, 16 nt, Human
gucuucauccuuagca

SEQ ID NO: 3637193 - RNA, 21 nt, Human
gucuucauccuuagcaacagc

SEQ ID NO: 3637194 - RNA, 23 nt, Human
gucuucaugaaaugcuaugucau

SEQ ID NO: 3637195 - RNA, 22 nt, Human
gucuucauuaagcccucuucca

SEQ ID NO: 3637196 - RNA, 15 nt, Human
gucuuccacaaagaa

SEQ ID NO: 3637197 - RNA, 19 nt, Human
gucuuccacaaagaaaauu

SEQ ID NO: 3637198 - RNA, 17 nt, Human
gucuuccauaauguaua

SEQ ID NO: 3637199 - RNA, 13 nt, Human
gucuucccaccca

SEQ ID NO: 3637200 - RNA, 16 nt, Human
gucuucccuagggcug

SEQ ID NO: 3637201 - RNA, 21 nt, Human
gucuuccgccccugccugcca

SEQ ID NO: 3637202 - RNA, 15 nt, Human
gucuuccgucucccc

SEQ ID NO: 3637203 - RNA, 16 nt, Human
gucuuccuacucuucu

SEQ ID NO: 3637204 - RNA, 19 nt, Human
gucuuccuacucuucucuc

SEQ ID NO: 3637205 - RNA, 22 nt, Human
gucuuccuacucuucucucugc

SEQ ID NO: 3637206 - RNA, 20 nt, Human
gucuuccuauuucagaaguu

SEQ ID NO: 3637207 - RNA, 14 nt, Human
gucuuccugacacu

SEQ ID NO: 3637208 - RNA, 17 nt, Human
gucuuccugcauucacc

SEQ ID NO: 3637209 - RNA, 20 nt, Human
gucuuccugcauucacccag

SEQ ID NO: 3637210 - RNA, 12 nt, Human
gucuuccugugg

SEQ ID NO: 3637211 - RNA, 15 nt, Human
gucuucggaaaccuu

SEQ ID NO: 3637212 - RNA, 13 nt, Human
gucuucguacagu

SEQ ID NO: 3637213 - RNA, 16 nt, Human
gucuucguacaguucu

SEQ ID NO: 3637214 - RNA, 18 nt, Human
gucuucguacaguucuuc

SEQ ID NO: 3637215 - RNA, 14 nt, Human
gucuucuaaacuuc

SEQ ID NO: 3637216 - RNA, 13 nt, Human
gucuucuaauuuc

SEQ ID NO: 3637217 - RNA, 18 nt, Human
gucuucucacaagccagc

SEQ ID NO: 3637218 - RNA, 15 nt, Human
gucuucucaggcucu

SEQ ID NO: 3637219 - RNA, 15 nt, Human
gucuucucccuggaa

SEQ ID NO: 3637220 - RNA, 12 nt, Human
gucuucugcuuu

SEQ ID NO: 3637221 - RNA, 22 nt, Human
gucuucugcuuuguugugugcc

SEQ ID NO: 3637222 - RNA, 23 nt, Human
gucuucuggacaggcucugcuuc

SEQ ID NO: 3637223 - RNA, 12 nt, Human
gucuucuguaua

SEQ ID NO: 3637224 - RNA, 20 nt, Human
gucuucuuacuuggaacuga

SEQ ID NO: 3637225 - RNA, 17 nt, Human
gucuucuuugcccacaa

SEQ ID NO: 3637226 - RNA, 18 nt, Human
gucuugaugaccaaaguc

SEQ ID NO: 3637227 - RNA, 18 nt, Human
gucuugauuuguuuuaga

SEQ ID NO: 3637228 - RNA, 19 nt, Human
gucuugcaauggcagccuu

SEQ ID NO: 3637229 - RNA, 20 nt, Human
gucuugcaauggcagccuug

SEQ ID NO: 3637230 - RNA, 23 nt, Human
gucuugcaauggcagccuuggca

SEQ ID NO: 3637231 - RNA, 13 nt, Human
gucuugccccauc

SEQ ID NO: 3637232 - RNA, 22 nt, Human
gucuugccccaucacugcgcca

SEQ ID NO: 3637233 - RNA, 16 nt, Human
gucuugccuuuuucau

SEQ ID NO: 3637234 - RNA, 18 nt, Human
gucuugccuuuuucauua

SEQ ID NO: 3637235 - RNA, 18 nt, Human
gucuugcuaccucaguca

SEQ ID NO: 3637236 - RNA, 18 nt, Human
gugugguugcucacagcu

SEQ ID NO: 3637237 - RNA, 17 nt, Human
gugugguuuaguguaaa

SEQ ID NO: 3637238 - RNA, 11 nt, Human
guguguaaaca

SEQ ID NO: 3637239 - RNA, 21 nt, Human
guguguaagaugucuuccuau

SEQ ID NO: 3637240 - RNA, 13 nt, Human
guguguagaguua

SEQ ID NO: 3637241 - RNA, 16 nt, Human
guguguagaguuaaga

SEQ ID NO: 3637242 - RNA, 20 nt, Human
guguguagaguuaagaagcu

SEQ ID NO: 3637243 - RNA, 21 nt, Human
guguguagaguuaagaagcug

SEQ ID NO: 3637244 - RNA, 23 nt, Human
guguguauauauguguauauaua

SEQ ID NO: 3637245 - RNA, 14 nt, Human
guguguauauggac

SEQ ID NO: 3637246 - RNA, 14 nt, Human
guguguauguguau

SEQ ID NO: 3637247 - RNA, 23 nt, Human
guguguauguguguuucuguccu

SEQ ID NO: 3637248 - RNA, 20 nt, Human
guguguauuaaaaaaaacaa

SEQ ID NO: 3637249 - RNA, 15 nt, Human
guguguauuugcuaa

SEQ ID NO: 3637250 - RNA, 19 nt, Human
guguguccaaaacugccuc

SEQ ID NO: 3637251 - RNA, 14 nt, Human
gugugucuuaauua

SEQ ID NO: 3637252 - RNA, 20 nt, Human
gugugugaaaaugugugugu

SEQ ID NO: 3637253 - RNA, 17 nt, Human
gugugugaaugaacacu

SEQ ID NO: 3637254 - RNA, 17 nt, Human
gugugugaccccuccug

SEQ ID NO: 3637255 - RNA, 22 nt, Human
gugugugaccccuccuggggcc

SEQ ID NO: 3637256 - RNA, 17 nt, Human
gugugugcccucugggc

SEQ ID NO: 3637257 - RNA, 23 nt, Human
gugugugcccucugggcucugag

SEQ ID NO: 3637258 - RNA, 17 nt, Human
guguguggcagagagag

SEQ ID NO: 3637259 - RNA, 17 nt, Human
gugugugguagaaacaa

SEQ ID NO: 3637260 - RNA, 13 nt, Human
guguguguaugug

SEQ ID NO: 3637261 - RNA, 14 nt, Human
guguguguaugugg

SEQ ID NO: 3637262 - RNA, 14 nt, Human
gugugugugcgugu

SEQ ID NO: 3637263 - RNA, 14 nt, Human
guguguguguccuu

SEQ ID NO: 3637264 - RNA, 12 nt, Human
guguguguguga

SEQ ID NO: 3637265 - RNA, 13 nt, Human
gugugugugugca

SEQ ID NO: 3637266 - RNA, 15 nt, Human
guguguguguguaug

SEQ ID NO: 3637267 - RNA, 14 nt, Human
gugugugugugugc

SEQ ID NO: 3637268 - RNA, 15 nt, Human
gugugugugugugug

SEQ ID NO: 3637269 - RNA, 11 nt, Human
guguguuccug

SEQ ID NO: 3637270 - RNA, 13 nt, Human
guguguuccuggc

SEQ ID NO: 3637271 - RNA, 20 nt, Human
guguguugauacuguugcac

SEQ ID NO: 3637272 - RNA, 22 nt, Human
guguguugauacuguugcacgu

SEQ ID NO: 3637273 - RNA, 14 nt, Human
guguguugcuuaug

SEQ ID NO: 3637274 - RNA, 14 nt, Human
guguguugugugug

SEQ ID NO: 3637275 - RNA, 17 nt, Human
guguguuguguguggga

SEQ ID NO: 3637276 - RNA, 18 nt, Human
guguguuuaaauaaagua

SEQ ID NO: 3637277 - RNA, 22 nt, Human
guguguuuaaauaaaguaucau

SEQ ID NO: 3637278 - RNA, 15 nt, Human
guguguuuaugugug

SEQ ID NO: 3637279 - RNA, 19 nt, Human
guguguuucuguccuguaa

SEQ ID NO: 3637280 - RNA, 16 nt, Human
guguguuuuaaaauga

SEQ ID NO: 3637281 - RNA, 17 nt, Human
guguguuuucauaauaa

SEQ ID NO: 3637282 - RNA, 18 nt, Human
guguguuuucauaauaaa

SEQ ID NO: 3637283 - RNA, 16 nt, Human
guguguuuuucuauua

SEQ ID NO: 3637284 - RNA, 14 nt, Human
guguuaacagaagg

SEQ ID NO: 3637285 - RNA, 17 nt, Human
guguuaacauuccaaga

SEQ ID NO: 3637286 - RNA, 20 nt, Human
guguuaaccaugguggggac

SEQ ID NO: 3637287 - RNA, 19 nt, Human
guguuaauacuaguuguga

SEQ ID NO: 3637288 - RNA, 15 nt, Human
guguuaaucaauuua

SEQ ID NO: 3637289 - RNA, 16 nt, Human
guguuaauuuaaguuu

SEQ ID NO: 3637290 - RNA, 15 nt, Human
guguuaccugugugc

SEQ ID NO: 3637291 - RNA, 20 nt, Human
guguuacuaaaaaaaagaug

SEQ ID NO: 3637292 - RNA, 21 nt, Human
guguuacuaaaaaaaagauga

SEQ ID NO: 3637293 - RNA, 14 nt, Human
guguuacuuuuugu

SEQ ID NO: 3637294 - RNA, 14 nt, Human
guguuaggccuggc

SEQ ID NO: 3637295 - RNA, 24 nt, Human
guguuaggccuggcacagugucug

SEQ ID NO: 3637296 - RNA, 22 nt, Human
guguuagggaagggccugccac

SEQ ID NO: 3637297 - RNA, 14 nt, Human
guguuaguggcacc

SEQ ID NO: 3637298 - RNA, 20 nt, Human
guguuauaauggguaauaua

SEQ ID NO: 3637299 - RNA, 23 nt, Human
guguuauaugaacauacaaaugc

SEQ ID NO: 3637300 - RNA, 14 nt, Human
guguuauguauuuc

SEQ ID NO: 3637301 - RNA, 16 nt, Human
guguuauucuuugcgu

SEQ ID NO: 3637302 - RNA, 24 nt, Human
guguuauugagagagauguguaau

SEQ ID NO: 3637303 - RNA, 21 nt, Human
guguuauuuggaaccuuguuu

SEQ ID NO: 3637304 - RNA, 14 nt, Human
guguucaauauuuu

SEQ ID NO: 3637305 - RNA, 14 nt, Human
guguucagaaaaaa

SEQ ID NO: 3637306 - RNA, 14 nt, Human
guguucauuguuuc

SEQ ID NO: 3637307 - RNA, 21 nt, Human
guguucccauuucagcugauc

SEQ ID NO: 3637308 - RNA, 18 nt, Human
guguuccccucuugucuc

SEQ ID NO: 3637309 - RNA, 19 nt, Human
guguuccccucuugucucc

SEQ ID NO: 3637310 - RNA, 22 nt, Human
guguuccccucuugucuccccu

SEQ ID NO: 3637311 - RNA, 18 nt, Human
guguuccccuuccacuga

SEQ ID NO: 3637312 - RNA, 19 nt, Human
guguuccccuuccacugag

SEQ ID NO: 3637313 - RNA, 22 nt, Human
guguuccccuuccacugagggc

SEQ ID NO: 3637314 - RNA, 23 nt, Human
guguuccccuuccacugagggca

SEQ ID NO: 3637315 - RNA, 22 nt, Human
guguuccuauauuccagguuua

SEQ ID NO: 3637316 - RNA, 10 nt, Human
guguuccugg

SEQ ID NO: 3637317 - RNA, 11 nt, Human
guguucguucu

SEQ ID NO: 3637318 - RNA, 23 nt, Human
guguucuauccaaacauguauuu

SEQ ID NO: 3637319 - RNA, 12 nt, Human
guguucucagag

SEQ ID NO: 3637320 - RNA, 13 nt, Human
guguucugugaua

SEQ ID NO: 3637321 - RNA, 13 nt, Human
guguucuguuaca

SEQ ID NO: 3637322 - RNA, 23 nt, Human
guguucuguuuguuauuguuuug

SEQ ID NO: 3637323 - RNA, 13 nt, Human
guguucuuugugu

SEQ ID NO: 3637324 - RNA, 12 nt, Human
guguugaaaacc

SEQ ID NO: 3637325 - RNA, 22 nt, Human
guguugagcaucugucccccuu

SEQ ID NO: 3637326 - RNA, 19 nt, Human
guguugagccuuuucccuc

SEQ ID NO: 3637327 - RNA, 14 nt, Human
guguugauacuguu

SEQ ID NO: 3637328 - RNA, 17 nt, Human
guguugauacuguugca

SEQ ID NO: 3637329 - RNA, 23 nt, Human
guguugauacuguugcacgugug

SEQ ID NO: 3637330 - RNA, 13 nt, Human
guguugcagaagg

SEQ ID NO: 3637331 - RNA, 15 nt, Human
guguugccacaggac

SEQ ID NO: 3637332 - RNA, 19 nt, Human
guguugccacaguagaacu

SEQ ID NO: 3637333 - RNA, 20 nt, Human
guguuggacaaaugugaaga

SEQ ID NO: 3637334 - RNA, 20 nt, Human
guguuggacaagcuucugag

SEQ ID NO: 3637335 - RNA, 16 nt, Human
guguuggcccaagcuc

SEQ ID NO: 3637336 - RNA, 18 nt, Human
guguuggcccaagcucuu

SEQ ID NO: 3637337 - RNA, 14 nt, Human
guguugggauacug

SEQ ID NO: 3637338 - RNA, 14 nt, Human
guguuguauuaaca

SEQ ID NO: 3637339 - RNA, 15 nt, Human
guguugucucuugag

SEQ ID NO: 3637340 - RNA, 18 nt, Human
guguuuaaagagagguua

SEQ ID NO: 3637341 - RNA, 21 nt, Human
guguuuaaaguucaacauguu

SEQ ID NO: 3637342 - RNA, 16 nt, Human
guguuuaaauaaagua

SEQ ID NO: 3637343 - RNA, 12 nt, Human
guguuuaacuga

SEQ ID NO: 3637344 - RNA, 14 nt, Human
guguuuauaaaaua

SEQ ID NO: 3637345 - RNA, 18 nt, Human
guguuuauaucuccuuug

SEQ ID NO: 3637346 - RNA, 12 nt, Human
guguuuaugugu

SEQ ID NO: 3637347 - RNA, 16 nt, Human
guguuuaugugugugu

SEQ ID NO: 3637348 - RNA, 15 nt, Human
guguuuauucuugau

SEQ ID NO: 3637349 - RNA, 19 nt, Human
guguuucgcggguaacugg

SEQ ID NO: 3637350 - RNA, 12 nt, Human
guguuucuauga

SEQ ID NO: 3637351 - RNA, 13 nt, Human
guguuucugacuc

SEQ ID NO: 3637352 - RNA, 21 nt, Human
guguuucuguccuguaacugu

SEQ ID NO: 3637353 - RNA, 13 nt, Human
guguuucuuuagu

SEQ ID NO: 3637354 - RNA, 16 nt, Human
guguuucuuuaguuuu

SEQ ID NO: 3637355 - RNA, 14 nt, Human
guguuuggcuuuca

SEQ ID NO: 3637356 - RNA, 17 nt, Human
guguuugguuuacauuu

SEQ ID NO: 3637357 - RNA, 12 nt, Human
guguuugucauu

SEQ ID NO: 3637358 - RNA, 13 nt, Human
guguuugucauua

SEQ ID NO: 3637359 - RNA, 12 nt, Human
guguuuguuccu

SEQ ID NO: 3637360 - RNA, 18 nt, Human
guguuuuaaaaugagaaa

SEQ ID NO: 3637361 - RNA, 13 nt, Human
guguuuuaaauuc

SEQ ID NO: 3637362 - RNA, 16 nt, Human
guguuuuaagaaaugu

SEQ ID NO: 3637363 - RNA, 22 nt, Human
guguuuuaauuccaauaugaug

SEQ ID NO: 3637364 - RNA, 14 nt, Human
guguuuuaauugua

SEQ ID NO: 3637365 - RNA, 16 nt, Human
guguuuuaauuguaaa

SEQ ID NO: 3637366 - RNA, 16 nt, Human
guguuuuagaugguuu

SEQ ID NO: 3637367 - RNA, 12 nt, Human
guguuuugcugu

SEQ ID NO: 3637368 - RNA, 14 nt, Human
guguuuuguaccag

SEQ ID NO: 3637369 - RNA, 21 nt, Human
guguuuuguucaccauuauaa

SEQ ID NO: 3637370 - RNA, 16 nt, Human
guguuuuguugaguuu

SEQ ID NO: 3637371 - RNA, 16 nt, Human
guguuuuguuuauuaa

SEQ ID NO: 3637372 - RNA, 14 nt, Human
guguuuuucuauua

SEQ ID NO: 3637373 - RNA, 22 nt, Human
guguuuuucuauuaaaagacuc

SEQ ID NO: 3637374 - RNA, 13 nt, Human
guguuuuucucca

SEQ ID NO: 3637375 - RNA, 14 nt, Human
guguuuuucugcuu

SEQ ID NO: 3637376 - RNA, 19 nt, Human
guguuuuucugcuuuugaa

SEQ ID NO: 3637377 - RNA, 15 nt, Human
guguuuuugaaauau

SEQ ID NO: 3637378 - RNA, 15 nt, Human
guguuuuugggaugu

SEQ ID NO: 3637379 - RNA, 18 nt, Human
guguuuuugggaugucuu

SEQ ID NO: 3637380 - RNA, 14 nt, Human
guguuuuuguaaag

SEQ ID NO: 3637381 - RNA, 14 nt, Human
guguuuuuuaagau

SEQ ID NO: 3637382 - RNA, 18 nt, Human
guuccucguucucccugg

SEQ ID NO: 3637383 - RNA, 23 nt, Human
guuccucugcucaccgcccauca

SEQ ID NO: 3637384 - RNA, 22 nt, Human
guuccucuuugguguacagacu

SEQ ID NO: 3637385 - RNA, 23 nt, Human
guuccugacaucacagcagccuc

SEQ ID NO: 3637386 - RNA, 20 nt, Human
guuccugaugacccaggcug

SEQ ID NO: 3637387 - RNA, 17 nt, Human
guuccugcagcagagcc

SEQ ID NO: 3637388 - RNA, 16 nt, Human
guuccugcuagaaaug

SEQ ID NO: 3637389 - RNA, 17 nt, Human
guuccugcuagaaaugg

SEQ ID NO: 3637390 - RNA, 11 nt, Human
guuccugcugc

SEQ ID NO: 3637391 - RNA, 14 nt, Human
guuccugcugcugu

SEQ ID NO: 3637392 - RNA, 13 nt, Human
guuccuggcaaua

SEQ ID NO: 3637393 - RNA, 15 nt, Human
guuccuggcucagcc

SEQ ID NO: 3637394 - RNA, 16 nt, Human
guuccuggcucagccu

SEQ ID NO: 3637395 - RNA, 22 nt, Human
guuccuggggcauccauggggu

SEQ ID NO: 3637396 - RNA, 16 nt, Human
guuccugucccugcgc

SEQ ID NO: 3637397 - RNA, 17 nt, Human
guuccugucccugcgcc

SEQ ID NO: 3637398 - RNA, 14 nt, Human
guuccuguggcucc

SEQ ID NO: 3637399 - RNA, 13 nt, Human
guuccuucccaau

SEQ ID NO: 3637400 - RNA, 20 nt, Human
guuccuucccugugccuccu

SEQ ID NO: 3637401 - RNA, 18 nt, Human
guuccuuccucugagccu

SEQ ID NO: 3637402 - RNA, 23 nt, Human
guuccuugaucuguauauacaau

SEQ ID NO: 3637403 - RNA, 21 nt, Human
guuccuugguccuaguaagaa

SEQ ID NO: 3637404 - RNA, 21 nt, Human
guuccuuuccaacguuuggaa

SEQ ID NO: 3637405 - RNA, 14 nt, Human
guucgacucagccu

SEQ ID NO: 3637406 - RNA, 20 nt, Human
guucgagaccagccuggcca

SEQ ID NO: 3637407 - RNA, 15 nt, Human
guucgcagccacccu

SEQ ID NO: 3637408 - RNA, 20 nt, Human
guucgcagccacccugagga

SEQ ID NO: 3637409 - RNA, 19 nt, Human
guucgcuuggcuccaugcu

SEQ ID NO: 3637410 - RNA, 14 nt, Human
guucggcucugggu

SEQ ID NO: 3637411 - RNA, 17 nt, Human
guucguggaaagggugc

SEQ ID NO: 3637412 - RNA, 13 nt, Human
guucguucuguuu

SEQ ID NO: 3637413 - RNA, 19 nt, Human
guucuaaaaauugugauca

SEQ ID NO: 3637414 - RNA, 14 nt, Human
guucuaaagaugga

SEQ ID NO: 3637415 - RNA, 17 nt, Human
guucuaaagauggaaaa

SEQ ID NO: 3637416 - RNA, 20 nt, Human
guucuaaagauggaaaaacc

SEQ ID NO: 3637417 - RNA, 10 nt, Human
guucuaaagc

SEQ ID NO: 3637418 - RNA, 16 nt, Human
guucuaaagcucugac

SEQ ID NO: 3637419 - RNA, 17 nt, Human
guucuaaaguucuaaga

SEQ ID NO: 3637420 - RNA, 14 nt, Human
guucuaagaaaccc

SEQ ID NO: 3637421 - RNA, 17 nt, Human
guucuaagacucaaaug

SEQ ID NO: 3637422 - RNA, 13 nt, Human
guucuaagaugug

SEQ ID NO: 3637423 - RNA, 17 nt, Human
guucuaagauucuaaug

SEQ ID NO: 3637424 - RNA, 14 nt, Human
guucuaagauucug

SEQ ID NO: 3637425 - RNA, 15 nt, Human
guucuaagauucuga

SEQ ID NO: 3637426 - RNA, 13 nt, Human
guucuaaggccua

SEQ ID NO: 3637427 - RNA, 20 nt, Human
guucuaaggccuaggauucu

SEQ ID NO: 3637428 - RNA, 16 nt, Human
guucuaagucuuucca

SEQ ID NO: 3637429 - RNA, 19 nt, Human
guucuaagucuuuccauug

SEQ ID NO: 3637430 - RNA, 15 nt, Human
guucuaaguuucuaa

SEQ ID NO: 3637431 - RNA, 20 nt, Human
guucuacaaucuauuuauug

SEQ ID NO: 3637432 - RNA, 18 nt, Human
guucuacccguuccaaaa

SEQ ID NO: 3637433 - RNA, 20 nt, Human
guucuaccucaggcagcuca

SEQ ID NO: 3637434 - RNA, 19 nt, Human
guucuacggaucaucaaca

SEQ ID NO: 3637435 - RNA, 20 nt, Human
guucuagacauggagguucu

SEQ ID NO: 3637436 - RNA, 21 nt, Human
guucuagacauggagguucua

SEQ ID NO: 3637437 - RNA, 12 nt, Human
guucuaggaaaa

SEQ ID NO: 3637438 - RNA, 13 nt, Human
guucuaggaaaau

SEQ ID NO: 3637439 - RNA, 23 nt, Human
guucuaggcacuguaguucuaag

SEQ ID NO: 3637440 - RNA, 14 nt, Human
guucuagguuucaa

SEQ ID NO: 3637441 - RNA, 22 nt, Human
guucuagguuucaaagaugcug

SEQ ID NO: 3637442 - RNA, 14 nt, Human
guucuaguguuuuc

SEQ ID NO: 3637443 - RNA, 15 nt, Human
guucuaguuugcauu

SEQ ID NO: 3637444 - RNA, 14 nt, Human
guucuaguuuuuua

SEQ ID NO: 3637445 - RNA, 21 nt, Human
guucuauccaaacauguauuu

SEQ ID NO: 3637446 - RNA, 14 nt, Human
guucuaugaacaac

SEQ ID NO: 3637447 - RNA, 12 nt, Human
guucuauguuua

SEQ ID NO: 3637448 - RNA, 18 nt, Human
guucuauuuggaauuuau

SEQ ID NO: 3637449 - RNA, 14 nt, Human
guucucaaugaaaa

SEQ ID NO: 3637450 - RNA, 23 nt, Human
guucucaaugugaaaaauguguc

SEQ ID NO: 3637451 - RNA, 21 nt, Human
guucucaauuccaacaguuua

SEQ ID NO: 3637452 - RNA, 12 nt, Human
guucucacaccc

SEQ ID NO: 3637453 - RNA, 16 nt, Human
guucucacacccaccg

SEQ ID NO: 3637454 - RNA, 12 nt, Human
guucucacuguu

SEQ ID NO: 3637455 - RNA, 19 nt, Human
guucucacuguucccucug

SEQ ID NO: 3637456 - RNA, 13 nt, Human
guucucagcuccc

SEQ ID NO: 3637457 - RNA, 18 nt, Human
guucucagcucccccugu

SEQ ID NO: 3637458 - RNA, 20 nt, Human
guucucagcucccccugucc

SEQ ID NO: 3637459 - RNA, 13 nt, Human
guucucagggcuc

SEQ ID NO: 3637460 - RNA, 23 nt, Human
guucucagggcuccugccuucug

SEQ ID NO: 3637461 - RNA, 22 nt, Human
guucuccaacaucacagcccag

SEQ ID NO: 3637462 - RNA, 23 nt, Human
guucuccaacaucacagcccagc

SEQ ID NO: 3637463 - RNA, 20 nt, Human
guucuccagucauuauguua

SEQ ID NO: 3637464 - RNA, 20 nt, Human
guucucccuguacaguguua

SEQ ID NO: 3637465 - RNA, 18 nt, Human
guucuccguuagcuccug

SEQ ID NO: 3637466 - RNA, 19 nt, Human
guucuccguuagcuccugu

SEQ ID NO: 3637467 - RNA, 17 nt, Human
guucuccucuccccucu

SEQ ID NO: 3637468 - RNA, 13 nt, Human
guucuccuuuucc

SEQ ID NO: 3637469 - RNA, 18 nt, Human
guucuccuuuuccucucu

SEQ ID NO: 3637470 - RNA, 22 nt, Human
guucuccuuuuccucucucccg

SEQ ID NO: 3637471 - RNA, 22 nt, Human
guucucuaaguuccacugagcu

SEQ ID NO: 3637472 - RNA, 17 nt, Human
guucucuaucauuuaau

SEQ ID NO: 3637473 - RNA, 20 nt, Human
guucucucaacaagaaauaa

SEQ ID NO: 3637474 - RNA, 21 nt, Human
guucucucuacugguccucuu

SEQ ID NO: 3637475 - RNA, 15 nt, Human
guucucucuauggua

SEQ ID NO: 3637476 - RNA, 23 nt, Human
guucucucuaugguaaagauauu

SEQ ID NO: 3637477 - RNA, 16 nt, Human
guucucugaggacacu

SEQ ID NO: 3637478 - RNA, 12 nt, Human
guucucugcccu

SEQ ID NO: 3637479 - RNA, 13 nt, Human
guucucugcccuc

SEQ ID NO: 3637480 - RNA, 15 nt, Human
guucucugcccucca

SEQ ID NO: 3637481 - RNA, 14 nt, Human
guucucugggagaa

SEQ ID NO: 3637482 - RNA, 12 nt, Human
guucugaagaag

SEQ ID NO: 3637483 - RNA, 15 nt, Human
guucugaauaauuuc

SEQ ID NO: 3637484 - RNA, 16 nt, Human
guucugaauaauuucu

SEQ ID NO: 3637485 - RNA, 17 nt, Human
guucugacauuaacagu

SEQ ID NO: 3637486 - RNA, 17 nt, Human
guucugagagaaaaaga

SEQ ID NO: 3637487 - RNA, 22 nt, Human
guucugagauuauuuuaaucua

SEQ ID NO: 3637488 - RNA, 14 nt, Human
guucugaguguuuu

SEQ ID NO: 3637489 - RNA, 14 nt, Human
guucugauauuaau

SEQ ID NO: 3637490 - RNA, 18 nt, Human
guucugaugaugugccug

SEQ ID NO: 3637491 - RNA, 13 nt, Human
guucugauuagaa

SEQ ID NO: 3637492 - RNA, 16 nt, Human
guucugauuagaaaug

SEQ ID NO: 3637493 - RNA, 18 nt, Human
guucugauuagaaaugac

SEQ ID NO: 3637494 - RNA, 16 nt, Human
guucugcaaaaauauu

SEQ ID NO: 3637495 - RNA, 12 nt, Human
guucugcacuga

SEQ ID NO: 3637496 - RNA, 16 nt, Human
guucugcacugaaaag

SEQ ID NO: 3637497 - RNA, 21 nt, Human
guucugcagacacgccuuccc

SEQ ID NO: 3637498 - RNA, 23 nt, Human
guucugcagguugaagccauguc

SEQ ID NO: 3637499 - RNA, 20 nt, Human
guucugccucugauguauuu

SEQ ID NO: 3637500 - RNA, 19 nt, Human
guucugccugccagcugca

SEQ ID NO: 3637501 - RNA, 17 nt, Human
guucugcuccucuccag

SEQ ID NO: 3637502 - RNA, 22 nt, Human
guucugcuccucuccaggcacc

SEQ ID NO: 3637503 - RNA, 14 nt, Human
guucugcucugguu

SEQ ID NO: 3637504 - RNA, 19 nt, Human
guucugcuggccuggaucu

SEQ ID NO: 3637505 - RNA, 23 nt, Human
guucuggcccucaccccugcccu

SEQ ID NO: 3637506 - RNA, 20 nt, Human
guucuggcucuuccaggcug

SEQ ID NO: 3637507 - RNA, 20 nt, Human
guucuggcugccccaaccug

SEQ ID NO: 3637508 - RNA, 11 nt, Human
guucugggaca

SEQ ID NO: 3637509 - RNA, 14 nt, Human
guucugggacacag

SEQ ID NO: 3637510 - RNA, 14 nt, Human
guucugggcucuuu

SEQ ID NO: 3637511 - RNA, 15 nt, Human
guucuggggccccuu

SEQ ID NO: 3637512 - RNA, 14 nt, Human
guucuggggggacc

SEQ ID NO: 3637513 - RNA, 19 nt, Human
guucuggggggacccagug

SEQ ID NO: 3637514 - RNA, 16 nt, Human
guucuggugaggccuu

SEQ ID NO: 3637515 - RNA, 18 nt, Human
guucuggugugaacuaaa

SEQ ID NO: 3637516 - RNA, 22 nt, Human
guucugguuuuuaaccauuguc

SEQ ID NO: 3637517 - RNA, 21 nt, Human
guucuguaaaauggaaaacuu

SEQ ID NO: 3637518 - RNA, 22 nt, Human
guucuguaaaauggaaaacuua

SEQ ID NO: 3637519 - RNA, 12 nt, Human
guucuguauuug

SEQ ID NO: 3637520 - RNA, 14 nt, Human
guucuguauuugaa

SEQ ID NO: 3637521 - RNA, 18 nt, Human
guucugucccuuggagcu

SEQ ID NO: 3637522 - RNA, 12 nt, Human
guucuguggaaa

SEQ ID NO: 3637523 - RNA, 21 nt, Human
guucugugguuuuccccuccc

SEQ ID NO: 3637524 - RNA, 23 nt, Human
guucugugguuuuccccucccug

SEQ ID NO: 3637525 - RNA, 13 nt, Human
guucuguuaacug

SEQ ID NO: 3637526 - RNA, 21 nt, Human
guucuguuacaaaauguaacu

SEQ ID NO: 3637527 - RNA, 17 nt, Human
uaaacuuuaauauguau

SEQ ID NO: 3637528 - RNA, 18 nt, Human
uaaacuuuagaguagcau

SEQ ID NO: 3637529 - RNA, 15 nt, Human
uaaacuuuaucacuu

SEQ ID NO: 3637530 - RNA, 17 nt, Human
uaaacuuugaaauauau

SEQ ID NO: 3637531 - RNA, 16 nt, Human
uaaacuuuuaauucau

SEQ ID NO: 3637532 - RNA, 17 nt, Human
uaaacuuuuagaaacuu

SEQ ID NO: 3637533 - RNA, 15 nt, Human
uaaacuuuucugaua

SEQ ID NO: 3637534 - RNA, 14 nt, Human
uaaacuuuuuuuca

SEQ ID NO: 3637535 - RNA, 20 nt, Human
uaaagaaaaaaaugucaaaa

SEQ ID NO: 3637536 - RNA, 17 nt, Human
uaaagaaaaaaauugaa

SEQ ID NO: 3637537 - RNA, 14 nt, Human
uaaagaaaaauauu

SEQ ID NO: 3637538 - RNA, 20 nt, Human
uaaagaaaaauauuuaaugu

SEQ ID NO: 3637539 - RNA, 21 nt, Human
uaaagaaaaauauuuaauguu

SEQ ID NO: 3637540 - RNA, 12 nt, Human
uaaagaaaacug

SEQ ID NO: 3637541 - RNA, 13 nt, Human
uaaagaaaacuuc

SEQ ID NO: 3637542 - RNA, 12 nt, Human
uaaagaaaagau

SEQ ID NO: 3637543 - RNA, 15 nt, Human
uaaagaaaagaugaa

SEQ ID NO: 3637544 - RNA, 18 nt, Human
uaaagaaaagaugcacuu

SEQ ID NO: 3637545 - RNA, 16 nt, Human
uaaagaaaauaaaauu

SEQ ID NO: 3637546 - RNA, 19 nt, Human
uaaagaaaauaucugaaau

SEQ ID NO: 3637547 - RNA, 18 nt, Human
uaaagaaaaucucuguga

SEQ ID NO: 3637548 - RNA, 14 nt, Human
uaaagaaacagcuu

SEQ ID NO: 3637549 - RNA, 15 nt, Human
uaaagaaacagcuuu

SEQ ID NO: 3637550 - RNA, 23 nt, Human
uaaagaaacagcuuucaagugcc

SEQ ID NO: 3637551 - RNA, 18 nt, Human
uaaagaaagagagaaaau

SEQ ID NO: 3637552 - RNA, 23 nt, Human
uaaagaaagagagaaaauaaaaa

SEQ ID NO: 3637553 - RNA, 11 nt, Human
uaaagaaagug

SEQ ID NO: 3637554 - RNA, 20 nt, Human
uaaagaaaguguauuuggaa

SEQ ID NO: 3637555 - RNA, 12 nt, Human
uaaagaaauaau

SEQ ID NO: 3637556 - RNA, 20 nt, Human
uaaagaagaccugagaaugu

SEQ ID NO: 3637557 - RNA, 14 nt, Human
uaaagaagaucugu

SEQ ID NO: 3637558 - RNA, 14 nt, Human
uaaagaagguuuca

SEQ ID NO: 3637559 - RNA, 15 nt, Human
uaaagaaguauuuuu

SEQ ID NO: 3637560 - RNA, 22 nt, Human
uaaagaaguauuuuuagaauaa

SEQ ID NO: 3637561 - RNA, 17 nt, Human
uaaagaaguugaaguuu

SEQ ID NO: 3637562 - RNA, 13 nt, Human
uaaagaaguuuga

SEQ ID NO: 3637563 - RNA, 14 nt, Human
uaaagaaguuugaa

SEQ ID NO: 3637564 - RNA, 18 nt, Human
uaaagaaguuugaacauu

SEQ ID NO: 3637565 - RNA, 12 nt, Human
uaaagaauacuu

SEQ ID NO: 3637566 - RNA, 13 nt, Human
uaaagaauacuug

SEQ ID NO: 3637567 - RNA, 17 nt, Human
uaaagaaucauuauuua

SEQ ID NO: 3637568 - RNA, 20 nt, Human
uaaagaauugugguuuauau

SEQ ID NO: 3637569 - RNA, 16 nt, Human
uaaagaauuucuuuau

SEQ ID NO: 3637570 - RNA, 14 nt, Human
uaaagacaaaaaac

SEQ ID NO: 3637571 - RNA, 23 nt, Human
uaaagacaggagacaaaagagca

SEQ ID NO: 3637572 - RNA, 13 nt, Human
uaaagaccaaacu

SEQ ID NO: 3637573 - RNA, 16 nt, Human
uaaagacguuuuauaa

SEQ ID NO: 3637574 - RNA, 11 nt, Human
uaaagacucua

SEQ ID NO: 3637575 - RNA, 13 nt, Human
uaaagagaaaauu

SEQ ID NO: 3637576 - RNA, 12 nt, Human
uaaagagaaacu

SEQ ID NO: 3637577 - RNA, 14 nt, Human
uaaagagaaacuuu

SEQ ID NO: 3637578 - RNA, 19 nt, Human
uaaagagaaacuuugugcu

SEQ ID NO: 3637579 - RNA, 13 nt, Human
uaaagagagguua

SEQ ID NO: 3637580 - RNA, 20 nt, Human
uaaagaggcguugcuuucac

SEQ ID NO: 3637581 - RNA, 17 nt, Human
uaaagaggcugaaagag

SEQ ID NO: 3637582 - RNA, 15 nt, Human
uaaagagucuagauu

SEQ ID NO: 3637583 - RNA, 18 nt, Human
uaaagagucuagauucaa

SEQ ID NO: 3637584 - RNA, 14 nt, Human
uaaagaguguggca

SEQ ID NO: 3637585 - RNA, 12 nt, Human
uaaagauaauau

SEQ ID NO: 3637586 - RNA, 17 nt, Human
uaaagauaauugcuauu

SEQ ID NO: 3637587 - RNA, 23 nt, Human
uaaagauacagaacucuuucaaa

SEQ ID NO: 3637588 - RNA, 24 nt, Human
uaaagauauggagaauugcugaag

SEQ ID NO: 3637589 - RNA, 17 nt, Human
uaaagauauuguucaaa

SEQ ID NO: 3637590 - RNA, 18 nt, Human
uaaagauauuuuuaucuu

SEQ ID NO: 3637591 - RNA, 17 nt, Human
uaaagaugaacucugaa

SEQ ID NO: 3637592 - RNA, 11 nt, Human
uaaagaugauc

SEQ ID NO: 3637593 - RNA, 21 nt, Human
uaaagaugaucuacucagaaa

SEQ ID NO: 3637594 - RNA, 16 nt, Human
uaaagauguagcaaac

SEQ ID NO: 3637595 - RNA, 21 nt, Human
uaaagauucuauaguucuaga

SEQ ID NO: 3637596 - RNA, 13 nt, Human
uaaagauuugggu

SEQ ID NO: 3637597 - RNA, 14 nt, Human
uaaagauuuugauc

SEQ ID NO: 3637598 - RNA, 16 nt, Human
uaaagcaaaaaaugaa

SEQ ID NO: 3637599 - RNA, 19 nt, Human
uaaagcaaaaaaugaaugu

SEQ ID NO: 3637600 - RNA, 22 nt, Human
uaaagcaacuguuaugaaauaa

SEQ ID NO: 3637601 - RNA, 21 nt, Human
uaaagcaagcucacuugcuuu

SEQ ID NO: 3637602 - RNA, 13 nt, Human
uaaagcaauagaa

SEQ ID NO: 3637603 - RNA, 15 nt, Human
uaaagcaauaugcau

SEQ ID NO: 3637604 - RNA, 12 nt, Human
uaaagcaauuuu

SEQ ID NO: 3637605 - RNA, 14 nt, Human
uaaagcaauuuucc

SEQ ID NO: 3637606 - RNA, 20 nt, Human
uaaagcaauuuuccuugaag

SEQ ID NO: 3637607 - RNA, 18 nt, Human
uaaagcaggcagaacuca

SEQ ID NO: 3637608 - RNA, 18 nt, Human
uaaagcaggccuuuugau

SEQ ID NO: 3637609 - RNA, 16 nt, Human
uaaagcagguucuugu

SEQ ID NO: 3637610 - RNA, 17 nt, Human
uaaagcaguauuuuucu

SEQ ID NO: 3637611 - RNA, 19 nt, Human
uaaagcagucacuuuuccu

SEQ ID NO: 3637612 - RNA, 18 nt, Human
uaaagcaucuaaacuuua

SEQ ID NO: 3637613 - RNA, 22 nt, Human
uaaagcaugaaugguauggaac

SEQ ID NO: 3637614 - RNA, 12 nt, Human
uaaagcauucca

SEQ ID NO: 3637615 - RNA, 12 nt, Human
uaaagcauugcu

SEQ ID NO: 3637616 - RNA, 20 nt, Human
uaaagcauuuaaccccccug

SEQ ID NO: 3637617 - RNA, 11 nt, Human
uaaagccaugu

SEQ ID NO: 3637618 - RNA, 15 nt, Human
uaaagccauguuuau

SEQ ID NO: 3637619 - RNA, 17 nt, Human
uaaagccauucugauua

SEQ ID NO: 3637620 - RNA, 11 nt, Human
uaaagccucaa

SEQ ID NO: 3637621 - RNA, 20 nt, Human
uaaagccuguauucucaaac

SEQ ID NO: 3637622 - RNA, 15 nt, Human
uaaagcguuugcaca

SEQ ID NO: 3637623 - RNA, 22 nt, Human
uaaagcuaaaauaaagaaauag

SEQ ID NO: 3637624 - RNA, 23 nt, Human
uaaagcuaaaauaaagaaauaga

SEQ ID NO: 3637625 - RNA, 14 nt, Human
uaaagcuagaaaug

SEQ ID NO: 3637626 - RNA, 15 nt, Human
uaaagcuagaaauga

SEQ ID NO: 3637627 - RNA, 14 nt, Human
uaaagcucaaauga

SEQ ID NO: 3637628 - RNA, 18 nt, Human
uaaagcugccuguaguua

SEQ ID NO: 3637629 - RNA, 23 nt, Human
uaaagcugccuguaguuaggaaa

SEQ ID NO: 3637630 - RNA, 19 nt, Human
uaaagcugguuuaauguuu

SEQ ID NO: 3637631 - RNA, 11 nt, Human
uaaagcuuguc

SEQ ID NO: 3637632 - RNA, 19 nt, Human
uaaagcuuucagaauaugu

SEQ ID NO: 3637633 - RNA, 23 nt, Human
uaaagcuuucagaauaugucagu

SEQ ID NO: 3637634 - RNA, 16 nt, Human
uaaagcuuuugaugug

SEQ ID NO: 3637635 - RNA, 13 nt, Human
uaaaggaaaugau

SEQ ID NO: 3637636 - RNA, 23 nt, Human
uaaaggaaucuagccagugaaca

SEQ ID NO: 3637637 - RNA, 14 nt, Human
uaaaggacagugaa

SEQ ID NO: 3637638 - RNA, 12 nt, Human
uaaaggacugua

SEQ ID NO: 3637639 - RNA, 16 nt, Human
uaaaggaguuuauguu

SEQ ID NO: 3637640 - RNA, 19 nt, Human
uaaaggaguuuauguucca

SEQ ID NO: 3637641 - RNA, 19 nt, Human
uaaaggcaccaucuaauag

SEQ ID NO: 3637642 - RNA, 21 nt, Human
uaaaggcagcuguugucucuu

SEQ ID NO: 3637643 - RNA, 15 nt, Human
uaaaggcccagcccc

SEQ ID NO: 3637644 - RNA, 17 nt, Human
uaaaggcccagccccua

SEQ ID NO: 3637645 - RNA, 23 nt, Human
uaaaggccucugccucacaacau

SEQ ID NO: 3637646 - RNA, 15 nt, Human
uaaaggcuaccuuau

SEQ ID NO: 3637647 - RNA, 19 nt, Human
uaaaggcucgauuuuguau

SEQ ID NO: 3637648 - RNA, 22 nt, Human
uaaaggcucgauuuuguaucug

SEQ ID NO: 3637649 - RNA, 22 nt, Human
uaaagggaagaaaacacuguua

SEQ ID NO: 3637650 - RNA, 22 nt, Human
uaaagggauauuuuuuucuauu

SEQ ID NO: 3637651 - RNA, 18 nt, Human
uaaaggguguacuuauau

SEQ ID NO: 3637652 - RNA, 23 nt, Human
uaaaggucacuuuucacauccuu

SEQ ID NO: 3637653 - RNA, 20 nt, Human
uaaagguccacaggucuaga

SEQ ID NO: 3637654 - RNA, 22 nt, Human
uaaagguccacaggucuagacu

SEQ ID NO: 3637655 - RNA, 19 nt, Human
uaaagguggccacaaauuc

SEQ ID NO: 3637656 - RNA, 17 nt, Human
uaaaggugguaugugug

SEQ ID NO: 3637657 - RNA, 21 nt, Human
uaaaggugguaugugugugua

SEQ ID NO: 3637658 - RNA, 17 nt, Human
uaaaggugucuuccucc

SEQ ID NO: 3637659 - RNA, 20 nt, Human
uaaaggugucuuccucccaa

SEQ ID NO: 3637660 - RNA, 13 nt, Human
uaaagguuaaaaa

SEQ ID NO: 3637661 - RNA, 21 nt, Human
uaaagguuucuauuuucucug

SEQ ID NO: 3637662 - RNA, 22 nt, Human
uaaaguaaaaacaaagaaauua

SEQ ID NO: 3637663 - RNA, 17 nt, Human
uaaaguaaagcuaaaau

SEQ ID NO: 3637664 - RNA, 13 nt, Human
uaaaguaaauaca

SEQ ID NO: 3637665 - RNA, 15 nt, Human
uaaaguacuuguagu

SEQ ID NO: 3637666 - RNA, 18 nt, Human
uaaaguagaagaggguuu

SEQ ID NO: 3637667 - RNA, 17 nt, Human
uaaaguauacucuuagg

SEQ ID NO: 3637668 - RNA, 14 nt, Human
uaaaguaucaugca

SEQ ID NO: 3637669 - RNA, 15 nt, Human
uaaaguaucaugcau

SEQ ID NO: 3637670 - RNA, 14 nt, Human
uaaaguaugaaucu

SEQ ID NO: 3637671 - RNA, 16 nt, Human
uaaaguaugaaucuau

SEQ ID NO: 3637672 - RNA, 22 nt, Human
uaaaguauguaaacaggagaca

SEQ ID NO: 3637673 - RNA, 17 nt, Human
uaacacaaguccuguga

SEQ ID NO: 3637674 - RNA, 15 nt, Human
uaacacacacagaaa

SEQ ID NO: 3637675 - RNA, 20 nt, Human
uaacacacacagaaaagcau

SEQ ID NO: 3637676 - RNA, 21 nt, Human
uaacacacacagaaaagcaua

SEQ ID NO: 3637677 - RNA, 17 nt, Human
uaacacacagcucccau

SEQ ID NO: 3637678 - RNA, 22 nt, Human
uaacacacuaccgaaugugucu

SEQ ID NO: 3637679 - RNA, 17 nt, Human
uaacacauuuuguauaa

SEQ ID NO: 3637680 - RNA, 19 nt, Human
uaacacauuuuguauaauu

SEQ ID NO: 3637681 - RNA, 23 nt, Human
uaacacauuuuguauaauuguau

SEQ ID NO: 3637682 - RNA, 19 nt, Human
uaacacauuuuuuugcaug

SEQ ID NO: 3637683 - RNA, 14 nt, Human
uaacaccagcauug

SEQ ID NO: 3637684 - RNA, 16 nt, Human
uaacaccugaugugua

SEQ ID NO: 3637685 - RNA, 13 nt, Human
uaacacuaauaua

SEQ ID NO: 3637686 - RNA, 22 nt, Human
uaacacuaauauauuuaaaaau

SEQ ID NO: 3637687 - RNA, 19 nt, Human
uaacacuacucaaagcaaa

SEQ ID NO: 3637688 - RNA, 19 nt, Human
uaacacuauguuuauuuac

SEQ ID NO: 3637689 - RNA, 19 nt, Human
uaacacucagaagccuggg

SEQ ID NO: 3637690 - RNA, 15 nt, Human
uaacacuguuaagag

SEQ ID NO: 3637691 - RNA, 22 nt, Human
uaacacuucuuacgcaaugcuu

SEQ ID NO: 3637692 - RNA, 15 nt, Human
uaacacuuuacaaug

SEQ ID NO: 3637693 - RNA, 13 nt, Human
uaacagaaaugua

SEQ ID NO: 3637694 - RNA, 13 nt, Human
uaacagaaauugu

SEQ ID NO: 3637695 - RNA, 19 nt, Human
uaacagaacagcuucaggu

SEQ ID NO: 3637696 - RNA, 20 nt, Human
uaacagaacagcuucagguu

SEQ ID NO: 3637697 - RNA, 11 nt, Human
uaacagacauu

SEQ ID NO: 3637698 - RNA, 15 nt, Human
uaacagaugcaaugu

SEQ ID NO: 3637699 - RNA, 21 nt, Human
uaacagaugcaaugugcuacu

SEQ ID NO: 3637700 - RNA, 15 nt, Human
uaacagcaguuucag

SEQ ID NO: 3637701 - RNA, 17 nt, Human
uaacagcaguuucaggu

SEQ ID NO: 3637702 - RNA, 19 nt, Human
uaacagccaggaguguuaa

SEQ ID NO: 3637703 - RNA, 11 nt, Human
uaacagcccuc

SEQ ID NO: 3637704 - RNA, 13 nt, Human
uaacagcucagga

SEQ ID NO: 3637705 - RNA, 16 nt, Human
uaacagcuccuuggga

SEQ ID NO: 3637706 - RNA, 12 nt, Human
uaacagcugaau

SEQ ID NO: 3637707 - RNA, 16 nt, Human
uaacaggacgagauga

SEQ ID NO: 3637708 - RNA, 20 nt, Human
uaacaggcaaacauuuucuc

SEQ ID NO: 3637709 - RNA, 19 nt, Human
uaacaggcagauacaggaa

SEQ ID NO: 3637710 - RNA, 15 nt, Human
uaacaggcauuuguu

SEQ ID NO: 3637711 - RNA, 20 nt, Human
uaacaggcauuuguucacug

SEQ ID NO: 3637712 - RNA, 22 nt, Human
uaacagggaacgugauuaguga

SEQ ID NO: 3637713 - RNA, 23 nt, Human
uaacagggaacgugauuagugaa

SEQ ID NO: 3637714 - RNA, 20 nt, Human
uaacagggaaggcaggcagg

SEQ ID NO: 3637715 - RNA, 23 nt, Human
uaacagggaaggcaggcagggcu

SEQ ID NO: 3637716 - RNA, 16 nt, Human
uaacagggccuugcua

SEQ ID NO: 3637717 - RNA, 18 nt, Human
uaacagggccuugcuaau

SEQ ID NO: 3637718 - RNA, 23 nt, Human
uaacagggucucuagugcuguga

SEQ ID NO: 3637719 - RNA, 23 nt, Human
uaacagguauuuuguuucuuuua

SEQ ID NO: 3637720 - RNA, 19 nt, Human
uaacaggucuccucuuaaa

SEQ ID NO: 3637721 - RNA, 16 nt, Human
uaacagguuauuuuag

SEQ ID NO: 3637722 - RNA, 23 nt, Human
uaacagguuauuuuaguuucugu

SEQ ID NO: 3637723 - RNA, 13 nt, Human
uaacagucauuua

SEQ ID NO: 3637724 - RNA, 15 nt, Human
uaacagucauuuaaa

SEQ ID NO: 3637725 - RNA, 23 nt, Human
uaacaguccccguggccaucccu

SEQ ID NO: 3637726 - RNA, 15 nt, Human
uaacagucuuacugc

SEQ ID NO: 3637727 - RNA, 21 nt, Human
uaacagugccauugucuuuau

SEQ ID NO: 3637728 - RNA, 16 nt, Human
uaacagugugguaguu

SEQ ID NO: 3637729 - RNA, 13 nt, Human
uaacaguuuucca

SEQ ID NO: 3637730 - RNA, 19 nt, Human
uaacaguuuuccaugaaaa

SEQ ID NO: 3637731 - RNA, 14 nt, Human
uaacauaaaucugu

SEQ ID NO: 3637732 - RNA, 15 nt, Human
uaacauaaaucugug

SEQ ID NO: 3637733 - RNA, 17 nt, Human
uaacauaaaucugugaa

SEQ ID NO: 3637734 - RNA, 23 nt, Human
uaacauacccgccuagcugcugu

SEQ ID NO: 3637735 - RNA, 22 nt, Human
uaacauaccuaagaaguacauu

SEQ ID NO: 3637736 - RNA, 19 nt, Human
uaacauagccaaaauguga

SEQ ID NO: 3637737 - RNA, 23 nt, Human
uaacauauaauguuguuauuuaa

SEQ ID NO: 3637738 - RNA, 19 nt, Human
uaacaucacuauccaugca

SEQ ID NO: 3637739 - RNA, 24 nt, Human
uaacauccaauaggaaugcuaaca

SEQ ID NO: 3637740 - RNA, 13 nt, Human
uaacaucugagaa

SEQ ID NO: 3637741 - RNA, 20 nt, Human
uaacaucuuuauugaaauuc

SEQ ID NO: 3637742 - RNA, 11 nt, Human
uaacaugaaau

SEQ ID NO: 3637743 - RNA, 14 nt, Human
uaacaugaauauuu

SEQ ID NO: 3637744 - RNA, 14 nt, Human
uaacaugcugugua

SEQ ID NO: 3637745 - RNA, 22 nt, Human
uaacaugcuguguaagcugugu

SEQ ID NO: 3637746 - RNA, 15 nt, Human
uaacauggaaguacu

SEQ ID NO: 3637747 - RNA, 18 nt, Human
uaacauggacaugaucuu

SEQ ID NO: 3637748 - RNA, 18 nt, Human
uaacauggugugcuucuu

SEQ ID NO: 3637749 - RNA, 12 nt, Human
uaacauguuaaa

SEQ ID NO: 3637750 - RNA, 19 nt, Human
uaacauuaccuuacugugg

SEQ ID NO: 3637751 - RNA, 17 nt, Human
uaacauuauauugcaau

SEQ ID NO: 3637752 - RNA, 16 nt, Human
uaacauuauuuauaug

SEQ ID NO: 3637753 - RNA, 21 nt, Human
uaacauucaggaauucuugga

SEQ ID NO: 3637754 - RNA, 18 nt, Human
uaacauuccaagacucua

SEQ ID NO: 3637755 - RNA, 22 nt, Human
uaacauuccaagacucuagagu

SEQ ID NO: 3637756 - RNA, 10 nt, Human
uaacauuccu

SEQ ID NO: 3637757 - RNA, 13 nt, Human
uaacauuccuaaa

SEQ ID NO: 3637758 - RNA, 22 nt, Human
uaacauuccucaugaauguaaa

SEQ ID NO: 3637759 - RNA, 23 nt, Human
uaacauucgaucucauucaguau

SEQ ID NO: 3637760 - RNA, 22 nt, Human
uaacauucuguaaaaugucugu

SEQ ID NO: 3637761 - RNA, 18 nt, Human
uaacauugaccaagaacu

SEQ ID NO: 3637762 - RNA, 21 nt, Human
uaacauugaccaagaacugca

SEQ ID NO: 3637763 - RNA, 22 nt, Human
uaacauugaccaagaacugcau

SEQ ID NO: 3637764 - RNA, 18 nt, Human
uaacauuucuaacucuga

SEQ ID NO: 3637765 - RNA, 22 nt, Human
uaacauuucuaacucugaugua

SEQ ID NO: 3637766 - RNA, 23 nt, Human
uaacauuucuaacucugauguaa

SEQ ID NO: 3637767 - RNA, 13 nt, Human
uaacauuugccuu

SEQ ID NO: 3637768 - RNA, 15 nt, Human
uaacauuugccuugc

SEQ ID NO: 3637769 - RNA, 21 nt, Human
uaacauuugccuugcagaacu

SEQ ID NO: 3637770 - RNA, 16 nt, Human
uaaccaaacaauuauu

SEQ ID NO: 3637771 - RNA, 20 nt, Human
uaaccaaggaaauauauuuu

SEQ ID NO: 3637772 - RNA, 21 nt, Human
uaaccaagguagaaugaccuu

SEQ ID NO: 3637773 - RNA, 12 nt, Human
uaaccaaguucc

SEQ ID NO: 3637774 - RNA, 17 nt, Human
uaaccaauguuuaaaaa

SEQ ID NO: 3637775 - RNA, 19 nt, Human
uaaccacagcuccuuuucc

SEQ ID NO: 3637776 - RNA, 22 nt, Human
uaaccacaucaauauugucauu

SEQ ID NO: 3637777 - RNA, 24 nt, Human
uaaccacaucaauauugucauucc

SEQ ID NO: 3637778 - RNA, 15 nt, Human
uaaccacugaaggga

SEQ ID NO: 3637779 - RNA, 20 nt, Human
uaaccacugcaaguccuuuu

SEQ ID NO: 3637780 - RNA, 19 nt, Human
uaaccacuuaaaaaauguc

SEQ ID NO: 3637781 - RNA, 16 nt, Human
uaaccacuucagcuga

SEQ ID NO: 3637782 - RNA, 22 nt, Human
uaaccagacacauacucauuuu

SEQ ID NO: 3637783 - RNA, 22 nt, Human
uaaccagaucuagucaaucaag

SEQ ID NO: 3637784 - RNA, 14 nt, Human
uaaccagcagaaau

SEQ ID NO: 3637785 - RNA, 19 nt, Human
uaaccaggccauuuuuggu

SEQ ID NO: 3637786 - RNA, 23 nt, Human
uaaccagucugaaguuucauuua

SEQ ID NO: 3637787 - RNA, 19 nt, Human
uaaccauugucuuguucug

SEQ ID NO: 3637788 - RNA, 14 nt, Human
uaaccauuugcacu

SEQ ID NO: 3637789 - RNA, 18 nt, Human
uaaccauuuuauaaagug

SEQ ID NO: 3637790 - RNA, 20 nt, Human
uaaccauuuuauaaagugcu

SEQ ID NO: 3637791 - RNA, 18 nt, Human
uaacccaaggagcacagg

SEQ ID NO: 3637792 - RNA, 17 nt, Human
uaacccacugagaggac

SEQ ID NO: 3637793 - RNA, 14 nt, Human
uaacccacuuguca

SEQ ID NO: 3637794 - RNA, 19 nt, Human
uaaccccagcucccuagga

SEQ ID NO: 3637795 - RNA, 12 nt, Human
uaaccccaggcc

SEQ ID NO: 3637796 - RNA, 14 nt, Human
uaaccccaggcccc

SEQ ID NO: 3637797 - RNA, 14 nt, Human
uaaccccauucuuu

SEQ ID NO: 3637798 - RNA, 16 nt, Human
uaaccccgucaacaaa

SEQ ID NO: 3637799 - RNA, 18 nt, Human
uaacccucccauggcacc

SEQ ID NO: 3637800 - RNA, 20 nt, Human
uaacccuggugguugcuguu

SEQ ID NO: 3637801 - RNA, 17 nt, Human
uaacccuuaucaccagc

SEQ ID NO: 3637802 - RNA, 19 nt, Human
uaacccuucaucuuccugu

SEQ ID NO: 3637803 - RNA, 21 nt, Human
uaacccuuugugugcucucca

SEQ ID NO: 3637804 - RNA, 22 nt, Human
uaaccuaaucaccauguaagca

SEQ ID NO: 3637805 - RNA, 19 nt, Human
uaaccuaguuaaagaaagg

SEQ ID NO: 3637806 - RNA, 22 nt, Human
uaaccuaguuaaagaaaggaaa

SEQ ID NO: 3637807 - RNA, 20 nt, Human
uaaccuauaugauuuauagu

SEQ ID NO: 3637808 - RNA, 20 nt, Human
uaaccuaugauauuuucugu

SEQ ID NO: 3637809 - RNA, 22 nt, Human
uaaccuauuuugaaaaauuccu

SEQ ID NO: 3637810 - RNA, 22 nt, Human
uaaccucaagugauccucccac

SEQ ID NO: 3637811 - RNA, 14 nt, Human
uaaccucagcucug

SEQ ID NO: 3637812 - RNA, 20 nt, Human
uaaccucagugucauuuaug

SEQ ID NO: 3637813 - RNA, 15 nt, Human
uaaccucgcccucuc

SEQ ID NO: 3637814 - RNA, 17 nt, Human
uaaccucgcccucuccu

SEQ ID NO: 3637815 - RNA, 15 nt, Human
uaaccucugcuuuua

SEQ ID NO: 3637816 - RNA, 19 nt, Human
uacacgaauagacaucaaa

SEQ ID NO: 3637817 - RNA, 13 nt, Human
uacacggaaaacg

SEQ ID NO: 3637818 - RNA, 22 nt, Human
uacacgguucaaaccugugaag

SEQ ID NO: 3637819 - RNA, 19 nt, Human
uacacguuagauuugccgu

SEQ ID NO: 3637820 - RNA, 18 nt, Human
uacacuaagagagaauga

SEQ ID NO: 3637821 - RNA, 19 nt, Human
uacacuaagagagaaugag

SEQ ID NO: 3637822 - RNA, 16 nt, Human
uacacucaggcuuuca

SEQ ID NO: 3637823 - RNA, 15 nt, Human
uacacuccagccuga

SEQ ID NO: 3637824 - RNA, 16 nt, Human
uacacuccagccugag

SEQ ID NO: 3637825 - RNA, 13 nt, Human
uacacucugcugu

SEQ ID NO: 3637826 - RNA, 14 nt, Human
uacacucugcuguu

SEQ ID NO: 3637827 - RNA, 16 nt, Human
uacacucuuuguaaga

SEQ ID NO: 3637828 - RNA, 16 nt, Human
uacacugaggagagau

SEQ ID NO: 3637829 - RNA, 19 nt, Human
uacacugcaaucauaugug

SEQ ID NO: 3637830 - RNA, 16 nt, Human
uacacugccuguauac

SEQ ID NO: 3637831 - RNA, 21 nt, Human
uacacuggaggagagaagaau

SEQ ID NO: 3637832 - RNA, 22 nt, Human
uacacuggaggagagaagaaug

SEQ ID NO: 3637833 - RNA, 20 nt, Human
uacacuggcaaugguaguuu

SEQ ID NO: 3637834 - RNA, 23 nt, Human
uacacuggcaaugguaguuucug

SEQ ID NO: 3637835 - RNA, 16 nt, Human
uacacugugcugaguc

SEQ ID NO: 3637836 - RNA, 21 nt, Human
uacacugugcugagucugaag

SEQ ID NO: 3637837 - RNA, 22 nt, Human
uacacugugcugagucugaagg

SEQ ID NO: 3637838 - RNA, 23 nt, Human
uacacugugcugagucugaaggc

SEQ ID NO: 3637839 - RNA, 17 nt, Human
uacacuguuagaacacu

SEQ ID NO: 3637840 - RNA, 19 nt, Human
uacacuuacuguuguccua

SEQ ID NO: 3637841 - RNA, 21 nt, Human
uacacuuacuguuguccuaug

SEQ ID NO: 3637842 - RNA, 16 nt, Human
uacacuucaguuaucu

SEQ ID NO: 3637843 - RNA, 18 nt, Human
uacacuugagaugauuuc

SEQ ID NO: 3637844 - RNA, 21 nt, Human
uacacuuggggagauuugcca

SEQ ID NO: 3637845 - RNA, 20 nt, Human
uacacuuguauaaauguaua

SEQ ID NO: 3637846 - RNA, 21 nt, Human
uacacuuuaugccggaugugc

SEQ ID NO: 3637847 - RNA, 22 nt, Human
uacacuuuaugccggaugugcu

SEQ ID NO: 3637848 - RNA, 14 nt, Human
uacacuuuguugca

SEQ ID NO: 3637849 - RNA, 15 nt, Human
uacacuuuguugcaa

SEQ ID NO: 3637850 - RNA, 15 nt, Human
uacacuuuuaugagc

SEQ ID NO: 3637851 - RNA, 18 nt, Human
uacacuuuuaugagcuuc

SEQ ID NO: 3637852 - RNA, 19 nt, Human
uacagaaaaacaaugguaa

SEQ ID NO: 3637853 - RNA, 20 nt, Human
uacagaaaguggugcucagu

SEQ ID NO: 3637854 - RNA, 14 nt, Human
uacagaaauacuau

SEQ ID NO: 3637855 - RNA, 19 nt, Human
uacagaacacgcuuucaca

SEQ ID NO: 3637856 - RNA, 15 nt, Human
uacagaacuucagaa

SEQ ID NO: 3637857 - RNA, 18 nt, Human
uacagaacuucagaaaga

SEQ ID NO: 3637858 - RNA, 14 nt, Human
uacagaagaaacug

SEQ ID NO: 3637859 - RNA, 13 nt, Human
uacagaauacuag

SEQ ID NO: 3637860 - RNA, 13 nt, Human
uacagaauauuuc

SEQ ID NO: 3637861 - RNA, 16 nt, Human
uacagaaucauugcuu

SEQ ID NO: 3637862 - RNA, 15 nt, Human
uacagaauuacugua

SEQ ID NO: 3637863 - RNA, 23 nt, Human
uacagaauuacuguaacugauua

SEQ ID NO: 3637864 - RNA, 20 nt, Human
uacagaauugugucugcagg

SEQ ID NO: 3637865 - RNA, 17 nt, Human
uacagaauuugaauuau

SEQ ID NO: 3637866 - RNA, 14 nt, Human
uacagacaaagcgu

SEQ ID NO: 3637867 - RNA, 11 nt, Human
uacagacacua

SEQ ID NO: 3637868 - RNA, 22 nt, Human
uacagacagagaauaugucugc

SEQ ID NO: 3637869 - RNA, 13 nt, Human
uacagacauauuu

SEQ ID NO: 3637870 - RNA, 14 nt, Human
uacagacauauuua

SEQ ID NO: 3637871 - RNA, 20 nt, Human
uacagaccgaacuguuguau

SEQ ID NO: 3637872 - RNA, 23 nt, Human
uacagaccgaacuguuguauaaa

SEQ ID NO: 3637873 - RNA, 14 nt, Human
uacagaccugcuuu

SEQ ID NO: 3637874 - RNA, 22 nt, Human
uacagaccugcuuuuugaaaug

SEQ ID NO: 3637875 - RNA, 13 nt, Human
uacagacguaugc

SEQ ID NO: 3637876 - RNA, 21 nt, Human
uacagagaagccagcuuguuu

SEQ ID NO: 3637877 - RNA, 14 nt, Human
uacagagaagccau

SEQ ID NO: 3637878 - RNA, 15 nt, Human
uacagagaagccauc

SEQ ID NO: 3637879 - RNA, 16 nt, Human
uacagagaagccauca

SEQ ID NO: 3637880 - RNA, 22 nt, Human
uacagagaagccaucaccucag

SEQ ID NO: 3637881 - RNA, 18 nt, Human
uacagagaagccuucaag

SEQ ID NO: 3637882 - RNA, 19 nt, Human
uacagagaagccuucaagc

SEQ ID NO: 3637883 - RNA, 17 nt, Human
uacagagaggagaaaca

SEQ ID NO: 3637884 - RNA, 22 nt, Human
uacagagaggucaagcccagga

SEQ ID NO: 3637885 - RNA, 15 nt, Human
uacagagaugucucu

SEQ ID NO: 3637886 - RNA, 23 nt, Human
uacagagcagacaguuaagagaa

SEQ ID NO: 3637887 - RNA, 20 nt, Human
uacagagccguaaaaacuga

SEQ ID NO: 3637888 - RNA, 17 nt, Human
uacagaggaaaucugua

SEQ ID NO: 3637889 - RNA, 18 nt, Human
uacagaggaaaucuguaa

SEQ ID NO: 3637890 - RNA, 16 nt, Human
uacagauaaaugauuc

SEQ ID NO: 3637891 - RNA, 13 nt, Human
uacagauaacauu

SEQ ID NO: 3637892 - RNA, 13 nt, Human
uacagauaggccu

SEQ ID NO: 3637893 - RNA, 17 nt, Human
uacagauaggccuucuu

SEQ ID NO: 3637894 - RNA, 13 nt, Human
uacagauauauuu

SEQ ID NO: 3637895 - RNA, 20 nt, Human
uacagauccccaagccuggc

SEQ ID NO: 3637896 - RNA, 13 nt, Human
uacagaugaaaau

SEQ ID NO: 3637897 - RNA, 14 nt, Human
uacagaugccuuuu

SEQ ID NO: 3637898 - RNA, 20 nt, Human
uacagauuuauuccuuuguu

SEQ ID NO: 3637899 - RNA, 16 nt, Human
uacagauuuugauagc

SEQ ID NO: 3637900 - RNA, 17 nt, Human
uacagauuuugauagca

SEQ ID NO: 3637901 - RNA, 18 nt, Human
uacagauuuugauagcaa

SEQ ID NO: 3637902 - RNA, 14 nt, Human
uacagcaaauccuu

SEQ ID NO: 3637903 - RNA, 20 nt, Human
uacagcaaauccuuugugaa

SEQ ID NO: 3637904 - RNA, 16 nt, Human
uacagcaaauuuauaa

SEQ ID NO: 3637905 - RNA, 19 nt, Human
uacagcaacaauuuaugaa

SEQ ID NO: 3637906 - RNA, 14 nt, Human
uacagcacuacucu

SEQ ID NO: 3637907 - RNA, 17 nt, Human
uacagcacuacucugug

SEQ ID NO: 3637908 - RNA, 17 nt, Human
uacagcacuacugggug

SEQ ID NO: 3637909 - RNA, 15 nt, Human
uacagcagcaagaaa

SEQ ID NO: 3637910 - RNA, 23 nt, Human
uacagcagcaagaaaaaaaaaug

SEQ ID NO: 3637911 - RNA, 16 nt, Human
uacagcaguagacauu

SEQ ID NO: 3637912 - RNA, 17 nt, Human
uacagcaguagacauuu

SEQ ID NO: 3637913 - RNA, 19 nt, Human
uacagcaguagacauuuua

SEQ ID NO: 3637914 - RNA, 22 nt, Human
uacagccaaagauaaucucuca

SEQ ID NO: 3637915 - RNA, 21 nt, Human
uacagccaagugccaaaugcu

SEQ ID NO: 3637916 - RNA, 19 nt, Human
uacagccagaccagauuaa

SEQ ID NO: 3637917 - RNA, 17 nt, Human
uacagcccaccuggcuu

SEQ ID NO: 3637918 - RNA, 18 nt, Human
uacagcuaaucagcauuc

SEQ ID NO: 3637919 - RNA, 16 nt, Human
uacagcucauuaaacu

SEQ ID NO: 3637920 - RNA, 18 nt, Human
uacagcucauuaaacuuu

SEQ ID NO: 3637921 - RNA, 15 nt, Human
uacagcuccccaagu

SEQ ID NO: 3637922 - RNA, 18 nt, Human
uacagcucccccagcucc

SEQ ID NO: 3637923 - RNA, 20 nt, Human
uacagcucccccagcucccc

SEQ ID NO: 3637924 - RNA, 20 nt, Human
uacagcuccuuugaaaacuc

SEQ ID NO: 3637925 - RNA, 13 nt, Human
uacagcucugacu

SEQ ID NO: 3637926 - RNA, 19 nt, Human
uacagcugagcacauucug

SEQ ID NO: 3637927 - RNA, 15 nt, Human
uacagcuggggugca

SEQ ID NO: 3637928 - RNA, 20 nt, Human
uacagcuggguggcacugcc

SEQ ID NO: 3637929 - RNA, 24 nt, Human
uacagcuggguggcacugccaugc

SEQ ID NO: 3637930 - RNA, 17 nt, Human
uacagcuguguuauucu

SEQ ID NO: 3637931 - RNA, 22 nt, Human
uacagcuugaccgugaggccag

SEQ ID NO: 3637932 - RNA, 18 nt, Human
uacagcuuucaugauuag

SEQ ID NO: 3637933 - RNA, 21 nt, Human
uacagcuuucugaccuucagc

SEQ ID NO: 3637934 - RNA, 20 nt, Human
uacagcuuugugacuguaua

SEQ ID NO: 3637935 - RNA, 22 nt, Human
uacagcuuugugacuguauaua

SEQ ID NO: 3637936 - RNA, 19 nt, Human
uacaggaaaagcugcugac

SEQ ID NO: 3637937 - RNA, 21 nt, Human
uacaggaaacaguugcaugua

SEQ ID NO: 3637938 - RNA, 18 nt, Human
uacaggaagguagaaaua

SEQ ID NO: 3637939 - RNA, 20 nt, Human
uacaggaugaugacuaugga

SEQ ID NO: 3637940 - RNA, 14 nt, Human
uacaggcacaaaau

SEQ ID NO: 3637941 - RNA, 19 nt, Human
uacaggcaccgagaauguu

SEQ ID NO: 3637942 - RNA, 15 nt, Human
uacaggcccugcucc

SEQ ID NO: 3637943 - RNA, 15 nt, Human
uacaggccucacaca

SEQ ID NO: 3637944 - RNA, 17 nt, Human
uacaggcuccugccacc

SEQ ID NO: 3637945 - RNA, 23 nt, Human
uacaggcuccugccaccacgccc

SEQ ID NO: 3637946 - RNA, 12 nt, Human
uacaggcuggcg

SEQ ID NO: 3637947 - RNA, 20 nt, Human
uacagggcacaggccaugga

SEQ ID NO: 3637948 - RNA, 21 nt, Human
uacagggcaugcauuuugcag

SEQ ID NO: 3637949 - RNA, 14 nt, Human
uacaggggaauauu

SEQ ID NO: 3637950 - RNA, 16 nt, Human
uacaggggaauauuuu

SEQ ID NO: 3637951 - RNA, 19 nt, Human
uacaggggaauauuuuauu

SEQ ID NO: 3637952 - RNA, 22 nt, Human
uacaggggaauauuuuauucaa

SEQ ID NO: 3637953 - RNA, 16 nt, Human
uacagggggucuggcu

SEQ ID NO: 3637954 - RNA, 21 nt, Human
uacagggggucuggcuggugu

SEQ ID NO: 3637955 - RNA, 17 nt, Human
uacagggguucuggaaa

SEQ ID NO: 3637956 - RNA, 20 nt, Human
uacaggguaacugugcugaa

SEQ ID NO: 3637957 - RNA, 19 nt, Human
uacaggguagauaaccugu

SEQ ID NO: 3637958 - RNA, 13 nt, Human
uacaggguuuuua

SEQ ID NO: 3637959 - RNA, 14 nt, Human
uacagguacuuugu

SEQ ID NO: 3637960 - RNA, 23 nt, Human
uaccagugcaggcuggccagccg

SEQ ID NO: 3637961 - RNA, 18 nt, Human
uaccaguuaauuuuucca

SEQ ID NO: 3637962 - RNA, 13 nt, Human
uaccauacauuua

SEQ ID NO: 3637963 - RNA, 19 nt, Human
uaccauagcgcugcucuua

SEQ ID NO: 3637964 - RNA, 13 nt, Human
uaccaucucccuc

SEQ ID NO: 3637965 - RNA, 14 nt, Human
uaccaugaacagaa

SEQ ID NO: 3637966 - RNA, 14 nt, Human
uaccaugucacugu

SEQ ID NO: 3637967 - RNA, 15 nt, Human
uaccaugucacugug

SEQ ID NO: 3637968 - RNA, 19 nt, Human
uaccauuaaaacugcuuuu

SEQ ID NO: 3637969 - RNA, 14 nt, Human
uaccauuaaaauau

SEQ ID NO: 3637970 - RNA, 15 nt, Human
uaccauuaaaauaug

SEQ ID NO: 3637971 - RNA, 17 nt, Human
uaccauuaaaauaugca

SEQ ID NO: 3637972 - RNA, 15 nt, Human
uaccauuaaaccauc

SEQ ID NO: 3637973 - RNA, 22 nt, Human
uaccauuaaaccaucucccugg

SEQ ID NO: 3637974 - RNA, 21 nt, Human
uaccauucacaauaaaagcuu

SEQ ID NO: 3637975 - RNA, 18 nt, Human
uaccauuuaguaagaaua

SEQ ID NO: 3637976 - RNA, 17 nt, Human
uaccauuuauacaaauu

SEQ ID NO: 3637977 - RNA, 13 nt, Human
uaccauuuguaau

SEQ ID NO: 3637978 - RNA, 17 nt, Human
uacccaaaacaagccug

SEQ ID NO: 3637979 - RNA, 15 nt, Human
uacccaaacugcuuu

SEQ ID NO: 3637980 - RNA, 18 nt, Human
uacccaagggcagaaagu

SEQ ID NO: 3637981 - RNA, 17 nt, Human
uacccacaccucugcca

SEQ ID NO: 3637982 - RNA, 23 nt, Human
uacccacccccacccaagggccu

SEQ ID NO: 3637983 - RNA, 23 nt, Human
uacccaccugagcuuuggacgca

SEQ ID NO: 3637984 - RNA, 14 nt, Human
uacccacugcucug

SEQ ID NO: 3637985 - RNA, 14 nt, Human
uacccagaaaguua

SEQ ID NO: 3637986 - RNA, 18 nt, Human
uacccagccaucugccca

SEQ ID NO: 3637987 - RNA, 23 nt, Human
uacccagccaucugcccaggggu

SEQ ID NO: 3637988 - RNA, 16 nt, Human
uacccaggaccaagcc

SEQ ID NO: 3637989 - RNA, 20 nt, Human
uacccaggguggagugcagu

SEQ ID NO: 3637990 - RNA, 17 nt, Human
uacccauagacaugaaa

SEQ ID NO: 3637991 - RNA, 14 nt, Human
uacccauauuacag

SEQ ID NO: 3637992 - RNA, 17 nt, Human
uacccauccccgcagug

SEQ ID NO: 3637993 - RNA, 20 nt, Human
uacccaucuaguacuugaaa

SEQ ID NO: 3637994 - RNA, 19 nt, Human
uacccaucuuaaaaacaac

SEQ ID NO: 3637995 - RNA, 14 nt, Human
uacccauuuguuca

SEQ ID NO: 3637996 - RNA, 18 nt, Human
uaccccaauuucggauuu

SEQ ID NO: 3637997 - RNA, 13 nt, Human
uaccccacccuca

SEQ ID NO: 3637998 - RNA, 15 nt, Human
uaccccacccucagc

SEQ ID NO: 3637999 - RNA, 15 nt, Human
uaccccaucauucau

SEQ ID NO: 3638000 - RNA, 21 nt, Human
uacccccagguggaaggcaga

SEQ ID NO: 3638001 - RNA, 22 nt, Human
uacccccgcccaggcuggccag

SEQ ID NO: 3638002 - RNA, 18 nt, Human
uacccccuccuucagaca

SEQ ID NO: 3638003 - RNA, 17 nt, Human
uaccccgcagacaccuu

SEQ ID NO: 3638004 - RNA, 13 nt, Human
uaccccucccagc

SEQ ID NO: 3638005 - RNA, 14 nt, Human
uaccccucccagcu

SEQ ID NO: 3638006 - RNA, 16 nt, Human
uaccccucccagcuga

SEQ ID NO: 3638007 - RNA, 21 nt, Human
uaccccugccuuugggagcag

SEQ ID NO: 3638008 - RNA, 12 nt, Human
uaccccuggcug

SEQ ID NO: 3638009 - RNA, 18 nt, Human
uaccccuggcuguacugc

SEQ ID NO: 3638010 - RNA, 13 nt, Human
uacccgggaaggg

SEQ ID NO: 3638011 - RNA, 15 nt, Human
uacccgggcagggcu

SEQ ID NO: 3638012 - RNA, 13 nt, Human
uacccguuccaaa

SEQ ID NO: 3638013 - RNA, 14 nt, Human
uacccuaaccaagu

SEQ ID NO: 3638014 - RNA, 17 nt, Human
uacccuaaugucuucau

SEQ ID NO: 3638015 - RNA, 23 nt, Human
uacccuauaucuauaaacacugu

SEQ ID NO: 3638016 - RNA, 16 nt, Human
uacccucauguucuua

SEQ ID NO: 3638017 - RNA, 13 nt, Human
uacccucccaccc

SEQ ID NO: 3638018 - RNA, 11 nt, Human
uacccuccccc

SEQ ID NO: 3638019 - RNA, 11 nt, Human
uacccucccug

SEQ ID NO: 3638020 - RNA, 15 nt, Human
uacccucccugcugu

SEQ ID NO: 3638021 - RNA, 17 nt, Human
uacccucccugcugucc

SEQ ID NO: 3638022 - RNA, 12 nt, Human
uacccuccuggc

SEQ ID NO: 3638023 - RNA, 18 nt, Human
uacccuccuuuuuuuccc

SEQ ID NO: 3638024 - RNA, 15 nt, Human
uacccucgggcccac

SEQ ID NO: 3638025 - RNA, 17 nt, Human
uacccucgggcccaccu

SEQ ID NO: 3638026 - RNA, 18 nt, Human
uacccucgggcccaccug

SEQ ID NO: 3638027 - RNA, 22 nt, Human
uacccucgggcccaccuggcca

SEQ ID NO: 3638028 - RNA, 16 nt, Human
uacccucucagcucca

SEQ ID NO: 3638029 - RNA, 15 nt, Human
uacccucuuugcugc

SEQ ID NO: 3638030 - RNA, 16 nt, Human
uacccucuuugcugca

SEQ ID NO: 3638031 - RNA, 17 nt, Human
uacccugaguucaucca

SEQ ID NO: 3638032 - RNA, 23 nt, Human
uacccugcgcccaguccuuccac

SEQ ID NO: 3638033 - RNA, 20 nt, Human
uacccuggcacuauaaugua

SEQ ID NO: 3638034 - RNA, 22 nt, Human
uacccuggcacuauaauguaag

SEQ ID NO: 3638035 - RNA, 12 nt, Human
uacccuggcccc

SEQ ID NO: 3638036 - RNA, 16 nt, Human
uacccuggccccucuc

SEQ ID NO: 3638037 - RNA, 18 nt, Human
uacccugggaaggccucu

SEQ ID NO: 3638038 - RNA, 11 nt, Human
uacccugggug

SEQ ID NO: 3638039 - RNA, 17 nt, Human
uacccuguacauaugua

SEQ ID NO: 3638040 - RNA, 18 nt, Human
uacccuucugugcccagc

SEQ ID NO: 3638041 - RNA, 21 nt, Human
uacccuucuuuccauuucucu

SEQ ID NO: 3638042 - RNA, 14 nt, Human
uacccuucuuuuau

SEQ ID NO: 3638043 - RNA, 20 nt, Human
uacccuucuuuuaugagcag

SEQ ID NO: 3638044 - RNA, 13 nt, Human
uacccuuggaaau

SEQ ID NO: 3638045 - RNA, 20 nt, Human
uacccuuuagacuguagccu

SEQ ID NO: 3638046 - RNA, 16 nt, Human
uacccuuuuccuuugu

SEQ ID NO: 3638047 - RNA, 21 nt, Human
uacccuuuuccuuugugguuu

SEQ ID NO: 3638048 - RNA, 22 nt, Human
uacccuuuucugaccaaagaga

SEQ ID NO: 3638049 - RNA, 16 nt, Human
uacccuuuuucuugaa

SEQ ID NO: 3638050 - RNA, 15 nt, Human
uaccgacaagcacag

SEQ ID NO: 3638051 - RNA, 18 nt, Human
uaccgagucucuucucca

SEQ ID NO: 3638052 - RNA, 20 nt, Human
uaccgaguucaagugauuuu

SEQ ID NO: 3638053 - RNA, 16 nt, Human
uaccgcguuguaaaau

SEQ ID NO: 3638054 - RNA, 21 nt, Human
uaccuaaaagagauuucaaga

SEQ ID NO: 3638055 - RNA, 19 nt, Human
uaccuaaacagauauaaau

SEQ ID NO: 3638056 - RNA, 22 nt, Human
uaccuaacgaaguauccuucag

SEQ ID NO: 3638057 - RNA, 15 nt, Human
uaccuaauuagagca

SEQ ID NO: 3638058 - RNA, 14 nt, Human
uaccuaccugugug

SEQ ID NO: 3638059 - RNA, 17 nt, Human
uaccuagcuaauuauuu

SEQ ID NO: 3638060 - RNA, 16 nt, Human
uaccuauaaugugugu

SEQ ID NO: 3638061 - RNA, 19 nt, Human
uaccuauaauguguguaug

SEQ ID NO: 3638062 - RNA, 23 nt, Human
uaccuauaauguguguaugugua

SEQ ID NO: 3638063 - RNA, 16 nt, Human
uaccuaucaucuuaag

SEQ ID NO: 3638064 - RNA, 20 nt, Human
uaccuauuuucauuguaaaa

SEQ ID NO: 3638065 - RNA, 15 nt, Human
uaccucaaacuaucu

SEQ ID NO: 3638066 - RNA, 19 nt, Human
uaccucaacaagaagaauu

SEQ ID NO: 3638067 - RNA, 13 nt, Human
uaccucaauguuu

SEQ ID NO: 3638068 - RNA, 15 nt, Human
uaccucaauguuuga

SEQ ID NO: 3638069 - RNA, 16 nt, Human
uaccucaauguuugag

SEQ ID NO: 3638070 - RNA, 15 nt, Human
uaccucacugggguc

SEQ ID NO: 3638071 - RNA, 11 nt, Human
uaccucagccu

SEQ ID NO: 3638072 - RNA, 12 nt, Human
uaccucagccua

SEQ ID NO: 3638073 - RNA, 14 nt, Human
uaccucagccuaga

SEQ ID NO: 3638074 - RNA, 16 nt, Human
uaccucagccuagacc

SEQ ID NO: 3638075 - RNA, 13 nt, Human
uaccucagccugg

SEQ ID NO: 3638076 - RNA, 17 nt, Human
uaccucaggcagcucaa

SEQ ID NO: 3638077 - RNA, 18 nt, Human
uaccucaggcagcucaag

SEQ ID NO: 3638078 - RNA, 14 nt, Human
uaccucaggcagga

SEQ ID NO: 3638079 - RNA, 15 nt, Human
uaccucaggcaggaa

SEQ ID NO: 3638080 - RNA, 14 nt, Human
uaccucauguuuau

SEQ ID NO: 3638081 - RNA, 19 nt, Human
uaccucauguuuaugaaaa

SEQ ID NO: 3638082 - RNA, 20 nt, Human
uaccuccaacagaacuaaau

SEQ ID NO: 3638083 - RNA, 15 nt, Human
uaccuccaacccugc

SEQ ID NO: 3638084 - RNA, 14 nt, Human
uaccucccacacuc

SEQ ID NO: 3638085 - RNA, 13 nt, Human
uaccuccccugcc

SEQ ID NO: 3638086 - RNA, 14 nt, Human
uaccuccccugccu

SEQ ID NO: 3638087 - RNA, 15 nt, Human
uaccuccccugccuu

SEQ ID NO: 3638088 - RNA, 13 nt, Human
uaccuccugagaa

SEQ ID NO: 3638089 - RNA, 11 nt, Human
uaccuccugcc

SEQ ID NO: 3638090 - RNA, 14 nt, Human
uaccuccugucucu

SEQ ID NO: 3638091 - RNA, 17 nt, Human
uaccucuaauaguauaa

SEQ ID NO: 3638092 - RNA, 16 nt, Human
uaccucuauauaccaa

SEQ ID NO: 3638093 - RNA, 14 nt, Human
uaccucugauaccu

SEQ ID NO: 3638094 - RNA, 18 nt, Human
uaccucugcauaaauauu

SEQ ID NO: 3638095 - RNA, 21 nt, Human
uaccucuggcugacuaaauuu

SEQ ID NO: 3638096 - RNA, 12 nt, Human
uaccucugugug

SEQ ID NO: 3638097 - RNA, 14 nt, Human
uaccucuuagcuga

SEQ ID NO: 3638098 - RNA, 16 nt, Human
uaccucuuagcugagu

SEQ ID NO: 3638099 - RNA, 19 nt, Human
uaccucuuuauuuuuugau

SEQ ID NO: 3638100 - RNA, 16 nt, Human
uaccucuuugaaagaa

SEQ ID NO: 3638101 - RNA, 21 nt, Human
uaccugaagggguuuucuuga

SEQ ID NO: 3638102 - RNA, 13 nt, Human
uaccugaagucuu

SEQ ID NO: 3638103 - RNA, 14 nt, Human
uaccugaagucuuu

SEQ ID NO: 3638104 - RNA, 16 nt, Human
uaccugaaugcucugu

SEQ ID NO: 3638105 - RNA, 13 nt, Human
uaccugacacaag

SEQ ID NO: 3638106 - RNA, 20 nt, Human
uaccugacacucccuugggc

SEQ ID NO: 3638107 - RNA, 19 nt, Human
uacugcacuccagccuggg

SEQ ID NO: 3638108 - RNA, 21 nt, Human
uacugcagcaccuccaggccu

SEQ ID NO: 3638109 - RNA, 22 nt, Human
uacugcagcuuuacaugcaauu

SEQ ID NO: 3638110 - RNA, 10 nt, Human
uacugcaggg

SEQ ID NO: 3638111 - RNA, 19 nt, Human
uacugcagggccaggacug

SEQ ID NO: 3638112 - RNA, 13 nt, Human
uacugcauacuuu

SEQ ID NO: 3638113 - RNA, 21 nt, Human
uacugcauacuuuuuaaaugu

SEQ ID NO: 3638114 - RNA, 19 nt, Human
uacugccaaccucgcucca

SEQ ID NO: 3638115 - RNA, 14 nt, Human
uacugccacucuuu

SEQ ID NO: 3638116 - RNA, 16 nt, Human
uacugccagaugcuga

SEQ ID NO: 3638117 - RNA, 18 nt, Human
uacugccagaugcugaug

SEQ ID NO: 3638118 - RNA, 18 nt, Human
uacugccauccuggccca

SEQ ID NO: 3638119 - RNA, 19 nt, Human
uacugccauccuggcccag

SEQ ID NO: 3638120 - RNA, 19 nt, Human
uacugccauguacuaguuu

SEQ ID NO: 3638121 - RNA, 21 nt, Human
uacugccauguacuaguuuua

SEQ ID NO: 3638122 - RNA, 21 nt, Human
uacugcccaggccugccuguu

SEQ ID NO: 3638123 - RNA, 21 nt, Human
uacugccuauuuuaauaaaca

SEQ ID NO: 3638124 - RNA, 14 nt, Human
uacugccuccccca

SEQ ID NO: 3638125 - RNA, 12 nt, Human
uacugccuuaau

SEQ ID NO: 3638126 - RNA, 22 nt, Human
uacugccuuaauaaaaaaugaa

SEQ ID NO: 3638127 - RNA, 12 nt, Human
uacugcgacuuu

SEQ ID NO: 3638128 - RNA, 18 nt, Human
uacugcgacuuucugccu

SEQ ID NO: 3638129 - RNA, 21 nt, Human
uacugcgacuuucugccugga

SEQ ID NO: 3638130 - RNA, 20 nt, Human
uacugcuaaguauuucccag

SEQ ID NO: 3638131 - RNA, 21 nt, Human
uacugcuaaguauuucccagc

SEQ ID NO: 3638132 - RNA, 14 nt, Human
uacugcucaggcug

SEQ ID NO: 3638133 - RNA, 22 nt, Human
uacugcucaggcugcagcugga

SEQ ID NO: 3638134 - RNA, 21 nt, Human
uacugcugagauacauacaga

SEQ ID NO: 3638135 - RNA, 17 nt, Human
uacuggaaguuuugcau

SEQ ID NO: 3638136 - RNA, 18 nt, Human
uacuggaaguuuugcauu

SEQ ID NO: 3638137 - RNA, 14 nt, Human
uacuggauaaauug

SEQ ID NO: 3638138 - RNA, 15 nt, Human
uacuggaucucuuaa

SEQ ID NO: 3638139 - RNA, 18 nt, Human
uacuggcaaaaggaucuu

SEQ ID NO: 3638140 - RNA, 14 nt, Human
uacuggccucgccu

SEQ ID NO: 3638141 - RNA, 19 nt, Human
uacuggccucgccuggccu

SEQ ID NO: 3638142 - RNA, 21 nt, Human
uacuggccucgccuggccuga

SEQ ID NO: 3638143 - RNA, 14 nt, Human
uacuggcuggugau

SEQ ID NO: 3638144 - RNA, 18 nt, Human
uacuggcuuaccuccuca

SEQ ID NO: 3638145 - RNA, 23 nt, Human
uacugggaaagggauuuucagcc

SEQ ID NO: 3638146 - RNA, 23 nt, Human
uacugggcccugagucugggcag

SEQ ID NO: 3638147 - RNA, 12 nt, Human
uacugggccuua

SEQ ID NO: 3638148 - RNA, 16 nt, Human
uacuggggaaacuggc

SEQ ID NO: 3638149 - RNA, 21 nt, Human
uacuggggaaacuggccaugg

SEQ ID NO: 3638150 - RNA, 21 nt, Human
uacuggggcuggggaaggaag

SEQ ID NO: 3638151 - RNA, 15 nt, Human
uacugggugucauuu

SEQ ID NO: 3638152 - RNA, 17 nt, Human
uacugggugucauuuca

SEQ ID NO: 3638153 - RNA, 20 nt, Human
uacugggugucauuucauuc

SEQ ID NO: 3638154 - RNA, 13 nt, Human
uacugguaagauu

SEQ ID NO: 3638155 - RNA, 21 nt, Human
uacugguaagauuguuauuaa

SEQ ID NO: 3638156 - RNA, 23 nt, Human
uacugguccaaaagauugcugaa

SEQ ID NO: 3638157 - RNA, 12 nt, Human
uacuggucucuc

SEQ ID NO: 3638158 - RNA, 19 nt, Human
uacuggugcagucauuaug

SEQ ID NO: 3638159 - RNA, 14 nt, Human
uacugguugcaugg

SEQ ID NO: 3638160 - RNA, 20 nt, Human
uacugguugcauggaaauca

SEQ ID NO: 3638161 - RNA, 17 nt, Human
uacuguaaagaaagaga

SEQ ID NO: 3638162 - RNA, 18 nt, Human
uacuguaaagaaagagag

SEQ ID NO: 3638163 - RNA, 21 nt, Human
uacuguaaagaaagagagaaa

SEQ ID NO: 3638164 - RNA, 14 nt, Human
uacuguaaagaauu

SEQ ID NO: 3638165 - RNA, 20 nt, Human
uacuguaaagagaccuaccu

SEQ ID NO: 3638166 - RNA, 12 nt, Human
uacuguaagaau

SEQ ID NO: 3638167 - RNA, 19 nt, Human
uacuguaaggcaaucaugg

SEQ ID NO: 3638168 - RNA, 18 nt, Human
uacuguaauaauaccuca

SEQ ID NO: 3638169 - RNA, 23 nt, Human
uacuguaauaauaccucaauguu

SEQ ID NO: 3638170 - RNA, 13 nt, Human
uacuguaauuccu

SEQ ID NO: 3638171 - RNA, 15 nt, Human
uacuguaauuccuca

SEQ ID NO: 3638172 - RNA, 16 nt, Human
uacuguaauuugugau

SEQ ID NO: 3638173 - RNA, 18 nt, Human
uacuguaauuugugauac

SEQ ID NO: 3638174 - RNA, 20 nt, Human
uacuguaauuugugauacaa

SEQ ID NO: 3638175 - RNA, 14 nt, Human
uacuguaauuuuau

SEQ ID NO: 3638176 - RNA, 12 nt, Human
uacuguacaaua

SEQ ID NO: 3638177 - RNA, 15 nt, Human
uacuguacaauaaaa

SEQ ID NO: 3638178 - RNA, 19 nt, Human
uacuguacauaaacaauga

SEQ ID NO: 3638179 - RNA, 15 nt, Human
uacuguacuaauucu

SEQ ID NO: 3638180 - RNA, 14 nt, Human
uacuguaguauucu

SEQ ID NO: 3638181 - RNA, 22 nt, Human
uacuguauagacaguuuguaaa

SEQ ID NO: 3638182 - RNA, 21 nt, Human
uacuguaucaugacaaagacu

SEQ ID NO: 3638183 - RNA, 11 nt, Human
uacuguaugau

SEQ ID NO: 3638184 - RNA, 14 nt, Human
uacuguaugaucaa

SEQ ID NO: 3638185 - RNA, 18 nt, Human
uacuguaugguuuuguuu

SEQ ID NO: 3638186 - RNA, 14 nt, Human
uacuguaugugaug

SEQ ID NO: 3638187 - RNA, 17 nt, Human
uacuguauuuuguauug

SEQ ID NO: 3638188 - RNA, 23 nt, Human
uacuguauuuuguauuguuucaa

SEQ ID NO: 3638189 - RNA, 22 nt, Human
uacuguauuuuuaccuuuuucc

SEQ ID NO: 3638190 - RNA, 14 nt, Human
uacugucaaaugau

SEQ ID NO: 3638191 - RNA, 16 nt, Human
uacugucaaaugaugu

SEQ ID NO: 3638192 - RNA, 15 nt, Human
uacugucaauaaaca

SEQ ID NO: 3638193 - RNA, 15 nt, Human
uacugucugauuggc

SEQ ID NO: 3638194 - RNA, 20 nt, Human
uacugucugguuuuaacaau

SEQ ID NO: 3638195 - RNA, 21 nt, Human
uacugucugguuuuaacaauu

SEQ ID NO: 3638196 - RNA, 15 nt, Human
uacugucuuaauuaa

SEQ ID NO: 3638197 - RNA, 13 nt, Human
uacugugacugau

SEQ ID NO: 3638198 - RNA, 16 nt, Human
uacuguggaaaaauau

SEQ ID NO: 3638199 - RNA, 16 nt, Human
uacuguggaggaagga

SEQ ID NO: 3638200 - RNA, 18 nt, Human
uacuguggaggaaggauu

SEQ ID NO: 3638201 - RNA, 22 nt, Human
uacuguggaggaaggauuguaa

SEQ ID NO: 3638202 - RNA, 23 nt, Human
uacuguggaggaaggauuguaaa

SEQ ID NO: 3638203 - RNA, 17 nt, Human
uacugugggcaauuuag

SEQ ID NO: 3638204 - RNA, 13 nt, Human
uacuguguaaacu

SEQ ID NO: 3638205 - RNA, 15 nt, Human
uacuguguaaacuca

SEQ ID NO: 3638206 - RNA, 13 nt, Human
uacuguguaauua

SEQ ID NO: 3638207 - RNA, 14 nt, Human
uacuguguaauuag

SEQ ID NO: 3638208 - RNA, 15 nt, Human
uacuguguacuguau

SEQ ID NO: 3638209 - RNA, 19 nt, Human
uacugugucucauggauuu

SEQ ID NO: 3638210 - RNA, 13 nt, Human
uacugugucuuug

SEQ ID NO: 3638211 - RNA, 17 nt, Human
uacuguguuaugcaaaa

SEQ ID NO: 3638212 - RNA, 22 nt, Human
uacuguguuaugcaaaagcaag

SEQ ID NO: 3638213 - RNA, 22 nt, Human
uacuguguuccuggcaauagug

SEQ ID NO: 3638214 - RNA, 18 nt, Human
uacuguguuuuauaaaau

SEQ ID NO: 3638215 - RNA, 18 nt, Human
uacuguuacugggcccug

SEQ ID NO: 3638216 - RNA, 16 nt, Human
uacuguuaucuaucug

SEQ ID NO: 3638217 - RNA, 13 nt, Human
uacuguuauucuu

SEQ ID NO: 3638218 - RNA, 14 nt, Human
uacuguuauucuuu

SEQ ID NO: 3638219 - RNA, 17 nt, Human
uacuguuauucuuugca

SEQ ID NO: 3638220 - RNA, 16 nt, Human
uacuguucagcuuuua

SEQ ID NO: 3638221 - RNA, 14 nt, Human
uacuguucuaaagc

SEQ ID NO: 3638222 - RNA, 18 nt, Human
uacuguucuaaagcucug

SEQ ID NO: 3638223 - RNA, 19 nt, Human
uacuguucuaaagcucuga

SEQ ID NO: 3638224 - RNA, 21 nt, Human
uacuguucuaaagcucugaca

SEQ ID NO: 3638225 - RNA, 17 nt, Human
uacuguucuucauuuua

SEQ ID NO: 3638226 - RNA, 17 nt, Human
uacuguucuugcugcua

SEQ ID NO: 3638227 - RNA, 20 nt, Human
uacuguucuugcugcuagaa

SEQ ID NO: 3638228 - RNA, 22 nt, Human
uacuguugauaauucuuauuuu

SEQ ID NO: 3638229 - RNA, 14 nt, Human
uacuguugcacgug

SEQ ID NO: 3638230 - RNA, 23 nt, Human
uacuguugcacguguguuuuucu

SEQ ID NO: 3638231 - RNA, 11 nt, Human
uacuguuggug

SEQ ID NO: 3638232 - RNA, 17 nt, Human
uacuguuguaagaauuc

SEQ ID NO: 3638233 - RNA, 22 nt, Human
uacuguuuauuacuuccaugaa

SEQ ID NO: 3638234 - RNA, 23 nt, Human
uacuguuuauuucuguuucucau

SEQ ID NO: 3638235 - RNA, 12 nt, Human
uacuguuugucu

SEQ ID NO: 3638236 - RNA, 21 nt, Human
uacuuaaaaaaaaaaaaaagc

SEQ ID NO: 3638237 - RNA, 12 nt, Human
uacuuaaagauu

SEQ ID NO: 3638238 - RNA, 19 nt, Human
uacuuaaagauuuaucaaa

SEQ ID NO: 3638239 - RNA, 17 nt, Human
uacuuaaaugaaagcau

SEQ ID NO: 3638240 - RNA, 18 nt, Human
uacuuaaaugaaagcaug

SEQ ID NO: 3638241 - RNA, 14 nt, Human
uacuuaaaugguaa

SEQ ID NO: 3638242 - RNA, 17 nt, Human
uacuuaaauguuaugua

SEQ ID NO: 3638243 - RNA, 13 nt, Human
uacuuaacuauuc

SEQ ID NO: 3638244 - RNA, 14 nt, Human
uacuuaagagaaau

SEQ ID NO: 3638245 - RNA, 17 nt, Human
uacuuaauaaauucaga

SEQ ID NO: 3638246 - RNA, 19 nt, Human
uacuuaauaaauucagaua

SEQ ID NO: 3638247 - RNA, 15 nt, Human
uacuuaauccaaugg

SEQ ID NO: 3638248 - RNA, 14 nt, Human
uacuuacauucucu

SEQ ID NO: 3638249 - RNA, 22 nt, Human
uacuuaccuaaacagauauaaa

SEQ ID NO: 3638250 - RNA, 18 nt, Human
uacuuagcaaaguuuuac

SEQ ID NO: 3638251 - RNA, 18 nt, Human
uacuuagcaauguuaucu

SEQ ID NO: 3638252 - RNA, 17 nt, Human
uagugcagcugaaauug

SEQ ID NO: 3638253 - RNA, 20 nt, Human
uagugcagcugauuuuaaca

SEQ ID NO: 3638254 - RNA, 22 nt, Human
uagugcagcugauuuuaacaau

SEQ ID NO: 3638255 - RNA, 22 nt, Human
uagugccacuuaauguauguua

SEQ ID NO: 3638256 - RNA, 16 nt, Human
uagugccuucuaaagg

SEQ ID NO: 3638257 - RNA, 17 nt, Human
uagugcggacaaguuuu

SEQ ID NO: 3638258 - RNA, 19 nt, Human
uagugcggacaaguuuuaa

SEQ ID NO: 3638259 - RNA, 15 nt, Human
uagugcuaacaugaa

SEQ ID NO: 3638260 - RNA, 17 nt, Human
uagugcuaagugugaac

SEQ ID NO: 3638261 - RNA, 18 nt, Human
uagugcuaagugugaacu

SEQ ID NO: 3638262 - RNA, 22 nt, Human
uagugcuccauaguuuggcauu

SEQ ID NO: 3638263 - RNA, 22 nt, Human
uagugcugaagcuuauuaaugc

SEQ ID NO: 3638264 - RNA, 13 nt, Human
uaguggaaaaaca

SEQ ID NO: 3638265 - RNA, 16 nt, Human
uaguggaaaauaggcu

SEQ ID NO: 3638266 - RNA, 20 nt, Human
uaguggacccugaaaugugu

SEQ ID NO: 3638267 - RNA, 21 nt, Human
uaguggacccugaaaugugug

SEQ ID NO: 3638268 - RNA, 15 nt, Human
uaguggauggaaggg

SEQ ID NO: 3638269 - RNA, 19 nt, Human
uaguggccagaccagagcu

SEQ ID NO: 3638270 - RNA, 18 nt, Human
uagugggcaccccacugc

SEQ ID NO: 3638271 - RNA, 21 nt, Human
uaguggggucucccucuccug

SEQ ID NO: 3638272 - RNA, 22 nt, Human
uaguggggucucccucuccugc

SEQ ID NO: 3638273 - RNA, 13 nt, Human
uaguggucuuugu

SEQ ID NO: 3638274 - RNA, 14 nt, Human
uaguggucuuugua

SEQ ID NO: 3638275 - RNA, 18 nt, Human
uaguggucuuuguaagag

SEQ ID NO: 3638276 - RNA, 23 nt, Human
uaguggucuuuguaagaguguag

SEQ ID NO: 3638277 - RNA, 17 nt, Human
uagugguggcucugaga

SEQ ID NO: 3638278 - RNA, 22 nt, Human
uagugguguuuuaaagagaaug

SEQ ID NO: 3638279 - RNA, 16 nt, Human
uaguguaaaaaugaga

SEQ ID NO: 3638280 - RNA, 18 nt, Human
uaguguaaaaaugagaac

SEQ ID NO: 3638281 - RNA, 13 nt, Human
uaguguaaaauaa

SEQ ID NO: 3638282 - RNA, 22 nt, Human
uaguguaaaauaagaaugauuu

SEQ ID NO: 3638283 - RNA, 18 nt, Human
uaguguaagcuagaagaa

SEQ ID NO: 3638284 - RNA, 18 nt, Human
uaguguacauuucuauaa

SEQ ID NO: 3638285 - RNA, 21 nt, Human
uaguguacauuucuauaaaua

SEQ ID NO: 3638286 - RNA, 21 nt, Human
uaguguaccuccucucagugu

SEQ ID NO: 3638287 - RNA, 23 nt, Human
uaguguaccuccucucaguguuu

SEQ ID NO: 3638288 - RNA, 21 nt, Human
uaguguagauuccauuuacug

SEQ ID NO: 3638289 - RNA, 14 nt, Human
uaguguaggcuuua

SEQ ID NO: 3638290 - RNA, 23 nt, Human
uaguguaggcuuuacuuagcuua

SEQ ID NO: 3638291 - RNA, 19 nt, Human
uaguguaguauucuucccu

SEQ ID NO: 3638292 - RNA, 14 nt, Human
uaguguaucaaaau

SEQ ID NO: 3638293 - RNA, 14 nt, Human
uaguguccuaugca

SEQ ID NO: 3638294 - RNA, 11 nt, Human
uagugugaaau

SEQ ID NO: 3638295 - RNA, 18 nt, Human
uaguguggaaauuaagaa

SEQ ID NO: 3638296 - RNA, 22 nt, Human
uaguguggaaauuaagaagaaa

SEQ ID NO: 3638297 - RNA, 17 nt, Human
uagugugggaggcuccu

SEQ ID NO: 3638298 - RNA, 22 nt, Human
uagugugguuuucuguuucuaa

SEQ ID NO: 3638299 - RNA, 16 nt, Human
uaguguucagaaaaaa

SEQ ID NO: 3638300 - RNA, 12 nt, Human
uaguguuggaga

SEQ ID NO: 3638301 - RNA, 23 nt, Human
uaguguuuuuuuauuucuacugu

SEQ ID NO: 3638302 - RNA, 18 nt, Human
uaguuaaagaaaggaaaa

SEQ ID NO: 3638303 - RNA, 12 nt, Human
uaguuaaauuuc

SEQ ID NO: 3638304 - RNA, 14 nt, Human
uaguuaacacacua

SEQ ID NO: 3638305 - RNA, 20 nt, Human
uaguuaacauaguaaguuca

SEQ ID NO: 3638306 - RNA, 12 nt, Human
uaguuaaccacu

SEQ ID NO: 3638307 - RNA, 21 nt, Human
uaguuaagacaugauuuccuu

SEQ ID NO: 3638308 - RNA, 13 nt, Human
uaguuaauggauu

SEQ ID NO: 3638309 - RNA, 15 nt, Human
uaguuaauuuaucua

SEQ ID NO: 3638310 - RNA, 16 nt, Human
uaguuaauuuaucuaa

SEQ ID NO: 3638311 - RNA, 12 nt, Human
uaguuaccuuau

SEQ ID NO: 3638312 - RNA, 17 nt, Human
uaguuaccuuauaguua

SEQ ID NO: 3638313 - RNA, 21 nt, Human
uaguuaccuuauaguuacugu

SEQ ID NO: 3638314 - RNA, 14 nt, Human
uaguuacucauuca

SEQ ID NO: 3638315 - RNA, 12 nt, Human
uaguuacuguaa

SEQ ID NO: 3638316 - RNA, 21 nt, Human
uaguuacuguugugaccugaa

SEQ ID NO: 3638317 - RNA, 22 nt, Human
uaguuaggaaauaaaaccuuuc

SEQ ID NO: 3638318 - RNA, 16 nt, Human
uaguuaguagcauguu

SEQ ID NO: 3638319 - RNA, 19 nt, Human
uaguuauacuuauuuguau

SEQ ID NO: 3638320 - RNA, 16 nt, Human
uaguuaucauguuagu

SEQ ID NO: 3638321 - RNA, 13 nt, Human
uaguuauguaaau

SEQ ID NO: 3638322 - RNA, 21 nt, Human
uaguuauguaaauaauucuuu

SEQ ID NO: 3638323 - RNA, 18 nt, Human
uaguucaagaaaugaaga

SEQ ID NO: 3638324 - RNA, 14 nt, Human
uaguucagcaaaac

SEQ ID NO: 3638325 - RNA, 18 nt, Human
uaguucagguaacaggca

SEQ ID NO: 3638326 - RNA, 15 nt, Human
uaguucauguaaaua

SEQ ID NO: 3638327 - RNA, 21 nt, Human
uaguucauguaaauaauacau

SEQ ID NO: 3638328 - RNA, 14 nt, Human
uaguuccacugaga

SEQ ID NO: 3638329 - RNA, 21 nt, Human
uaguuccccaaauacaaaguu

SEQ ID NO: 3638330 - RNA, 15 nt, Human
uaguuccccuguuua

SEQ ID NO: 3638331 - RNA, 16 nt, Human
uaguucccucugcuca

SEQ ID NO: 3638332 - RNA, 19 nt, Human
uaguucccucugcucagcc

SEQ ID NO: 3638333 - RNA, 23 nt, Human
uaguucccugaaaacccagagag

SEQ ID NO: 3638334 - RNA, 20 nt, Human
uaguuccucauuagcauuuu

SEQ ID NO: 3638335 - RNA, 14 nt, Human
uaguucuaagacuc

SEQ ID NO: 3638336 - RNA, 15 nt, Human
uaguucuagaaaaac

SEQ ID NO: 3638337 - RNA, 16 nt, Human
uaguucuagaaaaaca

SEQ ID NO: 3638338 - RNA, 19 nt, Human
uaguucugcuccagacagg

SEQ ID NO: 3638339 - RNA, 9 nt, Human
uaguucugu

SEQ ID NO: 3638340 - RNA, 15 nt, Human
uaguucuguagaaau

SEQ ID NO: 3638341 - RNA, 18 nt, Human
uaguucuguagaaauggu

SEQ ID NO: 3638342 - RNA, 21 nt, Human
uaguucuguauuugaaagugc

SEQ ID NO: 3638343 - RNA, 15 nt, Human
uaguugaauacuuga

SEQ ID NO: 3638344 - RNA, 19 nt, Human
uaguugaauacuugaacca

SEQ ID NO: 3638345 - RNA, 13 nt, Human
uaguugagcccca

SEQ ID NO: 3638346 - RNA, 18 nt, Human
uaguugaggaaagcacag

SEQ ID NO: 3638347 - RNA, 17 nt, Human
uaguugcaauagaacag

SEQ ID NO: 3638348 - RNA, 14 nt, Human
uaguugcaauugaa

SEQ ID NO: 3638349 - RNA, 17 nt, Human
uaguugcagaaacauuu

SEQ ID NO: 3638350 - RNA, 14 nt, Human
uaguugcuuuguua

SEQ ID NO: 3638351 - RNA, 18 nt, Human
uaguugcuuuugaaggaa

SEQ ID NO: 3638352 - RNA, 21 nt, Human
uaguuguaccgcaaugugacu

SEQ ID NO: 3638353 - RNA, 17 nt, Human
uaguugucucucuucag

SEQ ID NO: 3638354 - RNA, 18 nt, Human
uaguugugaccuuagugu

SEQ ID NO: 3638355 - RNA, 15 nt, Human
uaguuguguuucaac

SEQ ID NO: 3638356 - RNA, 21 nt, Human
uaguuguuucuagacuauaaa

SEQ ID NO: 3638357 - RNA, 20 nt, Human
uaguuguuugauucagacag

SEQ ID NO: 3638358 - RNA, 21 nt, Human
uaguuguuugauucagacagc

SEQ ID NO: 3638359 - RNA, 22 nt, Human
uaguuguuugauucagacagcu

SEQ ID NO: 3638360 - RNA, 16 nt, Human
uaguuuaaaacacauu

SEQ ID NO: 3638361 - RNA, 22 nt, Human
uaguuuaaccauaugcccacau

SEQ ID NO: 3638362 - RNA, 19 nt, Human
uaguuuacagaaaaaucuu

SEQ ID NO: 3638363 - RNA, 15 nt, Human
uaguuuacuauuuua

SEQ ID NO: 3638364 - RNA, 16 nt, Human
uaguuuacugagaaug

SEQ ID NO: 3638365 - RNA, 11 nt, Human
uaguuuacugu

SEQ ID NO: 3638366 - RNA, 13 nt, Human
uaguuuacuguuu

SEQ ID NO: 3638367 - RNA, 18 nt, Human
uaguuuagugugguuuuc

SEQ ID NO: 3638368 - RNA, 11 nt, Human
uaguuucaagc

SEQ ID NO: 3638369 - RNA, 19 nt, Human
uaguuucauauaaaguauc

SEQ ID NO: 3638370 - RNA, 12 nt, Human
uaguuucugagu

SEQ ID NO: 3638371 - RNA, 20 nt, Human
uaguuucugaguuuuaccaa

SEQ ID NO: 3638372 - RNA, 14 nt, Human
uaguuucuguucug

SEQ ID NO: 3638373 - RNA, 16 nt, Human
uaguuucuguucugug

SEQ ID NO: 3638374 - RNA, 12 nt, Human
uaguuucuugug

SEQ ID NO: 3638375 - RNA, 12 nt, Human
uaguuucuuuau

SEQ ID NO: 3638376 - RNA, 22 nt, Human
uaguuucuuuauuuuguguaaa

SEQ ID NO: 3638377 - RNA, 21 nt, Human
uaguuugaccucacagugacc

SEQ ID NO: 3638378 - RNA, 17 nt, Human
uaguuugacucaguaua

SEQ ID NO: 3638379 - RNA, 14 nt, Human
uaguuugaggaaau

SEQ ID NO: 3638380 - RNA, 21 nt, Human
uaguuugauuaaauucuugca

SEQ ID NO: 3638381 - RNA, 18 nt, Human
uaguuugcauuucagaaa

SEQ ID NO: 3638382 - RNA, 11 nt, Human
uaguuuggaua

SEQ ID NO: 3638383 - RNA, 11 nt, Human
uaguuuggauu

SEQ ID NO: 3638384 - RNA, 16 nt, Human
uaguuugggcuucagc

SEQ ID NO: 3638385 - RNA, 14 nt, Human
uaguuuguauaacu

SEQ ID NO: 3638386 - RNA, 18 nt, Human
uaguuuguauaacuucuu

SEQ ID NO: 3638387 - RNA, 12 nt, Human
uaguuugucuau

SEQ ID NO: 3638388 - RNA, 14 nt, Human
uaguuugugagaaa

SEQ ID NO: 3638389 - RNA, 13 nt, Human
uaguuuguuuaau

SEQ ID NO: 3638390 - RNA, 14 nt, Human
uaguuuuaaacuca

SEQ ID NO: 3638391 - RNA, 17 nt, Human
uaguuuuaguugcagaa

SEQ ID NO: 3638392 - RNA, 15 nt, Human
uaguuuuauaugcuu

SEQ ID NO: 3638393 - RNA, 16 nt, Human
uaguuuuauaugcuuc

SEQ ID NO: 3638394 - RNA, 17 nt, Human
uaguuuuaucacaugua

SEQ ID NO: 3638395 - RNA, 23 nt, Human
uaguuuucauacacagccugggc

SEQ ID NO: 3638396 - RNA, 13 nt, Human
uaguuuucucagc

SEQ ID NO: 3638397 - RNA, 13 nt, Human
uauaccugugccu

SEQ ID NO: 3638398 - RNA, 22 nt, Human
uauaccuguguuucuugccuca

SEQ ID NO: 3638399 - RNA, 17 nt, Human
uauaccuguuuaaauug

SEQ ID NO: 3638400 - RNA, 18 nt, Human
uauaccuguuuaaauugc

SEQ ID NO: 3638401 - RNA, 17 nt, Human
uauacgaaauaauuguu

SEQ ID NO: 3638402 - RNA, 15 nt, Human
uauacguguagcuau

SEQ ID NO: 3638403 - RNA, 19 nt, Human
uauacguguagcuauaucu

SEQ ID NO: 3638404 - RNA, 15 nt, Human
uauacuaagaaaaga

SEQ ID NO: 3638405 - RNA, 20 nt, Human
uauacuauaguaccaguagg

SEQ ID NO: 3638406 - RNA, 21 nt, Human
uauacuauuaaaaagguuuac

SEQ ID NO: 3638407 - RNA, 18 nt, Human
uauacucuagaugaaguu

SEQ ID NO: 3638408 - RNA, 20 nt, Human
uauacucuuauagacaacau

SEQ ID NO: 3638409 - RNA, 16 nt, Human
uauacucuuucuguau

SEQ ID NO: 3638410 - RNA, 17 nt, Human
uauacucuuucuguaua

SEQ ID NO: 3638411 - RNA, 17 nt, Human
uauacucuuuuuucaug

SEQ ID NO: 3638412 - RNA, 12 nt, Human
uauacugcauac

SEQ ID NO: 3638413 - RNA, 16 nt, Human
uauacugcauacuuuu

SEQ ID NO: 3638414 - RNA, 23 nt, Human
uauacugcuuggagcugagcaaa

SEQ ID NO: 3638415 - RNA, 13 nt, Human
uauacuggcaugc

SEQ ID NO: 3638416 - RNA, 16 nt, Human
uauacuguaaagaaag

SEQ ID NO: 3638417 - RNA, 22 nt, Human
uauacuguaaagaaagagagaa

SEQ ID NO: 3638418 - RNA, 21 nt, Human
uauacuguacaauaaaaacau

SEQ ID NO: 3638419 - RNA, 16 nt, Human
uauacuguacuuaaua

SEQ ID NO: 3638420 - RNA, 13 nt, Human
uauacuguucuuc

SEQ ID NO: 3638421 - RNA, 22 nt, Human
uauacuuaaauggaaaaaauga

SEQ ID NO: 3638422 - RNA, 21 nt, Human
uauacuuccuuacuuuuaagg

SEQ ID NO: 3638423 - RNA, 21 nt, Human
uauacuugaacaaaaggguca

SEQ ID NO: 3638424 - RNA, 23 nt, Human
uauacuugaacaaaagggucaga

SEQ ID NO: 3638425 - RNA, 22 nt, Human
uauacuuguggacuaaaagaua

SEQ ID NO: 3638426 - RNA, 22 nt, Human
uauacuugugguuuucaaauug

SEQ ID NO: 3638427 - RNA, 21 nt, Human
uauacuuuaaauaauuuaacu

SEQ ID NO: 3638428 - RNA, 19 nt, Human
uauacuuuaguagacauuu

SEQ ID NO: 3638429 - RNA, 20 nt, Human
uauacuuucccuacccucua

SEQ ID NO: 3638430 - RNA, 11 nt, Human
uauacuuuuuu

SEQ ID NO: 3638431 - RNA, 21 nt, Human
uauacuuuuuucuuauuuaac

SEQ ID NO: 3638432 - RNA, 20 nt, Human
uauagaaaaaaacauucuau

SEQ ID NO: 3638433 - RNA, 23 nt, Human
uauagaaaaauaaaaaucucuuu

SEQ ID NO: 3638434 - RNA, 12 nt, Human
uauagaaaaucu

SEQ ID NO: 3638435 - RNA, 15 nt, Human
uauagaaaaucuuca

SEQ ID NO: 3638436 - RNA, 18 nt, Human
uauagaaagcaagaugua

SEQ ID NO: 3638437 - RNA, 13 nt, Human
uauagaaagcuau

SEQ ID NO: 3638438 - RNA, 21 nt, Human
uauagaaaguguucuguuaca

SEQ ID NO: 3638439 - RNA, 11 nt, Human
uauagaaaugc

SEQ ID NO: 3638440 - RNA, 20 nt, Human
uauagaaccucuuugucuac

SEQ ID NO: 3638441 - RNA, 21 nt, Human
uauagaaccucuuugucuaca

SEQ ID NO: 3638442 - RNA, 20 nt, Human
uauagaacuggauuuucaga

SEQ ID NO: 3638443 - RNA, 17 nt, Human
uauagaacuucauggau

SEQ ID NO: 3638444 - RNA, 20 nt, Human
uauagaagaaugcaugcuuu

SEQ ID NO: 3638445 - RNA, 13 nt, Human
uauagaagcgauu

SEQ ID NO: 3638446 - RNA, 16 nt, Human
uauagaagucuucaug

SEQ ID NO: 3638447 - RNA, 17 nt, Human
uauagacagcuuugacu

SEQ ID NO: 3638448 - RNA, 15 nt, Human
uauagacaguuugua

SEQ ID NO: 3638449 - RNA, 19 nt, Human
uauagacauugaggaccuc

SEQ ID NO: 3638450 - RNA, 19 nt, Human
uauagacugccgugcauua

SEQ ID NO: 3638451 - RNA, 17 nt, Human
uauagagauaugcagaa

SEQ ID NO: 3638452 - RNA, 21 nt, Human
uauagagauaugcagaaggaa

SEQ ID NO: 3638453 - RNA, 22 nt, Human
uauagagauguuuuuaaaaguu

SEQ ID NO: 3638454 - RNA, 20 nt, Human
uauagagucauuguaauguu

SEQ ID NO: 3638455 - RNA, 17 nt, Human
uauagaguucaucccag

SEQ ID NO: 3638456 - RNA, 21 nt, Human
uauagauauaaugaacaaaau

SEQ ID NO: 3638457 - RNA, 18 nt, Human
uauagaucacauaacaga

SEQ ID NO: 3638458 - RNA, 15 nt, Human
uauagaucccccaga

SEQ ID NO: 3638459 - RNA, 22 nt, Human
uauagaugcaagauauuuauau

SEQ ID NO: 3638460 - RNA, 23 nt, Human
uauagaugggggaaagcaaagca

SEQ ID NO: 3638461 - RNA, 12 nt, Human
uauagaugucua

SEQ ID NO: 3638462 - RNA, 18 nt, Human
uauagaugucuuuuccca

SEQ ID NO: 3638463 - RNA, 15 nt, Human
uauagauguugcuaa

SEQ ID NO: 3638464 - RNA, 16 nt, Human
uauagauuagaaaaau

SEQ ID NO: 3638465 - RNA, 21 nt, Human
uauagauuagaaaaauuccua

SEQ ID NO: 3638466 - RNA, 18 nt, Human
uauagauuagaauucugu

SEQ ID NO: 3638467 - RNA, 19 nt, Human
uauagauuagaauucugua

SEQ ID NO: 3638468 - RNA, 16 nt, Human
uauagauuauaacuug

SEQ ID NO: 3638469 - RNA, 14 nt, Human
uauagauucuaaag

SEQ ID NO: 3638470 - RNA, 16 nt, Human
uauagcaaaacuuuua

SEQ ID NO: 3638471 - RNA, 19 nt, Human
uauagcaaaacuuuuaaac

SEQ ID NO: 3638472 - RNA, 18 nt, Human
uauagcacaucaccuggg

SEQ ID NO: 3638473 - RNA, 14 nt, Human
uauagcacuuugaa

SEQ ID NO: 3638474 - RNA, 21 nt, Human
uauagcacuuugaaauaccuc

SEQ ID NO: 3638475 - RNA, 22 nt, Human
uauagcacuuugaaauaccuca

SEQ ID NO: 3638476 - RNA, 18 nt, Human
uauagcagcaaaaauaua

SEQ ID NO: 3638477 - RNA, 21 nt, Human
uauagcagcaaaaauauaaaa

SEQ ID NO: 3638478 - RNA, 15 nt, Human
uauagcaucacuuaa

SEQ ID NO: 3638479 - RNA, 22 nt, Human
uauagccaaaaauagcuaaaua

SEQ ID NO: 3638480 - RNA, 17 nt, Human
uauagccaauauaacua

SEQ ID NO: 3638481 - RNA, 13 nt, Human
uauagcccagguc

SEQ ID NO: 3638482 - RNA, 20 nt, Human
uauagccuaggugacagagu

SEQ ID NO: 3638483 - RNA, 14 nt, Human
uauagccuggacug

SEQ ID NO: 3638484 - RNA, 14 nt, Human
uauagcuaaguaca

SEQ ID NO: 3638485 - RNA, 22 nt, Human
uauagcuacaggaagcacccca

SEQ ID NO: 3638486 - RNA, 14 nt, Human
uauagcuauuacug

SEQ ID NO: 3638487 - RNA, 12 nt, Human
uauagcuauuuu

SEQ ID NO: 3638488 - RNA, 22 nt, Human
uauagcugcuuccaguguagac

SEQ ID NO: 3638489 - RNA, 16 nt, Human
uauagcuguacaaaua

SEQ ID NO: 3638490 - RNA, 13 nt, Human
uauagcuguauug

SEQ ID NO: 3638491 - RNA, 14 nt, Human
uauagcuguauuga

SEQ ID NO: 3638492 - RNA, 12 nt, Human
uauagcuugaaa

SEQ ID NO: 3638493 - RNA, 13 nt, Human
uauagcuuuauuu

SEQ ID NO: 3638494 - RNA, 16 nt, Human
uauaggagacuuguag

SEQ ID NO: 3638495 - RNA, 17 nt, Human
uauaggagacuuguagu

SEQ ID NO: 3638496 - RNA, 18 nt, Human
uauaggagccuuaauuuu

SEQ ID NO: 3638497 - RNA, 15 nt, Human
uauaggaucauuugu

SEQ ID NO: 3638498 - RNA, 19 nt, Human
uauaggcauaccuccuaug

SEQ ID NO: 3638499 - RNA, 20 nt, Human
uauaggucucuucucccaga

SEQ ID NO: 3638500 - RNA, 17 nt, Human
uauaggugauguuugcu

SEQ ID NO: 3638501 - RNA, 20 nt, Human
uauaggugcuacaaaaacac

SEQ ID NO: 3638502 - RNA, 18 nt, Human
uauagguuuuaaagaccu

SEQ ID NO: 3638503 - RNA, 13 nt, Human
uauaguacaugau

SEQ ID NO: 3638504 - RNA, 16 nt, Human
uauaguaccuuugcuc

SEQ ID NO: 3638505 - RNA, 13 nt, Human
uauaguauaucug

SEQ ID NO: 3638506 - RNA, 20 nt, Human
uauaguauuugaaaacagaa

SEQ ID NO: 3638507 - RNA, 19 nt, Human
uauaguauuugauucaaaa

SEQ ID NO: 3638508 - RNA, 18 nt, Human
uauagucuaagacuauau

SEQ ID NO: 3638509 - RNA, 19 nt, Human
uauagugcaauauauuuug

SEQ ID NO: 3638510 - RNA, 17 nt, Human
uauagugcacaaaauga

SEQ ID NO: 3638511 - RNA, 21 nt, Human
uauaguguaaaauaagaauga

SEQ ID NO: 3638512 - RNA, 16 nt, Human
uauaguuaacacacua

SEQ ID NO: 3638513 - RNA, 17 nt, Human
uauaguuaacacacuac

SEQ ID NO: 3638514 - RNA, 19 nt, Human
uauaguuaaucuauaacua

SEQ ID NO: 3638515 - RNA, 15 nt, Human
uauaguuacugugua

SEQ ID NO: 3638516 - RNA, 16 nt, Human
uauaguuauguaaaua

SEQ ID NO: 3638517 - RNA, 22 nt, Human
uauaguuauuaaguucuuuaaa

SEQ ID NO: 3638518 - RNA, 12 nt, Human
uauaguucuaga

SEQ ID NO: 3638519 - RNA, 13 nt, Human
uauaguucuagac

SEQ ID NO: 3638520 - RNA, 14 nt, Human
uauaguugucagua

SEQ ID NO: 3638521 - RNA, 21 nt, Human
uauaguugucaguauuauucu

SEQ ID NO: 3638522 - RNA, 18 nt, Human
uauaguuguuuuauaugu

SEQ ID NO: 3638523 - RNA, 19 nt, Human
uauaguuuaaaacacauug

SEQ ID NO: 3638524 - RNA, 17 nt, Human
uauaguuuacuauuuua

SEQ ID NO: 3638525 - RNA, 22 nt, Human
uauaguuucagauauauaucau

SEQ ID NO: 3638526 - RNA, 15 nt, Human
uauaguuugggcuuc

SEQ ID NO: 3638527 - RNA, 15 nt, Human
uauaguuuguacaug

SEQ ID NO: 3638528 - RNA, 17 nt, Human
uauaguuuuacuuuuaa

SEQ ID NO: 3638529 - RNA, 23 nt, Human
uauauaaaaagaaaagauaaaga

SEQ ID NO: 3638530 - RNA, 11 nt, Human
uauauaaaaau

SEQ ID NO: 3638531 - RNA, 18 nt, Human
uauauaaaaauauauaua

SEQ ID NO: 3638532 - RNA, 19 nt, Human
uauauaaaacggugcugug

SEQ ID NO: 3638533 - RNA, 19 nt, Human
uauauaaaauaaauauaua

SEQ ID NO: 3638534 - RNA, 13 nt, Human
uauauaaaauaac

SEQ ID NO: 3638535 - RNA, 14 nt, Human
uauauaaaccuaaa

SEQ ID NO: 3638536 - RNA, 17 nt, Human
uauauaaaccuaaaaaa

SEQ ID NO: 3638537 - RNA, 22 nt, Human
uauauaaaccuaaaaaagauau

SEQ ID NO: 3638538 - RNA, 18 nt, Human
uauauaaagaauauauau

SEQ ID NO: 3638539 - RNA, 14 nt, Human
uauauaaagagaaa

SEQ ID NO: 3638540 - RNA, 18 nt, Human
uauauaaagagaaaauug

SEQ ID NO: 3638541 - RNA, 21 nt, Human
uaucagaagaccacaaaaauu

SEQ ID NO: 3638542 - RNA, 23 nt, Human
uaucagaagaccacaaaaauuga

SEQ ID NO: 3638543 - RNA, 10 nt, Human
uaucagaauu

SEQ ID NO: 3638544 - RNA, 18 nt, Human
uaucagaauugaaacacu

SEQ ID NO: 3638545 - RNA, 13 nt, Human
uaucagaauuugu

SEQ ID NO: 3638546 - RNA, 20 nt, Human
uaucagaauuuguguugaag

SEQ ID NO: 3638547 - RNA, 18 nt, Human
uaucagacacucuggcug

SEQ ID NO: 3638548 - RNA, 17 nt, Human
uaucagaggccuauaau

SEQ ID NO: 3638549 - RNA, 17 nt, Human
uaucagauugcuuuugu

SEQ ID NO: 3638550 - RNA, 13 nt, Human
uaucagccugucu

SEQ ID NO: 3638551 - RNA, 19 nt, Human
uaucagcggccccuugacu

SEQ ID NO: 3638552 - RNA, 18 nt, Human
uaucagcuacuuaagaga

SEQ ID NO: 3638553 - RNA, 20 nt, Human
uaucaggacccagaggaagg

SEQ ID NO: 3638554 - RNA, 16 nt, Human
uaucaggauuuccucu

SEQ ID NO: 3638555 - RNA, 9 nt, Human
uaucaguag

SEQ ID NO: 3638556 - RNA, 20 nt, Human
uaucagugacagaguucacu

SEQ ID NO: 3638557 - RNA, 22 nt, Human
uaucagugacagaguucacuau

SEQ ID NO: 3638558 - RNA, 13 nt, Human
uaucagugcuucc

SEQ ID NO: 3638559 - RNA, 15 nt, Human
uaucaguguuuaugu

SEQ ID NO: 3638560 - RNA, 20 nt, Human
uaucaguguuuuaaauucug

SEQ ID NO: 3638561 - RNA, 21 nt, Human
uaucaguguuuuaaauucuga

SEQ ID NO: 3638562 - RNA, 21 nt, Human
uaucaguuacucagcccuggg

SEQ ID NO: 3638563 - RNA, 15 nt, Human
uaucaguugcaauaa

SEQ ID NO: 3638564 - RNA, 22 nt, Human
uaucaguuugaucacacuauuu

SEQ ID NO: 3638565 - RNA, 23 nt, Human
uaucaguuugcuagcagaaaucu

SEQ ID NO: 3638566 - RNA, 16 nt, Human
uaucauaaaaucaaaa

SEQ ID NO: 3638567 - RNA, 22 nt, Human
uaucauacaaaucaguuaguuu

SEQ ID NO: 3638568 - RNA, 15 nt, Human
uaucauacuguucaa

SEQ ID NO: 3638569 - RNA, 14 nt, Human
uaucauagaaaugu

SEQ ID NO: 3638570 - RNA, 13 nt, Human
uaucauaguuaac

SEQ ID NO: 3638571 - RNA, 21 nt, Human
uaucauauauauacauacaug

SEQ ID NO: 3638572 - RNA, 15 nt, Human
uaucauauugguauu

SEQ ID NO: 3638573 - RNA, 20 nt, Human
uaucaucacguauguuauac

SEQ ID NO: 3638574 - RNA, 21 nt, Human
uaucaucacguauguuauaca

SEQ ID NO: 3638575 - RNA, 22 nt, Human
uaucaucaguauugaagcauuu

SEQ ID NO: 3638576 - RNA, 14 nt, Human
uaucauccacacau

SEQ ID NO: 3638577 - RNA, 17 nt, Human
uaucauccacauuguuu

SEQ ID NO: 3638578 - RNA, 20 nt, Human
uaucaucuguggacugaccu

SEQ ID NO: 3638579 - RNA, 11 nt, Human
uaucaugaaug

SEQ ID NO: 3638580 - RNA, 16 nt, Human
uaucaugaauuuuaaa

SEQ ID NO: 3638581 - RNA, 16 nt, Human
uaucaugacaaagacu

SEQ ID NO: 3638582 - RNA, 17 nt, Human
uaucaugacaaagacug

SEQ ID NO: 3638583 - RNA, 14 nt, Human
uaucaugcaaaaua

SEQ ID NO: 3638584 - RNA, 18 nt, Human
uaucaugccccuguacuc

SEQ ID NO: 3638585 - RNA, 14 nt, Human
uaucaugcccugug

SEQ ID NO: 3638586 - RNA, 22 nt, Human
uaucaugcuuuaaaguguaaua

SEQ ID NO: 3638587 - RNA, 15 nt, Human
uaucauggagugacg

SEQ ID NO: 3638588 - RNA, 16 nt, Human
uaucauggugaaaagc

SEQ ID NO: 3638589 - RNA, 16 nt, Human
uaucauguaaagaaau

SEQ ID NO: 3638590 - RNA, 21 nt, Human
uaucaugucaaacgugaaaau

SEQ ID NO: 3638591 - RNA, 14 nt, Human
uaucauguguaauc

SEQ ID NO: 3638592 - RNA, 19 nt, Human
uaucauguguaaucaauaa

SEQ ID NO: 3638593 - RNA, 13 nt, Human
uaucauguuaacc

SEQ ID NO: 3638594 - RNA, 20 nt, Human
uaucauguuaguaauaccuc

SEQ ID NO: 3638595 - RNA, 15 nt, Human
uaucauuaaaguucu

SEQ ID NO: 3638596 - RNA, 13 nt, Human
uaucauucaagug

SEQ ID NO: 3638597 - RNA, 12 nt, Human
uaucauucagca

SEQ ID NO: 3638598 - RNA, 18 nt, Human
uaucauucauucuuagcu

SEQ ID NO: 3638599 - RNA, 14 nt, Human
uaucauuccaaagg

SEQ ID NO: 3638600 - RNA, 16 nt, Human
uaucauucuaaagaua

SEQ ID NO: 3638601 - RNA, 18 nt, Human
uaucauuuaauaauauac

SEQ ID NO: 3638602 - RNA, 19 nt, Human
uaucauuuaauaauauacu

SEQ ID NO: 3638603 - RNA, 16 nt, Human
uaucauuuuuuccugu

SEQ ID NO: 3638604 - RNA, 23 nt, Human
uauccaaaauguguauuucuuau

SEQ ID NO: 3638605 - RNA, 14 nt, Human
uauccaaacaugua

SEQ ID NO: 3638606 - RNA, 20 nt, Human
uauccaaaucugaagauugc

SEQ ID NO: 3638607 - RNA, 15 nt, Human
uauccaauugcugcu

SEQ ID NO: 3638608 - RNA, 23 nt, Human
uauccaauugcugcuuguacacu

SEQ ID NO: 3638609 - RNA, 18 nt, Human
uauccacaugaaaauaaa

SEQ ID NO: 3638610 - RNA, 18 nt, Human
uauccacgagagcgcagc

SEQ ID NO: 3638611 - RNA, 17 nt, Human
uauccagaaaacuguga

SEQ ID NO: 3638612 - RNA, 18 nt, Human
uauccaggucaacagaau

SEQ ID NO: 3638613 - RNA, 14 nt, Human
uauccaguuacugc

SEQ ID NO: 3638614 - RNA, 14 nt, Human
uauccauauuuuau

SEQ ID NO: 3638615 - RNA, 13 nt, Human
uauccauguacug

SEQ ID NO: 3638616 - RNA, 15 nt, Human
uauccauguacugua

SEQ ID NO: 3638617 - RNA, 16 nt, Human
uauccauguacuguag

SEQ ID NO: 3638618 - RNA, 22 nt, Human
uauccauguacuguaguuuuuc

SEQ ID NO: 3638619 - RNA, 15 nt, Human
uauccauguacuugu

SEQ ID NO: 3638620 - RNA, 19 nt, Human
uaucccaacagucauguuu

SEQ ID NO: 3638621 - RNA, 12 nt, Human
uaucccauccca

SEQ ID NO: 3638622 - RNA, 20 nt, Human
uauccccaucucccugccug

SEQ ID NO: 3638623 - RNA, 15 nt, Human
uauccccccaucuug

SEQ ID NO: 3638624 - RNA, 19 nt, Human
uauccccccaucuugcuuc

SEQ ID NO: 3638625 - RNA, 15 nt, Human
uauccccucuacucu

SEQ ID NO: 3638626 - RNA, 14 nt, Human
uaucccgagucugg

SEQ ID NO: 3638627 - RNA, 17 nt, Human
uaucccgagucugggac

SEQ ID NO: 3638628 - RNA, 15 nt, Human
uaucccuacauguau

SEQ ID NO: 3638629 - RNA, 14 nt, Human
uaucccuccuguug

SEQ ID NO: 3638630 - RNA, 20 nt, Human
uaucccuccuguugggagag

SEQ ID NO: 3638631 - RNA, 14 nt, Human
uaucccugauaaau

SEQ ID NO: 3638632 - RNA, 13 nt, Human
uaucccugcccau

SEQ ID NO: 3638633 - RNA, 11 nt, Human
uaucccuuccg

SEQ ID NO: 3638634 - RNA, 14 nt, Human
uaucccuuccuuuu

SEQ ID NO: 3638635 - RNA, 18 nt, Human
uaucccuucucacagcac

SEQ ID NO: 3638636 - RNA, 17 nt, Human
uaucccuuggacauuuu

SEQ ID NO: 3638637 - RNA, 18 nt, Human
uaucccuuggacauuuua

SEQ ID NO: 3638638 - RNA, 18 nt, Human
uauccggacagagcacgu

SEQ ID NO: 3638639 - RNA, 16 nt, Human
uauccggacuccugcc

SEQ ID NO: 3638640 - RNA, 15 nt, Human
uauccuaauaaaaag

SEQ ID NO: 3638641 - RNA, 17 nt, Human
uauccuagcacaugcuu

SEQ ID NO: 3638642 - RNA, 14 nt, Human
uauccuauuucagu

SEQ ID NO: 3638643 - RNA, 20 nt, Human
uauccuccagguuuuucaau

SEQ ID NO: 3638644 - RNA, 22 nt, Human
uauccuccagguuuuucaauua

SEQ ID NO: 3638645 - RNA, 15 nt, Human
uauccucccuguaac

SEQ ID NO: 3638646 - RNA, 16 nt, Human
uauccucccuguaacu

SEQ ID NO: 3638647 - RNA, 14 nt, Human
uauccucuuuagag

SEQ ID NO: 3638648 - RNA, 17 nt, Human
uauccucuuuagaguua

SEQ ID NO: 3638649 - RNA, 22 nt, Human
uauccucuuuagaguuagacug

SEQ ID NO: 3638650 - RNA, 17 nt, Human
uauccugaaauuucaga

SEQ ID NO: 3638651 - RNA, 16 nt, Human
uauccugcccaguguu

SEQ ID NO: 3638652 - RNA, 16 nt, Human
uauccuggaacaauau

SEQ ID NO: 3638653 - RNA, 19 nt, Human
uauccuggcuuugcccaac

SEQ ID NO: 3638654 - RNA, 17 nt, Human
uauccugugacugucuc

SEQ ID NO: 3638655 - RNA, 22 nt, Human
uauccuuaugccacccccgcug

SEQ ID NO: 3638656 - RNA, 16 nt, Human
uauccuucaucuuuua

SEQ ID NO: 3638657 - RNA, 20 nt, Human
uauccuucaucuuuuaaaga

SEQ ID NO: 3638658 - RNA, 24 nt, Human
uauccuuuccucauuaaauuaccu

SEQ ID NO: 3638659 - RNA, 17 nt, Human
uauccuuuucuguguuu

SEQ ID NO: 3638660 - RNA, 18 nt, Human
uauccuuuucuucuaugu

SEQ ID NO: 3638661 - RNA, 14 nt, Human
uaucgaaauaacaa

SEQ ID NO: 3638662 - RNA, 15 nt, Human
uaucgaaauaacaau

SEQ ID NO: 3638663 - RNA, 18 nt, Human
uaucgaaauaacaauguu

SEQ ID NO: 3638664 - RNA, 19 nt, Human
uaucgaaauaacaauguua

SEQ ID NO: 3638665 - RNA, 15 nt, Human
uaucggaagcagugc

SEQ ID NO: 3638666 - RNA, 16 nt, Human
uaucgggaacaguguu

SEQ ID NO: 3638667 - RNA, 15 nt, Human
uaucgggagcagugu

SEQ ID NO: 3638668 - RNA, 15 nt, Human
uaucguaaaauuaag

SEQ ID NO: 3638669 - RNA, 18 nt, Human
uaucguauucaccuucag

SEQ ID NO: 3638670 - RNA, 16 nt, Human
uaucgucacugcuuaa

SEQ ID NO: 3638671 - RNA, 15 nt, Human
uaucguuaucacugu

SEQ ID NO: 3638672 - RNA, 20 nt, Human
uaucguuuuuguauuuucau

SEQ ID NO: 3638673 - RNA, 23 nt, Human
uaucuaaaagugucaccuuuucu

SEQ ID NO: 3638674 - RNA, 15 nt, Human
uaucuaaaguuuguu

SEQ ID NO: 3638675 - RNA, 16 nt, Human
uaucuaaauugaauaa

SEQ ID NO: 3638676 - RNA, 12 nt, Human
uaucuaaccagu

SEQ ID NO: 3638677 - RNA, 15 nt, Human
uaucuaaccagugau

SEQ ID NO: 3638678 - RNA, 16 nt, Human
uaucuaaccagugauu

SEQ ID NO: 3638679 - RNA, 13 nt, Human
uaucuaagaauac

SEQ ID NO: 3638680 - RNA, 20 nt, Human
uaucuaagaauacagcuuuc

SEQ ID NO: 3638681 - RNA, 16 nt, Human
uaucuaauaccucugu

SEQ ID NO: 3638682 - RNA, 14 nt, Human
uaucuaaugacaug

SEQ ID NO: 3638683 - RNA, 13 nt, Human
uaucuaauuuaua

SEQ ID NO: 3638684 - RNA, 19 nt, Human
uaucuaccaacuuucaaga

SEQ ID NO: 3638685 - RNA, 21 nt, Human
uaucuacccaagggcagaaag

SEQ ID NO: 3638686 - RNA, 16 nt, Human
uaucuacccagaauua

SEQ ID NO: 3638687 - RNA, 17 nt, Human
uauuuugguacuuuuau

SEQ ID NO: 3638688 - RNA, 21 nt, Human
uauuuugguucuuaguucuca

SEQ ID NO: 3638689 - RNA, 18 nt, Human
uauuuuguaaaauguauu

SEQ ID NO: 3638690 - RNA, 13 nt, Human
uauuuuguaaacu

SEQ ID NO: 3638691 - RNA, 21 nt, Human
uauuuuguaaacucaaaauau

SEQ ID NO: 3638692 - RNA, 16 nt, Human
uauuuuguaacuucca

SEQ ID NO: 3638693 - RNA, 16 nt, Human
uauuuuguaauuauug

SEQ ID NO: 3638694 - RNA, 12 nt, Human
uauuuuguaugc

SEQ ID NO: 3638695 - RNA, 16 nt, Human
uauuuuguaugcaagc

SEQ ID NO: 3638696 - RNA, 20 nt, Human
uauuuuguaugcaagcaguu

SEQ ID NO: 3638697 - RNA, 14 nt, Human
uauuuugugugaaa

SEQ ID NO: 3638698 - RNA, 15 nt, Human
uauuuugugugaaau

SEQ ID NO: 3638699 - RNA, 13 nt, Human
uauuuuuaaagau

SEQ ID NO: 3638700 - RNA, 15 nt, Human
uauuuuuaaaggcau

SEQ ID NO: 3638701 - RNA, 13 nt, Human
uauuuuuaaauaa

SEQ ID NO: 3638702 - RNA, 18 nt, Human
uauuuuuaagaaagaaau

SEQ ID NO: 3638703 - RNA, 16 nt, Human
uauuuuuacauuuaaa

SEQ ID NO: 3638704 - RNA, 18 nt, Human
uauuuuuacugccacucu

SEQ ID NO: 3638705 - RNA, 14 nt, Human
uauuuuuagaauaa

SEQ ID NO: 3638706 - RNA, 22 nt, Human
uauuuuuagaugguuacacugu

SEQ ID NO: 3638707 - RNA, 23 nt, Human
uauuuuuagaugguuacacuguu

SEQ ID NO: 3638708 - RNA, 15 nt, Human
uauuuuuauacagua

SEQ ID NO: 3638709 - RNA, 22 nt, Human
uauuuuuauauaauaucuaaag

SEQ ID NO: 3638710 - RNA, 23 nt, Human
uauuuuuauauaauaucuaaagu

SEQ ID NO: 3638711 - RNA, 17 nt, Human
uauuuuuauauuuccuu

SEQ ID NO: 3638712 - RNA, 12 nt, Human
uauuuuuaucca

SEQ ID NO: 3638713 - RNA, 13 nt, Human
uauuuuuauuugu

SEQ ID NO: 3638714 - RNA, 13 nt, Human
uauuuuucaaaau

SEQ ID NO: 3638715 - RNA, 14 nt, Human
uauuuuucaaggaa

SEQ ID NO: 3638716 - RNA, 13 nt, Human
uauuuuucagaga

SEQ ID NO: 3638717 - RNA, 14 nt, Human
uauuuuuccuuuuu

SEQ ID NO: 3638718 - RNA, 14 nt, Human
uauuuuugaaaaau

SEQ ID NO: 3638719 - RNA, 13 nt, Human
uauuuuugacaga

SEQ ID NO: 3638720 - RNA, 18 nt, Human
uauuuuugcugcuucuga

SEQ ID NO: 3638721 - RNA, 19 nt, Human
uauuuuuggcagucugaau

SEQ ID NO: 3638722 - RNA, 23 nt, Human
uauuuuuguuggagccacucugu

SEQ ID NO: 3638723 - RNA, 20 nt, Human
uauuuuuguuucuuccaaag

SEQ ID NO: 3638724 - RNA, 18 nt, Human
uauuuuuguuuuuauuaa

SEQ ID NO: 3638725 - RNA, 23 nt, Human
uauuuuuuaauuugaugaaagcu

SEQ ID NO: 3638726 - RNA, 20 nt, Human
uauuuuuuacauuuuacaca

SEQ ID NO: 3638727 - RNA, 14 nt, Human
uauuuuuuauacag

SEQ ID NO: 3638728 - RNA, 13 nt, Human
uauuuuuucccaa

SEQ ID NO: 3638729 - RNA, 15 nt, Human
uauuuuuucuugcau

SEQ ID NO: 3638730 - RNA, 21 nt, Human
uauuuuuuggacuucaaagca

SEQ ID NO: 3638731 - RNA, 18 nt, Human
uauuuuuuuaaaaucacu

SEQ ID NO: 3638732 - RNA, 19 nt, Human
uauuuuuuuaaaaucacua

SEQ ID NO: 3638733 - RNA, 20 nt, Human
uauuuuuuuaauuuaacaug

SEQ ID NO: 3638734 - RNA, 12 nt, Human
uauuuuuuuccu

SEQ ID NO: 3638735 - RNA, 14 nt, Human
uauuuuuuucuacc

SEQ ID NO: 3638736 - RNA, 17 nt, Human
uauuuuuuucuauuuuu

SEQ ID NO: 3638737 - RNA, 16 nt, Human
uauuuuuuucugaaau

SEQ ID NO: 3638738 - RNA, 19 nt, Human
uauuuuuuugcaagugaag

SEQ ID NO: 3638739 - RNA, 15 nt, Human
uauuuuuuuuaaaga

SEQ ID NO: 3638740 - RNA, 17 nt, Human
uauuuuuuuuaaagaaa

SEQ ID NO: 3638741 - RNA, 17 nt, Human
uauuuuuuuuaaguauu

SEQ ID NO: 3638742 - RNA, 19 nt, Human
uauuuuuuuuaauauuauu

SEQ ID NO: 3638743 - RNA, 19 nt, Human
uauuuuuuuuaauuguauu

SEQ ID NO: 3638744 - RNA, 20 nt, Human
uauuuuuuuuuuuugaaaaa

SEQ ID NO: 3638745 - RNA, 19 nt, Human
ucaaaaaaaaaaaaaugca

SEQ ID NO: 3638746 - RNA, 14 nt, Human
ucaaaaaaacacua

SEQ ID NO: 3638747 - RNA, 15 nt, Human
ucaaaaaaagaaaaa

SEQ ID NO: 3638748 - RNA, 15 nt, Human
ucaaaaaacuuguaa

SEQ ID NO: 3638749 - RNA, 13 nt, Human
ucaaaaacuguau

SEQ ID NO: 3638750 - RNA, 14 nt, Human
ucaaaaagaaauca

SEQ ID NO: 3638751 - RNA, 12 nt, Human
ucaaaaagaacc

SEQ ID NO: 3638752 - RNA, 14 nt, Human
ucaaaaauacaaaa

SEQ ID NO: 3638753 - RNA, 15 nt, Human
ucaaaaauauaacuu

SEQ ID NO: 3638754 - RNA, 14 nt, Human
ucaaaaaucugaag

SEQ ID NO: 3638755 - RNA, 20 nt, Human
ucaaaaaucugaagauuguu

SEQ ID NO: 3638756 - RNA, 16 nt, Human
ucaaaaauugaagaga

SEQ ID NO: 3638757 - RNA, 18 nt, Human
ucaaaaauugaagagaga

SEQ ID NO: 3638758 - RNA, 21 nt, Human
ucaaaacacaucuuuccuguc

SEQ ID NO: 3638759 - RNA, 14 nt, Human
ucaaaacacugugg

SEQ ID NO: 3638760 - RNA, 24 nt, Human
ucaaaacacuuguaauuuuguauc

SEQ ID NO: 3638761 - RNA, 22 nt, Human
ucaaaacauugugccaugucaa

SEQ ID NO: 3638762 - RNA, 15 nt, Human
ucaaaaccuuuugaa

SEQ ID NO: 3638763 - RNA, 18 nt, Human
ucaaaacucauuuccuau

SEQ ID NO: 3638764 - RNA, 24 nt, Human
ucaaaacuggagucccaaauguca

SEQ ID NO: 3638765 - RNA, 18 nt, Human
ucaaaacuuuaaaccugu

SEQ ID NO: 3638766 - RNA, 18 nt, Human
ucaaaagaaaaggcaaaa

SEQ ID NO: 3638767 - RNA, 12 nt, Human
ucaaaagacaau

SEQ ID NO: 3638768 - RNA, 15 nt, Human
ucaaaagacaauucu

SEQ ID NO: 3638769 - RNA, 16 nt, Human
ucaaaagacaauucuu

SEQ ID NO: 3638770 - RNA, 19 nt, Human
ucaaaagacaauucuuuau

SEQ ID NO: 3638771 - RNA, 17 nt, Human
ucaaaagacauguugua

SEQ ID NO: 3638772 - RNA, 20 nt, Human
ucaaaagagaaaaacaaaac

SEQ ID NO: 3638773 - RNA, 20 nt, Human
ucaaaagagcacuuuaauaa

SEQ ID NO: 3638774 - RNA, 17 nt, Human
ucaaaagcuauuuaaag

SEQ ID NO: 3638775 - RNA, 21 nt, Human
ucaaaagggccaaagaaccaa

SEQ ID NO: 3638776 - RNA, 21 nt, Human
ucaaaagguauuauacaugug

SEQ ID NO: 3638777 - RNA, 13 nt, Human
ucaaaaggugccu

SEQ ID NO: 3638778 - RNA, 18 nt, Human
ucaaaaguauuuuccugu

SEQ ID NO: 3638779 - RNA, 13 nt, Human
ucaaaaguuccaa

SEQ ID NO: 3638780 - RNA, 14 nt, Human
ucaaaaguugaaau

SEQ ID NO: 3638781 - RNA, 16 nt, Human
ucaaaaguugaaauua

SEQ ID NO: 3638782 - RNA, 15 nt, Human
ucaaaaguuggacua

SEQ ID NO: 3638783 - RNA, 17 nt, Human
ucaaaaguuggacuaaa

SEQ ID NO: 3638784 - RNA, 20 nt, Human
ucaaaaguuggacuaaaugc

SEQ ID NO: 3638785 - RNA, 14 nt, Human
ucaaaaguuuguuu

SEQ ID NO: 3638786 - RNA, 20 nt, Human
ucaaaauaaaaaccaagaag

SEQ ID NO: 3638787 - RNA, 13 nt, Human
ucaaaauaauucu

SEQ ID NO: 3638788 - RNA, 14 nt, Human
ucaaaauaauuuua

SEQ ID NO: 3638789 - RNA, 21 nt, Human
ucaaaauaccaugccauuuaa

SEQ ID NO: 3638790 - RNA, 22 nt, Human
ucaaaauagggacuaucuaucu

SEQ ID NO: 3638791 - RNA, 18 nt, Human
ucaaaauaucaaguguug

SEQ ID NO: 3638792 - RNA, 12 nt, Human
ucaaaauauuua

SEQ ID NO: 3638793 - RNA, 13 nt, Human
ucaaaauauuuaa

SEQ ID NO: 3638794 - RNA, 14 nt, Human
ucaaaauauuuaaa

SEQ ID NO: 3638795 - RNA, 15 nt, Human
ucaaaauauuuaaaa

SEQ ID NO: 3638796 - RNA, 22 nt, Human
ucaaaauauuuaaaaaugucuu

SEQ ID NO: 3638797 - RNA, 16 nt, Human
ucaaaauauuuguaca

SEQ ID NO: 3638798 - RNA, 19 nt, Human
ucaaaauauuuguacauag

SEQ ID NO: 3638799 - RNA, 19 nt, Human
ucaaaauauuuuuaaaaga

SEQ ID NO: 3638800 - RNA, 16 nt, Human
ucaaaaucucuccacu

SEQ ID NO: 3638801 - RNA, 22 nt, Human
ucaaaaucucuccacuuucagc

SEQ ID NO: 3638802 - RNA, 12 nt, Human
ucaaaaugcuuu

SEQ ID NO: 3638803 - RNA, 17 nt, Human
ucaaaaugcuuuuuauu

SEQ ID NO: 3638804 - RNA, 14 nt, Human
ucaaaaugucuaag

SEQ ID NO: 3638805 - RNA, 14 nt, Human
ucaaaaugucugua

SEQ ID NO: 3638806 - RNA, 21 nt, Human
ucaaaauguuaucuucucaag

SEQ ID NO: 3638807 - RNA, 19 nt, Human
ucaaaauuguuacaaauug

SEQ ID NO: 3638808 - RNA, 13 nt, Human
ucaaaauuugcug

SEQ ID NO: 3638809 - RNA, 17 nt, Human
ucaaacaaagccagaag

SEQ ID NO: 3638810 - RNA, 13 nt, Human
ucaaacaagaaug

SEQ ID NO: 3638811 - RNA, 21 nt, Human
ucaaacaaugacaaagcagau

SEQ ID NO: 3638812 - RNA, 15 nt, Human
ucaaacacaaaugca

SEQ ID NO: 3638813 - RNA, 11 nt, Human
ucaaacacagu

SEQ ID NO: 3638814 - RNA, 20 nt, Human
ucaaacacaguuacacuugu

SEQ ID NO: 3638815 - RNA, 16 nt, Human
ucaaacacugcaggca

SEQ ID NO: 3638816 - RNA, 17 nt, Human
ucaaacacuugugacuu

SEQ ID NO: 3638817 - RNA, 22 nt, Human
ucaaacaguacacuaucuuaau

SEQ ID NO: 3638818 - RNA, 20 nt, Human
ucaaacaguagguuggcagu

SEQ ID NO: 3638819 - RNA, 22 nt, Human
ucaaacaugaaguguguuuccu

SEQ ID NO: 3638820 - RNA, 13 nt, Human
ucaaacauuuucu

SEQ ID NO: 3638821 - RNA, 15 nt, Human
ucaaacauuuugaaa

SEQ ID NO: 3638822 - RNA, 21 nt, Human
ucaaaccaguauacaagauaa

SEQ ID NO: 3638823 - RNA, 16 nt, Human
ucaaaccauaaacuuc

SEQ ID NO: 3638824 - RNA, 22 nt, Human
ucaaacccacgauuuucuccag

SEQ ID NO: 3638825 - RNA, 19 nt, Human
ucaaacccuagccuugcuu

SEQ ID NO: 3638826 - RNA, 20 nt, Human
ucaaacccuagccuugcuug

SEQ ID NO: 3638827 - RNA, 13 nt, Human
ucaaaccugugaa

SEQ ID NO: 3638828 - RNA, 13 nt, Human
ucaaacuaaaaga

SEQ ID NO: 3638829 - RNA, 21 nt, Human
ucaaacuacuuugcugcuaau

SEQ ID NO: 3638830 - RNA, 17 nt, Human
ucaaacuaucuggccau

SEQ ID NO: 3638831 - RNA, 22 nt, Human
ucaaacucaaugcuuuauuugu

SEQ ID NO: 3638832 - RNA, 21 nt, Human
ucaaacuccaagguucccuug

SEQ ID NO: 3638833 - RNA, 14 nt, Human
ucaaggcacucuag

SEQ ID NO: 3638834 - RNA, 15 nt, Human
ucaaggcacugccug

SEQ ID NO: 3638835 - RNA, 15 nt, Human
ucaaggccucccaca

SEQ ID NO: 3638836 - RNA, 15 nt, Human
ucaaggccugucccu

SEQ ID NO: 3638837 - RNA, 20 nt, Human
ucaaggcuuauauucaacca

SEQ ID NO: 3638838 - RNA, 14 nt, Human
ucaagggcuuuccu

SEQ ID NO: 3638839 - RNA, 21 nt, Human
ucaagggcuuuccugugccag

SEQ ID NO: 3638840 - RNA, 16 nt, Human
ucaagggggacugucu

SEQ ID NO: 3638841 - RNA, 20 nt, Human
ucaagguaaaauucuaaaua

SEQ ID NO: 3638842 - RNA, 15 nt, Human
ucaaggucacuguuu

SEQ ID NO: 3638843 - RNA, 19 nt, Human
ucaaggucacuguuuccug

SEQ ID NO: 3638844 - RNA, 14 nt, Human
ucaagguucuaacc

SEQ ID NO: 3638845 - RNA, 13 nt, Human
ucaagguuuuagg

SEQ ID NO: 3638846 - RNA, 23 nt, Human
ucaaguaagaagacaugaaccaa

SEQ ID NO: 3638847 - RNA, 15 nt, Human
ucaaguaauacaaac

SEQ ID NO: 3638848 - RNA, 15 nt, Human
ucaaguaauugugaa

SEQ ID NO: 3638849 - RNA, 24 nt, Human
ucaaguacauaaaguacauaacaa

SEQ ID NO: 3638850 - RNA, 21 nt, Human
ucaaguauuauaccuuuuuua

SEQ ID NO: 3638851 - RNA, 15 nt, Human
ucaagucaaauuaau

SEQ ID NO: 3638852 - RNA, 18 nt, Human
ucaagucaaucauuucuc

SEQ ID NO: 3638853 - RNA, 19 nt, Human
ucaaguccugccucuuaaa

SEQ ID NO: 3638854 - RNA, 14 nt, Human
ucaagucucugcug

SEQ ID NO: 3638855 - RNA, 17 nt, Human
ucaagucucugcuggcc

SEQ ID NO: 3638856 - RNA, 12 nt, Human
ucaagucuuccc

SEQ ID NO: 3638857 - RNA, 18 nt, Human
ucaagucuuucucuuucc

SEQ ID NO: 3638858 - RNA, 15 nt, Human
ucaagugaaaaagga

SEQ ID NO: 3638859 - RNA, 17 nt, Human
ucaagugauccucccac

SEQ ID NO: 3638860 - RNA, 17 nt, Human
ucaagugauucucaugc

SEQ ID NO: 3638861 - RNA, 20 nt, Human
ucaagugauucucaugccuc

SEQ ID NO: 3638862 - RNA, 22 nt, Human
ucaagugauucucaugccucag

SEQ ID NO: 3638863 - RNA, 16 nt, Human
ucaagugauucuccug

SEQ ID NO: 3638864 - RNA, 17 nt, Human
ucaagugauucuccugc

SEQ ID NO: 3638865 - RNA, 12 nt, Human
ucaagugccuua

SEQ ID NO: 3638866 - RNA, 21 nt, Human
ucaaguuauugacaaacucuc

SEQ ID NO: 3638867 - RNA, 17 nt, Human
ucaaguuauuguacagc

SEQ ID NO: 3638868 - RNA, 14 nt, Human
ucaaguucuaagau

SEQ ID NO: 3638869 - RNA, 19 nt, Human
ucaaguucuaagauucuaa

SEQ ID NO: 3638870 - RNA, 16 nt, Human
ucaaguugcacacuca

SEQ ID NO: 3638871 - RNA, 21 nt, Human
ucaaguugggagccugaaaua

SEQ ID NO: 3638872 - RNA, 17 nt, Human
ucaaguugucagguuau

SEQ ID NO: 3638873 - RNA, 17 nt, Human
ucaaguugugcuuguuu

SEQ ID NO: 3638874 - RNA, 15 nt, Human
ucaaguuuuaaaguu

SEQ ID NO: 3638875 - RNA, 16 nt, Human
ucaaguuuuucagaaa

SEQ ID NO: 3638876 - RNA, 13 nt, Human
ucaauaaaaucau

SEQ ID NO: 3638877 - RNA, 14 nt, Human
ucaauaaaaucaug

SEQ ID NO: 3638878 - RNA, 21 nt, Human
ucaauaaaaucauguacauuu

SEQ ID NO: 3638879 - RNA, 21 nt, Human
ucaauaaaauccauacauuug

SEQ ID NO: 3638880 - RNA, 19 nt, Human
ucaauaaaaugugauuuuu

SEQ ID NO: 3638881 - RNA, 23 nt, Human
ucaauaaaaugugauuuuucuga

SEQ ID NO: 3638882 - RNA, 15 nt, Human
ucaauaaacagcagg

SEQ ID NO: 3638883 - RNA, 19 nt, Human
ucaauaaacuaaagaaaaa

SEQ ID NO: 3638884 - RNA, 21 nt, Human
ucaauaaagaaaacuuccaua

SEQ ID NO: 3638885 - RNA, 11 nt, Human
ucaauaaagua

SEQ ID NO: 3638886 - RNA, 12 nt, Human
ucaauaaaguau

SEQ ID NO: 3638887 - RNA, 17 nt, Human
ucaauaaaguaucuaca

SEQ ID NO: 3638888 - RNA, 14 nt, Human
ucaauaaaguauuu

SEQ ID NO: 3638889 - RNA, 22 nt, Human
ucaauaaaguauuuaauuagug

SEQ ID NO: 3638890 - RNA, 12 nt, Human
ucaauaaaguuu

SEQ ID NO: 3638891 - RNA, 15 nt, Human
ucaauaaaguuugau

SEQ ID NO: 3638892 - RNA, 19 nt, Human
ucaauaaaguuugaucuuc

SEQ ID NO: 3638893 - RNA, 16 nt, Human
ucaauaacagccgcuc

SEQ ID NO: 3638894 - RNA, 20 nt, Human
ucaauaacagccgcuccaga

SEQ ID NO: 3638895 - RNA, 14 nt, Human
ucaauaacgaaguu

SEQ ID NO: 3638896 - RNA, 14 nt, Human
ucaauaagccuugu

SEQ ID NO: 3638897 - RNA, 14 nt, Human
ucaauacacuaguu

SEQ ID NO: 3638898 - RNA, 22 nt, Human
ucaauagccacuaaccuugccu

SEQ ID NO: 3638899 - RNA, 17 nt, Human
ucaauagcguguguaga

SEQ ID NO: 3638900 - RNA, 13 nt, Human
ucaauaggaaaaa

SEQ ID NO: 3638901 - RNA, 22 nt, Human
ucaauaggaaaaacugauuuuu

SEQ ID NO: 3638902 - RNA, 13 nt, Human
ucaauaguaauau

SEQ ID NO: 3638903 - RNA, 22 nt, Human
ucaauauaauguuuuuaauauu

SEQ ID NO: 3638904 - RNA, 20 nt, Human
ucaauauauugaacuuuugu

SEQ ID NO: 3638905 - RNA, 14 nt, Human
ucaauauccuuugc

SEQ ID NO: 3638906 - RNA, 19 nt, Human
ucaauaucuaauauauaug

SEQ ID NO: 3638907 - RNA, 21 nt, Human
ucaauaucuaauauauaugaa

SEQ ID NO: 3638908 - RNA, 14 nt, Human
ucaauauuaaauac

SEQ ID NO: 3638909 - RNA, 17 nt, Human
ucaauauuaaauacaga

SEQ ID NO: 3638910 - RNA, 16 nt, Human
ucaauauucaauaaag

SEQ ID NO: 3638911 - RNA, 18 nt, Human
ucaauauuccugaaugaa

SEQ ID NO: 3638912 - RNA, 15 nt, Human
ucaauauugucauuc

SEQ ID NO: 3638913 - RNA, 17 nt, Human
ucaauauuuaaacaugg

SEQ ID NO: 3638914 - RNA, 13 nt, Human
ucaauauuuauua

SEQ ID NO: 3638915 - RNA, 19 nt, Human
ucaauauuucagauaauca

SEQ ID NO: 3638916 - RNA, 16 nt, Human
ucaauauuuuccauga

SEQ ID NO: 3638917 - RNA, 17 nt, Human
ucaauauuuuccaugaa

SEQ ID NO: 3638918 - RNA, 18 nt, Human
ucaauauuuuccaugaaa

SEQ ID NO: 3638919 - RNA, 16 nt, Human
ucaauauuuuuagaua

SEQ ID NO: 3638920 - RNA, 12 nt, Human
ucaaucacagcu

SEQ ID NO: 3638921 - RNA, 15 nt, Human
ucaaucaguauaauu

SEQ ID NO: 3638922 - RNA, 20 nt, Human
ucaaucaucugugugaaaau

SEQ ID NO: 3638923 - RNA, 14 nt, Human
ucaaucaugucagu

SEQ ID NO: 3638924 - RNA, 12 nt, Human
ucaaucauuucu

SEQ ID NO: 3638925 - RNA, 13 nt, Human
ucaaucauuucua

SEQ ID NO: 3638926 - RNA, 16 nt, Human
ucaaucauuucuauua

SEQ ID NO: 3638927 - RNA, 14 nt, Human
ucaaucauuucuca

SEQ ID NO: 3638928 - RNA, 18 nt, Human
ucaauccagaugguggga

SEQ ID NO: 3638929 - RNA, 13 nt, Human
ucaaucccaaaag

SEQ ID NO: 3638930 - RNA, 13 nt, Human
ucaaucccagccu

SEQ ID NO: 3638931 - RNA, 22 nt, Human
ucaauccccucauucaggaaaa

SEQ ID NO: 3638932 - RNA, 22 nt, Human
ucaauccuaauuucuccucccu

SEQ ID NO: 3638933 - RNA, 18 nt, Human
ucaaucucguauagaagu

SEQ ID NO: 3638934 - RNA, 21 nt, Human
ucaaucucguauagaagucuu

SEQ ID NO: 3638935 - RNA, 22 nt, Human
ucaaucucguauagaagucuuc

SEQ ID NO: 3638936 - RNA, 19 nt, Human
ucaaucuggauucauauuu

SEQ ID NO: 3638937 - RNA, 16 nt, Human
ucaaucuugcauguaa

SEQ ID NO: 3638938 - RNA, 18 nt, Human
ucaaucuugcauguaacg

SEQ ID NO: 3638939 - RNA, 15 nt, Human
ucaaugaauauugaa

SEQ ID NO: 3638940 - RNA, 15 nt, Human
ucaaugacagagccu

SEQ ID NO: 3638941 - RNA, 14 nt, Human
ucaaugacaugaau

SEQ ID NO: 3638942 - RNA, 22 nt, Human
ucaaugacaugaauuuuagcuu

SEQ ID NO: 3638943 - RNA, 13 nt, Human
ucaaugagagcau

SEQ ID NO: 3638944 - RNA, 16 nt, Human
ucaaugagguguccaa

SEQ ID NO: 3638945 - RNA, 17 nt, Human
ucaaugagguguccaac

SEQ ID NO: 3638946 - RNA, 11 nt, Human
ucaaugaucua

SEQ ID NO: 3638947 - RNA, 21 nt, Human
ucaaugaucuagguuuaacuc

SEQ ID NO: 3638948 - RNA, 18 nt, Human
ucaaugcacugacauugu

SEQ ID NO: 3638949 - RNA, 13 nt, Human
ucaaugcagccag

SEQ ID NO: 3638950 - RNA, 17 nt, Human
ucaaugcuauaacuaug

SEQ ID NO: 3638951 - RNA, 12 nt, Human
ucaaugcuauuu

SEQ ID NO: 3638952 - RNA, 15 nt, Human
ucaaugcuauuuuug

SEQ ID NO: 3638953 - RNA, 13 nt, Human
ucaaugcucauaa

SEQ ID NO: 3638954 - RNA, 17 nt, Human
ucaaugcuuuauuugua

SEQ ID NO: 3638955 - RNA, 14 nt, Human
ucaaugggcaauga

SEQ ID NO: 3638956 - RNA, 17 nt, Human
ucaaugguuugcaagga

SEQ ID NO: 3638957 - RNA, 22 nt, Human
ucaauguacuaggauacugcug

SEQ ID NO: 3638958 - RNA, 15 nt, Human
ucaaugucaaguacc

SEQ ID NO: 3638959 - RNA, 11 nt, Human
ucaaugucacu

SEQ ID NO: 3638960 - RNA, 12 nt, Human
ucaaugugaaaa

SEQ ID NO: 3638961 - RNA, 22 nt, Human
ucaauguguauaaauugucuuu

SEQ ID NO: 3638962 - RNA, 12 nt, Human
ucaauguucauu

SEQ ID NO: 3638963 - RNA, 13 nt, Human
ucaauguucauug

SEQ ID NO: 3638964 - RNA, 16 nt, Human
ucaauguucauuguaa

SEQ ID NO: 3638965 - RNA, 24 nt, Human
ucaauguucauuguaauguuacug

SEQ ID NO: 3638966 - RNA, 22 nt, Human
ucaauguuuaugcaaggaagga

SEQ ID NO: 3638967 - RNA, 23 nt, Human
ucaauguuuaugcaaggaaggaa

SEQ ID NO: 3638968 - RNA, 23 nt, Human
ucaauguuugaggagcauguuuu

SEQ ID NO: 3638969 - RNA, 13 nt, Human
ucaauuaaacgga

SEQ ID NO: 3638970 - RNA, 15 nt, Human
ucaauuaaacggauu

SEQ ID NO: 3638971 - RNA, 18 nt, Human
ucaauuaaacggauuauu

SEQ ID NO: 3638972 - RNA, 19 nt, Human
ucaauuaaacggauuauuu

SEQ ID NO: 3638973 - RNA, 17 nt, Human
ucaauuaaagaaauaau

SEQ ID NO: 3638974 - RNA, 19 nt, Human
ucaauuaaagaaauaauuu

SEQ ID NO: 3638975 - RNA, 16 nt, Human
ucaauuaaauguaggu

SEQ ID NO: 3638976 - RNA, 11 nt, Human
ucaauuaauaa

SEQ ID NO: 3638977 - RNA, 21 nt, Human
ucaauuaccagaaagauaaca

SEQ ID NO: 3638978 - RNA, 16 nt, Human
ucaauuacucuauaau

SEQ ID NO: 3638979 - RNA, 20 nt, Human
ucacccccucccacccccag

SEQ ID NO: 3638980 - RNA, 13 nt, Human
ucacccccucggg

SEQ ID NO: 3638981 - RNA, 14 nt, Human
ucacccccucgggu

SEQ ID NO: 3638982 - RNA, 18 nt, Human
ucacccccuucuccaucc

SEQ ID NO: 3638983 - RNA, 16 nt, Human
ucaccccgaggcccug

SEQ ID NO: 3638984 - RNA, 18 nt, Human
ucaccccgaggcccugca

SEQ ID NO: 3638985 - RNA, 21 nt, Human
ucaccccgcuguaagcuccuu

SEQ ID NO: 3638986 - RNA, 17 nt, Human
ucaccccggcaggcccu

SEQ ID NO: 3638987 - RNA, 18 nt, Human
ucaccccggcaggcccug

SEQ ID NO: 3638988 - RNA, 23 nt, Human
ucaccccggcaggcccugcagug

SEQ ID NO: 3638989 - RNA, 12 nt, Human
ucaccccuccac

SEQ ID NO: 3638990 - RNA, 14 nt, Human
ucaccccugcccug

SEQ ID NO: 3638991 - RNA, 18 nt, Human
ucaccccugguucucauc

SEQ ID NO: 3638992 - RNA, 19 nt, Human
ucaccccugguucucaucu

SEQ ID NO: 3638993 - RNA, 17 nt, Human
ucaccccuguccucacu

SEQ ID NO: 3638994 - RNA, 15 nt, Human
ucaccccuguuucug

SEQ ID NO: 3638995 - RNA, 16 nt, Human
ucacccgaggcugccc

SEQ ID NO: 3638996 - RNA, 18 nt, Human
ucacccgcuaagagggag

SEQ ID NO: 3638997 - RNA, 16 nt, Human
ucacccggugaccucu

SEQ ID NO: 3638998 - RNA, 14 nt, Human
ucacccuccaccuc

SEQ ID NO: 3638999 - RNA, 20 nt, Human
ucacccuccaccucuucacc

SEQ ID NO: 3639000 - RNA, 18 nt, Human
ucacccucguuuccagug

SEQ ID NO: 3639001 - RNA, 19 nt, Human
ucacccugagccccuuccu

SEQ ID NO: 3639002 - RNA, 21 nt, Human
ucacccugagccccuuccuug

SEQ ID NO: 3639003 - RNA, 19 nt, Human
ucacccuuaacccaaggag

SEQ ID NO: 3639004 - RNA, 13 nt, Human
ucacccuuguccu

SEQ ID NO: 3639005 - RNA, 19 nt, Human
ucaccgaaaacguggcugc

SEQ ID NO: 3639006 - RNA, 23 nt, Human
ucaccgaaaacguggcugcuuca

SEQ ID NO: 3639007 - RNA, 16 nt, Human
ucaccgagugggggca

SEQ ID NO: 3639008 - RNA, 19 nt, Human
ucaccggccgauggagaca

SEQ ID NO: 3639009 - RNA, 22 nt, Human
ucaccggcucucaccuggcccu

SEQ ID NO: 3639010 - RNA, 21 nt, Human
ucaccguggaccuuccugcca

SEQ ID NO: 3639011 - RNA, 14 nt, Human
ucaccuaacucaua

SEQ ID NO: 3639012 - RNA, 17 nt, Human
ucaccuaagagauucug

SEQ ID NO: 3639013 - RNA, 18 nt, Human
ucaccuagaaacuuguua

SEQ ID NO: 3639014 - RNA, 13 nt, Human
ucaccuagagcca

SEQ ID NO: 3639015 - RNA, 14 nt, Human
ucaccuaggaagcc

SEQ ID NO: 3639016 - RNA, 17 nt, Human
ucaccuaggaagccuca

SEQ ID NO: 3639017 - RNA, 20 nt, Human
ucaccuaggaagccucagau

SEQ ID NO: 3639018 - RNA, 23 nt, Human
ucaccuaggaagccucagauucc

SEQ ID NO: 3639019 - RNA, 16 nt, Human
ucaccucacucagcac

SEQ ID NO: 3639020 - RNA, 19 nt, Human
ucaccucacucagcaccac

SEQ ID NO: 3639021 - RNA, 12 nt, Human
ucaccucagccu

SEQ ID NO: 3639022 - RNA, 13 nt, Human
ucaccucauggaa

SEQ ID NO: 3639023 - RNA, 14 nt, Human
ucaccucauggaau

SEQ ID NO: 3639024 - RNA, 21 nt, Human
ucaccuccggucgugucucug

SEQ ID NO: 3639025 - RNA, 22 nt, Human
ucaccuccucuaagguugggca

SEQ ID NO: 3639026 - RNA, 12 nt, Human
ucaccuccugcu

SEQ ID NO: 3639027 - RNA, 13 nt, Human
ucaccuccugcug

SEQ ID NO: 3639028 - RNA, 14 nt, Human
ucaccuccugcugg

SEQ ID NO: 3639029 - RNA, 14 nt, Human
ucaccuccuucaau

SEQ ID NO: 3639030 - RNA, 22 nt, Human
ucaccucuagguccccauacuc

SEQ ID NO: 3639031 - RNA, 13 nt, Human
ucaccucucccac

SEQ ID NO: 3639032 - RNA, 13 nt, Human
ucaccucugccuc

SEQ ID NO: 3639033 - RNA, 18 nt, Human
ucaccucuggacuggcua

SEQ ID NO: 3639034 - RNA, 19 nt, Human
ucaccucuggacuggcuag

SEQ ID NO: 3639035 - RNA, 23 nt, Human
ucaccucuuaugcacaccuccca

SEQ ID NO: 3639036 - RNA, 23 nt, Human
ucaccugaagacucauucuucug

SEQ ID NO: 3639037 - RNA, 23 nt, Human
ucaccugagcccggaugcuucuc

SEQ ID NO: 3639038 - RNA, 17 nt, Human
ucaccugaggucgggag

SEQ ID NO: 3639039 - RNA, 19 nt, Human
ucaccugagucacccuacc

SEQ ID NO: 3639040 - RNA, 21 nt, Human
ucaccugauucaacuaaaaaa

SEQ ID NO: 3639041 - RNA, 21 nt, Human
ucaccugcaaagcucuguggc

SEQ ID NO: 3639042 - RNA, 13 nt, Human
ucaccugcacuaa

SEQ ID NO: 3639043 - RNA, 15 nt, Human
ucaccugccccucaa

SEQ ID NO: 3639044 - RNA, 16 nt, Human
ucaccugccccucaac

SEQ ID NO: 3639045 - RNA, 20 nt, Human
ucaccugcuggccccucacc

SEQ ID NO: 3639046 - RNA, 23 nt, Human
ucaccuggcuuguuuauuuugug

SEQ ID NO: 3639047 - RNA, 17 nt, Human
ucaccugggcaccuggg

SEQ ID NO: 3639048 - RNA, 18 nt, Human
ucaccuggggcugcuggc

SEQ ID NO: 3639049 - RNA, 20 nt, Human
ucaccuggggcugcuggccu

SEQ ID NO: 3639050 - RNA, 17 nt, Human
ucaccuguaaaacuuua

SEQ ID NO: 3639051 - RNA, 17 nt, Human
ucaccuguaaaccugag

SEQ ID NO: 3639052 - RNA, 15 nt, Human
ucaccuguacucuuc

SEQ ID NO: 3639053 - RNA, 21 nt, Human
ucaccugugcuucgggcccuu

SEQ ID NO: 3639054 - RNA, 20 nt, Human
ucaccuguugcuuacaauuu

SEQ ID NO: 3639055 - RNA, 21 nt, Human
ucaccuguuuuuaagcuguuu

SEQ ID NO: 3639056 - RNA, 19 nt, Human
ucaccuuagaccaccaagc

SEQ ID NO: 3639057 - RNA, 21 nt, Human
ucaccuuagaccaccaagccu

SEQ ID NO: 3639058 - RNA, 13 nt, Human
ucaccuucccuug

SEQ ID NO: 3639059 - RNA, 16 nt, Human
ucaccuucccuugcca

SEQ ID NO: 3639060 - RNA, 21 nt, Human
ucaccuucguuuacuaugccu

SEQ ID NO: 3639061 - RNA, 18 nt, Human
ucaccuugcaacacacag

SEQ ID NO: 3639062 - RNA, 19 nt, Human
ucaccuugcaacacacaga

SEQ ID NO: 3639063 - RNA, 23 nt, Human
ucaccuuggcaccagacacccag

SEQ ID NO: 3639064 - RNA, 12 nt, Human
ucaccuuuguag

SEQ ID NO: 3639065 - RNA, 18 nt, Human
ucaccuuuguccccaccg

SEQ ID NO: 3639066 - RNA, 16 nt, Human
ucaccuuuuaaauccu

SEQ ID NO: 3639067 - RNA, 18 nt, Human
ucaccuuuuaaauccugu

SEQ ID NO: 3639068 - RNA, 23 nt, Human
ucaccuuuuaaauccuguugaaa

SEQ ID NO: 3639069 - RNA, 13 nt, Human
ucacgacgcugca

SEQ ID NO: 3639070 - RNA, 16 nt, Human
ucacgcaacuugaaau

SEQ ID NO: 3639071 - RNA, 15 nt, Human
ucacgcaccucccau

SEQ ID NO: 3639072 - RNA, 17 nt, Human
ucacgcaccucccaucc

SEQ ID NO: 3639073 - RNA, 14 nt, Human
ucacgcaugcagug

SEQ ID NO: 3639074 - RNA, 22 nt, Human
ucacgccacugcacuccagccu

SEQ ID NO: 3639075 - RNA, 18 nt, Human
ucacgccagacuucccac

SEQ ID NO: 3639076 - RNA, 20 nt, Human
ucacgccuguaaucccagca

SEQ ID NO: 3639077 - RNA, 16 nt, Human
ucacgcuccccgccug

SEQ ID NO: 3639078 - RNA, 14 nt, Human
ucacgcuucacagu

SEQ ID NO: 3639079 - RNA, 17 nt, Human
ucacgcuuuccugaauc

SEQ ID NO: 3639080 - RNA, 14 nt, Human
ucacggaagagccu

SEQ ID NO: 3639081 - RNA, 16 nt, Human
ucacggaaguuuucaa

SEQ ID NO: 3639082 - RNA, 18 nt, Human
ucacggagauaugaagag

SEQ ID NO: 3639083 - RNA, 22 nt, Human
ucacggcaggacaacgaggaag

SEQ ID NO: 3639084 - RNA, 23 nt, Human
ucacggcaggacaacgaggaagc

SEQ ID NO: 3639085 - RNA, 13 nt, Human
ucacggcucacug

SEQ ID NO: 3639086 - RNA, 14 nt, Human
ucacggcugcgcac

SEQ ID NO: 3639087 - RNA, 20 nt, Human
ucacgggcaugggcacuccc

SEQ ID NO: 3639088 - RNA, 17 nt, Human
ucacggugccagguuuu

SEQ ID NO: 3639089 - RNA, 18 nt, Human
ucacguaaagcuagaaau

SEQ ID NO: 3639090 - RNA, 14 nt, Human
ucacgucauaggaa

SEQ ID NO: 3639091 - RNA, 17 nt, Human
ucacgugcgcugggcac

SEQ ID NO: 3639092 - RNA, 17 nt, Human
ucacgugguccuaaucu

SEQ ID NO: 3639093 - RNA, 18 nt, Human
ucacguguacuggcuccu

SEQ ID NO: 3639094 - RNA, 17 nt, Human
ucacguguaguguccau

SEQ ID NO: 3639095 - RNA, 12 nt, Human
ucacguguguga

SEQ ID NO: 3639096 - RNA, 17 nt, Human
ucacgugugugacucag

SEQ ID NO: 3639097 - RNA, 23 nt, Human
ucacguuuuguuuugugccaacc

SEQ ID NO: 3639098 - RNA, 21 nt, Human
ucacuaaagcaugaaauguga

SEQ ID NO: 3639099 - RNA, 19 nt, Human
ucacuaacauuauauugca

SEQ ID NO: 3639100 - RNA, 22 nt, Human
ucacuaacauuauauugcaaug

SEQ ID NO: 3639101 - RNA, 15 nt, Human
ucacuaauacacagu

SEQ ID NO: 3639102 - RNA, 19 nt, Human
ucacuaauacuaauucauu

SEQ ID NO: 3639103 - RNA, 14 nt, Human
ucacuaauucauua

SEQ ID NO: 3639104 - RNA, 22 nt, Human
ucacuacccaucgguguccauu

SEQ ID NO: 3639105 - RNA, 20 nt, Human
ucacuacccuauucucucuu

SEQ ID NO: 3639106 - RNA, 15 nt, Human
ucacuaccuccucag

SEQ ID NO: 3639107 - RNA, 16 nt, Human
ucacuaccuccucagg

SEQ ID NO: 3639108 - RNA, 18 nt, Human
ucacuaccuccucaggga

SEQ ID NO: 3639109 - RNA, 21 nt, Human
ucacuacucacagucucuuua

SEQ ID NO: 3639110 - RNA, 18 nt, Human
ucacuagcccuccuuuuu

SEQ ID NO: 3639111 - RNA, 21 nt, Human
ucacuagcccuccuuuuucca

SEQ ID NO: 3639112 - RNA, 15 nt, Human
ucacuagcuuugccu

SEQ ID NO: 3639113 - RNA, 16 nt, Human
ucacuaggcuucuggu

SEQ ID NO: 3639114 - RNA, 22 nt, Human
ucacuagugaccccuucccugu

SEQ ID NO: 3639115 - RNA, 17 nt, Human
ucacuauaaaugguguu

SEQ ID NO: 3639116 - RNA, 22 nt, Human
ucacuaugaaucuauuauacug

SEQ ID NO: 3639117 - RNA, 19 nt, Human
ucacuauggugccaaugga

SEQ ID NO: 3639118 - RNA, 20 nt, Human
ucacuauguugcccaggcag

SEQ ID NO: 3639119 - RNA, 18 nt, Human
ucacuauucaaguauuag

SEQ ID NO: 3639120 - RNA, 17 nt, Human
ucacuauuuccuuuaua

SEQ ID NO: 3639121 - RNA, 18 nt, Human
ucacuauuuccuuuauaa

SEQ ID NO: 3639122 - RNA, 18 nt, Human
ucacuauuuuuauuuaua

SEQ ID NO: 3639123 - RNA, 18 nt, Human
ucauuuaucuauaauuua

SEQ ID NO: 3639124 - RNA, 17 nt, Human
ucauuuaugauacaaaa

SEQ ID NO: 3639125 - RNA, 20 nt, Human
ucauuuauuuuaaaaaauga

SEQ ID NO: 3639126 - RNA, 23 nt, Human
ucauuucaccccucccuuucucc

SEQ ID NO: 3639127 - RNA, 12 nt, Human
ucauuucaccug

SEQ ID NO: 3639128 - RNA, 21 nt, Human
ucauuucacuguagcucuaaa

SEQ ID NO: 3639129 - RNA, 11 nt, Human
ucauuucaucu

SEQ ID NO: 3639130 - RNA, 14 nt, Human
ucauuucaucucau

SEQ ID NO: 3639131 - RNA, 15 nt, Human
ucauuucaucucauu

SEQ ID NO: 3639132 - RNA, 16 nt, Human
ucauuucaucucauuu

SEQ ID NO: 3639133 - RNA, 15 nt, Human
ucauuucaugcucug

SEQ ID NO: 3639134 - RNA, 14 nt, Human
ucauuucauuguau

SEQ ID NO: 3639135 - RNA, 13 nt, Human
ucauuuccaagca

SEQ ID NO: 3639136 - RNA, 21 nt, Human
ucauuuccauguaugcauaau

SEQ ID NO: 3639137 - RNA, 22 nt, Human
ucauuuccccauaacucaaugg

SEQ ID NO: 3639138 - RNA, 12 nt, Human
ucauuuccugcc

SEQ ID NO: 3639139 - RNA, 14 nt, Human
ucauuuccugcccu

SEQ ID NO: 3639140 - RNA, 15 nt, Human
ucauuuccugcccuu

SEQ ID NO: 3639141 - RNA, 13 nt, Human
ucauuucuauuuc

SEQ ID NO: 3639142 - RNA, 17 nt, Human
ucauuucuauuucuccu

SEQ ID NO: 3639143 - RNA, 17 nt, Human
ucauuucucacugugua

SEQ ID NO: 3639144 - RNA, 14 nt, Human
ucauuucucaucca

SEQ ID NO: 3639145 - RNA, 12 nt, Human
ucauuucugauu

SEQ ID NO: 3639146 - RNA, 16 nt, Human
ucauuucugcaucagc

SEQ ID NO: 3639147 - RNA, 22 nt, Human
ucauuucugcaucagcugcuga

SEQ ID NO: 3639148 - RNA, 16 nt, Human
ucauuugaacaacuag

SEQ ID NO: 3639149 - RNA, 18 nt, Human
ucauuugacuaagagucu

SEQ ID NO: 3639150 - RNA, 15 nt, Human
ucauuugagucucuu

SEQ ID NO: 3639151 - RNA, 14 nt, Human
ucauuugcuuugga

SEQ ID NO: 3639152 - RNA, 23 nt, Human
ucauuugggguagcuagaggaac

SEQ ID NO: 3639153 - RNA, 20 nt, Human
ucauuugguucauuaauucu

SEQ ID NO: 3639154 - RNA, 16 nt, Human
ucauuugucacacacu

SEQ ID NO: 3639155 - RNA, 22 nt, Human
ucauuuguggguuuuuauuucc

SEQ ID NO: 3639156 - RNA, 22 nt, Human
ucauuuguuaaaauuaucaaua

SEQ ID NO: 3639157 - RNA, 12 nt, Human
ucauuuguugug

SEQ ID NO: 3639158 - RNA, 20 nt, Human
ucauuuguugugaugucuuu

SEQ ID NO: 3639159 - RNA, 22 nt, Human
ucauuuguugugaugucuuuuc

SEQ ID NO: 3639160 - RNA, 13 nt, Human
ucauuuguuuaaa

SEQ ID NO: 3639161 - RNA, 14 nt, Human
ucauuuuacaguua

SEQ ID NO: 3639162 - RNA, 22 nt, Human
ucauuuuacaguuacuuuuccu

SEQ ID NO: 3639163 - RNA, 15 nt, Human
ucauuuuauauugaa

SEQ ID NO: 3639164 - RNA, 15 nt, Human
ucauuuuauguuaag

SEQ ID NO: 3639165 - RNA, 12 nt, Human
ucauuuucauua

SEQ ID NO: 3639166 - RNA, 14 nt, Human
ucauuuucuagaua

SEQ ID NO: 3639167 - RNA, 20 nt, Human
ucauuuucuagauacaauaa

SEQ ID NO: 3639168 - RNA, 16 nt, Human
ucauuuucuauaacag

SEQ ID NO: 3639169 - RNA, 14 nt, Human
ucauuuucugcaag

SEQ ID NO: 3639170 - RNA, 15 nt, Human
ucauuuucugcauuu

SEQ ID NO: 3639171 - RNA, 17 nt, Human
ucauuuugaagcuaauu

SEQ ID NO: 3639172 - RNA, 15 nt, Human
ucauuuugagcugaa

SEQ ID NO: 3639173 - RNA, 12 nt, Human
ucauuuugcuuu

SEQ ID NO: 3639174 - RNA, 13 nt, Human
ucauuuugcuuua

SEQ ID NO: 3639175 - RNA, 23 nt, Human
ucauuuugggacaauuguuuuaa

SEQ ID NO: 3639176 - RNA, 17 nt, Human
ucauuuuguaacaaaug

SEQ ID NO: 3639177 - RNA, 17 nt, Human
ucauuuuguguugaaga

SEQ ID NO: 3639178 - RNA, 19 nt, Human
ucauuuuguguugaagagc

SEQ ID NO: 3639179 - RNA, 21 nt, Human
ucauuuuguugcuuuugugaa

SEQ ID NO: 3639180 - RNA, 18 nt, Human
ucauuuuuaaucaugaaa

SEQ ID NO: 3639181 - RNA, 19 nt, Human
ucauuuuuaaucaugaaau

SEQ ID NO: 3639182 - RNA, 12 nt, Human
ucauuuuuacaa

SEQ ID NO: 3639183 - RNA, 18 nt, Human
ucauuuuucagaccuuuu

SEQ ID NO: 3639184 - RNA, 22 nt, Human
ucauuuuugaaacugcauuugu

SEQ ID NO: 3639185 - RNA, 17 nt, Human
ucauuuuugccauacau

SEQ ID NO: 3639186 - RNA, 21 nt, Human
ucauuuuuguacaguuugcug

SEQ ID NO: 3639187 - RNA, 23 nt, Human
ucauuuuuguacaguuugcugua

SEQ ID NO: 3639188 - RNA, 19 nt, Human
ucauuuuuguuucuaccuc

SEQ ID NO: 3639189 - RNA, 20 nt, Human
ucauuuuuguuucuaccucc

SEQ ID NO: 3639190 - RNA, 21 nt, Human
ucauuuuuuauauauaugcau

SEQ ID NO: 3639191 - RNA, 22 nt, Human
ucauuuuuuauauauaugcaua

SEQ ID NO: 3639192 - RNA, 13 nt, Human
ucauuuuuuccug

SEQ ID NO: 3639193 - RNA, 17 nt, Human
ucauuuuuuccuguuug

SEQ ID NO: 3639194 - RNA, 13 nt, Human
ucauuuuuucuua

SEQ ID NO: 3639195 - RNA, 13 nt, Human
ucauuuuuuuuaa

SEQ ID NO: 3639196 - RNA, 22 nt, Human
ucauuuuuuuucuuugaauaaa

SEQ ID NO: 3639197 - RNA, 15 nt, Human
uccaaaaaaauacug

SEQ ID NO: 3639198 - RNA, 22 nt, Human
uccaaaaagauuuucagaaaau

SEQ ID NO: 3639199 - RNA, 15 nt, Human
uccaaaaaucugccu

SEQ ID NO: 3639200 - RNA, 21 nt, Human
uccaaaaauguguaagaacaa

SEQ ID NO: 3639201 - RNA, 19 nt, Human
uccaaaaccgccagcucug

SEQ ID NO: 3639202 - RNA, 20 nt, Human
uccaaaaccgccagcucugu

SEQ ID NO: 3639203 - RNA, 15 nt, Human
uccaaaagaagcccc

SEQ ID NO: 3639204 - RNA, 18 nt, Human
uccaaaagaagcccccag

SEQ ID NO: 3639205 - RNA, 16 nt, Human
uccaaaagauugcuga

SEQ ID NO: 3639206 - RNA, 22 nt, Human
uccaaaagauugcugaaauuuu

SEQ ID NO: 3639207 - RNA, 19 nt, Human
uccaaaaguggccucuuug

SEQ ID NO: 3639208 - RNA, 17 nt, Human
uccaaaauaaaacuuuu

SEQ ID NO: 3639209 - RNA, 16 nt, Human
uccaaaaugugccuau

SEQ ID NO: 3639210 - RNA, 12 nt, Human
uccaaaauucuu

SEQ ID NO: 3639211 - RNA, 14 nt, Human
uccaaaauuuuuca

SEQ ID NO: 3639212 - RNA, 14 nt, Human
uccaaacaggcuca

SEQ ID NO: 3639213 - RNA, 15 nt, Human
uccaaacauguauuu

SEQ ID NO: 3639214 - RNA, 13 nt, Human
uccaaaccuucac

SEQ ID NO: 3639215 - RNA, 14 nt, Human
uccaaaccuucaca

SEQ ID NO: 3639216 - RNA, 12 nt, Human
uccaaacuaauu

SEQ ID NO: 3639217 - RNA, 23 nt, Human
uccaaacugacucuuaagaagac

SEQ ID NO: 3639218 - RNA, 16 nt, Human
uccaaacuggaaugag

SEQ ID NO: 3639219 - RNA, 12 nt, Human
uccaaagaaaug

SEQ ID NO: 3639220 - RNA, 17 nt, Human
uccaaagaaauguaagg

SEQ ID NO: 3639221 - RNA, 13 nt, Human
uccaaagagaaaa

SEQ ID NO: 3639222 - RNA, 13 nt, Human
uccaaagaggcug

SEQ ID NO: 3639223 - RNA, 15 nt, Human
uccaaagaggcugcc

SEQ ID NO: 3639224 - RNA, 12 nt, Human
uccaaagcagag

SEQ ID NO: 3639225 - RNA, 15 nt, Human
uccaaagcagagagc

SEQ ID NO: 3639226 - RNA, 13 nt, Human
uccaaagcagggu

SEQ ID NO: 3639227 - RNA, 13 nt, Human
uccaaagcuuuau

SEQ ID NO: 3639228 - RNA, 20 nt, Human
uccaaagcuuuauuaccagu

SEQ ID NO: 3639229 - RNA, 21 nt, Human
uccaaagcuuuauuaccagug

SEQ ID NO: 3639230 - RNA, 23 nt, Human
uccaaaggaagucuaggagcugg

SEQ ID NO: 3639231 - RNA, 19 nt, Human
uccaaaggaggcuggcagg

SEQ ID NO: 3639232 - RNA, 21 nt, Human
uccaaaggcauuuuauugcuu

SEQ ID NO: 3639233 - RNA, 21 nt, Human
uccaaaggccauggagagcug

SEQ ID NO: 3639234 - RNA, 23 nt, Human
uccaaaggccauggagagcugga

SEQ ID NO: 3639235 - RNA, 15 nt, Human
uccaaaguaaaauug

SEQ ID NO: 3639236 - RNA, 17 nt, Human
uccaaagucauaauugc

SEQ ID NO: 3639237 - RNA, 18 nt, Human
uccaaagucauaauugca

SEQ ID NO: 3639238 - RNA, 13 nt, Human
uccaaagucucua

SEQ ID NO: 3639239 - RNA, 10 nt, Human
uccaaauaaa

SEQ ID NO: 3639240 - RNA, 17 nt, Human
uccaaauaaaaacuaaa

SEQ ID NO: 3639241 - RNA, 15 nt, Human
uccaaauaaaauguu

SEQ ID NO: 3639242 - RNA, 20 nt, Human
uccaaauaauauguuuccuu

SEQ ID NO: 3639243 - RNA, 15 nt, Human
uccaaaugcagcuuu

SEQ ID NO: 3639244 - RNA, 19 nt, Human
uccaaauggagaagcugca

SEQ ID NO: 3639245 - RNA, 20 nt, Human
uccaaauggagaagcugcag

SEQ ID NO: 3639246 - RNA, 18 nt, Human
uccaaauggcgucuggaa

SEQ ID NO: 3639247 - RNA, 17 nt, Human
uccaaauguccuccaga

SEQ ID NO: 3639248 - RNA, 12 nt, Human
uccaaauucagu

SEQ ID NO: 3639249 - RNA, 23 nt, Human
uccaaauugugcuucuccccaga

SEQ ID NO: 3639250 - RNA, 22 nt, Human
uccaacaaaggguuuuaaugua

SEQ ID NO: 3639251 - RNA, 23 nt, Human
uccaacaagaagggacugagaga

SEQ ID NO: 3639252 - RNA, 21 nt, Human
uccaacaccaagcacagcagc

SEQ ID NO: 3639253 - RNA, 20 nt, Human
uccaacaccacagacacaca

SEQ ID NO: 3639254 - RNA, 22 nt, Human
uccaacaccacagacacacaca

SEQ ID NO: 3639255 - RNA, 20 nt, Human
uccaacagaacuaaauguuc

SEQ ID NO: 3639256 - RNA, 19 nt, Human
uccaacagcucaagucuuc

SEQ ID NO: 3639257 - RNA, 21 nt, Human
uccaacaguuuaaugaagauc

SEQ ID NO: 3639258 - RNA, 23 nt, Human
uccaacaguuuaaugaagaucua

SEQ ID NO: 3639259 - RNA, 18 nt, Human
uccaaccauucaaaaauu

SEQ ID NO: 3639260 - RNA, 17 nt, Human
uccaaccauuuucauua

SEQ ID NO: 3639261 - RNA, 22 nt, Human
uccaacccaugaugagcuccuc

SEQ ID NO: 3639262 - RNA, 16 nt, Human
uccaaccccaacucca

SEQ ID NO: 3639263 - RNA, 22 nt, Human
uccaaccccccagcacugagga

SEQ ID NO: 3639264 - RNA, 23 nt, Human
uccaaccccccagcacugaggaa

SEQ ID NO: 3639265 - RNA, 23 nt, Human
uccaacccgucuggcccaccagg

SEQ ID NO: 3639266 - RNA, 14 nt, Human
uccaacccucauca

SEQ ID NO: 3639267 - RNA, 17 nt, Human
uccaacccucaucacca

SEQ ID NO: 3639268 - RNA, 21 nt, Human
uccacagggucccacagccac

SEQ ID NO: 3639269 - RNA, 16 nt, Human
uccacaggucuagacu

SEQ ID NO: 3639270 - RNA, 16 nt, Human
uccacaguugccacca

SEQ ID NO: 3639271 - RNA, 18 nt, Human
uccacauaaggaaacugg

SEQ ID NO: 3639272 - RNA, 22 nt, Human
uccacauaaggaaacuggguuc

SEQ ID NO: 3639273 - RNA, 19 nt, Human
uccacauacccugaccugg

SEQ ID NO: 3639274 - RNA, 18 nt, Human
uccacauccggaggagaa

SEQ ID NO: 3639275 - RNA, 12 nt, Human
uccacauccucc

SEQ ID NO: 3639276 - RNA, 19 nt, Human
uccacaucuacguuuuugg

SEQ ID NO: 3639277 - RNA, 21 nt, Human
uccacaucuacguuuuuggug

SEQ ID NO: 3639278 - RNA, 13 nt, Human
uccacaucugccu

SEQ ID NO: 3639279 - RNA, 12 nt, Human
uccacaugcucu

SEQ ID NO: 3639280 - RNA, 14 nt, Human
uccacauguuacug

SEQ ID NO: 3639281 - RNA, 17 nt, Human
uccacauuguuuuaaaa

SEQ ID NO: 3639282 - RNA, 16 nt, Human
uccacauuucuaaaau

SEQ ID NO: 3639283 - RNA, 21 nt, Human
uccacauuuguuuugccaauu

SEQ ID NO: 3639284 - RNA, 19 nt, Human
uccaccaaaugugcuuuga

SEQ ID NO: 3639285 - RNA, 21 nt, Human
uccaccaccacuggccaccag

SEQ ID NO: 3639286 - RNA, 23 nt, Human
uccaccaccacuggccaccaggc

SEQ ID NO: 3639287 - RNA, 17 nt, Human
uccaccaccucccucac

SEQ ID NO: 3639288 - RNA, 18 nt, Human
uccaccaccucccucacc

SEQ ID NO: 3639289 - RNA, 22 nt, Human
uccaccaccucccucaccaaca

SEQ ID NO: 3639290 - RNA, 20 nt, Human
uccaccagcaucaccugccu

SEQ ID NO: 3639291 - RNA, 16 nt, Human
uccaccagucauuuuu

SEQ ID NO: 3639292 - RNA, 18 nt, Human
uccaccaucaagccacca

SEQ ID NO: 3639293 - RNA, 15 nt, Human
uccacccaacccuau

SEQ ID NO: 3639294 - RNA, 23 nt, Human
uccacccaacccuaucuccugac

SEQ ID NO: 3639295 - RNA, 19 nt, Human
uccacccaccucagccucc

SEQ ID NO: 3639296 - RNA, 12 nt, Human
uccacccagcaa

SEQ ID NO: 3639297 - RNA, 15 nt, Human
uccacccagcccauu

SEQ ID NO: 3639298 - RNA, 17 nt, Human
uccacccagcccauucu

SEQ ID NO: 3639299 - RNA, 14 nt, Human
uccacccaggagcc

SEQ ID NO: 3639300 - RNA, 15 nt, Human
uccacccaggagccc

SEQ ID NO: 3639301 - RNA, 22 nt, Human
uccacccauccuaccaaugcau

SEQ ID NO: 3639302 - RNA, 20 nt, Human
uccaccccaucccuccccag

SEQ ID NO: 3639303 - RNA, 22 nt, Human
uccaccccaucccuccccaguu

SEQ ID NO: 3639304 - RNA, 12 nt, Human
uccacccccucc

SEQ ID NO: 3639305 - RNA, 22 nt, Human
uccaccccuuucuagaccaaua

SEQ ID NO: 3639306 - RNA, 15 nt, Human
uccacccuccaccuu

SEQ ID NO: 3639307 - RNA, 16 nt, Human
uccacccucccagacc

SEQ ID NO: 3639308 - RNA, 22 nt, Human
uccacccucccagaccugccuc

SEQ ID NO: 3639309 - RNA, 14 nt, Human
uccacccugucccc

SEQ ID NO: 3639310 - RNA, 17 nt, Human
uccacccuuggccuguc

SEQ ID NO: 3639311 - RNA, 19 nt, Human
uccacccuuggccugucuc

SEQ ID NO: 3639312 - RNA, 17 nt, Human
uccaccgcagaaggaag

SEQ ID NO: 3639313 - RNA, 13 nt, Human
uccaccgcugccu

SEQ ID NO: 3639314 - RNA, 15 nt, Human
uccaccgcugccuaa

SEQ ID NO: 3639315 - RNA, 14 nt, Human
uccaccgcugcucc

SEQ ID NO: 3639316 - RNA, 15 nt, Human
uccaccguccccucc

SEQ ID NO: 3639317 - RNA, 21 nt, Human
uccaccuaguggcuguccagu

SEQ ID NO: 3639318 - RNA, 14 nt, Human
uccaccucaacucc

SEQ ID NO: 3639319 - RNA, 12 nt, Human
uccaccucaccc

SEQ ID NO: 3639320 - RNA, 14 nt, Human
uccaccucccugca

SEQ ID NO: 3639321 - RNA, 15 nt, Human
uccaccucccugcaa

SEQ ID NO: 3639322 - RNA, 23 nt, Human
uccaccucccugcaauaaaaugg

SEQ ID NO: 3639323 - RNA, 14 nt, Human
uccaccugagcugc

SEQ ID NO: 3639324 - RNA, 13 nt, Human
uccaccugccagg

SEQ ID NO: 3639325 - RNA, 18 nt, Human
uccaccugccagggacag

SEQ ID NO: 3639326 - RNA, 17 nt, Human
uccaccugcucccaggc

SEQ ID NO: 3639327 - RNA, 16 nt, Human
uccaccugcucugcug

SEQ ID NO: 3639328 - RNA, 18 nt, Human
uccaccugcucugcugau

SEQ ID NO: 3639329 - RNA, 13 nt, Human
uccaccuggaagc

SEQ ID NO: 3639330 - RNA, 17 nt, Human
uccaccuggccccaugu

SEQ ID NO: 3639331 - RNA, 23 nt, Human
uccaccugggcauauccaccacc

SEQ ID NO: 3639332 - RNA, 13 nt, Human
uccaccugucuca

SEQ ID NO: 3639333 - RNA, 13 nt, Human
uccaccugugggu

SEQ ID NO: 3639334 - RNA, 18 nt, Human
uccaccuuaaauuaaaca

SEQ ID NO: 3639335 - RNA, 22 nt, Human
uccaccuuaaauuaaacaauuu

SEQ ID NO: 3639336 - RNA, 15 nt, Human
uccaccuucccacuu

SEQ ID NO: 3639337 - RNA, 15 nt, Human
uccaccuucccaugc

SEQ ID NO: 3639338 - RNA, 17 nt, Human
uccaccuuucagcccac

SEQ ID NO: 3639339 - RNA, 20 nt, Human
uccaccuuucagcccacguc

SEQ ID NO: 3639340 - RNA, 16 nt, Human
uccacgacugucucca

SEQ ID NO: 3639341 - RNA, 19 nt, Human
uccacgacugucuccaugg

SEQ ID NO: 3639342 - RNA, 21 nt, Human
uccacgcgcuucgacuuuucu

SEQ ID NO: 3639343 - RNA, 15 nt, Human
uccacgcgugccgug

SEQ ID NO: 3639344 - RNA, 12 nt, Human
uccacgcugucu

SEQ ID NO: 3639345 - RNA, 16 nt, Human
uccacgcugucuccag

SEQ ID NO: 3639346 - RNA, 21 nt, Human
uccacggacucaaguuucuuc

SEQ ID NO: 3639347 - RNA, 20 nt, Human
uccacggagccacuccucug

SEQ ID NO: 3639348 - RNA, 20 nt, Human
uccacggcucuagguggggc

SEQ ID NO: 3639349 - RNA, 18 nt, Human
uccacguacugcagccuc

SEQ ID NO: 3639350 - RNA, 17 nt, Human
uccacguauuccccuuc

SEQ ID NO: 3639351 - RNA, 18 nt, Human
uccacguauuccccuucc

SEQ ID NO: 3639352 - RNA, 16 nt, Human
uccacgucccccuggg

SEQ ID NO: 3639353 - RNA, 17 nt, Human
uccacgucccccugggg

SEQ ID NO: 3639354 - RNA, 17 nt, Human
uccacuaaaaauauugu

SEQ ID NO: 3639355 - RNA, 16 nt, Human
uccacuacaccuggcu

SEQ ID NO: 3639356 - RNA, 13 nt, Human
uccacuacuccgu

SEQ ID NO: 3639357 - RNA, 13 nt, Human
uccacuacugcua

SEQ ID NO: 3639358 - RNA, 14 nt, Human
uccacucccaggca

SEQ ID NO: 3639359 - RNA, 19 nt, Human
uccacucccaggcagcccu

SEQ ID NO: 3639360 - RNA, 15 nt, Human
uccacuccuccuagc

SEQ ID NO: 3639361 - RNA, 21 nt, Human
uccacuccuccuagccaccca

SEQ ID NO: 3639362 - RNA, 21 nt, Human
uccacuccuuccugccaccug

SEQ ID NO: 3639363 - RNA, 15 nt, Human
uccacucguguguuu

SEQ ID NO: 3639364 - RNA, 18 nt, Human
uccacucguguguuucua

SEQ ID NO: 3639365 - RNA, 18 nt, Human
uccacucuacccucccac

SEQ ID NO: 3639366 - RNA, 23 nt, Human
uccacucuacccucccacccccu

SEQ ID NO: 3639367 - RNA, 18 nt, Human
uccacucucccccacccc

SEQ ID NO: 3639368 - RNA, 19 nt, Human
uccacucuccuugcuaccc

SEQ ID NO: 3639369 - RNA, 19 nt, Human
uccacucugauagaauuau

SEQ ID NO: 3639370 - RNA, 14 nt, Human
uccacucugcuucu

SEQ ID NO: 3639371 - RNA, 24 nt, Human
uccacucugcuucucugacuucug

SEQ ID NO: 3639372 - RNA, 13 nt, Human
uccacucuuucuu

SEQ ID NO: 3639373 - RNA, 15 nt, Human
uccacucuuucuuuc

SEQ ID NO: 3639374 - RNA, 14 nt, Human
uccacugagcucca

SEQ ID NO: 3639375 - RNA, 16 nt, Human
uccacugccucugccu

SEQ ID NO: 3639376 - RNA, 17 nt, Human
uccacugccucugccuu

SEQ ID NO: 3639377 - RNA, 19 nt, Human
uccacugccucugccuuag

SEQ ID NO: 3639378 - RNA, 12 nt, Human
uccacugccugg

SEQ ID NO: 3639379 - RNA, 13 nt, Human
uccacugccuucg

SEQ ID NO: 3639380 - RNA, 22 nt, Human
uccacugccuucgauacaccgg

SEQ ID NO: 3639381 - RNA, 16 nt, Human
uccacuggacuugagc

SEQ ID NO: 3639382 - RNA, 20 nt, Human
uccacuggguguaaacacau

SEQ ID NO: 3639383 - RNA, 12 nt, Human
uccacugucacc

SEQ ID NO: 3639384 - RNA, 22 nt, Human
uccacugucacuguuucucugc

SEQ ID NO: 3639385 - RNA, 14 nt, Human
uccacugugcacac

SEQ ID NO: 3639386 - RNA, 19 nt, Human
uccacugugcagguuccca

SEQ ID NO: 3639387 - RNA, 16 nt, Human
uccacugugcuuucag

SEQ ID NO: 3639388 - RNA, 15 nt, Human
uccacuguuuauuca

SEQ ID NO: 3639389 - RNA, 14 nt, Human
uccacuuacaucca

SEQ ID NO: 3639390 - RNA, 21 nt, Human
uccacuuagaaauugcauuuc

SEQ ID NO: 3639391 - RNA, 12 nt, Human
uccacuuggucu

SEQ ID NO: 3639392 - RNA, 15 nt, Human
uccacuuggucugug

SEQ ID NO: 3639393 - RNA, 21 nt, Human
uccacuuggucugugagaugc

SEQ ID NO: 3639394 - RNA, 15 nt, Human
uccacuuuaucuuga

SEQ ID NO: 3639395 - RNA, 13 nt, Human
uccacuuucagcu

SEQ ID NO: 3639396 - RNA, 16 nt, Human
uccacuuucagcuguc

SEQ ID NO: 3639397 - RNA, 17 nt, Human
uccacuuucagcugucu

SEQ ID NO: 3639398 - RNA, 19 nt, Human
uccacuuucuagccagagg

SEQ ID NO: 3639399 - RNA, 20 nt, Human
uccacuuucuagccagagga

SEQ ID NO: 3639400 - RNA, 16 nt, Human
uccacuuuguucuuua

SEQ ID NO: 3639401 - RNA, 15 nt, Human
uccacuuuguuucgu

SEQ ID NO: 3639402 - RNA, 23 nt, Human
uccacuuuguuucguggggaggu

SEQ ID NO: 3639403 - RNA, 20 nt, Human
uccacuuuuuuuuguauguu

SEQ ID NO: 3639404 - RNA, 23 nt, Human
uccagaaaacugugauuucagga

SEQ ID NO: 3639405 - RNA, 23 nt, Human
uccagaaagccccacccaggcca

SEQ ID NO: 3639406 - RNA, 14 nt, Human
uccagaaaggauau

SEQ ID NO: 3639407 - RNA, 19 nt, Human
uccagaaauacaauuuuag

SEQ ID NO: 3639408 - RNA, 11 nt, Human
uccagaaaugg

SEQ ID NO: 3639409 - RNA, 19 nt, Human
uccagaaaugucccuuucu

SEQ ID NO: 3639410 - RNA, 15 nt, Human
uccagaagaagagaa

SEQ ID NO: 3639411 - RNA, 19 nt, Human
uccagaagaauauucagga

SEQ ID NO: 3639412 - RNA, 19 nt, Human
uccagaagccucuggcuag

SEQ ID NO: 3639413 - RNA, 18 nt, Human
uccaucuaaacugccccc

SEQ ID NO: 3639414 - RNA, 16 nt, Human
uccaucuccaagaaug

SEQ ID NO: 3639415 - RNA, 23 nt, Human
uccaucucccgaauucgcuguua

SEQ ID NO: 3639416 - RNA, 22 nt, Human
uccaucuccuauaaucugucaa

SEQ ID NO: 3639417 - RNA, 16 nt, Human
uccaucucucauccuc

SEQ ID NO: 3639418 - RNA, 15 nt, Human
uccaucuggcagggu

SEQ ID NO: 3639419 - RNA, 21 nt, Human
uccaucugguuuucucuccag

SEQ ID NO: 3639420 - RNA, 14 nt, Human
uccaucuguacuug

SEQ ID NO: 3639421 - RNA, 18 nt, Human
uccaugaaaacguuuuau

SEQ ID NO: 3639422 - RNA, 21 nt, Human
uccaugaaaacguuuuauugu

SEQ ID NO: 3639423 - RNA, 15 nt, Human
uccaugaaggcagag

SEQ ID NO: 3639424 - RNA, 19 nt, Human
uccaugaaucgcuucucuu

SEQ ID NO: 3639425 - RNA, 20 nt, Human
uccaugaaucgcuucucuuu

SEQ ID NO: 3639426 - RNA, 15 nt, Human
uccaugaauguauca

SEQ ID NO: 3639427 - RNA, 17 nt, Human
uccaugaauuuuaaaau

SEQ ID NO: 3639428 - RNA, 15 nt, Human
uccaugacaggccug

SEQ ID NO: 3639429 - RNA, 14 nt, Human
uccaugacaucaag

SEQ ID NO: 3639430 - RNA, 19 nt, Human
uccaugacugcuugcccua

SEQ ID NO: 3639431 - RNA, 22 nt, Human
uccaugacugcuugcccuaagc

SEQ ID NO: 3639432 - RNA, 23 nt, Human
uccaugacugcuugcccuaagca

SEQ ID NO: 3639433 - RNA, 15 nt, Human
uccaugaguccccug

SEQ ID NO: 3639434 - RNA, 22 nt, Human
uccaugaguuaucaugaauuuu

SEQ ID NO: 3639435 - RNA, 18 nt, Human
uccaugaguuugcccugg

SEQ ID NO: 3639436 - RNA, 19 nt, Human
uccaugaguuugcccuggu

SEQ ID NO: 3639437 - RNA, 21 nt, Human
uccaugcacccucauacacag

SEQ ID NO: 3639438 - RNA, 21 nt, Human
uccaugcagggggcuccuggg

SEQ ID NO: 3639439 - RNA, 17 nt, Human
uccaugcaugacagccu

SEQ ID NO: 3639440 - RNA, 19 nt, Human
uccaugcaugacagccucu

SEQ ID NO: 3639441 - RNA, 15 nt, Human
uccaugccugagggu

SEQ ID NO: 3639442 - RNA, 17 nt, Human
uccaugcuauaaaaacu

SEQ ID NO: 3639443 - RNA, 20 nt, Human
uccaugcuccucacugcccg

SEQ ID NO: 3639444 - RNA, 19 nt, Human
uccaugcuuagucacugcc

SEQ ID NO: 3639445 - RNA, 20 nt, Human
uccaugcuuagucacugccu

SEQ ID NO: 3639446 - RNA, 23 nt, Human
uccaugcuuagucacugccugca

SEQ ID NO: 3639447 - RNA, 16 nt, Human
uccauggaaugcuuga

SEQ ID NO: 3639448 - RNA, 18 nt, Human
uccauggaaugcuugaaa

SEQ ID NO: 3639449 - RNA, 23 nt, Human
uccauggaaugcuugaaaaaugu

SEQ ID NO: 3639450 - RNA, 17 nt, Human
uccauggccagcagcac

SEQ ID NO: 3639451 - RNA, 20 nt, Human
uccauggcccugcaaaagga

SEQ ID NO: 3639452 - RNA, 14 nt, Human
uccauggcccugcc

SEQ ID NO: 3639453 - RNA, 22 nt, Human
uccauggccguguagaagcaug

SEQ ID NO: 3639454 - RNA, 15 nt, Human
uccauggcuuccucc

SEQ ID NO: 3639455 - RNA, 16 nt, Human
uccauggcuuccuccu

SEQ ID NO: 3639456 - RNA, 18 nt, Human
uccaugggcagagcccaa

SEQ ID NO: 3639457 - RNA, 16 nt, Human
uccauggggaagggau

SEQ ID NO: 3639458 - RNA, 17 nt, Human
uccaugggggcagggca

SEQ ID NO: 3639459 - RNA, 19 nt, Human
uccauggggucucucacag

SEQ ID NO: 3639460 - RNA, 23 nt, Human
uccauggggucucucacagacag

SEQ ID NO: 3639461 - RNA, 24 nt, Human
uccauguaacugccuagaaacaac

SEQ ID NO: 3639462 - RNA, 16 nt, Human
uccauguacuguaguu

SEQ ID NO: 3639463 - RNA, 20 nt, Human
uccauguacuguaguuuuuc

SEQ ID NO: 3639464 - RNA, 17 nt, Human
uccauguacuuguuugc

SEQ ID NO: 3639465 - RNA, 15 nt, Human
uccauguagcaggac

SEQ ID NO: 3639466 - RNA, 17 nt, Human
uccauguagcaggacug

SEQ ID NO: 3639467 - RNA, 16 nt, Human
uccaugucaagauuca

SEQ ID NO: 3639468 - RNA, 18 nt, Human
uccauguccccucccaga

SEQ ID NO: 3639469 - RNA, 18 nt, Human
uccaugucgccucugcau

SEQ ID NO: 3639470 - RNA, 19 nt, Human
uccaugugaaacauguugc

SEQ ID NO: 3639471 - RNA, 16 nt, Human
uccauguggacuuagg

SEQ ID NO: 3639472 - RNA, 18 nt, Human
uccauguggacuuaggaa

SEQ ID NO: 3639473 - RNA, 20 nt, Human
uccauguggacuuaggaagg

SEQ ID NO: 3639474 - RNA, 18 nt, Human
uccaugugguucuucaaa

SEQ ID NO: 3639475 - RNA, 19 nt, Human
uccauguuaguuuuuacuu

SEQ ID NO: 3639476 - RNA, 14 nt, Human
uccauguugcugcc

SEQ ID NO: 3639477 - RNA, 24 nt, Human
uccauguuggucaggcuggucuca

SEQ ID NO: 3639478 - RNA, 22 nt, Human
uccauuaacuuagcauguguug

SEQ ID NO: 3639479 - RNA, 17 nt, Human
uccauuaauuuaaauga

SEQ ID NO: 3639480 - RNA, 14 nt, Human
uccauuaggccagc

SEQ ID NO: 3639481 - RNA, 14 nt, Human
uccauuaucaugug

SEQ ID NO: 3639482 - RNA, 20 nt, Human
uccauuaucauguguaauca

SEQ ID NO: 3639483 - RNA, 21 nt, Human
uccauuccacacagaaugcaa

SEQ ID NO: 3639484 - RNA, 14 nt, Human
uccauuccacaucc

SEQ ID NO: 3639485 - RNA, 12 nt, Human
uccauuccucag

SEQ ID NO: 3639486 - RNA, 14 nt, Human
uccauuccucaggg

SEQ ID NO: 3639487 - RNA, 19 nt, Human
uccauucucaccuauccac

SEQ ID NO: 3639488 - RNA, 14 nt, Human
uccauucucccagg

SEQ ID NO: 3639489 - RNA, 14 nt, Human
uccauucuuucuga

SEQ ID NO: 3639490 - RNA, 21 nt, Human
uccauugacauguacagagaa

SEQ ID NO: 3639491 - RNA, 22 nt, Human
uccauugguccaagauuccgga

SEQ ID NO: 3639492 - RNA, 23 nt, Human
uccauuguaaaccacaaggcugu

SEQ ID NO: 3639493 - RNA, 23 nt, Human
uccauuguuugaaacaaagaagg

SEQ ID NO: 3639494 - RNA, 13 nt, Human
uccauuuaaacag

SEQ ID NO: 3639495 - RNA, 18 nt, Human
uccauuuaaacagauguc

SEQ ID NO: 3639496 - RNA, 12 nt, Human
uccauuuaauaa

SEQ ID NO: 3639497 - RNA, 20 nt, Human
uccauuuacuuaagacuuaa

SEQ ID NO: 3639498 - RNA, 16 nt, Human
uccauuuauauaugaa

SEQ ID NO: 3639499 - RNA, 15 nt, Human
uccauuucacuggcu

SEQ ID NO: 3639500 - RNA, 16 nt, Human
uccauuucaucuauuu

SEQ ID NO: 3639501 - RNA, 14 nt, Human
uccauuuccccucu

SEQ ID NO: 3639502 - RNA, 17 nt, Human
uccauuuccuuaugcug

SEQ ID NO: 3639503 - RNA, 14 nt, Human
uccauuucucaugu

SEQ ID NO: 3639504 - RNA, 14 nt, Human
uccauuugagaaaa

SEQ ID NO: 3639505 - RNA, 12 nt, Human
uccauuugcauu

SEQ ID NO: 3639506 - RNA, 19 nt, Human
uccauuuggaaaucuuuaa

SEQ ID NO: 3639507 - RNA, 14 nt, Human
uccauuugugugug

SEQ ID NO: 3639508 - RNA, 17 nt, Human
uccauuuguuaucuggg

SEQ ID NO: 3639509 - RNA, 17 nt, Human
uccauuuuaauuuuaaa

SEQ ID NO: 3639510 - RNA, 14 nt, Human
uccauuuuccccca

SEQ ID NO: 3639511 - RNA, 16 nt, Human
uccauuuugugaagcc

SEQ ID NO: 3639512 - RNA, 17 nt, Human
uccauuuugugaagccc

SEQ ID NO: 3639513 - RNA, 20 nt, Human
uccauuuugugaagcccugu

SEQ ID NO: 3639514 - RNA, 15 nt, Human
uccauuuuuacaagu

SEQ ID NO: 3639515 - RNA, 22 nt, Human
uccauuuuuacaaguuauagua

SEQ ID NO: 3639516 - RNA, 20 nt, Human
ucccaaaagcccauucauuc

SEQ ID NO: 3639517 - RNA, 20 nt, Human
ucccaaaauguugaaauaug

SEQ ID NO: 3639518 - RNA, 20 nt, Human
ucccaaaccacgccucuuga

SEQ ID NO: 3639519 - RNA, 24 nt, Human
ucccaaacgcccuuuccuccucag

SEQ ID NO: 3639520 - RNA, 21 nt, Human
ucccaaacgccuccccugccc

SEQ ID NO: 3639521 - RNA, 21 nt, Human
ucccaaagaaguucugguaug

SEQ ID NO: 3639522 - RNA, 20 nt, Human
ucccaaagcaagcaagaggc

SEQ ID NO: 3639523 - RNA, 12 nt, Human
ucccaaaggcau

SEQ ID NO: 3639524 - RNA, 21 nt, Human
ucccaaagugcugggauuaca

SEQ ID NO: 3639525 - RNA, 23 nt, Human
ucccaaagugcugggauuacaga

SEQ ID NO: 3639526 - RNA, 14 nt, Human
ucccaaaugagcca

SEQ ID NO: 3639527 - RNA, 20 nt, Human
ucccaaauuugauugauuug

SEQ ID NO: 3639528 - RNA, 22 nt, Human
ucccaaauuugauugauuugaa

SEQ ID NO: 3639529 - RNA, 19 nt, Human
ucccaacaaacauugaugc

SEQ ID NO: 3639530 - RNA, 19 nt, Human
ucccaacaacauccauguc

SEQ ID NO: 3639531 - RNA, 15 nt, Human
ucccaacacugccag

SEQ ID NO: 3639532 - RNA, 23 nt, Human
ucccaacaggaggacaauucaug

SEQ ID NO: 3639533 - RNA, 20 nt, Human
ucccaaccagugccaaggac

SEQ ID NO: 3639534 - RNA, 14 nt, Human
ucccaacucacccc

SEQ ID NO: 3639535 - RNA, 21 nt, Human
ucccaacucaccccagcccca

SEQ ID NO: 3639536 - RNA, 14 nt, Human
ucccaacuugccuu

SEQ ID NO: 3639537 - RNA, 22 nt, Human
ucccaagagaaggggaagcacu

SEQ ID NO: 3639538 - RNA, 19 nt, Human
ucccaagauuuuuucauuu

SEQ ID NO: 3639539 - RNA, 14 nt, Human
ucccaagccuucgg

SEQ ID NO: 3639540 - RNA, 22 nt, Human
ucccaagcuggagugcaguggu

SEQ ID NO: 3639541 - RNA, 17 nt, Human
ucccaagcugggcccca

SEQ ID NO: 3639542 - RNA, 18 nt, Human
ucccaagcugggccccag

SEQ ID NO: 3639543 - RNA, 22 nt, Human
ucccaaggaaagccccagcacu

SEQ ID NO: 3639544 - RNA, 23 nt, Human
ucccaaggcaaggggugccuggg

SEQ ID NO: 3639545 - RNA, 20 nt, Human
ucccaaggcugcgucuggag

SEQ ID NO: 3639546 - RNA, 16 nt, Human
ucccaaggggccugag

SEQ ID NO: 3639547 - RNA, 21 nt, Human
ucccaaguaacugggauuaca

SEQ ID NO: 3639548 - RNA, 23 nt, Human
ucccaaguaagaggcuggaguug

SEQ ID NO: 3639549 - RNA, 20 nt, Human
ucccaaguagcugggauuac

SEQ ID NO: 3639550 - RNA, 23 nt, Human
ucccaaguagcugggauuacagg

SEQ ID NO: 3639551 - RNA, 12 nt, Human
ucccaagugcca

SEQ ID NO: 3639552 - RNA, 23 nt, Human
ucccaaguuuccauagcaacagg

SEQ ID NO: 3639553 - RNA, 23 nt, Human
ucccaauagcacuuucauugcca

SEQ ID NO: 3639554 - RNA, 15 nt, Human
ucccaaucagcacug

SEQ ID NO: 3639555 - RNA, 22 nt, Human
uccugcccccacaccuggcccu

SEQ ID NO: 3639556 - RNA, 15 nt, Human
uccugcccccugaaa

SEQ ID NO: 3639557 - RNA, 21 nt, Human
uccugcccccugaaacuuauu

SEQ ID NO: 3639558 - RNA, 15 nt, Human
uccugccccucuuuc

SEQ ID NO: 3639559 - RNA, 16 nt, Human
uccugccccucuuucu

SEQ ID NO: 3639560 - RNA, 18 nt, Human
uccugccccucuuucucu

SEQ ID NO: 3639561 - RNA, 14 nt, Human
uccugccccuguuc

SEQ ID NO: 3639562 - RNA, 20 nt, Human
uccugcccgcagaccucugg

SEQ ID NO: 3639563 - RNA, 12 nt, Human
uccugcccuaca

SEQ ID NO: 3639564 - RNA, 23 nt, Human
uccugcccuacagaggucucugc

SEQ ID NO: 3639565 - RNA, 12 nt, Human
uccugcccuggg

SEQ ID NO: 3639566 - RNA, 21 nt, Human
uccugcccugggaggcaguga

SEQ ID NO: 3639567 - RNA, 19 nt, Human
uccugcccuuccucaguuu

SEQ ID NO: 3639568 - RNA, 16 nt, Human
uccugccgacuccugg

SEQ ID NO: 3639569 - RNA, 15 nt, Human
uccugccgcagagcu

SEQ ID NO: 3639570 - RNA, 20 nt, Human
uccugccgcagagcuggccg

SEQ ID NO: 3639571 - RNA, 22 nt, Human
uccugccgcccgagguggcugc

SEQ ID NO: 3639572 - RNA, 16 nt, Human
uccugccuaaggcuga

SEQ ID NO: 3639573 - RNA, 19 nt, Human
uccugccuaaggcugaacu

SEQ ID NO: 3639574 - RNA, 20 nt, Human
uccugccuaagugcagcccc

SEQ ID NO: 3639575 - RNA, 19 nt, Human
uccugccuauuaucuguca

SEQ ID NO: 3639576 - RNA, 13 nt, Human
uccugccucagcc

SEQ ID NO: 3639577 - RNA, 21 nt, Human
uccugccucagccucccgagu

SEQ ID NO: 3639578 - RNA, 17 nt, Human
uccugccucagccuccg

SEQ ID NO: 3639579 - RNA, 20 nt, Human
uccugccucgaacuggcugc

SEQ ID NO: 3639580 - RNA, 16 nt, Human
uccugccucuacuggg

SEQ ID NO: 3639581 - RNA, 17 nt, Human
uccugccucuacuggga

SEQ ID NO: 3639582 - RNA, 21 nt, Human
uccugccucuacugggaaggc

SEQ ID NO: 3639583 - RNA, 14 nt, Human
uccugccuggccag

SEQ ID NO: 3639584 - RNA, 21 nt, Human
uccugccuggucuccugcccc

SEQ ID NO: 3639585 - RNA, 23 nt, Human
uccugccuggucuccugccccca

SEQ ID NO: 3639586 - RNA, 20 nt, Human
uccugccugucuccuuugca

SEQ ID NO: 3639587 - RNA, 14 nt, Human
uccugccugucugc

SEQ ID NO: 3639588 - RNA, 16 nt, Human
uccugccugucugccc

SEQ ID NO: 3639589 - RNA, 14 nt, Human
uccugccuguggcg

SEQ ID NO: 3639590 - RNA, 19 nt, Human
uccugccuuccuccugggc

SEQ ID NO: 3639591 - RNA, 13 nt, Human
uccugccuucugu

SEQ ID NO: 3639592 - RNA, 16 nt, Human
uccugccuucuucuuu

SEQ ID NO: 3639593 - RNA, 22 nt, Human
uccugccuucuucuuuuugcug

SEQ ID NO: 3639594 - RNA, 15 nt, Human
uccugccuuugccuc

SEQ ID NO: 3639595 - RNA, 12 nt, Human
uccugccuuuua

SEQ ID NO: 3639596 - RNA, 23 nt, Human
uccugcggagugaagaggggcag

SEQ ID NO: 3639597 - RNA, 20 nt, Human
uccugcgggcuuuuccccgg

SEQ ID NO: 3639598 - RNA, 16 nt, Human
uccugcguccuccuca

SEQ ID NO: 3639599 - RNA, 19 nt, Human
uccugcuacaacuucagca

SEQ ID NO: 3639600 - RNA, 13 nt, Human
uccugcuagaaau

SEQ ID NO: 3639601 - RNA, 14 nt, Human
uccugcuagaaaug

SEQ ID NO: 3639602 - RNA, 18 nt, Human
uccugcuccacagccauc

SEQ ID NO: 3639603 - RNA, 14 nt, Human
uccugcuccacagu

SEQ ID NO: 3639604 - RNA, 18 nt, Human
uccugcuccacaguguug

SEQ ID NO: 3639605 - RNA, 20 nt, Human
uccugcugcaccaacccagc

SEQ ID NO: 3639606 - RNA, 21 nt, Human
uccugcugcaccaacccagcc

SEQ ID NO: 3639607 - RNA, 21 nt, Human
uccugcugcaguugccaguca

SEQ ID NO: 3639608 - RNA, 21 nt, Human
uccugcugccaguaccagccc

SEQ ID NO: 3639609 - RNA, 16 nt, Human
uccugcugcucccuca

SEQ ID NO: 3639610 - RNA, 18 nt, Human
uccugcugcugucugggu

SEQ ID NO: 3639611 - RNA, 19 nt, Human
uccugcugcugucugggug

SEQ ID NO: 3639612 - RNA, 15 nt, Human
uccugcugcuguguu

SEQ ID NO: 3639613 - RNA, 12 nt, Human
uccugcuugcca

SEQ ID NO: 3639614 - RNA, 16 nt, Human
uccugcuugccaaggc

SEQ ID NO: 3639615 - RNA, 15 nt, Human
uccugcuuuggcagu

SEQ ID NO: 3639616 - RNA, 18 nt, Human
uccugcuuugggaagccg

SEQ ID NO: 3639617 - RNA, 16 nt, Human
uccuggaaaggcucag

SEQ ID NO: 3639618 - RNA, 19 nt, Human
uccuggaaaggcucagucu

SEQ ID NO: 3639619 - RNA, 22 nt, Human
uccuggaaaggcucagucucag

SEQ ID NO: 3639620 - RNA, 15 nt, Human
uccuggaaauauuaa

SEQ ID NO: 3639621 - RNA, 22 nt, Human
uccuggaaauugacgaggggug

SEQ ID NO: 3639622 - RNA, 19 nt, Human
uccuggaacaauauuuuau

SEQ ID NO: 3639623 - RNA, 17 nt, Human
uccuggaaccuugcugu

SEQ ID NO: 3639624 - RNA, 14 nt, Human
uccuggaagccagc

SEQ ID NO: 3639625 - RNA, 20 nt, Human
uccuggaagccagcuuuccc

SEQ ID NO: 3639626 - RNA, 14 nt, Human
uccuggaagcugug

SEQ ID NO: 3639627 - RNA, 17 nt, Human
uccuggaauugccagcu

SEQ ID NO: 3639628 - RNA, 17 nt, Human
uccuggacacucagacc

SEQ ID NO: 3639629 - RNA, 19 nt, Human
uccuggacagcugugccuc

SEQ ID NO: 3639630 - RNA, 14 nt, Human
uccuggacucauug

SEQ ID NO: 3639631 - RNA, 19 nt, Human
uccuggacucauugcuuca

SEQ ID NO: 3639632 - RNA, 19 nt, Human
uccuggagagucucacucc

SEQ ID NO: 3639633 - RNA, 18 nt, Human
uccuggagcaaucacaga

SEQ ID NO: 3639634 - RNA, 20 nt, Human
uccuggagcaaucacagaug

SEQ ID NO: 3639635 - RNA, 16 nt, Human
uccuggagcagaagca

SEQ ID NO: 3639636 - RNA, 19 nt, Human
uccuggagcagaagcagca

SEQ ID NO: 3639637 - RNA, 20 nt, Human
uccuggagcagaagcagcaa

SEQ ID NO: 3639638 - RNA, 13 nt, Human
uccuggagcccga

SEQ ID NO: 3639639 - RNA, 14 nt, Human
uccuggaggcccag

SEQ ID NO: 3639640 - RNA, 15 nt, Human
uccuggaggcccagu

SEQ ID NO: 3639641 - RNA, 21 nt, Human
uccuggagggaagcacugccu

SEQ ID NO: 3639642 - RNA, 17 nt, Human
uccuggagguuccccag

SEQ ID NO: 3639643 - RNA, 14 nt, Human
uccuggaguucugg

SEQ ID NO: 3639644 - RNA, 14 nt, Human
uccuggaugucuga

SEQ ID NO: 3639645 - RNA, 18 nt, Human
uccuggauguugugugua

SEQ ID NO: 3639646 - RNA, 22 nt, Human
uccuggcacuaccaaaggacac

SEQ ID NO: 3639647 - RNA, 22 nt, Human
uccuggcacugcuuccagugag

SEQ ID NO: 3639648 - RNA, 19 nt, Human
uccuggcacuggaccccag

SEQ ID NO: 3639649 - RNA, 14 nt, Human
uccuggcagaaggg

SEQ ID NO: 3639650 - RNA, 15 nt, Human
uccuggcagaaugcu

SEQ ID NO: 3639651 - RNA, 11 nt, Human
uccuggcagcc

SEQ ID NO: 3639652 - RNA, 13 nt, Human
uccuggcagccca

SEQ ID NO: 3639653 - RNA, 14 nt, Human
uccuggcagcccag

SEQ ID NO: 3639654 - RNA, 17 nt, Human
uccuggcaguuuaaaaa

SEQ ID NO: 3639655 - RNA, 20 nt, Human
uccuggcaguuuaaaaaaau

SEQ ID NO: 3639656 - RNA, 20 nt, Human
uccuggccagauggcccgga

SEQ ID NO: 3639657 - RNA, 11 nt, Human
uccuggccauc

SEQ ID NO: 3639658 - RNA, 15 nt, Human
uccuggccaucccac

SEQ ID NO: 3639659 - RNA, 14 nt, Human
uccuggcccagccu

SEQ ID NO: 3639660 - RNA, 15 nt, Human
uccuggcccagccuu

SEQ ID NO: 3639661 - RNA, 22 nt, Human
uccuggccuauccgcugccagc

SEQ ID NO: 3639662 - RNA, 12 nt, Human
uccuggccucaa

SEQ ID NO: 3639663 - RNA, 15 nt, Human
uccuggccuugcuga

SEQ ID NO: 3639664 - RNA, 20 nt, Human
uccuggcgccuggcaguccg

SEQ ID NO: 3639665 - RNA, 16 nt, Human
uccuggcucagccuca

SEQ ID NO: 3639666 - RNA, 16 nt, Human
uccuggcuccugaggg

SEQ ID NO: 3639667 - RNA, 23 nt, Human
uccuggcucuugauaccccccuc

SEQ ID NO: 3639668 - RNA, 22 nt, Human
uccuggcugcggcgucugucug

SEQ ID NO: 3639669 - RNA, 14 nt, Human
uccuggcuucaggc

SEQ ID NO: 3639670 - RNA, 20 nt, Human
uccugggaaauauucccuag

SEQ ID NO: 3639671 - RNA, 19 nt, Human
uccugggagaaccucaggc

SEQ ID NO: 3639672 - RNA, 17 nt, Human
uccugggauguggcugc

SEQ ID NO: 3639673 - RNA, 18 nt, Human
uccugggauguggcugca

SEQ ID NO: 3639674 - RNA, 22 nt, Human
uccugggauguggcugcagcag

SEQ ID NO: 3639675 - RNA, 11 nt, Human
uccugggcaca

SEQ ID NO: 3639676 - RNA, 13 nt, Human
uccugggcagcug

SEQ ID NO: 3639677 - RNA, 14 nt, Human
uccugggcagcugc

SEQ ID NO: 3639678 - RNA, 15 nt, Human
uccugggcagcugcc

SEQ ID NO: 3639679 - RNA, 16 nt, Human
uccugggcagcugccu

SEQ ID NO: 3639680 - RNA, 21 nt, Human
uccugggccccucccuaccuc

SEQ ID NO: 3639681 - RNA, 16 nt, Human
uccugggcccucucug

SEQ ID NO: 3639682 - RNA, 16 nt, Human
uccugggccugcagaa

SEQ ID NO: 3639683 - RNA, 13 nt, Human
uccugggcgcccu

SEQ ID NO: 3639684 - RNA, 18 nt, Human
uccugggcgcccuggaag

SEQ ID NO: 3639685 - RNA, 19 nt, Human
uccuggggaaccugacccc

SEQ ID NO: 3639686 - RNA, 16 nt, Human
uccuggggccaggccg

SEQ ID NO: 3639687 - RNA, 15 nt, Human
uccuggggcguccag

SEQ ID NO: 3639688 - RNA, 16 nt, Human
uccuggggcucccuuc

SEQ ID NO: 3639689 - RNA, 13 nt, Human
uccugggggccug

SEQ ID NO: 3639690 - RNA, 17 nt, Human
uccugggggccugaccu

SEQ ID NO: 3639691 - RNA, 21 nt, Human
uccuggggguucuuucuuccu

SEQ ID NO: 3639692 - RNA, 19 nt, Human
uccuggggugcccuccacu

SEQ ID NO: 3639693 - RNA, 23 nt, Human
uccuggguggcuacucugugcca

SEQ ID NO: 3639694 - RNA, 15 nt, Human
uccuggguggucugc

SEQ ID NO: 3639695 - RNA, 19 nt, Human
uccuggguggucugcaggc

SEQ ID NO: 3639696 - RNA, 19 nt, Human
uccuggguucaagcgauuu

SEQ ID NO: 3639697 - RNA, 20 nt, Human
uccuggguuuuguauucucu

SEQ ID NO: 3639698 - RNA, 21 nt, Human
uccuggucaccuaggaagccu

SEQ ID NO: 3639699 - RNA, 14 nt, Human
uccuggucugaaaa

SEQ ID NO: 3639700 - RNA, 15 nt, Human
uccuuuucuuuuguu

SEQ ID NO: 3639701 - RNA, 17 nt, Human
uccuuuucuuuuguuac

SEQ ID NO: 3639702 - RNA, 18 nt, Human
uccuuuucuuuuguuacu

SEQ ID NO: 3639703 - RNA, 20 nt, Human
uccuuuucuuuuguuacugu

SEQ ID NO: 3639704 - RNA, 21 nt, Human
uccuuuucuuuuguuacuguu

SEQ ID NO: 3639705 - RNA, 16 nt, Human
uccuuuugacacugcu

SEQ ID NO: 3639706 - RNA, 22 nt, Human
uccuuuugacacugcucuaaca

SEQ ID NO: 3639707 - RNA, 20 nt, Human
uccuuuuguaaagugaagaa

SEQ ID NO: 3639708 - RNA, 21 nt, Human
uccuuuuguaaagugaagaau

SEQ ID NO: 3639709 - RNA, 11 nt, Human
uccuuuuguag

SEQ ID NO: 3639710 - RNA, 17 nt, Human
uccuuuuguguacagug

SEQ ID NO: 3639711 - RNA, 13 nt, Human
uccuuuuguguuc

SEQ ID NO: 3639712 - RNA, 20 nt, Human
uccuuuuuaaauucaguccu

SEQ ID NO: 3639713 - RNA, 21 nt, Human
uccuuuuuaugaggcaaccug

SEQ ID NO: 3639714 - RNA, 18 nt, Human
uccuuuuuauuuauaugu

SEQ ID NO: 3639715 - RNA, 15 nt, Human
uccuuuuuccaacaa

SEQ ID NO: 3639716 - RNA, 17 nt, Human
uccuuuuuccaacaaga

SEQ ID NO: 3639717 - RNA, 23 nt, Human
uccuuuuucugauuagcuuugug

SEQ ID NO: 3639718 - RNA, 17 nt, Human
uccuuuuugacacugaa

SEQ ID NO: 3639719 - RNA, 14 nt, Human
uccuuuuuguuauu

SEQ ID NO: 3639720 - RNA, 11 nt, Human
uccuuuuuucc

SEQ ID NO: 3639721 - RNA, 22 nt, Human
uccuuuuuuguuccuuuuuccu

SEQ ID NO: 3639722 - RNA, 14 nt, Human
uccuuuuuuuguac

SEQ ID NO: 3639723 - RNA, 12 nt, Human
ucgaaauaacaa

SEQ ID NO: 3639724 - RNA, 19 nt, Human
ucgaaauaacaauguuaag

SEQ ID NO: 3639725 - RNA, 17 nt, Human
ucgaacccacacugcaa

SEQ ID NO: 3639726 - RNA, 15 nt, Human
ucgaacuggcugcaa

SEQ ID NO: 3639727 - RNA, 23 nt, Human
ucgaagccuugccuaaauuuaau

SEQ ID NO: 3639728 - RNA, 16 nt, Human
ucgaagcucagcccac

SEQ ID NO: 3639729 - RNA, 18 nt, Human
ucgaagcucagcccaccc

SEQ ID NO: 3639730 - RNA, 19 nt, Human
ucgaagcucagcccacccc

SEQ ID NO: 3639731 - RNA, 20 nt, Human
ucgaagucauuaaacugguu

SEQ ID NO: 3639732 - RNA, 20 nt, Human
ucgaaucuacuaauuccaca

SEQ ID NO: 3639733 - RNA, 22 nt, Human
ucgaaucucugugccuucgucu

SEQ ID NO: 3639734 - RNA, 14 nt, Human
ucgaaugacacugu

SEQ ID NO: 3639735 - RNA, 15 nt, Human
ucgaauuaagaauau

SEQ ID NO: 3639736 - RNA, 16 nt, Human
ucgaauuaauagcuuu

SEQ ID NO: 3639737 - RNA, 20 nt, Human
ucgaauuuuuauuauuuguu

SEQ ID NO: 3639738 - RNA, 12 nt, Human
ucgacacagagu

SEQ ID NO: 3639739 - RNA, 22 nt, Human
ucgacagcauuuuccucugcuu

SEQ ID NO: 3639740 - RNA, 19 nt, Human
ucgaccccaaagccccuug

SEQ ID NO: 3639741 - RNA, 14 nt, Human
ucgacucaggaucc

SEQ ID NO: 3639742 - RNA, 16 nt, Human
ucgacucaggauccag

SEQ ID NO: 3639743 - RNA, 23 nt, Human
ucgacucugugcuggccagcgag

SEQ ID NO: 3639744 - RNA, 15 nt, Human
ucgacuguuguuauc

SEQ ID NO: 3639745 - RNA, 17 nt, Human
ucgacuguuguuaucug

SEQ ID NO: 3639746 - RNA, 17 nt, Human
ucgacuucgggcuggcc

SEQ ID NO: 3639747 - RNA, 19 nt, Human
ucgagaaagaggcaccagg

SEQ ID NO: 3639748 - RNA, 14 nt, Human
ucgagaacuuucau

SEQ ID NO: 3639749 - RNA, 18 nt, Human
ucgagaccaaccugacca

SEQ ID NO: 3639750 - RNA, 19 nt, Human
ucgagaccagccuggccaa

SEQ ID NO: 3639751 - RNA, 18 nt, Human
ucgagaccagccugggca

SEQ ID NO: 3639752 - RNA, 19 nt, Human
ucgagaccauccuggcuaa

SEQ ID NO: 3639753 - RNA, 22 nt, Human
ucgagaucccaacacugccagc

SEQ ID NO: 3639754 - RNA, 17 nt, Human
ucgagcaguccugccuc

SEQ ID NO: 3639755 - RNA, 16 nt, Human
ucgagcgcccugcaga

SEQ ID NO: 3639756 - RNA, 17 nt, Human
ucgagcgcccugcagac

SEQ ID NO: 3639757 - RNA, 19 nt, Human
ucgagcuauauuuaaguau

SEQ ID NO: 3639758 - RNA, 17 nt, Human
ucgaggacagggaggug

SEQ ID NO: 3639759 - RNA, 20 nt, Human
ucgaggacuguauuugugac

SEQ ID NO: 3639760 - RNA, 14 nt, Human
ucgaggaguaacaa

SEQ ID NO: 3639761 - RNA, 20 nt, Human
ucgaggaguaacaauacaaa

SEQ ID NO: 3639762 - RNA, 18 nt, Human
ucgaggcccagcgaccuc

SEQ ID NO: 3639763 - RNA, 20 nt, Human
ucgaggcugcagucagucau

SEQ ID NO: 3639764 - RNA, 18 nt, Human
ucgaggggcucucagcuc

SEQ ID NO: 3639765 - RNA, 15 nt, Human
ucgaggucagaggag

SEQ ID NO: 3639766 - RNA, 14 nt, Human
ucgaggugccuucu

SEQ ID NO: 3639767 - RNA, 23 nt, Human
ucgaggugccuucuucagggccu

SEQ ID NO: 3639768 - RNA, 12 nt, Human
ucgaguacugug

SEQ ID NO: 3639769 - RNA, 14 nt, Human
ucgagugagacaga

SEQ ID NO: 3639770 - RNA, 23 nt, Human
ucgagugagacagacuagaaguu

SEQ ID NO: 3639771 - RNA, 15 nt, Human
ucgaguuacagacaa

SEQ ID NO: 3639772 - RNA, 20 nt, Human
ucgauacugcgacuuucugc

SEQ ID NO: 3639773 - RNA, 23 nt, Human
ucgauacugcgacuuucugccug

SEQ ID NO: 3639774 - RNA, 13 nt, Human
ucgauauuuccau

SEQ ID NO: 3639775 - RNA, 23 nt, Human
ucgaugggggagucugaagcaga

SEQ ID NO: 3639776 - RNA, 17 nt, Human
ucgaugggggaugcuuc

SEQ ID NO: 3639777 - RNA, 19 nt, Human
ucgaugggggaugcuucau

SEQ ID NO: 3639778 - RNA, 12 nt, Human
ucgauuagacug

SEQ ID NO: 3639779 - RNA, 13 nt, Human
ucgauuagacugg

SEQ ID NO: 3639780 - RNA, 17 nt, Human
ucgauuuuguaucugca

SEQ ID NO: 3639781 - RNA, 17 nt, Human
ucgcaauguaagacucg

SEQ ID NO: 3639782 - RNA, 21 nt, Human
ucgcaccacuguguauuuaac

SEQ ID NO: 3639783 - RNA, 17 nt, Human
ucgcaccauucugacuc

SEQ ID NO: 3639784 - RNA, 21 nt, Human
ucgcacucuggcagcaccgcc

SEQ ID NO: 3639785 - RNA, 13 nt, Human
ucgcagccacccu

SEQ ID NO: 3639786 - RNA, 21 nt, Human
ucgcagccacccugaggaguc

SEQ ID NO: 3639787 - RNA, 14 nt, Human
ucgcagccugaguc

SEQ ID NO: 3639788 - RNA, 20 nt, Human
ucgcaggaagacccaacaca

SEQ ID NO: 3639789 - RNA, 21 nt, Human
ucgcaucaaaagacaauucuu

SEQ ID NO: 3639790 - RNA, 23 nt, Human
ucgcaucaaaagacaauucuuua

SEQ ID NO: 3639791 - RNA, 12 nt, Human
ucgcaucagcgc

SEQ ID NO: 3639792 - RNA, 19 nt, Human
ucgcauggucacacacuga

SEQ ID NO: 3639793 - RNA, 15 nt, Human
ucgcauuugucaaug

SEQ ID NO: 3639794 - RNA, 13 nt, Human
ucgccacaaacuc

SEQ ID NO: 3639795 - RNA, 18 nt, Human
ucgccaccccuccuuccu

SEQ ID NO: 3639796 - RNA, 18 nt, Human
ucgccagcugaugacuca

SEQ ID NO: 3639797 - RNA, 21 nt, Human
ucgccagcugaugacucaaga

SEQ ID NO: 3639798 - RNA, 17 nt, Human
ucgcccaaagccagaca

SEQ ID NO: 3639799 - RNA, 16 nt, Human
ucgcccaccgcaugcc

SEQ ID NO: 3639800 - RNA, 22 nt, Human
ucgcccaccgcaugcccccucg

SEQ ID NO: 3639801 - RNA, 14 nt, Human
ucgcccagucccag

SEQ ID NO: 3639802 - RNA, 18 nt, Human
ucgcccagucccagcagc

SEQ ID NO: 3639803 - RNA, 23 nt, Human
ucgcccagucccagcagccagcc

SEQ ID NO: 3639804 - RNA, 10 nt, Human
ucgcccauga

SEQ ID NO: 3639805 - RNA, 20 nt, Human
ucgccccagaucaccagccc

SEQ ID NO: 3639806 - RNA, 11 nt, Human
ucgcccgccca

SEQ ID NO: 3639807 - RNA, 19 nt, Human
ucgcccgcccacuguccug

SEQ ID NO: 3639808 - RNA, 22 nt, Human
ucgcccgcccacuguccugggc

SEQ ID NO: 3639809 - RNA, 16 nt, Human
ucgcccuuugcugcau

SEQ ID NO: 3639810 - RNA, 20 nt, Human
ucgccugacaaccacugguc

SEQ ID NO: 3639811 - RNA, 16 nt, Human
ucgccuguaaucucac

SEQ ID NO: 3639812 - RNA, 22 nt, Human
ucgccuuagcacuaccacuccu

SEQ ID NO: 3639813 - RNA, 14 nt, Human
ucgccuuagcaugu

SEQ ID NO: 3639814 - RNA, 16 nt, Human
ucgccuuucagcaggc

SEQ ID NO: 3639815 - RNA, 20 nt, Human
ucgccuuucagcaggcagcc

SEQ ID NO: 3639816 - RNA, 14 nt, Human
ucgcgacaaugcaa

SEQ ID NO: 3639817 - RNA, 19 nt, Human
ucgcgacaaugcaaaccau

SEQ ID NO: 3639818 - RNA, 15 nt, Human
ucgcgcucugcucag

SEQ ID NO: 3639819 - RNA, 13 nt, Human
ucgcgcugccugu

SEQ ID NO: 3639820 - RNA, 16 nt, Human
ucgcggcggagcuggc

SEQ ID NO: 3639821 - RNA, 16 nt, Human
ucgcgugcccucgcug

SEQ ID NO: 3639822 - RNA, 17 nt, Human
ucgcuacauuuccgcca

SEQ ID NO: 3639823 - RNA, 22 nt, Human
ucgcuagcaguggcaggcagag

SEQ ID NO: 3639824 - RNA, 21 nt, Human
ucgcuccccacucugcucuga

SEQ ID NO: 3639825 - RNA, 14 nt, Human
ucgcucccucccag

SEQ ID NO: 3639826 - RNA, 15 nt, Human
ucgcucccucccagg

SEQ ID NO: 3639827 - RNA, 23 nt, Human
ucgcucugcuggccuggccggca

SEQ ID NO: 3639828 - RNA, 15 nt, Human
ucgcucuuugagaaa

SEQ ID NO: 3639829 - RNA, 22 nt, Human
ucgcugagggcagacuggggca

SEQ ID NO: 3639830 - RNA, 14 nt, Human
ucgcugaugcuggg

SEQ ID NO: 3639831 - RNA, 20 nt, Human
ucgcugccagcucuguauca

SEQ ID NO: 3639832 - RNA, 11 nt, Human
ucgcugcugcg

SEQ ID NO: 3639833 - RNA, 22 nt, Human
ucgcuggacucucagucucuga

SEQ ID NO: 3639834 - RNA, 23 nt, Human
ucgcuggacucucagucucugag

SEQ ID NO: 3639835 - RNA, 22 nt, Human
ucgcuggauggcggaagcugcu

SEQ ID NO: 3639836 - RNA, 22 nt, Human
ucgcuggccccuuugggcccug

SEQ ID NO: 3639837 - RNA, 23 nt, Human
ucgcuggccccuuugggcccugc

SEQ ID NO: 3639838 - RNA, 16 nt, Human
ucgcugucacaggcgg

SEQ ID NO: 3639839 - RNA, 17 nt, Human
ucgcuguccuuucuaga

SEQ ID NO: 3639840 - RNA, 13 nt, Human
ucgcuguguguua

SEQ ID NO: 3639841 - RNA, 21 nt, Human
ucgcuguguguuaguucccaa

SEQ ID NO: 3639842 - RNA, 16 nt, Human
ucgcuucauguaacua

SEQ ID NO: 3639843 - RNA, 15 nt, Human
ucgcuuccgcauccu

SEQ ID NO: 3639844 - RNA, 15 nt, Human
ucuacaaucuauuua

SEQ ID NO: 3639845 - RNA, 19 nt, Human
ucuacaaugugaacuuuau

SEQ ID NO: 3639846 - RNA, 23 nt, Human
ucuacacagugggaacucugaca

SEQ ID NO: 3639847 - RNA, 17 nt, Human
ucuacacuaagagagaa

SEQ ID NO: 3639848 - RNA, 11 nt, Human
ucuacacucuc

SEQ ID NO: 3639849 - RNA, 13 nt, Human
ucuacacugugaa

SEQ ID NO: 3639850 - RNA, 12 nt, Human
ucuacacugugc

SEQ ID NO: 3639851 - RNA, 21 nt, Human
ucuacagauagagaguuguug

SEQ ID NO: 3639852 - RNA, 18 nt, Human
ucuacagaugagucacac

SEQ ID NO: 3639853 - RNA, 22 nt, Human
ucuacagcaaauuuauaauuuu

SEQ ID NO: 3639854 - RNA, 15 nt, Human
ucuacagcuccccca

SEQ ID NO: 3639855 - RNA, 20 nt, Human
ucuacagcucccccagcucc

SEQ ID NO: 3639856 - RNA, 12 nt, Human
ucuacagugguu

SEQ ID NO: 3639857 - RNA, 23 nt, Human
ucuacagugguuuuauacugaag

SEQ ID NO: 3639858 - RNA, 20 nt, Human
ucuacauaaguaauucaaga

SEQ ID NO: 3639859 - RNA, 16 nt, Human
ucuacauacuauggaa

SEQ ID NO: 3639860 - RNA, 23 nt, Human
ucuacauacuuucauccugacuc

SEQ ID NO: 3639861 - RNA, 22 nt, Human
ucuacaucuuuuuucacaaauu

SEQ ID NO: 3639862 - RNA, 13 nt, Human
ucuacaugaaugc

SEQ ID NO: 3639863 - RNA, 20 nt, Human
ucuacaugaggaacuguaga

SEQ ID NO: 3639864 - RNA, 12 nt, Human
ucuacauuucac

SEQ ID NO: 3639865 - RNA, 14 nt, Human
ucuacauuucuuag

SEQ ID NO: 3639866 - RNA, 15 nt, Human
ucuaccaacuggaag

SEQ ID NO: 3639867 - RNA, 14 nt, Human
ucuaccaacuuuca

SEQ ID NO: 3639868 - RNA, 17 nt, Human
ucuaccaacuuucaaga

SEQ ID NO: 3639869 - RNA, 18 nt, Human
ucuaccaacuuucaagaa

SEQ ID NO: 3639870 - RNA, 22 nt, Human
ucuaccaacuuucaagaacuug

SEQ ID NO: 3639871 - RNA, 13 nt, Human
ucuaccagacugu

SEQ ID NO: 3639872 - RNA, 21 nt, Human
ucuaccagugcaggcuggcca

SEQ ID NO: 3639873 - RNA, 12 nt, Human
ucuaccaucucc

SEQ ID NO: 3639874 - RNA, 19 nt, Human
ucuaccaugaacagaaaac

SEQ ID NO: 3639875 - RNA, 14 nt, Human
ucuaccauuucaga

SEQ ID NO: 3639876 - RNA, 15 nt, Human
ucuaccauuucagag

SEQ ID NO: 3639877 - RNA, 21 nt, Human
ucuacccaaaggauacuguaa

SEQ ID NO: 3639878 - RNA, 12 nt, Human
ucuacccagccc

SEQ ID NO: 3639879 - RNA, 13 nt, Human
ucuacccagccca

SEQ ID NO: 3639880 - RNA, 15 nt, Human
ucuacccagcccauc

SEQ ID NO: 3639881 - RNA, 20 nt, Human
ucuacccagcccaucuugcc

SEQ ID NO: 3639882 - RNA, 13 nt, Human
ucuacccagggcc

SEQ ID NO: 3639883 - RNA, 15 nt, Human
ucuacccauauuaca

SEQ ID NO: 3639884 - RNA, 21 nt, Human
ucuaccccagacuagauguag

SEQ ID NO: 3639885 - RNA, 13 nt, Human
ucuaccccuggau

SEQ ID NO: 3639886 - RNA, 15 nt, Human
ucuaccccuuacuua

SEQ ID NO: 3639887 - RNA, 15 nt, Human
ucuacccucccaccc

SEQ ID NO: 3639888 - RNA, 21 nt, Human
ucuacccucuuagaaaaacca

SEQ ID NO: 3639889 - RNA, 21 nt, Human
ucuacccugcauggcugagcu

SEQ ID NO: 3639890 - RNA, 19 nt, Human
ucuaccugaggggccucuu

SEQ ID NO: 3639891 - RNA, 12 nt, Human
ucuaccugccac

SEQ ID NO: 3639892 - RNA, 12 nt, Human
ucuaccugcccu

SEQ ID NO: 3639893 - RNA, 15 nt, Human
ucuaccuuccaguca

SEQ ID NO: 3639894 - RNA, 16 nt, Human
ucuaccuucuccccag

SEQ ID NO: 3639895 - RNA, 18 nt, Human
ucuacggaucaucaacaa

SEQ ID NO: 3639896 - RNA, 19 nt, Human
ucuacgguguaugguucug

SEQ ID NO: 3639897 - RNA, 12 nt, Human
ucuacguuucuu

SEQ ID NO: 3639898 - RNA, 13 nt, Human
ucuacguuucuuu

SEQ ID NO: 3639899 - RNA, 21 nt, Human
ucuacuaaaaagaaggaaaau

SEQ ID NO: 3639900 - RNA, 12 nt, Human
ucuacuaaaaau

SEQ ID NO: 3639901 - RNA, 15 nt, Human
ucuacuaaaaaugca

SEQ ID NO: 3639902 - RNA, 14 nt, Human
ucuacuauuuaugu

SEQ ID NO: 3639903 - RNA, 15 nt, Human
ucuacucauuuuaau

SEQ ID NO: 3639904 - RNA, 21 nt, Human
ucuacucgaguuacagacaaa

SEQ ID NO: 3639905 - RNA, 17 nt, Human
ucuacucuuaagccauc

SEQ ID NO: 3639906 - RNA, 22 nt, Human
ucuacucuuaaguuucucagcu

SEQ ID NO: 3639907 - RNA, 19 nt, Human
ucuacugaggugcuauguu

SEQ ID NO: 3639908 - RNA, 22 nt, Human
ucuacugaggugcuauguucuu

SEQ ID NO: 3639909 - RNA, 19 nt, Human
ucuacuuccaaacuaauuu

SEQ ID NO: 3639910 - RNA, 19 nt, Human
ucuacuucugcccuugcca

SEQ ID NO: 3639911 - RNA, 13 nt, Human
ucuacuugcucug

SEQ ID NO: 3639912 - RNA, 15 nt, Human
ucuacuugcucugga

SEQ ID NO: 3639913 - RNA, 16 nt, Human
ucuacuugcucuggac

SEQ ID NO: 3639914 - RNA, 20 nt, Human
ucuacuugcucuggaccugc

SEQ ID NO: 3639915 - RNA, 16 nt, Human
ucuacuuuaagcacua

SEQ ID NO: 3639916 - RNA, 22 nt, Human
ucuacuuuagaaugagagugug

SEQ ID NO: 3639917 - RNA, 18 nt, Human
ucuagaaaaacaggcacu

SEQ ID NO: 3639918 - RNA, 14 nt, Human
ucuagaaacaaaca

SEQ ID NO: 3639919 - RNA, 22 nt, Human
ucuagaaacgaguuggugucuu

SEQ ID NO: 3639920 - RNA, 22 nt, Human
ucuagaaagccuguuccccuca

SEQ ID NO: 3639921 - RNA, 18 nt, Human
ucuagaacuugacccccu

SEQ ID NO: 3639922 - RNA, 14 nt, Human
ucuagaagaaauga

SEQ ID NO: 3639923 - RNA, 19 nt, Human
ucuagaagaaaugaaauuu

SEQ ID NO: 3639924 - RNA, 17 nt, Human
ucuagaagccaagggaa

SEQ ID NO: 3639925 - RNA, 20 nt, Human
ucuagaaguuucccuuccuc

SEQ ID NO: 3639926 - RNA, 22 nt, Human
ucuagaaucugcaauucaaaag

SEQ ID NO: 3639927 - RNA, 19 nt, Human
ucuagaauuuuaagugcuu

SEQ ID NO: 3639928 - RNA, 23 nt, Human
ucuagacaagauauuguacauaa

SEQ ID NO: 3639929 - RNA, 15 nt, Human
ucuagacacuuuuuc

SEQ ID NO: 3639930 - RNA, 16 nt, Human
ucuagacacuuuuucu

SEQ ID NO: 3639931 - RNA, 14 nt, Human
ucuagaccaauaaa

SEQ ID NO: 3639932 - RNA, 14 nt, Human
ucuagacuuucugu

SEQ ID NO: 3639933 - RNA, 21 nt, Human
ucuagagaaguggacuggagg

SEQ ID NO: 3639934 - RNA, 20 nt, Human
ucuagagauaguacauaaag

SEQ ID NO: 3639935 - RNA, 18 nt, Human
ucuagagauauauauacu

SEQ ID NO: 3639936 - RNA, 14 nt, Human
ucuagagcacugcc

SEQ ID NO: 3639937 - RNA, 16 nt, Human
ucuagaggcuuccuuc

SEQ ID NO: 3639938 - RNA, 15 nt, Human
ucuagauaccuaaaa

SEQ ID NO: 3639939 - RNA, 16 nt, Human
ucuagaucagaugcuc

SEQ ID NO: 3639940 - RNA, 22 nt, Human
ucuagaucagaugcuccaagau

SEQ ID NO: 3639941 - RNA, 19 nt, Human
ucuagaugaaguuuuacau

SEQ ID NO: 3639942 - RNA, 23 nt, Human
ucuagaugaaguuuuacauuguu

SEQ ID NO: 3639943 - RNA, 22 nt, Human
ucuagaugauuaaauaagauuc

SEQ ID NO: 3639944 - RNA, 21 nt, Human
ucuagaugauuuuuugaaagu

SEQ ID NO: 3639945 - RNA, 18 nt, Human
ucuagauggcuccucuca

SEQ ID NO: 3639946 - RNA, 19 nt, Human
ucuagauggcuccucucag

SEQ ID NO: 3639947 - RNA, 16 nt, Human
ucuagauguaaauuuu

SEQ ID NO: 3639948 - RNA, 22 nt, Human
ucuagauguuuauucuucuaga

SEQ ID NO: 3639949 - RNA, 23 nt, Human
ucuagauuacccccucauuguuu

SEQ ID NO: 3639950 - RNA, 19 nt, Human
ucuagauucaaagguucua

SEQ ID NO: 3639951 - RNA, 14 nt, Human
ucuagauucucugg

SEQ ID NO: 3639952 - RNA, 15 nt, Human
ucuagcaaauguuau

SEQ ID NO: 3639953 - RNA, 22 nt, Human
ucuagcaaccgccucaaaaugu

SEQ ID NO: 3639954 - RNA, 23 nt, Human
ucuagcaaucacaacacuggcug

SEQ ID NO: 3639955 - RNA, 17 nt, Human
ucuagcacucauuuucu

SEQ ID NO: 3639956 - RNA, 16 nt, Human
ucuagcacuggccugc

SEQ ID NO: 3639957 - RNA, 17 nt, Human
ucuagcacuggccugca

SEQ ID NO: 3639958 - RNA, 21 nt, Human
ucuagcauggcauauuuuuca

SEQ ID NO: 3639959 - RNA, 22 nt, Human
ucuagcauggcauauuuuucac

SEQ ID NO: 3639960 - RNA, 21 nt, Human
ucuagccagccccucuucccc

SEQ ID NO: 3639961 - RNA, 14 nt, Human
ucuagcccugcccg

SEQ ID NO: 3639962 - RNA, 20 nt, Human
ucuagccuauuuaccugcag

SEQ ID NO: 3639963 - RNA, 16 nt, Human
ucuagccugcacuuug

SEQ ID NO: 3639964 - RNA, 22 nt, Human
ucuagccugcacuuugauguca

SEQ ID NO: 3639965 - RNA, 15 nt, Human
ucuagcguagugcag

SEQ ID NO: 3639966 - RNA, 16 nt, Human
ucuagcuaauggaaaa

SEQ ID NO: 3639967 - RNA, 21 nt, Human
ucuagcuagaaauaugauuuu

SEQ ID NO: 3639968 - RNA, 23 nt, Human
ucuagcuagaaauaugauuuuau

SEQ ID NO: 3639969 - RNA, 14 nt, Human
ucuagcucucuagg

SEQ ID NO: 3639970 - RNA, 22 nt, Human
ucuagcugaauugagccuaaaa

SEQ ID NO: 3639971 - RNA, 21 nt, Human
ucuaggaaaauauuuugaucu

SEQ ID NO: 3639972 - RNA, 22 nt, Human
ucuaggaaaauauuuugaucuu

SEQ ID NO: 3639973 - RNA, 16 nt, Human
ucuaggaaauauuuau

SEQ ID NO: 3639974 - RNA, 14 nt, Human
ucuaggaaaucuag

SEQ ID NO: 3639975 - RNA, 15 nt, Human
ucuaggaagaauuuu

SEQ ID NO: 3639976 - RNA, 15 nt, Human
ucuaggaagacuuug

SEQ ID NO: 3639977 - RNA, 23 nt, Human
ucuaggaccaugguuaagagucc

SEQ ID NO: 3639978 - RNA, 18 nt, Human
ucuaggacgccacccagc

SEQ ID NO: 3639979 - RNA, 16 nt, Human
ucuaggagcugggagg

SEQ ID NO: 3639980 - RNA, 17 nt, Human
ucuaggagcugggagga

SEQ ID NO: 3639981 - RNA, 18 nt, Human
ucuaggagcugggaggaa

SEQ ID NO: 3639982 - RNA, 19 nt, Human
ucuaggagggagacacugg

SEQ ID NO: 3639983 - RNA, 18 nt, Human
ucuaggaggucucuaaga

SEQ ID NO: 3639984 - RNA, 15 nt, Human
ucuaggcacuguagu

SEQ ID NO: 3639985 - RNA, 19 nt, Human
ucuagggaaaaaccagcgu

SEQ ID NO: 3639986 - RNA, 17 nt, Human
ucuagggagagacccuu

SEQ ID NO: 3639987 - RNA, 19 nt, Human
ucuagggcugggaaacacu

SEQ ID NO: 3639988 - RNA, 15 nt, Human
ucuggcccugccuuc

SEQ ID NO: 3639989 - RNA, 14 nt, Human
ucuggcccuggccc

SEQ ID NO: 3639990 - RNA, 15 nt, Human
ucuggcccuggcccu

SEQ ID NO: 3639991 - RNA, 20 nt, Human
ucuggccuagucccuuccac

SEQ ID NO: 3639992 - RNA, 15 nt, Human
ucuggccucugcuuu

SEQ ID NO: 3639993 - RNA, 13 nt, Human
ucuggccuggccu

SEQ ID NO: 3639994 - RNA, 17 nt, Human
ucuggccuucggccucc

SEQ ID NO: 3639995 - RNA, 13 nt, Human
ucuggccuuuccu

SEQ ID NO: 3639996 - RNA, 14 nt, Human
ucuggccuuuuccu

SEQ ID NO: 3639997 - RNA, 16 nt, Human
ucuggcuagaggccag

SEQ ID NO: 3639998 - RNA, 21 nt, Human
ucuggcuagaggccagcccca

SEQ ID NO: 3639999 - RNA, 22 nt, Human
ucuggcuagaggccagccccac

SEQ ID NO: 3640000 - RNA, 22 nt, Human
ucuggcuaugcauuugaaaauu

SEQ ID NO: 3640001 - RNA, 15 nt, Human
ucuggcucuaauuca

SEQ ID NO: 3640002 - RNA, 16 nt, Human
ucuggcucuaauucac

SEQ ID NO: 3640003 - RNA, 15 nt, Human
ucuggcucuuccagg

SEQ ID NO: 3640004 - RNA, 16 nt, Human
ucuggcucuuccaggc

SEQ ID NO: 3640005 - RNA, 23 nt, Human
ucuggcucuuccaggcugggaga

SEQ ID NO: 3640006 - RNA, 18 nt, Human
ucuggcugaacacuggca

SEQ ID NO: 3640007 - RNA, 13 nt, Human
ucuggcugaaccc

SEQ ID NO: 3640008 - RNA, 14 nt, Human
ucuggcugaacccu

SEQ ID NO: 3640009 - RNA, 20 nt, Human
ucuggcugaacccugugcug

SEQ ID NO: 3640010 - RNA, 18 nt, Human
ucuggcugacuaaauuug

SEQ ID NO: 3640011 - RNA, 16 nt, Human
ucuggcugagcccugc

SEQ ID NO: 3640012 - RNA, 14 nt, Human
ucuggcugcagagc

SEQ ID NO: 3640013 - RNA, 21 nt, Human
ucuggcugccccaaccugcug

SEQ ID NO: 3640014 - RNA, 21 nt, Human
ucuggcuggcuaacuggaagc

SEQ ID NO: 3640015 - RNA, 18 nt, Human
ucuggcugguagagcagg

SEQ ID NO: 3640016 - RNA, 12 nt, Human
ucuggcuggugu

SEQ ID NO: 3640017 - RNA, 20 nt, Human
ucuggcugguguuaacagaa

SEQ ID NO: 3640018 - RNA, 16 nt, Human
ucuggcuguaaggcuc

SEQ ID NO: 3640019 - RNA, 20 nt, Human
ucuggcuuggccacagccag

SEQ ID NO: 3640020 - RNA, 13 nt, Human
ucuggcuuggccu

SEQ ID NO: 3640021 - RNA, 23 nt, Human
ucuggcuuucuccgacugcuagg

SEQ ID NO: 3640022 - RNA, 19 nt, Human
ucugggaaccucccagagg

SEQ ID NO: 3640023 - RNA, 15 nt, Human
ucugggaacucccaa

SEQ ID NO: 3640024 - RNA, 14 nt, Human
ucugggaacuuguc

SEQ ID NO: 3640025 - RNA, 17 nt, Human
ucugggaauguauagua

SEQ ID NO: 3640026 - RNA, 15 nt, Human
ucugggacccuuucc

SEQ ID NO: 3640027 - RNA, 16 nt, Human
ucugggacccuuuccu

SEQ ID NO: 3640028 - RNA, 15 nt, Human
ucugggacuuccuug

SEQ ID NO: 3640029 - RNA, 17 nt, Human
ucugggacuuccuugcu

SEQ ID NO: 3640030 - RNA, 14 nt, Human
ucugggagcuggag

SEQ ID NO: 3640031 - RNA, 21 nt, Human
ucugggagggcagcagggcua

SEQ ID NO: 3640032 - RNA, 15 nt, Human
ucugggagucacaca

SEQ ID NO: 3640033 - RNA, 17 nt, Human
ucugggagucacacagu

SEQ ID NO: 3640034 - RNA, 14 nt, Human
ucugggcaggaccu

SEQ ID NO: 3640035 - RNA, 18 nt, Human
ucugggcaggaccucaga

SEQ ID NO: 3640036 - RNA, 14 nt, Human
ucugggcaggacuc

SEQ ID NO: 3640037 - RNA, 15 nt, Human
ucugggccagaauuu

SEQ ID NO: 3640038 - RNA, 12 nt, Human
ucugggccuggg

SEQ ID NO: 3640039 - RNA, 17 nt, Human
ucugggccugggcuagg

SEQ ID NO: 3640040 - RNA, 14 nt, Human
ucugggccuuggcc

SEQ ID NO: 3640041 - RNA, 19 nt, Human
ucugggcuagguagaaaaa

SEQ ID NO: 3640042 - RNA, 16 nt, Human
ucugggcuauggacac

SEQ ID NO: 3640043 - RNA, 17 nt, Human
ucugggcuauggacaca

SEQ ID NO: 3640044 - RNA, 18 nt, Human
ucugggcuauggacacag

SEQ ID NO: 3640045 - RNA, 14 nt, Human
ucugggcucugagu

SEQ ID NO: 3640046 - RNA, 14 nt, Human
ucugggcucuuucc

SEQ ID NO: 3640047 - RNA, 19 nt, Human
ucugggcugucuauucuag

SEQ ID NO: 3640048 - RNA, 14 nt, Human
ucugggcugugggc

SEQ ID NO: 3640049 - RNA, 21 nt, Human
ucugggcuuauaucuggccuc

SEQ ID NO: 3640050 - RNA, 16 nt, Human
ucugggcuuccuggag

SEQ ID NO: 3640051 - RNA, 20 nt, Human
ucuggggaaagacacugccu

SEQ ID NO: 3640052 - RNA, 21 nt, Human
ucuggggaaagacacugccug

SEQ ID NO: 3640053 - RNA, 19 nt, Human
ucuggggagcaggcagcca

SEQ ID NO: 3640054 - RNA, 21 nt, Human
ucuggggagcaggcagccagc

SEQ ID NO: 3640055 - RNA, 17 nt, Human
ucuggggagcuggacag

SEQ ID NO: 3640056 - RNA, 20 nt, Human
ucuggggcaggcugggccau

SEQ ID NO: 3640057 - RNA, 13 nt, Human
ucuggggccccuu

SEQ ID NO: 3640058 - RNA, 20 nt, Human
ucuggggccuaauaaaacug

SEQ ID NO: 3640059 - RNA, 21 nt, Human
ucuggggccuaauaaaacuga

SEQ ID NO: 3640060 - RNA, 14 nt, Human
ucuggggcucuagg

SEQ ID NO: 3640061 - RNA, 19 nt, Human
ucugggggcugaggagcag

SEQ ID NO: 3640062 - RNA, 19 nt, Human
ucuggggggacccagugca

SEQ ID NO: 3640063 - RNA, 13 nt, Human
ucugggggucagg

SEQ ID NO: 3640064 - RNA, 15 nt, Human
ucugggguccccagg

SEQ ID NO: 3640065 - RNA, 17 nt, Human
ucugggguucagccccu

SEQ ID NO: 3640066 - RNA, 15 nt, Human
ucugggucagugguc

SEQ ID NO: 3640067 - RNA, 15 nt, Human
ucuggguccuuccug

SEQ ID NO: 3640068 - RNA, 13 nt, Human
ucugggucuuuug

SEQ ID NO: 3640069 - RNA, 22 nt, Human
ucugggugcaggagcgcucccu

SEQ ID NO: 3640070 - RNA, 18 nt, Human
ucugggugcucccuacca

SEQ ID NO: 3640071 - RNA, 22 nt, Human
ucuggguggcucacucagcacu

SEQ ID NO: 3640072 - RNA, 23 nt, Human
ucuggguuccuuccucugagccu

SEQ ID NO: 3640073 - RNA, 21 nt, Human
ucugguaauauugacuuguau

SEQ ID NO: 3640074 - RNA, 22 nt, Human
ucugguaauauugacuuguaua

SEQ ID NO: 3640075 - RNA, 21 nt, Human
ucugguaaucgggguauaaua

SEQ ID NO: 3640076 - RNA, 18 nt, Human
ucugguagaagggaaagc

SEQ ID NO: 3640077 - RNA, 16 nt, Human
ucugguagauagaaau

SEQ ID NO: 3640078 - RNA, 13 nt, Human
ucugguagccugc

SEQ ID NO: 3640079 - RNA, 20 nt, Human
ucugguaggaauagcauguc

SEQ ID NO: 3640080 - RNA, 21 nt, Human
ucugguaucuaauucuuuaau

SEQ ID NO: 3640081 - RNA, 23 nt, Human
ucugguaugaacuugaggacaca

SEQ ID NO: 3640082 - RNA, 23 nt, Human
ucuggucaaagaaagaaaguuua

SEQ ID NO: 3640083 - RNA, 13 nt, Human
ucuggucccuugc

SEQ ID NO: 3640084 - RNA, 17 nt, Human
ucuggucucuaggcugg

SEQ ID NO: 3640085 - RNA, 18 nt, Human
ucuggucucuaggcuggg

SEQ ID NO: 3640086 - RNA, 19 nt, Human
ucuggucucuaggcugggg

SEQ ID NO: 3640087 - RNA, 16 nt, Human
ucuggugacaccagcc

SEQ ID NO: 3640088 - RNA, 17 nt, Human
ucuggugacaccagccu

SEQ ID NO: 3640089 - RNA, 16 nt, Human
ucuggugaccuuccaa

SEQ ID NO: 3640090 - RNA, 18 nt, Human
ucuggugaccuuccaaga

SEQ ID NO: 3640091 - RNA, 17 nt, Human
ucuggugagucaccacu

SEQ ID NO: 3640092 - RNA, 13 nt, Human
ucuggugccucca

SEQ ID NO: 3640093 - RNA, 16 nt, Human
ucugguggucucugcu

SEQ ID NO: 3640094 - RNA, 16 nt, Human
ucugguggucuguugg

SEQ ID NO: 3640095 - RNA, 13 nt, Human
ucugguuaaaaaa

SEQ ID NO: 3640096 - RNA, 15 nt, Human
ucugguuagcucagc

SEQ ID NO: 3640097 - RNA, 16 nt, Human
ucugguuagcucagcc

SEQ ID NO: 3640098 - RNA, 18 nt, Human
ucugguuagcucagcccc

SEQ ID NO: 3640099 - RNA, 20 nt, Human
ucugguuccuccccuccucc

SEQ ID NO: 3640100 - RNA, 13 nt, Human
ucugguucuaaca

SEQ ID NO: 3640101 - RNA, 19 nt, Human
ucugguucucaauuccaac

SEQ ID NO: 3640102 - RNA, 20 nt, Human
ucugguucucaauuccaaca

SEQ ID NO: 3640103 - RNA, 20 nt, Human
ucugguuguuucuguuccaa

SEQ ID NO: 3640104 - RNA, 15 nt, Human
ucugguuucaccgag

SEQ ID NO: 3640105 - RNA, 16 nt, Human
ucugguuucucauucu

SEQ ID NO: 3640106 - RNA, 23 nt, Human
ucugguuuggggcgaggcagagg

SEQ ID NO: 3640107 - RNA, 16 nt, Human
ucuguaaaaacacuga

SEQ ID NO: 3640108 - RNA, 19 nt, Human
ucuguaaaaacacugaaaa

SEQ ID NO: 3640109 - RNA, 14 nt, Human
ucuguaaaacuaag

SEQ ID NO: 3640110 - RNA, 21 nt, Human
ucuguaaaacuaagaaacuua

SEQ ID NO: 3640111 - RNA, 14 nt, Human
ucuguaaaaucuuu

SEQ ID NO: 3640112 - RNA, 16 nt, Human
ucuguaaaauggaaaa

SEQ ID NO: 3640113 - RNA, 13 nt, Human
ucuguaaacugug

SEQ ID NO: 3640114 - RNA, 16 nt, Human
ucuguaaacuguguau

SEQ ID NO: 3640115 - RNA, 20 nt, Human
ucuguaacgccugcuugucc

SEQ ID NO: 3640116 - RNA, 15 nt, Human
ucuguaagcugaagu

SEQ ID NO: 3640117 - RNA, 12 nt, Human
ucuguaauaaua

SEQ ID NO: 3640118 - RNA, 15 nt, Human
ucuguaauaauagac

SEQ ID NO: 3640119 - RNA, 16 nt, Human
ucuguaauaauagacu

SEQ ID NO: 3640120 - RNA, 15 nt, Human
ucuguaaucucguuu

SEQ ID NO: 3640121 - RNA, 16 nt, Human
ucuguaauucagguuu

SEQ ID NO: 3640122 - RNA, 12 nt, Human
ucuguaauugca

SEQ ID NO: 3640123 - RNA, 13 nt, Human
ucuguaauugcaa

SEQ ID NO: 3640124 - RNA, 14 nt, Human
ucuguaauuuuuca

SEQ ID NO: 3640125 - RNA, 13 nt, Human
ucuguacaaugaa

SEQ ID NO: 3640126 - RNA, 15 nt, Human
ucuguacagagccca

SEQ ID NO: 3640127 - RNA, 22 nt, Human
ucuguacagagccguaaaaacu

SEQ ID NO: 3640128 - RNA, 12 nt, Human
ucuguacauauu

SEQ ID NO: 3640129 - RNA, 12 nt, Human
ucuguaccaguu

SEQ ID NO: 3640130 - RNA, 16 nt, Human
ucuguaccauuuauuu

SEQ ID NO: 3640131 - RNA, 13 nt, Human
ucuguaccccaug

SEQ ID NO: 3640132 - RNA, 15 nt, Human
ucuguacugauucaa

SEQ ID NO: 3640133 - RNA, 17 nt, Human
ucuguacugauucaauu

SEQ ID NO: 3640134 - RNA, 13 nt, Human
ucuuccccuugcc

SEQ ID NO: 3640135 - RNA, 23 nt, Human
ucuuccccuugcccuugcccuga

SEQ ID NO: 3640136 - RNA, 19 nt, Human
ucuucccuacaguugaaaa

SEQ ID NO: 3640137 - RNA, 21 nt, Human
ucuucccuggaaaccuuccac

SEQ ID NO: 3640138 - RNA, 18 nt, Human
ucuucccugguaagaaaa

SEQ ID NO: 3640139 - RNA, 19 nt, Human
ucuucccugguaagaaaaa

SEQ ID NO: 3640140 - RNA, 17 nt, Human
ucuucccuuuccccagc

SEQ ID NO: 3640141 - RNA, 19 nt, Human
ucuucccuuuccccagcau

SEQ ID NO: 3640142 - RNA, 19 nt, Human
ucuucccuuuuacauacug

SEQ ID NO: 3640143 - RNA, 22 nt, Human
ucuucccuuuuacauacugcug

SEQ ID NO: 3640144 - RNA, 21 nt, Human
ucuuccgaaaaauccucuucc

SEQ ID NO: 3640145 - RNA, 16 nt, Human
ucuuccgccccugccu

SEQ ID NO: 3640146 - RNA, 23 nt, Human
ucuuccgccccugccugccaugu

SEQ ID NO: 3640147 - RNA, 16 nt, Human
ucuuccggagauguag

SEQ ID NO: 3640148 - RNA, 16 nt, Human
ucuuccuacucuucuc

SEQ ID NO: 3640149 - RNA, 20 nt, Human
ucuuccuacuggucucucua

SEQ ID NO: 3640150 - RNA, 19 nt, Human
ucuuccuaguuuucuccuc

SEQ ID NO: 3640151 - RNA, 23 nt, Human
ucuuccuaguuuucuccucccag

SEQ ID NO: 3640152 - RNA, 22 nt, Human
ucuuccuaucaaaaagauauca

SEQ ID NO: 3640153 - RNA, 13 nt, Human
ucuuccuauccca

SEQ ID NO: 3640154 - RNA, 17 nt, Human
ucuuccuaucccauccc

SEQ ID NO: 3640155 - RNA, 19 nt, Human
ucuuccuaucccucuccua

SEQ ID NO: 3640156 - RNA, 21 nt, Human
ucuuccuauuugccaugggcu

SEQ ID NO: 3640157 - RNA, 12 nt, Human
ucuuccucagcc

SEQ ID NO: 3640158 - RNA, 14 nt, Human
ucuuccucagccag

SEQ ID NO: 3640159 - RNA, 15 nt, Human
ucuuccucagccagc

SEQ ID NO: 3640160 - RNA, 20 nt, Human
ucuuccuccaaggacagaag

SEQ ID NO: 3640161 - RNA, 13 nt, Human
ucuuccucccaag

SEQ ID NO: 3640162 - RNA, 14 nt, Human
ucuuccucugcuga

SEQ ID NO: 3640163 - RNA, 16 nt, Human
ucuuccucuuccccca

SEQ ID NO: 3640164 - RNA, 16 nt, Human
ucuuccucuugacccu

SEQ ID NO: 3640165 - RNA, 15 nt, Human
ucuuccugacacuuu

SEQ ID NO: 3640166 - RNA, 11 nt, Human
ucuuccugacg

SEQ ID NO: 3640167 - RNA, 23 nt, Human
ucuuccugacgaaacuggccccg

SEQ ID NO: 3640168 - RNA, 22 nt, Human
ucuuccugccccucuuucucuu

SEQ ID NO: 3640169 - RNA, 19 nt, Human
ucuuccuggacaggccagg

SEQ ID NO: 3640170 - RNA, 12 nt, Human
ucuuccuggccg

SEQ ID NO: 3640171 - RNA, 22 nt, Human
ucuuccuggccgccugggucca

SEQ ID NO: 3640172 - RNA, 16 nt, Human
ucuuccuggugacccu

SEQ ID NO: 3640173 - RNA, 14 nt, Human
ucuuccuguaaucu

SEQ ID NO: 3640174 - RNA, 13 nt, Human
ucuuccugugggg

SEQ ID NO: 3640175 - RNA, 19 nt, Human
ucuuccugugggggaagag

SEQ ID NO: 3640176 - RNA, 14 nt, Human
ucuuccuguguccu

SEQ ID NO: 3640177 - RNA, 15 nt, Human
ucuuccuguguccug

SEQ ID NO: 3640178 - RNA, 19 nt, Human
ucuuccuguuaauguauuu

SEQ ID NO: 3640179 - RNA, 18 nt, Human
ucuuccuguuuuguacau

SEQ ID NO: 3640180 - RNA, 22 nt, Human
ucuuccuugaagaacugcaggc

SEQ ID NO: 3640181 - RNA, 23 nt, Human
ucuuccuugaagaacugcaggcc

SEQ ID NO: 3640182 - RNA, 16 nt, Human
ucuuccuuuacuuucc

SEQ ID NO: 3640183 - RNA, 18 nt, Human
ucuuccuuuacuuucccu

SEQ ID NO: 3640184 - RNA, 22 nt, Human
ucuuccuuuacuuucccuugcu

SEQ ID NO: 3640185 - RNA, 16 nt, Human
ucuuccuuucucuuuc

SEQ ID NO: 3640186 - RNA, 17 nt, Human
ucuuccuuucucuuucu

SEQ ID NO: 3640187 - RNA, 15 nt, Human
ucuuccuuuucacug

SEQ ID NO: 3640188 - RNA, 20 nt, Human
ucuucgcgcccgccccugca

SEQ ID NO: 3640189 - RNA, 22 nt, Human
ucuucggcccucagaugucccu

SEQ ID NO: 3640190 - RNA, 23 nt, Human
ucuucggcccucagaugucccuu

SEQ ID NO: 3640191 - RNA, 16 nt, Human
ucuucgggaagagagg

SEQ ID NO: 3640192 - RNA, 18 nt, Human
ucuucgggaagagaggag

SEQ ID NO: 3640193 - RNA, 14 nt, Human
ucuucgucuucacu

SEQ ID NO: 3640194 - RNA, 18 nt, Human
ucuucguucuuguuagua

SEQ ID NO: 3640195 - RNA, 13 nt, Human
ucuucuaaacuuc

SEQ ID NO: 3640196 - RNA, 22 nt, Human
ucuucuaaacuuccccaucuuc

SEQ ID NO: 3640197 - RNA, 14 nt, Human
ucuucuaaucuuuu

SEQ ID NO: 3640198 - RNA, 15 nt, Human
ucuucuaauugcugu

SEQ ID NO: 3640199 - RNA, 15 nt, Human
ucuucuaauuucaaa

SEQ ID NO: 3640200 - RNA, 14 nt, Human
ucuucuagaguuca

SEQ ID NO: 3640201 - RNA, 17 nt, Human
ucuucuagaguucagag

SEQ ID NO: 3640202 - RNA, 23 nt, Human
ucuucuagaugauuuuuugaaag

SEQ ID NO: 3640203 - RNA, 18 nt, Human
ucuucuagcauaucuuuc

SEQ ID NO: 3640204 - RNA, 17 nt, Human
ucuucuagguucuaaaa

SEQ ID NO: 3640205 - RNA, 19 nt, Human
ucuucuagugaugaugguu

SEQ ID NO: 3640206 - RNA, 14 nt, Human
ucuucuaugaccca

SEQ ID NO: 3640207 - RNA, 19 nt, Human
ucuucuauguaggaaaaaa

SEQ ID NO: 3640208 - RNA, 14 nt, Human
ucuucuauugccuc

SEQ ID NO: 3640209 - RNA, 12 nt, Human
ucuucuauuuau

SEQ ID NO: 3640210 - RNA, 15 nt, Human
ucuucuauuuuauuc

SEQ ID NO: 3640211 - RNA, 15 nt, Human
ucuucucaaaagaac

SEQ ID NO: 3640212 - RNA, 12 nt, Human
ucuucucaaagg

SEQ ID NO: 3640213 - RNA, 13 nt, Human
ucuucucaagugc

SEQ ID NO: 3640214 - RNA, 21 nt, Human
ucuucucagaaggcaaaugac

SEQ ID NO: 3640215 - RNA, 23 nt, Human
ucuucucagaaggcaaaugacuu

SEQ ID NO: 3640216 - RNA, 14 nt, Human
ucuucucagagugg

SEQ ID NO: 3640217 - RNA, 23 nt, Human
ucuucucauuucaccccucccuu

SEQ ID NO: 3640218 - RNA, 13 nt, Human
ucuucuccaccuc

SEQ ID NO: 3640219 - RNA, 13 nt, Human
ucuucuccacugg

SEQ ID NO: 3640220 - RNA, 14 nt, Human
ucuucuccagauuu

SEQ ID NO: 3640221 - RNA, 14 nt, Human
ucuucuccaggcug

SEQ ID NO: 3640222 - RNA, 16 nt, Human
ucuucucccagaaucc

SEQ ID NO: 3640223 - RNA, 21 nt, Human
ucuucucccagaaucccagcc

SEQ ID NO: 3640224 - RNA, 14 nt, Human
ucuucuccuuucac

SEQ ID NO: 3640225 - RNA, 20 nt, Human
ucuucucuagcuggugguuu

SEQ ID NO: 3640226 - RNA, 14 nt, Human
ucuucucucugcuc

SEQ ID NO: 3640227 - RNA, 13 nt, Human
ucuucucuguugu

SEQ ID NO: 3640228 - RNA, 14 nt, Human
ucuucucuuccugu

SEQ ID NO: 3640229 - RNA, 15 nt, Human
ucuucucuuccugua

SEQ ID NO: 3640230 - RNA, 21 nt, Human
ucuucucuuccuuuuaucagu

SEQ ID NO: 3640231 - RNA, 19 nt, Human
ucuucugaacucaaacuga

SEQ ID NO: 3640232 - RNA, 21 nt, Human
ucuucugaacuuggcgcugcc

SEQ ID NO: 3640233 - RNA, 17 nt, Human
ucuucugaauaaagcaa

SEQ ID NO: 3640234 - RNA, 15 nt, Human
ucuucugagcacugu

SEQ ID NO: 3640235 - RNA, 20 nt, Human
ucuucugagcuuacguaguu

SEQ ID NO: 3640236 - RNA, 21 nt, Human
ucuucugaguggcuaaaacuu

SEQ ID NO: 3640237 - RNA, 19 nt, Human
ucuucugaucacugaaaua

SEQ ID NO: 3640238 - RNA, 18 nt, Human
ucuucugccggcccuggg

SEQ ID NO: 3640239 - RNA, 11 nt, Human
ucuucugcucc

SEQ ID NO: 3640240 - RNA, 13 nt, Human
ucuucugcuccac

SEQ ID NO: 3640241 - RNA, 14 nt, Human
ucuucugcuccacc

SEQ ID NO: 3640242 - RNA, 16 nt, Human
ucuucugcuccacccu

SEQ ID NO: 3640243 - RNA, 19 nt, Human
ucuucugcuccacccuugg

SEQ ID NO: 3640244 - RNA, 22 nt, Human
ucuucugcuccacccuuggccu

SEQ ID NO: 3640245 - RNA, 18 nt, Human
ucuucugcuuaggagaga

SEQ ID NO: 3640246 - RNA, 12 nt, Human
ucuucugcuuca

SEQ ID NO: 3640247 - RNA, 23 nt, Human
ucuucugcuuuguugugugccuc

SEQ ID NO: 3640248 - RNA, 18 nt, Human
ucuucuggggcaggcugg

SEQ ID NO: 3640249 - RNA, 20 nt, Human
ucuucuggggcaggcugggc

SEQ ID NO: 3640250 - RNA, 22 nt, Human
ucuucuggggcaggcugggcca

SEQ ID NO: 3640251 - RNA, 20 nt, Human
ucuucuguacgucugacagg

SEQ ID NO: 3640252 - RNA, 21 nt, Human
ucuucuguacgucugacaggc

SEQ ID NO: 3640253 - RNA, 22 nt, Human
ucuucuguauuuuuuuuucuaa

SEQ ID NO: 3640254 - RNA, 13 nt, Human
ucuucugucccug

SEQ ID NO: 3640255 - RNA, 15 nt, Human
ucuucugucccuguu

SEQ ID NO: 3640256 - RNA, 21 nt, Human
ucuucuguguuuauaaaauau

SEQ ID NO: 3640257 - RNA, 18 nt, Human
ucuucuuaagacuuuugg

SEQ ID NO: 3640258 - RNA, 22 nt, Human
ucuucuuaauauguucuuuuaa

SEQ ID NO: 3640259 - RNA, 15 nt, Human
ucuucuuacaugcau

SEQ ID NO: 3640260 - RNA, 15 nt, Human
ucuucuucaccauuu

SEQ ID NO: 3640261 - RNA, 14 nt, Human
ucuucuucagaaga

SEQ ID NO: 3640262 - RNA, 16 nt, Human
ucuucuucagaagaca

SEQ ID NO: 3640263 - RNA, 13 nt, Human
ucuucuucccucc

SEQ ID NO: 3640264 - RNA, 22 nt, Human
ucuucuucucguccucguuugu

SEQ ID NO: 3640265 - RNA, 15 nt, Human
ucuucuucuucagaa

SEQ ID NO: 3640266 - RNA, 17 nt, Human
ucuucuugaaauuuuaa

SEQ ID NO: 3640267 - RNA, 21 nt, Human
ucuucuuggggcccagugcau

SEQ ID NO: 3640268 - RNA, 19 nt, Human
ucuucuuucagacuugcca

SEQ ID NO: 3640269 - RNA, 21 nt, Human
ucuucuuuuagcaguaaaaua

SEQ ID NO: 3640270 - RNA, 22 nt, Human
ucuucuuuugagcaacuuucuu

SEQ ID NO: 3640271 - RNA, 18 nt, Human
ucuucuuuuggcuuccau

SEQ ID NO: 3640272 - RNA, 16 nt, Human
ucuucuuuuuuuguga

SEQ ID NO: 3640273 - RNA, 17 nt, Human
ucuucuuuuuuugugau

SEQ ID NO: 3640274 - RNA, 23 nt, Human
ucuugaaagauucagguauguug

SEQ ID NO: 3640275 - RNA, 20 nt, Human
ucuugaaauauaggaacuua

SEQ ID NO: 3640276 - RNA, 19 nt, Human
ucuugaacuccugaccuca

SEQ ID NO: 3640277 - RNA, 17 nt, Human
ucuugaacucuuggccu

SEQ ID NO: 3640278 - RNA, 20 nt, Human
ugacacugcggggcuuggcu

SEQ ID NO: 3640279 - RNA, 23 nt, Human
ugacacugcggggcuuggcugag

SEQ ID NO: 3640280 - RNA, 21 nt, Human
ugacacugcucuaacagcccu

SEQ ID NO: 3640281 - RNA, 22 nt, Human
ugacacugcucuaacagcccuc

SEQ ID NO: 3640282 - RNA, 19 nt, Human
ugacacugguauuccugcc

SEQ ID NO: 3640283 - RNA, 17 nt, Human
ugacacuuaaaaauggu

SEQ ID NO: 3640284 - RNA, 15 nt, Human
ugacacuucaaggug

SEQ ID NO: 3640285 - RNA, 18 nt, Human
ugacacuucaaggugaca

SEQ ID NO: 3640286 - RNA, 22 nt, Human
ugacacuuuaauuaccaaccug

SEQ ID NO: 3640287 - RNA, 20 nt, Human
ugacacuuugccagaaagca

SEQ ID NO: 3640288 - RNA, 19 nt, Human
ugacacuuuucauaucauu

SEQ ID NO: 3640289 - RNA, 20 nt, Human
ugacagaaaauauguauuaa

SEQ ID NO: 3640290 - RNA, 13 nt, Human
ugacagaacacug

SEQ ID NO: 3640291 - RNA, 17 nt, Human
ugacagaacacugucuu

SEQ ID NO: 3640292 - RNA, 16 nt, Human
ugacagaaggaccagc

SEQ ID NO: 3640293 - RNA, 20 nt, Human
ugacagaaggaccagcccuu

SEQ ID NO: 3640294 - RNA, 18 nt, Human
ugacagaauauguuucaa

SEQ ID NO: 3640295 - RNA, 21 nt, Human
ugacagaauauguuucaaacu

SEQ ID NO: 3640296 - RNA, 23 nt, Human
ugacagaauauguuucaaacuuu

SEQ ID NO: 3640297 - RNA, 13 nt, Human
ugacagacacagg

SEQ ID NO: 3640298 - RNA, 16 nt, Human
ugacagacagcccucc

SEQ ID NO: 3640299 - RNA, 19 nt, Human
ugacagacaggcucuuagc

SEQ ID NO: 3640300 - RNA, 17 nt, Human
ugacagaccacaucuuu

SEQ ID NO: 3640301 - RNA, 17 nt, Human
ugacagacuccugagga

SEQ ID NO: 3640302 - RNA, 22 nt, Human
ugacagagagagauacucuggg

SEQ ID NO: 3640303 - RNA, 12 nt, Human
ugacagagccag

SEQ ID NO: 3640304 - RNA, 23 nt, Human
ugacagagccuucugaggacauu

SEQ ID NO: 3640305 - RNA, 19 nt, Human
ugacagagcgagacuccau

SEQ ID NO: 3640306 - RNA, 23 nt, Human
ugacagaggcagccccauucugc

SEQ ID NO: 3640307 - RNA, 22 nt, Human
ugacagagggauggaggaagaa

SEQ ID NO: 3640308 - RNA, 14 nt, Human
ugacagauugaauu

SEQ ID NO: 3640309 - RNA, 22 nt, Human
ugacagcacuaaacuuggugcu

SEQ ID NO: 3640310 - RNA, 21 nt, Human
ugacagcaugugcccuccuga

SEQ ID NO: 3640311 - RNA, 11 nt, Human
ugacagccucc

SEQ ID NO: 3640312 - RNA, 12 nt, Human
ugacagccuccc

SEQ ID NO: 3640313 - RNA, 17 nt, Human
ugacagccucccacccc

SEQ ID NO: 3640314 - RNA, 15 nt, Human
ugacagccugcagca

SEQ ID NO: 3640315 - RNA, 17 nt, Human
ugacagcgcacagcugc

SEQ ID NO: 3640316 - RNA, 19 nt, Human
ugacagcucuuuuugugaa

SEQ ID NO: 3640317 - RNA, 12 nt, Human
ugacagcugcuc

SEQ ID NO: 3640318 - RNA, 14 nt, Human
ugacagcugcuccu

SEQ ID NO: 3640319 - RNA, 23 nt, Human
ugacagcugcuccuagagggagg

SEQ ID NO: 3640320 - RNA, 15 nt, Human
ugacagcuuugcugc

SEQ ID NO: 3640321 - RNA, 20 nt, Human
ugacagcuuugcugcugaag

SEQ ID NO: 3640322 - RNA, 17 nt, Human
ugacaggcaaugcuggc

SEQ ID NO: 3640323 - RNA, 14 nt, Human
ugacaggcagcaga

SEQ ID NO: 3640324 - RNA, 19 nt, Human
ugacaggcagcagagacuu

SEQ ID NO: 3640325 - RNA, 18 nt, Human
ugacaggcagccuggaca

SEQ ID NO: 3640326 - RNA, 18 nt, Human
ugacaggcgaaagaaaac

SEQ ID NO: 3640327 - RNA, 11 nt, Human
ugacagggcac

SEQ ID NO: 3640328 - RNA, 16 nt, Human
ugacagggcacaccgg

SEQ ID NO: 3640329 - RNA, 12 nt, Human
ugacagggccag

SEQ ID NO: 3640330 - RNA, 20 nt, Human
ugacagggccaguggggccu

SEQ ID NO: 3640331 - RNA, 22 nt, Human
ugacagggccaguggggccugu

SEQ ID NO: 3640332 - RNA, 21 nt, Human
ugacaguaauuguguuuacau

SEQ ID NO: 3640333 - RNA, 22 nt, Human
ugacaguaauuguguuuacauu

SEQ ID NO: 3640334 - RNA, 13 nt, Human
ugacagucaucau

SEQ ID NO: 3640335 - RNA, 21 nt, Human
ugacagucaucaucagggccu

SEQ ID NO: 3640336 - RNA, 15 nt, Human
ugacaguccucucca

SEQ ID NO: 3640337 - RNA, 17 nt, Human
ugacaguccucuccacc

SEQ ID NO: 3640338 - RNA, 15 nt, Human
ugacagucuugugcu

SEQ ID NO: 3640339 - RNA, 19 nt, Human
ugacagugagguccugggg

SEQ ID NO: 3640340 - RNA, 20 nt, Human
ugacagugagguccuggggg

SEQ ID NO: 3640341 - RNA, 14 nt, Human
ugacagugccuggg

SEQ ID NO: 3640342 - RNA, 17 nt, Human
ugacagugccugggaau

SEQ ID NO: 3640343 - RNA, 21 nt, Human
ugacaguggccgcccaaggcc

SEQ ID NO: 3640344 - RNA, 16 nt, Human
ugacaguguugaaaau

SEQ ID NO: 3640345 - RNA, 13 nt, Human
ugacaguuauuuu

SEQ ID NO: 3640346 - RNA, 23 nt, Human
ugacaguuuuccauaaagaagau

SEQ ID NO: 3640347 - RNA, 17 nt, Human
ugacaguuuuucuguuu

SEQ ID NO: 3640348 - RNA, 20 nt, Human
ugacauaaaaacaacuuuau

SEQ ID NO: 3640349 - RNA, 14 nt, Human
ugacauaaaguuga

SEQ ID NO: 3640350 - RNA, 17 nt, Human
ugacauacauccaacau

SEQ ID NO: 3640351 - RNA, 16 nt, Human
ugacauacccccuccc

SEQ ID NO: 3640352 - RNA, 13 nt, Human
ugacauauacaua

SEQ ID NO: 3640353 - RNA, 15 nt, Human
ugacauaucuacacu

SEQ ID NO: 3640354 - RNA, 13 nt, Human
ugacauauuuaau

SEQ ID NO: 3640355 - RNA, 15 nt, Human
ugacauauuuaaugu

SEQ ID NO: 3640356 - RNA, 14 nt, Human
ugacaucacagcag

SEQ ID NO: 3640357 - RNA, 16 nt, Human
ugacaucacagcagcc

SEQ ID NO: 3640358 - RNA, 17 nt, Human
ugacaucaccacaguuu

SEQ ID NO: 3640359 - RNA, 19 nt, Human
ugacaucacuuguacaaaa

SEQ ID NO: 3640360 - RNA, 17 nt, Human
ugacaucagccagcugc

SEQ ID NO: 3640361 - RNA, 23 nt, Human
ugacaucaguggcauggcuccag

SEQ ID NO: 3640362 - RNA, 17 nt, Human
ugacauccaagcuuccu

SEQ ID NO: 3640363 - RNA, 14 nt, Human
ugacaucuggaauc

SEQ ID NO: 3640364 - RNA, 16 nt, Human
ugacaucuucaaagcu

SEQ ID NO: 3640365 - RNA, 17 nt, Human
ugacaucuugaauccuu

SEQ ID NO: 3640366 - RNA, 17 nt, Human
ugacaucuuuuuaaagc

SEQ ID NO: 3640367 - RNA, 15 nt, Human
ugacaugaagcuguu

SEQ ID NO: 3640368 - RNA, 21 nt, Human
ugacaugauuagcagaagaaa

SEQ ID NO: 3640369 - RNA, 22 nt, Human
ugacaugauuccuuccuguucu

SEQ ID NO: 3640370 - RNA, 11 nt, Human
ugacaugcacu

SEQ ID NO: 3640371 - RNA, 13 nt, Human
ugacaugcacuga

SEQ ID NO: 3640372 - RNA, 17 nt, Human
ugacaugcacugacccu

SEQ ID NO: 3640373 - RNA, 21 nt, Human
ugacaugcccucccuucuccc

SEQ ID NO: 3640374 - RNA, 22 nt, Human
ugacaugcccucccuucucccu

SEQ ID NO: 3640375 - RNA, 18 nt, Human
ugacaugcgggcugggca

SEQ ID NO: 3640376 - RNA, 19 nt, Human
ugacaugcgggcugggcag

SEQ ID NO: 3640377 - RNA, 20 nt, Human
ugacaugcgggcugggcagc

SEQ ID NO: 3640378 - RNA, 16 nt, Human
ugacaugggacauuug

SEQ ID NO: 3640379 - RNA, 17 nt, Human
ugacaugggacauuugc

SEQ ID NO: 3640380 - RNA, 17 nt, Human
ugacauggugccugaga

SEQ ID NO: 3640381 - RNA, 15 nt, Human
ugacaugucuuuucu

SEQ ID NO: 3640382 - RNA, 15 nt, Human
ugacaugugaaaccu

SEQ ID NO: 3640383 - RNA, 14 nt, Human
ugacauguggaaag

SEQ ID NO: 3640384 - RNA, 19 nt, Human
ugacauguggggccagguc

SEQ ID NO: 3640385 - RNA, 20 nt, Human
ugacauguggggccagguca

SEQ ID NO: 3640386 - RNA, 15 nt, Human
ugacaugugucaagc

SEQ ID NO: 3640387 - RNA, 19 nt, Human
ugacauguuauauauuuuu

SEQ ID NO: 3640388 - RNA, 13 nt, Human
ugacauguuuuau

SEQ ID NO: 3640389 - RNA, 20 nt, Human
ugacauuaugugguuuuaga

SEQ ID NO: 3640390 - RNA, 13 nt, Human
ugacauucccugc

SEQ ID NO: 3640391 - RNA, 16 nt, Human
ugacauucugaaugcu

SEQ ID NO: 3640392 - RNA, 18 nt, Human
ugacauucugaaugcuuc

SEQ ID NO: 3640393 - RNA, 20 nt, Human
ugacauucugaaugcuucua

SEQ ID NO: 3640394 - RNA, 14 nt, Human
ugacauugacuauu

SEQ ID NO: 3640395 - RNA, 14 nt, Human
ugacauugcaccug

SEQ ID NO: 3640396 - RNA, 18 nt, Human
ugacauugcuaagaugcu

SEQ ID NO: 3640397 - RNA, 11 nt, Human
ugacauugucu

SEQ ID NO: 3640398 - RNA, 20 nt, Human
ugacauuguuggccaaagcc

SEQ ID NO: 3640399 - RNA, 23 nt, Human
ugacauuuaauuuagugaucuua

SEQ ID NO: 3640400 - RNA, 17 nt, Human
ugacauuugucauuuuc

SEQ ID NO: 3640401 - RNA, 19 nt, Human
ugacauuugucauuuucau

SEQ ID NO: 3640402 - RNA, 24 nt, Human
ugacauuuguuugguuauagugca

SEQ ID NO: 3640403 - RNA, 15 nt, Human
ugacauuuuacauua

SEQ ID NO: 3640404 - RNA, 23 nt, Human
ugaccaaaaguuacauguuugca

SEQ ID NO: 3640405 - RNA, 18 nt, Human
ugaccaaaauccccuucu

SEQ ID NO: 3640406 - RNA, 16 nt, Human
ugaccaaaguccuuuu

SEQ ID NO: 3640407 - RNA, 19 nt, Human
ugaccaaauaucaccagga

SEQ ID NO: 3640408 - RNA, 16 nt, Human
ugaccaacauggagaa

SEQ ID NO: 3640409 - RNA, 23 nt, Human
ugaccaacauggagaaacccugu

SEQ ID NO: 3640410 - RNA, 22 nt, Human
ugaccaaccuuuucccaaccau

SEQ ID NO: 3640411 - RNA, 14 nt, Human
ugaccaagaacugc

SEQ ID NO: 3640412 - RNA, 17 nt, Human
ugaccaagagagaaaga

SEQ ID NO: 3640413 - RNA, 15 nt, Human
ugaccaagauacuua

SEQ ID NO: 3640414 - RNA, 20 nt, Human
ugaccaaguuauaaaucaau

SEQ ID NO: 3640415 - RNA, 18 nt, Human
ugaccaauugugcugcca

SEQ ID NO: 3640416 - RNA, 13 nt, Human
ugaccaauuuuaa

SEQ ID NO: 3640417 - RNA, 15 nt, Human
ugaccacacuuccug

SEQ ID NO: 3640418 - RNA, 15 nt, Human
ugaccacagcacagc

SEQ ID NO: 3640419 - RNA, 19 nt, Human
ugaccacagcacagccaac

SEQ ID NO: 3640420 - RNA, 18 nt, Human
ugaccacaggcaguuacu

SEQ ID NO: 3640421 - RNA, 18 nt, Human
ugaccacauagcaugagg

SEQ ID NO: 3640422 - RNA, 19 nt, Human
ugacuuacuguacaugaaa

SEQ ID NO: 3640423 - RNA, 19 nt, Human
ugacuuagaaucccugugu

SEQ ID NO: 3640424 - RNA, 14 nt, Human
ugacuuaguacaaa

SEQ ID NO: 3640425 - RNA, 16 nt, Human
ugacuuaguacaaagu

SEQ ID NO: 3640426 - RNA, 19 nt, Human
ugacuuaguacaaaguuuc

SEQ ID NO: 3640427 - RNA, 14 nt, Human
ugacuuauaguaca

SEQ ID NO: 3640428 - RNA, 17 nt, Human
ugacuuauuuauauaaa

SEQ ID NO: 3640429 - RNA, 18 nt, Human
ugacuuauuuucucugug

SEQ ID NO: 3640430 - RNA, 23 nt, Human
ugacuucaaugauaguaagaaaa

SEQ ID NO: 3640431 - RNA, 13 nt, Human
ugacuucaggggc

SEQ ID NO: 3640432 - RNA, 13 nt, Human
ugacuucauggaa

SEQ ID NO: 3640433 - RNA, 21 nt, Human
ugacuucauggaauggacauc

SEQ ID NO: 3640434 - RNA, 22 nt, Human
ugacuucauuaauaauaaauuc

SEQ ID NO: 3640435 - RNA, 20 nt, Human
ugacuuccccaauaucuugc

SEQ ID NO: 3640436 - RNA, 15 nt, Human
ugacuucuaaguaaa

SEQ ID NO: 3640437 - RNA, 22 nt, Human
ugacuucuaaguaaaaccacag

SEQ ID NO: 3640438 - RNA, 17 nt, Human
ugacuucuaauaucauu

SEQ ID NO: 3640439 - RNA, 14 nt, Human
ugacuucuccaggu

SEQ ID NO: 3640440 - RNA, 12 nt, Human
ugacuucugccu

SEQ ID NO: 3640441 - RNA, 21 nt, Human
ugacuucugcuggcaucaaga

SEQ ID NO: 3640442 - RNA, 22 nt, Human
ugacuugaagacuuacagcaaa

SEQ ID NO: 3640443 - RNA, 19 nt, Human
ugacuugacagaacacugu

SEQ ID NO: 3640444 - RNA, 23 nt, Human
ugacuugcacagggauucucaca

SEQ ID NO: 3640445 - RNA, 23 nt, Human
ugacuugcaugaagagaagcaau

SEQ ID NO: 3640446 - RNA, 12 nt, Human
ugacuuggcugg

SEQ ID NO: 3640447 - RNA, 13 nt, Human
ugacuuggcuggu

SEQ ID NO: 3640448 - RNA, 22 nt, Human
ugacuugggcacccccagccug

SEQ ID NO: 3640449 - RNA, 19 nt, Human
ugacuuggggagauggagu

SEQ ID NO: 3640450 - RNA, 15 nt, Human
ugacuuguuugucuu

SEQ ID NO: 3640451 - RNA, 21 nt, Human
ugacuuuagaaagcugacauu

SEQ ID NO: 3640452 - RNA, 15 nt, Human
ugacuuuauaaauuu

SEQ ID NO: 3640453 - RNA, 20 nt, Human
ugacuuuauuauuuauuuuu

SEQ ID NO: 3640454 - RNA, 15 nt, Human
ugacuuucauuggaa

SEQ ID NO: 3640455 - RNA, 21 nt, Human
ugacuuuccccaccagaugcu

SEQ ID NO: 3640456 - RNA, 16 nt, Human
ugacuuuccucuuugg

SEQ ID NO: 3640457 - RNA, 17 nt, Human
ugacuuugcuugcuuug

SEQ ID NO: 3640458 - RNA, 22 nt, Human
ugacuuuggauaauaaggaaaa

SEQ ID NO: 3640459 - RNA, 16 nt, Human
ugacuuuggcugcaug

SEQ ID NO: 3640460 - RNA, 20 nt, Human
ugacuuuuaaggcuaaaacu

SEQ ID NO: 3640461 - RNA, 16 nt, Human
ugacuuuucaaguauu

SEQ ID NO: 3640462 - RNA, 13 nt, Human
ugacuuuuccaug

SEQ ID NO: 3640463 - RNA, 19 nt, Human
ugacuuuuccauguaucua

SEQ ID NO: 3640464 - RNA, 19 nt, Human
ugacuuuucuguaauucag

SEQ ID NO: 3640465 - RNA, 14 nt, Human
ugacuuuucugugg

SEQ ID NO: 3640466 - RNA, 14 nt, Human
ugacuuuugcuuua

SEQ ID NO: 3640467 - RNA, 16 nt, Human
ugacuuuugcuuuaau

SEQ ID NO: 3640468 - RNA, 12 nt, Human
ugacuuuuguau

SEQ ID NO: 3640469 - RNA, 14 nt, Human
ugacuuuugugaaa

SEQ ID NO: 3640470 - RNA, 22 nt, Human
ugacuuuuucuaagagcucccg

SEQ ID NO: 3640471 - RNA, 18 nt, Human
ugacuuuuuuuguaugug

SEQ ID NO: 3640472 - RNA, 19 nt, Human
ugacuuuuuuuguaugugu

SEQ ID NO: 3640473 - RNA, 17 nt, Human
ugagaaaaagcuccugu

SEQ ID NO: 3640474 - RNA, 18 nt, Human
ugagaaaaagcuccuguc

SEQ ID NO: 3640475 - RNA, 18 nt, Human
ugagaaaaauauauacua

SEQ ID NO: 3640476 - RNA, 13 nt, Human
ugagaaaacaagc

SEQ ID NO: 3640477 - RNA, 18 nt, Human
ugagaaaaccccuuccca

SEQ ID NO: 3640478 - RNA, 21 nt, Human
ugagaaaacguuuuguuugaa

SEQ ID NO: 3640479 - RNA, 14 nt, Human
ugagaaaacuguga

SEQ ID NO: 3640480 - RNA, 22 nt, Human
ugagaaaacugugaccaaguau

SEQ ID NO: 3640481 - RNA, 12 nt, Human
ugagaaaauguc

SEQ ID NO: 3640482 - RNA, 16 nt, Human
ugagaaaauugaaaua

SEQ ID NO: 3640483 - RNA, 17 nt, Human
ugagaaaccuguaucuu

SEQ ID NO: 3640484 - RNA, 18 nt, Human
ugagaaaccuguaucuuu

SEQ ID NO: 3640485 - RNA, 23 nt, Human
ugagaaacuguuugaaaacuuca

SEQ ID NO: 3640486 - RNA, 18 nt, Human
ugagaaagacuauucaaa

SEQ ID NO: 3640487 - RNA, 20 nt, Human
ugagaaagacuauucaaaca

SEQ ID NO: 3640488 - RNA, 21 nt, Human
ugagaaagcccugucgggcuu

SEQ ID NO: 3640489 - RNA, 16 nt, Human
ugagaaagccuucuuu

SEQ ID NO: 3640490 - RNA, 19 nt, Human
ugagaaaggguagaauucu

SEQ ID NO: 3640491 - RNA, 21 nt, Human
ugagaaagucuuauuuauuca

SEQ ID NO: 3640492 - RNA, 15 nt, Human
ugagaaauaaaguuu

SEQ ID NO: 3640493 - RNA, 22 nt, Human
ugagaaauagcuuaugaaaaga

SEQ ID NO: 3640494 - RNA, 22 nt, Human
ugagaaaugaauaauuucccaa

SEQ ID NO: 3640495 - RNA, 11 nt, Human
ugagaaaugca

SEQ ID NO: 3640496 - RNA, 12 nt, Human
ugagaaaugcau

SEQ ID NO: 3640497 - RNA, 13 nt, Human
ugagaaaugcaua

SEQ ID NO: 3640498 - RNA, 23 nt, Human
ugagaaauguaaugcgauuuuau

SEQ ID NO: 3640499 - RNA, 13 nt, Human
ugagaaauuaagu

SEQ ID NO: 3640500 - RNA, 19 nt, Human
ugagaaauuucugugaaac

SEQ ID NO: 3640501 - RNA, 23 nt, Human
ugagaacaaagcuguuaaacugu

SEQ ID NO: 3640502 - RNA, 14 nt, Human
ugagaacacuguga

SEQ ID NO: 3640503 - RNA, 21 nt, Human
ugagaacagaucuccaaagcu

SEQ ID NO: 3640504 - RNA, 18 nt, Human
ugagaacccugcgugggg

SEQ ID NO: 3640505 - RNA, 20 nt, Human
ugagaaccguagaugauuuc

SEQ ID NO: 3640506 - RNA, 16 nt, Human
ugagaaccuggccuuc

SEQ ID NO: 3640507 - RNA, 12 nt, Human
ugagaaccuggg

SEQ ID NO: 3640508 - RNA, 21 nt, Human
ugagaaccuggguugcagaca

SEQ ID NO: 3640509 - RNA, 15 nt, Human
ugagaacuccugacu

SEQ ID NO: 3640510 - RNA, 17 nt, Human
ugagaagaaaacaucua

SEQ ID NO: 3640511 - RNA, 17 nt, Human
ugagaagagggccugug

SEQ ID NO: 3640512 - RNA, 22 nt, Human
ugagaagauucuucccauucuc

SEQ ID NO: 3640513 - RNA, 17 nt, Human
ugagaagccgugggugg

SEQ ID NO: 3640514 - RNA, 13 nt, Human
ugagaagccuuca

SEQ ID NO: 3640515 - RNA, 21 nt, Human
ugagaagcugcuccaggccug

SEQ ID NO: 3640516 - RNA, 22 nt, Human
ugagaagcugcuccaggccugc

SEQ ID NO: 3640517 - RNA, 17 nt, Human
ugagaaggaauuugagu

SEQ ID NO: 3640518 - RNA, 13 nt, Human
ugagaaggagaga

SEQ ID NO: 3640519 - RNA, 23 nt, Human
ugagaaggggaggaccucugggc

SEQ ID NO: 3640520 - RNA, 16 nt, Human
ugagaagguccuuaau

SEQ ID NO: 3640521 - RNA, 16 nt, Human
ugagaagguuuauugu

SEQ ID NO: 3640522 - RNA, 18 nt, Human
ugagaagguuuauuguua

SEQ ID NO: 3640523 - RNA, 19 nt, Human
ugagaagguuuauuguuaa

SEQ ID NO: 3640524 - RNA, 16 nt, Human
ugagaaguagccacag

SEQ ID NO: 3640525 - RNA, 22 nt, Human
ugagaagucaaacauuucaaag

SEQ ID NO: 3640526 - RNA, 19 nt, Human
ugagaagugaaugcuggga

SEQ ID NO: 3640527 - RNA, 21 nt, Human
ugagaagugaaugcugggacu

SEQ ID NO: 3640528 - RNA, 17 nt, Human
ugagaaguuuuguacag

SEQ ID NO: 3640529 - RNA, 15 nt, Human
ugagaauagaaggaa

SEQ ID NO: 3640530 - RNA, 17 nt, Human
ugagaaucagaucauuu

SEQ ID NO: 3640531 - RNA, 20 nt, Human
ugagaaucagaucauuucaa

SEQ ID NO: 3640532 - RNA, 20 nt, Human
ugagaaucccaaauuugauu

SEQ ID NO: 3640533 - RNA, 21 nt, Human
ugagaaucuacccccagaucc

SEQ ID NO: 3640534 - RNA, 23 nt, Human
ugagaaucuauauuuaacaagau

SEQ ID NO: 3640535 - RNA, 21 nt, Human
ugagaaucuuuauugagaaag

SEQ ID NO: 3640536 - RNA, 22 nt, Human
ugagaaucuuuauugagaaaga

SEQ ID NO: 3640537 - RNA, 15 nt, Human
ugagaaugaacaaag

SEQ ID NO: 3640538 - RNA, 17 nt, Human
ugagaaugaacaaagac

SEQ ID NO: 3640539 - RNA, 16 nt, Human
ugagaauuccaaggag

SEQ ID NO: 3640540 - RNA, 20 nt, Human
ugagaauugugcucaaaauu

SEQ ID NO: 3640541 - RNA, 15 nt, Human
ugagaauuucuaaaa

SEQ ID NO: 3640542 - RNA, 22 nt, Human
ugagaauuucuaaaaagauuag

SEQ ID NO: 3640543 - RNA, 13 nt, Human
ugagaauuuuaaa

SEQ ID NO: 3640544 - RNA, 18 nt, Human
ugagacaaaaauuaucua

SEQ ID NO: 3640545 - RNA, 21 nt, Human
ugagacaagaaaauaagagcu

SEQ ID NO: 3640546 - RNA, 16 nt, Human
ugagacaaugccuugu

SEQ ID NO: 3640547 - RNA, 19 nt, Human
ugagacacaggaugaagca

SEQ ID NO: 3640548 - RNA, 13 nt, Human
ugagacagaaucu

SEQ ID NO: 3640549 - RNA, 14 nt, Human
ugagacagagccuc

SEQ ID NO: 3640550 - RNA, 21 nt, Human
ugagacagaguuuucacucuu

SEQ ID NO: 3640551 - RNA, 19 nt, Human
ugagacagcccgggcucug

SEQ ID NO: 3640552 - RNA, 12 nt, Human
ugagacagcucu

SEQ ID NO: 3640553 - RNA, 14 nt, Human
ugagacagugaauu

SEQ ID NO: 3640554 - RNA, 15 nt, Human
ugagacagugaauuu

SEQ ID NO: 3640555 - RNA, 16 nt, Human
ugagacagugaauuug

SEQ ID NO: 3640556 - RNA, 14 nt, Human
ugagacagugcaca

SEQ ID NO: 3640557 - RNA, 19 nt, Human
ugagacagugcacaugaac

SEQ ID NO: 3640558 - RNA, 17 nt, Human
ugagacagugggaaaua

SEQ ID NO: 3640559 - RNA, 14 nt, Human
ugagacaguuucuu

SEQ ID NO: 3640560 - RNA, 15 nt, Human
ugagacaguuucuua

SEQ ID NO: 3640561 - RNA, 20 nt, Human
ugagacaguuucuuagcuuu

SEQ ID NO: 3640562 - RNA, 21 nt, Human
ugagacaguuucuuagcuuuu

SEQ ID NO: 3640563 - RNA, 13 nt, Human
ugagacauauuua

SEQ ID NO: 3640564 - RNA, 13 nt, Human
ugagaccacagag

SEQ ID NO: 3640565 - RNA, 21 nt, Human
ugagaccaguugaauaaaagu

SEQ ID NO: 3640566 - RNA, 18 nt, Human
ugaggaaaggccagcugg

SEQ ID NO: 3640567 - RNA, 19 nt, Human
ugaggaaagucauuggcuu

SEQ ID NO: 3640568 - RNA, 15 nt, Human
ugaggaaauuugcag

SEQ ID NO: 3640569 - RNA, 16 nt, Human
ugaggaaauuugcagc

SEQ ID NO: 3640570 - RNA, 18 nt, Human
ugaggaacggaucagaug

SEQ ID NO: 3640571 - RNA, 24 nt, Human
ugaggaagaacggggcucuucuca

SEQ ID NO: 3640572 - RNA, 19 nt, Human
ugaggaagccgcuggggcc

SEQ ID NO: 3640573 - RNA, 17 nt, Human
ugaggaagcgugaaggc

SEQ ID NO: 3640574 - RNA, 20 nt, Human
ugaggaaucaacagggcagc

SEQ ID NO: 3640575 - RNA, 21 nt, Human
ugaggaauccagacccggcug

SEQ ID NO: 3640576 - RNA, 18 nt, Human
ugaggaauggacauuucu

SEQ ID NO: 3640577 - RNA, 17 nt, Human
ugaggaauguauauguu

SEQ ID NO: 3640578 - RNA, 18 nt, Human
ugaggaauucuguauaga

SEQ ID NO: 3640579 - RNA, 21 nt, Human
ugaggaauuucaccuguaaac

SEQ ID NO: 3640580 - RNA, 14 nt, Human
ugaggaauuuucuu

SEQ ID NO: 3640581 - RNA, 18 nt, Human
ugaggaauuuucuuugug

SEQ ID NO: 3640582 - RNA, 16 nt, Human
ugaggacaaauugaga

SEQ ID NO: 3640583 - RNA, 20 nt, Human
ugaggacaaccauuccagac

SEQ ID NO: 3640584 - RNA, 14 nt, Human
ugaggacacauguc

SEQ ID NO: 3640585 - RNA, 15 nt, Human
ugaggacacugauau

SEQ ID NO: 3640586 - RNA, 15 nt, Human
ugaggacagaugccu

SEQ ID NO: 3640587 - RNA, 14 nt, Human
ugaggacagcuguc

SEQ ID NO: 3640588 - RNA, 19 nt, Human
ugaggacauggcuucugaa

SEQ ID NO: 3640589 - RNA, 20 nt, Human
ugaggacauuccaagacagu

SEQ ID NO: 3640590 - RNA, 17 nt, Human
ugaggacugauuucaga

SEQ ID NO: 3640591 - RNA, 23 nt, Human
ugaggacuuaaaauauuccugca

SEQ ID NO: 3640592 - RNA, 14 nt, Human
ugaggagaaugaaa

SEQ ID NO: 3640593 - RNA, 19 nt, Human
ugaggagacacaccugagg

SEQ ID NO: 3640594 - RNA, 20 nt, Human
ugaggagcagcuucaguugu

SEQ ID NO: 3640595 - RNA, 15 nt, Human
ugaggagcauguuuu

SEQ ID NO: 3640596 - RNA, 19 nt, Human
ugaggagcauguuuuguau

SEQ ID NO: 3640597 - RNA, 23 nt, Human
ugaggagcauguuuuguauacaa

SEQ ID NO: 3640598 - RNA, 15 nt, Human
ugaggagccaggccg

SEQ ID NO: 3640599 - RNA, 22 nt, Human
ugaggagcccauacucagccug

SEQ ID NO: 3640600 - RNA, 14 nt, Human
ugaggagccccagc

SEQ ID NO: 3640601 - RNA, 20 nt, Human
ugaggagccccaucugucua

SEQ ID NO: 3640602 - RNA, 16 nt, Human
ugaggagcugcuggcu

SEQ ID NO: 3640603 - RNA, 17 nt, Human
ugaggagcugcuggcuu

SEQ ID NO: 3640604 - RNA, 12 nt, Human
ugaggaggaagg

SEQ ID NO: 3640605 - RNA, 20 nt, Human
ugaggaggaugucccugggc

SEQ ID NO: 3640606 - RNA, 22 nt, Human
ugaggaggaugucccugggcca

SEQ ID NO: 3640607 - RNA, 22 nt, Human
ugaggaggggccccccugcccu

SEQ ID NO: 3640608 - RNA, 17 nt, Human
ugaggagggugggggag

SEQ ID NO: 3640609 - RNA, 15 nt, Human
ugaggaguaaaauuc

SEQ ID NO: 3640610 - RNA, 13 nt, Human
ugaggagucugag

SEQ ID NO: 3640611 - RNA, 21 nt, Human
ugaggagucugagguccugag

SEQ ID NO: 3640612 - RNA, 19 nt, Human
ugaggaguuuccuaaaagu

SEQ ID NO: 3640613 - RNA, 20 nt, Human
ugaggauacgacaguacacu

SEQ ID NO: 3640614 - RNA, 20 nt, Human
ugaggauauauuuucacuuu

SEQ ID NO: 3640615 - RNA, 18 nt, Human
ugaggauauucagaugua

SEQ ID NO: 3640616 - RNA, 17 nt, Human
ugaggaucagaaaguaa

SEQ ID NO: 3640617 - RNA, 13 nt, Human
ugaggaugaugua

SEQ ID NO: 3640618 - RNA, 22 nt, Human
ugaggaugauuauuuucaaggc

SEQ ID NO: 3640619 - RNA, 18 nt, Human
ugaggaugcagagucagc

SEQ ID NO: 3640620 - RNA, 19 nt, Human
ugaggauuaguuuagaaca

SEQ ID NO: 3640621 - RNA, 20 nt, Human
ugaggauuauuauaaaaggg

SEQ ID NO: 3640622 - RNA, 20 nt, Human
ugaggauuauugauaguacu

SEQ ID NO: 3640623 - RNA, 19 nt, Human
ugaggauuuagaaguguca

SEQ ID NO: 3640624 - RNA, 20 nt, Human
ugaggcaaccacaggcagca

SEQ ID NO: 3640625 - RNA, 20 nt, Human
ugaggcaauaaaaaucauag

SEQ ID NO: 3640626 - RNA, 17 nt, Human
ugaggcaaugucaggaa

SEQ ID NO: 3640627 - RNA, 20 nt, Human
ugaggcacaugucagcaagu

SEQ ID NO: 3640628 - RNA, 13 nt, Human
ugaggcagacagc

SEQ ID NO: 3640629 - RNA, 17 nt, Human
ugaggcagacagcagcu

SEQ ID NO: 3640630 - RNA, 23 nt, Human
ugaggcagacagcagcucaggca

SEQ ID NO: 3640631 - RNA, 13 nt, Human
ugaggcaggagaa

SEQ ID NO: 3640632 - RNA, 15 nt, Human
ugaggcaggagaauc

SEQ ID NO: 3640633 - RNA, 14 nt, Human
ugaggcagggaagu

SEQ ID NO: 3640634 - RNA, 20 nt, Human
ugaggcaggugacagugagg

SEQ ID NO: 3640635 - RNA, 15 nt, Human
ugaggcauccagcag

SEQ ID NO: 3640636 - RNA, 17 nt, Human
ugaggcaugaguuacug

SEQ ID NO: 3640637 - RNA, 16 nt, Human
ugaggccaagaauauu

SEQ ID NO: 3640638 - RNA, 20 nt, Human
ugaggccacacucagcacaa

SEQ ID NO: 3640639 - RNA, 23 nt, Human
ugaggccacacucagcacaaggc

SEQ ID NO: 3640640 - RNA, 23 nt, Human
ugaggccaccaguaaaagacauu

SEQ ID NO: 3640641 - RNA, 14 nt, Human
ugaggccacugaag

SEQ ID NO: 3640642 - RNA, 16 nt, Human
ugaggccacugaagag

SEQ ID NO: 3640643 - RNA, 15 nt, Human
ugaggccacuguguu

SEQ ID NO: 3640644 - RNA, 13 nt, Human
ugaggccagacca

SEQ ID NO: 3640645 - RNA, 14 nt, Human
ugaggccagccugg

SEQ ID NO: 3640646 - RNA, 15 nt, Human
ugaggccagccuggc

SEQ ID NO: 3640647 - RNA, 12 nt, Human
ugaggccaggag

SEQ ID NO: 3640648 - RNA, 16 nt, Human
ugaggccagggcagag

SEQ ID NO: 3640649 - RNA, 23 nt, Human
ugaggccauggacucuguccuga

SEQ ID NO: 3640650 - RNA, 15 nt, Human
ugaggcccagagggc

SEQ ID NO: 3640651 - RNA, 17 nt, Human
ugaggcccagggagagg

SEQ ID NO: 3640652 - RNA, 18 nt, Human
ugaggcccuccacaccug

SEQ ID NO: 3640653 - RNA, 22 nt, Human
ugaggcccuccacaccugcggc

SEQ ID NO: 3640654 - RNA, 22 nt, Human
ugaggcccuucucuccagcccc

SEQ ID NO: 3640655 - RNA, 17 nt, Human
ugaggccguugcugacu

SEQ ID NO: 3640656 - RNA, 21 nt, Human
ugaggccguugcugacuuaga

SEQ ID NO: 3640657 - RNA, 22 nt, Human
ugaggccuccagcuucaggcag

SEQ ID NO: 3640658 - RNA, 14 nt, Human
ugaggccucuugga

SEQ ID NO: 3640659 - RNA, 14 nt, Human
ugaggccugagacc

SEQ ID NO: 3640660 - RNA, 21 nt, Human
ugaggccugagacccaggacu

SEQ ID NO: 3640661 - RNA, 23 nt, Human
ugaggccugagacccaggacucc

SEQ ID NO: 3640662 - RNA, 17 nt, Human
ugaggccuggacuuucc

SEQ ID NO: 3640663 - RNA, 22 nt, Human
ugaggccugggccgcugccacg

SEQ ID NO: 3640664 - RNA, 23 nt, Human
ugaggcgccccaacccguggagg

SEQ ID NO: 3640665 - RNA, 16 nt, Human
ugaggcuaaguuggga

SEQ ID NO: 3640666 - RNA, 20 nt, Human
ugaggcuccacuuggucugu

SEQ ID NO: 3640667 - RNA, 23 nt, Human
ugaggcuccuuaggguuuucucu

SEQ ID NO: 3640668 - RNA, 16 nt, Human
ugaggcucugcccuug

SEQ ID NO: 3640669 - RNA, 16 nt, Human
ugaggcucuuucuggg

SEQ ID NO: 3640670 - RNA, 13 nt, Human
ugaggcugcagcg

SEQ ID NO: 3640671 - RNA, 20 nt, Human
ugaggcugcuuuccaaagcc

SEQ ID NO: 3640672 - RNA, 13 nt, Human
ugaggcuggacuc

SEQ ID NO: 3640673 - RNA, 11 nt, Human
ugaggcuggca

SEQ ID NO: 3640674 - RNA, 12 nt, Human
ugaggcugggaa

SEQ ID NO: 3640675 - RNA, 15 nt, Human
ugaggcugggcuccc

SEQ ID NO: 3640676 - RNA, 19 nt, Human
ugaggcugggggagagccg

SEQ ID NO: 3640677 - RNA, 11 nt, Human
ugaggcugugg

SEQ ID NO: 3640678 - RNA, 13 nt, Human
ugaggcuuagaga

SEQ ID NO: 3640679 - RNA, 23 nt, Human
ugaggcuuagcuuugcucugcca

SEQ ID NO: 3640680 - RNA, 15 nt, Human
ugaggcuuccagaga

SEQ ID NO: 3640681 - RNA, 17 nt, Human
ugagggaaaagaaaaag

SEQ ID NO: 3640682 - RNA, 17 nt, Human
ugagggaacagacagga

SEQ ID NO: 3640683 - RNA, 20 nt, Human
ugagggaacagacaggagaa

SEQ ID NO: 3640684 - RNA, 21 nt, Human
ugagggacaaauuuaaaacaa

SEQ ID NO: 3640685 - RNA, 23 nt, Human
ugagggacaaauuuaaaacaaac

SEQ ID NO: 3640686 - RNA, 13 nt, Human
ugagggaccagcc

SEQ ID NO: 3640687 - RNA, 18 nt, Human
ugagggacuggaaccagg

SEQ ID NO: 3640688 - RNA, 17 nt, Human
ugagggagaacaagacc

SEQ ID NO: 3640689 - RNA, 14 nt, Human
ugagggagauccca

SEQ ID NO: 3640690 - RNA, 16 nt, Human
ugagggagaugccaug

SEQ ID NO: 3640691 - RNA, 16 nt, Human
ugagggagcuuagcca

SEQ ID NO: 3640692 - RNA, 19 nt, Human
ugagggaggaccuggggca

SEQ ID NO: 3640693 - RNA, 22 nt, Human
ugagggaggaccuggggcacag

SEQ ID NO: 3640694 - RNA, 13 nt, Human
ugagggaggaggc

SEQ ID NO: 3640695 - RNA, 14 nt, Human
ugagggaggaggcc

SEQ ID NO: 3640696 - RNA, 17 nt, Human
ugagggauaagcaaaag

SEQ ID NO: 3640697 - RNA, 23 nt, Human
ugagggaucuauacuugcuuugu

SEQ ID NO: 3640698 - RNA, 15 nt, Human
ugagggcagcagcca

SEQ ID NO: 3640699 - RNA, 16 nt, Human
ugagggcagcagccag

SEQ ID NO: 3640700 - RNA, 17 nt, Human
ugagggcagcagccagc

SEQ ID NO: 3640701 - RNA, 18 nt, Human
ugagggcagcagccagcc

SEQ ID NO: 3640702 - RNA, 20 nt, Human
ugagggcagcagccagcccu

SEQ ID NO: 3640703 - RNA, 21 nt, Human
ugagggcagcagccagcccug

SEQ ID NO: 3640704 - RNA, 23 nt, Human
ugagggcagcagccagcccugcc

SEQ ID NO: 3640705 - RNA, 18 nt, Human
ugagggcaguucgcagcc

SEQ ID NO: 3640706 - RNA, 23 nt, Human
ugagggcaguucgcagccacccu

SEQ ID NO: 3640707 - RNA, 22 nt, Human
ugagggccaaaauauuuggaau

SEQ ID NO: 3640708 - RNA, 12 nt, Human
ugagggcccaga

SEQ ID NO: 3640709 - RNA, 13 nt, Human
ugagggcccagag

SEQ ID NO: 3640710 - RNA, 14 nt, Human
ugcauccuuccuau

SEQ ID NO: 3640711 - RNA, 15 nt, Human
ugcauccuuccuaua

SEQ ID NO: 3640712 - RNA, 18 nt, Human
ugcaucgagucaaaacuc

SEQ ID NO: 3640713 - RNA, 14 nt, Human
ugcaucguccccuc

SEQ ID NO: 3640714 - RNA, 18 nt, Human
ugcaucguccccuccccc

SEQ ID NO: 3640715 - RNA, 15 nt, Human
ugcaucguggagaca

SEQ ID NO: 3640716 - RNA, 12 nt, Human
ugcaucuaagcc

SEQ ID NO: 3640717 - RNA, 21 nt, Human
ugcaucuagaggcuuccuuca

SEQ ID NO: 3640718 - RNA, 14 nt, Human
ugcaucuccaccug

SEQ ID NO: 3640719 - RNA, 23 nt, Human
ugcaucuccacuuggcauuagcu

SEQ ID NO: 3640720 - RNA, 18 nt, Human
ugcaucucccagauaaug

SEQ ID NO: 3640721 - RNA, 13 nt, Human
ugcaucuggggcc

SEQ ID NO: 3640722 - RNA, 18 nt, Human
ugcaucuggguagcugua

SEQ ID NO: 3640723 - RNA, 19 nt, Human
ugcaucuggguagcuguaa

SEQ ID NO: 3640724 - RNA, 20 nt, Human
ugcaucuguauaaguaagaa

SEQ ID NO: 3640725 - RNA, 13 nt, Human
ugcaucuguccuc

SEQ ID NO: 3640726 - RNA, 19 nt, Human
ugcaucuguccucaugugu

SEQ ID NO: 3640727 - RNA, 12 nt, Human
ugcaucuuaaaa

SEQ ID NO: 3640728 - RNA, 14 nt, Human
ugcaucuuacugaa

SEQ ID NO: 3640729 - RNA, 22 nt, Human
ugcaucuuacugaagguaaaau

SEQ ID NO: 3640730 - RNA, 18 nt, Human
ugcaucuuauagcacuuu

SEQ ID NO: 3640731 - RNA, 20 nt, Human
ugcaucuuggggacaucucu

SEQ ID NO: 3640732 - RNA, 17 nt, Human
ugcaucuuugauguguu

SEQ ID NO: 3640733 - RNA, 11 nt, Human
ugcaugaaaau

SEQ ID NO: 3640734 - RNA, 13 nt, Human
ugcaugaagguuu

SEQ ID NO: 3640735 - RNA, 16 nt, Human
ugcaugauugcagaau

SEQ ID NO: 3640736 - RNA, 14 nt, Human
ugcaugauuuugua

SEQ ID NO: 3640737 - RNA, 18 nt, Human
ugcaugauuuuguaaccc

SEQ ID NO: 3640738 - RNA, 22 nt, Human
ugcaugcaaaugagcucugaaa

SEQ ID NO: 3640739 - RNA, 19 nt, Human
ugcaugcacuguucccccu

SEQ ID NO: 3640740 - RNA, 22 nt, Human
ugcaugccaaauuguaguucuu

SEQ ID NO: 3640741 - RNA, 23 nt, Human
ugcaugcccagagacccagcgga

SEQ ID NO: 3640742 - RNA, 14 nt, Human
ugcaugccuggucu

SEQ ID NO: 3640743 - RNA, 21 nt, Human
ugcaugcggcccagcccggcu

SEQ ID NO: 3640744 - RNA, 21 nt, Human
ugcaugcuauucacaauuauu

SEQ ID NO: 3640745 - RNA, 18 nt, Human
ugcaugcucucugcagcc

SEQ ID NO: 3640746 - RNA, 19 nt, Human
ugcaugcugucccuuacgu

SEQ ID NO: 3640747 - RNA, 21 nt, Human
ugcaugcugucccuuacguga

SEQ ID NO: 3640748 - RNA, 14 nt, Human
ugcauggaaaucag

SEQ ID NO: 3640749 - RNA, 19 nt, Human
ugcauggaaauucccuuca

SEQ ID NO: 3640750 - RNA, 20 nt, Human
ugcauggaccuaacauucga

SEQ ID NO: 3640751 - RNA, 13 nt, Human
ugcauggaggccc

SEQ ID NO: 3640752 - RNA, 20 nt, Human
ugcauggcacuugcaucugu

SEQ ID NO: 3640753 - RNA, 18 nt, Human
ugcauggcauccuccagc

SEQ ID NO: 3640754 - RNA, 21 nt, Human
ugcauggcauccuccagcccc

SEQ ID NO: 3640755 - RNA, 16 nt, Human
ugcauggcuccagaaa

SEQ ID NO: 3640756 - RNA, 18 nt, Human
ugcauggcuccagaaaug

SEQ ID NO: 3640757 - RNA, 20 nt, Human
ugcauggcuccagaaauguc

SEQ ID NO: 3640758 - RNA, 12 nt, Human
ugcaugggagca

SEQ ID NO: 3640759 - RNA, 23 nt, Human
ugcauggguuuuguagguacuuu

SEQ ID NO: 3640760 - RNA, 18 nt, Human
ugcaugguaauuuauagu

SEQ ID NO: 3640761 - RNA, 18 nt, Human
ugcauggugccccaggac

SEQ ID NO: 3640762 - RNA, 21 nt, Human
ugcauggugccccaggaccag

SEQ ID NO: 3640763 - RNA, 16 nt, Human
ugcaugguggcaccag

SEQ ID NO: 3640764 - RNA, 13 nt, Human
ugcaugguggcca

SEQ ID NO: 3640765 - RNA, 17 nt, Human
ugcaugguuuagaaagc

SEQ ID NO: 3640766 - RNA, 22 nt, Human
ugcaugguuucagcacuagcca

SEQ ID NO: 3640767 - RNA, 17 nt, Human
ugcaugguuuggagcug

SEQ ID NO: 3640768 - RNA, 13 nt, Human
ugcauguaaucaa

SEQ ID NO: 3640769 - RNA, 21 nt, Human
ugcauguagaggcuuguuuac

SEQ ID NO: 3640770 - RNA, 12 nt, Human
ugcauguaguaa

SEQ ID NO: 3640771 - RNA, 17 nt, Human
ugcauguaguaacacua

SEQ ID NO: 3640772 - RNA, 13 nt, Human
ugcauguaugucu

SEQ ID NO: 3640773 - RNA, 20 nt, Human
ugcaugucaaacaugagaug

SEQ ID NO: 3640774 - RNA, 14 nt, Human
ugcaugucuuuuaa

SEQ ID NO: 3640775 - RNA, 12 nt, Human
ugcaugugaaga

SEQ ID NO: 3640776 - RNA, 17 nt, Human
ugcaugugacucugaag

SEQ ID NO: 3640777 - RNA, 21 nt, Human
ugcaugugguuugguuccucu

SEQ ID NO: 3640778 - RNA, 13 nt, Human
ugcauguguguau

SEQ ID NO: 3640779 - RNA, 15 nt, Human
ugcauguguguauaa

SEQ ID NO: 3640780 - RNA, 13 nt, Human
ugcaugugugugc

SEQ ID NO: 3640781 - RNA, 14 nt, Human
ugcauguuauguuu

SEQ ID NO: 3640782 - RNA, 15 nt, Human
ugcauguuauguuua

SEQ ID NO: 3640783 - RNA, 17 nt, Human
ugcauguuccacuaacc

SEQ ID NO: 3640784 - RNA, 18 nt, Human
ugcauguuccacuaaccc

SEQ ID NO: 3640785 - RNA, 21 nt, Human
ugcauguugucuaagaaauug

SEQ ID NO: 3640786 - RNA, 17 nt, Human
ugcauuaaauuacagaa

SEQ ID NO: 3640787 - RNA, 20 nt, Human
ugcauuaaauuacagaaauu

SEQ ID NO: 3640788 - RNA, 14 nt, Human
ugcauuaaauucac

SEQ ID NO: 3640789 - RNA, 15 nt, Human
ugcauuaaauucaca

SEQ ID NO: 3640790 - RNA, 17 nt, Human
ugcauuaaauucacaaa

SEQ ID NO: 3640791 - RNA, 21 nt, Human
ugcauuaaauucacaaacuuu

SEQ ID NO: 3640792 - RNA, 12 nt, Human
ugcauuacagag

SEQ ID NO: 3640793 - RNA, 16 nt, Human
ugcauuacagagagga

SEQ ID NO: 3640794 - RNA, 17 nt, Human
ugcauuacagagaggag

SEQ ID NO: 3640795 - RNA, 18 nt, Human
ugcauuacagagaggaga

SEQ ID NO: 3640796 - RNA, 22 nt, Human
ugcauuacagagaggagaaaca

SEQ ID NO: 3640797 - RNA, 18 nt, Human
ugcauuacugcaugcacu

SEQ ID NO: 3640798 - RNA, 19 nt, Human
ugcauuagaaauagacagu

SEQ ID NO: 3640799 - RNA, 20 nt, Human
ugcauuagaaauagacagua

SEQ ID NO: 3640800 - RNA, 22 nt, Human
ugcauuagaaauagacaguaua

SEQ ID NO: 3640801 - RNA, 16 nt, Human
ugcauuagcacagauu

SEQ ID NO: 3640802 - RNA, 17 nt, Human
ugcauuagcacagauuu

SEQ ID NO: 3640803 - RNA, 22 nt, Human
ugcauuagggaugccuccuuuc

SEQ ID NO: 3640804 - RNA, 21 nt, Human
ugcauuauauuuguaaauuua

SEQ ID NO: 3640805 - RNA, 21 nt, Human
ugcauuaucuagauacuguau

SEQ ID NO: 3640806 - RNA, 14 nt, Human
ugcauuauuaaauu

SEQ ID NO: 3640807 - RNA, 17 nt, Human
ugcauuauuuuccagau

SEQ ID NO: 3640808 - RNA, 14 nt, Human
ugcauucaaauuaa

SEQ ID NO: 3640809 - RNA, 20 nt, Human
ugcauucacccagacagcuc

SEQ ID NO: 3640810 - RNA, 14 nt, Human
ugcauucccagugg

SEQ ID NO: 3640811 - RNA, 15 nt, Human
ugcauuccuuugucu

SEQ ID NO: 3640812 - RNA, 18 nt, Human
ugcauuccuuugucuuca

SEQ ID NO: 3640813 - RNA, 21 nt, Human
ugcauucguuguguuuuuuaa

SEQ ID NO: 3640814 - RNA, 16 nt, Human
ugcauucuauugccuu

SEQ ID NO: 3640815 - RNA, 18 nt, Human
ugcauucuauugccuucu

SEQ ID NO: 3640816 - RNA, 22 nt, Human
ugcauucuauugccuucuuuga

SEQ ID NO: 3640817 - RNA, 14 nt, Human
ugcauucugccucu

SEQ ID NO: 3640818 - RNA, 19 nt, Human
ugcauucugccucucuagg

SEQ ID NO: 3640819 - RNA, 20 nt, Human
ugcauucugccucucuagga

SEQ ID NO: 3640820 - RNA, 17 nt, Human
ugcauucuuauucauca

SEQ ID NO: 3640821 - RNA, 16 nt, Human
ugcauucuucucuguu

SEQ ID NO: 3640822 - RNA, 16 nt, Human
ugcauucuuucuguau

SEQ ID NO: 3640823 - RNA, 22 nt, Human
ugcauucuuuuaaaagacaaga

SEQ ID NO: 3640824 - RNA, 18 nt, Human
ugcauugaaaagagcuga

SEQ ID NO: 3640825 - RNA, 14 nt, Human
ugcauugaacacaa

SEQ ID NO: 3640826 - RNA, 23 nt, Human
ugcauugaacacaaacuguaaau

SEQ ID NO: 3640827 - RNA, 12 nt, Human
ugcauugaagau

SEQ ID NO: 3640828 - RNA, 20 nt, Human
ugcauugaccgcgacuaauu

SEQ ID NO: 3640829 - RNA, 14 nt, Human
ugcauugacuuuca

SEQ ID NO: 3640830 - RNA, 21 nt, Human
ugcauugacuuucaguaaaca

SEQ ID NO: 3640831 - RNA, 18 nt, Human
ugcauugacuuuccccac

SEQ ID NO: 3640832 - RNA, 13 nt, Human
ugcauugauauug

SEQ ID NO: 3640833 - RNA, 18 nt, Human
ugcauugauauugugaac

SEQ ID NO: 3640834 - RNA, 20 nt, Human
ugcauugcucuggaucuguu

SEQ ID NO: 3640835 - RNA, 17 nt, Human
ugcauuggaacuggagg

SEQ ID NO: 3640836 - RNA, 22 nt, Human
ugcauuggaacuggaggcaggg

SEQ ID NO: 3640837 - RNA, 19 nt, Human
ugcauuggaagaccccacc

SEQ ID NO: 3640838 - RNA, 20 nt, Human
ugcauuggaagaccccaccc

SEQ ID NO: 3640839 - RNA, 11 nt, Human
ugcauugucug

SEQ ID NO: 3640840 - RNA, 17 nt, Human
ugcauugucugucugca

SEQ ID NO: 3640841 - RNA, 12 nt, Human
ugcauugugcuu

SEQ ID NO: 3640842 - RNA, 20 nt, Human
ugcauuuaaaacagacacug

SEQ ID NO: 3640843 - RNA, 22 nt, Human
ugcauuuagcacaaaaaaaauu

SEQ ID NO: 3640844 - RNA, 13 nt, Human
ugcauuuauaugu

SEQ ID NO: 3640845 - RNA, 12 nt, Human
ugcauuucagaa

SEQ ID NO: 3640846 - RNA, 13 nt, Human
ugcauuuccugac

SEQ ID NO: 3640847 - RNA, 18 nt, Human
ugcauuucugaauagaaa

SEQ ID NO: 3640848 - RNA, 20 nt, Human
ugcauuuggagggagugagu

SEQ ID NO: 3640849 - RNA, 16 nt, Human
ugcauuuggucaagau

SEQ ID NO: 3640850 - RNA, 15 nt, Human
ugcauuugucuauuc

SEQ ID NO: 3640851 - RNA, 22 nt, Human
ugcauuugugcguaugcagugu

SEQ ID NO: 3640852 - RNA, 18 nt, Human
ugcauuuguuuauguaau

SEQ ID NO: 3640853 - RNA, 21 nt, Human
ugcauuuguuuuguuuacaga

SEQ ID NO: 3640854 - RNA, 21 nt, Human
ugcauuuuaaaaaugaaauuu

SEQ ID NO: 3640855 - RNA, 16 nt, Human
ugccauggaggcacac

SEQ ID NO: 3640856 - RNA, 17 nt, Human
ugccauggcgugucccu

SEQ ID NO: 3640857 - RNA, 22 nt, Human
ugccauggcuagguagaaguga

SEQ ID NO: 3640858 - RNA, 18 nt, Human
ugccauguaaauccccac

SEQ ID NO: 3640859 - RNA, 20 nt, Human
ugccauguaaauccccacug

SEQ ID NO: 3640860 - RNA, 14 nt, Human
ugccauguaccucc

SEQ ID NO: 3640861 - RNA, 15 nt, Human
ugccaugugaagagg

SEQ ID NO: 3640862 - RNA, 16 nt, Human
ugccaugugaagaggg

SEQ ID NO: 3640863 - RNA, 16 nt, Human
ugccaugugacucugg

SEQ ID NO: 3640864 - RNA, 22 nt, Human
ugccauguggaaggcaagccag

SEQ ID NO: 3640865 - RNA, 17 nt, Human
ugccaugugugcugaac

SEQ ID NO: 3640866 - RNA, 15 nt, Human
ugccauguugccccu

SEQ ID NO: 3640867 - RNA, 16 nt, Human
ugccauguuggccagg

SEQ ID NO: 3640868 - RNA, 19 nt, Human
ugccauguuggccaggcug

SEQ ID NO: 3640869 - RNA, 18 nt, Human
ugccauguuuugccaccc

SEQ ID NO: 3640870 - RNA, 18 nt, Human
ugccauuauuuucuguca

SEQ ID NO: 3640871 - RNA, 19 nt, Human
ugccauuauuuucugucag

SEQ ID NO: 3640872 - RNA, 18 nt, Human
ugccauucauagagagcc

SEQ ID NO: 3640873 - RNA, 11 nt, Human
ugccauuguag

SEQ ID NO: 3640874 - RNA, 22 nt, Human
ugccauuucuuccacaagagcc

SEQ ID NO: 3640875 - RNA, 13 nt, Human
ugccauuugauac

SEQ ID NO: 3640876 - RNA, 17 nt, Human
ugccauuugcacccucc

SEQ ID NO: 3640877 - RNA, 15 nt, Human
ugccauuuguacuga

SEQ ID NO: 3640878 - RNA, 14 nt, Human
ugccauuuugcauu

SEQ ID NO: 3640879 - RNA, 21 nt, Human
ugccauuuuggguuaggagaa

SEQ ID NO: 3640880 - RNA, 15 nt, Human
ugccauuuuucaaaa

SEQ ID NO: 3640881 - RNA, 19 nt, Human
ugcccaaagagcacaaaca

SEQ ID NO: 3640882 - RNA, 23 nt, Human
ugcccaaagagcacaaacauuuu

SEQ ID NO: 3640883 - RNA, 20 nt, Human
ugcccaaagaugcagccggu

SEQ ID NO: 3640884 - RNA, 21 nt, Human
ugcccaaagugcuuccaaggc

SEQ ID NO: 3640885 - RNA, 16 nt, Human
ugcccaacaccagccc

SEQ ID NO: 3640886 - RNA, 22 nt, Human
ugcccaacccuucccucaccuu

SEQ ID NO: 3640887 - RNA, 22 nt, Human
ugcccaaccugcucuccucuug

SEQ ID NO: 3640888 - RNA, 23 nt, Human
ugcccaaccugcucuccucuugc

SEQ ID NO: 3640889 - RNA, 24 nt, Human
ugcccaaccugcucuccucuugcc

SEQ ID NO: 3640890 - RNA, 18 nt, Human
ugcccaacuguguagcau

SEQ ID NO: 3640891 - RNA, 21 nt, Human
ugcccaagaauagaugcugac

SEQ ID NO: 3640892 - RNA, 22 nt, Human
ugcccaagaauagaugcugacu

SEQ ID NO: 3640893 - RNA, 23 nt, Human
ugcccaagaauagaugcugacug

SEQ ID NO: 3640894 - RNA, 16 nt, Human
ugcccaagccagaggc

SEQ ID NO: 3640895 - RNA, 22 nt, Human
ugcccaagccagaggcuggguu

SEQ ID NO: 3640896 - RNA, 14 nt, Human
ugcccaagcccagg

SEQ ID NO: 3640897 - RNA, 16 nt, Human
ugcccaagcccugaga

SEQ ID NO: 3640898 - RNA, 22 nt, Human
ugcccaaguuguggugcugaca

SEQ ID NO: 3640899 - RNA, 20 nt, Human
ugcccaauaugcaguucugc

SEQ ID NO: 3640900 - RNA, 20 nt, Human
ugcccaaugagacucuaggg

SEQ ID NO: 3640901 - RNA, 21 nt, Human
ugcccaaugagacucuagggu

SEQ ID NO: 3640902 - RNA, 15 nt, Human
ugcccaauuggagga

SEQ ID NO: 3640903 - RNA, 15 nt, Human
ugcccacaccuccug

SEQ ID NO: 3640904 - RNA, 21 nt, Human
ugcccacagcccgcaugcagc

SEQ ID NO: 3640905 - RNA, 14 nt, Human
ugcccacaggauca

SEQ ID NO: 3640906 - RNA, 16 nt, Human
ugcccacaggaucagu

SEQ ID NO: 3640907 - RNA, 20 nt, Human
ugcccacagugucaggcacu

SEQ ID NO: 3640908 - RNA, 21 nt, Human
ugcccacagugucaggcacug

SEQ ID NO: 3640909 - RNA, 23 nt, Human
ugcccacagugucaggcacuggg

SEQ ID NO: 3640910 - RNA, 19 nt, Human
ugcccacauguguccaucc

SEQ ID NO: 3640911 - RNA, 18 nt, Human
ugcccacauuuagucucu

SEQ ID NO: 3640912 - RNA, 17 nt, Human
ugcccaccccaccccca

SEQ ID NO: 3640913 - RNA, 19 nt, Human
ugcccaccccacccccacc

SEQ ID NO: 3640914 - RNA, 11 nt, Human
ugcccaccccc

SEQ ID NO: 3640915 - RNA, 14 nt, Human
ugcccacccccugc

SEQ ID NO: 3640916 - RNA, 19 nt, Human
ugcccacccccugcccugc

SEQ ID NO: 3640917 - RNA, 19 nt, Human
ugcccacccguggagaugg

SEQ ID NO: 3640918 - RNA, 20 nt, Human
ugcccacccguggagauggg

SEQ ID NO: 3640919 - RNA, 21 nt, Human
ugcccacccguggagauggga

SEQ ID NO: 3640920 - RNA, 18 nt, Human
ugcccacccugggagaca

SEQ ID NO: 3640921 - RNA, 22 nt, Human
ugcccaccucagccucccaaag

SEQ ID NO: 3640922 - RNA, 12 nt, Human
ugcccaccugcc

SEQ ID NO: 3640923 - RNA, 14 nt, Human
ugcccaccugccca

SEQ ID NO: 3640924 - RNA, 16 nt, Human
ugcccaccugccggcc

SEQ ID NO: 3640925 - RNA, 19 nt, Human
ugcccaccugccuggccgg

SEQ ID NO: 3640926 - RNA, 13 nt, Human
ugcccaccuggcc

SEQ ID NO: 3640927 - RNA, 18 nt, Human
ugcccacgcuggagugca

SEQ ID NO: 3640928 - RNA, 19 nt, Human
ugcccacggagucgugggg

SEQ ID NO: 3640929 - RNA, 15 nt, Human
ugcccacucccugca

SEQ ID NO: 3640930 - RNA, 16 nt, Human
ugcccacucccugcaa

SEQ ID NO: 3640931 - RNA, 14 nt, Human
ugcccacuccugcu

SEQ ID NO: 3640932 - RNA, 19 nt, Human
ugcccacuccugcucugcu

SEQ ID NO: 3640933 - RNA, 17 nt, Human
ugcccagaauaaguuau

SEQ ID NO: 3640934 - RNA, 21 nt, Human
ugcccagaauaaguuauugca

SEQ ID NO: 3640935 - RNA, 10 nt, Human
ugcccagaca

SEQ ID NO: 3640936 - RNA, 22 nt, Human
ugcccagaccccucuggccagg

SEQ ID NO: 3640937 - RNA, 15 nt, Human
ugcccagagacccag

SEQ ID NO: 3640938 - RNA, 23 nt, Human
ugcccagagacccagcggacaca

SEQ ID NO: 3640939 - RNA, 21 nt, Human
ugcccagagaugccuccaccg

SEQ ID NO: 3640940 - RNA, 15 nt, Human
ugcccagagcugggu

SEQ ID NO: 3640941 - RNA, 19 nt, Human
ugcccagagggcccaggca

SEQ ID NO: 3640942 - RNA, 16 nt, Human
ugcccagaucccagaa

SEQ ID NO: 3640943 - RNA, 17 nt, Human
ugcccagaucccagaag

SEQ ID NO: 3640944 - RNA, 22 nt, Human
ugcccagaucccagaaggaccu

SEQ ID NO: 3640945 - RNA, 16 nt, Human
ugcccagccucuuucc

SEQ ID NO: 3640946 - RNA, 16 nt, Human
ugcccagccuggaugc

SEQ ID NO: 3640947 - RNA, 17 nt, Human
ugcccagccuggaugcc

SEQ ID NO: 3640948 - RNA, 20 nt, Human
ugcccagccuggaugccauc

SEQ ID NO: 3640949 - RNA, 18 nt, Human
ugcccagcggacaguggc

SEQ ID NO: 3640950 - RNA, 21 nt, Human
ugcccagcggacaguggcagg

SEQ ID NO: 3640951 - RNA, 21 nt, Human
ugcccagcucagucuucccua

SEQ ID NO: 3640952 - RNA, 20 nt, Human
ugcccagcuugggcccagcu

SEQ ID NO: 3640953 - RNA, 19 nt, Human
ugcccaggagagccagccc

SEQ ID NO: 3640954 - RNA, 20 nt, Human
ugcccaggcaggucuugaac

SEQ ID NO: 3640955 - RNA, 14 nt, Human
ugcccaggcccaga

SEQ ID NO: 3640956 - RNA, 15 nt, Human
ugcccaggcccagac

SEQ ID NO: 3640957 - RNA, 12 nt, Human
ugcccaggcccc

SEQ ID NO: 3640958 - RNA, 15 nt, Human
ugcccaggccccugc

SEQ ID NO: 3640959 - RNA, 20 nt, Human
ugcccaggccccugccaccc

SEQ ID NO: 3640960 - RNA, 20 nt, Human
ugcccaggccggccagccuc

SEQ ID NO: 3640961 - RNA, 21 nt, Human
ugcccaggccggccagccuca

SEQ ID NO: 3640962 - RNA, 22 nt, Human
ugcccaggccggccagccucac

SEQ ID NO: 3640963 - RNA, 14 nt, Human
ugcccaggcuccau

SEQ ID NO: 3640964 - RNA, 11 nt, Human
ugcccaggcug

SEQ ID NO: 3640965 - RNA, 20 nt, Human
ugcccaggcuggcgugcagu

SEQ ID NO: 3640966 - RNA, 13 nt, Human
ugcccaggcuggu

SEQ ID NO: 3640967 - RNA, 14 nt, Human
ugcccaggcugugc

SEQ ID NO: 3640968 - RNA, 17 nt, Human
ugcccagggauuugucc

SEQ ID NO: 3640969 - RNA, 19 nt, Human
ugcccagggcucagccugg

SEQ ID NO: 3640970 - RNA, 16 nt, Human
ugcccaggggugcccc

SEQ ID NO: 3640971 - RNA, 17 nt, Human
ugcccagguggcugugg

SEQ ID NO: 3640972 - RNA, 14 nt, Human
ugcccaguccccca

SEQ ID NO: 3640973 - RNA, 23 nt, Human
ugcccagucccccaaccccagcc

SEQ ID NO: 3640974 - RNA, 14 nt, Human
ugcccaguuaaucu

SEQ ID NO: 3640975 - RNA, 23 nt, Human
ugcccaguuaaucuugcuuucuu

SEQ ID NO: 3640976 - RNA, 20 nt, Human
ugcccaucacaggguugggc

SEQ ID NO: 3640977 - RNA, 16 nt, Human
ugcccauccugucugu

SEQ ID NO: 3640978 - RNA, 21 nt, Human
ugcccaucgugaagaagccug

SEQ ID NO: 3640979 - RNA, 22 nt, Human
ugcccaucgugaagaagccugu

SEQ ID NO: 3640980 - RNA, 17 nt, Human
ugcccaugcugggcucc

SEQ ID NO: 3640981 - RNA, 15 nt, Human
ugcccaugggcacug

SEQ ID NO: 3640982 - RNA, 18 nt, Human
ugcccaugggcacugcug

SEQ ID NO: 3640983 - RNA, 22 nt, Human
ugcccaugggcacugcugggug

SEQ ID NO: 3640984 - RNA, 18 nt, Human
ugcccauucaccaaaauu

SEQ ID NO: 3640985 - RNA, 12 nt, Human
ugcccauuucau

SEQ ID NO: 3640986 - RNA, 21 nt, Human
ugcccauuucauauucuuuca

SEQ ID NO: 3640987 - RNA, 22 nt, Human
ugccccaaauaacuucaguccu

SEQ ID NO: 3640988 - RNA, 23 nt, Human
ugccccaaauaacuucaguccug

SEQ ID NO: 3640989 - RNA, 16 nt, Human
ugccccaaccugcuga

SEQ ID NO: 3640990 - RNA, 18 nt, Human
ugccccacuuguccuuag

SEQ ID NO: 3640991 - RNA, 19 nt, Human
ugccccacuuguccuuagc

SEQ ID NO: 3640992 - RNA, 15 nt, Human
ugccccagagcuguu

SEQ ID NO: 3640993 - RNA, 17 nt, Human
ugccccagagcuguuua

SEQ ID NO: 3640994 - RNA, 12 nt, Human
ugccccagccag

SEQ ID NO: 3640995 - RNA, 13 nt, Human
ugccccagccaga

SEQ ID NO: 3640996 - RNA, 14 nt, Human
ugccccagcucugg

SEQ ID NO: 3640997 - RNA, 18 nt, Human
ugccccagcucuggcuuc

SEQ ID NO: 3640998 - RNA, 18 nt, Human
ugcuuguaccucuggcug

SEQ ID NO: 3640999 - RNA, 22 nt, Human
ugcuuguaccucuggcugacua

SEQ ID NO: 3641000 - RNA, 20 nt, Human
ugcuugucuucugguacuuu

SEQ ID NO: 3641001 - RNA, 16 nt, Human
ugcuugugaaaaugug

SEQ ID NO: 3641002 - RNA, 18 nt, Human
ugcuugugaaaggaaaga

SEQ ID NO: 3641003 - RNA, 20 nt, Human
ugcuuguguaauuuauguga

SEQ ID NO: 3641004 - RNA, 12 nt, Human
ugcuuguguuau

SEQ ID NO: 3641005 - RNA, 18 nt, Human
ugcuuguuaacugagugc

SEQ ID NO: 3641006 - RNA, 14 nt, Human
ugcuuguuggauuu

SEQ ID NO: 3641007 - RNA, 22 nt, Human
ugcuuguugggauuccugaccc

SEQ ID NO: 3641008 - RNA, 23 nt, Human
ugcuuguugggauuccugaccca

SEQ ID NO: 3641009 - RNA, 23 nt, Human
ugcuuuaaaaacuauuuaacuug

SEQ ID NO: 3641010 - RNA, 12 nt, Human
ugcuuuaaacau

SEQ ID NO: 3641011 - RNA, 16 nt, Human
ugcuuuaaagauaaaa

SEQ ID NO: 3641012 - RNA, 17 nt, Human
ugcuuuaaaguguaaua

SEQ ID NO: 3641013 - RNA, 18 nt, Human
ugcuuuaauauaaaugca

SEQ ID NO: 3641014 - RNA, 20 nt, Human
ugcuuuaauauaaaugcaaa

SEQ ID NO: 3641015 - RNA, 20 nt, Human
ugcuuuaauaucaucaguau

SEQ ID NO: 3641016 - RNA, 15 nt, Human
ugcuuuaauugugaa

SEQ ID NO: 3641017 - RNA, 20 nt, Human
ugcuuuaauugugaauugau

SEQ ID NO: 3641018 - RNA, 14 nt, Human
ugcuuuaauuuuag

SEQ ID NO: 3641019 - RNA, 17 nt, Human
ugcuuuaauuuuagcaa

SEQ ID NO: 3641020 - RNA, 18 nt, Human
ugcuuuaccaaacagcaa

SEQ ID NO: 3641021 - RNA, 21 nt, Human
ugcuuuaccuuuucagggcug

SEQ ID NO: 3641022 - RNA, 15 nt, Human
ugcuuuagacuugaa

SEQ ID NO: 3641023 - RNA, 19 nt, Human
ugcuuuagacuugaaaaga

SEQ ID NO: 3641024 - RNA, 17 nt, Human
ugcuuuaggcucacggc

SEQ ID NO: 3641025 - RNA, 15 nt, Human
ugcuuuaugccuucu

SEQ ID NO: 3641026 - RNA, 13 nt, Human
ugcuuuaugcuga

SEQ ID NO: 3641027 - RNA, 20 nt, Human
ugcuuuauuaauguuuucaa

SEQ ID NO: 3641028 - RNA, 21 nt, Human
ugcuuuauuaauguuuucaaa

SEQ ID NO: 3641029 - RNA, 12 nt, Human
ugcuuucagaua

SEQ ID NO: 3641030 - RNA, 17 nt, Human
ugcuuucagauacugga

SEQ ID NO: 3641031 - RNA, 19 nt, Human
ugcuuucaucuuggucaca

SEQ ID NO: 3641032 - RNA, 14 nt, Human
ugcuuuccaaaccu

SEQ ID NO: 3641033 - RNA, 14 nt, Human
ugcuuuccaaagcc

SEQ ID NO: 3641034 - RNA, 20 nt, Human
ugcuuuccagaauaauauga

SEQ ID NO: 3641035 - RNA, 14 nt, Human
ugcuuuccauauuu

SEQ ID NO: 3641036 - RNA, 15 nt, Human
ugcuuuccauauuuu

SEQ ID NO: 3641037 - RNA, 22 nt, Human
ugcuuuccauauuuuuuuccuu

SEQ ID NO: 3641038 - RNA, 19 nt, Human
ugcuuuccauucgugaaaa

SEQ ID NO: 3641039 - RNA, 20 nt, Human
ugcuuuccauucgugaaaac

SEQ ID NO: 3641040 - RNA, 21 nt, Human
ugcuuuccguggcacugcaua

SEQ ID NO: 3641041 - RNA, 18 nt, Human
ugcuuucgaacugcuagu

SEQ ID NO: 3641042 - RNA, 19 nt, Human
ugcuuucguguaaauuaug

SEQ ID NO: 3641043 - RNA, 13 nt, Human
ugcuuucuauugu

SEQ ID NO: 3641044 - RNA, 18 nt, Human
ugcuuucuauuguacaga

SEQ ID NO: 3641045 - RNA, 18 nt, Human
ugcuuucuccauuguaaa

SEQ ID NO: 3641046 - RNA, 22 nt, Human
ugcuuucuccuuuaauuguaaa

SEQ ID NO: 3641047 - RNA, 20 nt, Human
ugcuuucugaagcuuuacca

SEQ ID NO: 3641048 - RNA, 14 nt, Human
ugcuuucugaucaa

SEQ ID NO: 3641049 - RNA, 15 nt, Human
ugcuuucugcucagc

SEQ ID NO: 3641050 - RNA, 15 nt, Human
ugcuuucuguuccaa

SEQ ID NO: 3641051 - RNA, 15 nt, Human
ugcuuucuuucguuu

SEQ ID NO: 3641052 - RNA, 18 nt, Human
ugcuuucuuuguuuggcu

SEQ ID NO: 3641053 - RNA, 20 nt, Human
ugcuuucuuuuuuaaaauca

SEQ ID NO: 3641054 - RNA, 22 nt, Human
ugcuuugaagcaguugugucag

SEQ ID NO: 3641055 - RNA, 22 nt, Human
ugcuuugacucaccuguuacuu

SEQ ID NO: 3641056 - RNA, 13 nt, Human
ugcuuugauauuu

SEQ ID NO: 3641057 - RNA, 17 nt, Human
ugcuuugauuuacagca

SEQ ID NO: 3641058 - RNA, 13 nt, Human
ugcuuugcuuucu

SEQ ID NO: 3641059 - RNA, 14 nt, Human
ugcuuugcuuucug

SEQ ID NO: 3641060 - RNA, 19 nt, Human
ugcuuugcuuucugcucag

SEQ ID NO: 3641061 - RNA, 17 nt, Human
ugcuuuggcuuacuugu

SEQ ID NO: 3641062 - RNA, 21 nt, Human
ugcuuugggcugcccuggugc

SEQ ID NO: 3641063 - RNA, 19 nt, Human
ugcuuuggucacuuuuaga

SEQ ID NO: 3641064 - RNA, 19 nt, Human
ugcuuuguaggugucucau

SEQ ID NO: 3641065 - RNA, 12 nt, Human
ugcuuuguauug

SEQ ID NO: 3641066 - RNA, 15 nt, Human
ugcuuugucuccucu

SEQ ID NO: 3641067 - RNA, 16 nt, Human
ugcuuugucuccucua

SEQ ID NO: 3641068 - RNA, 22 nt, Human
ugcuuugugauuuuuguaauuu

SEQ ID NO: 3641069 - RNA, 16 nt, Human
ugcuuugugugauuga

SEQ ID NO: 3641070 - RNA, 18 nt, Human
ugcuuuguuaccuuaaaa

SEQ ID NO: 3641071 - RNA, 19 nt, Human
ugcuuuguugugugccucu

SEQ ID NO: 3641072 - RNA, 20 nt, Human
ugcuuuguugugugccucua

SEQ ID NO: 3641073 - RNA, 21 nt, Human
ugcuuuguugugugccucuag

SEQ ID NO: 3641074 - RNA, 13 nt, Human
ugcuuuuaaaacu

SEQ ID NO: 3641075 - RNA, 13 nt, Human
ugcuuuuaaaauu

SEQ ID NO: 3641076 - RNA, 13 nt, Human
ugcuuuuaccaug

SEQ ID NO: 3641077 - RNA, 12 nt, Human
ugcuuuuauauc

SEQ ID NO: 3641078 - RNA, 20 nt, Human
ugcuuuuauaucuguaugua

SEQ ID NO: 3641079 - RNA, 16 nt, Human
ugcuuuuauuuugaaa

SEQ ID NO: 3641080 - RNA, 21 nt, Human
ugcuuuuauuuugaaaagcuu

SEQ ID NO: 3641081 - RNA, 17 nt, Human
ugcuuuucacugcugca

SEQ ID NO: 3641082 - RNA, 14 nt, Human
ugcuuuucagcuga

SEQ ID NO: 3641083 - RNA, 16 nt, Human
ugcuuuucaugcaaac

SEQ ID NO: 3641084 - RNA, 17 nt, Human
ugcuuuucaugcaaacu

SEQ ID NO: 3641085 - RNA, 19 nt, Human
ugcuuuucccucuuuucuu

SEQ ID NO: 3641086 - RNA, 17 nt, Human
ugcuuuucccuuuguga

SEQ ID NO: 3641087 - RNA, 18 nt, Human
ugcuuuucccuuugugag

SEQ ID NO: 3641088 - RNA, 21 nt, Human
ugcuuuucccuuugugaguca

SEQ ID NO: 3641089 - RNA, 12 nt, Human
ugcuuuugccca

SEQ ID NO: 3641090 - RNA, 23 nt, Human
ugcuuuuuaauauugauaugcuu

SEQ ID NO: 3641091 - RNA, 15 nt, Human
ugcuuuuuauaaaaa

SEQ ID NO: 3641092 - RNA, 18 nt, Human
ugcuuuuuauuucugcau

SEQ ID NO: 3641093 - RNA, 19 nt, Human
ugcuuuuuauuucugcaua

SEQ ID NO: 3641094 - RNA, 15 nt, Human
ugcuuuuucaccaga

SEQ ID NO: 3641095 - RNA, 14 nt, Human
ugcuuuuuccaacu

SEQ ID NO: 3641096 - RNA, 21 nt, Human
ugcuuuuuccaacucagaaau

SEQ ID NO: 3641097 - RNA, 13 nt, Human
ugcuuuuucuaau

SEQ ID NO: 3641098 - RNA, 13 nt, Human
ugcuuuuucugac

SEQ ID NO: 3641099 - RNA, 14 nt, Human
ugcuuuuucuuguu

SEQ ID NO: 3641100 - RNA, 13 nt, Human
ugcuuuuugaaau

SEQ ID NO: 3641101 - RNA, 14 nt, Human
ugcuuuuugaaaug

SEQ ID NO: 3641102 - RNA, 15 nt, Human
ugcuuuuugaaauga

SEQ ID NO: 3641103 - RNA, 20 nt, Human
ugcuuuuugaaaugaaauuu

SEQ ID NO: 3641104 - RNA, 20 nt, Human
ugcuuuuugagguggcacuu

SEQ ID NO: 3641105 - RNA, 21 nt, Human
ugcuuuuugagguggcacuuu

SEQ ID NO: 3641106 - RNA, 14 nt, Human
ugcuuuuuggaaag

SEQ ID NO: 3641107 - RNA, 16 nt, Human
ugcuuuuuguguuuuu

SEQ ID NO: 3641108 - RNA, 13 nt, Human
ugcuuuuuuugaa

SEQ ID NO: 3641109 - RNA, 15 nt, Human
ugcuuuuuuugaaac

SEQ ID NO: 3641110 - RNA, 13 nt, Human
uggaaaaaaaaaa

SEQ ID NO: 3641111 - RNA, 16 nt, Human
uggaaaaaaaaaaaag

SEQ ID NO: 3641112 - RNA, 17 nt, Human
uggaaaaaaaaaaaaga

SEQ ID NO: 3641113 - RNA, 16 nt, Human
uggaaaaaaaaaagac

SEQ ID NO: 3641114 - RNA, 17 nt, Human
uggaaaaaaaaaagaca

SEQ ID NO: 3641115 - RNA, 22 nt, Human
uggaaaaaaugauguucauuua

SEQ ID NO: 3641116 - RNA, 23 nt, Human
uggaaaaacaucugaaagccacg

SEQ ID NO: 3641117 - RNA, 17 nt, Human
uggaaaaauaaaacugu

SEQ ID NO: 3641118 - RNA, 13 nt, Human
uggaaaaaucaca

SEQ ID NO: 3641119 - RNA, 18 nt, Human
uggaaaaaugagagaagg

SEQ ID NO: 3641120 - RNA, 14 nt, Human
uggaaaacuuaguu

SEQ ID NO: 3641121 - RNA, 20 nt, Human
uggaaaacuuaguuugugaa

SEQ ID NO: 3641122 - RNA, 16 nt, Human
uggaaaaggaagacua

SEQ ID NO: 3641123 - RNA, 20 nt, Human
uggaaaaggaagacuagagg

SEQ ID NO: 3641124 - RNA, 22 nt, Human
uggaaaaguauguuagugcaaa

SEQ ID NO: 3641125 - RNA, 16 nt, Human
uggaaacaaaguggaa

SEQ ID NO: 3641126 - RNA, 20 nt, Human
uggaaacaaaguggaaggaa

SEQ ID NO: 3641127 - RNA, 22 nt, Human
uggaaacaaaguggaaggaaag

SEQ ID NO: 3641128 - RNA, 17 nt, Human
uggaaacacuaaauguu

SEQ ID NO: 3641129 - RNA, 20 nt, Human
uggaaacauuuauauuuuua

SEQ ID NO: 3641130 - RNA, 18 nt, Human
uggaaacauuuuuuaaaa

SEQ ID NO: 3641131 - RNA, 17 nt, Human
uggaaacccauaggccc

SEQ ID NO: 3641132 - RNA, 17 nt, Human
uggaaaccugaaaaaaa

SEQ ID NO: 3641133 - RNA, 16 nt, Human
uggaaaccuuccaccc

SEQ ID NO: 3641134 - RNA, 15 nt, Human
uggaaacuaaaacuu

SEQ ID NO: 3641135 - RNA, 18 nt, Human
uggaaacuauguguuuuu

SEQ ID NO: 3641136 - RNA, 19 nt, Human
uggaaacucuuuaacuucu

SEQ ID NO: 3641137 - RNA, 12 nt, Human
uggaaacugaau

SEQ ID NO: 3641138 - RNA, 15 nt, Human
uggaaacugaaugcu

SEQ ID NO: 3641139 - RNA, 16 nt, Human
uggaaacugaaugcuc

SEQ ID NO: 3641140 - RNA, 21 nt, Human
uggaaacuggaugaggucaua

SEQ ID NO: 3641141 - RNA, 17 nt, Human
uggaaacuguugccaga

SEQ ID NO: 3641142 - RNA, 23 nt, Human
uggaaagacagcuucucauccug

SEQ ID NO: 3641143 - RNA, 20 nt, Human
uggacucagggcagcgccag

SEQ ID NO: 3641144 - RNA, 18 nt, Human
uggacuccagaucugcac

SEQ ID NO: 3641145 - RNA, 20 nt, Human
uggacuccagccugccuggc

SEQ ID NO: 3641146 - RNA, 21 nt, Human
uggacuccagccugccuggca

SEQ ID NO: 3641147 - RNA, 17 nt, Human
uggacuccggcccuccu

SEQ ID NO: 3641148 - RNA, 21 nt, Human
uggacucuacacugugaacuu

SEQ ID NO: 3641149 - RNA, 17 nt, Human
uggacucuccccucuua

SEQ ID NO: 3641150 - RNA, 16 nt, Human
uggacucugcacauga

SEQ ID NO: 3641151 - RNA, 17 nt, Human
uggacucugcacaugaa

SEQ ID NO: 3641152 - RNA, 17 nt, Human
uggacucugcacauguc

SEQ ID NO: 3641153 - RNA, 18 nt, Human
uggacucuggacuuucuc

SEQ ID NO: 3641154 - RNA, 22 nt, Human
uggacucuggugccuccagagg

SEQ ID NO: 3641155 - RNA, 15 nt, Human
uggacucuguccuga

SEQ ID NO: 3641156 - RNA, 23 nt, Human
uggacucuguccugaaggccuga

SEQ ID NO: 3641157 - RNA, 18 nt, Human
uggacucuugcucuuucu

SEQ ID NO: 3641158 - RNA, 19 nt, Human
uggacucuuugguggcuuu

SEQ ID NO: 3641159 - RNA, 15 nt, Human
uggacugaagccugc

SEQ ID NO: 3641160 - RNA, 17 nt, Human
uggacugaagccugcag

SEQ ID NO: 3641161 - RNA, 18 nt, Human
uggacugaagccugcagg

SEQ ID NO: 3641162 - RNA, 13 nt, Human
uggacugacauuu

SEQ ID NO: 3641163 - RNA, 14 nt, Human
uggacugaggccug

SEQ ID NO: 3641164 - RNA, 19 nt, Human
uggacugagugggaagccc

SEQ ID NO: 3641165 - RNA, 15 nt, Human
uggacugaugcuuuu

SEQ ID NO: 3641166 - RNA, 14 nt, Human
uggacugcagaagc

SEQ ID NO: 3641167 - RNA, 18 nt, Human
uggacuggaaaaucucuu

SEQ ID NO: 3641168 - RNA, 23 nt, Human
uggacuggaggccccuggagcca

SEQ ID NO: 3641169 - RNA, 17 nt, Human
uggacuggaguggagca

SEQ ID NO: 3641170 - RNA, 14 nt, Human
uggacuggccccug

SEQ ID NO: 3641171 - RNA, 16 nt, Human
uggacuggccccuggg

SEQ ID NO: 3641172 - RNA, 17 nt, Human
uggacuggccccugggu

SEQ ID NO: 3641173 - RNA, 20 nt, Human
uggacuggcuagaguccuca

SEQ ID NO: 3641174 - RNA, 23 nt, Human
uggacuggcuguccuuuccagug

SEQ ID NO: 3641175 - RNA, 14 nt, Human
uggacugguuuuca

SEQ ID NO: 3641176 - RNA, 20 nt, Human
uggacugugaugccacacag

SEQ ID NO: 3641177 - RNA, 21 nt, Human
uggacuguggcacuugccugg

SEQ ID NO: 3641178 - RNA, 22 nt, Human
uggacuguggcacuugccuggg

SEQ ID NO: 3641179 - RNA, 15 nt, Human
uggacuguggugacu

SEQ ID NO: 3641180 - RNA, 16 nt, Human
uggacuguucccugag

SEQ ID NO: 3641181 - RNA, 17 nt, Human
uggacuguuuucucucg

SEQ ID NO: 3641182 - RNA, 17 nt, Human
uggacuuaaccggaguu

SEQ ID NO: 3641183 - RNA, 19 nt, Human
uggacuuaagcaucuggcu

SEQ ID NO: 3641184 - RNA, 21 nt, Human
uggacuuagaaagcaggggcu

SEQ ID NO: 3641185 - RNA, 14 nt, Human
uggacuucaaagca

SEQ ID NO: 3641186 - RNA, 18 nt, Human
uggacuucacauaagcuc

SEQ ID NO: 3641187 - RNA, 11 nt, Human
uggacuucugg

SEQ ID NO: 3641188 - RNA, 15 nt, Human
uggacuucuggggua

SEQ ID NO: 3641189 - RNA, 13 nt, Human
uggacuuguauau

SEQ ID NO: 3641190 - RNA, 17 nt, Human
uggacuuguauauuugu

SEQ ID NO: 3641191 - RNA, 18 nt, Human
uggacuuuccacccccuc

SEQ ID NO: 3641192 - RNA, 18 nt, Human
uggacuuucucuaauaau

SEQ ID NO: 3641193 - RNA, 21 nt, Human
uggacuuucucuaauaauaaa

SEQ ID NO: 3641194 - RNA, 24 nt, Human
uggacuuuguuaguuucuccaagc

SEQ ID NO: 3641195 - RNA, 13 nt, Human
uggagaaaauggg

SEQ ID NO: 3641196 - RNA, 17 nt, Human
uggagaaacuguagucu

SEQ ID NO: 3641197 - RNA, 19 nt, Human
uggagaaagcacugaccug

SEQ ID NO: 3641198 - RNA, 18 nt, Human
uggagaaagcugacuugg

SEQ ID NO: 3641199 - RNA, 15 nt, Human
uggagaaaggaguga

SEQ ID NO: 3641200 - RNA, 21 nt, Human
uggagaaagggcccugggccu

SEQ ID NO: 3641201 - RNA, 15 nt, Human
uggagaaaugaaaac

SEQ ID NO: 3641202 - RNA, 18 nt, Human
uggagaacuagaaccugg

SEQ ID NO: 3641203 - RNA, 21 nt, Human
uggagaacuagaaccuggagg

SEQ ID NO: 3641204 - RNA, 14 nt, Human
uggagaacuagaga

SEQ ID NO: 3641205 - RNA, 15 nt, Human
uggagaacuccuagg

SEQ ID NO: 3641206 - RNA, 17 nt, Human
uggagaagacccucccc

SEQ ID NO: 3641207 - RNA, 14 nt, Human
uggagaagagagga

SEQ ID NO: 3641208 - RNA, 16 nt, Human
uggagaagagaggaga

SEQ ID NO: 3641209 - RNA, 22 nt, Human
uggagaagcacacucuggucuu

SEQ ID NO: 3641210 - RNA, 19 nt, Human
uggagaagccacaggccug

SEQ ID NO: 3641211 - RNA, 23 nt, Human
uggagaagccacaggccugagau

SEQ ID NO: 3641212 - RNA, 13 nt, Human
uggagaagccauu

SEQ ID NO: 3641213 - RNA, 13 nt, Human
uggagaagcugca

SEQ ID NO: 3641214 - RNA, 14 nt, Human
uggagaagcugcag

SEQ ID NO: 3641215 - RNA, 12 nt, Human
uggagaaggaag

SEQ ID NO: 3641216 - RNA, 14 nt, Human
uggagaaggaaggc

SEQ ID NO: 3641217 - RNA, 23 nt, Human
uggagaagucucagcuaagcuca

SEQ ID NO: 3641218 - RNA, 22 nt, Human
uggagaagucuuagacuugaaa

SEQ ID NO: 3641219 - RNA, 18 nt, Human
uggagaauaauucuuuga

SEQ ID NO: 3641220 - RNA, 20 nt, Human
uggagaaucacaggcugggc

SEQ ID NO: 3641221 - RNA, 22 nt, Human
uggagaaugcaccauacucaug

SEQ ID NO: 3641222 - RNA, 17 nt, Human
uggagaauugcugaagg

SEQ ID NO: 3641223 - RNA, 22 nt, Human
uggagaauugcugaagggcauu

SEQ ID NO: 3641224 - RNA, 13 nt, Human
uggagacaaugca

SEQ ID NO: 3641225 - RNA, 16 nt, Human
uggagacaaugucugc

SEQ ID NO: 3641226 - RNA, 19 nt, Human
uggagacagccccagagca

SEQ ID NO: 3641227 - RNA, 20 nt, Human
uggagacauuccugggcaca

SEQ ID NO: 3641228 - RNA, 21 nt, Human
uggagacauuccugggcacag

SEQ ID NO: 3641229 - RNA, 22 nt, Human
uggagacauuccugggcacagu

SEQ ID NO: 3641230 - RNA, 20 nt, Human
uggagaccccaccagccuca

SEQ ID NO: 3641231 - RNA, 20 nt, Human
uggagacguggaaccucugu

SEQ ID NO: 3641232 - RNA, 23 nt, Human
uggagacguggaaccucugucuc

SEQ ID NO: 3641233 - RNA, 18 nt, Human
uggagacuaagcccuguc

SEQ ID NO: 3641234 - RNA, 18 nt, Human
uggagacuccugcccugu

SEQ ID NO: 3641235 - RNA, 20 nt, Human
uggagacugcuccugagccc

SEQ ID NO: 3641236 - RNA, 19 nt, Human
uggagacugcuucccaucc

SEQ ID NO: 3641237 - RNA, 19 nt, Human
uggagacugguccugugug

SEQ ID NO: 3641238 - RNA, 21 nt, Human
uggagacugugugugcccucu

SEQ ID NO: 3641239 - RNA, 22 nt, Human
uggagagaaacaauaaagagau

SEQ ID NO: 3641240 - RNA, 21 nt, Human
uggagagaaggccucccuagc

SEQ ID NO: 3641241 - RNA, 23 nt, Human
uggagagaaguuucuggcccugg

SEQ ID NO: 3641242 - RNA, 14 nt, Human
uggagagaggauuu

SEQ ID NO: 3641243 - RNA, 19 nt, Human
uggagagccagaaccugga

SEQ ID NO: 3641244 - RNA, 14 nt, Human
uggagagcccuggg

SEQ ID NO: 3641245 - RNA, 18 nt, Human
uggagagcuagaaccugg

SEQ ID NO: 3641246 - RNA, 19 nt, Human
uggagagcuagaaccugga

SEQ ID NO: 3641247 - RNA, 21 nt, Human
uggagagcuagaaccuggaga

SEQ ID NO: 3641248 - RNA, 23 nt, Human
uggagagcuagaaccuggagagc

SEQ ID NO: 3641249 - RNA, 17 nt, Human
uggagagcuaggagcaa

SEQ ID NO: 3641250 - RNA, 23 nt, Human
uggagagcuaggagcaaagccug

SEQ ID NO: 3641251 - RNA, 18 nt, Human
uggagagcuggagccugg

SEQ ID NO: 3641252 - RNA, 12 nt, Human
uggagaggaaca

SEQ ID NO: 3641253 - RNA, 16 nt, Human
uggagaggcccucugg

SEQ ID NO: 3641254 - RNA, 17 nt, Human
uggagagggaaugugaa

SEQ ID NO: 3641255 - RNA, 19 nt, Human
uggagagggaugaggugcu

SEQ ID NO: 3641256 - RNA, 17 nt, Human
uggagagugcaacagua

SEQ ID NO: 3641257 - RNA, 20 nt, Human
uggagagugcaacaguagca

SEQ ID NO: 3641258 - RNA, 19 nt, Human
uggagaguucaauggcugc

SEQ ID NO: 3641259 - RNA, 16 nt, Human
uggagauacuggugga

SEQ ID NO: 3641260 - RNA, 23 nt, Human
uggagaucaccaguguguggcuu

SEQ ID NO: 3641261 - RNA, 14 nt, Human
uggagauccuccug

SEQ ID NO: 3641262 - RNA, 18 nt, Human
uggagauccuccugcaga

SEQ ID NO: 3641263 - RNA, 20 nt, Human
uggagauccuccugcagacc

SEQ ID NO: 3641264 - RNA, 16 nt, Human
uggagaugaggccaga

SEQ ID NO: 3641265 - RNA, 18 nt, Human
uggagaugcugagggugu

SEQ ID NO: 3641266 - RNA, 11 nt, Human
uggagauguuu

SEQ ID NO: 3641267 - RNA, 19 nt, Human
uggagauguuuuagaguua

SEQ ID NO: 3641268 - RNA, 19 nt, Human
uggagauuugaaggucugc

SEQ ID NO: 3641269 - RNA, 18 nt, Human
uggagcaaagugguaggu

SEQ ID NO: 3641270 - RNA, 20 nt, Human
uggagcacaauaaauggcug

SEQ ID NO: 3641271 - RNA, 14 nt, Human
uggagcagaagcag

SEQ ID NO: 3641272 - RNA, 16 nt, Human
uggagcagaggggcug

SEQ ID NO: 3641273 - RNA, 18 nt, Human
uggagcaggcggugggga

SEQ ID NO: 3641274 - RNA, 15 nt, Human
uggagcaucaagcca

SEQ ID NO: 3641275 - RNA, 17 nt, Human
uggagcauuggcugaga

SEQ ID NO: 3641276 - RNA, 16 nt, Human
uggagccaacugcugc

SEQ ID NO: 3641277 - RNA, 17 nt, Human
uggagccaaggguucag

SEQ ID NO: 3641278 - RNA, 17 nt, Human
uggagccaccuguccca

SEQ ID NO: 3641279 - RNA, 22 nt, Human
uggagccaccugucccaccuca

SEQ ID NO: 3641280 - RNA, 15 nt, Human
uggagccacucuguu

SEQ ID NO: 3641281 - RNA, 11 nt, Human
uggagccaggc

SEQ ID NO: 3641282 - RNA, 15 nt, Human
uggagccaggcgugu

SEQ ID NO: 3641283 - RNA, 16 nt, Human
uggagcccacuguacu

SEQ ID NO: 3641284 - RNA, 19 nt, Human
uggagcccacuguacuugc

SEQ ID NO: 3641285 - RNA, 23 nt, Human
uggagcccacuguacuugcucuu

SEQ ID NO: 3641286 - RNA, 22 nt, Human
uggcacccaccguggaggagga

SEQ ID NO: 3641287 - RNA, 15 nt, Human
uggcacccggccccu

SEQ ID NO: 3641288 - RNA, 24 nt, Human
uggcaccgaagcccagagggucug

SEQ ID NO: 3641289 - RNA, 19 nt, Human
uggcaccugucugcuccag

SEQ ID NO: 3641290 - RNA, 22 nt, Human
uggcaccuucagacuuugcuuc

SEQ ID NO: 3641291 - RNA, 13 nt, Human
uggcaccuucccc

SEQ ID NO: 3641292 - RNA, 19 nt, Human
uggcacgguggcucaggcc

SEQ ID NO: 3641293 - RNA, 18 nt, Human
uggcacgucaucuaguuu

SEQ ID NO: 3641294 - RNA, 17 nt, Human
uggcacucacagaccug

SEQ ID NO: 3641295 - RNA, 19 nt, Human
uggcacucacagaccugga

SEQ ID NO: 3641296 - RNA, 16 nt, Human
uggcacucccuccagc

SEQ ID NO: 3641297 - RNA, 17 nt, Human
uggcacucccuccagca

SEQ ID NO: 3641298 - RNA, 19 nt, Human
uggcacucccuccagcaca

SEQ ID NO: 3641299 - RNA, 14 nt, Human
uggcacucgcugua

SEQ ID NO: 3641300 - RNA, 22 nt, Human
uggcacugagauauuuauuguu

SEQ ID NO: 3641301 - RNA, 10 nt, Human
uggcacugau

SEQ ID NO: 3641302 - RNA, 13 nt, Human
uggcacugccaug

SEQ ID NO: 3641303 - RNA, 12 nt, Human
uggcacugcugu

SEQ ID NO: 3641304 - RNA, 14 nt, Human
uggcacugcuucca

SEQ ID NO: 3641305 - RNA, 13 nt, Human
uggcacuggaugc

SEQ ID NO: 3641306 - RNA, 17 nt, Human
uggcacuggggcacuug

SEQ ID NO: 3641307 - RNA, 20 nt, Human
uggcacuggggcacuuggca

SEQ ID NO: 3641308 - RNA, 21 nt, Human
uggcacuuagcuaucagaaga

SEQ ID NO: 3641309 - RNA, 22 nt, Human
uggcacuugccauuccaaaaua

SEQ ID NO: 3641310 - RNA, 21 nt, Human
uggcagaaaaaaugucuguaa

SEQ ID NO: 3641311 - RNA, 23 nt, Human
uggcagaaagcaaaugugaccug

SEQ ID NO: 3641312 - RNA, 23 nt, Human
uggcagaaauacagucuuccaca

SEQ ID NO: 3641313 - RNA, 16 nt, Human
uggcagaacugagcuc

SEQ ID NO: 3641314 - RNA, 21 nt, Human
uggcagaacugagcuccucug

SEQ ID NO: 3641315 - RNA, 22 nt, Human
uggcagaagacaccagagcaga

SEQ ID NO: 3641316 - RNA, 23 nt, Human
uggcagaagacaccagagcagau

SEQ ID NO: 3641317 - RNA, 14 nt, Human
uggcagaaguguuu

SEQ ID NO: 3641318 - RNA, 19 nt, Human
uggcagaauaaucuuuggg

SEQ ID NO: 3641319 - RNA, 12 nt, Human
uggcagacagac

SEQ ID NO: 3641320 - RNA, 17 nt, Human
uggcagagaugccuccc

SEQ ID NO: 3641321 - RNA, 19 nt, Human
uggcagagaugccucccug

SEQ ID NO: 3641322 - RNA, 12 nt, Human
uggcagaggagg

SEQ ID NO: 3641323 - RNA, 20 nt, Human
uggcagaguuacaguucugu

SEQ ID NO: 3641324 - RNA, 17 nt, Human
uggcagaguugaagaca

SEQ ID NO: 3641325 - RNA, 17 nt, Human
uggcagaguuguaaaua

SEQ ID NO: 3641326 - RNA, 20 nt, Human
uggcagaguuguaaauauau

SEQ ID NO: 3641327 - RNA, 18 nt, Human
uggcagaguuuguguguu

SEQ ID NO: 3641328 - RNA, 22 nt, Human
uggcagaguuuguguguugucu

SEQ ID NO: 3641329 - RNA, 19 nt, Human
uggcagauaaucagccucu

SEQ ID NO: 3641330 - RNA, 13 nt, Human
uggcagaugcagc

SEQ ID NO: 3641331 - RNA, 17 nt, Human
uggcagauguaggaggg

SEQ ID NO: 3641332 - RNA, 18 nt, Human
uggcagauguaggaggga

SEQ ID NO: 3641333 - RNA, 20 nt, Human
uggcagauguaggagggacu

SEQ ID NO: 3641334 - RNA, 14 nt, Human
uggcagauucaaau

SEQ ID NO: 3641335 - RNA, 22 nt, Human
uggcagauuuagugaaagcuag

SEQ ID NO: 3641336 - RNA, 15 nt, Human
uggcagauuuuacaa

SEQ ID NO: 3641337 - RNA, 14 nt, Human
uggcagcagagugu

SEQ ID NO: 3641338 - RNA, 22 nt, Human
uggcagcaggccuguugcuuuu

SEQ ID NO: 3641339 - RNA, 13 nt, Human
uggcagcaggugc

SEQ ID NO: 3641340 - RNA, 20 nt, Human
uggcagcaggugcugcuacc

SEQ ID NO: 3641341 - RNA, 20 nt, Human
uggcagcauaaaggccuuuu

SEQ ID NO: 3641342 - RNA, 11 nt, Human
uggcagccaca

SEQ ID NO: 3641343 - RNA, 12 nt, Human
uggcagcccaga

SEQ ID NO: 3641344 - RNA, 18 nt, Human
uggcagcccagccagcgu

SEQ ID NO: 3641345 - RNA, 14 nt, Human
uggcagccccagca

SEQ ID NO: 3641346 - RNA, 19 nt, Human
uggcagccgugccuucagc

SEQ ID NO: 3641347 - RNA, 22 nt, Human
uggcagccuacuagggaccugg

SEQ ID NO: 3641348 - RNA, 16 nt, Human
uggcagccucuucaaa

SEQ ID NO: 3641349 - RNA, 11 nt, Human
uggcagccuug

SEQ ID NO: 3641350 - RNA, 14 nt, Human
uggcagcucagaga

SEQ ID NO: 3641351 - RNA, 14 nt, Human
uggcagcucuccag

SEQ ID NO: 3641352 - RNA, 15 nt, Human
uggcagcucuccagu

SEQ ID NO: 3641353 - RNA, 21 nt, Human
uggcagcucuggacagcccca

SEQ ID NO: 3641354 - RNA, 19 nt, Human
uggcagcugcgguccaccc

SEQ ID NO: 3641355 - RNA, 22 nt, Human
uggcagcugcgguccacccagg

SEQ ID NO: 3641356 - RNA, 12 nt, Human
uggcaggaaggc

SEQ ID NO: 3641357 - RNA, 17 nt, Human
uggcaggaaggcuuguu

SEQ ID NO: 3641358 - RNA, 14 nt, Human
uggcaggaccagga

SEQ ID NO: 3641359 - RNA, 17 nt, Human
uggcaggaccaggacua

SEQ ID NO: 3641360 - RNA, 20 nt, Human
uggcaggacgugggcugggc

SEQ ID NO: 3641361 - RNA, 12 nt, Human
uggcaggcagag

SEQ ID NO: 3641362 - RNA, 17 nt, Human
uggcaggcagaggccca

SEQ ID NO: 3641363 - RNA, 22 nt, Human
uggcaggcagaggcccaggcug

SEQ ID NO: 3641364 - RNA, 19 nt, Human
uggcaggcagcgccaagca

SEQ ID NO: 3641365 - RNA, 11 nt, Human
uggcaggcagg

SEQ ID NO: 3641366 - RNA, 12 nt, Human
uggcaggcaggg

SEQ ID NO: 3641367 - RNA, 15 nt, Human
uggcaggcuggccag

SEQ ID NO: 3641368 - RNA, 18 nt, Human
uggcaggcuggccagucc

SEQ ID NO: 3641369 - RNA, 21 nt, Human
uggcagggaggucaggcccug

SEQ ID NO: 3641370 - RNA, 22 nt, Human
uggcagggaggucaggcccugg

SEQ ID NO: 3641371 - RNA, 14 nt, Human
uggcagggcacagg

SEQ ID NO: 3641372 - RNA, 15 nt, Human
uggcagggcacaggg

SEQ ID NO: 3641373 - RNA, 17 nt, Human
uggcagggcacagggcc

SEQ ID NO: 3641374 - RNA, 17 nt, Human
uggcagggcucaggauu

SEQ ID NO: 3641375 - RNA, 21 nt, Human
uggcagggggcugcugcuggg

SEQ ID NO: 3641376 - RNA, 23 nt, Human
uggcagggggcugcugcugggcu

SEQ ID NO: 3641377 - RNA, 22 nt, Human
uggcagggguggaggagagccu

SEQ ID NO: 3641378 - RNA, 21 nt, Human
uggcagggguggcugccucau

SEQ ID NO: 3641379 - RNA, 23 nt, Human
uggcagguaggaauauuauauuu

SEQ ID NO: 3641380 - RNA, 23 nt, Human
uggcagugagugagccuggcucu

SEQ ID NO: 3641381 - RNA, 22 nt, Human
uggcagugcagcaaccagagca

SEQ ID NO: 3641382 - RNA, 16 nt, Human
uggcaguggaacuaag

SEQ ID NO: 3641383 - RNA, 14 nt, Human
uggcagugggagcu

SEQ ID NO: 3641384 - RNA, 19 nt, Human
uggcagugggagcugccug

SEQ ID NO: 3641385 - RNA, 17 nt, Human
uggcaguguuuugagaa

SEQ ID NO: 3641386 - RNA, 20 nt, Human
uggcaguuuauauuuaacuc

SEQ ID NO: 3641387 - RNA, 16 nt, Human
uggcaguuugguauuu

SEQ ID NO: 3641388 - RNA, 18 nt, Human
uggcaguuuugacaucag

SEQ ID NO: 3641389 - RNA, 16 nt, Human
uggcauaccuuucaca

SEQ ID NO: 3641390 - RNA, 14 nt, Human
uggcauagacaugg

SEQ ID NO: 3641391 - RNA, 21 nt, Human
uggcauagagcagcacuaaau

SEQ ID NO: 3641392 - RNA, 14 nt, Human
uggcauagcucugg

SEQ ID NO: 3641393 - RNA, 16 nt, Human
uggcauaguuucauaa

SEQ ID NO: 3641394 - RNA, 22 nt, Human
uggcaucaagaggugggagggc

SEQ ID NO: 3641395 - RNA, 14 nt, Human
uggcaucagcuggc

SEQ ID NO: 3641396 - RNA, 19 nt, Human
uggcaucccaguggccuca

SEQ ID NO: 3641397 - RNA, 15 nt, Human
uggcauccugugaag

SEQ ID NO: 3641398 - RNA, 15 nt, Human
uggcaucucuguccc

SEQ ID NO: 3641399 - RNA, 18 nt, Human
uggcaugagaaauacaaa

SEQ ID NO: 3641400 - RNA, 15 nt, Human
uggcaugcaccugca

SEQ ID NO: 3641401 - RNA, 19 nt, Human
uggcaugccuuccagcacc

SEQ ID NO: 3641402 - RNA, 17 nt, Human
uggcaugcuuaaauuuu

SEQ ID NO: 3641403 - RNA, 21 nt, Human
uggcauggaaauuuaaagcag

SEQ ID NO: 3641404 - RNA, 23 nt, Human
uggcauggaaauuuaaagcaggu

SEQ ID NO: 3641405 - RNA, 15 nt, Human
uggcaugggaaugaa

SEQ ID NO: 3641406 - RNA, 22 nt, Human
uggcauggugguugggacccag

SEQ ID NO: 3641407 - RNA, 17 nt, Human
uggcauguggccugugg

SEQ ID NO: 3641408 - RNA, 18 nt, Human
uggcauguggccuguggc

SEQ ID NO: 3641409 - RNA, 20 nt, Human
uggcauguuuugugcauuug

SEQ ID NO: 3641410 - RNA, 13 nt, Human
uggcauuaaaacu

SEQ ID NO: 3641411 - RNA, 23 nt, Human
uggcauuauguccacuguguaua

SEQ ID NO: 3641412 - RNA, 15 nt, Human
uggcauucuuguaca

SEQ ID NO: 3641413 - RNA, 14 nt, Human
uggcauuggcagca

SEQ ID NO: 3641414 - RNA, 21 nt, Human
uggcauuugugaucaugagau

SEQ ID NO: 3641415 - RNA, 14 nt, Human
uggccaaaaagaau

SEQ ID NO: 3641416 - RNA, 22 nt, Human
uggccaaaaagaaucugcauuu

SEQ ID NO: 3641417 - RNA, 15 nt, Human
uggccaaacaacagu

SEQ ID NO: 3641418 - RNA, 21 nt, Human
uggccaaagccaaagcuaggc

SEQ ID NO: 3641419 - RNA, 23 nt, Human
uggccaaagccaaagcuaggccu

SEQ ID NO: 3641420 - RNA, 16 nt, Human
uggccaaauuauuugu

SEQ ID NO: 3641421 - RNA, 18 nt, Human
uggccaaauuauuugugu

SEQ ID NO: 3641422 - RNA, 14 nt, Human
uggccaagagaaac

SEQ ID NO: 3641423 - RNA, 14 nt, Human
uggccaagcggcca

SEQ ID NO: 3641424 - RNA, 13 nt, Human
uggccaagcugag

SEQ ID NO: 3641425 - RNA, 14 nt, Human
uggccaagcugagg

SEQ ID NO: 3641426 - RNA, 15 nt, Human
uggccaaggagcugc

SEQ ID NO: 3641427 - RNA, 14 nt, Human
uggccaaguuccuc

SEQ ID NO: 3641428 - RNA, 17 nt, Human
uggccaauuaaggcauc

SEQ ID NO: 3641429 - RNA, 14 nt, Human
uggccacagccagg

SEQ ID NO: 3641430 - RNA, 14 nt, Human
ugguguuaaaacac

SEQ ID NO: 3641431 - RNA, 14 nt, Human
ugguguucuccugc

SEQ ID NO: 3641432 - RNA, 17 nt, Human
ugguguucuccugcugc

SEQ ID NO: 3641433 - RNA, 15 nt, Human
ugguguuuccuggca

SEQ ID NO: 3641434 - RNA, 20 nt, Human
ugguguuuucuuaugcagga

SEQ ID NO: 3641435 - RNA, 16 nt, Human
ugguguuuuucuugua

SEQ ID NO: 3641436 - RNA, 23 nt, Human
ugguguuuuucuuguaaaugugu

SEQ ID NO: 3641437 - RNA, 16 nt, Human
ugguuaagcuuugaca

SEQ ID NO: 3641438 - RNA, 15 nt, Human
ugguuaagucuguuu

SEQ ID NO: 3641439 - RNA, 14 nt, Human
ugguuagaaaugca

SEQ ID NO: 3641440 - RNA, 18 nt, Human
ugguuagcucagccccag

SEQ ID NO: 3641441 - RNA, 22 nt, Human
ugguuaggauggcaggacgugg

SEQ ID NO: 3641442 - RNA, 18 nt, Human
ugguuaggcauuguggga

SEQ ID NO: 3641443 - RNA, 20 nt, Human
ugguuaggcauugugggaag

SEQ ID NO: 3641444 - RNA, 15 nt, Human
ugguuauaaaaguga

SEQ ID NO: 3641445 - RNA, 19 nt, Human
ugguuauacaugacacuga

SEQ ID NO: 3641446 - RNA, 15 nt, Human
ugguuaugaaagaau

SEQ ID NO: 3641447 - RNA, 18 nt, Human
ugguuaugaaagaauaua

SEQ ID NO: 3641448 - RNA, 14 nt, Human
ugguuauggagagg

SEQ ID NO: 3641449 - RNA, 22 nt, Human
ugguuauuuagggaacugcuug

SEQ ID NO: 3641450 - RNA, 16 nt, Human
ugguuauuuuacuuuu

SEQ ID NO: 3641451 - RNA, 16 nt, Human
ugguuauuuuuauaca

SEQ ID NO: 3641452 - RNA, 19 nt, Human
ugguuauuuuuauacagua

SEQ ID NO: 3641453 - RNA, 23 nt, Human
ugguucaggguuggccccugccc

SEQ ID NO: 3641454 - RNA, 13 nt, Human
ugguucauaaaug

SEQ ID NO: 3641455 - RNA, 15 nt, Human
ugguucauaaaugaa

SEQ ID NO: 3641456 - RNA, 23 nt, Human
ugguucaucaguguuaaaaaauu

SEQ ID NO: 3641457 - RNA, 16 nt, Human
ugguuccagccugcca

SEQ ID NO: 3641458 - RNA, 21 nt, Human
ugguuccagggucccucugug

SEQ ID NO: 3641459 - RNA, 13 nt, Human
ugguuccaugccu

SEQ ID NO: 3641460 - RNA, 17 nt, Human
ugguuccaugccugagg

SEQ ID NO: 3641461 - RNA, 21 nt, Human
ugguuccauuguuuggagaca

SEQ ID NO: 3641462 - RNA, 23 nt, Human
ugguuccauuguuuggagacauu

SEQ ID NO: 3641463 - RNA, 11 nt, Human
ugguuccccug

SEQ ID NO: 3641464 - RNA, 19 nt, Human
ugguuccccuguucacucu

SEQ ID NO: 3641465 - RNA, 23 nt, Human
ugguuccccuguucacucuacuu

SEQ ID NO: 3641466 - RNA, 18 nt, Human
ugguucccguuucuccac

SEQ ID NO: 3641467 - RNA, 21 nt, Human
ugguuccuaggggaaugaggg

SEQ ID NO: 3641468 - RNA, 23 nt, Human
ugguuccuccccuccuccuggac

SEQ ID NO: 3641469 - RNA, 19 nt, Human
ugguuccugcuagaaaugg

SEQ ID NO: 3641470 - RNA, 22 nt, Human
ugguucuaaggaccugaaauuc

SEQ ID NO: 3641471 - RNA, 14 nt, Human
ugguucuauuuaau

SEQ ID NO: 3641472 - RNA, 11 nt, Human
ugguucucaau

SEQ ID NO: 3641473 - RNA, 12 nt, Human
ugguucucaaug

SEQ ID NO: 3641474 - RNA, 16 nt, Human
ugguucucaaugaaaa

SEQ ID NO: 3641475 - RNA, 16 nt, Human
ugguucucaauuccaa

SEQ ID NO: 3641476 - RNA, 17 nt, Human
ugguucucaucuuucuu

SEQ ID NO: 3641477 - RNA, 13 nt, Human
ugguucugaugcc

SEQ ID NO: 3641478 - RNA, 12 nt, Human
ugguucuggcca

SEQ ID NO: 3641479 - RNA, 17 nt, Human
ugguucuggcuguuuga

SEQ ID NO: 3641480 - RNA, 13 nt, Human
ugguucugugcca

SEQ ID NO: 3641481 - RNA, 18 nt, Human
ugguucugugucuguguu

SEQ ID NO: 3641482 - RNA, 15 nt, Human
ugguucuucauuuau

SEQ ID NO: 3641483 - RNA, 21 nt, Human
ugguucuugaggggaccagga

SEQ ID NO: 3641484 - RNA, 14 nt, Human
ugguucuuguauua

SEQ ID NO: 3641485 - RNA, 19 nt, Human
ugguucuuguguuggcugu

SEQ ID NO: 3641486 - RNA, 12 nt, Human
ugguugaagaag

SEQ ID NO: 3641487 - RNA, 18 nt, Human
ugguugaauaaacuagau

SEQ ID NO: 3641488 - RNA, 15 nt, Human
ugguugacuggguuu

SEQ ID NO: 3641489 - RNA, 17 nt, Human
ugguugagaaaugaaua

SEQ ID NO: 3641490 - RNA, 15 nt, Human
ugguugagguggaag

SEQ ID NO: 3641491 - RNA, 18 nt, Human
ugguugaugaucuuugca

SEQ ID NO: 3641492 - RNA, 18 nt, Human
ugguugaugccaaaaaaa

SEQ ID NO: 3641493 - RNA, 15 nt, Human
ugguugauggguucu

SEQ ID NO: 3641494 - RNA, 20 nt, Human
ugguugcacuuaugauuuca

SEQ ID NO: 3641495 - RNA, 16 nt, Human
ugguugcacuuuguag

SEQ ID NO: 3641496 - RNA, 14 nt, Human
ugguugcuuuaaua

SEQ ID NO: 3641497 - RNA, 16 nt, Human
ugguuggagagcuaga

SEQ ID NO: 3641498 - RNA, 12 nt, Human
ugguuggauaag

SEQ ID NO: 3641499 - RNA, 16 nt, Human
ugguuggcuggccuuc

SEQ ID NO: 3641500 - RNA, 23 nt, Human
ugguugggacccaguggcagggc

SEQ ID NO: 3641501 - RNA, 16 nt, Human
ugguugguuuucuucu

SEQ ID NO: 3641502 - RNA, 24 nt, Human
ugguugguuuugacuucagauuga

SEQ ID NO: 3641503 - RNA, 14 nt, Human
ugguuguauuagau

SEQ ID NO: 3641504 - RNA, 18 nt, Human
ugguuguauuagauguuc

SEQ ID NO: 3641505 - RNA, 15 nt, Human
ugguuguauucuuug

SEQ ID NO: 3641506 - RNA, 16 nt, Human
ugguuguauucuuuga

SEQ ID NO: 3641507 - RNA, 17 nt, Human
ugguugucaauauuaaa

SEQ ID NO: 3641508 - RNA, 22 nt, Human
ugguuguuaguuauagaugucu

SEQ ID NO: 3641509 - RNA, 14 nt, Human
ugguuguuucuucc

SEQ ID NO: 3641510 - RNA, 20 nt, Human
ugguuguuucuuccaagacu

SEQ ID NO: 3641511 - RNA, 15 nt, Human
ugguuuaaagaaagu

SEQ ID NO: 3641512 - RNA, 16 nt, Human
ugguuuaaagaaagug

SEQ ID NO: 3641513 - RNA, 21 nt, Human
ugguuuaaagaaaguguauuu

SEQ ID NO: 3641514 - RNA, 11 nt, Human
ugguuuacauu

SEQ ID NO: 3641515 - RNA, 15 nt, Human
ugguuuacauuuaaa

SEQ ID NO: 3641516 - RNA, 20 nt, Human
ugguuuacauuuaaagcauu

SEQ ID NO: 3641517 - RNA, 13 nt, Human
ugguuuaguguaa

SEQ ID NO: 3641518 - RNA, 13 nt, Human
ugguuuauauuuu

SEQ ID NO: 3641519 - RNA, 22 nt, Human
ugguuuauuggugaguuaggaa

SEQ ID NO: 3641520 - RNA, 16 nt, Human
ugguuuauuuuguauu

SEQ ID NO: 3641521 - RNA, 22 nt, Human
ugguuucagcaauauuuaagga

SEQ ID NO: 3641522 - RNA, 17 nt, Human
ugguuucauaggagaca

SEQ ID NO: 3641523 - RNA, 15 nt, Human
ugguuucauguuagu

SEQ ID NO: 3641524 - RNA, 17 nt, Human
ugguuuccaaggagcug

SEQ ID NO: 3641525 - RNA, 18 nt, Human
ugguuuccacaugcucug

SEQ ID NO: 3641526 - RNA, 13 nt, Human
ugguuucccaaga

SEQ ID NO: 3641527 - RNA, 20 nt, Human
ugguuucccccuucuacauu

SEQ ID NO: 3641528 - RNA, 19 nt, Human
ugguuuccucauuccugaa

SEQ ID NO: 3641529 - RNA, 12 nt, Human
ugguuuccugcc

SEQ ID NO: 3641530 - RNA, 15 nt, Human
ugguuucuagcauga

SEQ ID NO: 3641531 - RNA, 13 nt, Human
ugguuucucuucu

SEQ ID NO: 3641532 - RNA, 22 nt, Human
ugguuucuugugcacuggcacc

SEQ ID NO: 3641533 - RNA, 23 nt, Human
ugguuugaagaauguuaagacuu

SEQ ID NO: 3641534 - RNA, 17 nt, Human
ugguuugagcuuaguga

SEQ ID NO: 3641535 - RNA, 18 nt, Human
ugguuugcagcgacuggc

SEQ ID NO: 3641536 - RNA, 21 nt, Human
ugguuugccgguggugcaggu

SEQ ID NO: 3641537 - RNA, 11 nt, Human
ugguuuggaau

SEQ ID NO: 3641538 - RNA, 19 nt, Human
ugguuuggccaucucugga

SEQ ID NO: 3641539 - RNA, 20 nt, Human
ugguuuggccaucucuggau

SEQ ID NO: 3641540 - RNA, 21 nt, Human
ugguuuggcccuucuccuuuu

SEQ ID NO: 3641541 - RNA, 19 nt, Human
ugguuuggggcgaggcaga

SEQ ID NO: 3641542 - RNA, 23 nt, Human
ugguuuggggcgaggcagaggac

SEQ ID NO: 3641543 - RNA, 23 nt, Human
ugguuuggucccugguuuucagu

SEQ ID NO: 3641544 - RNA, 15 nt, Human
ugguuuguaaauuaa

SEQ ID NO: 3641545 - RNA, 13 nt, Human
ugguuuguccuga

SEQ ID NO: 3641546 - RNA, 12 nt, Human
ugguuuuaaaau

SEQ ID NO: 3641547 - RNA, 13 nt, Human
ugguuuuaaaaua

SEQ ID NO: 3641548 - RNA, 12 nt, Human
ugguuuuaagaa

SEQ ID NO: 3641549 - RNA, 17 nt, Human
ugguuuuaauugaagga

SEQ ID NO: 3641550 - RNA, 20 nt, Human
ugguuuuaauugaaggaaag

SEQ ID NO: 3641551 - RNA, 14 nt, Human
ugguuuucaaaaua

SEQ ID NO: 3641552 - RNA, 22 nt, Human
ugguuuuccccucccuggguuc

SEQ ID NO: 3641553 - RNA, 22 nt, Human
ugguuuuccuaaaugcagugaa

SEQ ID NO: 3641554 - RNA, 14 nt, Human
ugguuuuccugaaa

SEQ ID NO: 3641555 - RNA, 13 nt, Human
ugguuuuccugug

SEQ ID NO: 3641556 - RNA, 18 nt, Human
ugguuuucugccaaugac

SEQ ID NO: 3641557 - RNA, 12 nt, Human
ugguuuucuguu

SEQ ID NO: 3641558 - RNA, 15 nt, Human
ugguuuucuguucuu

SEQ ID NO: 3641559 - RNA, 22 nt, Human
ugguuuucuugggggaaaauac

SEQ ID NO: 3641560 - RNA, 19 nt, Human
ugguuuuguaagaugcugg

SEQ ID NO: 3641561 - RNA, 16 nt, Human
ugguuuuguuccccuc

SEQ ID NO: 3641562 - RNA, 20 nt, Human
ugguuuuguuccccuccucc

SEQ ID NO: 3641563 - RNA, 15 nt, Human
ugguuuuuaaauuuu

SEQ ID NO: 3641564 - RNA, 21 nt, Human
ugguuuuuaaauuuuguaaug

SEQ ID NO: 3641565 - RNA, 16 nt, Human
ugguuuuuacuuaacu

SEQ ID NO: 3641566 - RNA, 17 nt, Human
ugguuuuuauuucuccu

SEQ ID NO: 3641567 - RNA, 16 nt, Human
ugguuuuucaguuuuc

SEQ ID NO: 3641568 - RNA, 16 nt, Human
ugguuuuucuuuucuu

SEQ ID NO: 3641569 - RNA, 15 nt, Human
ugguuuuuuuucuaa

SEQ ID NO: 3641570 - RNA, 18 nt, Human
uguaaaaaaaaaugccuu

SEQ ID NO: 3641571 - RNA, 17 nt, Human
uguaaaaaagaaaaaca

SEQ ID NO: 3641572 - RNA, 23 nt, Human
uguaaaaaucuuuugaagcauag

SEQ ID NO: 3641573 - RNA, 14 nt, Human
uguaaaaaugagaa

SEQ ID NO: 3641574 - RNA, 17 nt, Human
uguaaaaaugagaacau

SEQ ID NO: 3641575 - RNA, 19 nt, Human
uguacacugaauauuuaua

SEQ ID NO: 3641576 - RNA, 21 nt, Human
uguacacugaauauuuauauu

SEQ ID NO: 3641577 - RNA, 22 nt, Human
uguacagaacacauuucucuga

SEQ ID NO: 3641578 - RNA, 17 nt, Human
uguacagaaucauugcu

SEQ ID NO: 3641579 - RNA, 18 nt, Human
uguacagaauucugcuac

SEQ ID NO: 3641580 - RNA, 21 nt, Human
uguacagaauucugcuaccuc

SEQ ID NO: 3641581 - RNA, 14 nt, Human
uguacagacaacaa

SEQ ID NO: 3641582 - RNA, 19 nt, Human
uguacagacauauuuaacu

SEQ ID NO: 3641583 - RNA, 17 nt, Human
uguacagacguaugcuu

SEQ ID NO: 3641584 - RNA, 18 nt, Human
uguacagacguaugcuua

SEQ ID NO: 3641585 - RNA, 16 nt, Human
uguacagagcccacgc

SEQ ID NO: 3641586 - RNA, 17 nt, Human
uguacagagcccacgcc

SEQ ID NO: 3641587 - RNA, 18 nt, Human
uguacagauucuuucagu

SEQ ID NO: 3641588 - RNA, 22 nt, Human
uguacagcaaggagauuuacaa

SEQ ID NO: 3641589 - RNA, 17 nt, Human
uguacagcuggcucuac

SEQ ID NO: 3641590 - RNA, 20 nt, Human
uguacaguagauuuuccaaa

SEQ ID NO: 3641591 - RNA, 15 nt, Human
uguacagucugucuu

SEQ ID NO: 3641592 - RNA, 20 nt, Human
uguacagucugucuucugua

SEQ ID NO: 3641593 - RNA, 12 nt, Human
uguacagucuug

SEQ ID NO: 3641594 - RNA, 14 nt, Human
uguacagugucuuu

SEQ ID NO: 3641595 - RNA, 22 nt, Human
uguacagugucuuuuuuuguau

SEQ ID NO: 3641596 - RNA, 23 nt, Human
uguacagugucuuuuuuuguaua

SEQ ID NO: 3641597 - RNA, 12 nt, Human
uguacaguguua

SEQ ID NO: 3641598 - RNA, 13 nt, Human
uguacaguguucu

SEQ ID NO: 3641599 - RNA, 20 nt, Human
uguacaguucaguuccucuu

SEQ ID NO: 3641600 - RNA, 16 nt, Human
uguacaguuugcugua

SEQ ID NO: 3641601 - RNA, 15 nt, Human
uguacaguuuggggc

SEQ ID NO: 3641602 - RNA, 11 nt, Human
uguacauaaaa

SEQ ID NO: 3641603 - RNA, 18 nt, Human
uguacauaaaagaauuuu

SEQ ID NO: 3641604 - RNA, 13 nt, Human
uguacauaacuga

SEQ ID NO: 3641605 - RNA, 15 nt, Human
uguacauaacugaaa

SEQ ID NO: 3641606 - RNA, 19 nt, Human
uguacauaaugcgugcaua

SEQ ID NO: 3641607 - RNA, 23 nt, Human
uguacauacgauuuaagguauuu

SEQ ID NO: 3641608 - RNA, 15 nt, Human
uguacauagccuaua

SEQ ID NO: 3641609 - RNA, 22 nt, Human
uguacauagccuauauuuacag

SEQ ID NO: 3641610 - RNA, 19 nt, Human
uguacauagugcuaacaug

SEQ ID NO: 3641611 - RNA, 20 nt, Human
uguacauagugcuaacauga

SEQ ID NO: 3641612 - RNA, 21 nt, Human
uguacauauguaaaauaaaau

SEQ ID NO: 3641613 - RNA, 20 nt, Human
uguacauaugugcuggaauu

SEQ ID NO: 3641614 - RNA, 19 nt, Human
uguacauauuuguggaaua

SEQ ID NO: 3641615 - RNA, 21 nt, Human
uguacaucccauguaacagaa

SEQ ID NO: 3641616 - RNA, 21 nt, Human
uguacaucuggcuuauuuuaa

SEQ ID NO: 3641617 - RNA, 12 nt, Human
uguacaugaaau

SEQ ID NO: 3641618 - RNA, 18 nt, Human
uguacaugaaauuuuugu

SEQ ID NO: 3641619 - RNA, 22 nt, Human
uguacaugaagaagcuaaaucc

SEQ ID NO: 3641620 - RNA, 21 nt, Human
uguacauggaauaacauguaa

SEQ ID NO: 3641621 - RNA, 17 nt, Human
uguacauggcagaguuu

SEQ ID NO: 3641622 - RNA, 14 nt, Human
uguacaugggacua

SEQ ID NO: 3641623 - RNA, 19 nt, Human
uguacaugggacuaugcuu

SEQ ID NO: 3641624 - RNA, 20 nt, Human
uguacaugggacuaugcuuu

SEQ ID NO: 3641625 - RNA, 15 nt, Human
uguacauguguagcc

SEQ ID NO: 3641626 - RNA, 17 nt, Human
uguacauguguagccug

SEQ ID NO: 3641627 - RNA, 22 nt, Human
uguacauuagucauucaauaaa

SEQ ID NO: 3641628 - RNA, 14 nt, Human
uguacauuuaaaau

SEQ ID NO: 3641629 - RNA, 18 nt, Human
uguacauuucuauaaaua

SEQ ID NO: 3641630 - RNA, 23 nt, Human
uguacauuuuguuguaaaaagaa

SEQ ID NO: 3641631 - RNA, 13 nt, Human
uguaccaaaauuu

SEQ ID NO: 3641632 - RNA, 18 nt, Human
uguaccaaccauccaauu

SEQ ID NO: 3641633 - RNA, 15 nt, Human
uguaccaagaaucuu

SEQ ID NO: 3641634 - RNA, 16 nt, Human
uguaccagugaauuuu

SEQ ID NO: 3641635 - RNA, 23 nt, Human
uguaccaguuaauuuuuccaacu

SEQ ID NO: 3641636 - RNA, 17 nt, Human
uguaccauuaaaauaug

SEQ ID NO: 3641637 - RNA, 19 nt, Human
uguaccauuaaaauaugca

SEQ ID NO: 3641638 - RNA, 12 nt, Human
uguacccaccgg

SEQ ID NO: 3641639 - RNA, 20 nt, Human
uguacccaccgggccacucc

SEQ ID NO: 3641640 - RNA, 21 nt, Human
uguacccaccgggccacuccu

SEQ ID NO: 3641641 - RNA, 14 nt, Human
uguacccaguuucu

SEQ ID NO: 3641642 - RNA, 23 nt, Human
uguaccccccaaccccugaggaa

SEQ ID NO: 3641643 - RNA, 16 nt, Human
uguacccccgcccagg

SEQ ID NO: 3641644 - RNA, 16 nt, Human
uguacccuuccuacag

SEQ ID NO: 3641645 - RNA, 13 nt, Human
uguaccuccccug

SEQ ID NO: 3641646 - RNA, 15 nt, Human
uguaccuccucucag

SEQ ID NO: 3641647 - RNA, 14 nt, Human
uguaccucuugagc

SEQ ID NO: 3641648 - RNA, 14 nt, Human
uguaccucuuuuag

SEQ ID NO: 3641649 - RNA, 21 nt, Human
uguaccuuuugaggagcccca

SEQ ID NO: 3641650 - RNA, 14 nt, Human
uguacgaagaguau

SEQ ID NO: 3641651 - RNA, 18 nt, Human
uguacggauuuucaguua

SEQ ID NO: 3641652 - RNA, 16 nt, Human
uguacuaaagccaaac

SEQ ID NO: 3641653 - RNA, 18 nt, Human
uguacuaaagccaaacau

SEQ ID NO: 3641654 - RNA, 20 nt, Human
uguacuaaagccaaacauau

SEQ ID NO: 3641655 - RNA, 19 nt, Human
uguacuaaccuacagagau

SEQ ID NO: 3641656 - RNA, 16 nt, Human
uguacuaacuagcauu

SEQ ID NO: 3641657 - RNA, 12 nt, Human
uguacuacaauu

SEQ ID NO: 3641658 - RNA, 17 nt, Human
uguacuaccuguguaua

SEQ ID NO: 3641659 - RNA, 19 nt, Human
uguacuagagaucugguuu

SEQ ID NO: 3641660 - RNA, 21 nt, Human
uguacuaguacuguguacugu

SEQ ID NO: 3641661 - RNA, 19 nt, Human
uguacuauaacauagaauu

SEQ ID NO: 3641662 - RNA, 21 nt, Human
uguacuauagcggcauauaga

SEQ ID NO: 3641663 - RNA, 12 nt, Human
uguacucuggcc

SEQ ID NO: 3641664 - RNA, 13 nt, Human
uguacucuggccu

SEQ ID NO: 3641665 - RNA, 15 nt, Human
uguacucuggccucu

SEQ ID NO: 3641666 - RNA, 12 nt, Human
uguacugaaaaa

SEQ ID NO: 3641667 - RNA, 18 nt, Human
uguacugaaguaaaacaa

SEQ ID NO: 3641668 - RNA, 19 nt, Human
uguacugagccuuguaauu

SEQ ID NO: 3641669 - RNA, 16 nt, Human
uguacugauucaauuu

SEQ ID NO: 3641670 - RNA, 17 nt, Human
uguacugauucaauuug

SEQ ID NO: 3641671 - RNA, 18 nt, Human
uguacugcauguuaccau

SEQ ID NO: 3641672 - RNA, 15 nt, Human
uguacugccugcuug

SEQ ID NO: 3641673 - RNA, 19 nt, Human
uguacuggagagcaacaca

SEQ ID NO: 3641674 - RNA, 20 nt, Human
uguacuggcuccucuguggu

SEQ ID NO: 3641675 - RNA, 19 nt, Human
uguacugugucauaaacag

SEQ ID NO: 3641676 - RNA, 23 nt, Human
uguacuguucucuucuugaacac

SEQ ID NO: 3641677 - RNA, 22 nt, Human
uguacuuaaaugguaauaagca

SEQ ID NO: 3641678 - RNA, 16 nt, Human
uguacuuaauaaauuc

SEQ ID NO: 3641679 - RNA, 22 nt, Human
uguacuucccgggccagggcug

SEQ ID NO: 3641680 - RNA, 11 nt, Human
uguacuuccug

SEQ ID NO: 3641681 - RNA, 23 nt, Human
uguacuugaagucuaaaagcaga

SEQ ID NO: 3641682 - RNA, 16 nt, Human
uguacuugaugacaga

SEQ ID NO: 3641683 - RNA, 14 nt, Human
uguacuuuguacaa

SEQ ID NO: 3641684 - RNA, 13 nt, Human
uguacuuugugcu

SEQ ID NO: 3641685 - RNA, 15 nt, Human
uguacuuuuaagacu

SEQ ID NO: 3641686 - RNA, 17 nt, Human
uguacuuuucauucucu

SEQ ID NO: 3641687 - RNA, 18 nt, Human
uguacuuuucauucucuu

SEQ ID NO: 3641688 - RNA, 18 nt, Human
uguacuuuuuaguuguuc

SEQ ID NO: 3641689 - RNA, 15 nt, Human
uguacuuuuuccaga

SEQ ID NO: 3641690 - RNA, 20 nt, Human
uguagaaaagaacuggaaac

SEQ ID NO: 3641691 - RNA, 21 nt, Human
uguagaaaagggaacugaaca

SEQ ID NO: 3641692 - RNA, 23 nt, Human
uguagaaaagggaacugaacauu

SEQ ID NO: 3641693 - RNA, 13 nt, Human
uguagaaaugguu

SEQ ID NO: 3641694 - RNA, 15 nt, Human
uguagaacacuaauu

SEQ ID NO: 3641695 - RNA, 17 nt, Human
uguagaacacuaauuca

SEQ ID NO: 3641696 - RNA, 20 nt, Human
uguagaacucacucugggcu

SEQ ID NO: 3641697 - RNA, 15 nt, Human
uguagaagcauggug

SEQ ID NO: 3641698 - RNA, 22 nt, Human
uguagaaguaggaagugaaaau

SEQ ID NO: 3641699 - RNA, 17 nt, Human
uguagaauguauuguac

SEQ ID NO: 3641700 - RNA, 18 nt, Human
uguagaauguauuguacc

SEQ ID NO: 3641701 - RNA, 19 nt, Human
uguagaauguauuguaccu

SEQ ID NO: 3641702 - RNA, 12 nt, Human
uguagacuauau

SEQ ID NO: 3641703 - RNA, 22 nt, Human
uguagacuauauacaugugugu

SEQ ID NO: 3641704 - RNA, 16 nt, Human
uguagagcagggcaag

SEQ ID NO: 3641705 - RNA, 12 nt, Human
uguagagccagg

SEQ ID NO: 3641706 - RNA, 15 nt, Human
uguagagccaggguc

SEQ ID NO: 3641707 - RNA, 18 nt, Human
uguagagccagggucuca

SEQ ID NO: 3641708 - RNA, 16 nt, Human
uguagaggagaaacug

SEQ ID NO: 3641709 - RNA, 17 nt, Human
uguagaguguagacugu

SEQ ID NO: 3641710 - RNA, 17 nt, Human
uguagaguuaagaagcu

SEQ ID NO: 3641711 - RNA, 18 nt, Human
uguagaguuaagaagcug

SEQ ID NO: 3641712 - RNA, 14 nt, Human
uguagauaaguguu

SEQ ID NO: 3641713 - RNA, 16 nt, Human
uguagauauuuggcuu

SEQ ID NO: 3641714 - RNA, 19 nt, Human
uguagauauuuggcuuaaa

SEQ ID NO: 3641715 - RNA, 22 nt, Human
uguagauauuuggcuuaaauau

SEQ ID NO: 3641716 - RNA, 22 nt, Human
uguagaucccaagaugacuggg

SEQ ID NO: 3641717 - RNA, 19 nt, Human
uguagaugaaaaagcaugu

SEQ ID NO: 3641718 - RNA, 21 nt, Human
uguagaugaaaaagcauguac

SEQ ID NO: 3641719 - RNA, 23 nt, Human
uguggcccugccaucuucccagc

SEQ ID NO: 3641720 - RNA, 17 nt, Human
uguggcccuggccugcu

SEQ ID NO: 3641721 - RNA, 18 nt, Human
uguggcccuggcucugcu

SEQ ID NO: 3641722 - RNA, 16 nt, Human
uguggcccuggcugcc

SEQ ID NO: 3641723 - RNA, 16 nt, Human
uguggcccuguccugc

SEQ ID NO: 3641724 - RNA, 15 nt, Human
uguggccuaaccugc

SEQ ID NO: 3641725 - RNA, 17 nt, Human
uguggccuaagaggcug

SEQ ID NO: 3641726 - RNA, 23 nt, Human
uguggccuaagaggcugcccucc

SEQ ID NO: 3641727 - RNA, 13 nt, Human
uguggccucagaa

SEQ ID NO: 3641728 - RNA, 16 nt, Human
uguggccucuucugag

SEQ ID NO: 3641729 - RNA, 17 nt, Human
uguggccugcacaguga

SEQ ID NO: 3641730 - RNA, 15 nt, Human
uguggccugggccuc

SEQ ID NO: 3641731 - RNA, 16 nt, Human
uguggccugggccucc

SEQ ID NO: 3641732 - RNA, 13 nt, Human
uguggccuguggc

SEQ ID NO: 3641733 - RNA, 16 nt, Human
uguggccuguggccug

SEQ ID NO: 3641734 - RNA, 17 nt, Human
uguggccuguggccugu

SEQ ID NO: 3641735 - RNA, 12 nt, Human
uguggcgagcca

SEQ ID NO: 3641736 - RNA, 18 nt, Human
uguggcgccgucuccagg

SEQ ID NO: 3641737 - RNA, 16 nt, Human
uguggcgggcaguggg

SEQ ID NO: 3641738 - RNA, 17 nt, Human
uguggcuaaaaaagcug

SEQ ID NO: 3641739 - RNA, 12 nt, Human
uguggcuccaca

SEQ ID NO: 3641740 - RNA, 22 nt, Human
uguggcuccaggccaaagugcc

SEQ ID NO: 3641741 - RNA, 14 nt, Human
uguggcuccccucu

SEQ ID NO: 3641742 - RNA, 15 nt, Human
uguggcuccccucua

SEQ ID NO: 3641743 - RNA, 15 nt, Human
uguggcuccuuccca

SEQ ID NO: 3641744 - RNA, 13 nt, Human
uguggcugaggag

SEQ ID NO: 3641745 - RNA, 21 nt, Human
uguggcugucagcaggaagca

SEQ ID NO: 3641746 - RNA, 12 nt, Human
uguggcuucugg

SEQ ID NO: 3641747 - RNA, 17 nt, Human
uguggcuuucuuucuuu

SEQ ID NO: 3641748 - RNA, 15 nt, Human
ugugggaaaaaaaug

SEQ ID NO: 3641749 - RNA, 11 nt, Human
ugugggaaagc

SEQ ID NO: 3641750 - RNA, 12 nt, Human
ugugggaacaga

SEQ ID NO: 3641751 - RNA, 15 nt, Human
ugugggaagaaacaa

SEQ ID NO: 3641752 - RNA, 18 nt, Human
ugugggaaugcggcaaga

SEQ ID NO: 3641753 - RNA, 17 nt, Human
ugugggacuagccuggc

SEQ ID NO: 3641754 - RNA, 16 nt, Human
ugugggacuguacaca

SEQ ID NO: 3641755 - RNA, 20 nt, Human
ugugggacuguacacacuuu

SEQ ID NO: 3641756 - RNA, 21 nt, Human
ugugggacuguacacacuuua

SEQ ID NO: 3641757 - RNA, 17 nt, Human
ugugggagaccggccug

SEQ ID NO: 3641758 - RNA, 14 nt, Human
ugugggagccucgc

SEQ ID NO: 3641759 - RNA, 23 nt, Human
ugugggauuaugggucacaggaa

SEQ ID NO: 3641760 - RNA, 19 nt, Human
ugugggccucaaggacuug

SEQ ID NO: 3641761 - RNA, 21 nt, Human
ugugggccucaaggacuugaa

SEQ ID NO: 3641762 - RNA, 20 nt, Human
ugugggccugggcuccugga

SEQ ID NO: 3641763 - RNA, 20 nt, Human
ugugggcgugagaccugccc

SEQ ID NO: 3641764 - RNA, 22 nt, Human
ugugggcuaguugggcuuccuc

SEQ ID NO: 3641765 - RNA, 16 nt, Human
ugugggcugcacucug

SEQ ID NO: 3641766 - RNA, 17 nt, Human
uguggggacccaggcuc

SEQ ID NO: 3641767 - RNA, 13 nt, Human
uguggggacuccg

SEQ ID NO: 3641768 - RNA, 15 nt, Human
uguggggccagguca

SEQ ID NO: 3641769 - RNA, 12 nt, Human
uguggggccccu

SEQ ID NO: 3641770 - RNA, 16 nt, Human
uguggggccugggagg

SEQ ID NO: 3641771 - RNA, 16 nt, Human
ugugggggacuguaag

SEQ ID NO: 3641772 - RNA, 16 nt, Human
ugugggggucugugug

SEQ ID NO: 3641773 - RNA, 21 nt, Human
ugugggguuuuuggagaaggu

SEQ ID NO: 3641774 - RNA, 19 nt, Human
uguggguaguggggaagag

SEQ ID NO: 3641775 - RNA, 20 nt, Human
uguggguggauauaaauaua

SEQ ID NO: 3641776 - RNA, 13 nt, Human
ugugggugggaga

SEQ ID NO: 3641777 - RNA, 12 nt, Human
uguggguguagc

SEQ ID NO: 3641778 - RNA, 15 nt, Human
uguggguguccugcc

SEQ ID NO: 3641779 - RNA, 14 nt, Human
uguggguucuacag

SEQ ID NO: 3641780 - RNA, 15 nt, Human
uguggguuuuuauuu

SEQ ID NO: 3641781 - RNA, 20 nt, Human
uguggguuuuuauuuccuau

SEQ ID NO: 3641782 - RNA, 23 nt, Human
ugugguaaaugccacacaccuuu

SEQ ID NO: 3641783 - RNA, 13 nt, Human
ugugguacagaga

SEQ ID NO: 3641784 - RNA, 17 nt, Human
ugugguacagagaagcc

SEQ ID NO: 3641785 - RNA, 18 nt, Human
ugugguacagagaagcca

SEQ ID NO: 3641786 - RNA, 19 nt, Human
ugugguacagagaagccag

SEQ ID NO: 3641787 - RNA, 23 nt, Human
ugugguacagagaagccagcuug

SEQ ID NO: 3641788 - RNA, 14 nt, Human
ugugguagaaacaa

SEQ ID NO: 3641789 - RNA, 17 nt, Human
ugugguaggccuuuuaa

SEQ ID NO: 3641790 - RNA, 19 nt, Human
ugugguaggccuuuuaaca

SEQ ID NO: 3641791 - RNA, 21 nt, Human
ugugguaggccuuuuaacauu

SEQ ID NO: 3641792 - RNA, 23 nt, Human
ugugguaggccuuuuaacauuuu

SEQ ID NO: 3641793 - RNA, 24 nt, Human
ugugguaggccuuuuaacauuuug

SEQ ID NO: 3641794 - RNA, 16 nt, Human
uguggucaaggcuaca

SEQ ID NO: 3641795 - RNA, 15 nt, Human
uguggucacagcugu

SEQ ID NO: 3641796 - RNA, 19 nt, Human
uguggugaugauguguaua

SEQ ID NO: 3641797 - RNA, 17 nt, Human
uguggugcagugugaaa

SEQ ID NO: 3641798 - RNA, 15 nt, Human
uguggugccugaggu

SEQ ID NO: 3641799 - RNA, 23 nt, Human
ugugguggguucuuuggaaggag

SEQ ID NO: 3641800 - RNA, 15 nt, Human
uguggugucugccug

SEQ ID NO: 3641801 - RNA, 17 nt, Human
ugugguguuagggugca

SEQ ID NO: 3641802 - RNA, 18 nt, Human
ugugguguuagggugcag

SEQ ID NO: 3641803 - RNA, 14 nt, Human
ugugguguuuccug

SEQ ID NO: 3641804 - RNA, 20 nt, Human
ugugguguuuccuggcacug

SEQ ID NO: 3641805 - RNA, 17 nt, Human
ugugguuccucugcuca

SEQ ID NO: 3641806 - RNA, 21 nt, Human
ugugguucugagauggcuccc

SEQ ID NO: 3641807 - RNA, 19 nt, Human
ugugguugacuuaugggcc

SEQ ID NO: 3641808 - RNA, 18 nt, Human
ugugguuuacuagcagga

SEQ ID NO: 3641809 - RNA, 15 nt, Human
ugugguuuaguguaa

SEQ ID NO: 3641810 - RNA, 21 nt, Human
ugugguuuaguguaaaaauga

SEQ ID NO: 3641811 - RNA, 17 nt, Human
ugugguuucauguuagu

SEQ ID NO: 3641812 - RNA, 18 nt, Human
ugugguuuccaaggagcu

SEQ ID NO: 3641813 - RNA, 13 nt, Human
ugugguuuggaau

SEQ ID NO: 3641814 - RNA, 10 nt, Human
ugugguuuua

SEQ ID NO: 3641815 - RNA, 15 nt, Human
ugugguuuucuguuu

SEQ ID NO: 3641816 - RNA, 21 nt, Human
uguguaaaaaaaccaccaaaa

SEQ ID NO: 3641817 - RNA, 14 nt, Human
uguguaaaauguga

SEQ ID NO: 3641818 - RNA, 17 nt, Human
uguguaaaaugugaagu

SEQ ID NO: 3641819 - RNA, 14 nt, Human
uguguaaacaaaau

SEQ ID NO: 3641820 - RNA, 22 nt, Human
uguguaaacaaaaugaagcugc

SEQ ID NO: 3641821 - RNA, 15 nt, Human
uguguaaauuauuga

SEQ ID NO: 3641822 - RNA, 14 nt, Human
uguguaacagcucc

SEQ ID NO: 3641823 - RNA, 23 nt, Human
uguguaaccauuuuauaaagugc

SEQ ID NO: 3641824 - RNA, 18 nt, Human
uguguaagacaaaaagcu

SEQ ID NO: 3641825 - RNA, 14 nt, Human
uguguaauaaagug

SEQ ID NO: 3641826 - RNA, 17 nt, Human
uguguaauaaaguguuu

SEQ ID NO: 3641827 - RNA, 23 nt, Human
uguguaauaaaguguuuucagag

SEQ ID NO: 3641828 - RNA, 21 nt, Human
uguguaauagaaaacugaaaa

SEQ ID NO: 3641829 - RNA, 17 nt, Human
uguguaauuguuccuuu

SEQ ID NO: 3641830 - RNA, 11 nt, Human
uguguaauuua

SEQ ID NO: 3641831 - RNA, 19 nt, Human
uguguaauuuaaaauugug

SEQ ID NO: 3641832 - RNA, 22 nt, Human
uguguaauuuaaaauugugaug

SEQ ID NO: 3641833 - RNA, 19 nt, Human
uguguaauuuaugugaaaa

SEQ ID NO: 3641834 - RNA, 14 nt, Human
uguguacaaagaaa

SEQ ID NO: 3641835 - RNA, 19 nt, Human
uguguacaaagaaauaaca

SEQ ID NO: 3641836 - RNA, 18 nt, Human
uguguacagaugaaugau

SEQ ID NO: 3641837 - RNA, 21 nt, Human
uguguacagaugaaugauaaa

SEQ ID NO: 3641838 - RNA, 15 nt, Human
uguguacauaacuga

SEQ ID NO: 3641839 - RNA, 17 nt, Human
uguguacauaacugaaa

SEQ ID NO: 3641840 - RNA, 14 nt, Human
uguguacucuggcc

SEQ ID NO: 3641841 - RNA, 19 nt, Human
uguguacuguauagacagu

SEQ ID NO: 3641842 - RNA, 20 nt, Human
uguguacuguauagacaguu

SEQ ID NO: 3641843 - RNA, 16 nt, Human
uguguagacaaauauu

SEQ ID NO: 3641844 - RNA, 21 nt, Human
uguguagacaaauauuuggag

SEQ ID NO: 3641845 - RNA, 18 nt, Human
uguguagaguuaagaagc

SEQ ID NO: 3641846 - RNA, 19 nt, Human
uguguagaguuaagaagcu

SEQ ID NO: 3641847 - RNA, 13 nt, Human
uguguagccuaug

SEQ ID NO: 3641848 - RNA, 12 nt, Human
uguguagccuuu

SEQ ID NO: 3641849 - RNA, 14 nt, Human
uguguagccuuuuu

SEQ ID NO: 3641850 - RNA, 22 nt, Human
uguguagcugugaccugcugag

SEQ ID NO: 3641851 - RNA, 22 nt, Human
uguguaguugucucucuucaga

SEQ ID NO: 3641852 - RNA, 16 nt, Human
uguguauaaauugucu

SEQ ID NO: 3641853 - RNA, 16 nt, Human
uguguauauauacaua

SEQ ID NO: 3641854 - RNA, 21 nt, Human
uguguauauauauauauaugu

SEQ ID NO: 3641855 - RNA, 20 nt, Human
uguguauauauaugugagga

SEQ ID NO: 3641856 - RNA, 16 nt, Human
uguguauauuauuugg

SEQ ID NO: 3641857 - RNA, 17 nt, Human
uguguauauuauuuggc

SEQ ID NO: 3641858 - RNA, 16 nt, Human
uguguauccauuauca

SEQ ID NO: 3641859 - RNA, 21 nt, Human
uguguauccauuaucaugugu

SEQ ID NO: 3641860 - RNA, 23 nt, Human
uguguauccauuaucauguguaa

SEQ ID NO: 3641861 - RNA, 21 nt, Human
uguguaucguaaccagccaga

SEQ ID NO: 3641862 - RNA, 19 nt, Human
uguguaugcacaugaacuu

SEQ ID NO: 3641863 - RNA, 16 nt, Human
uguguauguacauaua

SEQ ID NO: 3641864 - RNA, 23 nt, Human
uguuaguuucugaguuuuaccaa

SEQ ID NO: 3641865 - RNA, 12 nt, Human
uguuauaaucuu

SEQ ID NO: 3641866 - RNA, 20 nt, Human
uguuauacaaccuucauuua

SEQ ID NO: 3641867 - RNA, 12 nt, Human
uguuauauaauu

SEQ ID NO: 3641868 - RNA, 16 nt, Human
uguuauauauaaauau

SEQ ID NO: 3641869 - RNA, 17 nt, Human
uguuauaucauauguau

SEQ ID NO: 3641870 - RNA, 16 nt, Human
uguuauauccccugcu

SEQ ID NO: 3641871 - RNA, 18 nt, Human
uguuauauuuaaugcauu

SEQ ID NO: 3641872 - RNA, 13 nt, Human
uguuaucaaaaua

SEQ ID NO: 3641873 - RNA, 13 nt, Human
uguuaucaaacuu

SEQ ID NO: 3641874 - RNA, 19 nt, Human
uguuaucuguuugagaaag

SEQ ID NO: 3641875 - RNA, 15 nt, Human
uguuaucuucucaag

SEQ ID NO: 3641876 - RNA, 20 nt, Human
uguuaucuucucaaguucua

SEQ ID NO: 3641877 - RNA, 18 nt, Human
uguuaugacuauguaaac

SEQ ID NO: 3641878 - RNA, 13 nt, Human
uguuaugagccag

SEQ ID NO: 3641879 - RNA, 19 nt, Human
uguuaugauaaaaaauuuu

SEQ ID NO: 3641880 - RNA, 12 nt, Human
uguuaugcuauu

SEQ ID NO: 3641881 - RNA, 15 nt, Human
uguuaugcugugaca

SEQ ID NO: 3641882 - RNA, 15 nt, Human
uguuauguacuguac

SEQ ID NO: 3641883 - RNA, 17 nt, Human
uguuauguagauaacaa

SEQ ID NO: 3641884 - RNA, 15 nt, Human
uguuauguauauggu

SEQ ID NO: 3641885 - RNA, 14 nt, Human
uguuauuaaacaaa

SEQ ID NO: 3641886 - RNA, 22 nt, Human
uguuauuaaacguaugcaugug

SEQ ID NO: 3641887 - RNA, 23 nt, Human
uguuauuaaacguaugcauguga

SEQ ID NO: 3641888 - RNA, 20 nt, Human
uguuauuacauccuuguggc

SEQ ID NO: 3641889 - RNA, 21 nt, Human
uguuauuagagauuaccuccu

SEQ ID NO: 3641890 - RNA, 16 nt, Human
uguuauucaacagcaa

SEQ ID NO: 3641891 - RNA, 14 nt, Human
uguuauucuuugca

SEQ ID NO: 3641892 - RNA, 16 nt, Human
uguuauugugaaugau

SEQ ID NO: 3641893 - RNA, 19 nt, Human
uguuauugugaaugauuca

SEQ ID NO: 3641894 - RNA, 16 nt, Human
uguuauuguuuuguua

SEQ ID NO: 3641895 - RNA, 15 nt, Human
uguuauuuaaaugag

SEQ ID NO: 3641896 - RNA, 14 nt, Human
uguuauuuauauau

SEQ ID NO: 3641897 - RNA, 13 nt, Human
uguuauuuauuga

SEQ ID NO: 3641898 - RNA, 19 nt, Human
uguuauuuauugaaaugau

SEQ ID NO: 3641899 - RNA, 21 nt, Human
uguuauuucccuacauuaaac

SEQ ID NO: 3641900 - RNA, 17 nt, Human
uguuauuuguaauagau

SEQ ID NO: 3641901 - RNA, 17 nt, Human
uguuauuuguacaguuc

SEQ ID NO: 3641902 - RNA, 16 nt, Human
uguuauuuucagugau

SEQ ID NO: 3641903 - RNA, 18 nt, Human
uguuauuuucuguugaag

SEQ ID NO: 3641904 - RNA, 17 nt, Human
uguuauuuucuucuaag

SEQ ID NO: 3641905 - RNA, 14 nt, Human
uguuauuuugcaac

SEQ ID NO: 3641906 - RNA, 14 nt, Human
uguucaaacauuua

SEQ ID NO: 3641907 - RNA, 18 nt, Human
uguucaaagccacauuau

SEQ ID NO: 3641908 - RNA, 22 nt, Human
uguucaaagccacauuauuucu

SEQ ID NO: 3641909 - RNA, 15 nt, Human
uguucaaagcugccu

SEQ ID NO: 3641910 - RNA, 17 nt, Human
uguucaacaucacugaa

SEQ ID NO: 3641911 - RNA, 21 nt, Human
uguucaaugguucugaaauaa

SEQ ID NO: 3641912 - RNA, 22 nt, Human
uguucacaccuagcgucaguau

SEQ ID NO: 3641913 - RNA, 22 nt, Human
uguucaccauuauaaugaauuu

SEQ ID NO: 3641914 - RNA, 17 nt, Human
uguucacuaaacucuga

SEQ ID NO: 3641915 - RNA, 18 nt, Human
uguucacucacucuaaag

SEQ ID NO: 3641916 - RNA, 17 nt, Human
uguucacugaagacgcc

SEQ ID NO: 3641917 - RNA, 19 nt, Human
uguucacuuuuccucccuc

SEQ ID NO: 3641918 - RNA, 13 nt, Human
uguucagcacugu

SEQ ID NO: 3641919 - RNA, 17 nt, Human
uguucagcacugucccu

SEQ ID NO: 3641920 - RNA, 15 nt, Human
uguucagcuccagcu

SEQ ID NO: 3641921 - RNA, 16 nt, Human
uguucagcuccagcuc

SEQ ID NO: 3641922 - RNA, 22 nt, Human
uguucagcuccagcucaccagc

SEQ ID NO: 3641923 - RNA, 13 nt, Human
uguucaguaauaa

SEQ ID NO: 3641924 - RNA, 14 nt, Human
uguucagucuuuca

SEQ ID NO: 3641925 - RNA, 12 nt, Human
uguucauacauu

SEQ ID NO: 3641926 - RNA, 20 nt, Human
uguucauagcccaguagacc

SEQ ID NO: 3641927 - RNA, 23 nt, Human
uguucauagcccaguagaccuug

SEQ ID NO: 3641928 - RNA, 20 nt, Human
uguucaucauccagaugugg

SEQ ID NO: 3641929 - RNA, 19 nt, Human
uguucaucauccuaagcua

SEQ ID NO: 3641930 - RNA, 19 nt, Human
uguucaucccaugauguag

SEQ ID NO: 3641931 - RNA, 15 nt, Human
uguucaucuguaacu

SEQ ID NO: 3641932 - RNA, 14 nt, Human
uguucaugaaagau

SEQ ID NO: 3641933 - RNA, 14 nt, Human
uguucauggcagau

SEQ ID NO: 3641934 - RNA, 12 nt, Human
uguucauguuug

SEQ ID NO: 3641935 - RNA, 14 nt, Human
uguucauuccucca

SEQ ID NO: 3641936 - RNA, 22 nt, Human
uguucauuuagauugaaaacuu

SEQ ID NO: 3641937 - RNA, 11 nt, Human
uguucauuucc

SEQ ID NO: 3641938 - RNA, 18 nt, Human
uguucauuuguuauucuu

SEQ ID NO: 3641939 - RNA, 20 nt, Human
uguucauuuguuauucuuaa

SEQ ID NO: 3641940 - RNA, 18 nt, Human
uguuccaaauucaguuuc

SEQ ID NO: 3641941 - RNA, 21 nt, Human
uguuccaaauucaguuucaua

SEQ ID NO: 3641942 - RNA, 22 nt, Human
uguuccaaauucaguuucauaa

SEQ ID NO: 3641943 - RNA, 11 nt, Human
uguuccaagac

SEQ ID NO: 3641944 - RNA, 15 nt, Human
uguuccaagacauug

SEQ ID NO: 3641945 - RNA, 20 nt, Human
uguuccaagacauugucaau

SEQ ID NO: 3641946 - RNA, 15 nt, Human
uguuccaaguuucca

SEQ ID NO: 3641947 - RNA, 15 nt, Human
uguuccaaugccaca

SEQ ID NO: 3641948 - RNA, 18 nt, Human
uguuccagauucaaucga

SEQ ID NO: 3641949 - RNA, 14 nt, Human
uguuccagcaguuu

SEQ ID NO: 3641950 - RNA, 18 nt, Human
uguuccauaguuaaagaa

SEQ ID NO: 3641951 - RNA, 21 nt, Human
uguuccauugaagccgacucu

SEQ ID NO: 3641952 - RNA, 16 nt, Human
uguucccacaccccaa

SEQ ID NO: 3641953 - RNA, 21 nt, Human
uguucccaccaggcugcucag

SEQ ID NO: 3641954 - RNA, 22 nt, Human
uguucccagugacacuucagag

SEQ ID NO: 3641955 - RNA, 20 nt, Human
uguucccauguagcccccug

SEQ ID NO: 3641956 - RNA, 16 nt, Human
uguucccauucuugca

SEQ ID NO: 3641957 - RNA, 17 nt, Human
uguucccauuucagcug

SEQ ID NO: 3641958 - RNA, 22 nt, Human
uguuccccacugacagccuccc

SEQ ID NO: 3641959 - RNA, 14 nt, Human
uguuccccagagaa

SEQ ID NO: 3641960 - RNA, 13 nt, Human
uguuccccaucug

SEQ ID NO: 3641961 - RNA, 14 nt, Human
uguuccccucacug

SEQ ID NO: 3641962 - RNA, 13 nt, Human
uguuccccuccuc

SEQ ID NO: 3641963 - RNA, 17 nt, Human
uguuccccuccuccacu

SEQ ID NO: 3641964 - RNA, 19 nt, Human
uguuccccuccuccacucu

SEQ ID NO: 3641965 - RNA, 16 nt, Human
uguuccccucucccuu

SEQ ID NO: 3641966 - RNA, 23 nt, Human
uguuccccucucccuucccuccu

SEQ ID NO: 3641967 - RNA, 20 nt, Human
uguuccccucuugucucccc

SEQ ID NO: 3641968 - RNA, 17 nt, Human
uguuccccuuccacuga

SEQ ID NO: 3641969 - RNA, 20 nt, Human
uguuccccuuccacugaggg

SEQ ID NO: 3641970 - RNA, 23 nt, Human
uguuccccuuccacugagggcag

SEQ ID NO: 3641971 - RNA, 14 nt, Human
uguucccucugcuc

SEQ ID NO: 3641972 - RNA, 19 nt, Human
uguucccuuugucuuucaa

SEQ ID NO: 3641973 - RNA, 20 nt, Human
uguucccuuugucuuucaaa

SEQ ID NO: 3641974 - RNA, 15 nt, Human
uguuccuacgggcuu

SEQ ID NO: 3641975 - RNA, 14 nt, Human
uguuccuagugaaa

SEQ ID NO: 3641976 - RNA, 18 nt, Human
uguuccuagugaaagagg

SEQ ID NO: 3641977 - RNA, 21 nt, Human
uguuccugccuccuugauauu

SEQ ID NO: 3641978 - RNA, 16 nt, Human
uguuccugcugcuguc

SEQ ID NO: 3641979 - RNA, 10 nt, Human
uguuccuggc

SEQ ID NO: 3641980 - RNA, 14 nt, Human
uguuccuggcaaua

SEQ ID NO: 3641981 - RNA, 20 nt, Human
uguuccuuacuuuacugccu

SEQ ID NO: 3641982 - RNA, 18 nt, Human
uguuccuucccugugccu

SEQ ID NO: 3641983 - RNA, 19 nt, Human
uguuccuuccgcuuggagc

SEQ ID NO: 3641984 - RNA, 21 nt, Human
uguucgauuacgucaucaaaa

SEQ ID NO: 3641985 - RNA, 22 nt, Human
uguucgcauggucacacacuga

SEQ ID NO: 3641986 - RNA, 23 nt, Human
uguucgcauggucacacacugau

SEQ ID NO: 3641987 - RNA, 23 nt, Human
uguucgcguguguggguggauau

SEQ ID NO: 3641988 - RNA, 17 nt, Human
uguucgguuuuuuuccu

SEQ ID NO: 3641989 - RNA, 21 nt, Human
uguucgguuuuuuuccuguuu

SEQ ID NO: 3641990 - RNA, 19 nt, Human
uguucguugguuauacaag

SEQ ID NO: 3641991 - RNA, 13 nt, Human
uguucuaaagcuc

SEQ ID NO: 3641992 - RNA, 14 nt, Human
uguucuaaagcucu

SEQ ID NO: 3641993 - RNA, 15 nt, Human
uguucuaagaaguga

SEQ ID NO: 3641994 - RNA, 14 nt, Human
uguucuaagaugug

SEQ ID NO: 3641995 - RNA, 16 nt, Human
uguucuaaggcucuga

SEQ ID NO: 3641996 - RNA, 11 nt, Human
uguucuaaggg

SEQ ID NO: 3641997 - RNA, 14 nt, Human
uguucuaaguuucu

SEQ ID NO: 3641998 - RNA, 23 nt, Human
uguucuaaguuucuaagauucua

SEQ ID NO: 3641999 - RNA, 15 nt, Human
uguucuaauggauua

SEQ ID NO: 3642000 - RNA, 17 nt, Human
uguucuacccguuccaa

SEQ ID NO: 3642001 - RNA, 15 nt, Human
uguucuaguuuucag

SEQ ID NO: 3642002 - RNA, 22 nt, Human
uguucuaguuuucaguuuguau

SEQ ID NO: 3642003 - RNA, 14 nt, Human
uguucuaguuuuuu

SEQ ID NO: 3642004 - RNA, 12 nt, Human
uguucuauagcu

SEQ ID NO: 3642005 - RNA, 15 nt, Human
uguucuaugaacaac

SEQ ID NO: 3642006 - RNA, 18 nt, Human
uguucucagcucccccug

SEQ ID NO: 3642007 - RNA, 18 nt, Human
uguucucuaucauuuaau

SEQ ID NO: 3642008 - RNA, 15 nt, Human
uguucucucuucucc

SEQ ID NO: 3642009 - RNA, 20 nt, Human
uguuuauauaaaugcuuuua

SEQ ID NO: 3642010 - RNA, 15 nt, Human
uguuuauauuuucaa

SEQ ID NO: 3642011 - RNA, 19 nt, Human
uguuuaucagcaguuguua

SEQ ID NO: 3642012 - RNA, 17 nt, Human
uguuuaucccuuaagaa

SEQ ID NO: 3642013 - RNA, 20 nt, Human
uguuuaucccuuaagaauga

SEQ ID NO: 3642014 - RNA, 16 nt, Human
uguuuauccuuucaua

SEQ ID NO: 3642015 - RNA, 17 nt, Human
uguuuaucuagauguaa

SEQ ID NO: 3642016 - RNA, 20 nt, Human
uguuuaucuagauguaaauu

SEQ ID NO: 3642017 - RNA, 15 nt, Human
uguuuaugagaaacu

SEQ ID NO: 3642018 - RNA, 14 nt, Human
uguuuaugagccag

SEQ ID NO: 3642019 - RNA, 16 nt, Human
uguuuaugagccagac

SEQ ID NO: 3642020 - RNA, 21 nt, Human
uguuuaugagccagacaaaug

SEQ ID NO: 3642021 - RNA, 23 nt, Human
uguuuauggccucagcugccuca

SEQ ID NO: 3642022 - RNA, 20 nt, Human
uguuuauguaaacaaaucuu

SEQ ID NO: 3642023 - RNA, 22 nt, Human
uguuuaugugcuauuaauauuu

SEQ ID NO: 3642024 - RNA, 16 nt, Human
uguuuaugugugugug

SEQ ID NO: 3642025 - RNA, 14 nt, Human
uguuuauguuuuua

SEQ ID NO: 3642026 - RNA, 19 nt, Human
uguuuauuaaaauucugaa

SEQ ID NO: 3642027 - RNA, 15 nt, Human
uguuuauuaaaugcu

SEQ ID NO: 3642028 - RNA, 14 nt, Human
uguuuauuaacaaa

SEQ ID NO: 3642029 - RNA, 21 nt, Human
uguuuauuacuuccaugaauu

SEQ ID NO: 3642030 - RNA, 14 nt, Human
uguuuauuagauga

SEQ ID NO: 3642031 - RNA, 13 nt, Human
uguuuauucaaac

SEQ ID NO: 3642032 - RNA, 18 nt, Human
uguuuauucaaacugaaa

SEQ ID NO: 3642033 - RNA, 16 nt, Human
uguuuauucauaugca

SEQ ID NO: 3642034 - RNA, 19 nt, Human
uguuuauucauaugcauau

SEQ ID NO: 3642035 - RNA, 18 nt, Human
uguuuauuccugauaaua

SEQ ID NO: 3642036 - RNA, 13 nt, Human
uguuuauuccuug

SEQ ID NO: 3642037 - RNA, 14 nt, Human
uguuuauugucaaa

SEQ ID NO: 3642038 - RNA, 17 nt, Human
uguuuauugucaaagug

SEQ ID NO: 3642039 - RNA, 23 nt, Human
uguuuauuuauaagcagauuuaa

SEQ ID NO: 3642040 - RNA, 24 nt, Human
uguuuauuuauagaguguacuuaa

SEQ ID NO: 3642041 - RNA, 15 nt, Human
uguuuauuuaucagu

SEQ ID NO: 3642042 - RNA, 17 nt, Human
uguuuauuucuguuucu

SEQ ID NO: 3642043 - RNA, 20 nt, Human
uguuuauuuucuacguuucu

SEQ ID NO: 3642044 - RNA, 14 nt, Human
uguuuauuuuuaua

SEQ ID NO: 3642045 - RNA, 15 nt, Human
uguuuauuuuuauau

SEQ ID NO: 3642046 - RNA, 23 nt, Human
uguuuauuuuuauauagcuugaa

SEQ ID NO: 3642047 - RNA, 18 nt, Human
uguuuauuuuucauauug

SEQ ID NO: 3642048 - RNA, 17 nt, Human
uguuucaaacacaaaug

SEQ ID NO: 3642049 - RNA, 18 nt, Human
uguuucaaacacaaaugc

SEQ ID NO: 3642050 - RNA, 19 nt, Human
uguuucaaacacaaaugca

SEQ ID NO: 3642051 - RNA, 15 nt, Human
uguuucaaacuuuac

SEQ ID NO: 3642052 - RNA, 19 nt, Human
uguuucaagaaccuggaaa

SEQ ID NO: 3642053 - RNA, 12 nt, Human
uguuucaagagg

SEQ ID NO: 3642054 - RNA, 22 nt, Human
uguuucaaguucacaccugcag

SEQ ID NO: 3642055 - RNA, 15 nt, Human
uguuucaaucacugu

SEQ ID NO: 3642056 - RNA, 16 nt, Human
uguuucaaucacuguc

SEQ ID NO: 3642057 - RNA, 23 nt, Human
uguuucacaccggaagguuuuua

SEQ ID NO: 3642058 - RNA, 19 nt, Human
uguuucacaguuugaaaua

SEQ ID NO: 3642059 - RNA, 21 nt, Human
uguuucagcuaagggaagaca

SEQ ID NO: 3642060 - RNA, 12 nt, Human
uguuucauccuu

SEQ ID NO: 3642061 - RNA, 18 nt, Human
uguuucauccuucccacu

SEQ ID NO: 3642062 - RNA, 18 nt, Human
uguuuccaaccuggagua

SEQ ID NO: 3642063 - RNA, 22 nt, Human
uguuuccaauguuuagcaaaua

SEQ ID NO: 3642064 - RNA, 21 nt, Human
uguuuccaguacaccuuucag

SEQ ID NO: 3642065 - RNA, 14 nt, Human
uguuucccauaauu

SEQ ID NO: 3642066 - RNA, 17 nt, Human
uguuuccuaauaucaaa

SEQ ID NO: 3642067 - RNA, 21 nt, Human
uguuuccuaauaucaaaugca

SEQ ID NO: 3642068 - RNA, 16 nt, Human
uguuuccuagcugugu

SEQ ID NO: 3642069 - RNA, 14 nt, Human
uguuuccucuaguu

SEQ ID NO: 3642070 - RNA, 16 nt, Human
uguuuccugcaggcca

SEQ ID NO: 3642071 - RNA, 11 nt, Human
uguuuccuuuu

SEQ ID NO: 3642072 - RNA, 13 nt, Human
uguuuccuuuuuu

SEQ ID NO: 3642073 - RNA, 14 nt, Human
uguuucgcucuuug

SEQ ID NO: 3642074 - RNA, 22 nt, Human
uguuucggagacgggaccgggc

SEQ ID NO: 3642075 - RNA, 15 nt, Human
uguuucguggggagg

SEQ ID NO: 3642076 - RNA, 22 nt, Human
uguuucuaagguaacaagauga

SEQ ID NO: 3642077 - RNA, 18 nt, Human
uguuucuaauuugcugcu

SEQ ID NO: 3642078 - RNA, 17 nt, Human
uguuucuacuuugauau

SEQ ID NO: 3642079 - RNA, 22 nt, Human
uguuucuaguugaggaguuucc

SEQ ID NO: 3642080 - RNA, 23 nt, Human
uguuucuaguugaggaguuuccu

SEQ ID NO: 3642081 - RNA, 16 nt, Human
uguuucuauuuuuuga

SEQ ID NO: 3642082 - RNA, 17 nt, Human
uguuucucccccugggc

SEQ ID NO: 3642083 - RNA, 15 nt, Human
uguuucucccucuca

SEQ ID NO: 3642084 - RNA, 17 nt, Human
uguuucuccuucugaaa

SEQ ID NO: 3642085 - RNA, 15 nt, Human
uguuucucugcuguu

SEQ ID NO: 3642086 - RNA, 22 nt, Human
uguuucucuguuguaagaauag

SEQ ID NO: 3642087 - RNA, 20 nt, Human
uguuucucuugagcuggccu

SEQ ID NO: 3642088 - RNA, 13 nt, Human
uguuucugaaaau

SEQ ID NO: 3642089 - RNA, 12 nt, Human
uguuucugcagu

SEQ ID NO: 3642090 - RNA, 22 nt, Human
uguuucuggacccuuauaaaau

SEQ ID NO: 3642091 - RNA, 11 nt, Human
uguuucugggg

SEQ ID NO: 3642092 - RNA, 20 nt, Human
uguuucuggguccugaagaa

SEQ ID NO: 3642093 - RNA, 11 nt, Human
uguuucuguaa

SEQ ID NO: 3642094 - RNA, 22 nt, Human
uguuucuguacuuuuuggcaua

SEQ ID NO: 3642095 - RNA, 23 nt, Human
uguuucuguacuuuuuggcauaa

SEQ ID NO: 3642096 - RNA, 12 nt, Human
uguuucuguccu

SEQ ID NO: 3642097 - RNA, 13 nt, Human
uguuucugugggc

SEQ ID NO: 3642098 - RNA, 15 nt, Human
uguuucuguuccaaa

SEQ ID NO: 3642099 - RNA, 16 nt, Human
uguuucuguuccaaau

SEQ ID NO: 3642100 - RNA, 22 nt, Human
uguuucuuaacuauaaauaugu

SEQ ID NO: 3642101 - RNA, 15 nt, Human
uguuucuuaauuugg

SEQ ID NO: 3642102 - RNA, 14 nt, Human
uguuucuugcuugu

SEQ ID NO: 3642103 - RNA, 17 nt, Human
uguuucuugcuuguacc

SEQ ID NO: 3642104 - RNA, 19 nt, Human
uguuucuugcuuguaccuc

SEQ ID NO: 3642105 - RNA, 21 nt, Human
uguuucuuucucugaggacaa

SEQ ID NO: 3642106 - RNA, 13 nt, Human
uguuucuuugaau

SEQ ID NO: 3642107 - RNA, 16 nt, Human
uguuucuuugaauuuu

SEQ ID NO: 3642108 - RNA, 18 nt, Human
uguuucuuuguaaugaaa

SEQ ID NO: 3642109 - RNA, 12 nt, Human
uguuucuuugug

SEQ ID NO: 3642110 - RNA, 14 nt, Human
uguuucuuuuguau

SEQ ID NO: 3642111 - RNA, 20 nt, Human
uguuucuuuuguauguaaau

SEQ ID NO: 3642112 - RNA, 16 nt, Human
uguuugaaaauaguuu

SEQ ID NO: 3642113 - RNA, 17 nt, Human
uguuugaaaauaguuua

SEQ ID NO: 3642114 - RNA, 18 nt, Human
uguuugaaaauaguuuau

SEQ ID NO: 3642115 - RNA, 18 nt, Human
uguuugaaacaaagaagg

SEQ ID NO: 3642116 - RNA, 22 nt, Human
uguuugaaucccacgcuucucu

SEQ ID NO: 3642117 - RNA, 21 nt, Human
uguuugacgggaaacaaaacu

SEQ ID NO: 3642118 - RNA, 13 nt, Human
uguuugagcucag

SEQ ID NO: 3642119 - RNA, 15 nt, Human
uguuugaggaaagca

SEQ ID NO: 3642120 - RNA, 18 nt, Human
uguuugaggagcauguuu

SEQ ID NO: 3642121 - RNA, 20 nt, Human
uguuugaggagcauguuuug

SEQ ID NO: 3642122 - RNA, 22 nt, Human
uguuugagguuuuuaagccuua

SEQ ID NO: 3642123 - RNA, 16 nt, Human
uguuugaugcauuaaa

SEQ ID NO: 3642124 - RNA, 17 nt, Human
uguuugauucagacagc

SEQ ID NO: 3642125 - RNA, 14 nt, Human
uguuugcaagcagg

SEQ ID NO: 3642126 - RNA, 22 nt, Human
uguuugccauacuuugucugaa

SEQ ID NO: 3642127 - RNA, 15 nt, Human
uguuugcucagaaca

SEQ ID NO: 3642128 - RNA, 23 nt, Human
uguuugcuuauuguuccaagaca

SEQ ID NO: 3642129 - RNA, 22 nt, Human
uguuugcuuucugaucaaggcc

SEQ ID NO: 3642130 - RNA, 12 nt, Human
uguuuggaaaua

SEQ ID NO: 3642131 - RNA, 13 nt, Human
uguuuggagacag

SEQ ID NO: 3642132 - RNA, 15 nt, Human
uguuuggagacauuc

SEQ ID NO: 3642133 - RNA, 12 nt, Human
uguuuggagagc

SEQ ID NO: 3642134 - RNA, 19 nt, Human
uguuuggauguaauuuagg

SEQ ID NO: 3642135 - RNA, 15 nt, Human
uguuuggcauguaaa

SEQ ID NO: 3642136 - RNA, 16 nt, Human
uguuugggcagaaggg

SEQ ID NO: 3642137 - RNA, 22 nt, Human
uguuugggcagaagggagaagg

SEQ ID NO: 3642138 - RNA, 19 nt, Human
uguuuggggaugagaaagg

SEQ ID NO: 3642139 - RNA, 18 nt, Human
uguuuggguuuuuuuccu

SEQ ID NO: 3642140 - RNA, 12 nt, Human
uguuugguaaau

SEQ ID NO: 3642141 - RNA, 16 nt, Human
uguuugguauuguauu

SEQ ID NO: 3642142 - RNA, 22 nt, Human
uguuugguauuguauuuauuca

SEQ ID NO: 3642143 - RNA, 14 nt, Human
uguuugguuauagu

SEQ ID NO: 3642144 - RNA, 19 nt, Human
uguuuguaaauaagagauu

SEQ ID NO: 3642145 - RNA, 16 nt, Human
uguuuguaacaagaaa

SEQ ID NO: 3642146 - RNA, 17 nt, Human
uguuuguacaagauugu

SEQ ID NO: 3642147 - RNA, 16 nt, Human
uguuuguagugaaaua

SEQ ID NO: 3642148 - RNA, 18 nt, Human
uguuugucucuccuuuuc

SEQ ID NO: 3642149 - RNA, 17 nt, Human
uguuugucuucucccca

SEQ ID NO: 3642150 - RNA, 13 nt, Human
uguuugugauuga

SEQ ID NO: 3642151 - RNA, 13 nt, Human
uguuugugcugug

SEQ ID NO: 3642152 - RNA, 14 nt, Human
uguuugugcugugg

SEQ ID NO: 3642153 - RNA, 12 nt, Human
uguuugugcuuc

SEQ ID NO: 3642154 - RNA, 15 nt, Human
uuaguuccugugcac

SEQ ID NO: 3642155 - RNA, 21 nt, Human
uuaguucucacuguucccucu

SEQ ID NO: 3642156 - RNA, 15 nt, Human
uuaguugcuguaugu

SEQ ID NO: 3642157 - RNA, 16 nt, Human
uuaguuuagaacaggu

SEQ ID NO: 3642158 - RNA, 20 nt, Human
uuaguuuagaacagguuuuu

SEQ ID NO: 3642159 - RNA, 20 nt, Human
uuaguuuccuuuuuaauaug

SEQ ID NO: 3642160 - RNA, 15 nt, Human
uuaguuucuccaagc

SEQ ID NO: 3642161 - RNA, 20 nt, Human
uuaguuucugaguuuuacca

SEQ ID NO: 3642162 - RNA, 19 nt, Human
uuaguuucuguucugugga

SEQ ID NO: 3642163 - RNA, 14 nt, Human
uuaguuucuuuggg

SEQ ID NO: 3642164 - RNA, 22 nt, Human
uuaguuugcaguuacacuaaaa

SEQ ID NO: 3642165 - RNA, 15 nt, Human
uuaguuuguauauau

SEQ ID NO: 3642166 - RNA, 17 nt, Human
uuaguuuuaguugcaga

SEQ ID NO: 3642167 - RNA, 13 nt, Human
uuaguuuugcuuu

SEQ ID NO: 3642168 - RNA, 22 nt, Human
uuaguuuugcuuuuaguuuuuc

SEQ ID NO: 3642169 - RNA, 18 nt, Human
uuaguuuugugaagguga

SEQ ID NO: 3642170 - RNA, 14 nt, Human
uuaguuuugugcuu

SEQ ID NO: 3642171 - RNA, 17 nt, Human
uuaguuuuucauuaaau

SEQ ID NO: 3642172 - RNA, 19 nt, Human
uuaguuuuugguugggaau

SEQ ID NO: 3642173 - RNA, 18 nt, Human
uuaguuuuuguaauuuau

SEQ ID NO: 3642174 - RNA, 19 nt, Human
uuaguuuuuguaauuuauu

SEQ ID NO: 3642175 - RNA, 18 nt, Human
uuaguuuuugugaaguuu

SEQ ID NO: 3642176 - RNA, 19 nt, Human
uuauaaaaaaaaugaaaug

SEQ ID NO: 3642177 - RNA, 19 nt, Human
uuauaaaaaauggugccug

SEQ ID NO: 3642178 - RNA, 18 nt, Human
uuauaaaaaaugguucag

SEQ ID NO: 3642179 - RNA, 15 nt, Human
uuauaaaaauaaaaa

SEQ ID NO: 3642180 - RNA, 21 nt, Human
uuauaaaaauaaauagaaaag

SEQ ID NO: 3642181 - RNA, 16 nt, Human
uuauaaaaauauuaag

SEQ ID NO: 3642182 - RNA, 21 nt, Human
uuauaaaaauauuaagacaau

SEQ ID NO: 3642183 - RNA, 22 nt, Human
uuauaaaaggggguccguggaa

SEQ ID NO: 3642184 - RNA, 16 nt, Human
uuauaaaaguguucau

SEQ ID NO: 3642185 - RNA, 20 nt, Human
uuauaaaauccugugcaaua

SEQ ID NO: 3642186 - RNA, 13 nt, Human
uuauaaaauggcu

SEQ ID NO: 3642187 - RNA, 20 nt, Human
uuauaaaauggcuguaauca

SEQ ID NO: 3642188 - RNA, 14 nt, Human
uuauaaaauuaaag

SEQ ID NO: 3642189 - RNA, 17 nt, Human
uuauaaaauuaaagaaa

SEQ ID NO: 3642190 - RNA, 22 nt, Human
uuauaaaauuaaagaaaauaaa

SEQ ID NO: 3642191 - RNA, 16 nt, Human
uuauaaaauuaagcaa

SEQ ID NO: 3642192 - RNA, 17 nt, Human
uuauaaaauuuugcuuu

SEQ ID NO: 3642193 - RNA, 21 nt, Human
uuauaaacaagaaugaagguu

SEQ ID NO: 3642194 - RNA, 23 nt, Human
uuauaaacagacaauaugugagu

SEQ ID NO: 3642195 - RNA, 18 nt, Human
uuauaaacucauuuugcu

SEQ ID NO: 3642196 - RNA, 17 nt, Human
uuauaaacuuuaccuuu

SEQ ID NO: 3642197 - RNA, 12 nt, Human
uuauaaacuuuu

SEQ ID NO: 3642198 - RNA, 15 nt, Human
uuauaaaguagaaau

SEQ ID NO: 3642199 - RNA, 12 nt, Human
uuauaaagugcu

SEQ ID NO: 3642200 - RNA, 19 nt, Human
uuauaaagugcuuguguaa

SEQ ID NO: 3642201 - RNA, 15 nt, Human
uuauaaauauauuua

SEQ ID NO: 3642202 - RNA, 18 nt, Human
uuauaaaucuuaugcucu

SEQ ID NO: 3642203 - RNA, 15 nt, Human
uuauaaauuaaauau

SEQ ID NO: 3642204 - RNA, 18 nt, Human
uuauaaauuaaauauaug

SEQ ID NO: 3642205 - RNA, 11 nt, Human
uuauaaauuau

SEQ ID NO: 3642206 - RNA, 12 nt, Human
uuauaaauuucg

SEQ ID NO: 3642207 - RNA, 17 nt, Human
uuauaacagcauucuug

SEQ ID NO: 3642208 - RNA, 18 nt, Human
uuauaacucaucauaaaa

SEQ ID NO: 3642209 - RNA, 20 nt, Human
uuauaacucaucauaaaaua

SEQ ID NO: 3642210 - RNA, 22 nt, Human
uuauaacucaucauaaaauaaa

SEQ ID NO: 3642211 - RNA, 18 nt, Human
uuauaacugaaggagaag

SEQ ID NO: 3642212 - RNA, 17 nt, Human
uuauaacuguaaagaug

SEQ ID NO: 3642213 - RNA, 17 nt, Human
uuauaacuuaaaauauu

SEQ ID NO: 3642214 - RNA, 15 nt, Human
uuauaacuuaaugaa

SEQ ID NO: 3642215 - RNA, 14 nt, Human
uuauaacuuuuuau

SEQ ID NO: 3642216 - RNA, 16 nt, Human
uuauaacuuuuuauau

SEQ ID NO: 3642217 - RNA, 17 nt, Human
uuauaacuuuuuauauu

SEQ ID NO: 3642218 - RNA, 20 nt, Human
uuauaagaaaaaugugaauu

SEQ ID NO: 3642219 - RNA, 15 nt, Human
uuauaagaaagccug

SEQ ID NO: 3642220 - RNA, 20 nt, Human
uuauaagacucucacacuca

SEQ ID NO: 3642221 - RNA, 23 nt, Human
uuauaagcaaauuucaaaagaca

SEQ ID NO: 3642222 - RNA, 13 nt, Human
uuauaagcaucau

SEQ ID NO: 3642223 - RNA, 21 nt, Human
uuauaagcaucauuauuuaug

SEQ ID NO: 3642224 - RNA, 12 nt, Human
uuauaagcauug

SEQ ID NO: 3642225 - RNA, 22 nt, Human
uuauaagggcaaauuggagaaa

SEQ ID NO: 3642226 - RNA, 22 nt, Human
uuauaagguguuuucuguguaa

SEQ ID NO: 3642227 - RNA, 23 nt, Human
uuauaagguguuuucuguguaac

SEQ ID NO: 3642228 - RNA, 18 nt, Human
uuauaaguaucuucaugu

SEQ ID NO: 3642229 - RNA, 16 nt, Human
uuauaagucacaaaga

SEQ ID NO: 3642230 - RNA, 17 nt, Human
uuauaaguucacaaaau

SEQ ID NO: 3642231 - RNA, 15 nt, Human
uuauaauaauguuaa

SEQ ID NO: 3642232 - RNA, 15 nt, Human
uuauaauacucuguu

SEQ ID NO: 3642233 - RNA, 13 nt, Human
uuauaauauacua

SEQ ID NO: 3642234 - RNA, 14 nt, Human
uuauaaucaccagg

SEQ ID NO: 3642235 - RNA, 13 nt, Human
uuauaaucacuuu

SEQ ID NO: 3642236 - RNA, 16 nt, Human
uuauaauccuuaaauc

SEQ ID NO: 3642237 - RNA, 11 nt, Human
uuauaaucuuu

SEQ ID NO: 3642238 - RNA, 14 nt, Human
uuauaauucaguau

SEQ ID NO: 3642239 - RNA, 14 nt, Human
uuauaauucucauu

SEQ ID NO: 3642240 - RNA, 20 nt, Human
uuauaauuguacaaaauuaa

SEQ ID NO: 3642241 - RNA, 12 nt, Human
uuauaauuuuaa

SEQ ID NO: 3642242 - RNA, 16 nt, Human
uuauaauuuuccuaau

SEQ ID NO: 3642243 - RNA, 16 nt, Human
uuauaauuuugugaag

SEQ ID NO: 3642244 - RNA, 19 nt, Human
uuauacaaaauaagaacga

SEQ ID NO: 3642245 - RNA, 20 nt, Human
uuauacaaaccuaccaaaau

SEQ ID NO: 3642246 - RNA, 19 nt, Human
uuauacaaauuagaaaaug

SEQ ID NO: 3642247 - RNA, 12 nt, Human
uuauacaacagu

SEQ ID NO: 3642248 - RNA, 16 nt, Human
uuauacaacagugcua

SEQ ID NO: 3642249 - RNA, 15 nt, Human
uuauacaauaucauc

SEQ ID NO: 3642250 - RNA, 15 nt, Human
uuauacacuguaaug

SEQ ID NO: 3642251 - RNA, 22 nt, Human
uuauacagaauugugucugcag

SEQ ID NO: 3642252 - RNA, 22 nt, Human
uuauacagaccgaacuguugua

SEQ ID NO: 3642253 - RNA, 20 nt, Human
uuauacagauagaguuccau

SEQ ID NO: 3642254 - RNA, 22 nt, Human
uuauacagauagaguuccauau

SEQ ID NO: 3642255 - RNA, 20 nt, Human
uuauacaugacacugaaaug

SEQ ID NO: 3642256 - RNA, 20 nt, Human
uuauacaugugauacauuuu

SEQ ID NO: 3642257 - RNA, 16 nt, Human
uuauacauuaguaaau

SEQ ID NO: 3642258 - RNA, 21 nt, Human
uuauacauuaguaaaugucuu

SEQ ID NO: 3642259 - RNA, 23 nt, Human
uuauacauuaguaaaugucuuug

SEQ ID NO: 3642260 - RNA, 16 nt, Human
uuauaccauucagauc

SEQ ID NO: 3642261 - RNA, 15 nt, Human
uuauaccuaccugug

SEQ ID NO: 3642262 - RNA, 19 nt, Human
uuauaccucaaacuaucug

SEQ ID NO: 3642263 - RNA, 14 nt, Human
uuauaccuguuuaa

SEQ ID NO: 3642264 - RNA, 15 nt, Human
uuauaccuguuuaaa

SEQ ID NO: 3642265 - RNA, 14 nt, Human
uuauacgaaauaau

SEQ ID NO: 3642266 - RNA, 22 nt, Human
uuauacgcuggcaacacagagg

SEQ ID NO: 3642267 - RNA, 17 nt, Human
uuauacguguagcuaua

SEQ ID NO: 3642268 - RNA, 11 nt, Human
uuauacuaacu

SEQ ID NO: 3642269 - RNA, 16 nt, Human
uuauacucuuucugua

SEQ ID NO: 3642270 - RNA, 15 nt, Human
uuauacuguacaaua

SEQ ID NO: 3642271 - RNA, 18 nt, Human
uuauacuguacaauaaaa

SEQ ID NO: 3642272 - RNA, 23 nt, Human
uuauacuuucccuacccucuaga

SEQ ID NO: 3642273 - RNA, 18 nt, Human
uuauacuuuguaaagaca

SEQ ID NO: 3642274 - RNA, 12 nt, Human
uuauagaagaau

SEQ ID NO: 3642275 - RNA, 17 nt, Human
uuauagaagaaugcaug

SEQ ID NO: 3642276 - RNA, 23 nt, Human
uuauagaauauuuauuaccucug

SEQ ID NO: 3642277 - RNA, 15 nt, Human
uuauagacaaauaau

SEQ ID NO: 3642278 - RNA, 14 nt, Human
uuauagagaaugau

SEQ ID NO: 3642279 - RNA, 17 nt, Human
uuauagagcagaaauuc

SEQ ID NO: 3642280 - RNA, 12 nt, Human
uuauagauucua

SEQ ID NO: 3642281 - RNA, 15 nt, Human
uuauagauuugaccu

SEQ ID NO: 3642282 - RNA, 17 nt, Human
uuauagcaaacuuggaa

SEQ ID NO: 3642283 - RNA, 20 nt, Human
uuauagcaacaacaauuggu

SEQ ID NO: 3642284 - RNA, 14 nt, Human
uuauagcacuuuga

SEQ ID NO: 3642285 - RNA, 22 nt, Human
uuauagcacuuugaaauaccuc

SEQ ID NO: 3642286 - RNA, 22 nt, Human
uuauagccacaucccuuugaaa

SEQ ID NO: 3642287 - RNA, 20 nt, Human
uuauagccuggacugcuacc

SEQ ID NO: 3642288 - RNA, 16 nt, Human
uuauagcucaguuuau

SEQ ID NO: 3642289 - RNA, 15 nt, Human
uuauagcucuaaugu

SEQ ID NO: 3642290 - RNA, 18 nt, Human
uuauaggauuuauuuaaa

SEQ ID NO: 3642291 - RNA, 17 nt, Human
uuauaggucacuccugg

SEQ ID NO: 3642292 - RNA, 18 nt, Human
uuauaggugagaaaaaaa

SEQ ID NO: 3642293 - RNA, 22 nt, Human
uuauagguguugguuuuggggg

SEQ ID NO: 3642294 - RNA, 13 nt, Human
uuauaguaaugag

SEQ ID NO: 3642295 - RNA, 18 nt, Human
uuauaguauaucuggaca

SEQ ID NO: 3642296 - RNA, 16 nt, Human
uuauagucaauggcuu

SEQ ID NO: 3642297 - RNA, 21 nt, Human
uuauagugaauuaucccuuuu

SEQ ID NO: 3642298 - RNA, 21 nt, Human
uuauagugauguaaucuugaa

SEQ ID NO: 3642299 - RNA, 22 nt, Human
uuauuggcuuuucugauccagu

SEQ ID NO: 3642300 - RNA, 20 nt, Human
uuauugggcaagugauugaa

SEQ ID NO: 3642301 - RNA, 19 nt, Human
uuauuggugaguuaggaac

SEQ ID NO: 3642302 - RNA, 18 nt, Human
uuauuguaacagacauug

SEQ ID NO: 3642303 - RNA, 19 nt, Human
uuauuguaacagacauugu

SEQ ID NO: 3642304 - RNA, 15 nt, Human
uuauuguaccucucu

SEQ ID NO: 3642305 - RNA, 21 nt, Human
uuauuguauaaacuaucaguu

SEQ ID NO: 3642306 - RNA, 14 nt, Human
uuauuguauuuaug

SEQ ID NO: 3642307 - RNA, 12 nt, Human
uuauugucccaa

SEQ ID NO: 3642308 - RNA, 15 nt, Human
uuauugucuguaaau

SEQ ID NO: 3642309 - RNA, 21 nt, Human
uuauuguggauaacaaagaua

SEQ ID NO: 3642310 - RNA, 17 nt, Human
uuauuguguuugucauu

SEQ ID NO: 3642311 - RNA, 19 nt, Human
uuauuguguuugucauuag

SEQ ID NO: 3642312 - RNA, 19 nt, Human
uuauuguuccaagacauug

SEQ ID NO: 3642313 - RNA, 20 nt, Human
uuauuuaaacucuguugcaa

SEQ ID NO: 3642314 - RNA, 16 nt, Human
uuauuuaaaugucuaa

SEQ ID NO: 3642315 - RNA, 12 nt, Human
uuauuuaaauua

SEQ ID NO: 3642316 - RNA, 14 nt, Human
uuauuuaaauuuua

SEQ ID NO: 3642317 - RNA, 15 nt, Human
uuauuuaagacuaaa

SEQ ID NO: 3642318 - RNA, 10 nt, Human
uuauuuaaua

SEQ ID NO: 3642319 - RNA, 12 nt, Human
uuauuuaauaac

SEQ ID NO: 3642320 - RNA, 15 nt, Human
uuauuuaauaacauu

SEQ ID NO: 3642321 - RNA, 14 nt, Human
uuauuuacaaaugu

SEQ ID NO: 3642322 - RNA, 17 nt, Human
uuauuuacaagaagaac

SEQ ID NO: 3642323 - RNA, 15 nt, Human
uuauuuacagaugaa

SEQ ID NO: 3642324 - RNA, 20 nt, Human
uuauuuacagaugaauguau

SEQ ID NO: 3642325 - RNA, 15 nt, Human
uuauuuacugcuagu

SEQ ID NO: 3642326 - RNA, 16 nt, Human
uuauuuagacaagaga

SEQ ID NO: 3642327 - RNA, 18 nt, Human
uuauuuagggaacugcuu

SEQ ID NO: 3642328 - RNA, 21 nt, Human
uuauuuagggaacugcuugac

SEQ ID NO: 3642329 - RNA, 17 nt, Human
uuauuuauaaucacuuu

SEQ ID NO: 3642330 - RNA, 14 nt, Human
uuauuuaucaguga

SEQ ID NO: 3642331 - RNA, 22 nt, Human
uuauuuauccagaaaacuguga

SEQ ID NO: 3642332 - RNA, 15 nt, Human
uuauuuaugaaguuu

SEQ ID NO: 3642333 - RNA, 20 nt, Human
uuauuuaugccucuguauuu

SEQ ID NO: 3642334 - RNA, 13 nt, Human
uuauuuauguauu

SEQ ID NO: 3642335 - RNA, 14 nt, Human
uuauuuauuaagau

SEQ ID NO: 3642336 - RNA, 15 nt, Human
uuauuuauuuaaaug

SEQ ID NO: 3642337 - RNA, 23 nt, Human
uuauuucaaaauauacauucaaa

SEQ ID NO: 3642338 - RNA, 12 nt, Human
uuauuucaauau

SEQ ID NO: 3642339 - RNA, 24 nt, Human
uuauuucaauguaauuaaacuguu

SEQ ID NO: 3642340 - RNA, 23 nt, Human
uuauuucacacgcuguucuaaug

SEQ ID NO: 3642341 - RNA, 19 nt, Human
uuauuucagauuuugauaa

SEQ ID NO: 3642342 - RNA, 20 nt, Human
uuauuucaucauauuauaca

SEQ ID NO: 3642343 - RNA, 15 nt, Human
uuauuucaugaaaau

SEQ ID NO: 3642344 - RNA, 19 nt, Human
uuauuucaugauuagaaau

SEQ ID NO: 3642345 - RNA, 17 nt, Human
uuauuuccaaauaaaau

SEQ ID NO: 3642346 - RNA, 19 nt, Human
uuauuuccacuaaaaauau

SEQ ID NO: 3642347 - RNA, 19 nt, Human
uuauuucccccauuuuucc

SEQ ID NO: 3642348 - RNA, 18 nt, Human
uuauuuccuaguucugua

SEQ ID NO: 3642349 - RNA, 20 nt, Human
uuauuuccuaugauguauac

SEQ ID NO: 3642350 - RNA, 14 nt, Human
uuauuucuccuuuu

SEQ ID NO: 3642351 - RNA, 16 nt, Human
uuauuucucugauuug

SEQ ID NO: 3642352 - RNA, 13 nt, Human
uuauuucugcaua

SEQ ID NO: 3642353 - RNA, 15 nt, Human
uuauuucugcauaug

SEQ ID NO: 3642354 - RNA, 19 nt, Human
uuauuucuuaaacaaaugu

SEQ ID NO: 3642355 - RNA, 15 nt, Human
uuauuucuuuuacuu

SEQ ID NO: 3642356 - RNA, 15 nt, Human
uuauuugacuuuaau

SEQ ID NO: 3642357 - RNA, 20 nt, Human
uuauuugagaagcugcucaa

SEQ ID NO: 3642358 - RNA, 22 nt, Human
uuauuugaguggaguuacugaa

SEQ ID NO: 3642359 - RNA, 13 nt, Human
uuauuugcauguu

SEQ ID NO: 3642360 - RNA, 15 nt, Human
uuauuugcauguuau

SEQ ID NO: 3642361 - RNA, 16 nt, Human
uuauuuggaaaggaau

SEQ ID NO: 3642362 - RNA, 22 nt, Human
uuauuuggcaguuugguauuug

SEQ ID NO: 3642363 - RNA, 19 nt, Human
uuauuugggguugcaucag

SEQ ID NO: 3642364 - RNA, 19 nt, Human
uuauuuguaaauuuagugu

SEQ ID NO: 3642365 - RNA, 12 nt, Human
uuauuugucaaa

SEQ ID NO: 3642366 - RNA, 12 nt, Human
uuauuuguugag

SEQ ID NO: 3642367 - RNA, 15 nt, Human
uuauuuguuuucccg

SEQ ID NO: 3642368 - RNA, 14 nt, Human
uuauuuuaaacaaa

SEQ ID NO: 3642369 - RNA, 12 nt, Human
uuauuuuaaauu

SEQ ID NO: 3642370 - RNA, 14 nt, Human
uuauuuuaaauuau

SEQ ID NO: 3642371 - RNA, 22 nt, Human
uuauuuuaaauuauaaggacug

SEQ ID NO: 3642372 - RNA, 15 nt, Human
uuauuuuaauaaugu

SEQ ID NO: 3642373 - RNA, 16 nt, Human
uuauuuuaauaauguu

SEQ ID NO: 3642374 - RNA, 13 nt, Human
uuauuuuaaugug

SEQ ID NO: 3642375 - RNA, 19 nt, Human
uuauuuuacacagaaacac

SEQ ID NO: 3642376 - RNA, 13 nt, Human
uuauuuuacuuuu

SEQ ID NO: 3642377 - RNA, 13 nt, Human
uuauuuuagauau

SEQ ID NO: 3642378 - RNA, 20 nt, Human
uuauuuuagcaguucugcaa

SEQ ID NO: 3642379 - RNA, 21 nt, Human
uuauuuuagcaguucugcaaa

SEQ ID NO: 3642380 - RNA, 22 nt, Human
uuauuuuauaagaaaaacuuuu

SEQ ID NO: 3642381 - RNA, 16 nt, Human
uuauuuuauccucugg

SEQ ID NO: 3642382 - RNA, 18 nt, Human
uuauuuuaugagaaaugu

SEQ ID NO: 3642383 - RNA, 19 nt, Human
uuauuuuaugagaaaugua

SEQ ID NO: 3642384 - RNA, 14 nt, Human
uuauuuuauuauga

SEQ ID NO: 3642385 - RNA, 16 nt, Human
uuauuuuauuaugaaa

SEQ ID NO: 3642386 - RNA, 20 nt, Human
uuauuuuauuaugaaacuug

SEQ ID NO: 3642387 - RNA, 13 nt, Human
uuauuuucaagaa

SEQ ID NO: 3642388 - RNA, 14 nt, Human
uuauuuucaccugu

SEQ ID NO: 3642389 - RNA, 14 nt, Human
uuauuuucagcaug

SEQ ID NO: 3642390 - RNA, 14 nt, Human
uuauuuucaguauu

SEQ ID NO: 3642391 - RNA, 15 nt, Human
uuauuuucagugaua

SEQ ID NO: 3642392 - RNA, 12 nt, Human
uuauuuucuaaa

SEQ ID NO: 3642393 - RNA, 14 nt, Human
uuauuuucuaaagu

SEQ ID NO: 3642394 - RNA, 16 nt, Human
uuauuuucuccugaua

SEQ ID NO: 3642395 - RNA, 12 nt, Human
uuauuuucuggu

SEQ ID NO: 3642396 - RNA, 14 nt, Human
uuauuuucugucag

SEQ ID NO: 3642397 - RNA, 18 nt, Human
uuauuuucuuuugaauug

SEQ ID NO: 3642398 - RNA, 15 nt, Human
uuauuuugacauaaa

SEQ ID NO: 3642399 - RNA, 17 nt, Human
uuauuuugacauaaagu

SEQ ID NO: 3642400 - RNA, 16 nt, Human
uuauuuugauguaaag

SEQ ID NO: 3642401 - RNA, 22 nt, Human
uuauuuugccaagggcauaaau

SEQ ID NO: 3642402 - RNA, 23 nt, Human
uuauuuugccauggaugagaguc

SEQ ID NO: 3642403 - RNA, 19 nt, Human
uuauuuuggaaagaagaaa

SEQ ID NO: 3642404 - RNA, 13 nt, Human
uuauuuugguacu

SEQ ID NO: 3642405 - RNA, 18 nt, Human
uuauuuugguacuuuuau

SEQ ID NO: 3642406 - RNA, 12 nt, Human
uuauuuuguaau

SEQ ID NO: 3642407 - RNA, 21 nt, Human
uuauuuuguaauuauugugau

SEQ ID NO: 3642408 - RNA, 19 nt, Human
uuauuuugugcucauuuaa

SEQ ID NO: 3642409 - RNA, 14 nt, Human
uuauuuuguucaua

SEQ ID NO: 3642410 - RNA, 16 nt, Human
uuauuuuguucauaca

SEQ ID NO: 3642411 - RNA, 14 nt, Human
uuauuuuuaaagau

SEQ ID NO: 3642412 - RNA, 20 nt, Human
uuauuuuuagaauuuuguga

SEQ ID NO: 3642413 - RNA, 13 nt, Human
uuauuuuuagaug

SEQ ID NO: 3642414 - RNA, 17 nt, Human
uuauuuuuauacaguag

SEQ ID NO: 3642415 - RNA, 22 nt, Human
uuauuuuuauacaguagugaga

SEQ ID NO: 3642416 - RNA, 14 nt, Human
uuauuuuucaagga

SEQ ID NO: 3642417 - RNA, 16 nt, Human
uuauuuuucauauugu

SEQ ID NO: 3642418 - RNA, 10 nt, Human
uuauuuuucu

SEQ ID NO: 3642419 - RNA, 14 nt, Human
uuauuuuuucagac

SEQ ID NO: 3642420 - RNA, 15 nt, Human
uuauuuuuucagacc

SEQ ID NO: 3642421 - RNA, 14 nt, Human
uuauuuuuuucuac

SEQ ID NO: 3642422 - RNA, 13 nt, Human
uuauuuuuuucug

SEQ ID NO: 3642423 - RNA, 18 nt, Human
uucaaaaaaacacuaguu

SEQ ID NO: 3642424 - RNA, 12 nt, Human
uucaaaaacugu

SEQ ID NO: 3642425 - RNA, 20 nt, Human
uucaaaaacuguuuugggua

SEQ ID NO: 3642426 - RNA, 13 nt, Human
uucaaaaaguguu

SEQ ID NO: 3642427 - RNA, 12 nt, Human
uucaaaaaucug

SEQ ID NO: 3642428 - RNA, 16 nt, Human
uucaaaaaucugaaga

SEQ ID NO: 3642429 - RNA, 16 nt, Human
uucaaaaauguacaaa

SEQ ID NO: 3642430 - RNA, 16 nt, Human
uucaaaacaaacagau

SEQ ID NO: 3642431 - RNA, 20 nt, Human
uucaaaaccagguccaauga

SEQ ID NO: 3642432 - RNA, 19 nt, Human
uucaaaagacauguuguaa

SEQ ID NO: 3642433 - RNA, 21 nt, Human
uucaaaagguauuauacaugu

SEQ ID NO: 3642434 - RNA, 21 nt, Human
uucaaaaguauuuuccuguaa

SEQ ID NO: 3642435 - RNA, 16 nt, Human
uucaaaauauugagca

SEQ ID NO: 3642436 - RNA, 20 nt, Human
uucaaaauauuuaaaaaugu

SEQ ID NO: 3642437 - RNA, 15 nt, Human
uucaaaauccaaaaa

SEQ ID NO: 3642438 - RNA, 13 nt, Human
uucaaaauccuuc

SEQ ID NO: 3642439 - RNA, 17 nt, Human
uucaaaauccuuccaaa

SEQ ID NO: 3642440 - RNA, 23 nt, Human
uucaaaaugauuuccucuguaau

SEQ ID NO: 3642441 - RNA, 20 nt, Human
uucaaaaugcuuuuuauuau

SEQ ID NO: 3642442 - RNA, 16 nt, Human
uucaaaauggagggaa

SEQ ID NO: 3642443 - RNA, 17 nt, Human
uucaaaauuaaaucugu

SEQ ID NO: 3642444 - RNA, 15 nt, Human
uucaaacaagaaugu

SEQ ID NO: 3642445 - RNA, 14 nt, Human
uucaaacacaaaug

SEQ ID NO: 3642446 - RNA, 21 nt, Human
uucuacucuuaaguuucucag

SEQ ID NO: 3642447 - RNA, 20 nt, Human
uucuacugcucuccuccacc

SEQ ID NO: 3642448 - RNA, 13 nt, Human
uucuacugcuucu

SEQ ID NO: 3642449 - RNA, 23 nt, Human
uucuacugucaaaugaugugcaa

SEQ ID NO: 3642450 - RNA, 16 nt, Human
uucuacuuccaagacu

SEQ ID NO: 3642451 - RNA, 20 nt, Human
uucuacuugcucuggaccug

SEQ ID NO: 3642452 - RNA, 23 nt, Human
uucuacuugcucuggaccugccc

SEQ ID NO: 3642453 - RNA, 12 nt, Human
uucuagaaaaac

SEQ ID NO: 3642454 - RNA, 19 nt, Human
uucuagaaagagaaacagu

SEQ ID NO: 3642455 - RNA, 17 nt, Human
uucuagaaagccuguuc

SEQ ID NO: 3642456 - RNA, 20 nt, Human
uucuagaaguuucccuuccu

SEQ ID NO: 3642457 - RNA, 21 nt, Human
uucuagaaguuucccuuccuc

SEQ ID NO: 3642458 - RNA, 12 nt, Human
uucuagaccaau

SEQ ID NO: 3642459 - RNA, 16 nt, Human
uucuagagcacugcca

SEQ ID NO: 3642460 - RNA, 22 nt, Human
uucuagaguuuuauagccugga

SEQ ID NO: 3642461 - RNA, 19 nt, Human
uucuagauacaauaaauug

SEQ ID NO: 3642462 - RNA, 14 nt, Human
uucuagcauggcau

SEQ ID NO: 3642463 - RNA, 22 nt, Human
uucuagcauggcauauuuuuca

SEQ ID NO: 3642464 - RNA, 17 nt, Human
uucuagcauggcugcca

SEQ ID NO: 3642465 - RNA, 12 nt, Human
uucuagccugca

SEQ ID NO: 3642466 - RNA, 24 nt, Human
uucuagccugcacuuugaugucau

SEQ ID NO: 3642467 - RNA, 16 nt, Human
uucuagcgcaguuuuu

SEQ ID NO: 3642468 - RNA, 22 nt, Human
uucuagcuaauggaaaaugauu

SEQ ID NO: 3642469 - RNA, 16 nt, Human
uucuagcuagaaauau

SEQ ID NO: 3642470 - RNA, 17 nt, Human
uucuagcuagaaauaug

SEQ ID NO: 3642471 - RNA, 22 nt, Human
uucuagcuagaaauaugauuuu

SEQ ID NO: 3642472 - RNA, 12 nt, Human
uucuagcuguug

SEQ ID NO: 3642473 - RNA, 16 nt, Human
uucuaggaaaauaaaa

SEQ ID NO: 3642474 - RNA, 16 nt, Human
uucuaggaccuguguc

SEQ ID NO: 3642475 - RNA, 23 nt, Human
uucuaggcacuguaguucuaaga

SEQ ID NO: 3642476 - RNA, 16 nt, Human
uucuaggcaucucugu

SEQ ID NO: 3642477 - RNA, 16 nt, Human
uucuagggcugggaaa

SEQ ID NO: 3642478 - RNA, 21 nt, Human
uucuagguuucaaagaugcug

SEQ ID NO: 3642479 - RNA, 18 nt, Human
uucuagugcagcugaaau

SEQ ID NO: 3642480 - RNA, 12 nt, Human
uucuagugcugc

SEQ ID NO: 3642481 - RNA, 13 nt, Human
uucuagugcugcu

SEQ ID NO: 3642482 - RNA, 17 nt, Human
uucuaguggucuuugua

SEQ ID NO: 3642483 - RNA, 20 nt, Human
uucuaguggucuuuguaaga

SEQ ID NO: 3642484 - RNA, 16 nt, Human
uucuaguucugccagg

SEQ ID NO: 3642485 - RNA, 17 nt, Human
uucuaguucugccagga

SEQ ID NO: 3642486 - RNA, 14 nt, Human
uucuaguugaaaau

SEQ ID NO: 3642487 - RNA, 15 nt, Human
uucuaguuucccaca

SEQ ID NO: 3642488 - RNA, 14 nt, Human
uucuaguuugcauu

SEQ ID NO: 3642489 - RNA, 19 nt, Human
uucuaguuuucaguuugua

SEQ ID NO: 3642490 - RNA, 13 nt, Human
uucuaguuuuguc

SEQ ID NO: 3642491 - RNA, 21 nt, Human
uucuauaaaacucugcaugua

SEQ ID NO: 3642492 - RNA, 17 nt, Human
uucuauaaauagaugcu

SEQ ID NO: 3642493 - RNA, 14 nt, Human
uucuauaaggccau

SEQ ID NO: 3642494 - RNA, 21 nt, Human
uucuauaauuuccauuuacuu

SEQ ID NO: 3642495 - RNA, 14 nt, Human
uucuauacaaauau

SEQ ID NO: 3642496 - RNA, 21 nt, Human
uucuauacaaauauaaaucuu

SEQ ID NO: 3642497 - RNA, 15 nt, Human
uucuauagccaaaaa

SEQ ID NO: 3642498 - RNA, 17 nt, Human
uucuauagccaaaaaua

SEQ ID NO: 3642499 - RNA, 14 nt, Human
uucuauaguucuag

SEQ ID NO: 3642500 - RNA, 15 nt, Human
uucuauaguucuaga

SEQ ID NO: 3642501 - RNA, 14 nt, Human
uucuauauuuucau

SEQ ID NO: 3642502 - RNA, 21 nt, Human
uucuauauuuucauucuccua

SEQ ID NO: 3642503 - RNA, 14 nt, Human
uucuaucaagccca

SEQ ID NO: 3642504 - RNA, 18 nt, Human
uucuaucauuuuuguaca

SEQ ID NO: 3642505 - RNA, 23 nt, Human
uucuauccuacaacaagaguuua

SEQ ID NO: 3642506 - RNA, 15 nt, Human
uucuauccucuguaa

SEQ ID NO: 3642507 - RNA, 13 nt, Human
uucuaugagaaaa

SEQ ID NO: 3642508 - RNA, 16 nt, Human
uucuaugcaaaguucu

SEQ ID NO: 3642509 - RNA, 17 nt, Human
uucuaugcugaguuugu

SEQ ID NO: 3642510 - RNA, 16 nt, Human
uucuaugcugcuuuua

SEQ ID NO: 3642511 - RNA, 18 nt, Human
uucuaugcugcuuuuaua

SEQ ID NO: 3642512 - RNA, 21 nt, Human
uucuaugcugcuuuuauaucu

SEQ ID NO: 3642513 - RNA, 15 nt, Human
uucuauggguguuau

SEQ ID NO: 3642514 - RNA, 14 nt, Human
uucuauguuuacuu

SEQ ID NO: 3642515 - RNA, 13 nt, Human
uucuauuaaaaga

SEQ ID NO: 3642516 - RNA, 17 nt, Human
uucuauuaaaagacuca

SEQ ID NO: 3642517 - RNA, 19 nt, Human
uucuauuaaaagacucauc

SEQ ID NO: 3642518 - RNA, 21 nt, Human
uucuauuaaaagacucauccg

SEQ ID NO: 3642519 - RNA, 14 nt, Human
uucuauuaaaagug

SEQ ID NO: 3642520 - RNA, 21 nt, Human
uucuauuaaagugcuaagguu

SEQ ID NO: 3642521 - RNA, 14 nt, Human
uucuauugaauucg

SEQ ID NO: 3642522 - RNA, 13 nt, Human
uucuauugccucu

SEQ ID NO: 3642523 - RNA, 17 nt, Human
uucuauugccuucuuug

SEQ ID NO: 3642524 - RNA, 20 nt, Human
uucuauugccuucuuugaag

SEQ ID NO: 3642525 - RNA, 14 nt, Human
uucuauuguuacuc

SEQ ID NO: 3642526 - RNA, 17 nt, Human
uucuauuguuacucugg

SEQ ID NO: 3642527 - RNA, 17 nt, Human
uucuauuucuccuccau

SEQ ID NO: 3642528 - RNA, 15 nt, Human
uucuauuugcugggc

SEQ ID NO: 3642529 - RNA, 17 nt, Human
uucuauuugcugggcuu

SEQ ID NO: 3642530 - RNA, 18 nt, Human
uucuauuugcugggcuuu

SEQ ID NO: 3642531 - RNA, 16 nt, Human
uucuauuuggggcuug

SEQ ID NO: 3642532 - RNA, 19 nt, Human
uucuauuuuauuaugaaga

SEQ ID NO: 3642533 - RNA, 20 nt, Human
uucuauuuuauuaugaagaa

SEQ ID NO: 3642534 - RNA, 17 nt, Human
uucuauuuucauuuucu

SEQ ID NO: 3642535 - RNA, 20 nt, Human
uucuauuuucauuuucugca

SEQ ID NO: 3642536 - RNA, 23 nt, Human
uucuauuuucauuuucugcaagc

SEQ ID NO: 3642537 - RNA, 22 nt, Human
uucuauuuucucugauacuuuu

SEQ ID NO: 3642538 - RNA, 16 nt, Human
uucuauuuuuaucuga

SEQ ID NO: 3642539 - RNA, 15 nt, Human
uucuauuuuuuguuu

SEQ ID NO: 3642540 - RNA, 16 nt, Human
uucucaaaagaacuua

SEQ ID NO: 3642541 - RNA, 18 nt, Human
uucucaaaagcauuuauc

SEQ ID NO: 3642542 - RNA, 13 nt, Human
uucucaaacacag

SEQ ID NO: 3642543 - RNA, 20 nt, Human
uucucaaagaaauuuccacu

SEQ ID NO: 3642544 - RNA, 15 nt, Human
uucucaaagcaggaa

SEQ ID NO: 3642545 - RNA, 18 nt, Human
uucucaaaggagcgagca

SEQ ID NO: 3642546 - RNA, 21 nt, Human
uucucaaaguuuugaaaagcu

SEQ ID NO: 3642547 - RNA, 15 nt, Human
uucucaaccuaccac

SEQ ID NO: 3642548 - RNA, 18 nt, Human
uucucaagccgcauccca

SEQ ID NO: 3642549 - RNA, 21 nt, Human
uucucaagggacguccuccaa

SEQ ID NO: 3642550 - RNA, 17 nt, Human
uucucaaguucuaagau

SEQ ID NO: 3642551 - RNA, 22 nt, Human
uucucaaguucuaagauucuaa

SEQ ID NO: 3642552 - RNA, 11 nt, Human
uucucaaugaa

SEQ ID NO: 3642553 - RNA, 12 nt, Human
uucucaaugaaa

SEQ ID NO: 3642554 - RNA, 14 nt, Human
uucucacacccacc

SEQ ID NO: 3642555 - RNA, 21 nt, Human
uucucacacuggucugcuguc

SEQ ID NO: 3642556 - RNA, 22 nt, Human
uucucacagugggagccagggc

SEQ ID NO: 3642557 - RNA, 14 nt, Human
uucucaccagcugc

SEQ ID NO: 3642558 - RNA, 17 nt, Human
uucucaccagcugcaaa

SEQ ID NO: 3642559 - RNA, 19 nt, Human
uucucaccagcugcaaagu

SEQ ID NO: 3642560 - RNA, 12 nt, Human
uucucaccagga

SEQ ID NO: 3642561 - RNA, 18 nt, Human
uucucacuccuaccuggu

SEQ ID NO: 3642562 - RNA, 13 nt, Human
uucucagaagcac

SEQ ID NO: 3642563 - RNA, 13 nt, Human
uucucagaaucua

SEQ ID NO: 3642564 - RNA, 15 nt, Human
uucucagaaucuacc

SEQ ID NO: 3642565 - RNA, 19 nt, Human
uucucagaaucuacccaaa

SEQ ID NO: 3642566 - RNA, 22 nt, Human
uucucagacuuuggaaaaugca

SEQ ID NO: 3642567 - RNA, 13 nt, Human
uucucagauauuu

SEQ ID NO: 3642568 - RNA, 14 nt, Human
uucucagauauuua

SEQ ID NO: 3642569 - RNA, 15 nt, Human
uucucagauauuuau

SEQ ID NO: 3642570 - RNA, 20 nt, Human
uucucagauauuuauauuuu

SEQ ID NO: 3642571 - RNA, 19 nt, Human
uucucagauccuuguuuca

SEQ ID NO: 3642572 - RNA, 14 nt, Human
uucucagauuucug

SEQ ID NO: 3642573 - RNA, 15 nt, Human
uucucagauuucuga

SEQ ID NO: 3642574 - RNA, 13 nt, Human
uucucagcuccca

SEQ ID NO: 3642575 - RNA, 17 nt, Human
uucucagcucccccugu

SEQ ID NO: 3642576 - RNA, 18 nt, Human
uucucagcucccccuguc

SEQ ID NO: 3642577 - RNA, 18 nt, Human
uucucagcucuucugacu

SEQ ID NO: 3642578 - RNA, 17 nt, Human
uucucaggccaucauca

SEQ ID NO: 3642579 - RNA, 12 nt, Human
uucucagggcuc

SEQ ID NO: 3642580 - RNA, 15 nt, Human
uucucagggcuccug

SEQ ID NO: 3642581 - RNA, 16 nt, Human
uucucagggcuccugc

SEQ ID NO: 3642582 - RNA, 16 nt, Human
uucucagguguugcca

SEQ ID NO: 3642583 - RNA, 21 nt, Human
uucucagugccaacuguggcu

SEQ ID NO: 3642584 - RNA, 14 nt, Human
uucucaguuuucau

SEQ ID NO: 3642585 - RNA, 18 nt, Human
uucucauaauuccuacag

SEQ ID NO: 3642586 - RNA, 13 nt, Human
uucucauagcauu

SEQ ID NO: 3642587 - RNA, 18 nt, Human
uucucauagcauuaacua

SEQ ID NO: 3642588 - RNA, 21 nt, Human
uucucauagcauuaacuaauc

SEQ ID NO: 3642589 - RNA, 22 nt, Human
uucucauaggaaaaguacauuu

SEQ ID NO: 3642590 - RNA, 16 nt, Human
uucucaucacacacau

SEQ ID NO: 3642591 - RNA, 19 nt, Human
uucugggcaucuguucugg

SEQ ID NO: 3642592 - RNA, 13 nt, Human
uucugggcucuuu

SEQ ID NO: 3642593 - RNA, 20 nt, Human
uucuggggcaggcugggcca

SEQ ID NO: 3642594 - RNA, 15 nt, Human
uucuggggccccacc

SEQ ID NO: 3642595 - RNA, 22 nt, Human
uucuggggccuaauaaaacuga

SEQ ID NO: 3642596 - RNA, 23 nt, Human
uucuggggccuaauaaaacugau

SEQ ID NO: 3642597 - RNA, 20 nt, Human
uucuggggggacccagugca

SEQ ID NO: 3642598 - RNA, 23 nt, Human
uucuggggggacccagugcagaa

SEQ ID NO: 3642599 - RNA, 15 nt, Human
uucugggguccccag

SEQ ID NO: 3642600 - RNA, 16 nt, Human
uucugggucuuuugcu

SEQ ID NO: 3642601 - RNA, 17 nt, Human
uucugggucuuuugcua

SEQ ID NO: 3642602 - RNA, 14 nt, Human
uucuggguggccuc

SEQ ID NO: 3642603 - RNA, 11 nt, Human
uucugguaauc

SEQ ID NO: 3642604 - RNA, 14 nt, Human
uucuggucucucua

SEQ ID NO: 3642605 - RNA, 20 nt, Human
uucuggugugaacuaaacuu

SEQ ID NO: 3642606 - RNA, 14 nt, Human
uucugguucuaaca

SEQ ID NO: 3642607 - RNA, 20 nt, Human
uucuguaaacucaaaacuua

SEQ ID NO: 3642608 - RNA, 14 nt, Human
uucuguaaagcaaa

SEQ ID NO: 3642609 - RNA, 22 nt, Human
uucuguaaauaaugugcacuga

SEQ ID NO: 3642610 - RNA, 23 nt, Human
uucuguaauaacuagaacaaaua

SEQ ID NO: 3642611 - RNA, 23 nt, Human
uucuguaauauuuacaauguauu

SEQ ID NO: 3642612 - RNA, 16 nt, Human
uucuguaauucagguu

SEQ ID NO: 3642613 - RNA, 21 nt, Human
uucuguaauucagguuuuucc

SEQ ID NO: 3642614 - RNA, 22 nt, Human
uucuguaauucagguuuuuccu

SEQ ID NO: 3642615 - RNA, 16 nt, Human
uucuguacauagccua

SEQ ID NO: 3642616 - RNA, 13 nt, Human
uucuguaccaguu

SEQ ID NO: 3642617 - RNA, 18 nt, Human
uucuguacucaaauguag

SEQ ID NO: 3642618 - RNA, 14 nt, Human
uucuguacugauuu

SEQ ID NO: 3642619 - RNA, 21 nt, Human
uucuguacuguuacugggccc

SEQ ID NO: 3642620 - RNA, 13 nt, Human
uucuguacuuccu

SEQ ID NO: 3642621 - RNA, 13 nt, Human
uucuguagaaaug

SEQ ID NO: 3642622 - RNA, 14 nt, Human
uucuguagaaaugg

SEQ ID NO: 3642623 - RNA, 15 nt, Human
uucuguagaaauggu

SEQ ID NO: 3642624 - RNA, 21 nt, Human
uucuguaguacuccuuaagaa

SEQ ID NO: 3642625 - RNA, 15 nt, Human
uucuguagucauuua

SEQ ID NO: 3642626 - RNA, 20 nt, Human
uucuguagucauuuacuaaa

SEQ ID NO: 3642627 - RNA, 22 nt, Human
uucuguagucauuuacuaaaca

SEQ ID NO: 3642628 - RNA, 16 nt, Human
uucuguauauaaaugg

SEQ ID NO: 3642629 - RNA, 18 nt, Human
uucuguauauaaauggga

SEQ ID NO: 3642630 - RNA, 16 nt, Human
uucuguauauacuuuu

SEQ ID NO: 3642631 - RNA, 14 nt, Human
uucuguauuugaaa

SEQ ID NO: 3642632 - RNA, 20 nt, Human
uucuguauuuuuuuuucuaa

SEQ ID NO: 3642633 - RNA, 14 nt, Human
uucugucaagaaga

SEQ ID NO: 3642634 - RNA, 19 nt, Human
uucugucacaguaaaaaua

SEQ ID NO: 3642635 - RNA, 19 nt, Human
uucugucacucaggcugga

SEQ ID NO: 3642636 - RNA, 18 nt, Human
uucugucagaugagaaca

SEQ ID NO: 3642637 - RNA, 19 nt, Human
uucugucagaugagaacaa

SEQ ID NO: 3642638 - RNA, 23 nt, Human
uucugucagaugagaacaaagcu

SEQ ID NO: 3642639 - RNA, 21 nt, Human
uucugucccuagguguuuugu

SEQ ID NO: 3642640 - RNA, 15 nt, Human
uucugucccucacag

SEQ ID NO: 3642641 - RNA, 17 nt, Human
uucugucccuuggagcu

SEQ ID NO: 3642642 - RNA, 17 nt, Human
uucuguccuacucugug

SEQ ID NO: 3642643 - RNA, 22 nt, Human
uucuguccuuuuggcacugaga

SEQ ID NO: 3642644 - RNA, 23 nt, Human
uucuguccuuuuggcacugagau

SEQ ID NO: 3642645 - RNA, 16 nt, Human
uucugucucauaugau

SEQ ID NO: 3642646 - RNA, 11 nt, Human
uucugucucca

SEQ ID NO: 3642647 - RNA, 15 nt, Human
uucugucucucucuu

SEQ ID NO: 3642648 - RNA, 23 nt, Human
uucugugcccagaauacugaugg

SEQ ID NO: 3642649 - RNA, 24 nt, Human
uucugugcccagaauacugaugga

SEQ ID NO: 3642650 - RNA, 15 nt, Human
uucugugccugaaua

SEQ ID NO: 3642651 - RNA, 17 nt, Human
uucugugccugaauauu

SEQ ID NO: 3642652 - RNA, 13 nt, Human
uucuguggaaagu

SEQ ID NO: 3642653 - RNA, 15 nt, Human
uucuguggaaagugu

SEQ ID NO: 3642654 - RNA, 16 nt, Human
uucuguggaaagugua

SEQ ID NO: 3642655 - RNA, 20 nt, Human
uucuguggaaaguguaaagc

SEQ ID NO: 3642656 - RNA, 19 nt, Human
uucuguggggccccucacc

SEQ ID NO: 3642657 - RNA, 16 nt, Human
uucugugguuccucug

SEQ ID NO: 3642658 - RNA, 17 nt, Human
uucugugguuccucugc

SEQ ID NO: 3642659 - RNA, 22 nt, Human
uucugugguuuuccccucccug

SEQ ID NO: 3642660 - RNA, 23 nt, Human
uucugugguuuuccccucccugg

SEQ ID NO: 3642661 - RNA, 12 nt, Human
uucuguguauuu

SEQ ID NO: 3642662 - RNA, 13 nt, Human
uucuguguauuua

SEQ ID NO: 3642663 - RNA, 21 nt, Human
uucuguguauuuaauuguaaa

SEQ ID NO: 3642664 - RNA, 22 nt, Human
uucuguguauuuaauuguaaac

SEQ ID NO: 3642665 - RNA, 12 nt, Human
uucugugucuuu

SEQ ID NO: 3642666 - RNA, 23 nt, Human
uucugugugcaccuuaccaacuu

SEQ ID NO: 3642667 - RNA, 10 nt, Human
uucugugugu

SEQ ID NO: 3642668 - RNA, 15 nt, Human
uucuguguguuccug

SEQ ID NO: 3642669 - RNA, 20 nt, Human
uucuguguguuuucauaaua

SEQ ID NO: 3642670 - RNA, 14 nt, Human
uucuguguuuacag

SEQ ID NO: 3642671 - RNA, 12 nt, Human
uucuguguuuau

SEQ ID NO: 3642672 - RNA, 13 nt, Human
uucuguuaaaauc

SEQ ID NO: 3642673 - RNA, 15 nt, Human
uucuguuaacugaau

SEQ ID NO: 3642674 - RNA, 15 nt, Human
uucuguuacaaaaug

SEQ ID NO: 3642675 - RNA, 19 nt, Human
uucuguuccaaauucaguu

SEQ ID NO: 3642676 - RNA, 21 nt, Human
uucuguucuaguuuuuuacuu

SEQ ID NO: 3642677 - RNA, 16 nt, Human
uucuguucuggaggaa

SEQ ID NO: 3642678 - RNA, 13 nt, Human
uucuguucugugg

SEQ ID NO: 3642679 - RNA, 16 nt, Human
uucuguucuguggaaa

SEQ ID NO: 3642680 - RNA, 21 nt, Human
uucuguucuguggaaagugua

SEQ ID NO: 3642681 - RNA, 15 nt, Human
uucuguugcugccuc

SEQ ID NO: 3642682 - RNA, 16 nt, Human
uucuguugcugccuca

SEQ ID NO: 3642683 - RNA, 12 nt, Human
uucuguuguaac

SEQ ID NO: 3642684 - RNA, 14 nt, Human
uucuguuguaacuu

SEQ ID NO: 3642685 - RNA, 15 nt, Human
uucuguuguaacuua

SEQ ID NO: 3642686 - RNA, 17 nt, Human
uucuguuguaacuuaug

SEQ ID NO: 3642687 - RNA, 13 nt, Human
uucuguuuagaua

SEQ ID NO: 3642688 - RNA, 18 nt, Human
uucuguuuagauaauaca

SEQ ID NO: 3642689 - RNA, 12 nt, Human
uucuguuucaag

SEQ ID NO: 3642690 - RNA, 13 nt, Human
uucuguuuccugu

SEQ ID NO: 3642691 - RNA, 16 nt, Human
uucuguuuggaggagc

SEQ ID NO: 3642692 - RNA, 16 nt, Human
uucuguuuuauaauuu

SEQ ID NO: 3642693 - RNA, 17 nt, Human
uucuguuuuguuucgcu

SEQ ID NO: 3642694 - RNA, 22 nt, Human
uucuguuuuuaaaaauuagccu

SEQ ID NO: 3642695 - RNA, 14 nt, Human
uucuuaaaaaguaa

SEQ ID NO: 3642696 - RNA, 21 nt, Human
uucuuaaaaggcccauagcag

SEQ ID NO: 3642697 - RNA, 16 nt, Human
uucuuaaaaugcaaua

SEQ ID NO: 3642698 - RNA, 22 nt, Human
uucuuaaaaugcaauauuugua

SEQ ID NO: 3642699 - RNA, 15 nt, Human
uucuuaaagugccag

SEQ ID NO: 3642700 - RNA, 11 nt, Human
uucuuaaauaa

SEQ ID NO: 3642701 - RNA, 19 nt, Human
uucuuaaauaauaaagauc

SEQ ID NO: 3642702 - RNA, 12 nt, Human
uucuuaaauauc

SEQ ID NO: 3642703 - RNA, 15 nt, Human
uucuuaaauaucuuu

SEQ ID NO: 3642704 - RNA, 16 nt, Human
uucuuaaauaucuuuu

SEQ ID NO: 3642705 - RNA, 17 nt, Human
uucuuaaauaucuuuua

SEQ ID NO: 3642706 - RNA, 17 nt, Human
uucuuaacuucuugcuu

SEQ ID NO: 3642707 - RNA, 23 nt, Human
uucuuaagacgugauuuugcugu

SEQ ID NO: 3642708 - RNA, 22 nt, Human
uucuuaaguauguuauuuucug

SEQ ID NO: 3642709 - RNA, 18 nt, Human
uucuuaauauauagcauu

SEQ ID NO: 3642710 - RNA, 19 nt, Human
uucuuaaucuuuucacaaa

SEQ ID NO: 3642711 - RNA, 21 nt, Human
uucuuaaucuuuucacaaaua

SEQ ID NO: 3642712 - RNA, 15 nt, Human
uucuuaauguacaua

SEQ ID NO: 3642713 - RNA, 20 nt, Human
uucuuaauuauuauaaaaau

SEQ ID NO: 3642714 - RNA, 14 nt, Human
uucuuaauugcacu

SEQ ID NO: 3642715 - RNA, 20 nt, Human
uucuuaauugcacucuaaaa

SEQ ID NO: 3642716 - RNA, 14 nt, Human
uucuuaauuuggaa

SEQ ID NO: 3642717 - RNA, 13 nt, Human
uucuuacaaacca

SEQ ID NO: 3642718 - RNA, 21 nt, Human
uucuuacacugccuguauacu

SEQ ID NO: 3642719 - RNA, 13 nt, Human
uucuuacauaauu

SEQ ID NO: 3642720 - RNA, 17 nt, Human
uucuuacccaauuuccc

SEQ ID NO: 3642721 - RNA, 22 nt, Human
uucuuacccuguacauauguaa

SEQ ID NO: 3642722 - RNA, 16 nt, Human
uucuuaccgacaagca

SEQ ID NO: 3642723 - RNA, 18 nt, Human
uucuuacuaaacauuuug

SEQ ID NO: 3642724 - RNA, 22 nt, Human
uucuuacuauuaagcaguaaaa

SEQ ID NO: 3642725 - RNA, 16 nt, Human
uucuuacugauaauuu

SEQ ID NO: 3642726 - RNA, 13 nt, Human
uucuuacugcuug

SEQ ID NO: 3642727 - RNA, 13 nt, Human
uucuuagaaauuu

SEQ ID NO: 3642728 - RNA, 15 nt, Human
uucuuagaacagugg

SEQ ID NO: 3642729 - RNA, 16 nt, Human
uucuuagauaucuuuu

SEQ ID NO: 3642730 - RNA, 15 nt, Human
uucuuagcucaauga

SEQ ID NO: 3642731 - RNA, 16 nt, Human
uucuuagcucaaugag

SEQ ID NO: 3642732 - RNA, 23 nt, Human
uucuuagcucuuaauuguucauu

SEQ ID NO: 3642733 - RNA, 15 nt, Human
uucuuagcuuuuuaa

SEQ ID NO: 3642734 - RNA, 22 nt, Human
uucuuaguguugguuuaauauu

SEQ ID NO: 3642735 - RNA, 19 nt, Human
uucuuaguucucacuguuc

SEQ ID NO: 3642736 - RNA, 17 nt, Human
uugaacguuuucuaauu

SEQ ID NO: 3642737 - RNA, 21 nt, Human
uugaacguuuucuaauugcuu

SEQ ID NO: 3642738 - RNA, 14 nt, Human
uugaacuaagaaac

SEQ ID NO: 3642739 - RNA, 16 nt, Human
uugaacuaagaaacuu

SEQ ID NO: 3642740 - RNA, 15 nt, Human
uugaacucagaucug

SEQ ID NO: 3642741 - RNA, 20 nt, Human
uugaacucagaucugucuga

SEQ ID NO: 3642742 - RNA, 16 nt, Human
uugaacuccuggccuc

SEQ ID NO: 3642743 - RNA, 15 nt, Human
uugaacuccugggcu

SEQ ID NO: 3642744 - RNA, 16 nt, Human
uugaacucugggcuca

SEQ ID NO: 3642745 - RNA, 19 nt, Human
uugaacucuucaaucucuu

SEQ ID NO: 3642746 - RNA, 20 nt, Human
uugaacucuucacucuucaa

SEQ ID NO: 3642747 - RNA, 12 nt, Human
uugaacugaagg

SEQ ID NO: 3642748 - RNA, 20 nt, Human
uugaacuggcaauugucuau

SEQ ID NO: 3642749 - RNA, 20 nt, Human
uugaacuguaccaugugcua

SEQ ID NO: 3642750 - RNA, 15 nt, Human
uugaacuguuagaau

SEQ ID NO: 3642751 - RNA, 13 nt, Human
uugaacuuugacc

SEQ ID NO: 3642752 - RNA, 22 nt, Human
uugaacuuuuuuccacugaagu

SEQ ID NO: 3642753 - RNA, 14 nt, Human
uugaagaaacagau

SEQ ID NO: 3642754 - RNA, 19 nt, Human
uugaagaaacagauaccau

SEQ ID NO: 3642755 - RNA, 20 nt, Human
uugaagaaauuauaaagaua

SEQ ID NO: 3642756 - RNA, 20 nt, Human
uugaagaacugcaggcccug

SEQ ID NO: 3642757 - RNA, 18 nt, Human
uugaagaagguggaccuu

SEQ ID NO: 3642758 - RNA, 19 nt, Human
uugaagaagguggaccuuu

SEQ ID NO: 3642759 - RNA, 23 nt, Human
uugaagaauguuaagacuugaca

SEQ ID NO: 3642760 - RNA, 22 nt, Human
uugaagacaaaaauacucuaau

SEQ ID NO: 3642761 - RNA, 13 nt, Human
uugaagacacuga

SEQ ID NO: 3642762 - RNA, 15 nt, Human
uugaagacacugaaa

SEQ ID NO: 3642763 - RNA, 22 nt, Human
uugaagacacugaaauauacac

SEQ ID NO: 3642764 - RNA, 20 nt, Human
uugaagaccuaaccagggcc

SEQ ID NO: 3642765 - RNA, 20 nt, Human
uugaagacuucaaaauauug

SEQ ID NO: 3642766 - RNA, 21 nt, Human
uugaagagagauauaucugaa

SEQ ID NO: 3642767 - RNA, 13 nt, Human
uugaagaggaaaa

SEQ ID NO: 3642768 - RNA, 21 nt, Human
uugaagaggaaaaugaauaau

SEQ ID NO: 3642769 - RNA, 15 nt, Human
uugaagaggugagca

SEQ ID NO: 3642770 - RNA, 16 nt, Human
uugaagagguuuuaaa

SEQ ID NO: 3642771 - RNA, 21 nt, Human
uugaagagguuuuaaagcuuc

SEQ ID NO: 3642772 - RNA, 18 nt, Human
uugaagauaguaacugua

SEQ ID NO: 3642773 - RNA, 18 nt, Human
uugaagaugcugaaacag

SEQ ID NO: 3642774 - RNA, 13 nt, Human
uugaagauucuau

SEQ ID NO: 3642775 - RNA, 14 nt, Human
uugaagcacguaca

SEQ ID NO: 3642776 - RNA, 18 nt, Human
uugaagcacguacauuuu

SEQ ID NO: 3642777 - RNA, 13 nt, Human
uugaagcauuuua

SEQ ID NO: 3642778 - RNA, 22 nt, Human
uugaagcauuuuauaaaucgcu

SEQ ID NO: 3642779 - RNA, 21 nt, Human
uugaagccacugaagcuggga

SEQ ID NO: 3642780 - RNA, 16 nt, Human
uugaagccaucuaaag

SEQ ID NO: 3642781 - RNA, 17 nt, Human
uugaagccaugucuaca

SEQ ID NO: 3642782 - RNA, 15 nt, Human
uugaagcuaauuauu

SEQ ID NO: 3642783 - RNA, 16 nt, Human
uugaagcuaauuauuu

SEQ ID NO: 3642784 - RNA, 16 nt, Human
uugaaggaaaaauuca

SEQ ID NO: 3642785 - RNA, 11 nt, Human
uugaaggaaac

SEQ ID NO: 3642786 - RNA, 19 nt, Human
uugaaggaagccaaauuua

SEQ ID NO: 3642787 - RNA, 23 nt, Human
uugaaggaauacaauauauagcu

SEQ ID NO: 3642788 - RNA, 18 nt, Human
uugaaggaggugagggau

SEQ ID NO: 3642789 - RNA, 21 nt, Human
uugaaggaugcugucuucgua

SEQ ID NO: 3642790 - RNA, 12 nt, Human
uugaaggcaaaa

SEQ ID NO: 3642791 - RNA, 15 nt, Human
uugaaggcaaaauug

SEQ ID NO: 3642792 - RNA, 17 nt, Human
uugaaggcaaaauugca

SEQ ID NO: 3642793 - RNA, 15 nt, Human
uugaaggcagaaagc

SEQ ID NO: 3642794 - RNA, 15 nt, Human
uugaaggcccugcug

SEQ ID NO: 3642795 - RNA, 20 nt, Human
uugaaggcccugcugaguca

SEQ ID NO: 3642796 - RNA, 13 nt, Human
uugaaggccugga

SEQ ID NO: 3642797 - RNA, 15 nt, Human
uugaaggccuggaau

SEQ ID NO: 3642798 - RNA, 11 nt, Human
uugaaggcuua

SEQ ID NO: 3642799 - RNA, 17 nt, Human
uugaagggaaauuucag

SEQ ID NO: 3642800 - RNA, 23 nt, Human
uugaagggaaguugcuggaaaga

SEQ ID NO: 3642801 - RNA, 20 nt, Human
uugaagggaggggcuguguu

SEQ ID NO: 3642802 - RNA, 20 nt, Human
uugaagggccagagccaggg

SEQ ID NO: 3642803 - RNA, 19 nt, Human
uugaagggucuuucucaaa

SEQ ID NO: 3642804 - RNA, 18 nt, Human
uugaaguauuuugcugga

SEQ ID NO: 3642805 - RNA, 15 nt, Human
uugaagucacccggc

SEQ ID NO: 3642806 - RNA, 11 nt, Human
uugaagucuug

SEQ ID NO: 3642807 - RNA, 19 nt, Human
uugaaguguaggcagacac

SEQ ID NO: 3642808 - RNA, 20 nt, Human
uugaaguguaggcagacaca

SEQ ID NO: 3642809 - RNA, 21 nt, Human
uugaaguguauaauauaaaaa

SEQ ID NO: 3642810 - RNA, 19 nt, Human
uugaaguuagcuuuaacuu

SEQ ID NO: 3642811 - RNA, 22 nt, Human
uugaaguuaguggaaaucugaa

SEQ ID NO: 3642812 - RNA, 14 nt, Human
uugaaguuuacauu

SEQ ID NO: 3642813 - RNA, 16 nt, Human
uugaaguuuacauuuu

SEQ ID NO: 3642814 - RNA, 16 nt, Human
uugaauaaaagugcac

SEQ ID NO: 3642815 - RNA, 19 nt, Human
uugaauaaaguugaagcua

SEQ ID NO: 3642816 - RNA, 12 nt, Human
uugaauaaauaa

SEQ ID NO: 3642817 - RNA, 13 nt, Human
uugaauaaauguc

SEQ ID NO: 3642818 - RNA, 14 nt, Human
uugaauaaaugugu

SEQ ID NO: 3642819 - RNA, 12 nt, Human
uugaauaauaag

SEQ ID NO: 3642820 - RNA, 22 nt, Human
uugaauaccauuaaaacugcuu

SEQ ID NO: 3642821 - RNA, 16 nt, Human
uugaauacucugcccu

SEQ ID NO: 3642822 - RNA, 12 nt, Human
uugaauacuuga

SEQ ID NO: 3642823 - RNA, 15 nt, Human
uugaauacuuugaau

SEQ ID NO: 3642824 - RNA, 12 nt, Human
uugaauacuuuu

SEQ ID NO: 3642825 - RNA, 16 nt, Human
uugaauauccccuccc

SEQ ID NO: 3642826 - RNA, 14 nt, Human
uugaauaugauuaa

SEQ ID NO: 3642827 - RNA, 23 nt, Human
uugaauauuauuccucaaaaaau

SEQ ID NO: 3642828 - RNA, 13 nt, Human
uugaaucacagua

SEQ ID NO: 3642829 - RNA, 17 nt, Human
uugaaucaguauaaaca

SEQ ID NO: 3642830 - RNA, 18 nt, Human
uugaaucaguuuccaauu

SEQ ID NO: 3642831 - RNA, 17 nt, Human
uugaauccaugcuuggg

SEQ ID NO: 3642832 - RNA, 17 nt, Human
uugaaucuauuuaagua

SEQ ID NO: 3642833 - RNA, 20 nt, Human
uugaaucuauuuaaguaaaa

SEQ ID NO: 3642834 - RNA, 20 nt, Human
uugaaucuauuuaucuucau

SEQ ID NO: 3642835 - RNA, 23 nt, Human
uugaaucugauuggacauuuucu

SEQ ID NO: 3642836 - RNA, 24 nt, Human
uugaaucugauuggacauuuucuu

SEQ ID NO: 3642837 - RNA, 20 nt, Human
uugaaugaaaaauuuaagca

SEQ ID NO: 3642838 - RNA, 21 nt, Human
uugaaugaaaaauuuaagcau

SEQ ID NO: 3642839 - RNA, 23 nt, Human
uugaaugaaaaauuuaagcauug

SEQ ID NO: 3642840 - RNA, 18 nt, Human
uugaaugacaacagaagc

SEQ ID NO: 3642841 - RNA, 22 nt, Human
uugaaugagaugauucagaagg

SEQ ID NO: 3642842 - RNA, 21 nt, Human
uugaaugauuuuucuuuacaa

SEQ ID NO: 3642843 - RNA, 16 nt, Human
uugaaugcaaaccaua

SEQ ID NO: 3642844 - RNA, 12 nt, Human
uugaaugcauuu

SEQ ID NO: 3642845 - RNA, 13 nt, Human
uugaaugcauuuu

SEQ ID NO: 3642846 - RNA, 20 nt, Human
uugaauggcaauguuuugcu

SEQ ID NO: 3642847 - RNA, 19 nt, Human
uugaauguggcuugagaaa

SEQ ID NO: 3642848 - RNA, 15 nt, Human
uugaauguuaaauaa

SEQ ID NO: 3642849 - RNA, 18 nt, Human
uugaauguuaaauaaauu

SEQ ID NO: 3642850 - RNA, 17 nt, Human
uugaauguuaagcagau

SEQ ID NO: 3642851 - RNA, 12 nt, Human
uugaauuaaaac

SEQ ID NO: 3642852 - RNA, 12 nt, Human
uugaauuaucag

SEQ ID NO: 3642853 - RNA, 20 nt, Human
uugaauuaucagcaaagaaa

SEQ ID NO: 3642854 - RNA, 15 nt, Human
uugaauucauagaaa

SEQ ID NO: 3642855 - RNA, 16 nt, Human
uugaauucauuucacu

SEQ ID NO: 3642856 - RNA, 20 nt, Human
uugaauugaggggauuaaua

SEQ ID NO: 3642857 - RNA, 18 nt, Human
uugaauuguaacuguucu

SEQ ID NO: 3642858 - RNA, 14 nt, Human
uugaauuguaagga

SEQ ID NO: 3642859 - RNA, 13 nt, Human
uugaauuguuaca

SEQ ID NO: 3642860 - RNA, 12 nt, Human
uugaauuuaaca

SEQ ID NO: 3642861 - RNA, 20 nt, Human
uugaauuuaacaaugcgaau

SEQ ID NO: 3642862 - RNA, 22 nt, Human
uugaauuuauuggcuuuucuga

SEQ ID NO: 3642863 - RNA, 24 nt, Human
uugaauuuauuuuuaagaaagaaa

SEQ ID NO: 3642864 - RNA, 12 nt, Human
uugaauuuuaca

SEQ ID NO: 3642865 - RNA, 11 nt, Human
uugaauuuuca

SEQ ID NO: 3642866 - RNA, 16 nt, Human
uugaauuuucaagcau

SEQ ID NO: 3642867 - RNA, 18 nt, Human
uugaauuuucaagcaucu

SEQ ID NO: 3642868 - RNA, 19 nt, Human
uugaauuuucaagcaucuc

SEQ ID NO: 3642869 - RNA, 12 nt, Human
uugaauuuucau

SEQ ID NO: 3642870 - RNA, 14 nt, Human
uugaauuuucauuu

SEQ ID NO: 3642871 - RNA, 15 nt, Human
uugaauuuucauuuu

SEQ ID NO: 3642872 - RNA, 14 nt, Human
uugaauuuucugug

SEQ ID NO: 3642873 - RNA, 22 nt, Human
uugaauuuuguucucugggaga

SEQ ID NO: 3642874 - RNA, 13 nt, Human
uugaauuuuuccu

SEQ ID NO: 3642875 - RNA, 19 nt, Human
uugaauuuuuuuuaacauu

SEQ ID NO: 3642876 - RNA, 14 nt, Human
uugacaaaauguua

SEQ ID NO: 3642877 - RNA, 21 nt, Human
uugacaaaauguuauuucccu

SEQ ID NO: 3642878 - RNA, 20 nt, Human
uugacaaacuucuuucacuc

SEQ ID NO: 3642879 - RNA, 19 nt, Human
uugacaaagucaagccaca

SEQ ID NO: 3642880 - RNA, 23 nt, Human
uugacaaaucuguguauauuauu

SEQ ID NO: 3642881 - RNA, 17 nt, Human
uuguguaauaaaguguu

SEQ ID NO: 3642882 - RNA, 19 nt, Human
uuguguaauaaaguguuuu

SEQ ID NO: 3642883 - RNA, 23 nt, Human
uuguguaaugaaaaugaauaucu

SEQ ID NO: 3642884 - RNA, 24 nt, Human
uuguguaaugaaaaugaauaucua

SEQ ID NO: 3642885 - RNA, 15 nt, Human
uuguguacaguuauu

SEQ ID NO: 3642886 - RNA, 15 nt, Human
uuguguagccuuuuu

SEQ ID NO: 3642887 - RNA, 16 nt, Human
uuguguauauuuguau

SEQ ID NO: 3642888 - RNA, 23 nt, Human
uuguguauccauuaucaugugua

SEQ ID NO: 3642889 - RNA, 21 nt, Human
uuguguaucguaaccagccag

SEQ ID NO: 3642890 - RNA, 19 nt, Human
uuguguauuuacgcuuuga

SEQ ID NO: 3642891 - RNA, 23 nt, Human
uuguguauuuacgcuuugauuca

SEQ ID NO: 3642892 - RNA, 9 nt, Human
uuguguccc

SEQ ID NO: 3642893 - RNA, 14 nt, Human
uugugucuguacac

SEQ ID NO: 3642894 - RNA, 15 nt, Human
uugugucuguacacg

SEQ ID NO: 3642895 - RNA, 15 nt, Human
uugugucuuuugcau

SEQ ID NO: 3642896 - RNA, 16 nt, Human
uugugugaacuuggaa

SEQ ID NO: 3642897 - RNA, 17 nt, Human
uugugugaccaacugug

SEQ ID NO: 3642898 - RNA, 18 nt, Human
uugugugaccaacugugu

SEQ ID NO: 3642899 - RNA, 19 nt, Human
uugugugaccaacuguguu

SEQ ID NO: 3642900 - RNA, 21 nt, Human
uugugugaccaacuguguugu

SEQ ID NO: 3642901 - RNA, 23 nt, Human
uugugugaccaacuguguuguau

SEQ ID NO: 3642902 - RNA, 18 nt, Human
uugugugauauuucagaa

SEQ ID NO: 3642903 - RNA, 20 nt, Human
uugugugauauuucagaaau

SEQ ID NO: 3642904 - RNA, 21 nt, Human
uugugugcuaaacguguaugu

SEQ ID NO: 3642905 - RNA, 15 nt, Human
uugugugcucuccau

SEQ ID NO: 3642906 - RNA, 18 nt, Human
uugugugguuuggcccuu

SEQ ID NO: 3642907 - RNA, 20 nt, Human
uuguguguaugcugcuuuuc

SEQ ID NO: 3642908 - RNA, 16 nt, Human
uuguguguccccuugc

SEQ ID NO: 3642909 - RNA, 13 nt, Human
uugugugucuuaa

SEQ ID NO: 3642910 - RNA, 10 nt, Human
uugugugugg

SEQ ID NO: 3642911 - RNA, 16 nt, Human
uugugugugggagugu

SEQ ID NO: 3642912 - RNA, 10 nt, Human
uugugugugu

SEQ ID NO: 3642913 - RNA, 22 nt, Human
uuguguguucacuaaacucuga

SEQ ID NO: 3642914 - RNA, 17 nt, Human
uuguguguugucucuug

SEQ ID NO: 3642915 - RNA, 13 nt, Human
uuguguuacuaag

SEQ ID NO: 3642916 - RNA, 20 nt, Human
uuguguuacuaaguuuuuau

SEQ ID NO: 3642917 - RNA, 13 nt, Human
uuguguucaccuu

SEQ ID NO: 3642918 - RNA, 15 nt, Human
uuguguucuguuuug

SEQ ID NO: 3642919 - RNA, 13 nt, Human
uuguguugaagag

SEQ ID NO: 3642920 - RNA, 17 nt, Human
uuguguugaaggaacuu

SEQ ID NO: 3642921 - RNA, 14 nt, Human
uuguguuuauucuu

SEQ ID NO: 3642922 - RNA, 19 nt, Human
uuguguuugguuuacauuu

SEQ ID NO: 3642923 - RNA, 20 nt, Human
uuguguuugucauuagccug

SEQ ID NO: 3642924 - RNA, 21 nt, Human
uuguguuuuuaauuuauuuau

SEQ ID NO: 3642925 - RNA, 22 nt, Human
uuguuaaaaaaaaaaagauugu

SEQ ID NO: 3642926 - RNA, 13 nt, Human
uuguuaaaaauaa

SEQ ID NO: 3642927 - RNA, 14 nt, Human
uuguuaaaacuggc

SEQ ID NO: 3642928 - RNA, 14 nt, Human
uuguuaagaaaaau

SEQ ID NO: 3642929 - RNA, 19 nt, Human
uuguuaauaaaaguacaug

SEQ ID NO: 3642930 - RNA, 13 nt, Human
uuguuaauacaag

SEQ ID NO: 3642931 - RNA, 15 nt, Human
uuguuaauacaaggu

SEQ ID NO: 3642932 - RNA, 22 nt, Human
uuguuaauaucacucauuaauu

SEQ ID NO: 3642933 - RNA, 18 nt, Human
uuguuaaugaaaauguca

SEQ ID NO: 3642934 - RNA, 19 nt, Human
uuguuaaugaaaaugucag

SEQ ID NO: 3642935 - RNA, 17 nt, Human
uuguuaauggugcaaau

SEQ ID NO: 3642936 - RNA, 20 nt, Human
uuguuaauuuagaaaacuuu

SEQ ID NO: 3642937 - RNA, 22 nt, Human
uuguuaauuuagaaaacuuuaa

SEQ ID NO: 3642938 - RNA, 22 nt, Human
uuguuaauuuuuccuauauugc

SEQ ID NO: 3642939 - RNA, 22 nt, Human
uuguuacacauuaaguaaucaa

SEQ ID NO: 3642940 - RNA, 21 nt, Human
uuguuacaggcaccgagaaug

SEQ ID NO: 3642941 - RNA, 24 nt, Human
uuguuaccuuaaaacuaggcauuu

SEQ ID NO: 3642942 - RNA, 17 nt, Human
uuguuacuaacuaaacu

SEQ ID NO: 3642943 - RNA, 15 nt, Human
uuguuacucuuacga

SEQ ID NO: 3642944 - RNA, 19 nt, Human
uuguuacucuuacgaauau

SEQ ID NO: 3642945 - RNA, 15 nt, Human
uuguuacucuuggga

SEQ ID NO: 3642946 - RNA, 10 nt, Human
uuguuacugu

SEQ ID NO: 3642947 - RNA, 22 nt, Human
uuguuacuguucuugcugcuag

SEQ ID NO: 3642948 - RNA, 24 nt, Human
uuguuacuguucuugcugcuagaa

SEQ ID NO: 3642949 - RNA, 14 nt, Human
uuguuacuucugag

SEQ ID NO: 3642950 - RNA, 19 nt, Human
uuguuaguaugaggcauuu

SEQ ID NO: 3642951 - RNA, 20 nt, Human
uuguuagugugucuuagugu

SEQ ID NO: 3642952 - RNA, 14 nt, Human
uuguuaucaaaaua

SEQ ID NO: 3642953 - RNA, 13 nt, Human
uuguuaucuggga

SEQ ID NO: 3642954 - RNA, 13 nt, Human
uuguuaugaugug

SEQ ID NO: 3642955 - RNA, 15 nt, Human
uuguuaugaugugcu

SEQ ID NO: 3642956 - RNA, 17 nt, Human
uuguuaugaugugcuua

SEQ ID NO: 3642957 - RNA, 19 nt, Human
uuguuauggcuuaaugaca

SEQ ID NO: 3642958 - RNA, 18 nt, Human
uuguuauguagauaacaa

SEQ ID NO: 3642959 - RNA, 17 nt, Human
uuguuauuauaaaagua

SEQ ID NO: 3642960 - RNA, 23 nt, Human
uuguuauuauauaauuacauauu

SEQ ID NO: 3642961 - RNA, 14 nt, Human
uuguuauuuauaac

SEQ ID NO: 3642962 - RNA, 20 nt, Human
uuguuauuuauugaaaugau

SEQ ID NO: 3642963 - RNA, 15 nt, Human
uuguuauuuguacag

SEQ ID NO: 3642964 - RNA, 13 nt, Human
uuguuauuuucag

SEQ ID NO: 3642965 - RNA, 20 nt, Human
uuguucaaaauauguucuuu

SEQ ID NO: 3642966 - RNA, 16 nt, Human
uuguucaaacaauauc

SEQ ID NO: 3642967 - RNA, 20 nt, Human
uuguucaauaauaaauauuu

SEQ ID NO: 3642968 - RNA, 13 nt, Human
uuguucaauuaga

SEQ ID NO: 3642969 - RNA, 15 nt, Human
uuguucaauuagaau

SEQ ID NO: 3642970 - RNA, 15 nt, Human
uuguucacugaaggu

SEQ ID NO: 3642971 - RNA, 13 nt, Human
uuguucauacaua

SEQ ID NO: 3642972 - RNA, 16 nt, Human
uuguucauacauauuu

SEQ ID NO: 3642973 - RNA, 15 nt, Human
uuguucaucuguaac

SEQ ID NO: 3642974 - RNA, 12 nt, Human
uuguucauguuu

SEQ ID NO: 3642975 - RNA, 13 nt, Human
uuguucauguuug

SEQ ID NO: 3642976 - RNA, 19 nt, Human
uuguucauguuuggugcau

SEQ ID NO: 3642977 - RNA, 21 nt, Human
uuguucauuucauccuuucac

SEQ ID NO: 3642978 - RNA, 13 nt, Human
uuguuccagauuc

SEQ ID NO: 3642979 - RNA, 11 nt, Human
uuguuccaguu

SEQ ID NO: 3642980 - RNA, 17 nt, Human
uuguuccccacuggagc

SEQ ID NO: 3642981 - RNA, 19 nt, Human
uuguuccccuccuccacuc

SEQ ID NO: 3642982 - RNA, 14 nt, Human
uuguucccucuccc

SEQ ID NO: 3642983 - RNA, 16 nt, Human
uuguucgggugugcaa

SEQ ID NO: 3642984 - RNA, 23 nt, Human
uuguucucagaaucccuuaacag

SEQ ID NO: 3642985 - RNA, 13 nt, Human
uuguucucagcuc

SEQ ID NO: 3642986 - RNA, 15 nt, Human
uuguucucugggaga

SEQ ID NO: 3642987 - RNA, 20 nt, Human
uuguucucugggagaaaauc

SEQ ID NO: 3642988 - RNA, 21 nt, Human
uuguucugaaaugucaguucu

SEQ ID NO: 3642989 - RNA, 19 nt, Human
uuguucuggcucuuccagg

SEQ ID NO: 3642990 - RNA, 14 nt, Human
uuguucuguuaacu

SEQ ID NO: 3642991 - RNA, 18 nt, Human
uuguucuuccaaagcaga

SEQ ID NO: 3642992 - RNA, 13 nt, Human
uuguucuugauag

SEQ ID NO: 3642993 - RNA, 21 nt, Human
uuguucuuggcaauaaauuuu

SEQ ID NO: 3642994 - RNA, 14 nt, Human
uuguucuuuaaagu

SEQ ID NO: 3642995 - RNA, 15 nt, Human
uuguucuuucagaaa

SEQ ID NO: 3642996 - RNA, 15 nt, Human
uuguucuuuguucuu

SEQ ID NO: 3642997 - RNA, 12 nt, Human
uuguucuuuucc

SEQ ID NO: 3642998 - RNA, 12 nt, Human
uuguugacauuc

SEQ ID NO: 3642999 - RNA, 16 nt, Human
uuguugacauucugaa

SEQ ID NO: 3643000 - RNA, 14 nt, Human
uuguugaggugguc

SEQ ID NO: 3643001 - RNA, 21 nt, Human
uuguugauaaauuccacugga

SEQ ID NO: 3643002 - RNA, 15 nt, Human
uuguugauucucucc

SEQ ID NO: 3643003 - RNA, 14 nt, Human
uuguugcaaagguc

SEQ ID NO: 3643004 - RNA, 17 nt, Human
uuguugcaagaugugaa

SEQ ID NO: 3643005 - RNA, 20 nt, Human
uuguugcaagaugugaauua

SEQ ID NO: 3643006 - RNA, 14 nt, Human
uuguugcacugaag

SEQ ID NO: 3643007 - RNA, 15 nt, Human
uuguugcacugaagu

SEQ ID NO: 3643008 - RNA, 17 nt, Human
uuguugcauguuugaaa

SEQ ID NO: 3643009 - RNA, 18 nt, Human
uuguugcuucuugugaag

SEQ ID NO: 3643010 - RNA, 23 nt, Human
uuguuggcguaggcuacagagaa

SEQ ID NO: 3643011 - RNA, 15 nt, Human
uuguuguaaaaagaa

SEQ ID NO: 3643012 - RNA, 18 nt, Human
uuguuguaaccugcugug

SEQ ID NO: 3643013 - RNA, 17 nt, Human
uuguuguauaauuucga

SEQ ID NO: 3643014 - RNA, 15 nt, Human
uuguugucugcaacu

SEQ ID NO: 3643015 - RNA, 19 nt, Human
uuguugugacuuugacgcu

SEQ ID NO: 3643016 - RNA, 13 nt, Human
uuguugugcuuuu

SEQ ID NO: 3643017 - RNA, 22 nt, Human
uuguuguggguucuauguuuac

SEQ ID NO: 3643018 - RNA, 21 nt, Human
uuguuguuaaugaaaauguca

SEQ ID NO: 3643019 - RNA, 21 nt, Human
uuguuguuugccauacuuugu

SEQ ID NO: 3643020 - RNA, 23 nt, Human
uuguuguuugccauacuuugucu

SEQ ID NO: 3643021 - RNA, 17 nt, Human
uuguuuaaaaucauuuc

SEQ ID NO: 3643022 - RNA, 21 nt, Human
uuguuuaaaauguaauuuaaa

SEQ ID NO: 3643023 - RNA, 13 nt, Human
uuguuuaaagcaa

SEQ ID NO: 3643024 - RNA, 16 nt, Human
uuguuuaaugugaacu

SEQ ID NO: 3643025 - RNA, 22 nt, Human
uuguuuacagcacuacucugug

SEQ ID NO: 3643026 - RNA, 20 nt, Human
uuuaagcuaggaaaagaaau

SEQ ID NO: 3643027 - RNA, 14 nt, Human
uuuaagcucaaaau

SEQ ID NO: 3643028 - RNA, 17 nt, Human
uuuaagcucugagcugu

SEQ ID NO: 3643029 - RNA, 13 nt, Human
uuuaagcuguaaa

SEQ ID NO: 3643030 - RNA, 21 nt, Human
uuuaagcuguuacugucuuca

SEQ ID NO: 3643031 - RNA, 12 nt, Human
uuuaaggaaaca

SEQ ID NO: 3643032 - RNA, 15 nt, Human
uuuaaggaagaaaaa

SEQ ID NO: 3643033 - RNA, 16 nt, Human
uuuaaggaagaaaaau

SEQ ID NO: 3643034 - RNA, 20 nt, Human
uuuaaggagauguaagagcu

SEQ ID NO: 3643035 - RNA, 21 nt, Human
uuuaaggagauguaagagcuu

SEQ ID NO: 3643036 - RNA, 19 nt, Human
uuuaaggauaaaucauaaa

SEQ ID NO: 3643037 - RNA, 22 nt, Human
uuuaaggcagauuuuacagagc

SEQ ID NO: 3643038 - RNA, 15 nt, Human
uuuaagggaaagaaa

SEQ ID NO: 3643039 - RNA, 22 nt, Human
uuuaagggaguguacucccagg

SEQ ID NO: 3643040 - RNA, 20 nt, Human
uuuaaggguuuguggaaaau

SEQ ID NO: 3643041 - RNA, 19 nt, Human
uuuaagguagcuucagcua

SEQ ID NO: 3643042 - RNA, 15 nt, Human
uuuaaguaacuuuaa

SEQ ID NO: 3643043 - RNA, 22 nt, Human
uuuaaguaauguggaagaaaau

SEQ ID NO: 3643044 - RNA, 20 nt, Human
uuuaaguacuacacauuuuu

SEQ ID NO: 3643045 - RNA, 16 nt, Human
uuuaaguauucaagaa

SEQ ID NO: 3643046 - RNA, 18 nt, Human
uuuaaguauuuagguuuu

SEQ ID NO: 3643047 - RNA, 20 nt, Human
uuuaaguauuuauauauuua

SEQ ID NO: 3643048 - RNA, 15 nt, Human
uuuaagucucucgua

SEQ ID NO: 3643049 - RNA, 13 nt, Human
uuuaagugaaauu

SEQ ID NO: 3643050 - RNA, 14 nt, Human
uuuaagugaaauuu

SEQ ID NO: 3643051 - RNA, 21 nt, Human
uuuaagugcguguguagaguu

SEQ ID NO: 3643052 - RNA, 17 nt, Human
uuuaagugcugcauuua

SEQ ID NO: 3643053 - RNA, 22 nt, Human
uuuaaguguaacuggcaguuuu

SEQ ID NO: 3643054 - RNA, 18 nt, Human
uuuaaguguacuggauuu

SEQ ID NO: 3643055 - RNA, 17 nt, Human
uuuaaguuaauagauuu

SEQ ID NO: 3643056 - RNA, 14 nt, Human
uuuaaguuguuugc

SEQ ID NO: 3643057 - RNA, 14 nt, Human
uuuaaguuugcacu

SEQ ID NO: 3643058 - RNA, 19 nt, Human
uuuaaguuugcacucaaau

SEQ ID NO: 3643059 - RNA, 13 nt, Human
uuuaaguuuugac

SEQ ID NO: 3643060 - RNA, 11 nt, Human
uuuaauaaaag

SEQ ID NO: 3643061 - RNA, 20 nt, Human
uuuaauaaaauaauucuaaa

SEQ ID NO: 3643062 - RNA, 15 nt, Human
uuuaauaaacacucu

SEQ ID NO: 3643063 - RNA, 14 nt, Human
uuuaauaaacuacu

SEQ ID NO: 3643064 - RNA, 19 nt, Human
uuuaauaaacuacucuuug

SEQ ID NO: 3643065 - RNA, 20 nt, Human
uuuaauaaacuacucuuuga

SEQ ID NO: 3643066 - RNA, 22 nt, Human
uuuaauaacauuaccuuacugu

SEQ ID NO: 3643067 - RNA, 15 nt, Human
uuuaauaauaaucua

SEQ ID NO: 3643068 - RNA, 15 nt, Human
uuuaauaauauacuu

SEQ ID NO: 3643069 - RNA, 19 nt, Human
uuuaauaauguuucaaaca

SEQ ID NO: 3643070 - RNA, 15 nt, Human
uuuaauaauuagaaa

SEQ ID NO: 3643071 - RNA, 17 nt, Human
uuuaauacaguuuauuu

SEQ ID NO: 3643072 - RNA, 21 nt, Human
uuuaauagcgucauaacuaga

SEQ ID NO: 3643073 - RNA, 21 nt, Human
uuuaauagguuuggacaaaau

SEQ ID NO: 3643074 - RNA, 20 nt, Human
uuuaauagucauuccaaaua

SEQ ID NO: 3643075 - RNA, 12 nt, Human
uuuaauaguguu

SEQ ID NO: 3643076 - RNA, 22 nt, Human
uuuaauaguguuaaucaauuua

SEQ ID NO: 3643077 - RNA, 15 nt, Human
uuuaauauaaagccu

SEQ ID NO: 3643078 - RNA, 18 nt, Human
uuuaauauaaaguuuuau

SEQ ID NO: 3643079 - RNA, 13 nt, Human
uuuaauauaaaug

SEQ ID NO: 3643080 - RNA, 20 nt, Human
uuuaauauaaaugcaaauaa

SEQ ID NO: 3643081 - RNA, 15 nt, Human
uuuaauaucuucagc

SEQ ID NO: 3643082 - RNA, 12 nt, Human
uuuaauaugcaa

SEQ ID NO: 3643083 - RNA, 14 nt, Human
uuuaauauuaaagc

SEQ ID NO: 3643084 - RNA, 16 nt, Human
uuuaauauuacagaua

SEQ ID NO: 3643085 - RNA, 14 nt, Human
uuuaauauuuugca

SEQ ID NO: 3643086 - RNA, 21 nt, Human
uuuaaucacuuaacauuccua

SEQ ID NO: 3643087 - RNA, 12 nt, Human
uuuaaucagaaa

SEQ ID NO: 3643088 - RNA, 22 nt, Human
uuuaaucauaguuacuguguaa

SEQ ID NO: 3643089 - RNA, 12 nt, Human
uuuaaucaugaa

SEQ ID NO: 3643090 - RNA, 14 nt, Human
uuuaaucauugccu

SEQ ID NO: 3643091 - RNA, 15 nt, Human
uuuaaucauugccug

SEQ ID NO: 3643092 - RNA, 14 nt, Human
uuuaauccagaauu

SEQ ID NO: 3643093 - RNA, 21 nt, Human
uuuaauccagaauugaccuuu

SEQ ID NO: 3643094 - RNA, 16 nt, Human
uuuaauccccaguaaa

SEQ ID NO: 3643095 - RNA, 13 nt, Human
uuuaaucuacugc

SEQ ID NO: 3643096 - RNA, 17 nt, Human
uuuaaucugaaauucua

SEQ ID NO: 3643097 - RNA, 15 nt, Human
uuuaaugaacaaaug

SEQ ID NO: 3643098 - RNA, 16 nt, Human
uuuaaugaaugcuuaa

SEQ ID NO: 3643099 - RNA, 16 nt, Human
uuuaaugauuguuuaa

SEQ ID NO: 3643100 - RNA, 19 nt, Human
uuuaaugcauuaaaccugu

SEQ ID NO: 3643101 - RNA, 23 nt, Human
uuuaaugccgauauacucuagau

SEQ ID NO: 3643102 - RNA, 21 nt, Human
uuuaauggauuguuaauuuca

SEQ ID NO: 3643103 - RNA, 23 nt, Human
uuuaauggauuguuaauuucagu

SEQ ID NO: 3643104 - RNA, 17 nt, Human
uuuaauggcagcagaaa

SEQ ID NO: 3643105 - RNA, 22 nt, Human
uuuaauggccggcuggaaaugc

SEQ ID NO: 3643106 - RNA, 21 nt, Human
uuuaauggggguagcagcugg

SEQ ID NO: 3643107 - RNA, 15 nt, Human
uuuaaugugaacuug

SEQ ID NO: 3643108 - RNA, 20 nt, Human
uuuaaugugaacuuguagcu

SEQ ID NO: 3643109 - RNA, 13 nt, Human
uuuaaugugauga

SEQ ID NO: 3643110 - RNA, 16 nt, Human
uuuaaugugcugugua

SEQ ID NO: 3643111 - RNA, 17 nt, Human
uuuaaugugcuguguaa

SEQ ID NO: 3643112 - RNA, 20 nt, Human
uuuaaugugcuguguaaagu

SEQ ID NO: 3643113 - RNA, 13 nt, Human
uuuaauguugaac

SEQ ID NO: 3643114 - RNA, 17 nt, Human
uuuaauguuuaaaacau

SEQ ID NO: 3643115 - RNA, 15 nt, Human
uuuaauguuuuaaau

SEQ ID NO: 3643116 - RNA, 16 nt, Human
uuuaauuaaaaaauuu

SEQ ID NO: 3643117 - RNA, 20 nt, Human
uuuaauuaauugggccagcu

SEQ ID NO: 3643118 - RNA, 14 nt, Human
uuuaauuagugcua

SEQ ID NO: 3643119 - RNA, 17 nt, Human
uuuaauuagugcuaagu

SEQ ID NO: 3643120 - RNA, 22 nt, Human
uuuaauuagugcuaagugugaa

SEQ ID NO: 3643121 - RNA, 23 nt, Human
uuuaauuauuauucuucauaaca

SEQ ID NO: 3643122 - RNA, 23 nt, Human
uuuaauuauuauuuauauaugua

SEQ ID NO: 3643123 - RNA, 17 nt, Human
uuuaauucaccaaagua

SEQ ID NO: 3643124 - RNA, 16 nt, Human
uuuaauucauguuucu

SEQ ID NO: 3643125 - RNA, 23 nt, Human
uuuaauucauguuucuuaaaugg

SEQ ID NO: 3643126 - RNA, 13 nt, Human
uuuaauuccauga

SEQ ID NO: 3643127 - RNA, 11 nt, Human
uuuaauucucu

SEQ ID NO: 3643128 - RNA, 13 nt, Human
uuuaauucucuug

SEQ ID NO: 3643129 - RNA, 15 nt, Human
uuuaauugaaggaaa

SEQ ID NO: 3643130 - RNA, 19 nt, Human
uuuaauugaaggaaagauu

SEQ ID NO: 3643131 - RNA, 12 nt, Human
uuuaauuguaaa

SEQ ID NO: 3643132 - RNA, 17 nt, Human
uuuaauuguauuuuugu

SEQ ID NO: 3643133 - RNA, 14 nt, Human
uuuaauugucaugg

SEQ ID NO: 3643134 - RNA, 21 nt, Human
uuuaauugucaugguuacaaa

SEQ ID NO: 3643135 - RNA, 18 nt, Human
uuuaauuguuaagauaug

SEQ ID NO: 3643136 - RNA, 21 nt, Human
uuuaauuguuguuucuuucua

SEQ ID NO: 3643137 - RNA, 13 nt, Human
uuuaauuguuuaa

SEQ ID NO: 3643138 - RNA, 16 nt, Human
uuuaauuuaguaaaug

SEQ ID NO: 3643139 - RNA, 19 nt, Human
uuuaauuuaguaaauguua

SEQ ID NO: 3643140 - RNA, 20 nt, Human
uuuaauuuauguaacuugaa

SEQ ID NO: 3643141 - RNA, 23 nt, Human
uuuaauuucaagcuuauuuugga

SEQ ID NO: 3643142 - RNA, 20 nt, Human
uuuaauuucugucagaaugc

SEQ ID NO: 3643143 - RNA, 21 nt, Human
uuuaauuugccaaaauaaugu

SEQ ID NO: 3643144 - RNA, 15 nt, Human
uuuaauuuuggaauu

SEQ ID NO: 3643145 - RNA, 11 nt, Human
uuuaauuuugu

SEQ ID NO: 3643146 - RNA, 14 nt, Human
uuuaauuuuguaaa

SEQ ID NO: 3643147 - RNA, 14 nt, Human
uuuaauuuuuaaau

SEQ ID NO: 3643148 - RNA, 20 nt, Human
uuuacaaaagaggagcacuu

SEQ ID NO: 3643149 - RNA, 16 nt, Human
uuuacaaacugaagag

SEQ ID NO: 3643150 - RNA, 13 nt, Human
uuuacaaaggcug

SEQ ID NO: 3643151 - RNA, 12 nt, Human
uuuacaaauguu

SEQ ID NO: 3643152 - RNA, 19 nt, Human
uuuacaacacuuuaauggg

SEQ ID NO: 3643153 - RNA, 20 nt, Human
uuuacaacauaaucuaguuu

SEQ ID NO: 3643154 - RNA, 12 nt, Human
uuuacaagaaaa

SEQ ID NO: 3643155 - RNA, 19 nt, Human
uuuacaagaaaaaaugaau

SEQ ID NO: 3643156 - RNA, 21 nt, Human
uuuacaagcccccccuuccac

SEQ ID NO: 3643157 - RNA, 21 nt, Human
uuuacaaguguauaucagaaa

SEQ ID NO: 3643158 - RNA, 16 nt, Human
uuuacaauaaauaauc

SEQ ID NO: 3643159 - RNA, 17 nt, Human
uuuacaauaguucugug

SEQ ID NO: 3643160 - RNA, 13 nt, Human
uuuacaauguauu

SEQ ID NO: 3643161 - RNA, 16 nt, Human
uuuacaauugaaauga

SEQ ID NO: 3643162 - RNA, 19 nt, Human
uuuacacaauagaauuaua

SEQ ID NO: 3643163 - RNA, 19 nt, Human
uuuacacacuguacacaua

SEQ ID NO: 3643164 - RNA, 23 nt, Human
uuuacacacuguacacauaagcc

SEQ ID NO: 3643165 - RNA, 21 nt, Human
uuuacacauucggcucccugg

SEQ ID NO: 3643166 - RNA, 20 nt, Human
uuuacaccgacuagccagga

SEQ ID NO: 3643167 - RNA, 22 nt, Human
uuuacacggagcggauugcaaa

SEQ ID NO: 3643168 - RNA, 22 nt, Human
uuuacacucaggcuuucacuau

SEQ ID NO: 3643169 - RNA, 21 nt, Human
uuuacagagaugucucuuaua

SEQ ID NO: 3643170 - RNA, 20 nt, Human
uuuacagaggacaguauuug

SEQ ID NO: 3643171 - RNA, 19 nt, Human
uuuggaaacuaauaaaaua

SEQ ID NO: 3643172 - RNA, 16 nt, Human
uuuggaaaguagaaaa

SEQ ID NO: 3643173 - RNA, 15 nt, Human
uuuggaaaucuuuaa

SEQ ID NO: 3643174 - RNA, 23 nt, Human
uuuggaaauuagguugaaacaua

SEQ ID NO: 3643175 - RNA, 13 nt, Human
uuuggaagcaggg

SEQ ID NO: 3643176 - RNA, 18 nt, Human
uuuggaaguuuguguucu

SEQ ID NO: 3643177 - RNA, 13 nt, Human
uuuggaaucuaga

SEQ ID NO: 3643178 - RNA, 14 nt, Human
uuuggaauuuugug

SEQ ID NO: 3643179 - RNA, 13 nt, Human
uuuggacaguuua

SEQ ID NO: 3643180 - RNA, 16 nt, Human
uuuggacaguuuacca

SEQ ID NO: 3643181 - RNA, 20 nt, Human
uuuggaccaauagcccacag

SEQ ID NO: 3643182 - RNA, 16 nt, Human
uuuggacgcacacagc

SEQ ID NO: 3643183 - RNA, 17 nt, Human
uuuggacgcacacagcu

SEQ ID NO: 3643184 - RNA, 18 nt, Human
uuuggacuccaucucuca

SEQ ID NO: 3643185 - RNA, 22 nt, Human
uuuggagaaauuauuuaauaaa

SEQ ID NO: 3643186 - RNA, 14 nt, Human
uuuggagacuuucu

SEQ ID NO: 3643187 - RNA, 20 nt, Human
uuuggagcacaaaauucaaa

SEQ ID NO: 3643188 - RNA, 14 nt, Human
uuuggaggugcuua

SEQ ID NO: 3643189 - RNA, 20 nt, Human
uuuggagucagacagaugug

SEQ ID NO: 3643190 - RNA, 15 nt, Human
uuuggauagcauguc

SEQ ID NO: 3643191 - RNA, 13 nt, Human
uuuggauguaauu

SEQ ID NO: 3643192 - RNA, 20 nt, Human
uuuggauucuuauguagcag

SEQ ID NO: 3643193 - RNA, 16 nt, Human
uuuggauuggaugaau

SEQ ID NO: 3643194 - RNA, 22 nt, Human
uuuggauuggaugaauuccaaa

SEQ ID NO: 3643195 - RNA, 20 nt, Human
uuuggauuuaaaagccugcu

SEQ ID NO: 3643196 - RNA, 19 nt, Human
uuuggcaaacgcuaaagag

SEQ ID NO: 3643197 - RNA, 23 nt, Human
uuuggcaaacucuccaccacacg

SEQ ID NO: 3643198 - RNA, 14 nt, Human
uuuggcaaggaaag

SEQ ID NO: 3643199 - RNA, 16 nt, Human
uuuggcaauuuugugg

SEQ ID NO: 3643200 - RNA, 11 nt, Human
uuuggcacugg

SEQ ID NO: 3643201 - RNA, 20 nt, Human
uuuggcagagcuucuuccag

SEQ ID NO: 3643202 - RNA, 13 nt, Human
uuuggcagaguuc

SEQ ID NO: 3643203 - RNA, 13 nt, Human
uuuggcaggugca

SEQ ID NO: 3643204 - RNA, 21 nt, Human
uuuggcauaacauaaaucugu

SEQ ID NO: 3643205 - RNA, 23 nt, Human
uuuggcaucccugggccuugggc

SEQ ID NO: 3643206 - RNA, 12 nt, Human
uuuggccagaag

SEQ ID NO: 3643207 - RNA, 13 nt, Human
uuuggccaucucu

SEQ ID NO: 3643208 - RNA, 21 nt, Human
uuuggcccccgagcugggggc

SEQ ID NO: 3643209 - RNA, 22 nt, Human
uuuggccugaugaccaauuuua

SEQ ID NO: 3643210 - RNA, 19 nt, Human
uuuggcgcuauuacaaaua

SEQ ID NO: 3643211 - RNA, 14 nt, Human
uuuggcuccugccc

SEQ ID NO: 3643212 - RNA, 21 nt, Human
uuuggcugaaauucuccugga

SEQ ID NO: 3643213 - RNA, 13 nt, Human
uuuggcugugucu

SEQ ID NO: 3643214 - RNA, 14 nt, Human
uuuggcugugucua

SEQ ID NO: 3643215 - RNA, 14 nt, Human
uuuggcuuccauga

SEQ ID NO: 3643216 - RNA, 13 nt, Human
uuuggcuuucagg

SEQ ID NO: 3643217 - RNA, 20 nt, Human
uuugggaagugaagacugga

SEQ ID NO: 3643218 - RNA, 16 nt, Human
uuugggaauauuugaa

SEQ ID NO: 3643219 - RNA, 15 nt, Human
uuugggacccugcuu

SEQ ID NO: 3643220 - RNA, 20 nt, Human
uuugggacccugcuuuagag

SEQ ID NO: 3643221 - RNA, 22 nt, Human
uuugggauaggaaaaaugagua

SEQ ID NO: 3643222 - RNA, 17 nt, Human
uuugggaucccugucuu

SEQ ID NO: 3643223 - RNA, 17 nt, Human
uuugggaugucuuauuu

SEQ ID NO: 3643224 - RNA, 14 nt, Human
uuugggcccaggga

SEQ ID NO: 3643225 - RNA, 14 nt, Human
uuugggcccugcau

SEQ ID NO: 3643226 - RNA, 19 nt, Human
uuugggcugaauguaugua

SEQ ID NO: 3643227 - RNA, 15 nt, Human
uuugggcuugggccu

SEQ ID NO: 3643228 - RNA, 23 nt, Human
uuuggggaaggguuugaauuguu

SEQ ID NO: 3643229 - RNA, 22 nt, Human
uuuggggacagauucagucuug

SEQ ID NO: 3643230 - RNA, 19 nt, Human
uuuggggagguguucacug

SEQ ID NO: 3643231 - RNA, 16 nt, Human
uuuggggauaugcuua

SEQ ID NO: 3643232 - RNA, 19 nt, Human
uuuggggauucagauuucu

SEQ ID NO: 3643233 - RNA, 20 nt, Human
uuuggggcaggaguagcuga

SEQ ID NO: 3643234 - RNA, 14 nt, Human
uuuggggcgaggca

SEQ ID NO: 3643235 - RNA, 18 nt, Human
uuuggggcgaggcagagg

SEQ ID NO: 3643236 - RNA, 22 nt, Human
uuugggggaaaauuuagaaaua

SEQ ID NO: 3643237 - RNA, 15 nt, Human
uuugggggucaggca

SEQ ID NO: 3643238 - RNA, 20 nt, Human
uuugggguagcuagaggaac

SEQ ID NO: 3643239 - RNA, 13 nt, Human
uuuggguaaauca

SEQ ID NO: 3643240 - RNA, 17 nt, Human
uuuggguaccuauuuuc

SEQ ID NO: 3643241 - RNA, 13 nt, Human
uuuggguccagga

SEQ ID NO: 3643242 - RNA, 16 nt, Human
uuuggguuucugcccu

SEQ ID NO: 3643243 - RNA, 16 nt, Human
uuuggguuuuuuuccu

SEQ ID NO: 3643244 - RNA, 16 nt, Human
uuugguaaauguuucu

SEQ ID NO: 3643245 - RNA, 13 nt, Human
uuugguacaaaaa

SEQ ID NO: 3643246 - RNA, 16 nt, Human
uuugguaccagauaac

SEQ ID NO: 3643247 - RNA, 14 nt, Human
uuugguacuaauaa

SEQ ID NO: 3643248 - RNA, 19 nt, Human
uuugguagcugggaaagca

SEQ ID NO: 3643249 - RNA, 14 nt, Human
uuugguauuguauu

SEQ ID NO: 3643250 - RNA, 13 nt, Human
uuugguauuugaa

SEQ ID NO: 3643251 - RNA, 12 nt, Human
uuugguauuugc

SEQ ID NO: 3643252 - RNA, 20 nt, Human
uuuggucaguuggguuuuua

SEQ ID NO: 3643253 - RNA, 18 nt, Human
uuuggucgaggaguaaca

SEQ ID NO: 3643254 - RNA, 22 nt, Human
uuuggucgaggaguaacaauac

SEQ ID NO: 3643255 - RNA, 15 nt, Human
uuuggucucuugcuu

SEQ ID NO: 3643256 - RNA, 19 nt, Human
uuuggucuggacugacagc

SEQ ID NO: 3643257 - RNA, 22 nt, Human
uuuggucuggacugacagcaug

SEQ ID NO: 3643258 - RNA, 16 nt, Human
uuuggugcauagaacu

SEQ ID NO: 3643259 - RNA, 20 nt, Human
uuuggugcucauuuaaauau

SEQ ID NO: 3643260 - RNA, 19 nt, Human
uuuggugguuucagaaaug

SEQ ID NO: 3643261 - RNA, 20 nt, Human
uuugguuaagucuguuuuau

SEQ ID NO: 3643262 - RNA, 22 nt, Human
uuugguuaagucuguuuuauga

SEQ ID NO: 3643263 - RNA, 18 nt, Human
uuugguuauagugcaaua

SEQ ID NO: 3643264 - RNA, 13 nt, Human
uuugguuauuuua

SEQ ID NO: 3643265 - RNA, 17 nt, Human
uuugguuccucucuggu

SEQ ID NO: 3643266 - RNA, 13 nt, Human
uuugguucugggg

SEQ ID NO: 3643267 - RNA, 14 nt, Human
uuugguugaauaaa

SEQ ID NO: 3643268 - RNA, 17 nt, Human
uuugguugcuuuaauau

SEQ ID NO: 3643269 - RNA, 22 nt, Human
uuugguugguaacucuguaauu

SEQ ID NO: 3643270 - RNA, 12 nt, Human
uuugguuuacau

SEQ ID NO: 3643271 - RNA, 15 nt, Human
uuugguuuacauuua

SEQ ID NO: 3643272 - RNA, 16 nt, Human
uuugguuugguuuuua

SEQ ID NO: 3643273 - RNA, 15 nt, Human
uuugguuuuguuccc

SEQ ID NO: 3643274 - RNA, 16 nt, Human
uuugguuuuguucccc

SEQ ID NO: 3643275 - RNA, 19 nt, Human
uuugguuuuguuccccucc

SEQ ID NO: 3643276 - RNA, 21 nt, Human
uuuguaaaaacagcauugcuu

SEQ ID NO: 3643277 - RNA, 23 nt, Human
uuuguaaaaaucuuuugaagcau

SEQ ID NO: 3643278 - RNA, 17 nt, Human
uuuguaaacucaaaaua

SEQ ID NO: 3643279 - RNA, 16 nt, Human
uuuguaaacuuugaaa

SEQ ID NO: 3643280 - RNA, 19 nt, Human
uuuguaaacuuugaaauau

SEQ ID NO: 3643281 - RNA, 21 nt, Human
uuuguaaacuuugaaauauau

SEQ ID NO: 3643282 - RNA, 16 nt, Human
uuuguaaagaaaaaua

SEQ ID NO: 3643283 - RNA, 18 nt, Human
uuuguaaagaaaaauauu

SEQ ID NO: 3643284 - RNA, 13 nt, Human
uuuguaaagaaau

SEQ ID NO: 3643285 - RNA, 21 nt, Human
uuuguaaagaaauuuacuaua

SEQ ID NO: 3643286 - RNA, 17 nt, Human
uuuguaaaguccccaga

SEQ ID NO: 3643287 - RNA, 16 nt, Human
uuuguaaagugaagaa

SEQ ID NO: 3643288 - RNA, 12 nt, Human
uuuguaaagugu

SEQ ID NO: 3643289 - RNA, 22 nt, Human
uuuguaaaguugguuggauaag

SEQ ID NO: 3643290 - RNA, 22 nt, Human
uuuguaaauaagagauuuggag

SEQ ID NO: 3643291 - RNA, 15 nt, Human
uuuguaaaucugcca

SEQ ID NO: 3643292 - RNA, 17 nt, Human
uuuguaaaucugccaca

SEQ ID NO: 3643293 - RNA, 19 nt, Human
uuuguaaauguuauuucug

SEQ ID NO: 3643294 - RNA, 20 nt, Human
uuuguaaauguuauuucugc

SEQ ID NO: 3643295 - RNA, 22 nt, Human
uuuguaaauuaaacauaaaaca

SEQ ID NO: 3643296 - RNA, 20 nt, Human
uuuguaaccacaacuuucac

SEQ ID NO: 3643297 - RNA, 18 nt, Human
uuuguaaccucagcucug

SEQ ID NO: 3643298 - RNA, 23 nt, Human
uuuguaacuguuuagaugaaugu

SEQ ID NO: 3643299 - RNA, 13 nt, Human
uuuguaagaaacc

SEQ ID NO: 3643300 - RNA, 12 nt, Human
uuuguaagagug

SEQ ID NO: 3643301 - RNA, 17 nt, Human
uuuguaagaguguagaa

SEQ ID NO: 3643302 - RNA, 22 nt, Human
uuuguaagaguguagaagcauu

SEQ ID NO: 3643303 - RNA, 23 nt, Human
uuuguaagaguguagaagcauuc

SEQ ID NO: 3643304 - RNA, 14 nt, Human
uuuguaagaugcug

SEQ ID NO: 3643305 - RNA, 13 nt, Human
uuuguaaguuuau

SEQ ID NO: 3643306 - RNA, 14 nt, Human
uuuguaaguuucag

SEQ ID NO: 3643307 - RNA, 21 nt, Human
uuuguaaguuucaggugacau

SEQ ID NO: 3643308 - RNA, 23 nt, Human
uuuguaauaagcaaucaagguua

SEQ ID NO: 3643309 - RNA, 19 nt, Human
uuuguaauaauaaagaaua

SEQ ID NO: 3643310 - RNA, 15 nt, Human
uuuguaaugugugaa

SEQ ID NO: 3643311 - RNA, 22 nt, Human
uuuguaauuaaaagcaaaucau

SEQ ID NO: 3643312 - RNA, 13 nt, Human
uuuguaauuauga

SEQ ID NO: 3643313 - RNA, 18 nt, Human
uuuguaauugcuuacauu

SEQ ID NO: 3643314 - RNA, 20 nt, Human
uuuguaauugcuuacauuuu

SEQ ID NO: 3643315 - RNA, 16 nt, Human
uuuguaauuuucuuga

SEQ ID NO: 3643316 - RNA, 21 nt, Human
uuuuaagugaaagugaggaaa

SEQ ID NO: 3643317 - RNA, 14 nt, Human
uuuuaagugaaauu

SEQ ID NO: 3643318 - RNA, 16 nt, Human
uuuuaagugaaauuua

SEQ ID NO: 3643319 - RNA, 15 nt, Human
uuuuaaguuaauaga

SEQ ID NO: 3643320 - RNA, 18 nt, Human
uuuuaaguuaauagauuu

SEQ ID NO: 3643321 - RNA, 21 nt, Human
uuuuaaguuacacauuuuuca

SEQ ID NO: 3643322 - RNA, 14 nt, Human
uuuuaaguugcuga

SEQ ID NO: 3643323 - RNA, 19 nt, Human
uuuuaaguuucucugcaga

SEQ ID NO: 3643324 - RNA, 16 nt, Human
uuuuaaguuugcacuc

SEQ ID NO: 3643325 - RNA, 15 nt, Human
uuuuaauaaaagaaa

SEQ ID NO: 3643326 - RNA, 12 nt, Human
uuuuaauaaacu

SEQ ID NO: 3643327 - RNA, 20 nt, Human
uuuuaauaauguuucaaaca

SEQ ID NO: 3643328 - RNA, 21 nt, Human
uuuuaauagaauauaauuauc

SEQ ID NO: 3643329 - RNA, 18 nt, Human
uuuuaauccgccaauauu

SEQ ID NO: 3643330 - RNA, 19 nt, Human
uuuuaauccgccaauauua

SEQ ID NO: 3643331 - RNA, 16 nt, Human
uuuuaaugaacaaaug

SEQ ID NO: 3643332 - RNA, 16 nt, Human
uuuuaaugauuguuua

SEQ ID NO: 3643333 - RNA, 16 nt, Human
uuuuaaugcaguugcu

SEQ ID NO: 3643334 - RNA, 21 nt, Human
uuuuaaugcuaaucuugugaa

SEQ ID NO: 3643335 - RNA, 17 nt, Human
uuuuaaugcuccaaaug

SEQ ID NO: 3643336 - RNA, 23 nt, Human
uuuuaauggggguagcagcugga

SEQ ID NO: 3643337 - RNA, 19 nt, Human
uuuuaauguaauugauugu

SEQ ID NO: 3643338 - RNA, 20 nt, Human
uuuuaaugucauuuguuaaa

SEQ ID NO: 3643339 - RNA, 18 nt, Human
uuuuaaugugaugaugua

SEQ ID NO: 3643340 - RNA, 12 nt, Human
uuuuaaugugcu

SEQ ID NO: 3643341 - RNA, 17 nt, Human
uuuuaaugugcugugua

SEQ ID NO: 3643342 - RNA, 16 nt, Human
uuuuaauuaaaaacua

SEQ ID NO: 3643343 - RNA, 13 nt, Human
uuuuaauuaaaua

SEQ ID NO: 3643344 - RNA, 19 nt, Human
uuuuaauuaacuuuggauu

SEQ ID NO: 3643345 - RNA, 17 nt, Human
uuuuaauuauuauucuu

SEQ ID NO: 3643346 - RNA, 20 nt, Human
uuuuaauuauuauuuauaua

SEQ ID NO: 3643347 - RNA, 15 nt, Human
uuuuaauuccaugaa

SEQ ID NO: 3643348 - RNA, 14 nt, Human
uuuuaauugaaaag

SEQ ID NO: 3643349 - RNA, 24 nt, Human
uuuuaauugaucaguuuucaugug

SEQ ID NO: 3643350 - RNA, 14 nt, Human
uuuuaauuguuuaa

SEQ ID NO: 3643351 - RNA, 18 nt, Human
uuuuaauuuacuuguuuu

SEQ ID NO: 3643352 - RNA, 21 nt, Human
uuuuaauuuauuuauacuauu

SEQ ID NO: 3643353 - RNA, 15 nt, Human
uuuuaauuugaugaa

SEQ ID NO: 3643354 - RNA, 20 nt, Human
uuuuaauuugaugaaagcug

SEQ ID NO: 3643355 - RNA, 14 nt, Human
uuuuaauuuuaacc

SEQ ID NO: 3643356 - RNA, 12 nt, Human
uuuuaauuuugu

SEQ ID NO: 3643357 - RNA, 13 nt, Human
uuuuaauuuugua

SEQ ID NO: 3643358 - RNA, 21 nt, Human
uuuuaauuuuguaaaggugaa

SEQ ID NO: 3643359 - RNA, 16 nt, Human
uuuuaauuuugucugc

SEQ ID NO: 3643360 - RNA, 12 nt, Human
uuuuaauuuuua

SEQ ID NO: 3643361 - RNA, 12 nt, Human
uuuuacaaaugu

SEQ ID NO: 3643362 - RNA, 17 nt, Human
uuuuacaagaaguuuau

SEQ ID NO: 3643363 - RNA, 17 nt, Human
uuuuacaauaaaaucuu

SEQ ID NO: 3643364 - RNA, 19 nt, Human
uuuuacacauuagauuuua

SEQ ID NO: 3643365 - RNA, 13 nt, Human
uuuuacauaacug

SEQ ID NO: 3643366 - RNA, 15 nt, Human
uuuuacauacugcug

SEQ ID NO: 3643367 - RNA, 12 nt, Human
uuuuacaugaag

SEQ ID NO: 3643368 - RNA, 14 nt, Human
uuuuacaugaagua

SEQ ID NO: 3643369 - RNA, 15 nt, Human
uuuuacaugaaguau

SEQ ID NO: 3643370 - RNA, 16 nt, Human
uuuuaccagcuuuuaa

SEQ ID NO: 3643371 - RNA, 14 nt, Human
uuuuacccauaucc

SEQ ID NO: 3643372 - RNA, 19 nt, Human
uuuuacccuauaucuauaa

SEQ ID NO: 3643373 - RNA, 17 nt, Human
uuuuaccguuucuuccc

SEQ ID NO: 3643374 - RNA, 20 nt, Human
uuuuaccuaccacagugucu

SEQ ID NO: 3643375 - RNA, 19 nt, Human
uuuuaccugucacauugca

SEQ ID NO: 3643376 - RNA, 23 nt, Human
uuuuaccugucacauugcauucu

SEQ ID NO: 3643377 - RNA, 16 nt, Human
uuuuacucauugaaau

SEQ ID NO: 3643378 - RNA, 17 nt, Human
uuuuacucauugaaaug

SEQ ID NO: 3643379 - RNA, 20 nt, Human
uuuuacucauugaaauguca

SEQ ID NO: 3643380 - RNA, 23 nt, Human
uuuuacuccagguuauugcaaua

SEQ ID NO: 3643381 - RNA, 13 nt, Human
uuuuacuccccuu

SEQ ID NO: 3643382 - RNA, 22 nt, Human
uuuuacucuaugccccaaauau

SEQ ID NO: 3643383 - RNA, 13 nt, Human
uuuuacucugccu

SEQ ID NO: 3643384 - RNA, 14 nt, Human
uuuuacugaacaau

SEQ ID NO: 3643385 - RNA, 17 nt, Human
uuuuacugccacucuuu

SEQ ID NO: 3643386 - RNA, 23 nt, Human
uuuuacugcuuuuaacuucugau

SEQ ID NO: 3643387 - RNA, 18 nt, Human
uuuuacugguugcaugga

SEQ ID NO: 3643388 - RNA, 21 nt, Human
uuuuacugguugcauggaaau

SEQ ID NO: 3643389 - RNA, 14 nt, Human
uuuuacuguacaga

SEQ ID NO: 3643390 - RNA, 13 nt, Human
uuuuacugucuau

SEQ ID NO: 3643391 - RNA, 22 nt, Human
uuuuacugucuuaauuaaguaa

SEQ ID NO: 3643392 - RNA, 17 nt, Human
uuuuacuuuuaaacugu

SEQ ID NO: 3643393 - RNA, 20 nt, Human
uuuuacuuuuaaacugugua

SEQ ID NO: 3643394 - RNA, 12 nt, Human
uuuuacuuuuau

SEQ ID NO: 3643395 - RNA, 16 nt, Human
uuuuacuuuuuuuagu

SEQ ID NO: 3643396 - RNA, 19 nt, Human
uuuuagaaagcauuugaau

SEQ ID NO: 3643397 - RNA, 21 nt, Human
uuuuagaauaagaauuugcau

SEQ ID NO: 3643398 - RNA, 18 nt, Human
uuuuagaauuuugugaaa

SEQ ID NO: 3643399 - RNA, 17 nt, Human
uuuuagaguaagaaauu

SEQ ID NO: 3643400 - RNA, 17 nt, Human
uuuuagaguugauacua

SEQ ID NO: 3643401 - RNA, 19 nt, Human
uuuuagaugagauuguuuu

SEQ ID NO: 3643402 - RNA, 19 nt, Human
uuuuagaugguuacacugu

SEQ ID NO: 3643403 - RNA, 21 nt, Human
uuuuagcaauuuauacaauau

SEQ ID NO: 3643404 - RNA, 23 nt, Human
uuuuagcacagcguuaugugucu

SEQ ID NO: 3643405 - RNA, 22 nt, Human
uuuuagcauguguuugguucug

SEQ ID NO: 3643406 - RNA, 19 nt, Human
uuuuagccuaguucaucca

SEQ ID NO: 3643407 - RNA, 21 nt, Human
uuuuagcugaugaacuuauuc

SEQ ID NO: 3643408 - RNA, 22 nt, Human
uuuuagcugguggcaauaaaua

SEQ ID NO: 3643409 - RNA, 12 nt, Human
uuuuaggaaagg

SEQ ID NO: 3643410 - RNA, 11 nt, Human
uuuuaggaaau

SEQ ID NO: 3643411 - RNA, 20 nt, Human
uuuuaggagcuaaggcucua

SEQ ID NO: 3643412 - RNA, 23 nt, Human
uuuuaggagcuaaggcucuauga

SEQ ID NO: 3643413 - RNA, 15 nt, Human
uuuuagguagaaaaa

SEQ ID NO: 3643414 - RNA, 23 nt, Human
uuuuaggucaagggcuuacuauu

SEQ ID NO: 3643415 - RNA, 16 nt, Human
uuuuagguguugauuu

SEQ ID NO: 3643416 - RNA, 16 nt, Human
uuuuagguucuaaagu

SEQ ID NO: 3643417 - RNA, 18 nt, Human
uuuuagguucuaaaguuc

SEQ ID NO: 3643418 - RNA, 14 nt, Human
uuuuaguaaucugu

SEQ ID NO: 3643419 - RNA, 16 nt, Human
uuuuaguaaucuguac

SEQ ID NO: 3643420 - RNA, 19 nt, Human
uuuuaguaaucuguacauu

SEQ ID NO: 3643421 - RNA, 15 nt, Human
uuuuaguagagacag

SEQ ID NO: 3643422 - RNA, 13 nt, Human
uuuuaguccaaau

SEQ ID NO: 3643423 - RNA, 19 nt, Human
uuuuagugaacuugaaaua

SEQ ID NO: 3643424 - RNA, 14 nt, Human
uuuuagugcuuuug

SEQ ID NO: 3643425 - RNA, 18 nt, Human
uuuuagugugugcauaau

SEQ ID NO: 3643426 - RNA, 19 nt, Human
uuuuagugugugcauaaua

SEQ ID NO: 3643427 - RNA, 18 nt, Human
uuuuaguuccugugcaca

SEQ ID NO: 3643428 - RNA, 19 nt, Human
uuuuaguugcaacuuugua

SEQ ID NO: 3643429 - RNA, 20 nt, Human
uuuuaguuuaaaaaccuugu

SEQ ID NO: 3643430 - RNA, 22 nt, Human
uuuuaguuuuucauuaaauaaa

SEQ ID NO: 3643431 - RNA, 22 nt, Human
uuuuauaaaauggcuguaauca

SEQ ID NO: 3643432 - RNA, 22 nt, Human
uuuuauaaaauuaaagaaaaua

SEQ ID NO: 3643433 - RNA, 14 nt, Human
uuuuauaaacuuua

SEQ ID NO: 3643434 - RNA, 12 nt, Human
uuuuauaaagca

SEQ ID NO: 3643435 - RNA, 15 nt, Human
uuuuauaaagcaugu

SEQ ID NO: 3643436 - RNA, 13 nt, Human
uuuuauaaagugc

SEQ ID NO: 3643437 - RNA, 19 nt, Human
uuuuauaaagugcuugugu

SEQ ID NO: 3643438 - RNA, 18 nt, Human
uuuuauaaauaaacuguu

SEQ ID NO: 3643439 - RNA, 13 nt, Human
uuuuauaaauacu

SEQ ID NO: 3643440 - RNA, 12 nt, Human
uuuuauaaauua

SEQ ID NO: 3643441 - RNA, 14 nt, Human
uuuuauaagaaaaa

SEQ ID NO: 3643442 - RNA, 23 nt, Human
uuuuauaauaaaaggaaaagcaa

SEQ ID NO: 3643443 - RNA, 23 nt, Human
uuuuauaauuuugugaagcaaaa

SEQ ID NO: 3643444 - RNA, 13 nt, Human
uuuuauacauaaa

SEQ ID NO: 3643445 - RNA, 15 nt, Human
uuuuauaccuguuua

SEQ ID NO: 3643446 - RNA, 17 nt, Human
uuuuauaccuguuuaaa

SEQ ID NO: 3643447 - RNA, 16 nt, Human
uuuuauagauuugacc

SEQ ID NO: 3643448 - RNA, 13 nt, Human
uuuuauaguggaa

SEQ ID NO: 3643449 - RNA, 13 nt, Human
uuuuauauagcaa

SEQ ID NO: 3643450 - RNA, 15 nt, Human
uuuuauauauacagu

SEQ ID NO: 3643451 - RNA, 16 nt, Human
uuuuauauauaugcau

SEQ ID NO: 3643452 - RNA, 15 nt, Human
uuuuauaucuguaug

SEQ ID NO: 3643453 - RNA, 18 nt, Human
uuuuauaucuguauguau

SEQ ID NO: 3643454 - RNA, 22 nt, Human
uuuuauaugaagauaaguguau

SEQ ID NO: 3643455 - RNA, 13 nt, Human
uuuuauaugcuuu

SEQ ID NO: 3643456 - RNA, 11 nt, Human
uuuuauauuua

SEQ ID NO: 3643457 - RNA, 23 nt, Human
uuuuauauuuaguuauaguuuca

SEQ ID NO: 3643458 - RNA, 23 nt, Human
uuuuauauuuccuuuaugugaau

SEQ ID NO: 3643459 - RNA, 18 nt, Human
uuuuauauuugaaauauu

SEQ ID NO: 3643460 - RNA, 16 nt, Human
uuuuauauuuguaucg

SEQ ID NO: 3643461 - RNA, 13 nt, Human
uuuuguguacagu

SEQ ID NO: 3643462 - RNA, 12 nt, Human
uuuuguguacuu

SEQ ID NO: 3643463 - RNA, 14 nt, Human
uuuugugugaaauu

SEQ ID NO: 3643464 - RNA, 12 nt, Human
uuuuguguuuau

SEQ ID NO: 3643465 - RNA, 23 nt, Human
uuuuguuacuguucuugcugcua

SEQ ID NO: 3643466 - RNA, 20 nt, Human
uuuuguuccaaugucaaugu

SEQ ID NO: 3643467 - RNA, 15 nt, Human
uuuuguuccacaagu

SEQ ID NO: 3643468 - RNA, 21 nt, Human
uuuuguuccacaaguuaaaua

SEQ ID NO: 3643469 - RNA, 13 nt, Human
uuuuguucucugg

SEQ ID NO: 3643470 - RNA, 12 nt, Human
uuuuguucuuca

SEQ ID NO: 3643471 - RNA, 14 nt, Human
uuuuguucuucaga

SEQ ID NO: 3643472 - RNA, 18 nt, Human
uuuuguugacauucugaa

SEQ ID NO: 3643473 - RNA, 19 nt, Human
uuuuguugacauucugaau

SEQ ID NO: 3643474 - RNA, 20 nt, Human
uuuuguugacauucugaaug

SEQ ID NO: 3643475 - RNA, 14 nt, Human
uuuuguugauuaaa

SEQ ID NO: 3643476 - RNA, 12 nt, Human
uuuuguugcacu

SEQ ID NO: 3643477 - RNA, 13 nt, Human
uuuuguugcacug

SEQ ID NO: 3643478 - RNA, 18 nt, Human
uuuuguugcacugaaguu

SEQ ID NO: 3643479 - RNA, 21 nt, Human
uuuuguugcacugaaguuuga

SEQ ID NO: 3643480 - RNA, 16 nt, Human
uuuuguuguaaaaaga

SEQ ID NO: 3643481 - RNA, 19 nt, Human
uuuuguuguacuuaaaugg

SEQ ID NO: 3643482 - RNA, 19 nt, Human
uuuuguuguuucuuaaaua

SEQ ID NO: 3643483 - RNA, 21 nt, Human
uuuuguuguuucuuaaauaag

SEQ ID NO: 3643484 - RNA, 12 nt, Human
uuuuguuucaua

SEQ ID NO: 3643485 - RNA, 16 nt, Human
uuuuguuucauccugu

SEQ ID NO: 3643486 - RNA, 13 nt, Human
uuuuguuugcuau

SEQ ID NO: 3643487 - RNA, 22 nt, Human
uuuuguuugcuucauguguccc

SEQ ID NO: 3643488 - RNA, 12 nt, Human
uuuuguuuggac

SEQ ID NO: 3643489 - RNA, 16 nt, Human
uuuuguuugguaaaug

SEQ ID NO: 3643490 - RNA, 14 nt, Human
uuuuguuugucucu

SEQ ID NO: 3643491 - RNA, 17 nt, Human
uuuuguuugucucuccu

SEQ ID NO: 3643492 - RNA, 22 nt, Human
uuuuguuuuaaaacuggaccug

SEQ ID NO: 3643493 - RNA, 15 nt, Human
uuuuguuuucauuau

SEQ ID NO: 3643494 - RNA, 22 nt, Human
uuuuuaaaaaagcuuaaaacuu

SEQ ID NO: 3643495 - RNA, 23 nt, Human
uuuuuaaaaaagcuuaaaacuuu

SEQ ID NO: 3643496 - RNA, 15 nt, Human
uuuuuaaaaauaaag

SEQ ID NO: 3643497 - RNA, 20 nt, Human
uuuuuaaaagagacaaacug

SEQ ID NO: 3643498 - RNA, 12 nt, Human
uuuuuaaaagau

SEQ ID NO: 3643499 - RNA, 23 nt, Human
uuuuuaaaagaucuucaaaagua

SEQ ID NO: 3643500 - RNA, 11 nt, Human
uuuuuaaaagu

SEQ ID NO: 3643501 - RNA, 22 nt, Human
uuuuuaaaaguuucaaugugau

SEQ ID NO: 3643502 - RNA, 17 nt, Human
uuuuuaaaauauuuauu

SEQ ID NO: 3643503 - RNA, 14 nt, Human
uuuuuaaaaucuua

SEQ ID NO: 3643504 - RNA, 17 nt, Human
uuuuuaaaauggugcuu

SEQ ID NO: 3643505 - RNA, 19 nt, Human
uuuuuaaaauggugcuuaa

SEQ ID NO: 3643506 - RNA, 12 nt, Human
uuuuuaaaauuu

SEQ ID NO: 3643507 - RNA, 16 nt, Human
uuuuuaaaauuuuaau

SEQ ID NO: 3643508 - RNA, 16 nt, Human
uuuuuaaacuguacag

SEQ ID NO: 3643509 - RNA, 17 nt, Human
uuuuuaaagacagaguc

SEQ ID NO: 3643510 - RNA, 12 nt, Human
uuuuuaaagacu

SEQ ID NO: 3643511 - RNA, 13 nt, Human
uuuuuaaagcuua

SEQ ID NO: 3643512 - RNA, 16 nt, Human
uuuuuaaagcuuuuga

SEQ ID NO: 3643513 - RNA, 23 nt, Human
uuuuuaaauaaaaauuacugugu

SEQ ID NO: 3643514 - RNA, 13 nt, Human
uuuuuaaauaaac

SEQ ID NO: 3643515 - RNA, 16 nt, Human
uuuuuaaauauuuucu

SEQ ID NO: 3643516 - RNA, 13 nt, Human
uuuuuaaauuguu

SEQ ID NO: 3643517 - RNA, 20 nt, Human
uuuuuaaauuuuauuuccug

SEQ ID NO: 3643518 - RNA, 19 nt, Human
uuuuuaaauuuuguaauga

SEQ ID NO: 3643519 - RNA, 17 nt, Human
uuuuuaaccucuguuca

SEQ ID NO: 3643520 - RNA, 17 nt, Human
uuuuuaacuuuaccaug

SEQ ID NO: 3643521 - RNA, 11 nt, Human
uuuuuaagaua

SEQ ID NO: 3643522 - RNA, 20 nt, Human
uuuuuaagauaauaauauau

SEQ ID NO: 3643523 - RNA, 18 nt, Human
uuuuuaagccuuaaagga

SEQ ID NO: 3643524 - RNA, 14 nt, Human
uuuuuaagucuuuu

SEQ ID NO: 3643525 - RNA, 16 nt, Human
uuuuuaagugcugcau

SEQ ID NO: 3643526 - RNA, 19 nt, Human
uuuuuaagugcugcauuua

SEQ ID NO: 3643527 - RNA, 23 nt, Human
uuuuuaagugcugcauuuaaaag

SEQ ID NO: 3643528 - RNA, 18 nt, Human
uuuuuaaguuacacauuu

SEQ ID NO: 3643529 - RNA, 18 nt, Human
uuuuuaauaaaaaggcac

SEQ ID NO: 3643530 - RNA, 15 nt, Human
uuuuuaauaaacuac

SEQ ID NO: 3643531 - RNA, 20 nt, Human
uuuuuaauaaagacaggguu

SEQ ID NO: 3643532 - RNA, 14 nt, Human
uuuuuaauaauuua

SEQ ID NO: 3643533 - RNA, 13 nt, Human
uuuuuaaucauga

SEQ ID NO: 3643534 - RNA, 19 nt, Human
uuuuuaauggcagcagaaa

SEQ ID NO: 3643535 - RNA, 22 nt, Human
uuuuuaauggcagcagaaaacu

SEQ ID NO: 3643536 - RNA, 13 nt, Human
uuuuuaauuaaaa

SEQ ID NO: 3643537 - RNA, 14 nt, Human
uuuuuaauuaauug

SEQ ID NO: 3643538 - RNA, 19 nt, Human
uuuuuaauucaccaaagua

SEQ ID NO: 3643539 - RNA, 16 nt, Human
uuuuuaauuguuuaaa

SEQ ID NO: 3643540 - RNA, 21 nt, Human
uuuuuaauuuauuauugaaau

SEQ ID NO: 3643541 - RNA, 17 nt, Human
uuuuuaauuugaugaaa

SEQ ID NO: 3643542 - RNA, 20 nt, Human
uuuuuaauuugaugaaagcu

SEQ ID NO: 3643543 - RNA, 15 nt, Human
uuuuuacaaagcccu

SEQ ID NO: 3643544 - RNA, 23 nt, Human
uuuuuacaaauguuaaaaugugu

SEQ ID NO: 3643545 - RNA, 13 nt, Human
uuuuuacaagaag

SEQ ID NO: 3643546 - RNA, 14 nt, Human
uuuuuacaagaugu

SEQ ID NO: 3643547 - RNA, 20 nt, Human
uuuuuacaaguuauaguacu

SEQ ID NO: 3643548 - RNA, 18 nt, Human
uuuuuacaaguuuuaaau

SEQ ID NO: 3643549 - RNA, 19 nt, Human
uuuuuacaaguuuuaaaua

SEQ ID NO: 3643550 - RNA, 13 nt, Human
uuuuuacaauaaa

SEQ ID NO: 3643551 - RNA, 19 nt, Human
uuuuuacagcuguguuauu

SEQ ID NO: 3643552 - RNA, 12 nt, Human
uuuuuacauuuu

SEQ ID NO: 3643553 - RNA, 20 nt, Human
uuuuuacccauuuguucaua

SEQ ID NO: 3643554 - RNA, 22 nt, Human
uuuuuacguuugaagacauugc

SEQ ID NO: 3643555 - RNA, 17 nt, Human
uuuuuacucauugaaau

SEQ ID NO: 3643556 - RNA, 21 nt, Human
uuuuuacucauugaaauguca

SEQ ID NO: 3643557 - RNA, 18 nt, Human
uuuuuacuguguuuuaua

SEQ ID NO: 3643558 - RNA, 22 nt, Human
uuuuuagacagagucucacugu

SEQ ID NO: 3643559 - RNA, 23 nt, Human
uuuuuaguauuuauuuauguacu

SEQ ID NO: 3643560 - RNA, 15 nt, Human
uuuuuaguugaauuu

SEQ ID NO: 3643561 - RNA, 13 nt, Human
uuuuuauacaaaa

SEQ ID NO: 3643562 - RNA, 17 nt, Human
uuuuuauacaggggaau

SEQ ID NO: 3643563 - RNA, 23 nt, Human
uuuuuauacauaaacaagaccac

SEQ ID NO: 3643564 - RNA, 15 nt, Human
uuuuuauaccauuca

SEQ ID NO: 3643565 - RNA, 17 nt, Human
uuuuuauaccauucaga

SEQ ID NO: 3643566 - RNA, 21 nt, Human
uuuuuauaccuguuuaaauug

SEQ ID NO: 3643567 - RNA, 12 nt, Human
uuuuuauauaca

SEQ ID NO: 3643568 - RNA, 15 nt, Human
uuuuuauauaugugu

SEQ ID NO: 3643569 - RNA, 14 nt, Human
uuuuuauauuucaa

SEQ ID NO: 3643570 - RNA, 22 nt, Human
uuuuuauauuuccuuuauguga

SEQ ID NO: 3643571 - RNA, 12 nt, Human
uuuuuaucaugu

SEQ ID NO: 3643572 - RNA, 17 nt, Human
uuuuuaucuugggacug

SEQ ID NO: 3643573 - RNA, 14 nt, Human
uuuuuaucuuuaua

SEQ ID NO: 3643574 - RNA, 22 nt, Human
uuuuuauggcuuuugugcauua

SEQ ID NO: 3643575 - RNA, 12 nt, Human
uuuuuaugugug

SEQ ID NO: 3643576 - RNA, 13 nt, Human
uuuuuauguuaua

SEQ ID NO: 3643577 - RNA, 19 nt, Human
uuuuuauuaaucacugugu

SEQ ID NO: 3643578 - RNA, 18 nt, Human
uuuuuauuaguauuguug

SEQ ID NO: 3643579 - RNA, 15 nt, Human
uuuuuauuaugcaua

SEQ ID NO: 3643580 - RNA, 13 nt, Human
uuuuuauuauuug

SEQ ID NO: 3643581 - RNA, 15 nt, Human
uuuuuauugaugugc

SEQ ID NO: 3643582 - RNA, 13 nt, Human
uuuuuauugccuu

SEQ ID NO: 3643583 - RNA, 18 nt, Human
uuuuuauugcuaguauuu

SEQ ID NO: 3643584 - RNA, 12 nt, Human
uuuuuauuguug

SEQ ID NO: 3643585 - RNA, 21 nt, Human
uuuuuauuuauauguaugugu

SEQ ID NO: 3643586 - RNA, 15 nt, Human
uuuuuauuucuacug

SEQ ID NO: 3643587 - RNA, 16 nt, Human
uuuuuauuucuacugu

SEQ ID NO: 3643588 - RNA, 12 nt, Human
uuuuuauuucug

SEQ ID NO: 3643589 - RNA, 13 nt, Human
uuuuucaaaagaa

SEQ ID NO: 3643590 - RNA, 16 nt, Human
uuuuucaacuuugaau

SEQ ID NO: 3643591 - RNA, 16 nt, Human
uuuuucaauauauuga

SEQ ID NO: 3643592 - RNA, 12 nt, Human
uuuuucaauuaa

SEQ ID NO: 3643593 - RNA, 19 nt, Human
uuuuucaauuaaacggauu

SEQ ID NO: 3643594 - RNA, 20 nt, Human
uuuuucaauuaaacggauua

SEQ ID NO: 3643595 - RNA, 16 nt, Human
uuuuucacggaaguuu

SEQ ID NO: 3643596 - RNA, 19 nt, Human
uuuuucacucuaagucaug

SEQ ID NO: 3643597 - RNA, 14 nt, Human
uuuuucagaaauau

SEQ ID NO: 3643598 - RNA, 10 nt, Human
uuuuucagac

SEQ ID NO: 3643599 - RNA, 11 nt, Human
uuuuucagacc

SEQ ID NO: 3643600 - RNA, 20 nt, Human
uuuuucaggagcgcaagaua

SEQ ID NO: 3643601 - RNA, 17 nt, Human
uuuuucaguauuauaug

SEQ ID NO: 3643602 - RNA, 14 nt, Human
uuuuucaguuccaa

SEQ ID NO: 3643603 - RNA, 17 nt, Human
uuuuucaguuccaagaa

SEQ ID NO: 3643604 - RNA, 21 nt, Human
uuuuucaguuccaagaaagau

SEQ ID NO: 3643605 - RNA, 16 nt, Human
uuuuucaguuguucuu

SEQ ID NO: 3643606 - RNA, 15 nt, Human
uuuuucaguuuucag

SEQ ID NO: 3643607 - RNA, 16 nt, Human
uuuuucaucuucaguu

SEQ ID NO: 3643608 - RNA, 19 nt, Human
acuauucuugauguaaaau

SEQ ID NO: 3643609 - RNA, 20 nt, Human
acuauucuugauguaaaauc

SEQ ID NO: 3643610 - RNA, 15 nt, Human
acuauugcauuuuac

SEQ ID NO: 3643611 - RNA, 14 nt, Human
acuauuggaaagua

SEQ ID NO: 3643612 - RNA, 13 nt, Human
acuauuggagggu

SEQ ID NO: 3643613 - RNA, 13 nt, Human
acuauuuaaacuu

SEQ ID NO: 3643614 - RNA, 16 nt, Human
acuauuuaaacuuaua

SEQ ID NO: 3643615 - RNA, 11 nt, Human
acuauuuaaag

SEQ ID NO: 3643616 - RNA, 12 nt, Human
acuauuuaacug

SEQ ID NO: 3643617 - RNA, 13 nt, Human
acuauuuaacuga

SEQ ID NO: 3643618 - RNA, 15 nt, Human
acuauuuaacugacu

SEQ ID NO: 3643619 - RNA, 14 nt, Human
acuauuuaacuuga

SEQ ID NO: 3643620 - RNA, 20 nt, Human
acuauuuauugacucugggu

SEQ ID NO: 3643621 - RNA, 16 nt, Human
acuauuuauuuacaaa

SEQ ID NO: 3643622 - RNA, 18 nt, Human
acuauuuauuuacaaaug

SEQ ID NO: 3643623 - RNA, 19 nt, Human
acuauuuauuuacaaaugu

SEQ ID NO: 3643624 - RNA, 13 nt, Human
acuauuuccuuua

SEQ ID NO: 3643625 - RNA, 22 nt, Human
acuauuucugggucuuuugcua

SEQ ID NO: 3643626 - RNA, 23 nt, Human
acuauuucugggucuuuugcuac

SEQ ID NO: 3643627 - RNA, 18 nt, Human
acuauuugucuuucagga

SEQ ID NO: 3643628 - RNA, 13 nt, Human
acuauuuuacuuc

SEQ ID NO: 3643629 - RNA, 15 nt, Human
acuauuuuaugcaaa

SEQ ID NO: 3643630 - RNA, 11 nt, Human
acuauuuuauu

SEQ ID NO: 3643631 - RNA, 14 nt, Human
acuauuuucagaau

SEQ ID NO: 3643632 - RNA, 17 nt, Human
acuauuuucagaaucug

SEQ ID NO: 3643633 - RNA, 14 nt, Human
acuauuuucuuuuu

SEQ ID NO: 3643634 - RNA, 13 nt, Human
acuauuuuuacug

SEQ ID NO: 3643635 - RNA, 22 nt, Human
acuauuuuuguuuuuauuaaaa

SEQ ID NO: 3643636 - RNA, 13 nt, Human
acucaaaagcugg

SEQ ID NO: 3643637 - RNA, 20 nt, Human
acucaaaauauuuguacaua

SEQ ID NO: 3643638 - RNA, 15 nt, Human
acucaaacacagaga

SEQ ID NO: 3643639 - RNA, 19 nt, Human
acucaaaccaaaucacuga

SEQ ID NO: 3643640 - RNA, 16 nt, Human
acucaaacuucuggcu

SEQ ID NO: 3643641 - RNA, 23 nt, Human
acucaaacuuuuccccuguccug

SEQ ID NO: 3643642 - RNA, 19 nt, Human
acucaaaguuucagagacc

SEQ ID NO: 3643643 - RNA, 14 nt, Human
acucaaaucaagaa

SEQ ID NO: 3643644 - RNA, 17 nt, Human
acucaaaugaguaacau

SEQ ID NO: 3643645 - RNA, 18 nt, Human
acucaaaugcucagacca

SEQ ID NO: 3643646 - RNA, 23 nt, Human
acucaaaugcucagaccagcucu

SEQ ID NO: 3643647 - RNA, 16 nt, Human
acucaaauguucuaag

SEQ ID NO: 3643648 - RNA, 17 nt, Human
acucaaauguucuaagu

SEQ ID NO: 3643649 - RNA, 19 nt, Human
acucaaauuaaucuuucuu

SEQ ID NO: 3643650 - RNA, 23 nt, Human
acucaaauuuuggcgaaucucaa

SEQ ID NO: 3643651 - RNA, 19 nt, Human
acucaacaugagucaagag

SEQ ID NO: 3643652 - RNA, 23 nt, Human
acucaacauguuacugaccagca

SEQ ID NO: 3643653 - RNA, 16 nt, Human
acucaaccaaauggua

SEQ ID NO: 3643654 - RNA, 13 nt, Human
acucaacccucuc

SEQ ID NO: 3643655 - RNA, 17 nt, Human
acucaagacuuccagag

SEQ ID NO: 3643656 - RNA, 20 nt, Human
acucaagacuuccagagccu

SEQ ID NO: 3643657 - RNA, 15 nt, Human
acucaagaggcugag

SEQ ID NO: 3643658 - RNA, 15 nt, Human
acucaagcacugaua

SEQ ID NO: 3643659 - RNA, 11 nt, Human
acucaagccaa

SEQ ID NO: 3643660 - RNA, 17 nt, Human
acucaagccaagcagcc

SEQ ID NO: 3643661 - RNA, 14 nt, Human
acucaagcccgcgg

SEQ ID NO: 3643662 - RNA, 17 nt, Human
acucaagcggguggcuc

SEQ ID NO: 3643663 - RNA, 17 nt, Human
acucaaguucaaggacc

SEQ ID NO: 3643664 - RNA, 15 nt, Human
acucaauauuuucca

SEQ ID NO: 3643665 - RNA, 22 nt, Human
acucaauauuuuccaugaaaau

SEQ ID NO: 3643666 - RNA, 14 nt, Human
acucaaugcacuga

SEQ ID NO: 3643667 - RNA, 16 nt, Human
acucaaugcacugaca

SEQ ID NO: 3643668 - RNA, 12 nt, Human
acucaaugcuuu

SEQ ID NO: 3643669 - RNA, 15 nt, Human
acucaaugcuuuauu

SEQ ID NO: 3643670 - RNA, 19 nt, Human
acucaaugcuuuauuugua

SEQ ID NO: 3643671 - RNA, 20 nt, Human
acucaaugcuuuauuuguaa

SEQ ID NO: 3643672 - RNA, 22 nt, Human
acucaaugcuuuauuuguaaau

SEQ ID NO: 3643673 - RNA, 19 nt, Human
acucaauggaguaugucug

SEQ ID NO: 3643674 - RNA, 23 nt, Human
acucaauggaguaugucugaugg

SEQ ID NO: 3643675 - RNA, 19 nt, Human
acucaaugugugccgagcc

SEQ ID NO: 3643676 - RNA, 21 nt, Human
acucaauguuacuaucugcuu

SEQ ID NO: 3643677 - RNA, 22 nt, Human
acucacaagugcucaucuguug

SEQ ID NO: 3643678 - RNA, 15 nt, Human
acucacacagccagg

SEQ ID NO: 3643679 - RNA, 22 nt, Human
acucacacagccaggugccuug

SEQ ID NO: 3643680 - RNA, 12 nt, Human
acucacacaggc

SEQ ID NO: 3643681 - RNA, 22 nt, Human
acucacacaggcauuuccuggg

SEQ ID NO: 3643682 - RNA, 19 nt, Human
acucacagaccuggagccc

SEQ ID NO: 3643683 - RNA, 16 nt, Human
acucacagagacacag

SEQ ID NO: 3643684 - RNA, 22 nt, Human
acucacaugcuggacaggucug

SEQ ID NO: 3643685 - RNA, 16 nt, Human
acucacauggcuaugu

SEQ ID NO: 3643686 - RNA, 20 nt, Human
acucacauggcuauguuuua

SEQ ID NO: 3643687 - RNA, 21 nt, Human
acucaccagccccacugccag

SEQ ID NO: 3643688 - RNA, 19 nt, Human
acucaccaguguccccucc

SEQ ID NO: 3643689 - RNA, 15 nt, Human
acucaccaucugugc

SEQ ID NO: 3643690 - RNA, 18 nt, Human
acucaccaugaagcgaaa

SEQ ID NO: 3643691 - RNA, 18 nt, Human
acucacccccaaggggca

SEQ ID NO: 3643692 - RNA, 16 nt, Human
acucaccuaauguuua

SEQ ID NO: 3643693 - RNA, 23 nt, Human
acucaccuaauguuuaugagcca

SEQ ID NO: 3643694 - RNA, 19 nt, Human
acucaccucccccaucucu

SEQ ID NO: 3643695 - RNA, 16 nt, Human
acucaccucuaaaaca

SEQ ID NO: 3643696 - RNA, 11 nt, Human
acucaccucug

SEQ ID NO: 3643697 - RNA, 14 nt, Human
acucaccucugccu

SEQ ID NO: 3643698 - RNA, 17 nt, Human
acucaccucugccucaa

SEQ ID NO: 3643699 - RNA, 22 nt, Human
acucaccugcacuaacagagug

SEQ ID NO: 3643700 - RNA, 13 nt, Human
acucaccugcugg

SEQ ID NO: 3643701 - RNA, 16 nt, Human
acucaccugcuggccc

SEQ ID NO: 3643702 - RNA, 17 nt, Human
acucaccugcuggcccc

SEQ ID NO: 3643703 - RNA, 12 nt, Human
acucaccugggg

SEQ ID NO: 3643704 - RNA, 18 nt, Human
acucaccuggggcugcug

SEQ ID NO: 3643705 - RNA, 19 nt, Human
acucacguggguccugagg

SEQ ID NO: 3643706 - RNA, 20 nt, Human
acucacuaauucauuaaucu

SEQ ID NO: 3643707 - RNA, 17 nt, Human
acucacuaggcccccac

SEQ ID NO: 3643708 - RNA, 19 nt, Human
acucacucaaguucaagga

SEQ ID NO: 3643709 - RNA, 16 nt, Human
acucacuccuuuuaaa

SEQ ID NO: 3643710 - RNA, 22 nt, Human
acucacugcucaagaagacaug

SEQ ID NO: 3643711 - RNA, 17 nt, Human
acucacuggcagcccca

SEQ ID NO: 3643712 - RNA, 19 nt, Human
acucacuggugguuuuccg

SEQ ID NO: 3643713 - RNA, 15 nt, Human
acucacuuucuagau

SEQ ID NO: 3643714 - RNA, 17 nt, Human
acucacuuuucccacuc

SEQ ID NO: 3643715 - RNA, 13 nt, Human
acucagaaauuca

SEQ ID NO: 3643716 - RNA, 21 nt, Human
acucagaaauuuaauucaugu

SEQ ID NO: 3643717 - RNA, 21 nt, Human
acucagaacugucggaggaaa

SEQ ID NO: 3643718 - RNA, 14 nt, Human
acucagaagacacu

SEQ ID NO: 3643719 - RNA, 16 nt, Human
acucagaagacacuga

SEQ ID NO: 3643720 - RNA, 17 nt, Human
acucagaagacacugau

SEQ ID NO: 3643721 - RNA, 13 nt, Human
acuaaauuugaua

SEQ ID NO: 3643722 - RNA, 17 nt, Human
acuaaauuugauacuua

SEQ ID NO: 3643723 - RNA, 18 nt, Human
acuaaauuugauacuuau

SEQ ID NO: 3643724 - RNA, 22 nt, Human
acuaaauuugauacuuauauuu

SEQ ID NO: 3643725 - RNA, 19 nt, Human
acuaaauuuggggacagau

SEQ ID NO: 3643726 - RNA, 15 nt, Human
acuaacacucagaag

SEQ ID NO: 3643727 - RNA, 17 nt, Human
acuaacacucagaagcc

SEQ ID NO: 3643728 - RNA, 17 nt, Human
acuaacaggauauuuaa

SEQ ID NO: 3643729 - RNA, 12 nt, Human
acuaacaggcuu

SEQ ID NO: 3643730 - RNA, 12 nt, Human
acuaacauuaua

SEQ ID NO: 3643731 - RNA, 14 nt, Human
acuaaccaaaucuc

SEQ ID NO: 3643732 - RNA, 17 nt, Human
acuaaccagcagaaaug

SEQ ID NO: 3643733 - RNA, 23 nt, Human
acuaaccagggaagcugucccuc

SEQ ID NO: 3643734 - RNA, 17 nt, Human
acuaaccccaacgcaca

SEQ ID NO: 3643735 - RNA, 15 nt, Human
acuaaccuugccugg

SEQ ID NO: 3643736 - RNA, 21 nt, Human
acuaaccuugccugguacagu

SEQ ID NO: 3643737 - RNA, 14 nt, Human
acuaacuaaaacaa

SEQ ID NO: 3643738 - RNA, 15 nt, Human
acuaacuaaaacaaa

SEQ ID NO: 3643739 - RNA, 13 nt, Human
acuaacuaaacuc

SEQ ID NO: 3643740 - RNA, 13 nt, Human
acuaacuagagca

SEQ ID NO: 3643741 - RNA, 19 nt, Human
acuaagaaccccucugcuu

SEQ ID NO: 3643742 - RNA, 18 nt, Human
acuaagaauucaaacugg

SEQ ID NO: 3643743 - RNA, 15 nt, Human
acuaagagagaauga

SEQ ID NO: 3643744 - RNA, 15 nt, Human
acuaagagucucuau

SEQ ID NO: 3643745 - RNA, 20 nt, Human
acuaagaucgguuaacaaau

SEQ ID NO: 3643746 - RNA, 17 nt, Human
acuaagaugacauugcu

SEQ ID NO: 3643747 - RNA, 19 nt, Human
acuaagaugacauugcuaa

SEQ ID NO: 3643748 - RNA, 13 nt, Human
acuaagauucuuu

SEQ ID NO: 3643749 - RNA, 17 nt, Human
acuaagauucuuuuaaa

SEQ ID NO: 3643750 - RNA, 13 nt, Human
acuaagcagagga

SEQ ID NO: 3643751 - RNA, 22 nt, Human
acuaagcagaggaggggccgcu

SEQ ID NO: 3643752 - RNA, 16 nt, Human
acuaagccacaagaaa

SEQ ID NO: 3643753 - RNA, 16 nt, Human
acuaagcccugucgag

SEQ ID NO: 3643754 - RNA, 20 nt, Human
aggaaccuggaccaaagcug

SEQ ID NO: 3643755 - RNA, 20 nt, Human
aggaacgguaaauuucugug

SEQ ID NO: 3643756 - RNA, 14 nt, Human
aggaacucccagca

SEQ ID NO: 3643757 - RNA, 18 nt, Human
aggaacucuggcuuccag

SEQ ID NO: 3643758 - RNA, 19 nt, Human
aggaacucuggcuuccagg

SEQ ID NO: 3643759 - RNA, 13 nt, Human
aggaacugcagca

SEQ ID NO: 3643760 - RNA, 16 nt, Human
aggaacugcugggcuu

SEQ ID NO: 3643761 - RNA, 18 nt, Human
aggaacugggccuguugc

SEQ ID NO: 3643762 - RNA, 23 nt, Human
aggaacuuaaauaaugugaaacu

SEQ ID NO: 3643763 - RNA, 14 nt, Human
aggaacuuccaggu

SEQ ID NO: 3643764 - RNA, 14 nt, Human
aggaagaaaaauca

SEQ ID NO: 3643765 - RNA, 17 nt, Human
aggaagaaacagaagag

SEQ ID NO: 3643766 - RNA, 21 nt, Human
aggaagaacacccucuaaaug

SEQ ID NO: 3643767 - RNA, 16 nt, Human
aggaagaacguuuuuu

SEQ ID NO: 3643768 - RNA, 17 nt, Human
aggaagaagcuuaggca

SEQ ID NO: 3643769 - RNA, 17 nt, Human
aggaagaauuuuaaaaa

SEQ ID NO: 3643770 - RNA, 23 nt, Human
aggaagaauuuuaaaaaugaauc

SEQ ID NO: 3643771 - RNA, 17 nt, Human
aggaagacaguucuaca

SEQ ID NO: 3643772 - RNA, 18 nt, Human
aggaagacccaacacaug

SEQ ID NO: 3643773 - RNA, 19 nt, Human
aggaagacuucaucccucu

SEQ ID NO: 3643774 - RNA, 15 nt, Human
aggaagacuuuggaa

SEQ ID NO: 3643775 - RNA, 14 nt, Human
aggaagagaaacca

SEQ ID NO: 3643776 - RNA, 14 nt, Human
aggaagagagcaug

SEQ ID NO: 3643777 - RNA, 23 nt, Human
aggaagagcaggcacauggagga

SEQ ID NO: 3643778 - RNA, 17 nt, Human
aggaagagccuuccacc

SEQ ID NO: 3643779 - RNA, 19 nt, Human
aggaagagccuuccaccca

SEQ ID NO: 3643780 - RNA, 21 nt, Human
aggaagagccuuccacccagg

SEQ ID NO: 3643781 - RNA, 20 nt, Human
aggaagaggggaagcagaaa

SEQ ID NO: 3643782 - RNA, 15 nt, Human
aggaagagucuuggu

SEQ ID NO: 3643783 - RNA, 22 nt, Human
aggaagauauacaugaaaauuu

SEQ ID NO: 3643784 - RNA, 16 nt, Human
aggaagaucccccaga

SEQ ID NO: 3643785 - RNA, 18 nt, Human
aggaagaucccccagaaa

SEQ ID NO: 3643786 - RNA, 16 nt, Human
aggaagaucuuaaauu

SEQ ID NO: 3643787 - RNA, 17 nt, Human
aggaagcacaugccucu

SEQ ID NO: 3643788 - RNA, 22 nt, Human
aggaagcacaugccucucucag

SEQ ID NO: 3643789 - RNA, 24 nt, Human
aggaagcacaugccucucucaggc

SEQ ID NO: 3643790 - RNA, 18 nt, Human
aggaagcaccccaugcca

SEQ ID NO: 3643791 - RNA, 15 nt, Human
aggaagcagaauaaa

SEQ ID NO: 3643792 - RNA, 19 nt, Human
aggaagcagaauaaagcaa

SEQ ID NO: 3643793 - RNA, 21 nt, Human
aggaagcagaauaaagcaauu

SEQ ID NO: 3643794 - RNA, 22 nt, Human
aggaagcagaauaaagcaauuu

SEQ ID NO: 3643795 - RNA, 15 nt, Human
aggaagccaaagagu

SEQ ID NO: 3643796 - RNA, 15 nt, Human
aggaagccaaauuua

SEQ ID NO: 3643797 - RNA, 16 nt, Human
aggaagccacagcugg

SEQ ID NO: 3643798 - RNA, 21 nt, Human
aggaagccagcaggcucucag

SEQ ID NO: 3643799 - RNA, 20 nt, Human
aggaagcccaggagccucac

SEQ ID NO: 3643800 - RNA, 19 nt, Human
aggaagccgcuggggccag

SEQ ID NO: 3643801 - RNA, 14 nt, Human
aggaagccguccug

SEQ ID NO: 3643802 - RNA, 20 nt, Human
aggaagccucagauuccuuc

SEQ ID NO: 3643803 - RNA, 12 nt, Human
aggaagccuucc

SEQ ID NO: 3643804 - RNA, 12 nt, Human
aggaagcucagg

SEQ ID NO: 3643805 - RNA, 15 nt, Human
aggaagcucagggcc

SEQ ID NO: 3643806 - RNA, 16 nt, Human
aggaagcucagggccu

SEQ ID NO: 3643807 - RNA, 17 nt, Human
aggaagcucagggccug

SEQ ID NO: 3643808 - RNA, 18 nt, Human
aggaagcucagggccugg

SEQ ID NO: 3643809 - RNA, 19 nt, Human
aggaagcuccaguccugcu

SEQ ID NO: 3643810 - RNA, 20 nt, Human
aggaagcuccaguccugcuc

SEQ ID NO: 3643811 - RNA, 18 nt, Human
aggaagcugugagagcag

SEQ ID NO: 3643812 - RNA, 13 nt, Human
aggaagcuuucuc

SEQ ID NO: 3643813 - RNA, 18 nt, Human
aggaagcuuucucugcuu

SEQ ID NO: 3643814 - RNA, 19 nt, Human
aggaagcuuucucugcuuc

SEQ ID NO: 3643815 - RNA, 12 nt, Human
aggaaggaaaga

SEQ ID NO: 3643816 - RNA, 16 nt, Human
aggaaggacuaugaaa

SEQ ID NO: 3643817 - RNA, 19 nt, Human
aggaaggagacucaccucu

SEQ ID NO: 3643818 - RNA, 18 nt, Human
aggaaggagagccugcug

SEQ ID NO: 3643819 - RNA, 13 nt, Human
aggaaggagcugc

SEQ ID NO: 3643820 - RNA, 18 nt, Human
aggaaggagcugccugga

SEQ ID NO: 3643821 - RNA, 19 nt, Human
aggaaggagcugccuggac

SEQ ID NO: 3643822 - RNA, 20 nt, Human
aggaaggaggacccaggaca

SEQ ID NO: 3643823 - RNA, 14 nt, Human
aggaaggauuguaa

SEQ ID NO: 3643824 - RNA, 18 nt, Human
aggaaggauuguaaaaaa

SEQ ID NO: 3643825 - RNA, 13 nt, Human
aggaaggcaagag

SEQ ID NO: 3643826 - RNA, 14 nt, Human
aggaaggcaagagg

SEQ ID NO: 3643827 - RNA, 15 nt, Human
aggaaggcaggaaga

SEQ ID NO: 3643828 - RNA, 18 nt, Human
aggaaggcagggaggagg

SEQ ID NO: 3643829 - RNA, 20 nt, Human
aggaaggcagggaggaggca

SEQ ID NO: 3643830 - RNA, 22 nt, Human
aggaaggcugagaggagagaga

SEQ ID NO: 3643831 - RNA, 15 nt, Human
aggaaggcugucuca

SEQ ID NO: 3643832 - RNA, 19 nt, Human
aggaaggcuuguugugcuu

SEQ ID NO: 3643833 - RNA, 22 nt, Human
aggaaggcuuguugugcuuuua

SEQ ID NO: 3643834 - RNA, 17 nt, Human
aggaagggaccaaggca

SEQ ID NO: 3643835 - RNA, 19 nt, Human
aggaagggauguauuugua

SEQ ID NO: 3643836 - RNA, 17 nt, Human
aggaagggcaggaagga

SEQ ID NO: 3643837 - RNA, 12 nt, Human
aggaaggggcug

SEQ ID NO: 3643838 - RNA, 16 nt, Human
aggaaggggcuggacu

SEQ ID NO: 3643839 - RNA, 19 nt, Human
aggaagggggguugcagug

SEQ ID NO: 3643840 - RNA, 16 nt, Human
aggaaggucauuucca

SEQ ID NO: 3643841 - RNA, 18 nt, Human
aggaaggucauuuccaug

SEQ ID NO: 3643842 - RNA, 17 nt, Human
aggaaggucucauucuu

SEQ ID NO: 3643843 - RNA, 15 nt, Human
aggaagguggauggc

SEQ ID NO: 3643844 - RNA, 14 nt, Human
aggaaggugguggg

SEQ ID NO: 3643845 - RNA, 14 nt, Human
aggaagguucuggu

SEQ ID NO: 3643846 - RNA, 21 nt, Human
aggaagguucuggugugaacu

SEQ ID NO: 3643847 - RNA, 14 nt, Human
aggaagguuuucuc

SEQ ID NO: 3643848 - RNA, 19 nt, Human
aggaaguacuggagaaaau

SEQ ID NO: 3643849 - RNA, 14 nt, Human
aggaaguagaaaca

SEQ ID NO: 3643850 - RNA, 13 nt, Human
aggaaguagagga

SEQ ID NO: 3643851 - RNA, 18 nt, Human
aggaaguagcacaggcug

SEQ ID NO: 3643852 - RNA, 20 nt, Human
aggaagucucaucuggggag

SEQ ID NO: 3643853 - RNA, 16 nt, Human
aggaaguguaacagcu

SEQ ID NO: 3643854 - RNA, 18 nt, Human
aggaaguugacuuauagu

SEQ ID NO: 3643855 - RNA, 15 nt, Human
aggaaguuuucugua

SEQ ID NO: 3643856 - RNA, 21 nt, Human
aggaauaaauaaaaauggaua

SEQ ID NO: 3643857 - RNA, 19 nt, Human
aggaauaaauugcuccuug

SEQ ID NO: 3643858 - RNA, 20 nt, Human
aggaauaaauugcuccuuga

SEQ ID NO: 3643859 - RNA, 12 nt, Human
aggaauaagaau

SEQ ID NO: 3643860 - RNA, 14 nt, Human
aggaauaaggccuu

SEQ ID NO: 3643861 - RNA, 23 nt, Human
aggaauaaugggcuuagagcagu

SEQ ID NO: 3643862 - RNA, 16 nt, Human
aggaauaauuauuuau

SEQ ID NO: 3643863 - RNA, 14 nt, Human
auaaucagccucuu

SEQ ID NO: 3643864 - RNA, 15 nt, Human
auaaucagccucuua

SEQ ID NO: 3643865 - RNA, 17 nt, Human
auaaucagccucuuaaa

SEQ ID NO: 3643866 - RNA, 19 nt, Human
auaaucaucaaguaauaca

SEQ ID NO: 3643867 - RNA, 18 nt, Human
auaaucaucucugucaca

SEQ ID NO: 3643868 - RNA, 16 nt, Human
auaaucccagcacuuu

SEQ ID NO: 3643869 - RNA, 20 nt, Human
auaaucccuggaugauauuu

SEQ ID NO: 3643870 - RNA, 14 nt, Human
auaauccugcaaag

SEQ ID NO: 3643871 - RNA, 20 nt, Human
auaauccugugaaaauauga

SEQ ID NO: 3643872 - RNA, 16 nt, Human
auaauccuuaaaucuu

SEQ ID NO: 3643873 - RNA, 18 nt, Human
auaauccuugauaauaua

SEQ ID NO: 3643874 - RNA, 12 nt, Human
auaaucuagaac

SEQ ID NO: 3643875 - RNA, 13 nt, Human
auaaucugauuug

SEQ ID NO: 3643876 - RNA, 12 nt, Human
auaaucugucaa

SEQ ID NO: 3643877 - RNA, 20 nt, Human
auaaucugucaaaacacugu

SEQ ID NO: 3643878 - RNA, 21 nt, Human
auaaucuuucacaggggacag

SEQ ID NO: 3643879 - RNA, 12 nt, Human
auaaugaagccc

SEQ ID NO: 3643880 - RNA, 14 nt, Human
auaaugaauacuuu

SEQ ID NO: 3643881 - RNA, 15 nt, Human
auaaugagcuauuaa

SEQ ID NO: 3643882 - RNA, 19 nt, Human
auaaugcaaagaaucccua

SEQ ID NO: 3643883 - RNA, 13 nt, Human
auaaugcaguaug

SEQ ID NO: 3643884 - RNA, 14 nt, Human
auaaugcaguaugg

SEQ ID NO: 3643885 - RNA, 19 nt, Human
auaaugcaguaugguacau

SEQ ID NO: 3643886 - RNA, 20 nt, Human
auaaugccauuuuaaggaaa

SEQ ID NO: 3643887 - RNA, 15 nt, Human
auaaugccuuuguaa

SEQ ID NO: 3643888 - RNA, 16 nt, Human
auaaugccuuuguaac

SEQ ID NO: 3643889 - RNA, 21 nt, Human
auaaugcgugcauaccacuuu

SEQ ID NO: 3643890 - RNA, 17 nt, Human
auaaugcuacaauuuua

SEQ ID NO: 3643891 - RNA, 20 nt, Human
auaaugcuacaauuuuaaga

SEQ ID NO: 3643892 - RNA, 14 nt, Human
auaauggaaaaaaa

SEQ ID NO: 3643893 - RNA, 16 nt, Human
auaauggaaaaugcca

SEQ ID NO: 3643894 - RNA, 17 nt, Human
auaauggaagagaaauc

SEQ ID NO: 3643895 - RNA, 21 nt, Human
auaauggaagagaaaucucau

SEQ ID NO: 3643896 - RNA, 19 nt, Human
auaauggacagauuaauau

SEQ ID NO: 3643897 - RNA, 20 nt, Human
auaauggucccauccaggca

SEQ ID NO: 3643898 - RNA, 18 nt, Human
auaaugguugacuggguu

SEQ ID NO: 3643899 - RNA, 23 nt, Human
aggaauucuguauagauuagaau

SEQ ID NO: 3643900 - RNA, 19 nt, Human
aggaauugacccacaagaa

SEQ ID NO: 3643901 - RNA, 19 nt, Human
aggaauuucccaggacccu

SEQ ID NO: 3643902 - RNA, 15 nt, Human
aggaauuucugagug

SEQ ID NO: 3643903 - RNA, 15 nt, Human
aggaauuucuuaacu

SEQ ID NO: 3643904 - RNA, 23 nt, Human
aggaauuucuuaacuucuugcuu

SEQ ID NO: 3643905 - RNA, 19 nt, Human
aggacaaaaaugaacugaa

SEQ ID NO: 3643906 - RNA, 13 nt, Human
aggacaaaacuuc

SEQ ID NO: 3643907 - RNA, 15 nt, Human
aggacaaaacuucuu

SEQ ID NO: 3643908 - RNA, 21 nt, Human
aggacaaaacuucuugucaga

SEQ ID NO: 3643909 - RNA, 22 nt, Human
aggacaaaacuucuugucagac

SEQ ID NO: 3643910 - RNA, 19 nt, Human
aggacaaagugccaaagaa

SEQ ID NO: 3643911 - RNA, 21 nt, Human
aggacaaaucugcaaagcaug

SEQ ID NO: 3643912 - RNA, 16 nt, Human
aggacaacgaggaagc

SEQ ID NO: 3643913 - RNA, 18 nt, Human
aggacaaggugcaggcag

SEQ ID NO: 3643914 - RNA, 20 nt, Human
aggacaaggugcaggcaggc

SEQ ID NO: 3643915 - RNA, 23 nt, Human
aggacaaggugcaggcaggcugg

SEQ ID NO: 3643916 - RNA, 19 nt, Human
aggacaaucaguccccucc

SEQ ID NO: 3643917 - RNA, 20 nt, Human
aggacaaucaguccccuccc

SEQ ID NO: 3643918 - RNA, 22 nt, Human
aggacaaucaguccccucccau

SEQ ID NO: 3643919 - RNA, 23 nt, Human
aggacacacuaaucgaacuauga

SEQ ID NO: 3643920 - RNA, 12 nt, Human
aggacacaggcc

SEQ ID NO: 3643921 - RNA, 15 nt, Human
aggacacaggccugu

SEQ ID NO: 3643922 - RNA, 21 nt, Human
aggacaccacacccagccuca

SEQ ID NO: 3643923 - RNA, 22 nt, Human
aggacaccacacccagccucag

SEQ ID NO: 3643924 - RNA, 23 nt, Human
aggacaccacacccagccucagu

SEQ ID NO: 3643925 - RNA, 18 nt, Human
aggacaccuguacuggag

SEQ ID NO: 3643926 - RNA, 19 nt, Human
aggacaccuguacuggaga

SEQ ID NO: 3643927 - RNA, 22 nt, Human
aggacacgcgccccccucccag

SEQ ID NO: 3643928 - RNA, 18 nt, Human
aggacacgggccugucca

SEQ ID NO: 3643929 - RNA, 23 nt, Human
aggacacuaaccacgcuggaccu

SEQ ID NO: 3643930 - RNA, 14 nt, Human
aggacacuuccugc

SEQ ID NO: 3643931 - RNA, 13 nt, Human
aggacagaaagga

SEQ ID NO: 3643932 - RNA, 23 nt, Human
aggacagaaaggagaguggccau

SEQ ID NO: 3643933 - RNA, 16 nt, Human
aggacagaaggcuccu

SEQ ID NO: 3643934 - RNA, 21 nt, Human
aggacagaaggcuccugcccc

SEQ ID NO: 3643935 - RNA, 14 nt, Human
aggacagagagaaa

SEQ ID NO: 3643936 - RNA, 17 nt, Human
aggacagaugccuccuu

SEQ ID NO: 3643937 - RNA, 21 nt, Human
aggacagaugccuccuuccuc

SEQ ID NO: 3643938 - RNA, 16 nt, Human
aggacaggagaugcug

SEQ ID NO: 3643939 - RNA, 20 nt, Human
aggacaggauccaggccggc

SEQ ID NO: 3643940 - RNA, 16 nt, Human
aggacaggcugcggcc

SEQ ID NO: 3643941 - RNA, 21 nt, Human
aggacaggcugcggccccucc

SEQ ID NO: 3643942 - RNA, 15 nt, Human
aggacagggguuccu

SEQ ID NO: 3643943 - RNA, 15 nt, Human
aggacagugcuucag

SEQ ID NO: 3643944 - RNA, 18 nt, Human
aggacagugcuucagccu

SEQ ID NO: 3643945 - RNA, 19 nt, Human
aggacagugcuucagccug

SEQ ID NO: 3643946 - RNA, 20 nt, Human
aggacagugcuucagccuga

SEQ ID NO: 3643947 - RNA, 21 nt, Human
aggacagugcuugauacagga

SEQ ID NO: 3643948 - RNA, 20 nt, Human
aggacauaaugggguccugg

SEQ ID NO: 3643949 - RNA, 16 nt, Human
aggacaucagcaaaca

SEQ ID NO: 3643950 - RNA, 13 nt, Human
aggacaugcaaua

SEQ ID NO: 3643951 - RNA, 16 nt, Human
aggacaugcaauaaaa

SEQ ID NO: 3643952 - RNA, 22 nt, Human
aggacaugcaauaaaauuuaaa

SEQ ID NO: 3643953 - RNA, 22 nt, Human
aggacaugcgguagccagcaca

SEQ ID NO: 3643954 - RNA, 21 nt, Human
aggacauggcuucugaaccug

SEQ ID NO: 3643955 - RNA, 15 nt, Human
aggacauuaugugug

SEQ ID NO: 3643956 - RNA, 18 nt, Human
aggaccaacaagggcagu

SEQ ID NO: 3643957 - RNA, 19 nt, Human
aggaccaagcaucuugggg

SEQ ID NO: 3643958 - RNA, 17 nt, Human
aggaccacucagccccu

SEQ ID NO: 3643959 - RNA, 12 nt, Human
aggaccagccca

SEQ ID NO: 3643960 - RNA, 13 nt, Human
aggaccagcuggg

SEQ ID NO: 3643961 - RNA, 23 nt, Human
aggaccaggacuauagcccaggu

SEQ ID NO: 3643962 - RNA, 13 nt, Human
aggaccaggacuc

SEQ ID NO: 3643963 - RNA, 19 nt, Human
aggaccaggacucccuccu

SEQ ID NO: 3643964 - RNA, 18 nt, Human
aggaccaggauccagccu

SEQ ID NO: 3643965 - RNA, 13 nt, Human
aggaccaggcaau

SEQ ID NO: 3643966 - RNA, 12 nt, Human
aggaccagggcu

SEQ ID NO: 3643967 - RNA, 22 nt, Human
aggaccaggguuggcaccuucc

SEQ ID NO: 3643968 - RNA, 12 nt, Human
aggacccaagca

SEQ ID NO: 3643969 - RNA, 15 nt, Human
aggacccaagcagag

SEQ ID NO: 3643970 - RNA, 15 nt, Human
aggacccagacccag

SEQ ID NO: 3643971 - RNA, 14 nt, Human
aggacccaggacag

SEQ ID NO: 3643972 - RNA, 23 nt, Human
aggacccaggacaggauccaggc

SEQ ID NO: 3643973 - RNA, 18 nt, Human
aggacccaucacgccugu

SEQ ID NO: 3643974 - RNA, 20 nt, Human
aggacccaucacgccugugc

SEQ ID NO: 3643975 - RNA, 13 nt, Human
aggaccccagcuc

SEQ ID NO: 3643976 - RNA, 15 nt, Human
aggacccccuucccc

SEQ ID NO: 3643977 - RNA, 17 nt, Human
aggacccccuuccccua

SEQ ID NO: 3643978 - RNA, 21 nt, Human
aggacccggaggggccuggca

SEQ ID NO: 3643979 - RNA, 14 nt, Human
aggacccugccagg

SEQ ID NO: 3643980 - RNA, 15 nt, Human
aggacccugccaggc

SEQ ID NO: 3643981 - RNA, 13 nt, Human
aggacccuggacc

SEQ ID NO: 3643982 - RNA, 12 nt, Human
aggacccuuccc

SEQ ID NO: 3643983 - RNA, 13 nt, Human
aggacccuucccu

SEQ ID NO: 3643984 - RNA, 16 nt, Human
aggaccgccaaagaau

SEQ ID NO: 3643985 - RNA, 16 nt, Human
aggaccggcggcucgg

SEQ ID NO: 3643986 - RNA, 17 nt, Human
aggaccguggcccugcc

SEQ ID NO: 3643987 - RNA, 14 nt, Human
aggaccuaaaacau

SEQ ID NO: 3643988 - RNA, 16 nt, Human
aggaccuaaaacaucu

SEQ ID NO: 3643989 - RNA, 15 nt, Human
aggaccucagcugcu

SEQ ID NO: 3643990 - RNA, 18 nt, Human
aggaccucagcugcuucu

SEQ ID NO: 3643991 - RNA, 18 nt, Human
aggaccuccucuuccccc

SEQ ID NO: 3643992 - RNA, 14 nt, Human
aggaccucgugcca

SEQ ID NO: 3643993 - RNA, 18 nt, Human
aggaccucugaaacccug

SEQ ID NO: 3643994 - RNA, 14 nt, Human
aggaccucugggcu

SEQ ID NO: 3643995 - RNA, 20 nt, Human
aggaccugaaauuccaaagu

SEQ ID NO: 3643996 - RNA, 12 nt, Human
aggaccugagcc

SEQ ID NO: 3643997 - RNA, 13 nt, Human
aggaccugagccu

SEQ ID NO: 3643998 - RNA, 15 nt, Human
aggaccugagccugc

SEQ ID NO: 3643999 - RNA, 17 nt, Human
aggaccugagccugccg

SEQ ID NO: 3644000 - RNA, 21 nt, Human
aggaccugagccugccgagca

SEQ ID NO: 3644001 - RNA, 12 nt, Human
aggaccugcccg

SEQ ID NO: 3644002 - RNA, 16 nt, Human
aggaccuggggcacag

SEQ ID NO: 3644003 - RNA, 17 nt, Human
aggaccuggggcacagu

SEQ ID NO: 3644004 - RNA, 13 nt, Human
aggaccugugucc

SEQ ID NO: 3644005 - RNA, 15 nt, Human
aggaccuuaucugug

SEQ ID NO: 3644006 - RNA, 23 nt, Human
aggaccuucacucuaagauguua

SEQ ID NO: 3644007 - RNA, 19 nt, Human
aggaccuucgggcugugcc

SEQ ID NO: 3644008 - RNA, 21 nt, Human
aggaccuuuccaccacagcca

SEQ ID NO: 3644009 - RNA, 22 nt, Human
aggaccuuuccaccacagccag

SEQ ID NO: 3644010 - RNA, 14 nt, Human
aggacgccacccag

SEQ ID NO: 3644011 - RNA, 12 nt, Human
aggacgccacuc

SEQ ID NO: 3644012 - RNA, 20 nt, Human
aggacgccacucauuucauc

SEQ ID NO: 3644013 - RNA, 23 nt, Human
aggacgccacucauuucaucuca

SEQ ID NO: 3644014 - RNA, 13 nt, Human
aggacgcucucug

SEQ ID NO: 3644015 - RNA, 19 nt, Human
aggacgcucucuggccuuc

SEQ ID NO: 3644016 - RNA, 19 nt, Human
aggacgcugaccguggagc

SEQ ID NO: 3644017 - RNA, 17 nt, Human
aggacgcuucacaggac

SEQ ID NO: 3644018 - RNA, 19 nt, Human
aggacgcuucacaggacag

SEQ ID NO: 3644019 - RNA, 13 nt, Human
aggacgcuucuga

SEQ ID NO: 3644020 - RNA, 15 nt, Human
aggacggggccggcc

SEQ ID NO: 3644021 - RNA, 16 nt, Human
aggacggggccggcca

SEQ ID NO: 3644022 - RNA, 21 nt, Human
aggacggggccggccaggugg

SEQ ID NO: 3644023 - RNA, 16 nt, Human
aggacggugcaaccca

SEQ ID NO: 3644024 - RNA, 14 nt, Human
aggacgugggcggc

SEQ ID NO: 3644025 - RNA, 19 nt, Human
aggacgugggcugggccca

SEQ ID NO: 3644026 - RNA, 22 nt, Human
aggacuaacacucagaagccug

SEQ ID NO: 3644027 - RNA, 21 nt, Human
auauauguguuuuucacauuu

SEQ ID NO: 3644028 - RNA, 23 nt, Human
auauauguguuuuucacauuugc

SEQ ID NO: 3644029 - RNA, 16 nt, Human
auauauguugauuucu

SEQ ID NO: 3644030 - RNA, 21 nt, Human
auauauguuuuaagaggcagg

SEQ ID NO: 3644031 - RNA, 17 nt, Human
auauauuaaaaauauaa

SEQ ID NO: 3644032 - RNA, 20 nt, Human
auauauuaaaauuccaaauu

SEQ ID NO: 3644033 - RNA, 17 nt, Human
auauauuauaaauauau

SEQ ID NO: 3644034 - RNA, 20 nt, Human
auauauuauauggaaauaua

SEQ ID NO: 3644035 - RNA, 18 nt, Human
auauauuauuacuuguaa

SEQ ID NO: 3644036 - RNA, 13 nt, Human
auauauuauuaua

SEQ ID NO: 3644037 - RNA, 18 nt, Human
auauauuauuauaaucuu

SEQ ID NO: 3644038 - RNA, 20 nt, Human
auauauucuggcugauaaaa

SEQ ID NO: 3644039 - RNA, 17 nt, Human
auauauucuuauaaaaa

SEQ ID NO: 3644040 - RNA, 22 nt, Human
auauauugaacuuuuguacuga

SEQ ID NO: 3644041 - RNA, 18 nt, Human
auauauugaauauuuuau

SEQ ID NO: 3644042 - RNA, 16 nt, Human
auauauuguguugacu

SEQ ID NO: 3644043 - RNA, 14 nt, Human
aucaauuuuucuua

SEQ ID NO: 3644044 - RNA, 19 nt, Human
aucaauuuuucuuauuuca

SEQ ID NO: 3644045 - RNA, 13 nt, Human
aucacaaaaauuu

SEQ ID NO: 3644046 - RNA, 15 nt, Human
aucacaaaugacuuu

SEQ ID NO: 3644047 - RNA, 20 nt, Human
aucacaaaugacuuuauuau

SEQ ID NO: 3644048 - RNA, 16 nt, Human
aucacaagauggaauu

SEQ ID NO: 3644049 - RNA, 14 nt, Human
aucacaauacagau

SEQ ID NO: 3644050 - RNA, 11 nt, Human
aucacacacau

SEQ ID NO: 3644051 - RNA, 14 nt, Human
aucacacacaugga

SEQ ID NO: 3644052 - RNA, 14 nt, Human
aucacaccugcccu

SEQ ID NO: 3644053 - RNA, 14 nt, Human
aucacacuauuuua

SEQ ID NO: 3644054 - RNA, 16 nt, Human
aucacacuauuuuaga

SEQ ID NO: 3644055 - RNA, 14 nt, Human
aucacacuucugug

SEQ ID NO: 3644056 - RNA, 12 nt, Human
aucacagcagcc

SEQ ID NO: 3644057 - RNA, 15 nt, Human
aucacagcccagccc

SEQ ID NO: 3644058 - RNA, 21 nt, Human
aucacagccucugaaaaccaa

SEQ ID NO: 3644059 - RNA, 16 nt, Human
aucacagcugcuuucu

SEQ ID NO: 3644060 - RNA, 21 nt, Human
aucacagcuuguuuuggacuu

SEQ ID NO: 3644061 - RNA, 13 nt, Human
aucacaggcuggg

SEQ ID NO: 3644062 - RNA, 14 nt, Human
aucacaggcugggc

SEQ ID NO: 3644063 - RNA, 15 nt, Human
aucacaggcugggcu

SEQ ID NO: 3644064 - RNA, 19 nt, Human
aucacagggcagagccggg

SEQ ID NO: 3644065 - RNA, 22 nt, Human
aucacagggccccagaaggcag

SEQ ID NO: 3644066 - RNA, 15 nt, Human
aucacaguuuugguu

SEQ ID NO: 3644067 - RNA, 19 nt, Human
aucacaucuuuuaagacaa

SEQ ID NO: 3644068 - RNA, 22 nt, Human
aucacaugaauuauuacagugu

SEQ ID NO: 3644069 - RNA, 11 nt, Human
aucacauguau

SEQ ID NO: 3644070 - RNA, 14 nt, Human
aucacauguauguu

SEQ ID NO: 3644071 - RNA, 15 nt, Human
aucacauguggacuu

SEQ ID NO: 3644072 - RNA, 22 nt, Human
aucacauuauuugcauguuacc

SEQ ID NO: 3644073 - RNA, 24 nt, Human
aucacauugagcugauauaaauuc

SEQ ID NO: 3644074 - RNA, 18 nt, Human
aucaccaacgucugugcc

SEQ ID NO: 3644075 - RNA, 23 nt, Human
aucaccacaaacuguaauacaau

SEQ ID NO: 3644076 - RNA, 13 nt, Human
aucaccacaguuu

SEQ ID NO: 3644077 - RNA, 16 nt, Human
aucaccagaauaaacc

SEQ ID NO: 3644078 - RNA, 23 nt, Human
aucaccagagagggacugacacc

SEQ ID NO: 3644079 - RNA, 13 nt, Human
aucaccagggcca

SEQ ID NO: 3644080 - RNA, 15 nt, Human
aucacccagacauaa

SEQ ID NO: 3644081 - RNA, 23 nt, Human
aucacccagacauaaaggaaaag

SEQ ID NO: 3644082 - RNA, 23 nt, Human
aucacccuuaccaugugccugau

SEQ ID NO: 3644083 - RNA, 20 nt, Human
aucaccgacgcgucuccugu

SEQ ID NO: 3644084 - RNA, 16 nt, Human
aucaccgacugaaaau

SEQ ID NO: 3644085 - RNA, 19 nt, Human
auauauuuauuuaaagcau

SEQ ID NO: 3644086 - RNA, 14 nt, Human
auauauuucagaua

SEQ ID NO: 3644087 - RNA, 12 nt, Human
auauauuucuau

SEQ ID NO: 3644088 - RNA, 17 nt, Human
auauauuucuauuauua

SEQ ID NO: 3644089 - RNA, 13 nt, Human
auauauuugugua

SEQ ID NO: 3644090 - RNA, 15 nt, Human
auauauuuuaagacg

SEQ ID NO: 3644091 - RNA, 18 nt, Human
auauauuuuacaauuuuu

SEQ ID NO: 3644092 - RNA, 22 nt, Human
auauauuuuauuuuuagaauuu

SEQ ID NO: 3644093 - RNA, 22 nt, Human
auauauuuuguaugcaagcagu

SEQ ID NO: 3644094 - RNA, 16 nt, Human
auauauuuuuaagaua

SEQ ID NO: 3644095 - RNA, 15 nt, Human
auauauuuuuauauu

SEQ ID NO: 3644096 - RNA, 19 nt, Human
auauauuuuuauauuuacu

SEQ ID NO: 3644097 - RNA, 21 nt, Human
auauauuuuucacaguuuuuc

SEQ ID NO: 3644098 - RNA, 19 nt, Human
auauauuuuuuucugaaau

SEQ ID NO: 3644099 - RNA, 14 nt, Human
auaucaaaguauuu

SEQ ID NO: 3644100 - RNA, 13 nt, Human
auaucaaagucau

SEQ ID NO: 3644101 - RNA, 21 nt, Human
auaucaaagucauuaaagaca

SEQ ID NO: 3644102 - RNA, 12 nt, Human
auaucaaaugca

SEQ ID NO: 3644103 - RNA, 13 nt, Human
auaucaaaugcag

SEQ ID NO: 3644104 - RNA, 15 nt, Human
auaucaagaugauuc

SEQ ID NO: 3644105 - RNA, 13 nt, Human
auaucacagaaaa

SEQ ID NO: 3644106 - RNA, 14 nt, Human
auaucacucauuaa

SEQ ID NO: 3644107 - RNA, 11 nt, Human
auaucacuucc

SEQ ID NO: 3644108 - RNA, 22 nt, Human
auaucagccugagucuccugug

SEQ ID NO: 3644109 - RNA, 23 nt, Human
auaucaguaacccccuuaaauuu

SEQ ID NO: 3644110 - RNA, 17 nt, Human
auaucaguuacucagcc

SEQ ID NO: 3644111 - RNA, 20 nt, Human
auaucaguuacucagcccug

SEQ ID NO: 3644112 - RNA, 13 nt, Human
auaucaguuugcu

SEQ ID NO: 3644113 - RNA, 14 nt, Human
auaucauauguaua

SEQ ID NO: 3644114 - RNA, 14 nt, Human
auaucauauuggua

SEQ ID NO: 3644115 - RNA, 19 nt, Human
auaucauauugguauucac

SEQ ID NO: 3644116 - RNA, 21 nt, Human
auaucaucagcauaccuuuau

SEQ ID NO: 3644117 - RNA, 21 nt, Human
auaucaucuaccuagauuuaa

SEQ ID NO: 3644118 - RNA, 20 nt, Human
auaucaugcaaaauauguuu

SEQ ID NO: 3644119 - RNA, 18 nt, Human
auaucauguaaagaaaug

SEQ ID NO: 3644120 - RNA, 19 nt, Human
auaucauguaaagaaaugu

SEQ ID NO: 3644121 - RNA, 21 nt, Human
auaucauguaaagaaaugucu

SEQ ID NO: 3644122 - RNA, 22 nt, Human
auaucauguaaagaaaugucuu

SEQ ID NO: 3644123 - RNA, 23 nt, Human
auaucauuauaacugaaggagaa

SEQ ID NO: 3644124 - RNA, 13 nt, Human
auaucauucagca

SEQ ID NO: 3644125 - RNA, 14 nt, Human
auaucauucagcaa

SEQ ID NO: 3644126 - RNA, 21 nt, Human
auaucauuuauuuuuuacauu

SEQ ID NO: 3644127 - RNA, 12 nt, Human
auauccaaaagc

SEQ ID NO: 3644128 - RNA, 16 nt, Human
auauccaaguuugaau

SEQ ID NO: 3644129 - RNA, 14 nt, Human
auauccaccaccuc

SEQ ID NO: 3644130 - RNA, 16 nt, Human
auauccaccaccuccc

SEQ ID NO: 3644131 - RNA, 21 nt, Human
auauccacuuguccaugugaa

SEQ ID NO: 3644132 - RNA, 19 nt, Human
auauccaggucaacagaau

SEQ ID NO: 3644133 - RNA, 17 nt, Human
auauccauagugacuuu

SEQ ID NO: 3644134 - RNA, 21 nt, Human
auauccaugaccuaguuuucc

SEQ ID NO: 3644135 - RNA, 15 nt, Human
auauccauguacugu

SEQ ID NO: 3644136 - RNA, 20 nt, Human
auaucccaaacugugaugaa

SEQ ID NO: 3644137 - RNA, 13 nt, Human
auaucccacuggg

SEQ ID NO: 3644138 - RNA, 17 nt, Human
auaucccgggggugggg

SEQ ID NO: 3644139 - RNA, 20 nt, Human
auaucccuccuguugggaga

SEQ ID NO: 3644140 - RNA, 19 nt, Human
auaucccuuggacauuuua

SEQ ID NO: 3644141 - RNA, 13 nt, Human
auauccuaaacau

SEQ ID NO: 3644142 - RNA, 16 nt, Human
auauccuaauaaaaag

SEQ ID NO: 3644143 - RNA, 11 nt, Human
auauccucugu

SEQ ID NO: 3644144 - RNA, 13 nt, Human
auauccugagcca

SEQ ID NO: 3644145 - RNA, 15 nt, Human
auauccugagccauc

SEQ ID NO: 3644146 - RNA, 13 nt, Human
auauccugccuca

SEQ ID NO: 3644147 - RNA, 13 nt, Human
auauccugcuuga

SEQ ID NO: 3644148 - RNA, 14 nt, Human
auauccugugacug

SEQ ID NO: 3644149 - RNA, 22 nt, Human
auauccuucuagaucauacaca

SEQ ID NO: 3644150 - RNA, 21 nt, Human
auauccuuuuagucugcauau

SEQ ID NO: 3644151 - RNA, 14 nt, Human
auauccuuuucuuc

SEQ ID NO: 3644152 - RNA, 21 nt, Human
auauccuuuucuucuauguag

SEQ ID NO: 3644153 - RNA, 14 nt, Human
auaucuaaauuuag

SEQ ID NO: 3644154 - RNA, 13 nt, Human
auaucuaauauau

SEQ ID NO: 3644155 - RNA, 23 nt, Human
auaucuacagauagagaguuguu

SEQ ID NO: 3644156 - RNA, 21 nt, Human
auaucuaccccagacuagaug

SEQ ID NO: 3644157 - RNA, 23 nt, Human
auaucuaccccagacuagaugua

SEQ ID NO: 3644158 - RNA, 19 nt, Human
auaucuagguuuaugacag

SEQ ID NO: 3644159 - RNA, 22 nt, Human
auaucuagguuuaugacaguaa

SEQ ID NO: 3644160 - RNA, 14 nt, Human
auaucuaguaugaa

SEQ ID NO: 3644161 - RNA, 13 nt, Human
auaucuauaaaau

SEQ ID NO: 3644162 - RNA, 15 nt, Human
auaucuauaaaauag

SEQ ID NO: 3644163 - RNA, 16 nt, Human
auaucuauauauaauu

SEQ ID NO: 3644164 - RNA, 23 nt, Human
auaucuauauauaauucuguaca

SEQ ID NO: 3644165 - RNA, 15 nt, Human
auaucuauauauaua

SEQ ID NO: 3644166 - RNA, 19 nt, Human
auaucuauauauauaauuu

SEQ ID NO: 3644167 - RNA, 16 nt, Human
auaucuauauuuuaca

SEQ ID NO: 3644168 - RNA, 15 nt, Human
auaucuaucagagua

SEQ ID NO: 3644169 - RNA, 13 nt, Human
auaucuaucuauu

SEQ ID NO: 3644170 - RNA, 14 nt, Human
auaucuauuaauau

SEQ ID NO: 3644171 - RNA, 15 nt, Human
auaucuauuaauaua

SEQ ID NO: 3644172 - RNA, 22 nt, Human
auaucuauuaauauauguauua

SEQ ID NO: 3644173 - RNA, 23 nt, Human
auaucucaaugaaccauaaauuc

SEQ ID NO: 3644174 - RNA, 12 nt, Human
auaucucaucuc

SEQ ID NO: 3644175 - RNA, 23 nt, Human
auaucuccuuuguauucugucuu

SEQ ID NO: 3644176 - RNA, 22 nt, Human
auaucucuauuuaauuuugaca

SEQ ID NO: 3644177 - RNA, 14 nt, Human
auaucucuauuuga

SEQ ID NO: 3644178 - RNA, 23 nt, Human
auaucugaaaacuggaauaagaa

SEQ ID NO: 3644179 - RNA, 20 nt, Human
auaucugaaaauguaugugu

SEQ ID NO: 3644180 - RNA, 15 nt, Human
auaucugaagcccuc

SEQ ID NO: 3644181 - RNA, 17 nt, Human
auaucugaggaauucug

SEQ ID NO: 3644182 - RNA, 13 nt, Human
auaucugcaaaaa

SEQ ID NO: 3644183 - RNA, 16 nt, Human
auaucugccuuuauug

SEQ ID NO: 3644184 - RNA, 11 nt, Human
auaucugcugu

SEQ ID NO: 3644185 - RNA, 13 nt, Human
auaucugcuguau

SEQ ID NO: 3644186 - RNA, 13 nt, Human
auaucugcugucc

SEQ ID NO: 3644187 - RNA, 16 nt, Human
auaucugcuucagugg

SEQ ID NO: 3644188 - RNA, 15 nt, Human
auaucuggacaagcc

SEQ ID NO: 3644189 - RNA, 21 nt, Human
auauguucacaccuagcguca

SEQ ID NO: 3644190 - RNA, 14 nt, Human
auauguucacuguc

SEQ ID NO: 3644191 - RNA, 16 nt, Human
auauguucugacauaa

SEQ ID NO: 3644192 - RNA, 18 nt, Human
auauguugcuauaauaaa

SEQ ID NO: 3644193 - RNA, 13 nt, Human
auauguugcucag

SEQ ID NO: 3644194 - RNA, 21 nt, Human
auauguuguucuuacaaacca

SEQ ID NO: 3644195 - RNA, 14 nt, Human
auauguuucaaacu

SEQ ID NO: 3644196 - RNA, 14 nt, Human
auauguuucacaca

SEQ ID NO: 3644197 - RNA, 16 nt, Human
auauguuuccuucccu

SEQ ID NO: 3644198 - RNA, 18 nt, Human
auauguuuccuuguuuau

SEQ ID NO: 3644199 - RNA, 18 nt, Human
auauguuuuaagaggcag

SEQ ID NO: 3644200 - RNA, 15 nt, Human
auauguuuuauuuca

SEQ ID NO: 3644201 - RNA, 21 nt, Human
auauguuuugugggaacagau

SEQ ID NO: 3644202 - RNA, 12 nt, Human
auauuaaaaaac

SEQ ID NO: 3644203 - RNA, 18 nt, Human
auauuaaaaauauaaaac

SEQ ID NO: 3644204 - RNA, 19 nt, Human
auauuaaaaaugguaaaau

SEQ ID NO: 3644205 - RNA, 14 nt, Human
auauuaaaaauugg

SEQ ID NO: 3644206 - RNA, 18 nt, Human
auauuaaaagucacaaug

SEQ ID NO: 3644207 - RNA, 17 nt, Human
auauuaaaauauggcua

SEQ ID NO: 3644208 - RNA, 12 nt, Human
auauuaaacaaa

SEQ ID NO: 3644209 - RNA, 12 nt, Human
auauuaaagcca

SEQ ID NO: 3644210 - RNA, 15 nt, Human
auauuaaagccaugu

SEQ ID NO: 3644211 - RNA, 18 nt, Human
auauuaaagccauguuua

SEQ ID NO: 3644212 - RNA, 20 nt, Human
auauuaaauacagacacuaa

SEQ ID NO: 3644213 - RNA, 23 nt, Human
auauuaaauauguuagcaaagag

SEQ ID NO: 3644214 - RNA, 16 nt, Human
auauuaaauuuuuugu

SEQ ID NO: 3644215 - RNA, 18 nt, Human
auauuaaccagauauaua

SEQ ID NO: 3644216 - RNA, 15 nt, Human
auauuaagaaagacu

SEQ ID NO: 3644217 - RNA, 22 nt, Human
auauuaagaaagacuaucuaaa

SEQ ID NO: 3644218 - RNA, 13 nt, Human
auauuaagaauga

SEQ ID NO: 3644219 - RNA, 20 nt, Human
auauuaagcaugacagaaaa

SEQ ID NO: 3644220 - RNA, 16 nt, Human
auauuacaaugaucac

SEQ ID NO: 3644221 - RNA, 22 nt, Human
auauuacacaaauacuuauuca

SEQ ID NO: 3644222 - RNA, 12 nt, Human
auauuacauuua

SEQ ID NO: 3644223 - RNA, 22 nt, Human
auauuacauuuauuuauccaga

SEQ ID NO: 3644224 - RNA, 15 nt, Human
auauuaccagcaaga

SEQ ID NO: 3644225 - RNA, 17 nt, Human
auauuaccuaaugaaag

SEQ ID NO: 3644226 - RNA, 17 nt, Human
auauuacgguuugcccc

SEQ ID NO: 3644227 - RNA, 15 nt, Human
auauuacugacauuu

SEQ ID NO: 3644228 - RNA, 18 nt, Human
auauuacuuuaucacuuu

SEQ ID NO: 3644229 - RNA, 15 nt, Human
auauuagacuucugu

SEQ ID NO: 3644230 - RNA, 22 nt, Human
auauuagacuucuguuuucaau

SEQ ID NO: 3644231 - RNA, 13 nt, Human
auauuagauguga

SEQ ID NO: 3644232 - RNA, 14 nt, Human
auauuagaugugau

SEQ ID NO: 3644233 - RNA, 22 nt, Human
auauuagcauuuaguccaaugu

SEQ ID NO: 3644234 - RNA, 19 nt, Human
auauuaguauuaucuuguu

SEQ ID NO: 3644235 - RNA, 19 nt, Human
auauuagucauagaagaac

SEQ ID NO: 3644236 - RNA, 13 nt, Human
auauuaguugcuu

SEQ ID NO: 3644237 - RNA, 23 nt, Human
auauuauaaaggauaaagaagga

SEQ ID NO: 3644238 - RNA, 20 nt, Human
auauuauacaggaaagcaau

SEQ ID NO: 3644239 - RNA, 14 nt, Human
auauuauacuugua

SEQ ID NO: 3644240 - RNA, 22 nt, Human
auauuauacuuguaauuaugga

SEQ ID NO: 3644241 - RNA, 14 nt, Human
auauuauauuugga

SEQ ID NO: 3644242 - RNA, 16 nt, Human
auauuauauuuggaug

SEQ ID NO: 3644243 - RNA, 19 nt, Human
auauuaucaugcaaaugcu

SEQ ID NO: 3644244 - RNA, 13 nt, Human
auauuaucuuugu

SEQ ID NO: 3644245 - RNA, 16 nt, Human
auauuaugagaugcug

SEQ ID NO: 3644246 - RNA, 15 nt, Human
auauuaugcaaauuc

SEQ ID NO: 3644247 - RNA, 19 nt, Human
auauuaugcaaauucccag

SEQ ID NO: 3644248 - RNA, 16 nt, Human
auauuauguuaaaacu

SEQ ID NO: 3644249 - RNA, 13 nt, Human
auauuauuucuag

SEQ ID NO: 3644250 - RNA, 14 nt, Human
auauuauuucuagg

SEQ ID NO: 3644251 - RNA, 20 nt, Human
auauuauuucuaggaagaau

SEQ ID NO: 3644252 - RNA, 14 nt, Human
aucagggccugggg

SEQ ID NO: 3644253 - RNA, 22 nt, Human
aucagggccuggggccugagag

SEQ ID NO: 3644254 - RNA, 23 nt, Human
aucagggccuggggccugagaga

SEQ ID NO: 3644255 - RNA, 15 nt, Human
aucaggggagaaaaa

SEQ ID NO: 3644256 - RNA, 16 nt, Human
aucagggggaagaagc

SEQ ID NO: 3644257 - RNA, 23 nt, Human
aucagguaacuaacugcauacac

SEQ ID NO: 3644258 - RNA, 14 nt, Human
aucagguccugcuc

SEQ ID NO: 3644259 - RNA, 13 nt, Human
aucaggucuccca

SEQ ID NO: 3644260 - RNA, 17 nt, Human
aucagguuaggcaguau

SEQ ID NO: 3644261 - RNA, 15 nt, Human
aucaguaacccccuu

SEQ ID NO: 3644262 - RNA, 19 nt, Human
aucaguaacccccuuaaau

SEQ ID NO: 3644263 - RNA, 15 nt, Human
aucaguacuuguuuc

SEQ ID NO: 3644264 - RNA, 14 nt, Human
aucaguaggcuaau

SEQ ID NO: 3644265 - RNA, 16 nt, Human
aucaguaggcuaaugu

SEQ ID NO: 3644266 - RNA, 16 nt, Human
aucaguaguucacaua

SEQ ID NO: 3644267 - RNA, 23 nt, Human
aucaguaguuugcauuucagaaa

SEQ ID NO: 3644268 - RNA, 14 nt, Human
aucaguauaaacaa

SEQ ID NO: 3644269 - RNA, 18 nt, Human
aucaguauaaacaaaguu

SEQ ID NO: 3644270 - RNA, 21 nt, Human
aucaguauaauucuguacuga

SEQ ID NO: 3644271 - RNA, 15 nt, Human
aucaguauuaauacu

SEQ ID NO: 3644272 - RNA, 22 nt, Human
aucaguauugaagcauuuuaua

SEQ ID NO: 3644273 - RNA, 16 nt, Human
aucaguccccucccau

SEQ ID NO: 3644274 - RNA, 17 nt, Human
aucaguccccucccauc

SEQ ID NO: 3644275 - RNA, 22 nt, Human
aucaguccccucccaucuggga

SEQ ID NO: 3644276 - RNA, 23 nt, Human
aucaguccccucccaucugggag

SEQ ID NO: 3644277 - RNA, 23 nt, Human
aucaguccuagaauguuucauuu

SEQ ID NO: 3644278 - RNA, 13 nt, Human
aucagucucugag

SEQ ID NO: 3644279 - RNA, 13 nt, Human
aucagugcccucc

SEQ ID NO: 3644280 - RNA, 17 nt, Human
aucagugcccuccagga

SEQ ID NO: 3644281 - RNA, 19 nt, Human
aucaguguaccauuugccu

SEQ ID NO: 3644282 - RNA, 19 nt, Human
aucagugugucuaaauuug

SEQ ID NO: 3644283 - RNA, 23 nt, Human
aucagugugucuaaauuugaaug

SEQ ID NO: 3644284 - RNA, 12 nt, Human
aucaguguuaaa

SEQ ID NO: 3644285 - RNA, 14 nt, Human
aucaguguuaaaaa

SEQ ID NO: 3644286 - RNA, 15 nt, Human
aucaguguuggccau

SEQ ID NO: 3644287 - RNA, 21 nt, Human
aucaguguuguugcucuagga

SEQ ID NO: 3644288 - RNA, 22 nt, Human
aucaguguuuaugugcuauuaa

SEQ ID NO: 3644289 - RNA, 17 nt, Human
aucaguguuuuaaauuc

SEQ ID NO: 3644290 - RNA, 20 nt, Human
aucaguguuuuaaauucuga

SEQ ID NO: 3644291 - RNA, 18 nt, Human
aucaguuaacuauugcau

SEQ ID NO: 3644292 - RNA, 20 nt, Human
aucaguuacccacucggucc

SEQ ID NO: 3644293 - RNA, 21 nt, Human
aucaguuacucagcccugggc

SEQ ID NO: 3644294 - RNA, 18 nt, Human
aucaguuacucugaaggg

SEQ ID NO: 3644295 - RNA, 14 nt, Human
aucaguuauucauu

SEQ ID NO: 3644296 - RNA, 18 nt, Human
aucaguucauuagaaaua

SEQ ID NO: 3644297 - RNA, 22 nt, Human
aucaguugaggccaggaguuua

SEQ ID NO: 3644298 - RNA, 20 nt, Human
aucaguugcgcguucugaaa

SEQ ID NO: 3644299 - RNA, 22 nt, Human
aucaguuugaucacacuauuuu

SEQ ID NO: 3644300 - RNA, 22 nt, Human
aucaguuugcuagcagaaaucu

SEQ ID NO: 3644301 - RNA, 16 nt, Human
aucauaaacugugugc

SEQ ID NO: 3644302 - RNA, 13 nt, Human
aucauaaagucag

SEQ ID NO: 3644303 - RNA, 14 nt, Human
aucauaaaguuaga

SEQ ID NO: 3644304 - RNA, 15 nt, Human
aucauaaaguuagaa

SEQ ID NO: 3644305 - RNA, 16 nt, Human
aucauaaaguuagaau

SEQ ID NO: 3644306 - RNA, 23 nt, Human
aucauaaguauuuggaauuagaa

SEQ ID NO: 3644307 - RNA, 17 nt, Human
aucauaagugaauuuau

SEQ ID NO: 3644308 - RNA, 19 nt, Human
aucauaagugaauuuauac

SEQ ID NO: 3644309 - RNA, 18 nt, Human
aucauacuccuaugcuuu

SEQ ID NO: 3644310 - RNA, 17 nt, Human
aucauagguauuucaaa

SEQ ID NO: 3644311 - RNA, 18 nt, Human
aucauagguauuucaaaa

SEQ ID NO: 3644312 - RNA, 14 nt, Human
aucauaguuuuauu

SEQ ID NO: 3644313 - RNA, 18 nt, Human
aucauauaaauagaaugu

SEQ ID NO: 3644314 - RNA, 22 nt, Human
aucauauaaauagaauguaaau

SEQ ID NO: 3644315 - RNA, 20 nt, Human
aucauauauauacauacaug

SEQ ID NO: 3644316 - RNA, 18 nt, Human
aucauaugauucugcuuu

SEQ ID NO: 3644317 - RNA, 16 nt, Human
aucauauuauacagac

SEQ ID NO: 3644318 - RNA, 17 nt, Human
aucauauugaugaaaag

SEQ ID NO: 3644319 - RNA, 23 nt, Human
aucauauugguauauccuuuucu

SEQ ID NO: 3644320 - RNA, 20 nt, Human
aucaucaacaagauuuccuu

SEQ ID NO: 3644321 - RNA, 17 nt, Human
aucaucaagaagggcug

SEQ ID NO: 3644322 - RNA, 18 nt, Human
aucaucaagaagggcugc

SEQ ID NO: 3644323 - RNA, 22 nt, Human
aucaucaagaagggcugcauga

SEQ ID NO: 3644324 - RNA, 15 nt, Human
aucaucaagagaauu

SEQ ID NO: 3644325 - RNA, 19 nt, Human
aucaucaaggcacugccug

SEQ ID NO: 3644326 - RNA, 16 nt, Human
aucaucaaguaauaca

SEQ ID NO: 3644327 - RNA, 18 nt, Human
aucaucaaguaauacaaa

SEQ ID NO: 3644328 - RNA, 21 nt, Human
aucaucacguauguuauacaa

SEQ ID NO: 3644329 - RNA, 20 nt, Human
aucaucagaaaggaaaaaca

SEQ ID NO: 3644330 - RNA, 14 nt, Human
aucaucagggccug

SEQ ID NO: 3644331 - RNA, 15 nt, Human
aucaucagggccugg

SEQ ID NO: 3644332 - RNA, 19 nt, Human
aucaucaguauugaagcau

SEQ ID NO: 3644333 - RNA, 14 nt, Human
aggcauuuccuggg

SEQ ID NO: 3644334 - RNA, 16 nt, Human
aggcauuuccugggug

SEQ ID NO: 3644335 - RNA, 20 nt, Human
aggcauuuccuggguggcua

SEQ ID NO: 3644336 - RNA, 19 nt, Human
aggcauuuguaaauauuaa

SEQ ID NO: 3644337 - RNA, 21 nt, Human
aggcauuuucccccuuggcuc

SEQ ID NO: 3644338 - RNA, 15 nt, Human
aggcauuuuuaccau

SEQ ID NO: 3644339 - RNA, 22 nt, Human
aggccaaaccucuguucagugu

SEQ ID NO: 3644340 - RNA, 16 nt, Human
aggccaaacucaccug

SEQ ID NO: 3644341 - RNA, 20 nt, Human
aggccaaacucaccugcccc

SEQ ID NO: 3644342 - RNA, 12 nt, Human
aggccaaacugc

SEQ ID NO: 3644343 - RNA, 18 nt, Human
aggccaaagacaaauagu

SEQ ID NO: 3644344 - RNA, 16 nt, Human
aggccaaaggaagcac

SEQ ID NO: 3644345 - RNA, 18 nt, Human
aggccaaaggaagcacau

SEQ ID NO: 3644346 - RNA, 23 nt, Human
aggccaaaggaagcacaugccuc

SEQ ID NO: 3644347 - RNA, 14 nt, Human
aggccaagaaacgu

SEQ ID NO: 3644348 - RNA, 16 nt, Human
aggccaagaauauugc

SEQ ID NO: 3644349 - RNA, 14 nt, Human
aggccaagagcaga

SEQ ID NO: 3644350 - RNA, 21 nt, Human
aggccaagagguuuggcuccu

SEQ ID NO: 3644351 - RNA, 18 nt, Human
aggccaagaguggcccca

SEQ ID NO: 3644352 - RNA, 20 nt, Human
aggccaagaguggccccacc

SEQ ID NO: 3644353 - RNA, 23 nt, Human
aggccaagaguggccccaccugg

SEQ ID NO: 3644354 - RNA, 17 nt, Human
aggccaaggccuucucc

SEQ ID NO: 3644355 - RNA, 18 nt, Human
aggccaaggcggguggau

SEQ ID NO: 3644356 - RNA, 21 nt, Human
aggccaagguguccuacagaa

SEQ ID NO: 3644357 - RNA, 23 nt, Human
aggccaaguccgcagaagcccug

SEQ ID NO: 3644358 - RNA, 23 nt, Human
aggccaaguuuguaucaggugcc

SEQ ID NO: 3644359 - RNA, 15 nt, Human
aggccacaagacccu

SEQ ID NO: 3644360 - RNA, 21 nt, Human
aggccacacuucaaacuacuu

SEQ ID NO: 3644361 - RNA, 20 nt, Human
aggccacauccacagucucc

SEQ ID NO: 3644362 - RNA, 14 nt, Human
aggccacaugggag

SEQ ID NO: 3644363 - RNA, 22 nt, Human
aggccacauggggcugggcagc

SEQ ID NO: 3644364 - RNA, 13 nt, Human
aggccaccaggau

SEQ ID NO: 3644365 - RNA, 15 nt, Human
aggccaccuccccag

SEQ ID NO: 3644366 - RNA, 12 nt, Human
aggccaccuccu

SEQ ID NO: 3644367 - RNA, 15 nt, Human
aggccaccucuccaa

SEQ ID NO: 3644368 - RNA, 16 nt, Human
aggccaccucuccaag

SEQ ID NO: 3644369 - RNA, 23 nt, Human
aggccaccucuccaagggcuucu

SEQ ID NO: 3644370 - RNA, 11 nt, Human
aggccaccugc

SEQ ID NO: 3644371 - RNA, 14 nt, Human
aggccaccugcagg

SEQ ID NO: 3644372 - RNA, 14 nt, Human
aggccaccugcccc

SEQ ID NO: 3644373 - RNA, 19 nt, Human
aggccaccugcccccuucu

SEQ ID NO: 3644374 - RNA, 22 nt, Human
aggccaccugcccccuucuccc

SEQ ID NO: 3644375 - RNA, 19 nt, Human
aggccacgugauguggagg

SEQ ID NO: 3644376 - RNA, 23 nt, Human
aggccacgugauguggagggcac

SEQ ID NO: 3644377 - RNA, 20 nt, Human
aggccacuggagacgcauau

SEQ ID NO: 3644378 - RNA, 19 nt, Human
aggccacuggccccugaga

SEQ ID NO: 3644379 - RNA, 14 nt, Human
aggccacuguguuc

SEQ ID NO: 3644380 - RNA, 16 nt, Human
aggccagaccauggac

SEQ ID NO: 3644381 - RNA, 15 nt, Human
aggccagagcccacu

SEQ ID NO: 3644382 - RNA, 17 nt, Human
aggccagagcccacucc

SEQ ID NO: 3644383 - RNA, 18 nt, Human
aggccagaggcccccagc

SEQ ID NO: 3644384 - RNA, 20 nt, Human
aggccagagggagugacaga

SEQ ID NO: 3644385 - RNA, 17 nt, Human
aggccagaguggccugg

SEQ ID NO: 3644386 - RNA, 21 nt, Human
aggccagaguggccuggccag

SEQ ID NO: 3644387 - RNA, 14 nt, Human
aggccagccuccga

SEQ ID NO: 3644388 - RNA, 23 nt, Human
aggccagccuggccuccugccuc

SEQ ID NO: 3644389 - RNA, 13 nt, Human
aggccagcugccu

SEQ ID NO: 3644390 - RNA, 14 nt, Human
aggccagcugcuug

SEQ ID NO: 3644391 - RNA, 16 nt, Human
aggccagcugcuuggg

SEQ ID NO: 3644392 - RNA, 15 nt, Human
aggccagcuggcagc

SEQ ID NO: 3644393 - RNA, 16 nt, Human
aggccagcuggcagca

SEQ ID NO: 3644394 - RNA, 19 nt, Human
aggccagcuggcagcagag

SEQ ID NO: 3644395 - RNA, 16 nt, Human
aggccagcugugguuu

SEQ ID NO: 3644396 - RNA, 20 nt, Human
aggccagcugugguuuucuu

SEQ ID NO: 3644397 - RNA, 21 nt, Human
aggccagcugugguuuucuuu

SEQ ID NO: 3644398 - RNA, 18 nt, Human
aggccaggacucugcagc

SEQ ID NO: 3644399 - RNA, 20 nt, Human
aggccaggacucugcagccu

SEQ ID NO: 3644400 - RNA, 18 nt, Human
aggccaggccaccaggau

SEQ ID NO: 3644401 - RNA, 15 nt, Human
aggccaggccagcug

SEQ ID NO: 3644402 - RNA, 15 nt, Human
aggccaggcccucug

SEQ ID NO: 3644403 - RNA, 18 nt, Human
aggccaggcccucugccc

SEQ ID NO: 3644404 - RNA, 19 nt, Human
aggccaggcccucugccca

SEQ ID NO: 3644405 - RNA, 19 nt, Human
aggccagggacaguaauaa

SEQ ID NO: 3644406 - RNA, 19 nt, Human
aggccagggagcaguggcu

SEQ ID NO: 3644407 - RNA, 15 nt, Human
aggccagggcagagu

SEQ ID NO: 3644408 - RNA, 19 nt, Human
aggccagggggccaguccc

SEQ ID NO: 3644409 - RNA, 12 nt, Human
aggccaggguca

SEQ ID NO: 3644410 - RNA, 15 nt, Human
aggccaggugcaggu

SEQ ID NO: 3644411 - RNA, 14 nt, Human
aggccagugagcca

SEQ ID NO: 3644412 - RNA, 16 nt, Human
aggccauaaaacaggu

SEQ ID NO: 3644413 - RNA, 21 nt, Human
aggccaucaucaguggagcca

SEQ ID NO: 3644414 - RNA, 11 nt, Human
aggccaucugg

SEQ ID NO: 3644415 - RNA, 22 nt, Human
aggccaucugggcuccuccagg

SEQ ID NO: 3644416 - RNA, 15 nt, Human
aggccaucuuccagg

SEQ ID NO: 3644417 - RNA, 19 nt, Human
aggccaucuuccagguggg

SEQ ID NO: 3644418 - RNA, 19 nt, Human
aggccaugaaaaaaaugau

SEQ ID NO: 3644419 - RNA, 19 nt, Human
aggccaugauucgcccaaa

SEQ ID NO: 3644420 - RNA, 17 nt, Human
aggccauggagagcugg

SEQ ID NO: 3644421 - RNA, 20 nt, Human
aggccauggaggcaguagga

SEQ ID NO: 3644422 - RNA, 21 nt, Human
aggccaugggcacugugggua

SEQ ID NO: 3644423 - RNA, 16 nt, Human
aggccaugggccuccu

SEQ ID NO: 3644424 - RNA, 17 nt, Human
aggccaugggccuccug

SEQ ID NO: 3644425 - RNA, 20 nt, Human
aggccauguuccaauaaaca

SEQ ID NO: 3644426 - RNA, 21 nt, Human
aggccauguuccaauaaacag

SEQ ID NO: 3644427 - RNA, 23 nt, Human
aggccauguuccaauaaacagga

SEQ ID NO: 3644428 - RNA, 15 nt, Human
aggccauucuuuccc

SEQ ID NO: 3644429 - RNA, 19 nt, Human
aggccauugugaaccaaug

SEQ ID NO: 3644430 - RNA, 20 nt, Human
aggccauugugaaccaaugc

SEQ ID NO: 3644431 - RNA, 14 nt, Human
aggccauuuuuggu

SEQ ID NO: 3644432 - RNA, 13 nt, Human
aggcccaaagccu

SEQ ID NO: 3644433 - RNA, 23 nt, Human
aggcccaaauuaucaagcuaaua

SEQ ID NO: 3644434 - RNA, 20 nt, Human
aggcccaagagaugaagagu

SEQ ID NO: 3644435 - RNA, 14 nt, Human
aggcccacacacag

SEQ ID NO: 3644436 - RNA, 16 nt, Human
aggcccacacacaggu

SEQ ID NO: 3644437 - RNA, 19 nt, Human
aggcccacaggaggcaagc

SEQ ID NO: 3644438 - RNA, 17 nt, Human
aggcccacauuggaaga

SEQ ID NO: 3644439 - RNA, 16 nt, Human
aggcccacugugccuc

SEQ ID NO: 3644440 - RNA, 16 nt, Human
aggcccagagggccug

SEQ ID NO: 3644441 - RNA, 18 nt, Human
aggcccagagggccugca

SEQ ID NO: 3644442 - RNA, 20 nt, Human
aggcccagagggccugcaag

SEQ ID NO: 3644443 - RNA, 21 nt, Human
aggcccagagggccugcaagg

SEQ ID NO: 3644444 - RNA, 22 nt, Human
aggcccagcauugcugguucua

SEQ ID NO: 3644445 - RNA, 13 nt, Human
aggcccagccccu

SEQ ID NO: 3644446 - RNA, 20 nt, Human
aggcccagccgacccccucu

SEQ ID NO: 3644447 - RNA, 15 nt, Human
aggcccaggcugccg

SEQ ID NO: 3644448 - RNA, 16 nt, Human
aggcccaggcugggaa

SEQ ID NO: 3644449 - RNA, 17 nt, Human
aggcccagugagaugca

SEQ ID NO: 3644450 - RNA, 21 nt, Human
aggcccaugggaggcuggagu

SEQ ID NO: 3644451 - RNA, 23 nt, Human
aggccccaaaaccacagcccugu

SEQ ID NO: 3644452 - RNA, 21 nt, Human
aggccccaaaggaaaaagcac

SEQ ID NO: 3644453 - RNA, 22 nt, Human
aucagaaaguaauuucuucuca

SEQ ID NO: 3644454 - RNA, 14 nt, Human
aucagaaauacaga

SEQ ID NO: 3644455 - RNA, 23 nt, Human
aucagaaauacagauuuugauag

SEQ ID NO: 3644456 - RNA, 15 nt, Human
aucagaaauuuuuau

SEQ ID NO: 3644457 - RNA, 14 nt, Human
aucagaacagcaga

SEQ ID NO: 3644458 - RNA, 14 nt, Human
aucagaacagcugu

SEQ ID NO: 3644459 - RNA, 15 nt, Human
aucagaacagcuguu

SEQ ID NO: 3644460 - RNA, 23 nt, Human
aucagaagaccacaaaaauugac

SEQ ID NO: 3644461 - RNA, 12 nt, Human
aucagaagagag

SEQ ID NO: 3644462 - RNA, 13 nt, Human
aucagaagauaac

SEQ ID NO: 3644463 - RNA, 17 nt, Human
aucagaagccuauugua

SEQ ID NO: 3644464 - RNA, 18 nt, Human
aucagaaguuucucagcu

SEQ ID NO: 3644465 - RNA, 20 nt, Human
aucagaauggaagagagaaa

SEQ ID NO: 3644466 - RNA, 13 nt, Human
aucagaauuugug

SEQ ID NO: 3644467 - RNA, 14 nt, Human
aucagaauuugugu

SEQ ID NO: 3644468 - RNA, 20 nt, Human
aucagaccauaauguuacau

SEQ ID NO: 3644469 - RNA, 22 nt, Human
aucagaccuuggaucagaugaa

SEQ ID NO: 3644470 - RNA, 13 nt, Human
aucagacugacag

SEQ ID NO: 3644471 - RNA, 18 nt, Human
aucagacuucacacugca

SEQ ID NO: 3644472 - RNA, 14 nt, Human
aucagagaaggaac

SEQ ID NO: 3644473 - RNA, 22 nt, Human
aucagagaugcaccaccaagcc

SEQ ID NO: 3644474 - RNA, 21 nt, Human
aucagagcagcagugaaaaca

SEQ ID NO: 3644475 - RNA, 15 nt, Human
aucagagguaucuua

SEQ ID NO: 3644476 - RNA, 15 nt, Human
aucagaguagaaaua

SEQ ID NO: 3644477 - RNA, 21 nt, Human
aggccccgaggacccagaccc

SEQ ID NO: 3644478 - RNA, 22 nt, Human
aggccccgcuuguccagcgccu

SEQ ID NO: 3644479 - RNA, 21 nt, Human
aggccccuauguaguccgugc

SEQ ID NO: 3644480 - RNA, 14 nt, Human
aggccccuggaggc

SEQ ID NO: 3644481 - RNA, 12 nt, Human
aggccccuggcc

SEQ ID NO: 3644482 - RNA, 16 nt, Human
aggccccuggcccagc

SEQ ID NO: 3644483 - RNA, 18 nt, Human
aggcccgagcagcugagc

SEQ ID NO: 3644484 - RNA, 15 nt, Human
aggcccggccucuca

SEQ ID NO: 3644485 - RNA, 16 nt, Human
aggcccggcuccaggc

SEQ ID NO: 3644486 - RNA, 21 nt, Human
aggcccggcuccaggcuccuu

SEQ ID NO: 3644487 - RNA, 15 nt, Human
aggcccguccggcag

SEQ ID NO: 3644488 - RNA, 23 nt, Human
aggcccgucuguccaucugcccg

SEQ ID NO: 3644489 - RNA, 18 nt, Human
aggcccucaagucuuucu

SEQ ID NO: 3644490 - RNA, 18 nt, Human
aggcccuccacaccugcg

SEQ ID NO: 3644491 - RNA, 20 nt, Human
aggcccuccacaccugcggc

SEQ ID NO: 3644492 - RNA, 19 nt, Human
aggcccuccucccucccag

SEQ ID NO: 3644493 - RNA, 23 nt, Human
aggcccuccucccucccagcucc

SEQ ID NO: 3644494 - RNA, 20 nt, Human
aggcccucgggcccagcccc

SEQ ID NO: 3644495 - RNA, 13 nt, Human
aggcccucuggag

SEQ ID NO: 3644496 - RNA, 15 nt, Human
aggcccucuggagug

SEQ ID NO: 3644497 - RNA, 13 nt, Human
aggcccugcacug

SEQ ID NO: 3644498 - RNA, 16 nt, Human
aggcccugcacugucc

SEQ ID NO: 3644499 - RNA, 17 nt, Human
aggcccugcacuguccu

SEQ ID NO: 3644500 - RNA, 21 nt, Human
aggcccugcacuguccugcuc

SEQ ID NO: 3644501 - RNA, 11 nt, Human
aggcccugcag

SEQ ID NO: 3644502 - RNA, 12 nt, Human
aggcccugcucc

SEQ ID NO: 3644503 - RNA, 18 nt, Human
aggcccugcuccugcagc

SEQ ID NO: 3644504 - RNA, 21 nt, Human
aggcccuggaucagcguggcc

SEQ ID NO: 3644505 - RNA, 13 nt, Human
aggcccugucugu

SEQ ID NO: 3644506 - RNA, 22 nt, Human
aggcccuuauuuucaagaaacu

SEQ ID NO: 3644507 - RNA, 19 nt, Human
aggcccuuccucuccacug

SEQ ID NO: 3644508 - RNA, 15 nt, Human
aggcccuucucucca

SEQ ID NO: 3644509 - RNA, 22 nt, Human
aggcccuucucuccagccccug

SEQ ID NO: 3644510 - RNA, 22 nt, Human
aggcccuugucggccccaccag

SEQ ID NO: 3644511 - RNA, 16 nt, Human
aggcccuuuccucagg

SEQ ID NO: 3644512 - RNA, 16 nt, Human
aggccgaagcucuggc

SEQ ID NO: 3644513 - RNA, 19 nt, Human
aggccgagaagcaagaaag

SEQ ID NO: 3644514 - RNA, 16 nt, Human
aggccgagaagccagu

SEQ ID NO: 3644515 - RNA, 19 nt, Human
aggccgauuugggaaccaa

SEQ ID NO: 3644516 - RNA, 12 nt, Human
aggccgcagcuc

SEQ ID NO: 3644517 - RNA, 13 nt, Human
aggccgcagcucu

SEQ ID NO: 3644518 - RNA, 17 nt, Human
aggccgcagcucuugcc

SEQ ID NO: 3644519 - RNA, 18 nt, Human
aggccgccccagccucug

SEQ ID NO: 3644520 - RNA, 16 nt, Human
aggccgcgcccuuucc

SEQ ID NO: 3644521 - RNA, 20 nt, Human
aggccgcgcguccagcugcc

SEQ ID NO: 3644522 - RNA, 13 nt, Human
aggccggcagccc

SEQ ID NO: 3644523 - RNA, 19 nt, Human
aggccggcagccccagccu

SEQ ID NO: 3644524 - RNA, 20 nt, Human
aggccggcagccccagccug

SEQ ID NO: 3644525 - RNA, 13 nt, Human
aggccggccagcc

SEQ ID NO: 3644526 - RNA, 20 nt, Human
aggccggcgagcccugugga

SEQ ID NO: 3644527 - RNA, 13 nt, Human
aggccgggcagag

SEQ ID NO: 3644528 - RNA, 18 nt, Human
aggccgggccuguacagu

SEQ ID NO: 3644529 - RNA, 22 nt, Human
aggccgggccuguacagucugu

SEQ ID NO: 3644530 - RNA, 14 nt, Human
aggccggugugccu

SEQ ID NO: 3644531 - RNA, 22 nt, Human
aggccgugacgucuggguggcc

SEQ ID NO: 3644532 - RNA, 15 nt, Human
aggccguggcugcug

SEQ ID NO: 3644533 - RNA, 16 nt, Human
aggccuaaaaguaaac

SEQ ID NO: 3644534 - RNA, 17 nt, Human
aggccuaaaaguaaaca

SEQ ID NO: 3644535 - RNA, 22 nt, Human
aggccuaaucucauaccucuga

SEQ ID NO: 3644536 - RNA, 16 nt, Human
aggccuaccccgcaga

SEQ ID NO: 3644537 - RNA, 13 nt, Human
aggccuacuccug

SEQ ID NO: 3644538 - RNA, 17 nt, Human
aggccuacuccugucuu

SEQ ID NO: 3644539 - RNA, 14 nt, Human
aggccuagacucug

SEQ ID NO: 3644540 - RNA, 17 nt, Human
aggccuagacucugucu

SEQ ID NO: 3644541 - RNA, 18 nt, Human
aggccuaggaggguccuc

SEQ ID NO: 3644542 - RNA, 20 nt, Human
aggccuagucagccacaugg

SEQ ID NO: 3644543 - RNA, 15 nt, Human
aggccuaguccugcg

SEQ ID NO: 3644544 - RNA, 18 nt, Human
aggccuauguugauccau

SEQ ID NO: 3644545 - RNA, 13 nt, Human
aggccuauuucau

SEQ ID NO: 3644546 - RNA, 18 nt, Human
aggccucaacuccuccca

SEQ ID NO: 3644547 - RNA, 13 nt, Human
aggccucagccag

SEQ ID NO: 3644548 - RNA, 13 nt, Human
aggccucagggcu

SEQ ID NO: 3644549 - RNA, 14 nt, Human
aggccucaggugcu

SEQ ID NO: 3644550 - RNA, 19 nt, Human
aggccucaggugcugucca

SEQ ID NO: 3644551 - RNA, 21 nt, Human
aggccucaggugcuguccaug

SEQ ID NO: 3644552 - RNA, 14 nt, Human
aggccuccagcuca

SEQ ID NO: 3644553 - RNA, 16 nt, Human
aggccuccagcucagc

SEQ ID NO: 3644554 - RNA, 18 nt, Human
aggccuccagcucagcag

SEQ ID NO: 3644555 - RNA, 20 nt, Human
aggccuccagcucagcagug

SEQ ID NO: 3644556 - RNA, 17 nt, Human
aggccuccaucucaugu

SEQ ID NO: 3644557 - RNA, 15 nt, Human
aggccucccacagug

SEQ ID NO: 3644558 - RNA, 13 nt, Human
aggccucccucaa

SEQ ID NO: 3644559 - RNA, 15 nt, Human
aggccucccucucuc

SEQ ID NO: 3644560 - RNA, 22 nt, Human
aggccucccucucucuucugcu

SEQ ID NO: 3644561 - RNA, 14 nt, Human
aggccuccuggccc

SEQ ID NO: 3644562 - RNA, 14 nt, Human
aggccuccuggcug

SEQ ID NO: 3644563 - RNA, 22 nt, Human
aggccuccuguggccugccagu

SEQ ID NO: 3644564 - RNA, 23 nt, Human
aggccuccuguggccugccaguc

SEQ ID NO: 3644565 - RNA, 14 nt, Human
aggccucgcaggaa

SEQ ID NO: 3644566 - RNA, 20 nt, Human
aggccucucaccucugugcc

SEQ ID NO: 3644567 - RNA, 12 nt, Human
aggccucucuca

SEQ ID NO: 3644568 - RNA, 18 nt, Human
aggccucugccucacaac

SEQ ID NO: 3644569 - RNA, 15 nt, Human
aggccucuuggagac

SEQ ID NO: 3644570 - RNA, 17 nt, Human
aggccugaaauccuggu

SEQ ID NO: 3644571 - RNA, 23 nt, Human
aggccugaaucaugagccugcug

SEQ ID NO: 3644572 - RNA, 16 nt, Human
aggccugacugccaag

SEQ ID NO: 3644573 - RNA, 21 nt, Human
aggccugacugccaagccaug

SEQ ID NO: 3644574 - RNA, 16 nt, Human
aggccugacuucugcu

SEQ ID NO: 3644575 - RNA, 21 nt, Human
aggccugacuucugcuggcau

SEQ ID NO: 3644576 - RNA, 14 nt, Human
aggccugagaccca

SEQ ID NO: 3644577 - RNA, 23 nt, Human
aggccugagauuucaucugcucu

SEQ ID NO: 3644578 - RNA, 14 nt, Human
aggccugagcgcuc

SEQ ID NO: 3644579 - RNA, 21 nt, Human
aggccugagcgcuccugccgc

SEQ ID NO: 3644580 - RNA, 16 nt, Human
aggccugaggaugagc

SEQ ID NO: 3644581 - RNA, 19 nt, Human
aggccugaggaugagcugg

SEQ ID NO: 3644582 - RNA, 23 nt, Human
aggccugaggaugagcuggaagg

SEQ ID NO: 3644583 - RNA, 19 nt, Human
aggccugagguuacuggaa

SEQ ID NO: 3644584 - RNA, 14 nt, Human
aggccugcacacaa

SEQ ID NO: 3644585 - RNA, 23 nt, Human
aggccugccagacggcacccacc

SEQ ID NO: 3644586 - RNA, 17 nt, Human
aggccugccuccagggc

SEQ ID NO: 3644587 - RNA, 21 nt, Human
aggccugccuccagggcugga

SEQ ID NO: 3644588 - RNA, 22 nt, Human
aggccugccucccacuucacug

SEQ ID NO: 3644589 - RNA, 18 nt, Human
aggccugcgacccugggg

SEQ ID NO: 3644590 - RNA, 15 nt, Human
aggccugcucaggga

SEQ ID NO: 3644591 - RNA, 14 nt, Human
aggccugcucccug

SEQ ID NO: 3644592 - RNA, 20 nt, Human
aggccugcuuugucuccucu

SEQ ID NO: 3644593 - RNA, 17 nt, Human
aggccuggacuuuccug

SEQ ID NO: 3644594 - RNA, 22 nt, Human
aggccuggacuuuccugcaacu

SEQ ID NO: 3644595 - RNA, 15 nt, Human
aggccuggcacagug

SEQ ID NO: 3644596 - RNA, 13 nt, Human
aggccuggccaga

SEQ ID NO: 3644597 - RNA, 17 nt, Human
aggccuggccagaugca

SEQ ID NO: 3644598 - RNA, 23 nt, Human
aggccuggccagaugcaccagcc

SEQ ID NO: 3644599 - RNA, 14 nt, Human
aggccuggccaggc

SEQ ID NO: 3644600 - RNA, 15 nt, Human
aggccuggccaggca

SEQ ID NO: 3644601 - RNA, 20 nt, Human
aggccuggccuuggagaacg

SEQ ID NO: 3644602 - RNA, 20 nt, Human
aggccugggccgcugccacg

SEQ ID NO: 3644603 - RNA, 18 nt, Human
aggccuggggugacccgg

SEQ ID NO: 3644604 - RNA, 15 nt, Human
aggccugucccuggc

SEQ ID NO: 3644605 - RNA, 23 nt, Human
aggccugucccuggccaucucug

SEQ ID NO: 3644606 - RNA, 14 nt, Human
aggccugucuguga

SEQ ID NO: 3644607 - RNA, 23 nt, Human
aggccuguguagcugugaccugc

SEQ ID NO: 3644608 - RNA, 20 nt, Human
aggccuguugcuauagagcc

SEQ ID NO: 3644609 - RNA, 18 nt, Human
aggccuguuuggccucuc

SEQ ID NO: 3644610 - RNA, 18 nt, Human
aggccuuaucauucauuc

SEQ ID NO: 3644611 - RNA, 19 nt, Human
aggccuuaucauucauucu

SEQ ID NO: 3644612 - RNA, 17 nt, Human
aggccuuaucuccaaga

SEQ ID NO: 3644613 - RNA, 17 nt, Human
aucaucaguauugaagc

SEQ ID NO: 3644614 - RNA, 14 nt, Human
aucaucauggccag

SEQ ID NO: 3644615 - RNA, 15 nt, Human
aucaucauuauuauu

SEQ ID NO: 3644616 - RNA, 13 nt, Human
aucauccacacau

SEQ ID NO: 3644617 - RNA, 14 nt, Human
aucauccagaaguu

SEQ ID NO: 3644618 - RNA, 17 nt, Human
aucauccagauguggcu

SEQ ID NO: 3644619 - RNA, 19 nt, Human
aucaucccuuucccuuggu

SEQ ID NO: 3644620 - RNA, 15 nt, Human
aucauccucuggcuu

SEQ ID NO: 3644621 - RNA, 12 nt, Human
aucaucuaaguc

SEQ ID NO: 3644622 - RNA, 24 nt, Human
augacguacaaguaguucuguauu

SEQ ID NO: 3644623 - RNA, 23 nt, Human
augacuaaaaauauuauaacuua

SEQ ID NO: 3644624 - RNA, 16 nt, Human
augacuaaagagagaa

SEQ ID NO: 3644625 - RNA, 19 nt, Human
augacuaaagagagaaugu

SEQ ID NO: 3644626 - RNA, 20 nt, Human
augacuaaagagagaaugua

SEQ ID NO: 3644627 - RNA, 18 nt, Human
augacuagaaagugaaua

SEQ ID NO: 3644628 - RNA, 19 nt, Human
augacuagaggcagggagg

SEQ ID NO: 3644629 - RNA, 16 nt, Human
augacucaagauuccc

SEQ ID NO: 3644630 - RNA, 19 nt, Human
augacucaagauucccagg

SEQ ID NO: 3644631 - RNA, 20 nt, Human
augacucaagauucccagga

SEQ ID NO: 3644632 - RNA, 14 nt, Human
augacucagaauau

SEQ ID NO: 3644633 - RNA, 19 nt, Human
augacucaggacauccccc

SEQ ID NO: 3644634 - RNA, 18 nt, Human
augacucuugacucuugc

SEQ ID NO: 3644635 - RNA, 18 nt, Human
augacucuuuauugucug

SEQ ID NO: 3644636 - RNA, 16 nt, Human
augacugaaagcacug

SEQ ID NO: 3644637 - RNA, 13 nt, Human
augacugcauuuu

SEQ ID NO: 3644638 - RNA, 17 nt, Human
augacugcuugcccuaa

SEQ ID NO: 3644639 - RNA, 14 nt, Human
augacuggcauuuu

SEQ ID NO: 3644640 - RNA, 15 nt, Human
augacuggcauuuua

SEQ ID NO: 3644641 - RNA, 13 nt, Human
augacuguagaau

SEQ ID NO: 3644642 - RNA, 14 nt, Human
augacuguguugua

SEQ ID NO: 3644643 - RNA, 14 nt, Human
augacuguuuuuaa

SEQ ID NO: 3644644 - RNA, 21 nt, Human
augacuguuuuucggacaguu

SEQ ID NO: 3644645 - RNA, 15 nt, Human
augacuguuuuuuaa

SEQ ID NO: 3644646 - RNA, 17 nt, Human
augacuuaguacaaagu

SEQ ID NO: 3644647 - RNA, 16 nt, Human
augacuugcuacuuuu

SEQ ID NO: 3644648 - RNA, 21 nt, Human
augacuugggcacccccagcc

SEQ ID NO: 3644649 - RNA, 22 nt, Human
augacuugggcacccccagccu

SEQ ID NO: 3644650 - RNA, 23 nt, Human
augacuuggugucuaauguguag

SEQ ID NO: 3644651 - RNA, 17 nt, Human
augacuuuauuauuuau

SEQ ID NO: 3644652 - RNA, 16 nt, Human
augacuuuauugcauc

SEQ ID NO: 3644653 - RNA, 21 nt, Human
augacuuuauugcaucugggu

SEQ ID NO: 3644654 - RNA, 21 nt, Human
augacuuucuuuuuguagcug

SEQ ID NO: 3644655 - RNA, 15 nt, Human
augacuuuuuauaaa

SEQ ID NO: 3644656 - RNA, 18 nt, Human
augacuuuuuauaaaaug

SEQ ID NO: 3644657 - RNA, 18 nt, Human
augacuuuuugaaaguaa

SEQ ID NO: 3644658 - RNA, 14 nt, Human
augagaaaagaggc

SEQ ID NO: 3644659 - RNA, 17 nt, Human
augagaaaaugucuuua

SEQ ID NO: 3644660 - RNA, 14 nt, Human
augagaaacugcau

SEQ ID NO: 3644661 - RNA, 11 nt, Human
augagaaacuu

SEQ ID NO: 3644662 - RNA, 15 nt, Human
augagaaagccuucu

SEQ ID NO: 3644663 - RNA, 23 nt, Human
augagaaaucuaaaaaacgaaaa

SEQ ID NO: 3644664 - RNA, 14 nt, Human
agggaagggagcca

SEQ ID NO: 3644665 - RNA, 17 nt, Human
agggaaggguuucucua

SEQ ID NO: 3644666 - RNA, 15 nt, Human
agggaaguaguuauc

SEQ ID NO: 3644667 - RNA, 19 nt, Human
agggaauaagguacaagaa

SEQ ID NO: 3644668 - RNA, 15 nt, Human
agggaauagaaaugu

SEQ ID NO: 3644669 - RNA, 23 nt, Human
agggaauccccgaaggugcugga

SEQ ID NO: 3644670 - RNA, 13 nt, Human
agggaaugccuga

SEQ ID NO: 3644671 - RNA, 18 nt, Human
agggaaugccugagugcc

SEQ ID NO: 3644672 - RNA, 21 nt, Human
agggaaugccugagugccugg

SEQ ID NO: 3644673 - RNA, 22 nt, Human
agggaauuucuaucuaaaugau

SEQ ID NO: 3644674 - RNA, 15 nt, Human
agggacaaaggagcc

SEQ ID NO: 3644675 - RNA, 18 nt, Human
agggacaaaggagccugu

SEQ ID NO: 3644676 - RNA, 19 nt, Human
agggacaaauuuaaaacaa

SEQ ID NO: 3644677 - RNA, 20 nt, Human
agggacaaauuuaaaacaaa

SEQ ID NO: 3644678 - RNA, 15 nt, Human
agggacacacagccu

SEQ ID NO: 3644679 - RNA, 15 nt, Human
agggacaccagccag

SEQ ID NO: 3644680 - RNA, 16 nt, Human
agggacaccagccagg

SEQ ID NO: 3644681 - RNA, 18 nt, Human
agggacaccagccaggcu

SEQ ID NO: 3644682 - RNA, 18 nt, Human
agggacagagacaccugc

SEQ ID NO: 3644683 - RNA, 19 nt, Human
agggacagagacaccugca

SEQ ID NO: 3644684 - RNA, 14 nt, Human
agggacagagccau

SEQ ID NO: 3644685 - RNA, 17 nt, Human
agggacagaggccccag

SEQ ID NO: 3644686 - RNA, 13 nt, Human
agggacagagggg

SEQ ID NO: 3644687 - RNA, 21 nt, Human
agggacagcccacugagaagu

SEQ ID NO: 3644688 - RNA, 16 nt, Human
agggacaggaccccag

SEQ ID NO: 3644689 - RNA, 13 nt, Human
agggacagucuca

SEQ ID NO: 3644690 - RNA, 15 nt, Human
agggacauauucauu

SEQ ID NO: 3644691 - RNA, 23 nt, Human
agggacauauucauuuggaaaua

SEQ ID NO: 3644692 - RNA, 19 nt, Human
agggacauguuuugauaaa

SEQ ID NO: 3644693 - RNA, 20 nt, Human
agggacauguuuugauaaag

SEQ ID NO: 3644694 - RNA, 13 nt, Human
agggaccaaggca

SEQ ID NO: 3644695 - RNA, 23 nt, Human
agggaccaaggcaaggcaggugc

SEQ ID NO: 3644696 - RNA, 14 nt, Human
agggaccacagcaa

SEQ ID NO: 3644697 - RNA, 13 nt, Human
agggaccaugugu

SEQ ID NO: 3644698 - RNA, 15 nt, Human
agggacccuuugggg

SEQ ID NO: 3644699 - RNA, 13 nt, Human
agggaccucuccc

SEQ ID NO: 3644700 - RNA, 13 nt, Human
agggaccugggga

SEQ ID NO: 3644701 - RNA, 14 nt, Human
agggaccuugaagg

SEQ ID NO: 3644702 - RNA, 17 nt, Human
agggacgaagaagagcc

SEQ ID NO: 3644703 - RNA, 22 nt, Human
agggacgaagaagagccacagu

SEQ ID NO: 3644704 - RNA, 19 nt, Human
agggacggccaagaaugua

SEQ ID NO: 3644705 - RNA, 20 nt, Human
agggacggccaagaauguac

SEQ ID NO: 3644706 - RNA, 17 nt, Human
agggacucaucuuuccc

SEQ ID NO: 3644707 - RNA, 22 nt, Human
agggacucaucuuucccuccuu

SEQ ID NO: 3644708 - RNA, 21 nt, Human
agggacucugaagccucuggg

SEQ ID NO: 3644709 - RNA, 16 nt, Human
agggacugaccagcag

SEQ ID NO: 3644710 - RNA, 15 nt, Human
agggacugaggggag

SEQ ID NO: 3644711 - RNA, 16 nt, Human
agggacugccucugcc

SEQ ID NO: 3644712 - RNA, 15 nt, Human
agggacuggaaccag

SEQ ID NO: 3644713 - RNA, 22 nt, Human
agggacugucgcugcuucgugg

SEQ ID NO: 3644714 - RNA, 12 nt, Human
agggacuuaaaa

SEQ ID NO: 3644715 - RNA, 13 nt, Human
agggacuuagcaa

SEQ ID NO: 3644716 - RNA, 15 nt, Human
agggacuugaaguug

SEQ ID NO: 3644717 - RNA, 15 nt, Human
agggacuuggaagcu

SEQ ID NO: 3644718 - RNA, 16 nt, Human
agggagaaggaucuag

SEQ ID NO: 3644719 - RNA, 20 nt, Human
agggagacacuggccccuca

SEQ ID NO: 3644720 - RNA, 12 nt, Human
agggagagccca

SEQ ID NO: 3644721 - RNA, 17 nt, Human
agggagaggagugacug

SEQ ID NO: 3644722 - RNA, 13 nt, Human
agggagagggagg

SEQ ID NO: 3644723 - RNA, 14 nt, Human
agggagauuuugag

SEQ ID NO: 3644724 - RNA, 21 nt, Human
agggagcacaacccccagcuc

SEQ ID NO: 3644725 - RNA, 19 nt, Human
agggagcaggcggugggca

SEQ ID NO: 3644726 - RNA, 16 nt, Human
agggagcagggaaggc

SEQ ID NO: 3644727 - RNA, 17 nt, Human
agggagcauuuuccucc

SEQ ID NO: 3644728 - RNA, 10 nt, Human
agggagccaa

SEQ ID NO: 3644729 - RNA, 15 nt, Human
agggagccaagggau

SEQ ID NO: 3644730 - RNA, 13 nt, Human
agggagccuccug

SEQ ID NO: 3644731 - RNA, 15 nt, Human
agggagccuccugcc

SEQ ID NO: 3644732 - RNA, 22 nt, Human
agggagccuccugcccaguccc

SEQ ID NO: 3644733 - RNA, 18 nt, Human
agggagcggaaagcagcu

SEQ ID NO: 3644734 - RNA, 19 nt, Human
agggagcggccggccagcc

SEQ ID NO: 3644735 - RNA, 21 nt, Human
agggagcggccggccagcccc

SEQ ID NO: 3644736 - RNA, 15 nt, Human
agggagcuagccaga

SEQ ID NO: 3644737 - RNA, 17 nt, Human
agggagcuagccagagg

SEQ ID NO: 3644738 - RNA, 19 nt, Human
agggagcuggcuccagccu

SEQ ID NO: 3644739 - RNA, 23 nt, Human
agggaggaaucgaggaaccagag

SEQ ID NO: 3644740 - RNA, 14 nt, Human
agggaggaccuggg

SEQ ID NO: 3644741 - RNA, 21 nt, Human
agggaggacgcucucuggccu

SEQ ID NO: 3644742 - RNA, 12 nt, Human
agggaggaggag

SEQ ID NO: 3644743 - RNA, 20 nt, Human
agggaggaggcagagaagaa

SEQ ID NO: 3644744 - RNA, 15 nt, Human
agggaggcaagcccu

SEQ ID NO: 3644745 - RNA, 16 nt, Human
agggaggcaagcccug

SEQ ID NO: 3644746 - RNA, 13 nt, Human
agggaggcagccu

SEQ ID NO: 3644747 - RNA, 16 nt, Human
agggaggcagccucca

SEQ ID NO: 3644748 - RNA, 17 nt, Human
agggaggcagccuccag

SEQ ID NO: 3644749 - RNA, 17 nt, Human
agggaggcauggucugc

SEQ ID NO: 3644750 - RNA, 17 nt, Human
agggaggccaucugggg

SEQ ID NO: 3644751 - RNA, 11 nt, Human
agggaggcccc

SEQ ID NO: 3644752 - RNA, 16 nt, Human
agggaggccccagggg

SEQ ID NO: 3644753 - RNA, 18 nt, Human
agggaggcgggggcugcc

SEQ ID NO: 3644754 - RNA, 22 nt, Human
agggaggcugcugcugcucuug

SEQ ID NO: 3644755 - RNA, 18 nt, Human
agggagggacauggcccc

SEQ ID NO: 3644756 - RNA, 17 nt, Human
agggagggagggcucca

SEQ ID NO: 3644757 - RNA, 16 nt, Human
agggagggcagagcug

SEQ ID NO: 3644758 - RNA, 20 nt, Human
agggagggcagagcuggugc

SEQ ID NO: 3644759 - RNA, 21 nt, Human
agggagggcagagcuggugcg

SEQ ID NO: 3644760 - RNA, 13 nt, Human
agggagggccugg

SEQ ID NO: 3644761 - RNA, 12 nt, Human
agggagggcucc

SEQ ID NO: 3644762 - RNA, 13 nt, Human
agggagggcucca

SEQ ID NO: 3644763 - RNA, 15 nt, Human
agggagggcuccaga

SEQ ID NO: 3644764 - RNA, 19 nt, Human
agggagggcuccagacaca

SEQ ID NO: 3644765 - RNA, 12 nt, Human
agggagggcucu

SEQ ID NO: 3644766 - RNA, 13 nt, Human
agggagggcucug

SEQ ID NO: 3644767 - RNA, 16 nt, Human
agggagggcucugagg

SEQ ID NO: 3644768 - RNA, 21 nt, Human
aucucuucagucucuauacca

SEQ ID NO: 3644769 - RNA, 21 nt, Human
aucucuucuggguuccuuccu

SEQ ID NO: 3644770 - RNA, 17 nt, Human
aucucuucuuaauguac

SEQ ID NO: 3644771 - RNA, 19 nt, Human
aucucuucuuaauguacau

SEQ ID NO: 3644772 - RNA, 13 nt, Human
aucucuuucacau

SEQ ID NO: 3644773 - RNA, 17 nt, Human
aucucuuucacauuguu

SEQ ID NO: 3644774 - RNA, 22 nt, Human
aucucuuucuaaagacaggaga

SEQ ID NO: 3644775 - RNA, 19 nt, Human
aucucuuuuauauuuguag

SEQ ID NO: 3644776 - RNA, 10 nt, Human
aucucuuuuc

SEQ ID NO: 3644777 - RNA, 19 nt, Human
aucucuuuuugcuuucgaa

SEQ ID NO: 3644778 - RNA, 19 nt, Human
aucugaaaaauacuuuugg

SEQ ID NO: 3644779 - RNA, 14 nt, Human
aucugaaaacugga

SEQ ID NO: 3644780 - RNA, 15 nt, Human
aucugaaaacuggaa

SEQ ID NO: 3644781 - RNA, 12 nt, Human
aucugaaaaugu

SEQ ID NO: 3644782 - RNA, 14 nt, Human
aucugaaaauguau

SEQ ID NO: 3644783 - RNA, 19 nt, Human
aucugaaaauguaugugua

SEQ ID NO: 3644784 - RNA, 17 nt, Human
aucugaaauaaggaaug

SEQ ID NO: 3644785 - RNA, 21 nt, Human
aucugaaauaggaaacaagug

SEQ ID NO: 3644786 - RNA, 14 nt, Human
aucugaagauuguu

SEQ ID NO: 3644787 - RNA, 16 nt, Human
aucugaagauuguuua

SEQ ID NO: 3644788 - RNA, 15 nt, Human
aucugaagcccuccc

SEQ ID NO: 3644789 - RNA, 17 nt, Human
aucugaagucagaucug

SEQ ID NO: 3644790 - RNA, 23 nt, Human
aucugaagucagaucugccuaag

SEQ ID NO: 3644791 - RNA, 17 nt, Human
aucugaauaccucuuug

SEQ ID NO: 3644792 - RNA, 12 nt, Human
aucugaauuuuu

SEQ ID NO: 3644793 - RNA, 20 nt, Human
aucugaauuuuuaaacaagu

SEQ ID NO: 3644794 - RNA, 18 nt, Human
aucugacaugauuccuuc

SEQ ID NO: 3644795 - RNA, 19 nt, Human
aucugacaugauuccuucc

SEQ ID NO: 3644796 - RNA, 20 nt, Human
aucugacccagugcccccac

SEQ ID NO: 3644797 - RNA, 21 nt, Human
aucugacccuaugggucuagg

SEQ ID NO: 3644798 - RNA, 16 nt, Human
aucugagaaucuuuau

SEQ ID NO: 3644799 - RNA, 13 nt, Human
aucugagaaugaa

SEQ ID NO: 3644800 - RNA, 23 nt, Human
aucugagagaggcuaaaauguuu

SEQ ID NO: 3644801 - RNA, 22 nt, Human
aucugagcaagagcuggcaaag

SEQ ID NO: 3644802 - RNA, 15 nt, Human
aucugagccagugcu

SEQ ID NO: 3644803 - RNA, 18 nt, Human
aucugagcucuuugcacu

SEQ ID NO: 3644804 - RNA, 17 nt, Human
aucugagcugagccagg

SEQ ID NO: 3644805 - RNA, 18 nt, Human
aucugagcugagccaggc

SEQ ID NO: 3644806 - RNA, 23 nt, Human
aucugaggaaucaacagggcagc

SEQ ID NO: 3644807 - RNA, 17 nt, Human
aucugaggaauucugua

SEQ ID NO: 3644808 - RNA, 18 nt, Human
aucugagggaaauguuuu

SEQ ID NO: 3644809 - RNA, 22 nt, Human
aucugagggaaauguuuuguaa

SEQ ID NO: 3644810 - RNA, 23 nt, Human
aucugagggaaauguuuuguaaa

SEQ ID NO: 3644811 - RNA, 20 nt, Human
aucugagguccugugaucuu

SEQ ID NO: 3644812 - RNA, 18 nt, Human
aucugauauguauuguuu

SEQ ID NO: 3644813 - RNA, 18 nt, Human
aucugaucagaacaaaug

SEQ ID NO: 3644814 - RNA, 22 nt, Human
aucugauggccuuaauuuccuu

SEQ ID NO: 3644815 - RNA, 17 nt, Human
aucugauggcuucucca

SEQ ID NO: 3644816 - RNA, 19 nt, Human
aucugauuuguuuuccucu

SEQ ID NO: 3644817 - RNA, 11 nt, Human
aucugcaaaag

SEQ ID NO: 3644818 - RNA, 22 nt, Human
aucugcaaaaggccucuuguaa

SEQ ID NO: 3644819 - RNA, 22 nt, Human
aucugcaaagcauguuuugcau

SEQ ID NO: 3644820 - RNA, 10 nt, Human
aucugcaccc

SEQ ID NO: 3644821 - RNA, 18 nt, Human
aucugcaccccccugggc

SEQ ID NO: 3644822 - RNA, 19 nt, Human
aucugcaccccccugggcu

SEQ ID NO: 3644823 - RNA, 18 nt, Human
aucugcaccccuucucuc

SEQ ID NO: 3644824 - RNA, 20 nt, Human
aucugcaccccuucucuccu

SEQ ID NO: 3644825 - RNA, 21 nt, Human
aucugcaccccuucucuccuc

SEQ ID NO: 3644826 - RNA, 21 nt, Human
aucugcacccucgaugaagcc

SEQ ID NO: 3644827 - RNA, 16 nt, Human
aucugcacccuucuuu

SEQ ID NO: 3644828 - RNA, 17 nt, Human
aucugcacccuucuuuu

SEQ ID NO: 3644829 - RNA, 22 nt, Human
aucugcagaaggaaaaaugugu

SEQ ID NO: 3644830 - RNA, 19 nt, Human
agggauggccguuggccac

SEQ ID NO: 3644831 - RNA, 15 nt, Human
agggaugggccuggc

SEQ ID NO: 3644832 - RNA, 14 nt, Human
agggaugguguuca

SEQ ID NO: 3644833 - RNA, 14 nt, Human
agggauguauuugu

SEQ ID NO: 3644834 - RNA, 13 nt, Human
agggauguggguu

SEQ ID NO: 3644835 - RNA, 21 nt, Human
agggauguggguuccacagac

SEQ ID NO: 3644836 - RNA, 21 nt, Human
agggauguuauuauccuuggg

SEQ ID NO: 3644837 - RNA, 18 nt, Human
agggauguucuggcccuc

SEQ ID NO: 3644838 - RNA, 18 nt, Human
agggauuaaccucugcac

SEQ ID NO: 3644839 - RNA, 17 nt, Human
agggauuacccaagcaa

SEQ ID NO: 3644840 - RNA, 20 nt, Human
agggauuagggagagaagau

SEQ ID NO: 3644841 - RNA, 15 nt, Human
agggauucaggcugc

SEQ ID NO: 3644842 - RNA, 18 nt, Human
agggauucaggcugcuug

SEQ ID NO: 3644843 - RNA, 22 nt, Human
agggauuccuaaucacucagag

SEQ ID NO: 3644844 - RNA, 17 nt, Human
agggauugauuuuaaaa

SEQ ID NO: 3644845 - RNA, 19 nt, Human
agggauugauuuuaaaaug

SEQ ID NO: 3644846 - RNA, 15 nt, Human
agggauuucuuaggg

SEQ ID NO: 3644847 - RNA, 12 nt, Human
agggauuugagg

SEQ ID NO: 3644848 - RNA, 18 nt, Human
agggcaaagccagguccc

SEQ ID NO: 3644849 - RNA, 20 nt, Human
agggcaaagccaggucccuc

SEQ ID NO: 3644850 - RNA, 20 nt, Human
agggcaaaugacaugcacug

SEQ ID NO: 3644851 - RNA, 21 nt, Human
agggcaaaugacaugcacuga

SEQ ID NO: 3644852 - RNA, 23 nt, Human
agggcaaaugacaugcacugacc

SEQ ID NO: 3644853 - RNA, 17 nt, Human
agggcaaauuggagaaa

SEQ ID NO: 3644854 - RNA, 21 nt, Human
agggcaagcuccgcaggacuu

SEQ ID NO: 3644855 - RNA, 22 nt, Human
agggcaagggccaugcugaagg

SEQ ID NO: 3644856 - RNA, 12 nt, Human
agggcaagucuu

SEQ ID NO: 3644857 - RNA, 18 nt, Human
agggcaauuaauuccuuc

SEQ ID NO: 3644858 - RNA, 14 nt, Human
agggcaauuggaac

SEQ ID NO: 3644859 - RNA, 17 nt, Human
agggcacaccgggcacu

SEQ ID NO: 3644860 - RNA, 14 nt, Human
agggcacaggagcu

SEQ ID NO: 3644861 - RNA, 18 nt, Human
agggcacaggagcuaccu

SEQ ID NO: 3644862 - RNA, 14 nt, Human
agggcacaggccau

SEQ ID NO: 3644863 - RNA, 19 nt, Human
agggcacaggccauggaug

SEQ ID NO: 3644864 - RNA, 19 nt, Human
agggcacauuccuugccug

SEQ ID NO: 3644865 - RNA, 15 nt, Human
agggcacuggagcug

SEQ ID NO: 3644866 - RNA, 14 nt, Human
agggcacugggcug

SEQ ID NO: 3644867 - RNA, 16 nt, Human
agggcacugguggccc

SEQ ID NO: 3644868 - RNA, 15 nt, Human
agggcagaaaguaga

SEQ ID NO: 3644869 - RNA, 17 nt, Human
agggcagaacacuaacc

SEQ ID NO: 3644870 - RNA, 22 nt, Human
agggcagaacacuaaccugacc

SEQ ID NO: 3644871 - RNA, 20 nt, Human
agggcagaccacauugcuuu

SEQ ID NO: 3644872 - RNA, 12 nt, Human
agggcagagcug

SEQ ID NO: 3644873 - RNA, 15 nt, Human
agggcagagcuggug

SEQ ID NO: 3644874 - RNA, 16 nt, Human
agggcagagcuggugc

SEQ ID NO: 3644875 - RNA, 14 nt, Human
agggcagaggcugg

SEQ ID NO: 3644876 - RNA, 15 nt, Human
agggcagaggcugga

SEQ ID NO: 3644877 - RNA, 22 nt, Human
agggcagaggcuggaggcaggg

SEQ ID NO: 3644878 - RNA, 17 nt, Human
agggcagagucacacgg

SEQ ID NO: 3644879 - RNA, 12 nt, Human
agggcagaguga

SEQ ID NO: 3644880 - RNA, 16 nt, Human
agggcagauuuuaguu

SEQ ID NO: 3644881 - RNA, 14 nt, Human
agggcagcagaucu

SEQ ID NO: 3644882 - RNA, 17 nt, Human
agggcagcagccagccc

SEQ ID NO: 3644883 - RNA, 19 nt, Human
agggcagcagccagcccug

SEQ ID NO: 3644884 - RNA, 23 nt, Human
agggcagcagccagcccugccug

SEQ ID NO: 3644885 - RNA, 22 nt, Human
agggcagccagggagagcccag

SEQ ID NO: 3644886 - RNA, 16 nt, Human
agggcagccugccugg

SEQ ID NO: 3644887 - RNA, 17 nt, Human
agggcagccugccugga

SEQ ID NO: 3644888 - RNA, 17 nt, Human
agggcagcugggcccaa

SEQ ID NO: 3644889 - RNA, 20 nt, Human
agggcagcugggcccaaccc

SEQ ID NO: 3644890 - RNA, 11 nt, Human
agggcagcuug

SEQ ID NO: 3644891 - RNA, 16 nt, Human
agggcaggaaggagag

SEQ ID NO: 3644892 - RNA, 22 nt, Human
agggcagggaccacacccugua

SEQ ID NO: 3644893 - RNA, 12 nt, Human
agggcagggacu

SEQ ID NO: 3644894 - RNA, 13 nt, Human
agggcagggcauc

SEQ ID NO: 3644895 - RNA, 16 nt, Human
agggcagggcucugau

SEQ ID NO: 3644896 - RNA, 20 nt, Human
agggcagucauuggcugucu

SEQ ID NO: 3644897 - RNA, 13 nt, Human
agggcaguguuuc

SEQ ID NO: 3644898 - RNA, 18 nt, Human
agggcaguguuuccuuuu

SEQ ID NO: 3644899 - RNA, 20 nt, Human
agggcaguucgcagccaccc

SEQ ID NO: 3644900 - RNA, 13 nt, Human
agggcaguuuucu

SEQ ID NO: 3644901 - RNA, 19 nt, Human
agggcauaaaacagcuuug

SEQ ID NO: 3644902 - RNA, 21 nt, Human
agggcauccauaccagcucgc

SEQ ID NO: 3644903 - RNA, 23 nt, Human
agggcaucuccugugcaugggug

SEQ ID NO: 3644904 - RNA, 17 nt, Human
agggcaucucugggcug

SEQ ID NO: 3644905 - RNA, 18 nt, Human
agggcaugcauuuugcag

SEQ ID NO: 3644906 - RNA, 20 nt, Human
agggcaugccccggccaccu

SEQ ID NO: 3644907 - RNA, 21 nt, Human
agggcaugcgcacaaggcuga

SEQ ID NO: 3644908 - RNA, 14 nt, Human
agggcauucuuucc

SEQ ID NO: 3644909 - RNA, 19 nt, Human
agggcauucuuucccagug

SEQ ID NO: 3644910 - RNA, 19 nt, Human
agggcauuugagaaaugca

SEQ ID NO: 3644911 - RNA, 18 nt, Human
agggccaaaagcuucccu

SEQ ID NO: 3644912 - RNA, 22 nt, Human
augacuguuuuucggacaguuu

SEQ ID NO: 3644913 - RNA, 22 nt, Human
augacuuauuguggauaacaaa

SEQ ID NO: 3644914 - RNA, 16 nt, Human
augacuucauuaauaa

SEQ ID NO: 3644915 - RNA, 13 nt, Human
augacuucccaac

SEQ ID NO: 3644916 - RNA, 18 nt, Human
augacuuggugucuaaug

SEQ ID NO: 3644917 - RNA, 20 nt, Human
augacuuguagcauauucuu

SEQ ID NO: 3644918 - RNA, 11 nt, Human
augacuuugga

SEQ ID NO: 3644919 - RNA, 20 nt, Human
augagaaacuggcaaagcag

SEQ ID NO: 3644920 - RNA, 21 nt, Human
augagaaacuuaaauguuauu

SEQ ID NO: 3644921 - RNA, 19 nt, Human
augagaaagccuucuuuug

SEQ ID NO: 3644922 - RNA, 15 nt, Human
augagaaauguaaug

SEQ ID NO: 3644923 - RNA, 16 nt, Human
augagaaauguaaugc

SEQ ID NO: 3644924 - RNA, 13 nt, Human
augagaacaaagc

SEQ ID NO: 3644925 - RNA, 18 nt, Human
augagaacaaagcuguua

SEQ ID NO: 3644926 - RNA, 23 nt, Human
augagaacaaagcuguuaaacug

SEQ ID NO: 3644927 - RNA, 14 nt, Human
augagaacagacug

SEQ ID NO: 3644928 - RNA, 12 nt, Human
augagaacaugu

SEQ ID NO: 3644929 - RNA, 19 nt, Human
augagaacauguugguauu

SEQ ID NO: 3644930 - RNA, 13 nt, Human
augagaagaauag

SEQ ID NO: 3644931 - RNA, 14 nt, Human
augagaauuucuaa

SEQ ID NO: 3644932 - RNA, 13 nt, Human
augagacacagga

SEQ ID NO: 3644933 - RNA, 14 nt, Human
augagacacaggau

SEQ ID NO: 3644934 - RNA, 15 nt, Human
augagacucuagggu

SEQ ID NO: 3644935 - RNA, 23 nt, Human
augagacuuccaaaccugacaga

SEQ ID NO: 3644936 - RNA, 21 nt, Human
augagacuuuaaaagcauuuu

SEQ ID NO: 3644937 - RNA, 14 nt, Human
augagagacacacu

SEQ ID NO: 3644938 - RNA, 19 nt, Human
augagagacacacugaaga

SEQ ID NO: 3644939 - RNA, 20 nt, Human
augagagacacacugaagaa

SEQ ID NO: 3644940 - RNA, 13 nt, Human
augagaggaggca

SEQ ID NO: 3644941 - RNA, 20 nt, Human
augagaggggagagcugaac

SEQ ID NO: 3644942 - RNA, 15 nt, Human
augagaguuuuggau

SEQ ID NO: 3644943 - RNA, 18 nt, Human
augagaguuuuggaugca

SEQ ID NO: 3644944 - RNA, 16 nt, Human
augagauacuuugcau

SEQ ID NO: 3644945 - RNA, 21 nt, Human
augagauagaagauguuugcu

SEQ ID NO: 3644946 - RNA, 20 nt, Human
augagaucaggcucugccuc

SEQ ID NO: 3644947 - RNA, 22 nt, Human
augagaucuaggugaggauuga

SEQ ID NO: 3644948 - RNA, 17 nt, Human
augagaucugaaugugg

SEQ ID NO: 3644949 - RNA, 23 nt, Human
augagaugauacauccaaagcag

SEQ ID NO: 3644950 - RNA, 22 nt, Human
augagaugcuggcuugggcagc

SEQ ID NO: 3644951 - RNA, 17 nt, Human
augagauuaauuccuuu

SEQ ID NO: 3644952 - RNA, 13 nt, Human
augagcaccucca

SEQ ID NO: 3644953 - RNA, 13 nt, Human
augagcacuucua

SEQ ID NO: 3644954 - RNA, 15 nt, Human
augagcagaagcucu

SEQ ID NO: 3644955 - RNA, 14 nt, Human
augagcagaaggaa

SEQ ID NO: 3644956 - RNA, 21 nt, Human
augagcauuggauacagcagu

SEQ ID NO: 3644957 - RNA, 21 nt, Human
augagccaccgcgcccagccu

SEQ ID NO: 3644958 - RNA, 14 nt, Human
augagccagacaaa

SEQ ID NO: 3644959 - RNA, 11 nt, Human
augagcccaga

SEQ ID NO: 3644960 - RNA, 12 nt, Human
augagcccagag

SEQ ID NO: 3644961 - RNA, 16 nt, Human
augagcccagagaaca

SEQ ID NO: 3644962 - RNA, 17 nt, Human
augagcccagagaacag

SEQ ID NO: 3644963 - RNA, 19 nt, Human
augagccgcccaaggccuu

SEQ ID NO: 3644964 - RNA, 23 nt, Human
augagccgcugugagccccuggu

SEQ ID NO: 3644965 - RNA, 12 nt, Human
augagccucagc

SEQ ID NO: 3644966 - RNA, 15 nt, Human
augagccucagcauc

SEQ ID NO: 3644967 - RNA, 17 nt, Human
augagccucagcauccu

SEQ ID NO: 3644968 - RNA, 21 nt, Human
augagccucagcauccuggca

SEQ ID NO: 3644969 - RNA, 14 nt, Human
augagccugcugga

SEQ ID NO: 3644970 - RNA, 17 nt, Human
augagccugcuggaagc

SEQ ID NO: 3644971 - RNA, 19 nt, Human
augagcuacgccugccucc

SEQ ID NO: 3644972 - RNA, 14 nt, Human
augagcuauguauu

SEQ ID NO: 3644973 - RNA, 16 nt, Human
augagcuauguauuaa

SEQ ID NO: 3644974 - RNA, 17 nt, Human
augagcuauuaaaacuc

SEQ ID NO: 3644975 - RNA, 22 nt, Human
augagcuauuaaaacucagccu

SEQ ID NO: 3644976 - RNA, 22 nt, Human
augagcucccacaagccugagg

SEQ ID NO: 3644977 - RNA, 22 nt, Human
augagcucgcauuugucaauga

SEQ ID NO: 3644978 - RNA, 18 nt, Human
augagcuuucugaacagc

SEQ ID NO: 3644979 - RNA, 21 nt, Human
augagcuuucugaacagcugg

SEQ ID NO: 3644980 - RNA, 21 nt, Human
augaggaaaauucuuaaaagg

SEQ ID NO: 3644981 - RNA, 22 nt, Human
augaggaacuguagaugaugua

SEQ ID NO: 3644982 - RNA, 16 nt, Human
augaggaaggaacagc

SEQ ID NO: 3644983 - RNA, 14 nt, Human
augaggaauaauua

SEQ ID NO: 3644984 - RNA, 14 nt, Human
augaggaggaagga

SEQ ID NO: 3644985 - RNA, 13 nt, Human
augaggaggaugc

SEQ ID NO: 3644986 - RNA, 18 nt, Human
augaggaggaugcuaaaa

SEQ ID NO: 3644987 - RNA, 24 nt, Human
augaggaggaugucccugggccag

SEQ ID NO: 3644988 - RNA, 22 nt, Human
augaggaggcagaaagcagagg

SEQ ID NO: 3644989 - RNA, 13 nt, Human
augaggaggggag

SEQ ID NO: 3644990 - RNA, 14 nt, Human
augaggaggggagg

SEQ ID NO: 3644991 - RNA, 21 nt, Human
augaggaggggccccccugcc

SEQ ID NO: 3644992 - RNA, 14 nt, Human
augaggaggguggg

SEQ ID NO: 3644993 - RNA, 22 nt, Human
augaggagggugggggagggag

SEQ ID NO: 3644994 - RNA, 18 nt, Human
augaggagugaacauuug

SEQ ID NO: 3644995 - RNA, 21 nt, Human
augaggaugcagagucagcag

SEQ ID NO: 3644996 - RNA, 22 nt, Human
augaggaugcagagucagcaga

SEQ ID NO: 3644997 - RNA, 19 nt, Human
augaggcaaccugauugua

SEQ ID NO: 3644998 - RNA, 20 nt, Human
augaggcaaccugauuguaa

SEQ ID NO: 3644999 - RNA, 14 nt, Human
augaggcauuuggc

SEQ ID NO: 3645000 - RNA, 23 nt, Human
augaggccacugcugcuucucca

SEQ ID NO: 3645001 - RNA, 15 nt, Human
augaggccauggacu

SEQ ID NO: 3645002 - RNA, 14 nt, Human
augaggcccuccac

SEQ ID NO: 3645003 - RNA, 21 nt, Human
augaggccgcuagaggccuga

SEQ ID NO: 3645004 - RNA, 15 nt, Human
augaggccucuugga

SEQ ID NO: 3645005 - RNA, 21 nt, Human
augaggccucuuggaccucug

SEQ ID NO: 3645006 - RNA, 23 nt, Human
augaggccucuuggaccucugcu

SEQ ID NO: 3645007 - RNA, 17 nt, Human
augaggcuugcugagag

SEQ ID NO: 3645008 - RNA, 20 nt, Human
augagggacuggaaccaggg

SEQ ID NO: 3645009 - RNA, 16 nt, Human
augagggaucacaggg

SEQ ID NO: 3645010 - RNA, 17 nt, Human
augagggcagcagccag

SEQ ID NO: 3645011 - RNA, 22 nt, Human
augagggcagcagccagcccug

SEQ ID NO: 3645012 - RNA, 13 nt, Human
augaggggagggg

SEQ ID NO: 3645013 - RNA, 15 nt, Human
augaggggcccgagc

SEQ ID NO: 3645014 - RNA, 20 nt, Human
augagggguuccuccccucc

SEQ ID NO: 3645015 - RNA, 22 nt, Human
augagggguuccuccccuccag

SEQ ID NO: 3645016 - RNA, 20 nt, Human
augaggguaucaaauaaaau

SEQ ID NO: 3645017 - RNA, 13 nt, Human
augagggucuugg

SEQ ID NO: 3645018 - RNA, 17 nt, Human
augagguacugagagug

SEQ ID NO: 3645019 - RNA, 15 nt, Human
augaggucagagccu

SEQ ID NO: 3645020 - RNA, 16 nt, Human
augaggucccaggcag

SEQ ID NO: 3645021 - RNA, 20 nt, Human
augaggucccaggcagagaa

SEQ ID NO: 3645022 - RNA, 14 nt, Human
augaggugcuggga

SEQ ID NO: 3645023 - RNA, 13 nt, Human
augaggugggagg

SEQ ID NO: 3645024 - RNA, 16 nt, Human
augaguacaaaugccu

SEQ ID NO: 3645025 - RNA, 23 nt, Human
augaguauacaauauauaaaaau

SEQ ID NO: 3645026 - RNA, 17 nt, Human
augagucaaugugcagu

SEQ ID NO: 3645027 - RNA, 19 nt, Human
augagucaaugugcagugu

SEQ ID NO: 3645028 - RNA, 16 nt, Human
augaguccaaacugga

SEQ ID NO: 3645029 - RNA, 19 nt, Human
augaguccaaacuggaaug

SEQ ID NO: 3645030 - RNA, 13 nt, Human
augaguccccugu

SEQ ID NO: 3645031 - RNA, 23 nt, Human
augaguccccuguuuguuucuga

SEQ ID NO: 3645032 - RNA, 18 nt, Human
augaguccuugaaaauau

SEQ ID NO: 3645033 - RNA, 21 nt, Human
augaguccuugaaaauauuuu

SEQ ID NO: 3645034 - RNA, 13 nt, Human
augagucuagaug

SEQ ID NO: 3645035 - RNA, 22 nt, Human
augcucucugcagccagcccag

SEQ ID NO: 3645036 - RNA, 23 nt, Human
augcucucugcagccagcccagc

SEQ ID NO: 3645037 - RNA, 18 nt, Human
augcucugcauguuacau

SEQ ID NO: 3645038 - RNA, 19 nt, Human
augcucugcauguuacaua

SEQ ID NO: 3645039 - RNA, 16 nt, Human
augcucuuagaaaauu

SEQ ID NO: 3645040 - RNA, 18 nt, Human
augcucuuauuucaucau

SEQ ID NO: 3645041 - RNA, 15 nt, Human
augcucuuucccacc

SEQ ID NO: 3645042 - RNA, 16 nt, Human
augcucuuuuguuugg

SEQ ID NO: 3645043 - RNA, 21 nt, Human
augcucuuuuuuacucauuga

SEQ ID NO: 3645044 - RNA, 24 nt, Human
augcucuuuuuuacucauugaaau

SEQ ID NO: 3645045 - RNA, 17 nt, Human
augcugaacauugcaua

SEQ ID NO: 3645046 - RNA, 23 nt, Human
augcugaacauugcauauaacuu

SEQ ID NO: 3645047 - RNA, 14 nt, Human
augcugaggccugg

SEQ ID NO: 3645048 - RNA, 15 nt, Human
augcugaggccuggg

SEQ ID NO: 3645049 - RNA, 22 nt, Human
augcugaggccugggccgcugc

SEQ ID NO: 3645050 - RNA, 13 nt, Human
augcugagggugu

SEQ ID NO: 3645051 - RNA, 18 nt, Human
augcugagucucccaagg

SEQ ID NO: 3645052 - RNA, 12 nt, Human
augcugaucauc

SEQ ID NO: 3645053 - RNA, 24 nt, Human
augcugaucaucgccagaggugcu

SEQ ID NO: 3645054 - RNA, 18 nt, Human
augcugauguucagugua

SEQ ID NO: 3645055 - RNA, 21 nt, Human
augcugauguucaguguaauu

SEQ ID NO: 3645056 - RNA, 16 nt, Human
agguggaagagggcug

SEQ ID NO: 3645057 - RNA, 21 nt, Human
agguggaagcccuccuuccac

SEQ ID NO: 3645058 - RNA, 21 nt, Human
agguggaauuauuuuaaaaga

SEQ ID NO: 3645059 - RNA, 14 nt, Human
agguggaccuuuua

SEQ ID NO: 3645060 - RNA, 15 nt, Human
agguggaccuuuuaa

SEQ ID NO: 3645061 - RNA, 15 nt, Human
agguggagguugcau

SEQ ID NO: 3645062 - RNA, 15 nt, Human
agguggaguggaugc

SEQ ID NO: 3645063 - RNA, 19 nt, Human
agguggauuuuguuuaaaa

SEQ ID NO: 3645064 - RNA, 17 nt, Human
agguggcacuuuuucau

SEQ ID NO: 3645065 - RNA, 15 nt, Human
agguggcagcccugu

SEQ ID NO: 3645066 - RNA, 17 nt, Human
agguggcaggugagcaa

SEQ ID NO: 3645067 - RNA, 22 nt, Human
agguggcaucagugucuuucca

SEQ ID NO: 3645068 - RNA, 17 nt, Human
agguggccaaguuccuc

SEQ ID NO: 3645069 - RNA, 12 nt, Human
agguggccaugc

SEQ ID NO: 3645070 - RNA, 19 nt, Human
agguggccaugccucagcc

SEQ ID NO: 3645071 - RNA, 17 nt, Human
agguggcucuccaguua

SEQ ID NO: 3645072 - RNA, 19 nt, Human
agguggcucuccaguuagu

SEQ ID NO: 3645073 - RNA, 19 nt, Human
agguggcugacccaguccc

SEQ ID NO: 3645074 - RNA, 20 nt, Human
agguggcugacccagucccu

SEQ ID NO: 3645075 - RNA, 21 nt, Human
agguggcugacccagucccug

SEQ ID NO: 3645076 - RNA, 17 nt, Human
agguggcugagccccug

SEQ ID NO: 3645077 - RNA, 18 nt, Human
agguggcugccuggagcc

SEQ ID NO: 3645078 - RNA, 14 nt, Human
aggugggagcagga

SEQ ID NO: 3645079 - RNA, 15 nt, Human
aggugggagcaggag

SEQ ID NO: 3645080 - RNA, 17 nt, Human
aggugggagcaggagau

SEQ ID NO: 3645081 - RNA, 13 nt, Human
aggugggagcuug

SEQ ID NO: 3645082 - RNA, 13 nt, Human
aggugggaggaug

SEQ ID NO: 3645083 - RNA, 16 nt, Human
aggugggauccuccag

SEQ ID NO: 3645084 - RNA, 22 nt, Human
aggugggcaggugguggcacug

SEQ ID NO: 3645085 - RNA, 17 nt, Human
aggugggccagccccuc

SEQ ID NO: 3645086 - RNA, 22 nt, Human
aggugggccagccccucccacc

SEQ ID NO: 3645087 - RNA, 22 nt, Human
aggugggcccaggaccagcugg

SEQ ID NO: 3645088 - RNA, 12 nt, Human
aggugggcccgg

SEQ ID NO: 3645089 - RNA, 22 nt, Human
aggugggccuugcuaccucaag

SEQ ID NO: 3645090 - RNA, 19 nt, Human
aggugggcgggcagcacag

SEQ ID NO: 3645091 - RNA, 20 nt, Human
aggugggcgggcagcacagc

SEQ ID NO: 3645092 - RNA, 22 nt, Human
aggugggcgggcagcacagcaa

SEQ ID NO: 3645093 - RNA, 15 nt, Human
aggugggcugagccc

SEQ ID NO: 3645094 - RNA, 16 nt, Human
aggugggcugagcccu

SEQ ID NO: 3645095 - RNA, 17 nt, Human
aggugggcugagcccug

SEQ ID NO: 3645096 - RNA, 18 nt, Human
aggugggcugagcccugg

SEQ ID NO: 3645097 - RNA, 19 nt, Human
aggugggcugagcccuggc

SEQ ID NO: 3645098 - RNA, 21 nt, Human
aggugggcugggcccucucuu

SEQ ID NO: 3645099 - RNA, 18 nt, Human
aggugggcuucaguaagu

SEQ ID NO: 3645100 - RNA, 14 nt, Human
agguggggacaggg

SEQ ID NO: 3645101 - RNA, 17 nt, Human
agguggggacagggaug

SEQ ID NO: 3645102 - RNA, 18 nt, Human
agguggggagacugggcu

SEQ ID NO: 3645103 - RNA, 21 nt, Human
agguggggagacugggcugag

SEQ ID NO: 3645104 - RNA, 22 nt, Human
aggugggguauuuaccacagca

SEQ ID NO: 3645105 - RNA, 21 nt, Human
agguggguuuucuucccauca

SEQ ID NO: 3645106 - RNA, 22 nt, Human
agguggguuuucuucccaucac

SEQ ID NO: 3645107 - RNA, 14 nt, Human
agguggucugaaug

SEQ ID NO: 3645108 - RNA, 23 nt, Human
agguggucugaauguucugacau

SEQ ID NO: 3645109 - RNA, 19 nt, Human
aggugguggcacugagccc

SEQ ID NO: 3645110 - RNA, 18 nt, Human
agguggugggcauucucu

SEQ ID NO: 3645111 - RNA, 19 nt, Human
agguggugggcauucucuc

SEQ ID NO: 3645112 - RNA, 21 nt, Human
agguggugucacugucccucc

SEQ ID NO: 3645113 - RNA, 23 nt, Human
aggugucagccauugcacccagc

SEQ ID NO: 3645114 - RNA, 19 nt, Human
agguguccagcauugcugg

SEQ ID NO: 3645115 - RNA, 20 nt, Human
agguguccagcauugcugga

SEQ ID NO: 3645116 - RNA, 16 nt, Human
agguguccuacagaaa

SEQ ID NO: 3645117 - RNA, 18 nt, Human
agguguccuacagaaaaa

SEQ ID NO: 3645118 - RNA, 20 nt, Human
agguguccuacagaaaaacc

SEQ ID NO: 3645119 - RNA, 16 nt, Human
aggugucucaggcugc

SEQ ID NO: 3645120 - RNA, 18 nt, Human
aggugucucaggcugccu

SEQ ID NO: 3645121 - RNA, 16 nt, Human
aggugucugcacccag

SEQ ID NO: 3645122 - RNA, 13 nt, Human
aggugucuguauc

SEQ ID NO: 3645123 - RNA, 16 nt, Human
aggugucuuccuccca

SEQ ID NO: 3645124 - RNA, 19 nt, Human
aggugucuuccucccaagu

SEQ ID NO: 3645125 - RNA, 17 nt, Human
aggugugaaccaccaca

SEQ ID NO: 3645126 - RNA, 22 nt, Human
aggugugaaccaccacacccag

SEQ ID NO: 3645127 - RNA, 21 nt, Human
aggugugaaggugauuuaagg

SEQ ID NO: 3645128 - RNA, 15 nt, Human
aggugugaggcagga

SEQ ID NO: 3645129 - RNA, 22 nt, Human
aggugugagucaccaagcccag

SEQ ID NO: 3645130 - RNA, 14 nt, Human
aggugugcaagaga

SEQ ID NO: 3645131 - RNA, 18 nt, Human
aggugugggggcugcagc

SEQ ID NO: 3645132 - RNA, 21 nt, Human
aggugugguguaauuuauaaa

SEQ ID NO: 3645133 - RNA, 14 nt, Human
agguguuagagagg

SEQ ID NO: 3645134 - RNA, 12 nt, Human
agguguuauuug

SEQ ID NO: 3645135 - RNA, 22 nt, Human
agguguugaagaaauuauaaag

SEQ ID NO: 3645136 - RNA, 18 nt, Human
agguguugauuuucuguu

SEQ ID NO: 3645137 - RNA, 21 nt, Human
agguguugauuuucuguugua

SEQ ID NO: 3645138 - RNA, 21 nt, Human
agguguugccaaauauguccu

SEQ ID NO: 3645139 - RNA, 22 nt, Human
agguguugccaaauauguccug

SEQ ID NO: 3645140 - RNA, 18 nt, Human
agguguuggugacaauug

SEQ ID NO: 3645141 - RNA, 20 nt, Human
agguguuuaaagagagguua

SEQ ID NO: 3645142 - RNA, 18 nt, Human
agguguuuauuaaaauuc

SEQ ID NO: 3645143 - RNA, 15 nt, Human
agguguuugaaaaua

SEQ ID NO: 3645144 - RNA, 17 nt, Human
agguguuugaaaauagu

SEQ ID NO: 3645145 - RNA, 22 nt, Human
agguguuugaacagaggccaca

SEQ ID NO: 3645146 - RNA, 18 nt, Human
agguguuuuguucaccau

SEQ ID NO: 3645147 - RNA, 22 nt, Human
agguguuuuuuaugaagugcgu

SEQ ID NO: 3645148 - RNA, 23 nt, Human
agguguuuuuuaugaagugcgug

SEQ ID NO: 3645149 - RNA, 18 nt, Human
agguuaaaaaaaaaaguc

SEQ ID NO: 3645150 - RNA, 15 nt, Human
agguuaaaaaaaugg

SEQ ID NO: 3645151 - RNA, 16 nt, Human
agguuaaaaagaaaag

SEQ ID NO: 3645152 - RNA, 11 nt, Human
agguuaaaugu

SEQ ID NO: 3645153 - RNA, 12 nt, Human
agguuaaauguu

SEQ ID NO: 3645154 - RNA, 19 nt, Human
agguuaaauguuuuguaaa

SEQ ID NO: 3645155 - RNA, 16 nt, Human
agguuaacuauguaca

SEQ ID NO: 3645156 - RNA, 16 nt, Human
agguuaauauuuaaga

SEQ ID NO: 3645157 - RNA, 15 nt, Human
agguuaauuccaauu

SEQ ID NO: 3645158 - RNA, 14 nt, Human
agguuacaacagau

SEQ ID NO: 3645159 - RNA, 21 nt, Human
agguuacaacagauuugugaa

SEQ ID NO: 3645160 - RNA, 22 nt, Human
agguuacaacagauuugugaac

SEQ ID NO: 3645161 - RNA, 24 nt, Human
agguuacaacagauuugugaacuc

SEQ ID NO: 3645162 - RNA, 15 nt, Human
agguuacaagccugc

SEQ ID NO: 3645163 - RNA, 17 nt, Human
agguuacccuguaacau

SEQ ID NO: 3645164 - RNA, 21 nt, Human
agguuacccuguaacaugcaa

SEQ ID NO: 3645165 - RNA, 22 nt, Human
agguuagauuuuguauucaggg

SEQ ID NO: 3645166 - RNA, 19 nt, Human
agguuauaauuuuuuuuaa

SEQ ID NO: 3645167 - RNA, 19 nt, Human
agguuauaggucacuccug

SEQ ID NO: 3645168 - RNA, 17 nt, Human
agguuaucgaaauaaca

SEQ ID NO: 3645169 - RNA, 16 nt, Human
agguuaucugucccag

SEQ ID NO: 3645170 - RNA, 17 nt, Human
agguuaucugucccagg

SEQ ID NO: 3645171 - RNA, 18 nt, Human
agguuauuaugauuagcu

SEQ ID NO: 3645172 - RNA, 19 nt, Human
agguuauuuuaguuucugu

SEQ ID NO: 3645173 - RNA, 16 nt, Human
agguuauuuucuccug

SEQ ID NO: 3645174 - RNA, 13 nt, Human
agguucagccaag

SEQ ID NO: 3645175 - RNA, 15 nt, Human
agguucaugcccaag

SEQ ID NO: 3645176 - RNA, 12 nt, Human
agguucauggau

SEQ ID NO: 3645177 - RNA, 17 nt, Human
agguuccaacuguauau

SEQ ID NO: 3645178 - RNA, 13 nt, Human
agguucccacuua

SEQ ID NO: 3645179 - RNA, 16 nt, Human
agguucccucugagaa

SEQ ID NO: 3645180 - RNA, 20 nt, Human
agguucccuguucuuccucc

SEQ ID NO: 3645181 - RNA, 13 nt, Human
agguucccuuuga

SEQ ID NO: 3645182 - RNA, 18 nt, Human
agguuccgcuuggagcag

SEQ ID NO: 3645183 - RNA, 12 nt, Human
agguuccucugc

SEQ ID NO: 3645184 - RNA, 11 nt, Human
agguucuaaag

SEQ ID NO: 3645185 - RNA, 12 nt, Human
agguucuaaagu

SEQ ID NO: 3645186 - RNA, 14 nt, Human
agguucuaaaguuc

SEQ ID NO: 3645187 - RNA, 16 nt, Human
agguucuaaaguucua

SEQ ID NO: 3645188 - RNA, 19 nt, Human
agguucuaaaguucuaaga

SEQ ID NO: 3645189 - RNA, 20 nt, Human
agguucuaaaguucuaagau

SEQ ID NO: 3645190 - RNA, 23 nt, Human
agguucuaaaguucuaagauucu

SEQ ID NO: 3645191 - RNA, 20 nt, Human
agguucuccguuagcuccug

SEQ ID NO: 3645192 - RNA, 17 nt, Human
agguucucuccucccca

SEQ ID NO: 3645193 - RNA, 20 nt, Human
agguucucucuacugguccu

SEQ ID NO: 3645194 - RNA, 15 nt, Human
agguucuuaaaagug

SEQ ID NO: 3645195 - RNA, 17 nt, Human
agguucuuagugucacu

SEQ ID NO: 3645196 - RNA, 19 nt, Human
agguucuucccuuuuacau

SEQ ID NO: 3645197 - RNA, 19 nt, Human
agguucuucuuccugaagc

SEQ ID NO: 3645198 - RNA, 13 nt, Human
agguugaaaaaca

SEQ ID NO: 3645199 - RNA, 12 nt, Human
agguugaaagac

SEQ ID NO: 3645200 - RNA, 15 nt, Human
auggccaugguaccc

SEQ ID NO: 3645201 - RNA, 14 nt, Human
auggcccaguguca

SEQ ID NO: 3645202 - RNA, 15 nt, Human
auggcccauccugug

SEQ ID NO: 3645203 - RNA, 15 nt, Human
auggcccauucuacu

SEQ ID NO: 3645204 - RNA, 23 nt, Human
auggcccauucuacuugcucugg

SEQ ID NO: 3645205 - RNA, 24 nt, Human
auggcccauucuacuugcucugga

SEQ ID NO: 3645206 - RNA, 15 nt, Human
auggccccagcacag

SEQ ID NO: 3645207 - RNA, 23 nt, Human
auggccccucugaccugcacugg

SEQ ID NO: 3645208 - RNA, 18 nt, Human
auggcccggaugcugcuu

SEQ ID NO: 3645209 - RNA, 21 nt, Human
auggcccggaugcugcuuccg

SEQ ID NO: 3645210 - RNA, 13 nt, Human
auggcccucuggu

SEQ ID NO: 3645211 - RNA, 11 nt, Human
auggcccuggg

SEQ ID NO: 3645212 - RNA, 18 nt, Human
auggcccuuccuccucca

SEQ ID NO: 3645213 - RNA, 21 nt, Human
auggcccuuccuccuccacca

SEQ ID NO: 3645214 - RNA, 18 nt, Human
auggccggagaggaccgg

SEQ ID NO: 3645215 - RNA, 21 nt, Human
auggccguguagaagcauggu

SEQ ID NO: 3645216 - RNA, 15 nt, Human
auggccuaaauuuau

SEQ ID NO: 3645217 - RNA, 21 nt, Human
auggccuauuauauuaaaaua

SEQ ID NO: 3645218 - RNA, 13 nt, Human
auggccucagcug

SEQ ID NO: 3645219 - RNA, 18 nt, Human
auggccucauguggcugg

SEQ ID NO: 3645220 - RNA, 20 nt, Human
auggccucauguggcuggaa

SEQ ID NO: 3645221 - RNA, 22 nt, Human
auggccucuuacuaauguaaaa

SEQ ID NO: 3645222 - RNA, 19 nt, Human
auggccugagacuuucuuu

SEQ ID NO: 3645223 - RNA, 22 nt, Human
auggccugcaaacugggaaccc

SEQ ID NO: 3645224 - RNA, 17 nt, Human
auggccuuaauuuccuu

SEQ ID NO: 3645225 - RNA, 20 nt, Human
auggccuuugcuugaaagaa

SEQ ID NO: 3645226 - RNA, 16 nt, Human
auggcgcagugccucu

SEQ ID NO: 3645227 - RNA, 20 nt, Human
auggcgccaccagcucugcc

SEQ ID NO: 3645228 - RNA, 17 nt, Human
auggcguaaguacagag

SEQ ID NO: 3645229 - RNA, 19 nt, Human
auggcuaacuuacaaagau

SEQ ID NO: 3645230 - RNA, 18 nt, Human
auggcuacuuugguuucu

SEQ ID NO: 3645231 - RNA, 14 nt, Human
auggcuauaaauau

SEQ ID NO: 3645232 - RNA, 16 nt, Human
auggcuauaaauauau

SEQ ID NO: 3645233 - RNA, 15 nt, Human
auggcuauaggugcu

SEQ ID NO: 3645234 - RNA, 16 nt, Human
auggcuauaggugcua

SEQ ID NO: 3645235 - RNA, 19 nt, Human
auggcuauaggugcuacaa

SEQ ID NO: 3645236 - RNA, 14 nt, Human
auggcuaugcuuaa

SEQ ID NO: 3645237 - RNA, 19 nt, Human
auggcucacuauggugcca

SEQ ID NO: 3645238 - RNA, 22 nt, Human
auggcucacuauggugccaaug

SEQ ID NO: 3645239 - RNA, 13 nt, Human
auggcucagaggg

SEQ ID NO: 3645240 - RNA, 13 nt, Human
auggcuccagucu

SEQ ID NO: 3645241 - RNA, 22 nt, Human
auggcuccagucugcugcccuc

SEQ ID NO: 3645242 - RNA, 12 nt, Human
auggcucccagg

SEQ ID NO: 3645243 - RNA, 17 nt, Human
auggcucugcaccccuc

SEQ ID NO: 3645244 - RNA, 22 nt, Human
auggcucugcaccccucugccc

SEQ ID NO: 3645245 - RNA, 12 nt, Human
auggcucuggac

SEQ ID NO: 3645246 - RNA, 22 nt, Human
auggcucuggacucuaaagacc

SEQ ID NO: 3645247 - RNA, 12 nt, Human
auggcucuucau

SEQ ID NO: 3645248 - RNA, 18 nt, Human
auggcugacuuugcucuu

SEQ ID NO: 3645249 - RNA, 20 nt, Human
auggcugauaauuuuaaauu

SEQ ID NO: 3645250 - RNA, 12 nt, Human
auggcugcugaa

SEQ ID NO: 3645251 - RNA, 18 nt, Human
auggcuggagcuagaauu

SEQ ID NO: 3645252 - RNA, 15 nt, Human
auggcuggccacugc

SEQ ID NO: 3645253 - RNA, 22 nt, Human
auggcugggaacugcagaccug

SEQ ID NO: 3645254 - RNA, 15 nt, Human
auggcugugaggaug

SEQ ID NO: 3645255 - RNA, 16 nt, Human
auggcugugccucugc

SEQ ID NO: 3645256 - RNA, 19 nt, Human
auggcugugccucugccug

SEQ ID NO: 3645257 - RNA, 16 nt, Human
auggcuguggagugug

SEQ ID NO: 3645258 - RNA, 16 nt, Human
auggcuuaguuuucau

SEQ ID NO: 3645259 - RNA, 19 nt, Human
auggcuuauccagcuggug

SEQ ID NO: 3645260 - RNA, 16 nt, Human
auggcuuccaaggugg

SEQ ID NO: 3645261 - RNA, 14 nt, Human
auggcuuguucauc

SEQ ID NO: 3645262 - RNA, 23 nt, Human
auggcuuuauuuguuuuuuuugu

SEQ ID NO: 3645263 - RNA, 16 nt, Human
auggcuuucagaaaac

SEQ ID NO: 3645264 - RNA, 23 nt, Human
auggcuuucagaaaacgggaagc

SEQ ID NO: 3645265 - RNA, 15 nt, Human
auggcuuuguauaga

SEQ ID NO: 3645266 - RNA, 16 nt, Human
auggcuuuguauagaa

SEQ ID NO: 3645267 - RNA, 18 nt, Human
augggaaaacugccaaua

SEQ ID NO: 3645268 - RNA, 14 nt, Human
augucgauuaaaau

SEQ ID NO: 3645269 - RNA, 14 nt, Human
augucgccucugca

SEQ ID NO: 3645270 - RNA, 13 nt, Human
augucggccucua

SEQ ID NO: 3645271 - RNA, 19 nt, Human
augucguaguuacucucag

SEQ ID NO: 3645272 - RNA, 18 nt, Human
augucgucgagcuccccc

SEQ ID NO: 3645273 - RNA, 14 nt, Human
augucuaaaauugu

SEQ ID NO: 3645274 - RNA, 18 nt, Human
augucuaauguauuuuau

SEQ ID NO: 3645275 - RNA, 21 nt, Human
augucuaugauucguguaauu

SEQ ID NO: 3645276 - RNA, 15 nt, Human
augucuauucagcuu

SEQ ID NO: 3645277 - RNA, 12 nt, Human
augucuauuuaa

SEQ ID NO: 3645278 - RNA, 23 nt, Human
augucuauuuaagccucauauuu

SEQ ID NO: 3645279 - RNA, 14 nt, Human
augucucacugagc

SEQ ID NO: 3645280 - RNA, 22 nt, Human
augucucacugagcacuguuuu

SEQ ID NO: 3645281 - RNA, 22 nt, Human
augucucaggucccugcagggc

SEQ ID NO: 3645282 - RNA, 23 nt, Human
augucucagguuuguuuugugaa

SEQ ID NO: 3645283 - RNA, 14 nt, Human
augucuccuaagca

SEQ ID NO: 3645284 - RNA, 16 nt, Human
augucucgugguagga

SEQ ID NO: 3645285 - RNA, 15 nt, Human
augucucuaaagcac

SEQ ID NO: 3645286 - RNA, 13 nt, Human
augucucucagaa

SEQ ID NO: 3645287 - RNA, 21 nt, Human
augucucucagaauucuucag

SEQ ID NO: 3645288 - RNA, 14 nt, Human
augucucugcaaac

SEQ ID NO: 3645289 - RNA, 21 nt, Human
augucucugugagacucgaga

SEQ ID NO: 3645290 - RNA, 16 nt, Human
augucucuucugagcu

SEQ ID NO: 3645291 - RNA, 18 nt, Human
augucugaacuuugggaa

SEQ ID NO: 3645292 - RNA, 15 nt, Human
augucugagugaacc

SEQ ID NO: 3645293 - RNA, 16 nt, Human
augucugagugaaccu

SEQ ID NO: 3645294 - RNA, 15 nt, Human
augucugcagcccug

SEQ ID NO: 3645295 - RNA, 14 nt, Human
augucugccaauuu

SEQ ID NO: 3645296 - RNA, 16 nt, Human
augucugccaauuuuu

SEQ ID NO: 3645297 - RNA, 23 nt, Human
augucugccaauuuuugccuuca

SEQ ID NO: 3645298 - RNA, 15 nt, Human
augucugccacacaa

SEQ ID NO: 3645299 - RNA, 21 nt, Human
augucugguucucaauuccaa

SEQ ID NO: 3645300 - RNA, 18 nt, Human
augucuguagcuccucaa

SEQ ID NO: 3645301 - RNA, 20 nt, Human
augucugugcuagggaaacu

SEQ ID NO: 3645302 - RNA, 14 nt, Human
augucuguucuaca

SEQ ID NO: 3645303 - RNA, 16 nt, Human
augucuguugaugacu

SEQ ID NO: 3645304 - RNA, 16 nt, Human
augucuguuuaagaaa

SEQ ID NO: 3645305 - RNA, 13 nt, Human
augucuguuugcu

SEQ ID NO: 3645306 - RNA, 14 nt, Human
augucuguuugcug

SEQ ID NO: 3645307 - RNA, 13 nt, Human
augucuuaaugaa

SEQ ID NO: 3645308 - RNA, 20 nt, Human
augucuuaaugaaguuugaa

SEQ ID NO: 3645309 - RNA, 12 nt, Human
augucuuauuuu

SEQ ID NO: 3645310 - RNA, 15 nt, Human
augucuuauuuuuag

SEQ ID NO: 3645311 - RNA, 17 nt, Human
augucuucaaggcuuca

SEQ ID NO: 3645312 - RNA, 15 nt, Human
augucuucauaaagu

SEQ ID NO: 3645313 - RNA, 22 nt, Human
augucuucauaccuacauguau

SEQ ID NO: 3645314 - RNA, 18 nt, Human
augucuucauuucauugu

SEQ ID NO: 3645315 - RNA, 18 nt, Human
augucuuccauguaucuu

SEQ ID NO: 3645316 - RNA, 13 nt, Human
augucuuccugga

SEQ ID NO: 3645317 - RNA, 17 nt, Human
augucuucguacaguuc

SEQ ID NO: 3645318 - RNA, 14 nt, Human
augucuucucccug

SEQ ID NO: 3645319 - RNA, 15 nt, Human
augucuucucccugg

SEQ ID NO: 3645320 - RNA, 18 nt, Human
augucuuguaagcaaaag

SEQ ID NO: 3645321 - RNA, 11 nt, Human
augucuugugu

SEQ ID NO: 3645322 - RNA, 20 nt, Human
augucuuuguuggaaaagaa

SEQ ID NO: 3645323 - RNA, 23 nt, Human
augucuuuguuggaaaagaauac

SEQ ID NO: 3645324 - RNA, 20 nt, Human
augucuuuuauaguggaaaa

SEQ ID NO: 3645325 - RNA, 16 nt, Human
augucuuuuauauuug

SEQ ID NO: 3645326 - RNA, 20 nt, Human
augucuuuuauauuuguauc

SEQ ID NO: 3645327 - RNA, 14 nt, Human
augucuuuucuugc

SEQ ID NO: 3645328 - RNA, 16 nt, Human
augucuuuucuuggca

SEQ ID NO: 3645329 - RNA, 19 nt, Human
augucuuuugaugaauaga

SEQ ID NO: 3645330 - RNA, 16 nt, Human
augucuuuuuaagcuu

SEQ ID NO: 3645331 - RNA, 17 nt, Human
augucuuuuuuuuaaug

SEQ ID NO: 3645332 - RNA, 18 nt, Human
augucuuuuuuuuaaugu

SEQ ID NO: 3645333 - RNA, 18 nt, Human
augugaaaaggcaaaaag

SEQ ID NO: 3645334 - RNA, 13 nt, Human
augugaaacacuu

SEQ ID NO: 3645335 - RNA, 22 nt, Human
augugaaacacuuugccuccug

SEQ ID NO: 3645336 - RNA, 12 nt, Human
augugaaaccuu

SEQ ID NO: 3645337 - RNA, 20 nt, Human
augugaaaggauaugaaucu

SEQ ID NO: 3645338 - RNA, 18 nt, Human
augugaaaucauucauuu

SEQ ID NO: 3645339 - RNA, 15 nt, Human
augugaacacaucag

SEQ ID NO: 3645340 - RNA, 16 nt, Human
augugaacagcggcug

SEQ ID NO: 3645341 - RNA, 22 nt, Human
augugaaccauuaaccagaucu

SEQ ID NO: 3645342 - RNA, 12 nt, Human
augugaacuugu

SEQ ID NO: 3645343 - RNA, 14 nt, Human
augugaacuuguag

SEQ ID NO: 3645344 - RNA, 20 nt, Human
augugaacuuguagcuguaa

SEQ ID NO: 3645345 - RNA, 15 nt, Human
auguggguuccacag

SEQ ID NO: 3645346 - RNA, 17 nt, Human
auguggguuccacagac

SEQ ID NO: 3645347 - RNA, 15 nt, Human
auguggucacagcug

SEQ ID NO: 3645348 - RNA, 16 nt, Human
auguggucacagcugu

SEQ ID NO: 3645349 - RNA, 18 nt, Human
auguggugaggcaggcuu

SEQ ID NO: 3645350 - RNA, 15 nt, Human
auguggugggacagg

SEQ ID NO: 3645351 - RNA, 21 nt, Human
auguggugggacagggaccca

SEQ ID NO: 3645352 - RNA, 15 nt, Human
augugguuacacacu

SEQ ID NO: 3645353 - RNA, 17 nt, Human
augugguuauuucucug

SEQ ID NO: 3645354 - RNA, 15 nt, Human
augugguucuucaaa

SEQ ID NO: 3645355 - RNA, 17 nt, Human
augugguuuucuuaagg

SEQ ID NO: 3645356 - RNA, 21 nt, Human
auguguaaacaauuuuauaua

SEQ ID NO: 3645357 - RNA, 22 nt, Human
auguguaacacagugccuucaa

SEQ ID NO: 3645358 - RNA, 13 nt, Human
auguguaaguauu

SEQ ID NO: 3645359 - RNA, 19 nt, Human
auguguacaucccauguaa

SEQ ID NO: 3645360 - RNA, 21 nt, Human
auguguacaucccauguaaca

SEQ ID NO: 3645361 - RNA, 14 nt, Human
auguguacauggca

SEQ ID NO: 3645362 - RNA, 22 nt, Human
auguguacauggcagaguuugu

SEQ ID NO: 3645363 - RNA, 17 nt, Human
auguguagccugugcau

SEQ ID NO: 3645364 - RNA, 21 nt, Human
auguguagcugcaaaaauaau

SEQ ID NO: 3645365 - RNA, 23 nt, Human
auguguauaaaaauaaaaaagau

SEQ ID NO: 3645366 - RNA, 14 nt, Human
auguguauaaauug

SEQ ID NO: 3645367 - RNA, 16 nt, Human
auguguauauauacau

SEQ ID NO: 3645368 - RNA, 19 nt, Human
auguguauauauacauaca

SEQ ID NO: 3645369 - RNA, 23 nt, Human
auguguauauauacauacacuug

SEQ ID NO: 3645370 - RNA, 18 nt, Human
auguguaucggaugcuuu

SEQ ID NO: 3645371 - RNA, 20 nt, Human
auguguauuuccagugcaau

SEQ ID NO: 3645372 - RNA, 14 nt, Human
auguguauuucuua

SEQ ID NO: 3645373 - RNA, 16 nt, Human
auguguauuucuuaua

SEQ ID NO: 3645374 - RNA, 21 nt, Human
augugucacuacucacagucu

SEQ ID NO: 3645375 - RNA, 15 nt, Human
augugucacuugugc

SEQ ID NO: 3645376 - RNA, 17 nt, Human
augugucacuugugcuu

SEQ ID NO: 3645377 - RNA, 14 nt, Human
augugucccagaag

SEQ ID NO: 3645378 - RNA, 22 nt, Human
auguguccuaucuaucuuccaa

SEQ ID NO: 3645379 - RNA, 20 nt, Human
augugucuguauuucaugug

SEQ ID NO: 3645380 - RNA, 21 nt, Human
augugucuguauuucaugugg

SEQ ID NO: 3645381 - RNA, 13 nt, Human
augugucuuuaga

SEQ ID NO: 3645382 - RNA, 21 nt, Human
augugucuuuagauagcccug

SEQ ID NO: 3645383 - RNA, 13 nt, Human
augugugaaguga

SEQ ID NO: 3645384 - RNA, 16 nt, Human
augugugcaugugugu

SEQ ID NO: 3645385 - RNA, 20 nt, Human
augugugccauagaguuuaa

SEQ ID NO: 3645386 - RNA, 15 nt, Human
augugugcccagcuu

SEQ ID NO: 3645387 - RNA, 15 nt, Human
augugugcgagugug

SEQ ID NO: 3645388 - RNA, 19 nt, Human
augugugcgagugugugca

SEQ ID NO: 3645389 - RNA, 17 nt, Human
augugugcucuucuucu

SEQ ID NO: 3645390 - RNA, 15 nt, Human
auguguggcagauuu

SEQ ID NO: 3645391 - RNA, 14 nt, Human
auguguggccugca

SEQ ID NO: 3645392 - RNA, 20 nt, Human
auguguguagacaaauauuu

SEQ ID NO: 3645393 - RNA, 21 nt, Human
auguguguauaagugcacaca

SEQ ID NO: 3645394 - RNA, 15 nt, Human
auguguguauaugga

SEQ ID NO: 3645395 - RNA, 16 nt, Human
auguguguauauggac

SEQ ID NO: 3645396 - RNA, 17 nt, Human
auguguguauauguaug

SEQ ID NO: 3645397 - RNA, 22 nt, Human
auguguguauauguaugugugu

SEQ ID NO: 3645398 - RNA, 20 nt, Human
auguguguaugggugugugu

SEQ ID NO: 3645399 - RNA, 18 nt, Human
augugugugaugugacau

SEQ ID NO: 3645400 - RNA, 19 nt, Human
augugugugaugugacauu

SEQ ID NO: 3645401 - RNA, 20 nt, Human
augugugugaugugacauuu

SEQ ID NO: 3645402 - RNA, 16 nt, Human
augugugugcaagugu

SEQ ID NO: 3645403 - RNA, 19 nt, Human
augugugugcaagugugug

SEQ ID NO: 3645404 - RNA, 21 nt, Human
auguguguguaugcuacuaca

SEQ ID NO: 3645405 - RNA, 21 nt, Human
auguguguguauguuugcaca

SEQ ID NO: 3645406 - RNA, 15 nt, Human
auguguguugauacu

SEQ ID NO: 3645407 - RNA, 22 nt, Human
auguguguugauacuguugcac

SEQ ID NO: 3645408 - RNA, 12 nt, Human
auguguguuuaa

SEQ ID NO: 3645409 - RNA, 19 nt, Human
auguguguuuaaauaaagu

SEQ ID NO: 3645410 - RNA, 13 nt, Human
auguguuaaucuu

SEQ ID NO: 3645411 - RNA, 20 nt, Human
auguguuaaucuuaauguau

SEQ ID NO: 3645412 - RNA, 13 nt, Human
auguguucuuauu

SEQ ID NO: 3645413 - RNA, 13 nt, Human
auguguugccacu

SEQ ID NO: 3645414 - RNA, 16 nt, Human
auguguuggacaaaug

SEQ ID NO: 3645415 - RNA, 17 nt, Human
auguguuggacaaaugu

SEQ ID NO: 3645416 - RNA, 22 nt, Human
auguguuggacaaaugugaaga

SEQ ID NO: 3645417 - RNA, 22 nt, Human
auguguuggggaagggccugcc

SEQ ID NO: 3645418 - RNA, 13 nt, Human
auguguugugaua

SEQ ID NO: 3645419 - RNA, 13 nt, Human
auguguuuagaau

SEQ ID NO: 3645420 - RNA, 20 nt, Human
auguguuuagaauugaaggu

SEQ ID NO: 3645421 - RNA, 17 nt, Human
auguguuucacaguuug

SEQ ID NO: 3645422 - RNA, 22 nt, Human
auguguuucacaguuugaaaua

SEQ ID NO: 3645423 - RNA, 12 nt, Human
auguguuuccau

SEQ ID NO: 3645424 - RNA, 12 nt, Human
auguguuugugu

SEQ ID NO: 3645425 - RNA, 15 nt, Human
auguguuuuagaugg

SEQ ID NO: 3645426 - RNA, 16 nt, Human
auguguuuuauaaaau

SEQ ID NO: 3645427 - RNA, 16 nt, Human
auguguuuuucuccag

SEQ ID NO: 3645428 - RNA, 17 nt, Human
auguguuuuucuccagu

SEQ ID NO: 3645429 - RNA, 15 nt, Human
auguuaaaauguauu

SEQ ID NO: 3645430 - RNA, 14 nt, Human
auguuaaaaugugu

SEQ ID NO: 3645431 - RNA, 15 nt, Human
auguuaaacuagcau

SEQ ID NO: 3645432 - RNA, 19 nt, Human
auguuaaacuagcauaucu

SEQ ID NO: 3645433 - RNA, 12 nt, Human
augguggcuggg

SEQ ID NO: 3645434 - RNA, 17 nt, Human
augguggcuucagcucc

SEQ ID NO: 3645435 - RNA, 17 nt, Human
auggugggcuucagggc

SEQ ID NO: 3645436 - RNA, 22 nt, Human
auggugguaaacauucucucag

SEQ ID NO: 3645437 - RNA, 24 nt, Human
auggugguugggacccaguggcag

SEQ ID NO: 3645438 - RNA, 20 nt, Human
augguguaauaagacauaac

SEQ ID NO: 3645439 - RNA, 19 nt, Human
augguguagaacacuaauu

SEQ ID NO: 3645440 - RNA, 18 nt, Human
auggugugaaagucagau

SEQ ID NO: 3645441 - RNA, 18 nt, Human
auggugugaacccgggag

SEQ ID NO: 3645442 - RNA, 23 nt, Human
augguguggacugaaugggauca

SEQ ID NO: 3645443 - RNA, 14 nt, Human
augguguuacugca

SEQ ID NO: 3645444 - RNA, 15 nt, Human
augguguucuccugc

SEQ ID NO: 3645445 - RNA, 20 nt, Human
augguguugcccugagugga

SEQ ID NO: 3645446 - RNA, 16 nt, Human
augguguuuucaugua

SEQ ID NO: 3645447 - RNA, 22 nt, Human
augguguuuuucuuguaaaugu

SEQ ID NO: 3645448 - RNA, 13 nt, Human
augguuaacuaau

SEQ ID NO: 3645449 - RNA, 17 nt, Human
augguuacaaacuacag

SEQ ID NO: 3645450 - RNA, 15 nt, Human
augguuaugaaagaa

SEQ ID NO: 3645451 - RNA, 19 nt, Human
augguuaugaaagaauaua

SEQ ID NO: 3645452 - RNA, 17 nt, Human
augguuccaugccugag

SEQ ID NO: 3645453 - RNA, 18 nt, Human
augguuccaugccugagg

SEQ ID NO: 3645454 - RNA, 20 nt, Human
augguuccaugccugagggu

SEQ ID NO: 3645455 - RNA, 22 nt, Human
augguuccaugccugagggugg

SEQ ID NO: 3645456 - RNA, 20 nt, Human
augguuccccuguucacucu

SEQ ID NO: 3645457 - RNA, 21 nt, Human
augguucccuugaugaagaag

SEQ ID NO: 3645458 - RNA, 16 nt, Human
augguucguucuguuu

SEQ ID NO: 3645459 - RNA, 16 nt, Human
augguucucaggccug

SEQ ID NO: 3645460 - RNA, 16 nt, Human
augguugagaaaugaa

SEQ ID NO: 3645461 - RNA, 15 nt, Human
augguugccuuaaag

SEQ ID NO: 3645462 - RNA, 17 nt, Human
augguugccuuaaagaa

SEQ ID NO: 3645463 - RNA, 18 nt, Human
augguugccuuaaagaaa

SEQ ID NO: 3645464 - RNA, 23 nt, Human
augguugguaacacaaauuuuca

SEQ ID NO: 3645465 - RNA, 12 nt, Human
augguuguauua

SEQ ID NO: 3645466 - RNA, 16 nt, Human
augguuguauuagaug

SEQ ID NO: 3645467 - RNA, 18 nt, Human
augguuguauuagauguu

SEQ ID NO: 3645468 - RNA, 18 nt, Human
augguugucuguuuuugu

SEQ ID NO: 3645469 - RNA, 22 nt, Human
augguuuauuuuguauuguggu

SEQ ID NO: 3645470 - RNA, 22 nt, Human
augguuucagcacuagccaaac

SEQ ID NO: 3645471 - RNA, 22 nt, Human
augguuuccuccauuugagaaa

SEQ ID NO: 3645472 - RNA, 22 nt, Human
augguuugacucccgaacauca

SEQ ID NO: 3645473 - RNA, 18 nt, Human
augguuugcaaggaagcc

SEQ ID NO: 3645474 - RNA, 15 nt, Human
augguuuggagcuga

SEQ ID NO: 3645475 - RNA, 14 nt, Human
augguuuucuugug

SEQ ID NO: 3645476 - RNA, 17 nt, Human
augguuuuugagauauu

SEQ ID NO: 3645477 - RNA, 11 nt, Human
auguaaaaagg

SEQ ID NO: 3645478 - RNA, 21 nt, Human
auguaaaacauuuauuuugac

SEQ ID NO: 3645479 - RNA, 13 nt, Human
auguaaaagccua

SEQ ID NO: 3645480 - RNA, 14 nt, Human
auguaaaaucuugu

SEQ ID NO: 3645481 - RNA, 16 nt, Human
auguaaaaucuuguca

SEQ ID NO: 3645482 - RNA, 20 nt, Human
auguaaaaucuugucaugug

SEQ ID NO: 3645483 - RNA, 16 nt, Human
auguaaaauguugaau

SEQ ID NO: 3645484 - RNA, 13 nt, Human
auguaaaauguuu

SEQ ID NO: 3645485 - RNA, 14 nt, Human
auguaaaauuuugc

SEQ ID NO: 3645486 - RNA, 18 nt, Human
auguaaacaaaauuuagu

SEQ ID NO: 3645487 - RNA, 15 nt, Human
auguaaacagugccu

SEQ ID NO: 3645488 - RNA, 23 nt, Human
auguaaacauaauucuuguauau

SEQ ID NO: 3645489 - RNA, 15 nt, Human
auguuaccucugaau

SEQ ID NO: 3645490 - RNA, 14 nt, Human
auguuacuauuuuc

SEQ ID NO: 3645491 - RNA, 21 nt, Human
auguuacuauuuucuacaauu

SEQ ID NO: 3645492 - RNA, 23 nt, Human
auguuacuauuuucuacaauuaa

SEQ ID NO: 3645493 - RNA, 17 nt, Human
auguuacucucuugcac

SEQ ID NO: 3645494 - RNA, 18 nt, Human
auguuacugaucaugcau

SEQ ID NO: 3645495 - RNA, 24 nt, Human
auguuagacucaugguguguuaca

SEQ ID NO: 3645496 - RNA, 15 nt, Human
auguuagagacuuuu

SEQ ID NO: 3645497 - RNA, 14 nt, Human
auguuagaguaaug

SEQ ID NO: 3645498 - RNA, 18 nt, Human
auguuaggaaaauuucac

SEQ ID NO: 3645499 - RNA, 20 nt, Human
auguuaguaauaccucuaau

SEQ ID NO: 3645500 - RNA, 16 nt, Human
auguuagucauuguua

SEQ ID NO: 3645501 - RNA, 20 nt, Human
auguuaguuaccuuauaguu

SEQ ID NO: 3645502 - RNA, 18 nt, Human
auguuaguuaguguagau

SEQ ID NO: 3645503 - RNA, 15 nt, Human
auguuauagugaauu

SEQ ID NO: 3645504 - RNA, 16 nt, Human
auguuauaucauaugu

SEQ ID NO: 3645505 - RNA, 21 nt, Human
auguuauauguuguucuuaca

SEQ ID NO: 3645506 - RNA, 18 nt, Human
auguuaugacuauguaaa

SEQ ID NO: 3645507 - RNA, 13 nt, Human
auguuauguaaaa

SEQ ID NO: 3645508 - RNA, 14 nt, Human
auguuauguaaaag

SEQ ID NO: 3645509 - RNA, 12 nt, Human
auguuauguuua

SEQ ID NO: 3645510 - RNA, 13 nt, Human
auguuauguuuaa

SEQ ID NO: 3645511 - RNA, 19 nt, Human
auguuauguuuaauaagcu

SEQ ID NO: 3645512 - RNA, 15 nt, Human
auguuauuagauguu

SEQ ID NO: 3645513 - RNA, 13 nt, Human
auguuauuaucug

SEQ ID NO: 3645514 - RNA, 14 nt, Human
auguuauucuagua

SEQ ID NO: 3645515 - RNA, 13 nt, Human
auguuauugaaaa

SEQ ID NO: 3645516 - RNA, 18 nt, Human
auguuauuucugcaaaca

SEQ ID NO: 3645517 - RNA, 22 nt, Human
auguuauuuguuauuuucagua

SEQ ID NO: 3645518 - RNA, 19 nt, Human
auguuauuuuuuaauuauu

SEQ ID NO: 3645519 - RNA, 20 nt, Human
auguuauuuuuuaauuauua

SEQ ID NO: 3645520 - RNA, 23 nt, Human
auguucaaagucaaauaacuccu

SEQ ID NO: 3645521 - RNA, 14 nt, Human
auguucaacuggag

SEQ ID NO: 3645522 - RNA, 18 nt, Human
auguucaauuauuucccc

SEQ ID NO: 3645523 - RNA, 16 nt, Human
auguucagauuauugg

SEQ ID NO: 3645524 - RNA, 19 nt, Human
auguucagcacugucccuu

SEQ ID NO: 3645525 - RNA, 16 nt, Human
auguucaguguaauuu

SEQ ID NO: 3645526 - RNA, 21 nt, Human
auguucaucauccuaagcuau

SEQ ID NO: 3645527 - RNA, 15 nt, Human
auguuccacuaaccc

SEQ ID NO: 3645528 - RNA, 17 nt, Human
auguuccagacauucuc

SEQ ID NO: 3645529 - RNA, 13 nt, Human
auguucccuccgg

SEQ ID NO: 3645530 - RNA, 16 nt, Human
auguuccuagugaaag

SEQ ID NO: 3645531 - RNA, 17 nt, Human
auguuccucaaagcuug

SEQ ID NO: 3645532 - RNA, 21 nt, Human
auguuccucaaagcuuggauu

SEQ ID NO: 3645533 - RNA, 11 nt, Human
auguuccuucc

SEQ ID NO: 3645534 - RNA, 12 nt, Human
auguuccuucca

SEQ ID NO: 3645535 - RNA, 17 nt, Human
auguucuaagaagugaa

SEQ ID NO: 3645536 - RNA, 13 nt, Human
auguucuaaguuu

SEQ ID NO: 3645537 - RNA, 21 nt, Human
auguucuaaguuucuaagauu

SEQ ID NO: 3645538 - RNA, 19 nt, Human
auguucuaugguuaugaaa

SEQ ID NO: 3645539 - RNA, 22 nt, Human
auguucuauuucagugccaaua

SEQ ID NO: 3645540 - RNA, 20 nt, Human
auguucuccagucauuaugu

SEQ ID NO: 3645541 - RNA, 18 nt, Human
auguucucuaucauuuaa

SEQ ID NO: 3645542 - RNA, 21 nt, Human
auguucucuaucauuuaauaa

SEQ ID NO: 3645543 - RNA, 13 nt, Human
auguucucugagg

SEQ ID NO: 3645544 - RNA, 18 nt, Human
auguucugaauaauuucu

SEQ ID NO: 3645545 - RNA, 16 nt, Human
auguucugacauuaac

SEQ ID NO: 3645546 - RNA, 17 nt, Human
auguucugacauuaaca

SEQ ID NO: 3645547 - RNA, 14 nt, Human
auguucugccccca

SEQ ID NO: 3645548 - RNA, 18 nt, Human
auguucugcccccagccc

SEQ ID NO: 3645549 - RNA, 13 nt, Human
auguucugcuuuc

SEQ ID NO: 3645550 - RNA, 14 nt, Human
auguucugggacac

SEQ ID NO: 3645551 - RNA, 20 nt, Human
auguucugucccuugccccc

SEQ ID NO: 3645552 - RNA, 15 nt, Human
auguucuuaauucuu

SEQ ID NO: 3645553 - RNA, 14 nt, Human
auguucuuccaguu

SEQ ID NO: 3645554 - RNA, 11 nt, Human
auguucuuuau

SEQ ID NO: 3645555 - RNA, 13 nt, Human
auguucuuuauau

SEQ ID NO: 3645556 - RNA, 20 nt, Human
auguucuuucacccuuuucu

SEQ ID NO: 3645557 - RNA, 13 nt, Human
auguucuuuggaa

SEQ ID NO: 3645558 - RNA, 14 nt, Human
auguucuuuggaaa

SEQ ID NO: 3645559 - RNA, 20 nt, Human
auguucuuuuaaaugauuga

SEQ ID NO: 3645560 - RNA, 13 nt, Human
auguugaacaaaa

SEQ ID NO: 3645561 - RNA, 15 nt, Human
auguugaacaaaaua

SEQ ID NO: 3645562 - RNA, 16 nt, Human
auguugaagccuuugu

SEQ ID NO: 3645563 - RNA, 19 nt, Human
auguugaauacuuuuuaca

SEQ ID NO: 3645564 - RNA, 22 nt, Human
auguugaaugcccacaggcaaa

SEQ ID NO: 3645565 - RNA, 14 nt, Human
auguugacauuugu

SEQ ID NO: 3645566 - RNA, 22 nt, Human
auguugagaaucccaaauuuga

SEQ ID NO: 3645567 - RNA, 18 nt, Human
auguugagccaggccugg

SEQ ID NO: 3645568 - RNA, 14 nt, Human
auguugagggaaca

SEQ ID NO: 3645569 - RNA, 13 nt, Human
auguugaggugga

SEQ ID NO: 3645570 - RNA, 14 nt, Human
auguugaugcaauc

SEQ ID NO: 3645571 - RNA, 12 nt, Human
auguugauuucu

SEQ ID NO: 3645572 - RNA, 16 nt, Human
auguugauuuuuacug

SEQ ID NO: 3645573 - RNA, 19 nt, Human
auguugcaaugugaaaaau

SEQ ID NO: 3645574 - RNA, 22 nt, Human
auguugcaaugugaaaaaucug

SEQ ID NO: 3645575 - RNA, 17 nt, Human
auguugcauagaauaaa

SEQ ID NO: 3645576 - RNA, 18 nt, Human
auguugcauagaauaaaa

SEQ ID NO: 3645577 - RNA, 12 nt, Human
auguugcccagg

SEQ ID NO: 3645578 - RNA, 14 nt, Human
auguugcccaggca

SEQ ID NO: 3645579 - RNA, 15 nt, Human
auguugcccaggcag

SEQ ID NO: 3645580 - RNA, 20 nt, Human
auguugcccaggcaggucuu

SEQ ID NO: 3645581 - RNA, 22 nt, Human
auguugccccuuucucuuuucc

SEQ ID NO: 3645582 - RNA, 13 nt, Human
auguugcugccaa

SEQ ID NO: 3645583 - RNA, 17 nt, Human
auguuggaagagaaagc

SEQ ID NO: 3645584 - RNA, 19 nt, Human
auguuggacaccuuuaggu

SEQ ID NO: 3645585 - RNA, 22 nt, Human
auguuggauaaggaauuauaga

SEQ ID NO: 3645586 - RNA, 21 nt, Human
auguuggauuuauaaaugcua

SEQ ID NO: 3645587 - RNA, 21 nt, Human
auguuggcagaugcagcucuu

SEQ ID NO: 3645588 - RNA, 23 nt, Human
auguuggccaccaggugccuuuc

SEQ ID NO: 3645589 - RNA, 13 nt, Human
auguuggccaggc

SEQ ID NO: 3645590 - RNA, 16 nt, Human
auguuggccaggcugc

SEQ ID NO: 3645591 - RNA, 16 nt, Human
auguuggccaggcugg

SEQ ID NO: 3645592 - RNA, 13 nt, Human
auguuggcuggga

SEQ ID NO: 3645593 - RNA, 17 nt, Human
auguugguauuuaucua

SEQ ID NO: 3645594 - RNA, 21 nt, Human
auguugguauuuaucuauugu

SEQ ID NO: 3645595 - RNA, 14 nt, Human
auguuguaagcaac

SEQ ID NO: 3645596 - RNA, 19 nt, Human
auguuguaauauuucuuca

SEQ ID NO: 3645597 - RNA, 16 nt, Human
auguuguaaugcugca

SEQ ID NO: 3645598 - RNA, 15 nt, Human
auguuguagauacaa

SEQ ID NO: 3645599 - RNA, 22 nt, Human
auguuguagauacaaucagcug

SEQ ID NO: 3645600 - RNA, 18 nt, Human
auguuguaguguccccca

SEQ ID NO: 3645601 - RNA, 22 nt, Human
auguuguccaauuguugacagu

SEQ ID NO: 3645602 - RNA, 22 nt, Human
auguugucuaagaaauugaaua

SEQ ID NO: 3645603 - RNA, 19 nt, Human
auguugugaauaauuacag

SEQ ID NO: 3645604 - RNA, 21 nt, Human
auguuguguuucuguucaccu

SEQ ID NO: 3645605 - RNA, 17 nt, Human
auguuguuaaaauuaug

SEQ ID NO: 3645606 - RNA, 12 nt, Human
auguuguuauuu

SEQ ID NO: 3645607 - RNA, 14 nt, Human
auguuguuauuuaa

SEQ ID NO: 3645608 - RNA, 17 nt, Human
auguuguuauuuaaaga

SEQ ID NO: 3645609 - RNA, 17 nt, Human
auguuguuuuguacaga

SEQ ID NO: 3645610 - RNA, 21 nt, Human
auguuguuuuguacagaugug

SEQ ID NO: 3645611 - RNA, 16 nt, Human
auguuuaaaacaccuu

SEQ ID NO: 3645612 - RNA, 22 nt, Human
auguuuaaaacaccuucuauag

SEQ ID NO: 3645613 - RNA, 18 nt, Human
auguuuaaaauaaaauga

SEQ ID NO: 3645614 - RNA, 18 nt, Human
auguuuaaaguaauuguu

SEQ ID NO: 3645615 - RNA, 22 nt, Human
auguuuaaaguaauuguuccag

SEQ ID NO: 3645616 - RNA, 12 nt, Human
auguuuaagauu

SEQ ID NO: 3645617 - RNA, 21 nt, Human
auguuuaagauuuaauuugcc

SEQ ID NO: 3645618 - RNA, 16 nt, Human
auguuuaagcagaauu

SEQ ID NO: 3645619 - RNA, 20 nt, Human
auguuuaagcagaauuggaa

SEQ ID NO: 3645620 - RNA, 21 nt, Human
auguuuaagcagaauuggaaa

SEQ ID NO: 3645621 - RNA, 14 nt, Human
auguuuaaucuguu

SEQ ID NO: 3645622 - RNA, 18 nt, Human
auguuuacacucuuugua

SEQ ID NO: 3645623 - RNA, 19 nt, Human
auguuuacacucuuuguaa

SEQ ID NO: 3645624 - RNA, 17 nt, Human
auguuuacagaggacag

SEQ ID NO: 3645625 - RNA, 21 nt, Human
auguuuacagggagccuccug

SEQ ID NO: 3645626 - RNA, 20 nt, Human
auguuuacauaucaccucau

SEQ ID NO: 3645627 - RNA, 17 nt, Human
auguuuagacuuuaaca

SEQ ID NO: 3645628 - RNA, 18 nt, Human
auguuuagacuuuaacau

SEQ ID NO: 3645629 - RNA, 20 nt, Human
auguuuauaaaucuuaugcu

SEQ ID NO: 3645630 - RNA, 20 nt, Human
auguuuauaucugcaaaaaa

SEQ ID NO: 3645631 - RNA, 14 nt, Human
auguuuaucugcuu

SEQ ID NO: 3645632 - RNA, 13 nt, Human
auguuuaugaaaa

SEQ ID NO: 3645633 - RNA, 19 nt, Human
auguuuaugaaaauaaaua

SEQ ID NO: 3645634 - RNA, 15 nt, Human
auuaaacauaaaaca

SEQ ID NO: 3645635 - RNA, 16 nt, Human
auuaaacaugcuguac

SEQ ID NO: 3645636 - RNA, 16 nt, Human
auuaaaccaucucccu

SEQ ID NO: 3645637 - RNA, 17 nt, Human
auuaaaccaucucccug

SEQ ID NO: 3645638 - RNA, 14 nt, Human
auuaaacccuggau

SEQ ID NO: 3645639 - RNA, 17 nt, Human
auuaaaccggaccaucu

SEQ ID NO: 3645640 - RNA, 20 nt, Human
auuaaaccugucuccacugu

SEQ ID NO: 3645641 - RNA, 14 nt, Human
auuaaacgauuuuu

SEQ ID NO: 3645642 - RNA, 14 nt, Human
auuaaacggauuau

SEQ ID NO: 3645643 - RNA, 15 nt, Human
auuaaacggauuauu

SEQ ID NO: 3645644 - RNA, 16 nt, Human
auuaaacggauuauuu

SEQ ID NO: 3645645 - RNA, 19 nt, Human
auuaaacggauuauuuuuu

SEQ ID NO: 3645646 - RNA, 20 nt, Human
auuaaacggauuauuuuuuc

SEQ ID NO: 3645647 - RNA, 19 nt, Human
auuaaacguaugcauguga

SEQ ID NO: 3645648 - RNA, 20 nt, Human
auuaaacguaugcaugugaa

SEQ ID NO: 3645649 - RNA, 13 nt, Human
auuaaacuguuaa

SEQ ID NO: 3645650 - RNA, 17 nt, Human
auuaaacuguuaacuua

SEQ ID NO: 3645651 - RNA, 13 nt, Human
auuaaacuucaua

SEQ ID NO: 3645652 - RNA, 18 nt, Human
auuaaacuuuuaauucau

SEQ ID NO: 3645653 - RNA, 19 nt, Human
auuaaacuuuuaauucauu

SEQ ID NO: 3645654 - RNA, 12 nt, Human
auuaaacuuuuu

SEQ ID NO: 3645655 - RNA, 20 nt, Human
aguggcuucacuccugcugu

SEQ ID NO: 3645656 - RNA, 19 nt, Human
aguggcuucauuagagcag

SEQ ID NO: 3645657 - RNA, 21 nt, Human
aguggcuucauuagagcaggc

SEQ ID NO: 3645658 - RNA, 18 nt, Human
aguggcuugaaaucuuuu

SEQ ID NO: 3645659 - RNA, 17 nt, Human
aguggcuuuaaugaaua

SEQ ID NO: 3645660 - RNA, 14 nt, Human
agugggaaaaaugu

SEQ ID NO: 3645661 - RNA, 18 nt, Human
agugggaaaaauguagga

SEQ ID NO: 3645662 - RNA, 12 nt, Human
agugggaagccc

SEQ ID NO: 3645663 - RNA, 22 nt, Human
agugggaagcccauccugacca

SEQ ID NO: 3645664 - RNA, 15 nt, Human
agugggacccauaga

SEQ ID NO: 3645665 - RNA, 13 nt, Human
agugggagaaaac

SEQ ID NO: 3645666 - RNA, 17 nt, Human
agugggagaaaacacuu

SEQ ID NO: 3645667 - RNA, 19 nt, Human
agugggagaaggcagugau

SEQ ID NO: 3645668 - RNA, 16 nt, Human
agugggaggggcaggc

SEQ ID NO: 3645669 - RNA, 22 nt, Human
agugggaggggcaggcugacau

SEQ ID NO: 3645670 - RNA, 22 nt, Human
agugggaggguaccagcagaaa

SEQ ID NO: 3645671 - RNA, 14 nt, Human
agugggcaaaagcu

SEQ ID NO: 3645672 - RNA, 15 nt, Human
agugggccaggacag

SEQ ID NO: 3645673 - RNA, 17 nt, Human
agugggcugcaucuggg

SEQ ID NO: 3645674 - RNA, 13 nt, Human
aguggggaagagu

SEQ ID NO: 3645675 - RNA, 15 nt, Human
aguggggacagagca

SEQ ID NO: 3645676 - RNA, 14 nt, Human
aguggggccugugg

SEQ ID NO: 3645677 - RNA, 20 nt, Human
aguggggcucucugaguccu

SEQ ID NO: 3645678 - RNA, 19 nt, Human
agugggggagagcaggcug

SEQ ID NO: 3645679 - RNA, 22 nt, Human
aguggggggaacgcccacuucc

SEQ ID NO: 3645680 - RNA, 12 nt, Human
aguggggguggg

SEQ ID NO: 3645681 - RNA, 18 nt, Human
aguggggucucccucucc

SEQ ID NO: 3645682 - RNA, 19 nt, Human
agugggguuaucucugugu

SEQ ID NO: 3645683 - RNA, 19 nt, Human
agugggguugcaaccacug

SEQ ID NO: 3645684 - RNA, 21 nt, Human
agugggucccacuuccccucc

SEQ ID NO: 3645685 - RNA, 13 nt, Human
agugggugaauaa

SEQ ID NO: 3645686 - RNA, 19 nt, Human
agugggugaauaauacagu

SEQ ID NO: 3645687 - RNA, 16 nt, Human
agugggugacaagagc

SEQ ID NO: 3645688 - RNA, 18 nt, Human
agugggugacaagagccu

SEQ ID NO: 3645689 - RNA, 19 nt, Human
agugggugacaagagccug

SEQ ID NO: 3645690 - RNA, 21 nt, Human
agugggugacaagagccugau

SEQ ID NO: 3645691 - RNA, 18 nt, Human
agugggugagaugcugga

SEQ ID NO: 3645692 - RNA, 11 nt, Human
agugggugggg

SEQ ID NO: 3645693 - RNA, 14 nt, Human
aguggguggggagu

SEQ ID NO: 3645694 - RNA, 15 nt, Human
aguggguuucacaag

SEQ ID NO: 3645695 - RNA, 15 nt, Human
aguggguuuuuuagu

SEQ ID NO: 3645696 - RNA, 21 nt, Human
aguggguuuuuuaguugaauu

SEQ ID NO: 3645697 - RNA, 17 nt, Human
agugguaagcuaugucc

SEQ ID NO: 3645698 - RNA, 15 nt, Human
agugguaucuugcag

SEQ ID NO: 3645699 - RNA, 19 nt, Human
agugguccauggaaugcuu

SEQ ID NO: 3645700 - RNA, 13 nt, Human
aguggucuuugua

SEQ ID NO: 3645701 - RNA, 17 nt, Human
aguggucuuuguaagag

SEQ ID NO: 3645702 - RNA, 15 nt, Human
aguggugauuugaaa

SEQ ID NO: 3645703 - RNA, 11 nt, Human
aguggugccua

SEQ ID NO: 3645704 - RNA, 15 nt, Human
aguggugcucaguug

SEQ ID NO: 3645705 - RNA, 17 nt, Human
aguggugcucaguugua

SEQ ID NO: 3645706 - RNA, 22 nt, Human
aguggugcucaguuguagaaug

SEQ ID NO: 3645707 - RNA, 14 nt, Human
agugguggcagggc

SEQ ID NO: 3645708 - RNA, 14 nt, Human
aguggugggggaag

SEQ ID NO: 3645709 - RNA, 19 nt, Human
aguggugguauguaaugga

SEQ ID NO: 3645710 - RNA, 23 nt, Human
aguggugguuuucuguucuuucu

SEQ ID NO: 3645711 - RNA, 19 nt, Human
agugguuguuaguuauaga

SEQ ID NO: 3645712 - RNA, 23 nt, Human
agugguuuaggcuauuuguaaau

SEQ ID NO: 3645713 - RNA, 22 nt, Human
agugguuuccacaugcucugag

SEQ ID NO: 3645714 - RNA, 22 nt, Human
agugguuugauggugacuuccu

SEQ ID NO: 3645715 - RNA, 17 nt, Human
agugguuuuauacugaa

SEQ ID NO: 3645716 - RNA, 21 nt, Human
agugguuuuauacugaaggaa

SEQ ID NO: 3645717 - RNA, 15 nt, Human
aguguaaaaaugaga

SEQ ID NO: 3645718 - RNA, 11 nt, Human
aguguaaaaua

SEQ ID NO: 3645719 - RNA, 13 nt, Human
aguguaaaauaag

SEQ ID NO: 3645720 - RNA, 14 nt, Human
aguguaaaauauuu

SEQ ID NO: 3645721 - RNA, 18 nt, Human
aguguaaaauauuuugaa

SEQ ID NO: 3645722 - RNA, 17 nt, Human
aguguaaagcauuccaa

SEQ ID NO: 3645723 - RNA, 14 nt, Human
aguguaaauccuuu

SEQ ID NO: 3645724 - RNA, 15 nt, Human
aguguaaauguuagu

SEQ ID NO: 3645725 - RNA, 19 nt, Human
aguguaacaagaaaggaga

SEQ ID NO: 3645726 - RNA, 13 nt, Human
aguguaacagcug

SEQ ID NO: 3645727 - RNA, 20 nt, Human
aguguaacuugcuuaaauuu

SEQ ID NO: 3645728 - RNA, 14 nt, Human
aguguaaugaauac

SEQ ID NO: 3645729 - RNA, 19 nt, Human
aguguaauguagcguguuu

SEQ ID NO: 3645730 - RNA, 22 nt, Human
aguguacauggaauaacaugua

SEQ ID NO: 3645731 - RNA, 19 nt, Human
aguguaccauuaaaauaug

SEQ ID NO: 3645732 - RNA, 23 nt, Human
aguguacccccgcccaggcuggc

SEQ ID NO: 3645733 - RNA, 23 nt, Human
aguguacuaauuaacauauaaua

SEQ ID NO: 3645734 - RNA, 14 nt, Human
aguguacucccagg

SEQ ID NO: 3645735 - RNA, 15 nt, Human
aguguacucccaggg

SEQ ID NO: 3645736 - RNA, 17 nt, Human
aguguacuuaacuauuc

SEQ ID NO: 3645737 - RNA, 13 nt, Human
aguguagaagcau

SEQ ID NO: 3645738 - RNA, 17 nt, Human
aguguagaagcauuccu

SEQ ID NO: 3645739 - RNA, 23 nt, Human
aguguagaucagagcagcaguga

SEQ ID NO: 3645740 - RNA, 17 nt, Human
aguguagccccaagaag

SEQ ID NO: 3645741 - RNA, 13 nt, Human
aguguaggcagac

SEQ ID NO: 3645742 - RNA, 15 nt, Human
aguguaggcagacac

SEQ ID NO: 3645743 - RNA, 18 nt, Human
aguguaggcuuuacuuag

SEQ ID NO: 3645744 - RNA, 19 nt, Human
aguguaggcuuuacuuagc

SEQ ID NO: 3645745 - RNA, 16 nt, Human
aguguaguuuacagaa

SEQ ID NO: 3645746 - RNA, 15 nt, Human
aguguauaauauaaa

SEQ ID NO: 3645747 - RNA, 16 nt, Human
aguguauaauauaaaa

SEQ ID NO: 3645748 - RNA, 17 nt, Human
aguguauaauauaaaaa

SEQ ID NO: 3645749 - RNA, 13 nt, Human
aguguaucaaaau

SEQ ID NO: 3645750 - RNA, 16 nt, Human
aguguaucaaaaugcu

SEQ ID NO: 3645751 - RNA, 14 nt, Human
aguguaugauuacu

SEQ ID NO: 3645752 - RNA, 20 nt, Human
aguguauggaaauaaaugua

SEQ ID NO: 3645753 - RNA, 14 nt, Human
aguguauuaaauga

SEQ ID NO: 3645754 - RNA, 17 nt, Human
aguguauuaaaugaaca

SEQ ID NO: 3645755 - RNA, 17 nt, Human
aguguauuaggaagugu

SEQ ID NO: 3645756 - RNA, 23 nt, Human
aguguauuuggaaauaaagucag

SEQ ID NO: 3645757 - RNA, 16 nt, Human
aguguauuuuucaaua

SEQ ID NO: 3645758 - RNA, 17 nt, Human
aguguauuuuuuuacua

SEQ ID NO: 3645759 - RNA, 14 nt, Human
agugucaaguugug

SEQ ID NO: 3645760 - RNA, 17 nt, Human
agugucaaguugugcuu

SEQ ID NO: 3645761 - RNA, 18 nt, Human
agugucaaguugugcuug

SEQ ID NO: 3645762 - RNA, 16 nt, Human
agugucacucaaggcg

SEQ ID NO: 3645763 - RNA, 23 nt, Human
agugucagaaggagcuacaaaac

SEQ ID NO: 3645764 - RNA, 20 nt, Human
agugucauauguaggugucu

SEQ ID NO: 3645765 - RNA, 16 nt, Human
agugucaucagaagau

SEQ ID NO: 3645766 - RNA, 12 nt, Human
agugucauguuu

SEQ ID NO: 3645767 - RNA, 13 nt, Human
agugucauuucca

SEQ ID NO: 3645768 - RNA, 17 nt, Human
aguguccccuccacugu

SEQ ID NO: 3645769 - RNA, 23 nt, Human
aguguccuaugcaauaaaauuau

SEQ ID NO: 3645770 - RNA, 14 nt, Human
aguguccucagggg

SEQ ID NO: 3645771 - RNA, 22 nt, Human
aguguccucuucccucucugca

SEQ ID NO: 3645772 - RNA, 19 nt, Human
agugucuauaaaagaaaca

SEQ ID NO: 3645773 - RNA, 20 nt, Human
agugucuauaaaagaaacac

SEQ ID NO: 3645774 - RNA, 18 nt, Human
agugucucaguccaccug

SEQ ID NO: 3645775 - RNA, 16 nt, Human
agugucuggaauugug

SEQ ID NO: 3645776 - RNA, 17 nt, Human
agugucuggaauugugg

SEQ ID NO: 3645777 - RNA, 13 nt, Human
agugucuggcugc

SEQ ID NO: 3645778 - RNA, 16 nt, Human
agugucuguguuuuga

SEQ ID NO: 3645779 - RNA, 18 nt, Human
agugucuuaauuaaaaga

SEQ ID NO: 3645780 - RNA, 18 nt, Human
aguuuguguguugucuug

SEQ ID NO: 3645781 - RNA, 15 nt, Human
aguuuguugaaacac

SEQ ID NO: 3645782 - RNA, 20 nt, Human
aguuuguuucuuugaauuuu

SEQ ID NO: 3645783 - RNA, 23 nt, Human
aguuuguuucuuugaauuuucau

SEQ ID NO: 3645784 - RNA, 16 nt, Human
aguuuuaaaaaaauaa

SEQ ID NO: 3645785 - RNA, 15 nt, Human
aguuuuaaacucauu

SEQ ID NO: 3645786 - RNA, 16 nt, Human
aguuuuaauccagaau

SEQ ID NO: 3645787 - RNA, 13 nt, Human
aguuuuacaaagg

SEQ ID NO: 3645788 - RNA, 19 nt, Human
aguuuuacccuauaucuau

SEQ ID NO: 3645789 - RNA, 14 nt, Human
aguuuuaguugcag

SEQ ID NO: 3645790 - RNA, 15 nt, Human
aguuuuaguuuucuc

SEQ ID NO: 3645791 - RNA, 16 nt, Human
aguuuuauaugcuucu

SEQ ID NO: 3645792 - RNA, 13 nt, Human
aguuuuaucacau

SEQ ID NO: 3645793 - RNA, 15 nt, Human
aguuuuaucauuuuc

SEQ ID NO: 3645794 - RNA, 16 nt, Human
aguuuuauugagaauu

SEQ ID NO: 3645795 - RNA, 21 nt, Human
aguuuuauugagaauuuuaaa

SEQ ID NO: 3645796 - RNA, 19 nt, Human
aguuuuauuuauauuuauu

SEQ ID NO: 3645797 - RNA, 20 nt, Human
aguuuuauuuauauuuauug

SEQ ID NO: 3645798 - RNA, 22 nt, Human
aguuuuauuuauauuuauugac

SEQ ID NO: 3645799 - RNA, 19 nt, Human
aguuuuauuuuauguuuag

SEQ ID NO: 3645800 - RNA, 21 nt, Human
aguuuuauuuucuaaaguacu

SEQ ID NO: 3645801 - RNA, 12 nt, Human
aguuuucagaaa

SEQ ID NO: 3645802 - RNA, 18 nt, Human
aguuuucagaaaaagaaa

SEQ ID NO: 3645803 - RNA, 17 nt, Human
aguuuucagaaccucuu

SEQ ID NO: 3645804 - RNA, 18 nt, Human
aguuuucagaaccucuuc

SEQ ID NO: 3645805 - RNA, 12 nt, Human
aguuuucagugg

SEQ ID NO: 3645806 - RNA, 18 nt, Human
aguuuuccuaaauguaua

SEQ ID NO: 3645807 - RNA, 22 nt, Human
aguuuuccuaagugauuguaug

SEQ ID NO: 3645808 - RNA, 18 nt, Human
aguuuuccuaugcuuuga

SEQ ID NO: 3645809 - RNA, 22 nt, Human
aguuuuccucuauacaucucuc

SEQ ID NO: 3645810 - RNA, 12 nt, Human
aguuuuccuucu

SEQ ID NO: 3645811 - RNA, 15 nt, Human
aguuuucuuccauga

SEQ ID NO: 3645812 - RNA, 12 nt, Human
aguuuucuuguu

SEQ ID NO: 3645813 - RNA, 18 nt, Human
aguuuucuuguugcuuug

SEQ ID NO: 3645814 - RNA, 16 nt, Human
aguuuugaaaagcuau

SEQ ID NO: 3645815 - RNA, 19 nt, Human
aguuuugacaagcuggcuu

SEQ ID NO: 3645816 - RNA, 22 nt, Human
aguuuugacaucagccagcugc

SEQ ID NO: 3645817 - RNA, 18 nt, Human
aguuuugagaacguaaag

SEQ ID NO: 3645818 - RNA, 18 nt, Human
aguuuugaguagauauua

SEQ ID NO: 3645819 - RNA, 20 nt, Human
aguuuugaguagauauuacu

SEQ ID NO: 3645820 - RNA, 21 nt, Human
aguuuugaguagauauuacuu

SEQ ID NO: 3645821 - RNA, 18 nt, Human
aguuuugauaugaguaua

SEQ ID NO: 3645822 - RNA, 16 nt, Human
aguuuugcaaagugca

SEQ ID NO: 3645823 - RNA, 17 nt, Human
aguuuugcauaguucua

SEQ ID NO: 3645824 - RNA, 16 nt, Human
aguuuugcauuuaugg

SEQ ID NO: 3645825 - RNA, 19 nt, Human
aguuuugccagaacaguuu

SEQ ID NO: 3645826 - RNA, 21 nt, Human
aguuuugcuuuuaguuuuucu

SEQ ID NO: 3645827 - RNA, 19 nt, Human
aguuuugggaaguuaaagg

SEQ ID NO: 3645828 - RNA, 21 nt, Human
aguuuugguugcuuuaauauc

SEQ ID NO: 3645829 - RNA, 15 nt, Human
aguuuuguaaauuuc

SEQ ID NO: 3645830 - RNA, 14 nt, Human
aguuuugucauuca

SEQ ID NO: 3645831 - RNA, 18 nt, Human
aguuuugugaaauuuuuc

SEQ ID NO: 3645832 - RNA, 21 nt, Human
aguuuugugaaggugauuuau

SEQ ID NO: 3645833 - RNA, 16 nt, Human
aguuuuguguuuguug

SEQ ID NO: 3645834 - RNA, 18 nt, Human
aguuuuguuguacuuaaa

SEQ ID NO: 3645835 - RNA, 12 nt, Human
aguuuuguuugg

SEQ ID NO: 3645836 - RNA, 18 nt, Human
aguuuuguuuggaccaaa

SEQ ID NO: 3645837 - RNA, 23 nt, Human
aguuuuguuuuaaaacuggaccu

SEQ ID NO: 3645838 - RNA, 17 nt, Human
aguuuuuacaagaugua

SEQ ID NO: 3645839 - RNA, 21 nt, Human
aguuuuuaccuaccacagugu

SEQ ID NO: 3645840 - RNA, 17 nt, Human
aguuuuuauggggcuga

SEQ ID NO: 3645841 - RNA, 20 nt, Human
aguuuuuauugcuuguugga

SEQ ID NO: 3645842 - RNA, 22 nt, Human
aguuuuucagaguggaaugcuu

SEQ ID NO: 3645843 - RNA, 20 nt, Human
aguuuuucaggagcgcaaga

SEQ ID NO: 3645844 - RNA, 21 nt, Human
aguuuuucaggagcgcaagau

SEQ ID NO: 3645845 - RNA, 23 nt, Human
aguuuuucccagcuacaccuuuc

SEQ ID NO: 3645846 - RNA, 15 nt, Human
aguuuuuccuggaau

SEQ ID NO: 3645847 - RNA, 13 nt, Human
aguuuuucugucc

SEQ ID NO: 3645848 - RNA, 12 nt, Human
aguuuuucuuaa

SEQ ID NO: 3645849 - RNA, 16 nt, Human
aguuuuugauagcuuu

SEQ ID NO: 3645850 - RNA, 23 nt, Human
aguuuuuggaguguuauguauuu

SEQ ID NO: 3645851 - RNA, 16 nt, Human
aguuuuugguugggaa

SEQ ID NO: 3645852 - RNA, 20 nt, Human
aguuuuuguucuuaauugca

SEQ ID NO: 3645853 - RNA, 17 nt, Human
aguuuuuuauuaugcau

SEQ ID NO: 3645854 - RNA, 12 nt, Human
aguuuuuucauc

SEQ ID NO: 3645855 - RNA, 14 nt, Human
aguuuuuucaucuu

SEQ ID NO: 3645856 - RNA, 21 nt, Human
aguuuuuugaaauuaugugac

SEQ ID NO: 3645857 - RNA, 15 nt, Human
aguuuuuuuuauaca

SEQ ID NO: 3645858 - RNA, 18 nt, Human
aguuuuuuuuuucuuguc

SEQ ID NO: 3645859 - RNA, 13 nt, Human
auaaaaaaaaaua

SEQ ID NO: 3645860 - RNA, 22 nt, Human
auaaaaaaaaauagaugucuuu

SEQ ID NO: 3645861 - RNA, 19 nt, Human
auaaaaaaaagaaaugaaa

SEQ ID NO: 3645862 - RNA, 20 nt, Human
auaaaaaaaaugaaauguuu

SEQ ID NO: 3645863 - RNA, 12 nt, Human
auaaaaaaagaa

SEQ ID NO: 3645864 - RNA, 16 nt, Human
auaaaaaaagaaaaaa

SEQ ID NO: 3645865 - RNA, 16 nt, Human
auaaaaaaagaaagca

SEQ ID NO: 3645866 - RNA, 18 nt, Human
auuaucuugauacauuca

SEQ ID NO: 3645867 - RNA, 23 nt, Human
auuaucuugauacauucaaauuu

SEQ ID NO: 3645868 - RNA, 23 nt, Human
auuaucuuuucauacauuuucua

SEQ ID NO: 3645869 - RNA, 14 nt, Human
auuaugaauuacau

SEQ ID NO: 3645870 - RNA, 18 nt, Human
auuaugaauuacauuugu

SEQ ID NO: 3645871 - RNA, 22 nt, Human
auuaugaauuacauuuguauaa

SEQ ID NO: 3645872 - RNA, 23 nt, Human
auuaugagacacaggaugaagca

SEQ ID NO: 3645873 - RNA, 20 nt, Human
auuaugagaggcaaugauug

SEQ ID NO: 3645874 - RNA, 16 nt, Human
auuaugaguuugcuua

SEQ ID NO: 3645875 - RNA, 16 nt, Human
auuaugauggaagaca

SEQ ID NO: 3645876 - RNA, 21 nt, Human
auuaugauuuggguuggggaa

SEQ ID NO: 3645877 - RNA, 22 nt, Human
auuaugcaauuagccucauagu

SEQ ID NO: 3645878 - RNA, 16 nt, Human
auuaugcagaauacuu

SEQ ID NO: 3645879 - RNA, 17 nt, Human
auuaugcagaauacuuu

SEQ ID NO: 3645880 - RNA, 20 nt, Human
auuaugcccaguuucugccu

SEQ ID NO: 3645881 - RNA, 20 nt, Human
auuaugcggaaagguauuug

SEQ ID NO: 3645882 - RNA, 15 nt, Human
auuaugcuucuugga

SEQ ID NO: 3645883 - RNA, 14 nt, Human
auuauggaaaacug

SEQ ID NO: 3645884 - RNA, 14 nt, Human
auuauggaaacaga

SEQ ID NO: 3645885 - RNA, 16 nt, Human
auuauggaagauuuua

SEQ ID NO: 3645886 - RNA, 17 nt, Human
auuauggaagauuuuaa

SEQ ID NO: 3645887 - RNA, 17 nt, Human
auuauggcauauauuaa

SEQ ID NO: 3645888 - RNA, 18 nt, Human
auuaugggaaucaagauu

SEQ ID NO: 3645889 - RNA, 16 nt, Human
auuaugggucacagga

SEQ ID NO: 3645890 - RNA, 12 nt, Human
auuauguaaauc

SEQ ID NO: 3645891 - RNA, 14 nt, Human
auuauguaaauccc

SEQ ID NO: 3645892 - RNA, 15 nt, Human
auuauguaaauccca

SEQ ID NO: 3645893 - RNA, 22 nt, Human
auuauguaaaucccauuauuca

SEQ ID NO: 3645894 - RNA, 22 nt, Human
auuauguccugugagaugugua

SEQ ID NO: 3645895 - RNA, 13 nt, Human
auuaugugccaga

SEQ ID NO: 3645896 - RNA, 23 nt, Human
auuaugugccagauuuaugcaua

SEQ ID NO: 3645897 - RNA, 15 nt, Human
auuauguguguuuua

SEQ ID NO: 3645898 - RNA, 20 nt, Human
auuauguuuauauaaaugcu

SEQ ID NO: 3645899 - RNA, 14 nt, Human
auuauguuuuacug

SEQ ID NO: 3645900 - RNA, 16 nt, Human
auuauguuuuuauuaa

SEQ ID NO: 3645901 - RNA, 11 nt, Human
auuauuaaagg

SEQ ID NO: 3645902 - RNA, 11 nt, Human
auuauuaacaa

SEQ ID NO: 3645903 - RNA, 23 nt, Human
auuauuaacauaccuaagaagua

SEQ ID NO: 3645904 - RNA, 19 nt, Human
auuauuaacuacauuuaug

SEQ ID NO: 3645905 - RNA, 20 nt, Human
auuauuaacuacauuuauga

SEQ ID NO: 3645906 - RNA, 22 nt, Human
auuauuaaugaaaauaagaauu

SEQ ID NO: 3645907 - RNA, 23 nt, Human
auuauuacuguugauaauucuua

SEQ ID NO: 3645908 - RNA, 19 nt, Human
auuauuacuuguaaauaua

SEQ ID NO: 3645909 - RNA, 22 nt, Human
auuauuacuuguaaauauaaag

SEQ ID NO: 3645910 - RNA, 12 nt, Human
auuauuacuuuu

SEQ ID NO: 3645911 - RNA, 14 nt, Human
auuauuacuuuugc

SEQ ID NO: 3645912 - RNA, 17 nt, Human
auuauuagaaucaaaca

SEQ ID NO: 3645913 - RNA, 23 nt, Human
auuauuagaaucaaacauuuuga

SEQ ID NO: 3645914 - RNA, 16 nt, Human
auuauuauaaaaauau

SEQ ID NO: 3645915 - RNA, 13 nt, Human
auuauucaaaguu

SEQ ID NO: 3645916 - RNA, 14 nt, Human
auuauucaaaguug

SEQ ID NO: 3645917 - RNA, 22 nt, Human
auuauucaccauguaaaacaaa

SEQ ID NO: 3645918 - RNA, 20 nt, Human
auuauucauuuaaaaugauu

SEQ ID NO: 3645919 - RNA, 13 nt, Human
auuauucauuuag

SEQ ID NO: 3645920 - RNA, 21 nt, Human
auuauucccuguacaauauuu

SEQ ID NO: 3645921 - RNA, 22 nt, Human
auuauucccuguacaauauuua

SEQ ID NO: 3645922 - RNA, 16 nt, Human
auuauuccucaaaaaa

SEQ ID NO: 3645923 - RNA, 12 nt, Human
auuauucucuuu

SEQ ID NO: 3645924 - RNA, 11 nt, Human
auugugcugcc

SEQ ID NO: 3645925 - RNA, 15 nt, Human
auugugcugccauuu

SEQ ID NO: 3645926 - RNA, 17 nt, Human
auuguggaauguuggau

SEQ ID NO: 3645927 - RNA, 17 nt, Human
auuguggcuauccugau

SEQ ID NO: 3645928 - RNA, 12 nt, Human
auuguggcuccu

SEQ ID NO: 3645929 - RNA, 19 nt, Human
auuguggcuccuaucugug

SEQ ID NO: 3645930 - RNA, 16 nt, Human
auaaguacuguguaca

SEQ ID NO: 3645931 - RNA, 19 nt, Human
auaaguauuuauaauagca

SEQ ID NO: 3645932 - RNA, 16 nt, Human
auaaguauuucaaauu

SEQ ID NO: 3645933 - RNA, 18 nt, Human
auaagucaacaguaaacc

SEQ ID NO: 3645934 - RNA, 16 nt, Human
auaagucauuguaugu

SEQ ID NO: 3645935 - RNA, 16 nt, Human
auaagugaaaaucuua

SEQ ID NO: 3645936 - RNA, 14 nt, Human
auaagugaauuuau

SEQ ID NO: 3645937 - RNA, 15 nt, Human
auaagugaauuuaua

SEQ ID NO: 3645938 - RNA, 21 nt, Human
auaagugcacacagaaauaua

SEQ ID NO: 3645939 - RNA, 16 nt, Human
auaagugcuguauaaa

SEQ ID NO: 3645940 - RNA, 22 nt, Human
auaagugcuguauaaaaucagc

SEQ ID NO: 3645941 - RNA, 22 nt, Human
auaaguggacaaauuuugaguu

SEQ ID NO: 3645942 - RNA, 19 nt, Human
auaaguguacgauucuuaa

SEQ ID NO: 3645943 - RNA, 13 nt, Human
auaaguguauuuu

SEQ ID NO: 3645944 - RNA, 14 nt, Human
auaaguuauugcag

SEQ ID NO: 3645945 - RNA, 19 nt, Human
auaaguuauuuuuguacau

SEQ ID NO: 3645946 - RNA, 24 nt, Human
auaaguucaaauucuucugaacuc

SEQ ID NO: 3645947 - RNA, 13 nt, Human
auaaguucacaaa

SEQ ID NO: 3645948 - RNA, 14 nt, Human
auaaguucauacau

SEQ ID NO: 3645949 - RNA, 16 nt, Human
auaaguuccuuuccuu

SEQ ID NO: 3645950 - RNA, 18 nt, Human
auaaguuggaaacacuaa

SEQ ID NO: 3645951 - RNA, 23 nt, Human
auaaguuggaaacacuaaauguu

SEQ ID NO: 3645952 - RNA, 14 nt, Human
auaaguuuauuucu

SEQ ID NO: 3645953 - RNA, 20 nt, Human
auaaguuucacugacuuaga

SEQ ID NO: 3645954 - RNA, 13 nt, Human
auaaguuugaagg

SEQ ID NO: 3645955 - RNA, 19 nt, Human
auaaguuugaaggaaacag

SEQ ID NO: 3645956 - RNA, 20 nt, Human
auaaguuugaaggaaacagu

SEQ ID NO: 3645957 - RNA, 17 nt, Human
auaauaaaaaaagaaag

SEQ ID NO: 3645958 - RNA, 17 nt, Human
auaauaaaaaauuucag

SEQ ID NO: 3645959 - RNA, 13 nt, Human
auaauaaaauagu

SEQ ID NO: 3645960 - RNA, 13 nt, Human
auaauaaaaucac

SEQ ID NO: 3645961 - RNA, 13 nt, Human
auaauaaacauaa

SEQ ID NO: 3645962 - RNA, 21 nt, Human
auaauaaacauaaugaaaaua

SEQ ID NO: 3645963 - RNA, 14 nt, Human
auaauaaacugucc

SEQ ID NO: 3645964 - RNA, 12 nt, Human
auaauaaacuuu

SEQ ID NO: 3645965 - RNA, 13 nt, Human
auaauaaagaaua

SEQ ID NO: 3645966 - RNA, 22 nt, Human
auaauaaaguauuccaccuuaa

SEQ ID NO: 3645967 - RNA, 23 nt, Human
auaauaaaguauuccaccuuaaa

SEQ ID NO: 3645968 - RNA, 14 nt, Human
auaauaaaguguuu

SEQ ID NO: 3645969 - RNA, 12 nt, Human
auaauaaauagu

SEQ ID NO: 3645970 - RNA, 23 nt, Human
auaauaaauucccuggccuuuca

SEQ ID NO: 3645971 - RNA, 22 nt, Human
auaauaaggaaaaguuuaauau

SEQ ID NO: 3645972 - RNA, 14 nt, Human
auaauaauuaguaa

SEQ ID NO: 3645973 - RNA, 14 nt, Human
auaauacacaaaau

SEQ ID NO: 3645974 - RNA, 21 nt, Human
auaauacacuaauuccuuucu

SEQ ID NO: 3645975 - RNA, 16 nt, Human
auaauacacuugcccu

SEQ ID NO: 3645976 - RNA, 18 nt, Human
auaauacagaaucuuguu

SEQ ID NO: 3645977 - RNA, 15 nt, Human
auaauacugaaccac

SEQ ID NO: 3645978 - RNA, 22 nt, Human
auaauacugcugagauacauac

SEQ ID NO: 3645979 - RNA, 17 nt, Human
auaauacuuuguauaca

SEQ ID NO: 3645980 - RNA, 19 nt, Human
auaauacuuuguauacaag

SEQ ID NO: 3645981 - RNA, 13 nt, Human
auaauagacugua

SEQ ID NO: 3645982 - RNA, 12 nt, Human
auaauagauucu

SEQ ID NO: 3645983 - RNA, 13 nt, Human
auaauagauucuc

SEQ ID NO: 3645984 - RNA, 21 nt, Human
auaauagcaacuuuuguguaa

SEQ ID NO: 3645985 - RNA, 13 nt, Human
auaauauauauau

SEQ ID NO: 3645986 - RNA, 22 nt, Human
auaauauauguuuuaaauauag

SEQ ID NO: 3645987 - RNA, 23 nt, Human
auaauauauucuauuuuuauacu

SEQ ID NO: 3645988 - RNA, 15 nt, Human
auaauauauuguguu

SEQ ID NO: 3645989 - RNA, 13 nt, Human
auaauauauuuuc

SEQ ID NO: 3645990 - RNA, 22 nt, Human
auaauauccaggucaacagaau

SEQ ID NO: 3645991 - RNA, 23 nt, Human
auaauauccaggucaacagaaug

SEQ ID NO: 3645992 - RNA, 19 nt, Human
auaauaucuaaaguuauau

SEQ ID NO: 3645993 - RNA, 20 nt, Human
auaauaucuaaaguuauauu

SEQ ID NO: 3645994 - RNA, 15 nt, Human
auaauaugagaauca

SEQ ID NO: 3645995 - RNA, 20 nt, Human
auaauaugcacacagugcuu

SEQ ID NO: 3645996 - RNA, 20 nt, Human
auaauauguuuccuucccuc

SEQ ID NO: 3645997 - RNA, 14 nt, Human
auaauauuguugua

SEQ ID NO: 3645998 - RNA, 17 nt, Human
auaauauuguuguauaa

SEQ ID NO: 3645999 - RNA, 19 nt, Human
auaauauuguuguauaauu

SEQ ID NO: 3646000 - RNA, 21 nt, Human
auaauauuguuugguaaaugu

SEQ ID NO: 3646001 - RNA, 18 nt, Human
auaauauuuuuaauauau

SEQ ID NO: 3646002 - RNA, 16 nt, Human
auaaucaagagccuua

SEQ ID NO: 3646003 - RNA, 15 nt, Human
auaaucaccagggcc

SEQ ID NO: 3646004 - RNA, 16 nt, Human
auaaucacgcuuuccu

SEQ ID NO: 3646005 - RNA, 18 nt, Human
auaaucacgcuuuccuga

SEQ ID NO: 3646006 - RNA, 22 nt, Human
auaaucacucuaauuaauugua

SEQ ID NO: 3646007 - RNA, 21 nt, Human
auaaucauuauuacuuuugcu

SEQ ID NO: 3646008 - RNA, 17 nt, Human
auaauccagucuucacu

SEQ ID NO: 3646009 - RNA, 15 nt, Human
auaaucccagcacuu

SEQ ID NO: 3646010 - RNA, 18 nt, Human
auaauccugcaaaguaca

SEQ ID NO: 3646011 - RNA, 15 nt, Human
auaaucuagaacaca

SEQ ID NO: 3646012 - RNA, 23 nt, Human
auaaucuaguuuacagaaaaauc

SEQ ID NO: 3646013 - RNA, 17 nt, Human
auaaucuauuucuauga

SEQ ID NO: 3646014 - RNA, 19 nt, Human
auaaucucugauucccuga

SEQ ID NO: 3646015 - RNA, 23 nt, Human
auaaucucugauucccugauuua

SEQ ID NO: 3646016 - RNA, 16 nt, Human
auaaucucuucuuaua

SEQ ID NO: 3646017 - RNA, 18 nt, Human
auaaucuggacuccucug

SEQ ID NO: 3646018 - RNA, 19 nt, Human
auaaucuggacuccucugu

SEQ ID NO: 3646019 - RNA, 20 nt, Human
auaaucuggacuccucuguc

SEQ ID NO: 3646020 - RNA, 22 nt, Human
auaaucuggacuccucugucca

SEQ ID NO: 3646021 - RNA, 17 nt, Human
auaaucuguacaaugaa

SEQ ID NO: 3646022 - RNA, 20 nt, Human
auaaucuguuuuuacguaug

SEQ ID NO: 3646023 - RNA, 17 nt, Human
auaaucuuauaauuguu

SEQ ID NO: 3646024 - RNA, 20 nt, Human
auaaucuucugccuucucau

SEQ ID NO: 3646025 - RNA, 20 nt, Human
auaaucuuguuucugaaaag

SEQ ID NO: 3646026 - RNA, 21 nt, Human
auaaucuuguuucugaaaaga

SEQ ID NO: 3646027 - RNA, 17 nt, Human
auaaugaaaauauuuuu

SEQ ID NO: 3646028 - RNA, 16 nt, Human
auaaugaacaaaauua

SEQ ID NO: 3646029 - RNA, 13 nt, Human
auaaugaacagaa

SEQ ID NO: 3646030 - RNA, 14 nt, Human
auaaugaagcuuua

SEQ ID NO: 3646031 - RNA, 12 nt, Human
auaaugaaugac

SEQ ID NO: 3646032 - RNA, 21 nt, Human
auaaugagcuauuaaaacuca

SEQ ID NO: 3646033 - RNA, 16 nt, Human
auaaugauaaaacacc

SEQ ID NO: 3646034 - RNA, 17 nt, Human
auaaugauaaaacaccu

SEQ ID NO: 3646035 - RNA, 20 nt, Human
auaaugaucgaaaaaauaau

SEQ ID NO: 3646036 - RNA, 20 nt, Human
auaaugcgugcauaccacuu

SEQ ID NO: 3646037 - RNA, 21 nt, Human
auaaugcuaauuuaaagagac

SEQ ID NO: 3646038 - RNA, 14 nt, Human
auaaugcuacaauu

SEQ ID NO: 3646039 - RNA, 15 nt, Human
auaaugcuacaauuu

SEQ ID NO: 3646040 - RNA, 15 nt, Human
auaaugcuuaauuuc

SEQ ID NO: 3646041 - RNA, 17 nt, Human
auaaugcuuaauuucua

SEQ ID NO: 3646042 - RNA, 18 nt, Human
auaaugcuuaauuucuaa

SEQ ID NO: 3646043 - RNA, 14 nt, Human
auaaugcuucagau

SEQ ID NO: 3646044 - RNA, 15 nt, Human
auaaugcuucagaua

SEQ ID NO: 3646045 - RNA, 23 nt, Human
auaauggaaaaaaaaaaaagagg

SEQ ID NO: 3646046 - RNA, 21 nt, Human
auaaugggauuuucuuuucuu

SEQ ID NO: 3646047 - RNA, 17 nt, Human
auaaugggccacugaaa

SEQ ID NO: 3646048 - RNA, 23 nt, Human
auaaugggccacugaaaucuguc

SEQ ID NO: 3646049 - RNA, 17 nt, Human
auaauggguuucuuuca

SEQ ID NO: 3646050 - RNA, 17 nt, Human
auaaugguaccagauaa

SEQ ID NO: 3646051 - RNA, 17 nt, Human
auaauggucccauccag

SEQ ID NO: 3646052 - RNA, 18 nt, Human
auaauggucccauccagg

SEQ ID NO: 3646053 - RNA, 14 nt, Human
auaaugguuucaaa

SEQ ID NO: 3646054 - RNA, 22 nt, Human
auaauguauaaagaacaaggua

SEQ ID NO: 3646055 - RNA, 13 nt, Human
auaaugucuuguu

SEQ ID NO: 3646056 - RNA, 19 nt, Human
auaaugucuuguuaauauu

SEQ ID NO: 3646057 - RNA, 20 nt, Human
auaaugucuuguuaauauuc

SEQ ID NO: 3646058 - RNA, 19 nt, Human
auaaugugggaagaaacaa

SEQ ID NO: 3646059 - RNA, 19 nt, Human
auaauguguaguucaugua

SEQ ID NO: 3646060 - RNA, 13 nt, Human
auaauguguguau

SEQ ID NO: 3646061 - RNA, 15 nt, Human
auaauguguguaugu

SEQ ID NO: 3646062 - RNA, 10 nt, Human
auaauguuaa

SEQ ID NO: 3646063 - RNA, 11 nt, Human
auaauguuaaa

SEQ ID NO: 3646064 - RNA, 12 nt, Human
auaauguuaaau

SEQ ID NO: 3646065 - RNA, 18 nt, Human
auaauguuaaauuuguaa

SEQ ID NO: 3646066 - RNA, 23 nt, Human
auaauguuaaauuuguaaguuuc

SEQ ID NO: 3646067 - RNA, 22 nt, Human
auaauguucugcuaaauuucaa

SEQ ID NO: 3646068 - RNA, 18 nt, Human
auaauguugugguuuguu

SEQ ID NO: 3646069 - RNA, 16 nt, Human
auugcagguggaacuc

SEQ ID NO: 3646070 - RNA, 19 nt, Human
auugcagucauagaagaga

SEQ ID NO: 3646071 - RNA, 22 nt, Human
auugcauacuauuaaacaugcu

SEQ ID NO: 3646072 - RNA, 15 nt, Human
auugcaucauuuaca

SEQ ID NO: 3646073 - RNA, 21 nt, Human
auugcaucuagguaauuuuua

SEQ ID NO: 3646074 - RNA, 15 nt, Human
auugcaucucccaga

SEQ ID NO: 3646075 - RNA, 21 nt, Human
auugcaucuggguagcuguaa

SEQ ID NO: 3646076 - RNA, 13 nt, Human
auugcaucuguau

SEQ ID NO: 3646077 - RNA, 14 nt, Human
auugcaucuguaua

SEQ ID NO: 3646078 - RNA, 13 nt, Human
auugcaugugacu

SEQ ID NO: 3646079 - RNA, 15 nt, Human
auugcauugacuuuc

SEQ ID NO: 3646080 - RNA, 18 nt, Human
auugccaaaacccagcug

SEQ ID NO: 3646081 - RNA, 19 nt, Human
auugccaaaacccagcugc

SEQ ID NO: 3646082 - RNA, 21 nt, Human
auugccaaacauuaauguuga

SEQ ID NO: 3646083 - RNA, 15 nt, Human
auugccagugucuuu

SEQ ID NO: 3646084 - RNA, 20 nt, Human
auugccagugucuuucuuug

SEQ ID NO: 3646085 - RNA, 21 nt, Human
auugccagugucuuucuuugg

SEQ ID NO: 3646086 - RNA, 12 nt, Human
auugccauauug

SEQ ID NO: 3646087 - RNA, 18 nt, Human
auugccauucccugccug

SEQ ID NO: 3646088 - RNA, 15 nt, Human
auugcccaggcuggu

SEQ ID NO: 3646089 - RNA, 16 nt, Human
auugcccaggcugguc

SEQ ID NO: 3646090 - RNA, 16 nt, Human
auugcccccagggcac

SEQ ID NO: 3646091 - RNA, 13 nt, Human
auugccuccuccu

SEQ ID NO: 3646092 - RNA, 13 nt, Human
auugccucugaaa

SEQ ID NO: 3646093 - RNA, 22 nt, Human
auugccuguguauggaaaaacc

SEQ ID NO: 3646094 - RNA, 13 nt, Human
auugccuucauuu

SEQ ID NO: 3646095 - RNA, 19 nt, Human
auugccuucucaccagcug

SEQ ID NO: 3646096 - RNA, 16 nt, Human
auugccuucuuugaag

SEQ ID NO: 3646097 - RNA, 17 nt, Human
auugccuucuuugaaga

SEQ ID NO: 3646098 - RNA, 23 nt, Human
auugccuuuagugaucacagcag

SEQ ID NO: 3646099 - RNA, 18 nt, Human
auugccuuuuuucuguau

SEQ ID NO: 3646100 - RNA, 16 nt, Human
auugcgagagaugugu

SEQ ID NO: 3646101 - RNA, 17 nt, Human
auugcgagagaugugug

SEQ ID NO: 3646102 - RNA, 18 nt, Human
auugcggacagccacggc

SEQ ID NO: 3646103 - RNA, 19 nt, Human
auugcggacagccacggcc

SEQ ID NO: 3646104 - RNA, 20 nt, Human
auugcgucuuagcagugauu

SEQ ID NO: 3646105 - RNA, 15 nt, Human
auuuauaaacuuuuu

SEQ ID NO: 3646106 - RNA, 17 nt, Human
auuuauaaagcuaaaau

SEQ ID NO: 3646107 - RNA, 21 nt, Human
auuuauaaagcuaaaauaacc

SEQ ID NO: 3646108 - RNA, 13 nt, Human
auuuauaaaugcu

SEQ ID NO: 3646109 - RNA, 17 nt, Human
auuuauaacucaucaua

SEQ ID NO: 3646110 - RNA, 21 nt, Human
auuuauaacucaucauaaaau

SEQ ID NO: 3646111 - RNA, 20 nt, Human
auuuauaauguuaguagaaa

SEQ ID NO: 3646112 - RNA, 20 nt, Human
auuuauaauucaguauguuu

SEQ ID NO: 3646113 - RNA, 15 nt, Human
auuuauacaagauug

SEQ ID NO: 3646114 - RNA, 19 nt, Human
auuuauacaggucauauua

SEQ ID NO: 3646115 - RNA, 17 nt, Human
auuuauaccuaacugaa

SEQ ID NO: 3646116 - RNA, 21 nt, Human
auuuauaguaaugaguuuaaa

SEQ ID NO: 3646117 - RNA, 16 nt, Human
auuuauaguuuauaca

SEQ ID NO: 3646118 - RNA, 17 nt, Human
auuuauaguuuauacag

SEQ ID NO: 3646119 - RNA, 20 nt, Human
auuuauaguuuauacaguuu

SEQ ID NO: 3646120 - RNA, 18 nt, Human
auuuauauaauuauguua

SEQ ID NO: 3646121 - RNA, 13 nt, Human
auuuauauaugaa

SEQ ID NO: 3646122 - RNA, 15 nt, Human
auuuauauaugaaaa

SEQ ID NO: 3646123 - RNA, 16 nt, Human
auuuauauaugaaaac

SEQ ID NO: 3646124 - RNA, 19 nt, Human
auuuauauaugaaaacuau

SEQ ID NO: 3646125 - RNA, 22 nt, Human
auuuauauaugaaaacuauaca

SEQ ID NO: 3646126 - RNA, 15 nt, Human
auuuauauauguauu

SEQ ID NO: 3646127 - RNA, 15 nt, Human
auuuauauauuggua

SEQ ID NO: 3646128 - RNA, 19 nt, Human
auuuauauggggaauauau

SEQ ID NO: 3646129 - RNA, 17 nt, Human
auuuauauguacaugag

SEQ ID NO: 3646130 - RNA, 13 nt, Human
auuuauauguacu

SEQ ID NO: 3646131 - RNA, 16 nt, Human
auuuauauguacuguu

SEQ ID NO: 3646132 - RNA, 17 nt, Human
auuuauauguacuguuu

SEQ ID NO: 3646133 - RNA, 15 nt, Human
auuuauauuguaaau

SEQ ID NO: 3646134 - RNA, 18 nt, Human
auuuauauuguaaauauu

SEQ ID NO: 3646135 - RNA, 20 nt, Human
auuuauauuuauugacucuu

SEQ ID NO: 3646136 - RNA, 22 nt, Human
auuuauauuuauugacucuuga

SEQ ID NO: 3646137 - RNA, 13 nt, Human
auuuauauuucac

SEQ ID NO: 3646138 - RNA, 21 nt, Human
auuuaucaaacccuagccuug

SEQ ID NO: 3646139 - RNA, 13 nt, Human
auuuaucaaagca

SEQ ID NO: 3646140 - RNA, 17 nt, Human
auuuaucacacaaagca

SEQ ID NO: 3646141 - RNA, 15 nt, Human
auuuaucagugacag

SEQ ID NO: 3646142 - RNA, 18 nt, Human
auuuaucagugacagagu

SEQ ID NO: 3646143 - RNA, 23 nt, Human
auuuaucagugacagaguucacu

SEQ ID NO: 3646144 - RNA, 12 nt, Human
auuuauccacua

SEQ ID NO: 3646145 - RNA, 16 nt, Human
auuuauccagaaaacu

SEQ ID NO: 3646146 - RNA, 12 nt, Human
auuuauccucug

SEQ ID NO: 3646147 - RNA, 17 nt, Human
auuuaucuaaauaugga

SEQ ID NO: 3646148 - RNA, 20 nt, Human
auuuaucuaaauuaaagccu

SEQ ID NO: 3646149 - RNA, 16 nt, Human
auuuaucuauuguaag

SEQ ID NO: 3646150 - RNA, 20 nt, Human
auuuaucugggauuaugguu

SEQ ID NO: 3646151 - RNA, 20 nt, Human
auuuaucuguguuuuugaaa

SEQ ID NO: 3646152 - RNA, 14 nt, Human
auuuaucuuugaua

SEQ ID NO: 3646153 - RNA, 13 nt, Human
auuuaugaauaua

SEQ ID NO: 3646154 - RNA, 23 nt, Human
auuuaugaauugaauuaucuugg

SEQ ID NO: 3646155 - RNA, 19 nt, Human
auuuaugaguuuuugauag

SEQ ID NO: 3646156 - RNA, 13 nt, Human
auuuaugauuuaa

SEQ ID NO: 3646157 - RNA, 16 nt, Human
auuuaugauuuaauaa

SEQ ID NO: 3646158 - RNA, 19 nt, Human
auuuaugcauggaaaccug

SEQ ID NO: 3646159 - RNA, 22 nt, Human
auuuaugccuugaugauuuaau

SEQ ID NO: 3646160 - RNA, 16 nt, Human
auuuaugggccccugg

SEQ ID NO: 3646161 - RNA, 18 nt, Human
auuuauggucaacacuua

SEQ ID NO: 3646162 - RNA, 16 nt, Human
auuuauguaacuugaa

SEQ ID NO: 3646163 - RNA, 21 nt, Human
auuuauguaaugaaguaaagc

SEQ ID NO: 3646164 - RNA, 18 nt, Human
auuuauguagaugugcau

SEQ ID NO: 3646165 - RNA, 19 nt, Human
auuuauguauugugcaaug

SEQ ID NO: 3646166 - RNA, 22 nt, Human
auuuaugucuauuuaagccuca

SEQ ID NO: 3646167 - RNA, 13 nt, Human
auuuaugugugag

SEQ ID NO: 3646168 - RNA, 22 nt, Human
auuuaugugugaggagcugcug

SEQ ID NO: 3646169 - RNA, 14 nt, Human
auuuauguuaaaag

SEQ ID NO: 3646170 - RNA, 16 nt, Human
auuuauguuaaaagau

SEQ ID NO: 3646171 - RNA, 18 nt, Human
auuuauguuguauagauu

SEQ ID NO: 3646172 - RNA, 21 nt, Human
auuuauuaaaaugauuguaaa

SEQ ID NO: 3646173 - RNA, 23 nt, Human
auuuauuaaaaugauuguaaaau

SEQ ID NO: 3646174 - RNA, 13 nt, Human
auuuauuaaagaa

SEQ ID NO: 3646175 - RNA, 18 nt, Human
auuuauuaaagaaaaaaa

SEQ ID NO: 3646176 - RNA, 12 nt, Human
auuuauuaaaua

SEQ ID NO: 3646177 - RNA, 14 nt, Human
auuuauuaaauaaa

SEQ ID NO: 3646178 - RNA, 18 nt, Human
auuuauuaaauaaaauca

SEQ ID NO: 3646179 - RNA, 20 nt, Human
auuuauuaaaugcccagccc

SEQ ID NO: 3646180 - RNA, 22 nt, Human
auuuauuaacugcucaguguuu

SEQ ID NO: 3646181 - RNA, 13 nt, Human
auuuauuaacuua

SEQ ID NO: 3646182 - RNA, 14 nt, Human
auuuauuaacuuaa

SEQ ID NO: 3646183 - RNA, 20 nt, Human
auuuauuaacuuaauaauca

SEQ ID NO: 3646184 - RNA, 16 nt, Human
auuuauuaagauggau

SEQ ID NO: 3646185 - RNA, 14 nt, Human
auuuauuaccucug

SEQ ID NO: 3646186 - RNA, 15 nt, Human
auuuauuaccucuga

SEQ ID NO: 3646187 - RNA, 19 nt, Human
auuuauuacuguaagaaaa

SEQ ID NO: 3646188 - RNA, 22 nt, Human
auuuauuacuguaagaaaauau

SEQ ID NO: 3646189 - RNA, 19 nt, Human
auuuauuagcccugcauuu

SEQ ID NO: 3646190 - RNA, 16 nt, Human
auuuauuaguuaauau

SEQ ID NO: 3646191 - RNA, 11 nt, Human
auuuauuauuu

SEQ ID NO: 3646192 - RNA, 12 nt, Human
auuuauucaaga

SEQ ID NO: 3646193 - RNA, 14 nt, Human
auuuauucaauaaa

SEQ ID NO: 3646194 - RNA, 16 nt, Human
auuuauucaauaaagu

SEQ ID NO: 3646195 - RNA, 18 nt, Human
auuuauucagcuucauuu

SEQ ID NO: 3646196 - RNA, 17 nt, Human
auuuauucauauuuucu

SEQ ID NO: 3646197 - RNA, 22 nt, Human
auuuauucauuauuugucaaau

SEQ ID NO: 3646198 - RNA, 19 nt, Human
auuuauuccauauucaugu

SEQ ID NO: 3646199 - RNA, 14 nt, Human
auuuauucugcuca

SEQ ID NO: 3646200 - RNA, 18 nt, Human
auuuauucugggaaugua

SEQ ID NO: 3646201 - RNA, 20 nt, Human
auuuauucugggaauguaua

SEQ ID NO: 3646202 - RNA, 22 nt, Human
auuuauucugggaauguauagu

SEQ ID NO: 3646203 - RNA, 13 nt, Human
auuuauugacucu

SEQ ID NO: 3646204 - RNA, 16 nt, Human
auuuauugacucuuga

SEQ ID NO: 3646205 - RNA, 14 nt, Human
auuuauugaggaaa

SEQ ID NO: 3646206 - RNA, 17 nt, Human
auuuauugaggaaaaau

SEQ ID NO: 3646207 - RNA, 19 nt, Human
auuuauugcacaaaauaua

SEQ ID NO: 3646208 - RNA, 19 nt, Human
auuuauugcacauuguuca

SEQ ID NO: 3646209 - RNA, 24 nt, Human
auuuauugcagaggauguucauaa

SEQ ID NO: 3646210 - RNA, 21 nt, Human
auuuauugcaggauggugucu

SEQ ID NO: 3646211 - RNA, 22 nt, Human
auuuauugcuguguaacacugu

SEQ ID NO: 3646212 - RNA, 14 nt, Human
auuuauugcuugau

SEQ ID NO: 3646213 - RNA, 12 nt, Human
auuuauugcuuu

SEQ ID NO: 3646214 - RNA, 20 nt, Human
auuuuaaaagaugcaaugua

SEQ ID NO: 3646215 - RNA, 19 nt, Human
auuuuaaaagccacauaga

SEQ ID NO: 3646216 - RNA, 17 nt, Human
auuuuaaaauaaacuuu

SEQ ID NO: 3646217 - RNA, 20 nt, Human
auuuuaaaauagcguucuug

SEQ ID NO: 3646218 - RNA, 22 nt, Human
auuuuaaaaucugagggaaaug

SEQ ID NO: 3646219 - RNA, 23 nt, Human
auuuuaaaaucugagggaaaugu

SEQ ID NO: 3646220 - RNA, 14 nt, Human
auuuuaaaaugaga

SEQ ID NO: 3646221 - RNA, 14 nt, Human
auuuuaaaauguac

SEQ ID NO: 3646222 - RNA, 22 nt, Human
auuuuaaaauguacauguauua

SEQ ID NO: 3646223 - RNA, 15 nt, Human
auuuuaaaauuucau

SEQ ID NO: 3646224 - RNA, 17 nt, Human
auuuuaaaauuuguucu

SEQ ID NO: 3646225 - RNA, 17 nt, Human
auuuuaaacaaaauaga

SEQ ID NO: 3646226 - RNA, 21 nt, Human
auuuuaaacaaaauagaaagu

SEQ ID NO: 3646227 - RNA, 13 nt, Human
auuuuaaacacau

SEQ ID NO: 3646228 - RNA, 14 nt, Human
auuuuaaacacauu

SEQ ID NO: 3646229 - RNA, 15 nt, Human
auuuuaaacagagga

SEQ ID NO: 3646230 - RNA, 22 nt, Human
auuuuaaaccauaaaaagcuga

SEQ ID NO: 3646231 - RNA, 18 nt, Human
auuuuaaacuagaugacc

SEQ ID NO: 3646232 - RNA, 20 nt, Human
auuuuaaacuagaugaccuc

SEQ ID NO: 3646233 - RNA, 17 nt, Human
auuuuaaagaauugugu

SEQ ID NO: 3646234 - RNA, 18 nt, Human
auuuuaaagccauucuga

SEQ ID NO: 3646235 - RNA, 13 nt, Human
auuuuaaaguaug

SEQ ID NO: 3646236 - RNA, 19 nt, Human
auuuuaaaguaugcauuau

SEQ ID NO: 3646237 - RNA, 12 nt, Human
auuuuaaaguua

SEQ ID NO: 3646238 - RNA, 14 nt, Human
auuuuaaaguuagu

SEQ ID NO: 3646239 - RNA, 16 nt, Human
auuuuaaauggacaga

SEQ ID NO: 3646240 - RNA, 18 nt, Human
auuuuaaaugugugagug

SEQ ID NO: 3646241 - RNA, 23 nt, Human
auuuuaaaugugugagugcaugu

SEQ ID NO: 3646242 - RNA, 11 nt, Human
auuuuaaauua

SEQ ID NO: 3646243 - RNA, 14 nt, Human
auuuuaaauuauaa

SEQ ID NO: 3646244 - RNA, 22 nt, Human
auuuuaaauuauaacuuaaaau

SEQ ID NO: 3646245 - RNA, 18 nt, Human
auuuuaaauuauaaggac

SEQ ID NO: 3646246 - RNA, 13 nt, Human
auuuuaacaaaag

SEQ ID NO: 3646247 - RNA, 16 nt, Human
auuuuaacaaaagcaa

SEQ ID NO: 3646248 - RNA, 17 nt, Human
auuuuaacaacagcugg

SEQ ID NO: 3646249 - RNA, 14 nt, Human
auuuuaacaagaag

SEQ ID NO: 3646250 - RNA, 18 nt, Human
auuuuaacaagaagauga

SEQ ID NO: 3646251 - RNA, 22 nt, Human
auuuuaacaauaacuacugugu

SEQ ID NO: 3646252 - RNA, 17 nt, Human
auuuuaaccugcauaaa

SEQ ID NO: 3646253 - RNA, 16 nt, Human
auuuuaacuaaauuuu

SEQ ID NO: 3646254 - RNA, 15 nt, Human
auuuuaacucugucu

SEQ ID NO: 3646255 - RNA, 16 nt, Human
auuuuaacucugucuu

SEQ ID NO: 3646256 - RNA, 13 nt, Human
auuuuaacuuaga

SEQ ID NO: 3646257 - RNA, 15 nt, Human
auuuuaacuuuauca

SEQ ID NO: 3646258 - RNA, 20 nt, Human
auuuuaagacguguuugugu

SEQ ID NO: 3646259 - RNA, 16 nt, Human
auuuuaagauuccuuu

SEQ ID NO: 3646260 - RNA, 17 nt, Human
auuuuaagauuccuuuu

SEQ ID NO: 3646261 - RNA, 19 nt, Human
auuuuaagccuuuguugaa

SEQ ID NO: 3646262 - RNA, 19 nt, Human
auuuuaagcuaggaaaaga

SEQ ID NO: 3646263 - RNA, 20 nt, Human
auuuuaagcuaggaaaagaa

SEQ ID NO: 3646264 - RNA, 16 nt, Human
auuuuaaguauugcau

SEQ ID NO: 3646265 - RNA, 20 nt, Human
auuuuaagucccugucaccu

SEQ ID NO: 3646266 - RNA, 22 nt, Human
auuuuaagucccugucaccucu

SEQ ID NO: 3646267 - RNA, 17 nt, Human
auuuuaagugcuuugua

SEQ ID NO: 3646268 - RNA, 13 nt, Human
auuuuaauaauau

SEQ ID NO: 3646269 - RNA, 14 nt, Human
auuuuaauaauguu

SEQ ID NO: 3646270 - RNA, 15 nt, Human
auuuuaauaauguuu

SEQ ID NO: 3646271 - RNA, 20 nt, Human
auuuuaauagggaauauauc

SEQ ID NO: 3646272 - RNA, 18 nt, Human
auuuuaaucaaguugaau

SEQ ID NO: 3646273 - RNA, 21 nt, Human
auuuuaaugcaccugaauguu

SEQ ID NO: 3646274 - RNA, 20 nt, Human
auuuuaauggauuguuaauu

SEQ ID NO: 3646275 - RNA, 16 nt, Human
auuuuaauguaauuga

SEQ ID NO: 3646276 - RNA, 13 nt, Human
auuuuaaugugau

SEQ ID NO: 3646277 - RNA, 22 nt, Human
auuuuaaugugaugauguaauu

SEQ ID NO: 3646278 - RNA, 24 nt, Human
auuuuaaugugaugauguaauuga

SEQ ID NO: 3646279 - RNA, 15 nt, Human
auuuuaauuagguua

SEQ ID NO: 3646280 - RNA, 23 nt, Human
auuuuaauuagguuaacuaugua

SEQ ID NO: 3646281 - RNA, 19 nt, Human
auuuuaauuauuauucuuc

SEQ ID NO: 3646282 - RNA, 19 nt, Human
auuuuaauuucaagcuuau

SEQ ID NO: 3646283 - RNA, 18 nt, Human
auuuuaauuuuuaaaugc

SEQ ID NO: 3646284 - RNA, 22 nt, Human
auuuuacaaaagaggagcacuu

SEQ ID NO: 3646285 - RNA, 15 nt, Human
auuuuacaaaagaug

SEQ ID NO: 3646286 - RNA, 21 nt, Human
auuuuacaauugaaaugacua

SEQ ID NO: 3646287 - RNA, 14 nt, Human
auuuuacacagaaa

SEQ ID NO: 3646288 - RNA, 22 nt, Human
auuuuacacagaaacacugccu

SEQ ID NO: 3646289 - RNA, 13 nt, Human
auuuuacacauua

SEQ ID NO: 3646290 - RNA, 18 nt, Human
auuuuacagcucauuaaa

SEQ ID NO: 3646291 - RNA, 22 nt, Human
auuuuacagcucauuaaacuuu

SEQ ID NO: 3646292 - RNA, 23 nt, Human
auuuuacagcucauuaaacuuuu

SEQ ID NO: 3646293 - RNA, 22 nt, Human
auuuuacaguuaaggaauauaa

SEQ ID NO: 3646294 - RNA, 16 nt, Human
auuuuacauaaauuua

SEQ ID NO: 3646295 - RNA, 17 nt, Human
auuuuacauaaauuuag

SEQ ID NO: 3646296 - RNA, 19 nt, Human
auuuuacaugaaguauuuu

SEQ ID NO: 3646297 - RNA, 12 nt, Human
auuuuacauuaa

SEQ ID NO: 3646298 - RNA, 15 nt, Human
auuuuacauuaaauu

SEQ ID NO: 3646299 - RNA, 13 nt, Human
auuuuaccaaguu

SEQ ID NO: 3646300 - RNA, 17 nt, Human
auuuuaccacugcugug

SEQ ID NO: 3646301 - RNA, 16 nt, Human
auuuuaccagcagaag

SEQ ID NO: 3646302 - RNA, 22 nt, Human
auuuuaccuagcuaauuauuua

SEQ ID NO: 3646303 - RNA, 15 nt, Human
auuuuaccucuuauu

SEQ ID NO: 3646304 - RNA, 18 nt, Human
auuuuaccucuuauugca

SEQ ID NO: 3646305 - RNA, 22 nt, Human
auuuuaccuguuuuuguuucuu

SEQ ID NO: 3646306 - RNA, 22 nt, Human
auuuuacuccauaaacagacug

SEQ ID NO: 3646307 - RNA, 13 nt, Human
auuuuacugucuu

SEQ ID NO: 3646308 - RNA, 14 nt, Human
auuuuacugucuua

SEQ ID NO: 3646309 - RNA, 23 nt, Human
auuuuacugucuuaauuaaguaa

SEQ ID NO: 3646310 - RNA, 13 nt, Human
auuuaauuuugac

SEQ ID NO: 3646311 - RNA, 14 nt, Human
auuuaauuuugaca

SEQ ID NO: 3646312 - RNA, 22 nt, Human
auuuaauuuugacacugaaaua

SEQ ID NO: 3646313 - RNA, 19 nt, Human
auuuacaaaaauauaaaau

SEQ ID NO: 3646314 - RNA, 20 nt, Human
auuuacaaaaauauaaaaua

SEQ ID NO: 3646315 - RNA, 14 nt, Human
auuuacaaagugug

SEQ ID NO: 3646316 - RNA, 15 nt, Human
auuuacaaagugugu

SEQ ID NO: 3646317 - RNA, 15 nt, Human
auuuacaaauguuuu

SEQ ID NO: 3646318 - RNA, 14 nt, Human
auuuacaagaagaa

SEQ ID NO: 3646319 - RNA, 13 nt, Human
auuuacaauguau

SEQ ID NO: 3646320 - RNA, 14 nt, Human
auuuacaauguauu

SEQ ID NO: 3646321 - RNA, 14 nt, Human
auuuacacugccau

SEQ ID NO: 3646322 - RNA, 20 nt, Human
auuuacacuuuugagacuuu

SEQ ID NO: 3646323 - RNA, 16 nt, Human
auuuacauaugaaauu

SEQ ID NO: 3646324 - RNA, 21 nt, Human
auuuacaugaauugcauuuua

SEQ ID NO: 3646325 - RNA, 17 nt, Human
auuuaccacagcagcug

SEQ ID NO: 3646326 - RNA, 22 nt, Human
auuuaccacuuguguuuugcaa

SEQ ID NO: 3646327 - RNA, 23 nt, Human
auuuaccagccuccguauuucag

SEQ ID NO: 3646328 - RNA, 18 nt, Human
auuuaccagggauguaga

SEQ ID NO: 3646329 - RNA, 14 nt, Human
auuuaccuaagauu

SEQ ID NO: 3646330 - RNA, 15 nt, Human
auuuaccucagccug

SEQ ID NO: 3646331 - RNA, 15 nt, Human
auuuacgcuuugauu

SEQ ID NO: 3646332 - RNA, 19 nt, Human
auuuacgcuuugauucaua

SEQ ID NO: 3646333 - RNA, 16 nt, Human
auuuacguuuuuguaa

SEQ ID NO: 3646334 - RNA, 20 nt, Human
auuuacuaaaauggacugug

SEQ ID NO: 3646335 - RNA, 19 nt, Human
auuuacuaaacauaugauu

SEQ ID NO: 3646336 - RNA, 22 nt, Human
auuuacuaaacauaugauuuca

SEQ ID NO: 3646337 - RNA, 15 nt, Human
auuuacuaagccaca

SEQ ID NO: 3646338 - RNA, 22 nt, Human
auuuacuacaauauguacauuu

SEQ ID NO: 3646339 - RNA, 15 nt, Human
auuuacuacaguagu

SEQ ID NO: 3646340 - RNA, 15 nt, Human
auuuacuacuuuugc

SEQ ID NO: 3646341 - RNA, 13 nt, Human
auuuacucauuau

SEQ ID NO: 3646342 - RNA, 22 nt, Human
auuuacucauucauuuauucau

SEQ ID NO: 3646343 - RNA, 21 nt, Human
auuuacugcauucuucugauc

SEQ ID NO: 3646344 - RNA, 14 nt, Human
auuuacuucuuaua

SEQ ID NO: 3646345 - RNA, 19 nt, Human
auuuacuucuuauacauuu

SEQ ID NO: 3646346 - RNA, 15 nt, Human
auuuacuuguuuugg

SEQ ID NO: 3646347 - RNA, 15 nt, Human
auuuacuuugaauuu

SEQ ID NO: 3646348 - RNA, 18 nt, Human
auuuagaaaaaaguuuac

SEQ ID NO: 3646349 - RNA, 22 nt, Human
auuuagaaagaagcccaauauu

SEQ ID NO: 3646350 - RNA, 14 nt, Human
auuuagaagaaaga

SEQ ID NO: 3646351 - RNA, 15 nt, Human
auuuagaagaaagau

SEQ ID NO: 3646352 - RNA, 12 nt, Human
auuuagaagcca

SEQ ID NO: 3646353 - RNA, 14 nt, Human
auuuagaaguguca

SEQ ID NO: 3646354 - RNA, 18 nt, Human
auuuagaagugucauguu

SEQ ID NO: 3646355 - RNA, 19 nt, Human
auuuagacuuggauucuuu

SEQ ID NO: 3646356 - RNA, 23 nt, Human
auuuagacuuggauucuuuccau

SEQ ID NO: 3646357 - RNA, 20 nt, Human
auuuagagaacuguggccgu

SEQ ID NO: 3646358 - RNA, 23 nt, Human
auuuauuaacuuaauaaucaaga

SEQ ID NO: 3646359 - RNA, 15 nt, Human
auuuauuaagaugga

SEQ ID NO: 3646360 - RNA, 12 nt, Human
auuuauuaauau

SEQ ID NO: 3646361 - RNA, 14 nt, Human
auuuauuaauauuu

SEQ ID NO: 3646362 - RNA, 15 nt, Human
auuuauuaauauuua

SEQ ID NO: 3646363 - RNA, 23 nt, Human
auuuauuaauauuuaacauuauu

SEQ ID NO: 3646364 - RNA, 20 nt, Human
auuuauuacuguaagaaaau

SEQ ID NO: 3646365 - RNA, 13 nt, Human
auuuauuauggca

SEQ ID NO: 3646366 - RNA, 12 nt, Human
auuuauuauuga

SEQ ID NO: 3646367 - RNA, 13 nt, Human
auuuauucaauaa

SEQ ID NO: 3646368 - RNA, 15 nt, Human
auuuauucaauaaag

SEQ ID NO: 3646369 - RNA, 18 nt, Human
auuuauucaauaaaguau

SEQ ID NO: 3646370 - RNA, 22 nt, Human
auuuauucaauaaaguauuuaa

SEQ ID NO: 3646371 - RNA, 18 nt, Human
auuuauucaauuccucug

SEQ ID NO: 3646372 - RNA, 14 nt, Human
auuuauucauuagu

SEQ ID NO: 3646373 - RNA, 20 nt, Human
auuuauuccauauucaugua

SEQ ID NO: 3646374 - RNA, 13 nt, Human
auuuauuccuuug

SEQ ID NO: 3646375 - RNA, 14 nt, Human
auuuauucuaauua

SEQ ID NO: 3646376 - RNA, 13 nt, Human
auuuauucugcuc

SEQ ID NO: 3646377 - RNA, 16 nt, Human
auuuauucugggaaug

SEQ ID NO: 3646378 - RNA, 15 nt, Human
auuuauugaaaugau

SEQ ID NO: 3646379 - RNA, 14 nt, Human
auuuauugaguuuu

SEQ ID NO: 3646380 - RNA, 13 nt, Human
auuuauugcacaa

SEQ ID NO: 3646381 - RNA, 14 nt, Human
auuuauugcacaaa

SEQ ID NO: 3646382 - RNA, 18 nt, Human
auuuauugcuacuuccug

SEQ ID NO: 3646383 - RNA, 13 nt, Human
auuuauugcuuua

SEQ ID NO: 3646384 - RNA, 20 nt, Human
auuuauuggcuuuucugauc

SEQ ID NO: 3646385 - RNA, 23 nt, Human
auuuauuggcuuuucugauccag

SEQ ID NO: 3646386 - RNA, 16 nt, Human
auuuauuguauucugg

SEQ ID NO: 3646387 - RNA, 19 nt, Human
auuuauuguuuauuuauca

SEQ ID NO: 3646388 - RNA, 21 nt, Human
auuuauuguuuauuuaucagu

SEQ ID NO: 3646389 - RNA, 22 nt, Human
auuuauuguuuauuuaucagug

SEQ ID NO: 3646390 - RNA, 20 nt, Human
auuuauuuaaaagauucauu

SEQ ID NO: 3646391 - RNA, 14 nt, Human
auuuauuuaaaaua

SEQ ID NO: 3646392 - RNA, 15 nt, Human
auuuauuuaaagcau

SEQ ID NO: 3646393 - RNA, 12 nt, Human
auuuauuuaaau

SEQ ID NO: 3646394 - RNA, 15 nt, Human
auuuauuuaauauuu

SEQ ID NO: 3646395 - RNA, 18 nt, Human
auuuauuuaauauuuaau

SEQ ID NO: 3646396 - RNA, 16 nt, Human
auuuauuuacaaaugu

SEQ ID NO: 3646397 - RNA, 23 nt, Human
auuuauuuacagaugaauguauu

SEQ ID NO: 3646398 - RNA, 15 nt, Human
auuuauuuauccaga

SEQ ID NO: 3646399 - RNA, 14 nt, Human
auuuauuuaugugu

SEQ ID NO: 3646400 - RNA, 14 nt, Human
auuuauuuauuaag

SEQ ID NO: 3646401 - RNA, 17 nt, Human
auuuauuuauuaagaug

SEQ ID NO: 3646402 - RNA, 14 nt, Human
auuuauuuauucau

SEQ ID NO: 3646403 - RNA, 16 nt, Human
auuuauuuauuuauuc

SEQ ID NO: 3646404 - RNA, 18 nt, Human
auuuauuuccaauguuuc

SEQ ID NO: 3646405 - RNA, 20 nt, Human
auuuauuuccacuaaaaaua

SEQ ID NO: 3646406 - RNA, 21 nt, Human
auuuauuuccacuaaaaauau

SEQ ID NO: 3646407 - RNA, 22 nt, Human
auuuauuuccacuaaaaauauu

SEQ ID NO: 3646408 - RNA, 16 nt, Human
auuuauuugaaugauu

SEQ ID NO: 3646409 - RNA, 21 nt, Human
auuuauuugaaugauuuuucu

SEQ ID NO: 3646410 - RNA, 16 nt, Human
auuuauuugcuucuuc

SEQ ID NO: 3646411 - RNA, 20 nt, Human
auuuauuuuauuuuagcagu

SEQ ID NO: 3646412 - RNA, 17 nt, Human
auuuauuuuccucccca

SEQ ID NO: 3646413 - RNA, 16 nt, Human
auuuauuuucuuuuga

SEQ ID NO: 3646414 - RNA, 12 nt, Human
auuuauuuugac

SEQ ID NO: 3646415 - RNA, 13 nt, Human
auuuauuuuguaa

SEQ ID NO: 3646416 - RNA, 15 nt, Human
auuuauuuuucaguu

SEQ ID NO: 3646417 - RNA, 19 nt, Human
auuuauuuuucaguuccaa

SEQ ID NO: 3646418 - RNA, 20 nt, Human
auuuauuuuucaguuccaag

SEQ ID NO: 3646419 - RNA, 14 nt, Human
auuuauuuuuuaca

SEQ ID NO: 3646420 - RNA, 18 nt, Human
auuuauuuuuuacauuau

SEQ ID NO: 3646421 - RNA, 19 nt, Human
auuuauuuuuuuuaaagaa

SEQ ID NO: 3646422 - RNA, 19 nt, Human
auuuauuuuuuuuaauugu

SEQ ID NO: 3646423 - RNA, 22 nt, Human
auuuauuuuuuuuaauuguauu

SEQ ID NO: 3646424 - RNA, 14 nt, Human
auuucaaaaauaua

SEQ ID NO: 3646425 - RNA, 18 nt, Human
auuucaaaaauauaacuu

SEQ ID NO: 3646426 - RNA, 19 nt, Human
auuucaaaaauauaacuua

SEQ ID NO: 3646427 - RNA, 22 nt, Human
auuucaaaaauuuggaauucug

SEQ ID NO: 3646428 - RNA, 17 nt, Human
auuucaaaagacauguu

SEQ ID NO: 3646429 - RNA, 18 nt, Human
auuucaaaagacauguug

SEQ ID NO: 3646430 - RNA, 21 nt, Human
auuucaaaagacauguuguaa

SEQ ID NO: 3646431 - RNA, 13 nt, Human
auuucaaaaugcu

SEQ ID NO: 3646432 - RNA, 20 nt, Human
auuucaagaaaaaauaaaug

SEQ ID NO: 3646433 - RNA, 22 nt, Human
auuucaagaaaaaauaaaugga

SEQ ID NO: 3646434 - RNA, 15 nt, Human
auuucaagaccuucu

SEQ ID NO: 3646435 - RNA, 12 nt, Human
auuucaagcuua

SEQ ID NO: 3646436 - RNA, 21 nt, Human
auuucaagcuuauuuuggaga

SEQ ID NO: 3646437 - RNA, 11 nt, Human
auuucaaguuc

SEQ ID NO: 3646438 - RNA, 23 nt, Human
auuucaaguuccaaguugcuaau

SEQ ID NO: 3646439 - RNA, 20 nt, Human
auuucaauguaauuaaacug

SEQ ID NO: 3646440 - RNA, 22 nt, Human
auuucaauguaauuaaacuguu

SEQ ID NO: 3646441 - RNA, 20 nt, Human
auuucaauguguauaaauug

SEQ ID NO: 3646442 - RNA, 17 nt, Human
auuucaauuuguucagu

SEQ ID NO: 3646443 - RNA, 18 nt, Human
auuucacaaauauuaaaa

SEQ ID NO: 3646444 - RNA, 23 nt, Human
auuucacaaauauuaaaaagucu

SEQ ID NO: 3646445 - RNA, 20 nt, Human
auuucacaacagaucaauuu

SEQ ID NO: 3646446 - RNA, 23 nt, Human
auuucacaguguguuugugauug

SEQ ID NO: 3646447 - RNA, 21 nt, Human
auuucacauuaauauuugcug

SEQ ID NO: 3646448 - RNA, 16 nt, Human
auuucacauuaauggu

SEQ ID NO: 3646449 - RNA, 22 nt, Human
auuucacauuaauggucuaaaa

SEQ ID NO: 3646450 - RNA, 17 nt, Human
auuucacauuauucugg

SEQ ID NO: 3646451 - RNA, 23 nt, Human
auuucaccacucaaaggccagac

SEQ ID NO: 3646452 - RNA, 21 nt, Human
auuucaccccucccuuucucc

SEQ ID NO: 3646453 - RNA, 18 nt, Human
auuucaccuguaaaccug

SEQ ID NO: 3646454 - RNA, 18 nt, Human
auuucacgucauaggaag

SEQ ID NO: 3646455 - RNA, 16 nt, Human
auuucacuagaaaagc

SEQ ID NO: 3646456 - RNA, 16 nt, Human
auuucacuggagcaca

SEQ ID NO: 3646457 - RNA, 22 nt, Human
auuucacugucuuuaauucugu

SEQ ID NO: 3646458 - RNA, 23 nt, Human
auuucacugucuuuaauucugua

SEQ ID NO: 3646459 - RNA, 15 nt, Human
auuucacuugagugg

SEQ ID NO: 3646460 - RNA, 19 nt, Human
auuucacuuuagaugcuga

SEQ ID NO: 3646461 - RNA, 21 nt, Human
auuucagaaauacagauaaau

SEQ ID NO: 3646462 - RNA, 16 nt, Human
auuucagaaguuuaaa

SEQ ID NO: 3646463 - RNA, 23 nt, Human
auuucagagugacuacacacagu

SEQ ID NO: 3646464 - RNA, 13 nt, Human
auuucagauguaa

SEQ ID NO: 3646465 - RNA, 14 nt, Human
auuucagauguaau

SEQ ID NO: 3646466 - RNA, 15 nt, Human
auuucagauguaaug

SEQ ID NO: 3646467 - RNA, 18 nt, Human
auuucagauucccagagc

SEQ ID NO: 3646468 - RNA, 15 nt, Human
auuucagauuuguga

SEQ ID NO: 3646469 - RNA, 15 nt, Human
auuucagauuuugau

SEQ ID NO: 3646470 - RNA, 20 nt, Human
auuucaggaggaauacugaa

SEQ ID NO: 3646471 - RNA, 23 nt, Human
auuucagguuguuggugacuauc

SEQ ID NO: 3646472 - RNA, 20 nt, Human
auuucagguuuuguaaagau

SEQ ID NO: 3646473 - RNA, 20 nt, Human
auuucaguaaaccugucuga

SEQ ID NO: 3646474 - RNA, 20 nt, Human
auuuucugguagauagaaau

SEQ ID NO: 3646475 - RNA, 19 nt, Human
auuuucugguaggaauagc

SEQ ID NO: 3646476 - RNA, 14 nt, Human
auuuucugguucua

SEQ ID NO: 3646477 - RNA, 16 nt, Human
auuuucugugccugaa

SEQ ID NO: 3646478 - RNA, 14 nt, Human
auuuucuguguguu

SEQ ID NO: 3646479 - RNA, 19 nt, Human
auuuucuguguguuccugg

SEQ ID NO: 3646480 - RNA, 23 nt, Human
auuuucuguguuuugcuguacca

SEQ ID NO: 3646481 - RNA, 20 nt, Human
auuuucuuacccaauuuccc

SEQ ID NO: 3646482 - RNA, 19 nt, Human
auuuucuuauugcgcugcu

SEQ ID NO: 3646483 - RNA, 14 nt, Human
auuuucuucaguug

SEQ ID NO: 3646484 - RNA, 18 nt, Human
auuuucuucaugcaauga

SEQ ID NO: 3646485 - RNA, 21 nt, Human
auuuucuucaugcaaugacau

SEQ ID NO: 3646486 - RNA, 12 nt, Human
auuuucuucuaa

SEQ ID NO: 3646487 - RNA, 13 nt, Human
auuuucuucuaag

SEQ ID NO: 3646488 - RNA, 21 nt, Human
auuuucuugaugacuggaauu

SEQ ID NO: 3646489 - RNA, 23 nt, Human
auuuucuugauguagcagaauau

SEQ ID NO: 3646490 - RNA, 12 nt, Human
auuuucuuuaau

SEQ ID NO: 3646491 - RNA, 16 nt, Human
auuuucuuucuguaac

SEQ ID NO: 3646492 - RNA, 18 nt, Human
auuuucuuuugaauuguu

SEQ ID NO: 3646493 - RNA, 20 nt, Human
auuuucuuuugaauuguuuu

SEQ ID NO: 3646494 - RNA, 20 nt, Human
auuuucuuuuuaauaaaaag

SEQ ID NO: 3646495 - RNA, 19 nt, Human
auuuugaaaaauuccuauu

SEQ ID NO: 3646496 - RNA, 19 nt, Human
auuuugaaaacuacauuuu

SEQ ID NO: 3646497 - RNA, 19 nt, Human
auuuugaaaagcuucuuaa

SEQ ID NO: 3646498 - RNA, 17 nt, Human
auuuugaaaaguaauau

SEQ ID NO: 3646499 - RNA, 21 nt, Human
auuuugaaaaguaauauuuau

SEQ ID NO: 3646500 - RNA, 15 nt, Human
auuuugaaagucugu

SEQ ID NO: 3646501 - RNA, 19 nt, Human
auuuugaaagucuguccuu

SEQ ID NO: 3646502 - RNA, 13 nt, Human
auuuuauucuuga

SEQ ID NO: 3646503 - RNA, 14 nt, Human
auuuuauucuugau

SEQ ID NO: 3646504 - RNA, 18 nt, Human
auuuuauuguaacagaca

SEQ ID NO: 3646505 - RNA, 20 nt, Human
auuuuauuguaacagacauu

SEQ ID NO: 3646506 - RNA, 17 nt, Human
auuuuauuuagacaaga

SEQ ID NO: 3646507 - RNA, 23 nt, Human
auuuuauuuccuggacauccucu

SEQ ID NO: 3646508 - RNA, 22 nt, Human
auuuuauuuguaggggaacuca

SEQ ID NO: 3646509 - RNA, 17 nt, Human
auuuuauuuuuuucuac

SEQ ID NO: 3646510 - RNA, 20 nt, Human
auuuuauuuuuuucucucug

SEQ ID NO: 3646511 - RNA, 21 nt, Human
auuuuauuuuuuucugaauua

SEQ ID NO: 3646512 - RNA, 15 nt, Human
auuuucaaaaccagg

SEQ ID NO: 3646513 - RNA, 13 nt, Human
auuuucaaaagau

SEQ ID NO: 3646514 - RNA, 15 nt, Human
auuuucaaaagauaa

SEQ ID NO: 3646515 - RNA, 24 nt, Human
auuuucaaaagauaauauuuuaca

SEQ ID NO: 3646516 - RNA, 16 nt, Human
auuuucaaagacuuaa

SEQ ID NO: 3646517 - RNA, 22 nt, Human
auuuucaaagcuuuuuccagag

SEQ ID NO: 3646518 - RNA, 17 nt, Human
auuuucaacauuucaaa

SEQ ID NO: 3646519 - RNA, 20 nt, Human
auuuucaacugucuuccuca

SEQ ID NO: 3646520 - RNA, 13 nt, Human
auuuucaagaaac

SEQ ID NO: 3646521 - RNA, 14 nt, Human
auuuucaagaaacu

SEQ ID NO: 3646522 - RNA, 20 nt, Human
auuuucaagacugaauucca

SEQ ID NO: 3646523 - RNA, 22 nt, Human
auuuucaagcaucuccugagga

SEQ ID NO: 3646524 - RNA, 16 nt, Human
auuuucaauagccacu

SEQ ID NO: 3646525 - RNA, 14 nt, Human
auuuucaauucaaa

SEQ ID NO: 3646526 - RNA, 20 nt, Human
auuuucaauucaaaaaugua

SEQ ID NO: 3646527 - RNA, 16 nt, Human
auuuucacaugaacau

SEQ ID NO: 3646528 - RNA, 22 nt, Human
auuuucacauucccaucuguca

SEQ ID NO: 3646529 - RNA, 20 nt, Human
auuuucacauucuuggcuua

SEQ ID NO: 3646530 - RNA, 16 nt, Human
auuuucaccccacccu

SEQ ID NO: 3646531 - RNA, 14 nt, Human
auuuucacuguguc

SEQ ID NO: 3646532 - RNA, 17 nt, Human
auuuucagaaaauauua

SEQ ID NO: 3646533 - RNA, 17 nt, Human
auauuuaaaaaugucuu

SEQ ID NO: 3646534 - RNA, 14 nt, Human
auauuuaaaacuuu

SEQ ID NO: 3646535 - RNA, 15 nt, Human
auauuuaaaagaaag

SEQ ID NO: 3646536 - RNA, 18 nt, Human
auauuuaaacagcagugu

SEQ ID NO: 3646537 - RNA, 21 nt, Human
auauuuaaacaugguuacaau

SEQ ID NO: 3646538 - RNA, 22 nt, Human
auauuuaaaggcccuaucuguu

SEQ ID NO: 3646539 - RNA, 13 nt, Human
auauuuaaagucu

SEQ ID NO: 3646540 - RNA, 21 nt, Human
auauuuaaauguaaagacaaa

SEQ ID NO: 3646541 - RNA, 14 nt, Human
auauuuaagaaaau

SEQ ID NO: 3646542 - RNA, 18 nt, Human
auauuuaagaaaauacaa

SEQ ID NO: 3646543 - RNA, 14 nt, Human
auauuuaaugcauu

SEQ ID NO: 3646544 - RNA, 19 nt, Human
auauuuaaugcauuaaacc

SEQ ID NO: 3646545 - RNA, 22 nt, Human
auauuuaaugcauuaaaccugu

SEQ ID NO: 3646546 - RNA, 22 nt, Human
auauuuaauguugaacaaaaua

SEQ ID NO: 3646547 - RNA, 13 nt, Human
auauuuaauguuu

SEQ ID NO: 3646548 - RNA, 20 nt, Human
auauuuaauguuuuaaaugu

SEQ ID NO: 3646549 - RNA, 15 nt, Human
auauuuaauuauuaa

SEQ ID NO: 3646550 - RNA, 17 nt, Human
auauuuaauuauuaacu

SEQ ID NO: 3646551 - RNA, 18 nt, Human
auauuuacauaugaaauu

SEQ ID NO: 3646552 - RNA, 19 nt, Human
auauuuacauaugaaauuu

SEQ ID NO: 3646553 - RNA, 17 nt, Human
auauuuaccucagccug

SEQ ID NO: 3646554 - RNA, 18 nt, Human
auauuuaccucagccugg

SEQ ID NO: 3646555 - RNA, 20 nt, Human
auauuuacuaaaauggacug

SEQ ID NO: 3646556 - RNA, 23 nt, Human
auauuuacuaagccacaagaaau

SEQ ID NO: 3646557 - RNA, 20 nt, Human
auauuuagauguaauuuugu

SEQ ID NO: 3646558 - RNA, 21 nt, Human
auauuuaguuauaguuucaga

SEQ ID NO: 3646559 - RNA, 21 nt, Human
auauuuauaacucaucauaaa

SEQ ID NO: 3646560 - RNA, 23 nt, Human
auauuuauaacucaucauaaaau

SEQ ID NO: 3646561 - RNA, 15 nt, Human
auauuuauagucaca

SEQ ID NO: 3646562 - RNA, 20 nt, Human
auauuuauauaauuauguua

SEQ ID NO: 3646563 - RNA, 14 nt, Human
auauuuauauuuca

SEQ ID NO: 3646564 - RNA, 15 nt, Human
auauuuauauuucac

SEQ ID NO: 3646565 - RNA, 13 nt, Human
auauuuaugaaga

SEQ ID NO: 3646566 - RNA, 14 nt, Human
auauuuaugaagaa

SEQ ID NO: 3646567 - RNA, 17 nt, Human
auauuuaugaagaaaau

SEQ ID NO: 3646568 - RNA, 16 nt, Human
auauuuauuaccucug

SEQ ID NO: 3646569 - RNA, 14 nt, Human
auauuuauuacugu

SEQ ID NO: 3646570 - RNA, 13 nt, Human
auauuuauugcuu

SEQ ID NO: 3646571 - RNA, 14 nt, Human
auauuuauugcuuu

SEQ ID NO: 3646572 - RNA, 22 nt, Human
auauuuauuguuuauuuaucag

SEQ ID NO: 3646573 - RNA, 23 nt, Human
auauuuauuguuuauuuaucagu

SEQ ID NO: 3646574 - RNA, 13 nt, Human
auauuuauuuuaa

SEQ ID NO: 3646575 - RNA, 22 nt, Human
auauuuauuuucuuuugaauug

SEQ ID NO: 3646576 - RNA, 17 nt, Human
auauuucaaguacacug

SEQ ID NO: 3646577 - RNA, 19 nt, Human
auauuucaaguacacugaa

SEQ ID NO: 3646578 - RNA, 20 nt, Human
auauuucagauguaauguuu

SEQ ID NO: 3646579 - RNA, 11 nt, Human
auauuucauca

SEQ ID NO: 3646580 - RNA, 18 nt, Human
auauuucccaugauuuca

SEQ ID NO: 3646581 - RNA, 21 nt, Human
auauuucccaugauuucaugu

SEQ ID NO: 3646582 - RNA, 21 nt, Human
auauuucccauuugugccaga

SEQ ID NO: 3646583 - RNA, 12 nt, Human
auauuuccuuua

SEQ ID NO: 3646584 - RNA, 16 nt, Human
auauuucuauugaauu

SEQ ID NO: 3646585 - RNA, 13 nt, Human
auauuucuauuuu

SEQ ID NO: 3646586 - RNA, 15 nt, Human
auauuucuauuuuau

SEQ ID NO: 3646587 - RNA, 23 nt, Human
auauuucuauuuuauuaugaaga

SEQ ID NO: 3646588 - RNA, 20 nt, Human
auauuucugcuuucuuugau

SEQ ID NO: 3646589 - RNA, 15 nt, Human
auauuugaaaaaaac

SEQ ID NO: 3646590 - RNA, 13 nt, Human
auauuugaaauau

SEQ ID NO: 3646591 - RNA, 14 nt, Human
auauuugaaggguc

SEQ ID NO: 3646592 - RNA, 19 nt, Human
auauuugaaucuugucuca

SEQ ID NO: 3646593 - RNA, 20 nt, Human
auauuugaauuuuaaaucua

SEQ ID NO: 3646594 - RNA, 16 nt, Human
auauuugacuugcaug

SEQ ID NO: 3646595 - RNA, 20 nt, Human
auauuugacuugcaugaaga

SEQ ID NO: 3646596 - RNA, 12 nt, Human
auauuugauuua

SEQ ID NO: 3646597 - RNA, 18 nt, Human
auauuugauuuauuaacu

SEQ ID NO: 3646598 - RNA, 23 nt, Human
auauuugauuuauuaacuuaaua

SEQ ID NO: 3646599 - RNA, 12 nt, Human
auauuugcacua

SEQ ID NO: 3646600 - RNA, 19 nt, Human
auauuugcaguuuuucauu

SEQ ID NO: 3646601 - RNA, 23 nt, Human
auauuugcaguuuuucauuuuaa

SEQ ID NO: 3646602 - RNA, 17 nt, Human
auauuuggaugcagagu

SEQ ID NO: 3646603 - RNA, 15 nt, Human
auauuuggcuuaaau

SEQ ID NO: 3646604 - RNA, 21 nt, Human
auauuuggcuuaaauauaguu

SEQ ID NO: 3646605 - RNA, 13 nt, Human
auauuuguaaaau

SEQ ID NO: 3646606 - RNA, 16 nt, Human
auauuuguaaagcuau

SEQ ID NO: 3646607 - RNA, 15 nt, Human
auauuuguaaggcuu

SEQ ID NO: 3646608 - RNA, 21 nt, Human
auauuuguaaggcuuguucca

SEQ ID NO: 3646609 - RNA, 12 nt, Human
auauuuguacau

SEQ ID NO: 3646610 - RNA, 21 nt, Human
auauuuguacuuucuguuaaa

SEQ ID NO: 3646611 - RNA, 18 nt, Human
auauuuguauuuauucuu

SEQ ID NO: 3646612 - RNA, 23 nt, Human
auauuugucaauuuaugaauaua

SEQ ID NO: 3646613 - RNA, 20 nt, Human
auauuugugauagcacuuuc

SEQ ID NO: 3646614 - RNA, 21 nt, Human
auauuugugauagcacuuucu

SEQ ID NO: 3646615 - RNA, 14 nt, Human
auauuugugcauuu

SEQ ID NO: 3646616 - RNA, 22 nt, Human
auauuugugcuauaguauuuga

SEQ ID NO: 3646617 - RNA, 11 nt, Human
auauuugugua

SEQ ID NO: 3646618 - RNA, 16 nt, Human
auauuugugugcuaaa

SEQ ID NO: 3646619 - RNA, 13 nt, Human
auauuuguuaaau

SEQ ID NO: 3646620 - RNA, 22 nt, Human
auauuuguuaaauauuuacaua

SEQ ID NO: 3646621 - RNA, 15 nt, Human
auauuuguuauguag

SEQ ID NO: 3646622 - RNA, 17 nt, Human
auauuuuaaaauaaacu

SEQ ID NO: 3646623 - RNA, 18 nt, Human
auauuuuaaaauuuguuc

SEQ ID NO: 3646624 - RNA, 15 nt, Human
auauuuuaaagaauu

SEQ ID NO: 3646625 - RNA, 17 nt, Human
auauuuuaacuccacug

SEQ ID NO: 3646626 - RNA, 14 nt, Human
auauuuuaauuuca

SEQ ID NO: 3646627 - RNA, 17 nt, Human
auauuuuaauuucaagc

SEQ ID NO: 3646628 - RNA, 13 nt, Human
auauuuuaauuuu

SEQ ID NO: 3646629 - RNA, 15 nt, Human
auauuuuaauuuuua

SEQ ID NO: 3646630 - RNA, 14 nt, Human
auauuuuacauaca

SEQ ID NO: 3646631 - RNA, 15 nt, Human
auauuuuauauaaag

SEQ ID NO: 3646632 - RNA, 14 nt, Human
auauuuuauauuac

SEQ ID NO: 3646633 - RNA, 12 nt, Human
auauuuuaugau

SEQ ID NO: 3646634 - RNA, 19 nt, Human
auauuuuaugguuauguuu

SEQ ID NO: 3646635 - RNA, 16 nt, Human
auauuuuauuacuguu

SEQ ID NO: 3646636 - RNA, 12 nt, Human
auauuuuauuca

SEQ ID NO: 3646637 - RNA, 16 nt, Human
auauuuuauucaaggu

SEQ ID NO: 3646638 - RNA, 17 nt, Human
auauuuuauuucaaugu

SEQ ID NO: 3646639 - RNA, 19 nt, Human
auauuuuauuucaauguaa

SEQ ID NO: 3646640 - RNA, 20 nt, Human
auauuuuauuucaauguaau

SEQ ID NO: 3646641 - RNA, 20 nt, Human
auauuuuauuuuuagaauuu

SEQ ID NO: 3646642 - RNA, 19 nt, Human
auauuuucaaaguacauaa

SEQ ID NO: 3646643 - RNA, 21 nt, Human
auauuuucaauucaaaaaugu

SEQ ID NO: 3646644 - RNA, 23 nt, Human
auauuuucaauucaaaaauguac

SEQ ID NO: 3646645 - RNA, 14 nt, Human
auauuuucaguaau

SEQ ID NO: 3646646 - RNA, 23 nt, Human
auauuuucaugacuuuuccaugu

SEQ ID NO: 3646647 - RNA, 22 nt, Human
aucaugaaacuuguuucacuga

SEQ ID NO: 3646648 - RNA, 18 nt, Human
aucaugaagauauuuuuc

SEQ ID NO: 3646649 - RNA, 12 nt, Human
aucaugaagccu

SEQ ID NO: 3646650 - RNA, 19 nt, Human
aucaugaauuuuaaaguau

SEQ ID NO: 3646651 - RNA, 17 nt, Human
aucaugaccagcaaaua

SEQ ID NO: 3646652 - RNA, 21 nt, Human
aucaugagccugcuggaagcc

SEQ ID NO: 3646653 - RNA, 23 nt, Human
aucaugagugaauaaaugucuug

SEQ ID NO: 3646654 - RNA, 12 nt, Human
aucaugcaaaau

SEQ ID NO: 3646655 - RNA, 19 nt, Human
aucaugcaaaugcuguauu

SEQ ID NO: 3646656 - RNA, 22 nt, Human
aucaugcagcucaacuuucugu

SEQ ID NO: 3646657 - RNA, 15 nt, Human
aucaugcauagagug

SEQ ID NO: 3646658 - RNA, 15 nt, Human
aucaugccucugagg

SEQ ID NO: 3646659 - RNA, 20 nt, Human
aucaugcuuuaaaguguaau

SEQ ID NO: 3646660 - RNA, 19 nt, Human
aucauggaaauauuaugca

SEQ ID NO: 3646661 - RNA, 20 nt, Human
aucauggaaugguuauaaaa

SEQ ID NO: 3646662 - RNA, 19 nt, Human
aucauggagguuugaagau

SEQ ID NO: 3646663 - RNA, 12 nt, Human
aucauggccagc

SEQ ID NO: 3646664 - RNA, 13 nt, Human
aucauggccagcu

SEQ ID NO: 3646665 - RNA, 22 nt, Human
aucaugguagagaaucucuccc

SEQ ID NO: 3646666 - RNA, 23 nt, Human
aucaugguguaauaagacauaac

SEQ ID NO: 3646667 - RNA, 18 nt, Human
aucauguaaagaaauguc

SEQ ID NO: 3646668 - RNA, 15 nt, Human
aucauguacauuucu

SEQ ID NO: 3646669 - RNA, 17 nt, Human
aucauguaguaucaaau

SEQ ID NO: 3646670 - RNA, 21 nt, Human
aucauguaguaucaaauauua

SEQ ID NO: 3646671 - RNA, 19 nt, Human
aucaugucaggccugugug

SEQ ID NO: 3646672 - RNA, 16 nt, Human
aucauguccauacacu

SEQ ID NO: 3646673 - RNA, 14 nt, Human
aucauguccccaaa

SEQ ID NO: 3646674 - RNA, 20 nt, Human
aucauguccccaaaccugca

SEQ ID NO: 3646675 - RNA, 14 nt, Human
aucaugucuggcua

SEQ ID NO: 3646676 - RNA, 12 nt, Human
aucaugugaaau

SEQ ID NO: 3646677 - RNA, 14 nt, Human
aucaugugaaauca

SEQ ID NO: 3646678 - RNA, 15 nt, Human
aucaugugaaaucau

SEQ ID NO: 3646679 - RNA, 16 nt, Human
aucaugugaaaucauu

SEQ ID NO: 3646680 - RNA, 19 nt, Human
aucauguguaaucaauaaa

SEQ ID NO: 3646681 - RNA, 21 nt, Human
aucauguuaguaauaccucua

SEQ ID NO: 3646682 - RNA, 22 nt, Human
aucauguuaguaauaccucuaa

SEQ ID NO: 3646683 - RNA, 16 nt, Human
aucauguugaucaugu

SEQ ID NO: 3646684 - RNA, 14 nt, Human
aucauguuucuuug

SEQ ID NO: 3646685 - RNA, 15 nt, Human
aucauguuucuuuga

SEQ ID NO: 3646686 - RNA, 23 nt, Human
aucauguuucuuugaucaugaau

SEQ ID NO: 3646687 - RNA, 12 nt, Human
aucauguuugcu

SEQ ID NO: 3646688 - RNA, 13 nt, Human
aucauguuugcuc

SEQ ID NO: 3646689 - RNA, 14 nt, Human
aucauguuuuggug

SEQ ID NO: 3646690 - RNA, 17 nt, Human
aucauguuuuggugaaa

SEQ ID NO: 3646691 - RNA, 19 nt, Human
aucauguuuuggugaaaau

SEQ ID NO: 3646692 - RNA, 11 nt, Human
aucauuaaagu

SEQ ID NO: 3646693 - RNA, 14 nt, Human
aucauuaaaguucu

SEQ ID NO: 3646694 - RNA, 15 nt, Human
aucauuaagacaacu

SEQ ID NO: 3646695 - RNA, 13 nt, Human
aucauuacuauaa

SEQ ID NO: 3646696 - RNA, 15 nt, Human
aucauuauuuaugua

SEQ ID NO: 3646697 - RNA, 19 nt, Human
aucauucacuucacugugc

SEQ ID NO: 3646698 - RNA, 12 nt, Human
aucauucagcaa

SEQ ID NO: 3646699 - RNA, 15 nt, Human
aucauucauuuuugu

SEQ ID NO: 3646700 - RNA, 15 nt, Human
aucauucccucucau

SEQ ID NO: 3646701 - RNA, 22 nt, Human
aucauucccuucgacagcauuu

SEQ ID NO: 3646702 - RNA, 20 nt, Human
aucauuccuuuuuauuuaua

SEQ ID NO: 3646703 - RNA, 21 nt, Human
aucauucucugucucauccau

SEQ ID NO: 3646704 - RNA, 20 nt, Human
aucauucuuauuucaugaaa

SEQ ID NO: 3646705 - RNA, 23 nt, Human
aucauucuuauuucaugaaaauu

SEQ ID NO: 3646706 - RNA, 13 nt, Human
aucauugaaaucu

SEQ ID NO: 3646707 - RNA, 19 nt, Human
aucauugaaaucuuuuugc

SEQ ID NO: 3646708 - RNA, 21 nt, Human
aucauugcugucugcagccuu

SEQ ID NO: 3646709 - RNA, 11 nt, Human
aucauugcuua

SEQ ID NO: 3646710 - RNA, 13 nt, Human
aucauuguacagu

SEQ ID NO: 3646711 - RNA, 15 nt, Human
aucauuguacaguuu

SEQ ID NO: 3646712 - RNA, 18 nt, Human
aucauuguauauaugugu

SEQ ID NO: 3646713 - RNA, 14 nt, Human
aucauuguccagag

SEQ ID NO: 3646714 - RNA, 15 nt, Human
aucauugugaaauua

SEQ ID NO: 3646715 - RNA, 20 nt, Human
aucauuguuuggcauugaaa

SEQ ID NO: 3646716 - RNA, 15 nt, Human
aucauuguuuugaau

SEQ ID NO: 3646717 - RNA, 14 nt, Human
aucauuuacaagac

SEQ ID NO: 3646718 - RNA, 15 nt, Human
aucauuuauuggaug

SEQ ID NO: 3646719 - RNA, 21 nt, Human
aucauuuauuuuaagcacucu

SEQ ID NO: 3646720 - RNA, 19 nt, Human
aucauuuauuuuuuacauu

SEQ ID NO: 3646721 - RNA, 21 nt, Human
aucauuucuauuaaaugagca

SEQ ID NO: 3646722 - RNA, 14 nt, Human
aucauuugaggaau

SEQ ID NO: 3646723 - RNA, 18 nt, Human
aucauuugcccuuaagga

SEQ ID NO: 3646724 - RNA, 14 nt, Human
aucauuuguuuaaa

SEQ ID NO: 3646725 - RNA, 15 nt, Human
aucauuuguuuaaaa

SEQ ID NO: 3646726 - RNA, 14 nt, Human
aucauuuuaauuau

SEQ ID NO: 3646727 - RNA, 15 nt, Human
aucauuuuaggaaag

SEQ ID NO: 3646728 - RNA, 18 nt, Human
aucauuuuauaugucaaa

SEQ ID NO: 3646729 - RNA, 13 nt, Human
aucauuuugcauu

SEQ ID NO: 3646730 - RNA, 19 nt, Human
aucauuuugcauucaaauu

SEQ ID NO: 3646731 - RNA, 19 nt, Human
aucauuuugccucuuuucu

SEQ ID NO: 3646732 - RNA, 14 nt, Human
aucauuuuuuacuu

SEQ ID NO: 3646733 - RNA, 17 nt, Human
aucauuuuuuauauaua

SEQ ID NO: 3646734 - RNA, 23 nt, Human
aucauuuuuuccuguuugggaag

SEQ ID NO: 3646735 - RNA, 20 nt, Human
caaccucggcuccuggacuc

SEQ ID NO: 3646736 - RNA, 14 nt, Human
caaccucucacucc

SEQ ID NO: 3646737 - RNA, 17 nt, Human
caaccucucacucccca

SEQ ID NO: 3646738 - RNA, 16 nt, Human
caaccucugcuuccca

SEQ ID NO: 3646739 - RNA, 17 nt, Human
caaccucugcuucccag

SEQ ID NO: 3646740 - RNA, 14 nt, Human
caaccucuuccucc

SEQ ID NO: 3646741 - RNA, 15 nt, Human
caaccucuuggccug

SEQ ID NO: 3646742 - RNA, 12 nt, Human
caaccugaaccu

SEQ ID NO: 3646743 - RNA, 21 nt, Human
caaccugaauacccuuuucug

SEQ ID NO: 3646744 - RNA, 16 nt, Human
caaccugauugugucu

SEQ ID NO: 3646745 - RNA, 16 nt, Human
caaccugcucuccucu

SEQ ID NO: 3646746 - RNA, 23 nt, Human
caaccugcucuccucuugccacu

SEQ ID NO: 3646747 - RNA, 13 nt, Human
caaccugggucca

SEQ ID NO: 3646748 - RNA, 17 nt, Human
caaccuggguccaaaua

SEQ ID NO: 3646749 - RNA, 20 nt, Human
caaccuggguccaaauaaaa

SEQ ID NO: 3646750 - RNA, 16 nt, Human
caaccuggucacagga

SEQ ID NO: 3646751 - RNA, 13 nt, Human
caaccuguaaauu

SEQ ID NO: 3646752 - RNA, 22 nt, Human
caaccuguaauaaauaugagug

SEQ ID NO: 3646753 - RNA, 18 nt, Human
caaccugugaucaagcaa

SEQ ID NO: 3646754 - RNA, 18 nt, Human
caaccuuagauguucuaa

SEQ ID NO: 3646755 - RNA, 14 nt, Human
caaccuucaagcug

SEQ ID NO: 3646756 - RNA, 20 nt, Human
caaccuucuguggcucacag

SEQ ID NO: 3646757 - RNA, 17 nt, Human
caaccuuucaccuuugu

SEQ ID NO: 3646758 - RNA, 14 nt, Human
caacgaagaaaaaa

SEQ ID NO: 3646759 - RNA, 15 nt, Human
caacgaggaagcccu

SEQ ID NO: 3646760 - RNA, 18 nt, Human
caacgaucacaaaugacu

SEQ ID NO: 3646761 - RNA, 20 nt, Human
caacgaucacaaaugacuuu

SEQ ID NO: 3646762 - RNA, 14 nt, Human
caacgccgugggcu

SEQ ID NO: 3646763 - RNA, 14 nt, Human
caacgucugugcca

SEQ ID NO: 3646764 - RNA, 13 nt, Human
caacgugcauugu

SEQ ID NO: 3646765 - RNA, 16 nt, Human
caacgugcauugugcu

SEQ ID NO: 3646766 - RNA, 14 nt, Human
caacguggcccaga

SEQ ID NO: 3646767 - RNA, 23 nt, Human
caacguuguacuguaugugauga

SEQ ID NO: 3646768 - RNA, 22 nt, Human
caacguuuggaagauccuguga

SEQ ID NO: 3646769 - RNA, 17 nt, Human
caacuaaaauuugaagu

SEQ ID NO: 3646770 - RNA, 19 nt, Human
caacuaaaauuugaaguag

SEQ ID NO: 3646771 - RNA, 13 nt, Human
caacuaacaagaa

SEQ ID NO: 3646772 - RNA, 15 nt, Human
caacuaauuuuugua

SEQ ID NO: 3646773 - RNA, 18 nt, Human
caacuaauuuuuguauuu

SEQ ID NO: 3646774 - RNA, 18 nt, Human
caacuacacaaagcaggc

SEQ ID NO: 3646775 - RNA, 19 nt, Human
caacuacagucuaaagcug

SEQ ID NO: 3646776 - RNA, 20 nt, Human
caacuacccaaaacaagccu

SEQ ID NO: 3646777 - RNA, 19 nt, Human
caacuacccccagcugugc

SEQ ID NO: 3646778 - RNA, 15 nt, Human
caacuaccugagcua

SEQ ID NO: 3646779 - RNA, 15 nt, Human
caacuagacauuacc

SEQ ID NO: 3646780 - RNA, 17 nt, Human
caacuagacauucuguc

SEQ ID NO: 3646781 - RNA, 21 nt, Human
caacuagacauucugucgccu

SEQ ID NO: 3646782 - RNA, 17 nt, Human
caacuaggcuucagcau

SEQ ID NO: 3646783 - RNA, 18 nt, Human
caacuauauuaucaugca

SEQ ID NO: 3646784 - RNA, 21 nt, Human
caacuaucucauuuccaagca

SEQ ID NO: 3646785 - RNA, 16 nt, Human
caacuaugauuuggaa

SEQ ID NO: 3646786 - RNA, 18 nt, Human
caacuaugauuuggaaaa

SEQ ID NO: 3646787 - RNA, 19 nt, Human
caacuaugauuuggaaaau

SEQ ID NO: 3646788 - RNA, 22 nt, Human
caacuaugauuuggaaaauaaa

SEQ ID NO: 3646789 - RNA, 12 nt, Human
caacuauuuuau

SEQ ID NO: 3646790 - RNA, 21 nt, Human
caacuauuuuauuauccuaga

SEQ ID NO: 3646791 - RNA, 14 nt, Human
caacuauuuucaga

SEQ ID NO: 3646792 - RNA, 17 nt, Human
caacuauuuucagaugu

SEQ ID NO: 3646793 - RNA, 16 nt, Human
caaagagaaaaagaaa

SEQ ID NO: 3646794 - RNA, 17 nt, Human
caaagagaaaaagaaau

SEQ ID NO: 3646795 - RNA, 19 nt, Human
caaagagaaaaagaaaugc

SEQ ID NO: 3646796 - RNA, 16 nt, Human
caaagagacuggagca

SEQ ID NO: 3646797 - RNA, 17 nt, Human
caaagagacuggagcau

SEQ ID NO: 3646798 - RNA, 19 nt, Human
caaagagagaaaauaaaga

SEQ ID NO: 3646799 - RNA, 21 nt, Human
caaagagagauuuuuuuuuaa

SEQ ID NO: 3646800 - RNA, 21 nt, Human
caaagagaguuuuuaauagaa

SEQ ID NO: 3646801 - RNA, 14 nt, Human
caaagagcugccua

SEQ ID NO: 3646802 - RNA, 20 nt, Human
caaagaggacucgcuuguaa

SEQ ID NO: 3646803 - RNA, 21 nt, Human
caaagaggacucgcuuguaaa

SEQ ID NO: 3646804 - RNA, 23 nt, Human
caaagaggacucgcuuguaaaua

SEQ ID NO: 3646805 - RNA, 20 nt, Human
caaagaggcugaggcuggca

SEQ ID NO: 3646806 - RNA, 13 nt, Human
caaagaggcugcc

SEQ ID NO: 3646807 - RNA, 15 nt, Human
caaagagggcuuccu

SEQ ID NO: 3646808 - RNA, 21 nt, Human
caaagagguuuuaaaaaaauc

SEQ ID NO: 3646809 - RNA, 17 nt, Human
caaagaguagacauuuc

SEQ ID NO: 3646810 - RNA, 17 nt, Human
caaagauagacaggucc

SEQ ID NO: 3646811 - RNA, 14 nt, Human
caaagauauuuugc

SEQ ID NO: 3646812 - RNA, 16 nt, Human
caaagauauuuugcuu

SEQ ID NO: 3646813 - RNA, 18 nt, Human
caaagauauuuugcuuug

SEQ ID NO: 3646814 - RNA, 14 nt, Human
caaagaucaaaaua

SEQ ID NO: 3646815 - RNA, 15 nt, Human
caaagaucaaaauaa

SEQ ID NO: 3646816 - RNA, 16 nt, Human
caaagaucaaaauaaa

SEQ ID NO: 3646817 - RNA, 17 nt, Human
caaagaucaaaauaaaa

SEQ ID NO: 3646818 - RNA, 20 nt, Human
caaagaucaaaauaaaaagu

SEQ ID NO: 3646819 - RNA, 14 nt, Human
caaagaugcagccg

SEQ ID NO: 3646820 - RNA, 23 nt, Human
caaagaugcagccgccuuccuug

SEQ ID NO: 3646821 - RNA, 19 nt, Human
caaagauggcucagagggg

SEQ ID NO: 3646822 - RNA, 18 nt, Human
caaagauguuugucagau

SEQ ID NO: 3646823 - RNA, 21 nt, Human
caaagauucaaaauugacauu

SEQ ID NO: 3646824 - RNA, 17 nt, Human
caaagcaaaccaacaag

SEQ ID NO: 3646825 - RNA, 13 nt, Human
caaagcacagugu

SEQ ID NO: 3646826 - RNA, 15 nt, Human
caaagcacaguguua

SEQ ID NO: 3646827 - RNA, 16 nt, Human
caaagcacaguuugaa

SEQ ID NO: 3646828 - RNA, 17 nt, Human
caaagcacauugaaaga

SEQ ID NO: 3646829 - RNA, 22 nt, Human
caaagcaccaaaauaagaaaag

SEQ ID NO: 3646830 - RNA, 20 nt, Human
caaagcacgaaauguuauuu

SEQ ID NO: 3646831 - RNA, 22 nt, Human
caaagcacugacuucuaaguaa

SEQ ID NO: 3646832 - RNA, 22 nt, Human
caaagcacuuggacucuugcuc

SEQ ID NO: 3646833 - RNA, 23 nt, Human
caaagcacuuggacucuugcucu

SEQ ID NO: 3646834 - RNA, 19 nt, Human
caaagcagacagcuccacc

SEQ ID NO: 3646835 - RNA, 12 nt, Human
caaagcagccac

SEQ ID NO: 3646836 - RNA, 22 nt, Human
caaagcagugcaugcugucccu

SEQ ID NO: 3646837 - RNA, 14 nt, Human
caaagcaguugaau

SEQ ID NO: 3646838 - RNA, 19 nt, Human
caaagcauagauguuuugg

SEQ ID NO: 3646839 - RNA, 16 nt, Human
caaagcaugaaaugga

SEQ ID NO: 3646840 - RNA, 24 nt, Human
caaagcauggacauuuagaagaaa

SEQ ID NO: 3646841 - RNA, 17 nt, Human
caaagcauguuuugcau

SEQ ID NO: 3646842 - RNA, 20 nt, Human
caaagcauuugacuuucugu

SEQ ID NO: 3646843 - RNA, 17 nt, Human
caaagccaaacucugcc

SEQ ID NO: 3646844 - RNA, 18 nt, Human
caaagccaaacucugcca

SEQ ID NO: 3646845 - RNA, 14 nt, Human
caaagccagguccc

SEQ ID NO: 3646846 - RNA, 19 nt, Human
caaagcccaaagugguaua

SEQ ID NO: 3646847 - RNA, 19 nt, Human
caaagccccaugcuggagc

SEQ ID NO: 3646848 - RNA, 14 nt, Human
caaagcccccagag

SEQ ID NO: 3646849 - RNA, 15 nt, Human
caaagcccccagagc

SEQ ID NO: 3646850 - RNA, 14 nt, Human
caaagcgaauuuua

SEQ ID NO: 3646851 - RNA, 20 nt, Human
caaagcgaauuuuaaaagau

SEQ ID NO: 3646852 - RNA, 17 nt, Human
caaagcggggggagggu

SEQ ID NO: 3646853 - RNA, 13 nt, Human
caaagcuaggccu

SEQ ID NO: 3646854 - RNA, 15 nt, Human
caaagcuaggccugg

SEQ ID NO: 3646855 - RNA, 21 nt, Human
caaagcuaggguggcccuugc

SEQ ID NO: 3646856 - RNA, 22 nt, Human
caaagcuaggguggcccuugca

SEQ ID NO: 3646857 - RNA, 20 nt, Human
caaagcucaaauaaaaauaa

SEQ ID NO: 3646858 - RNA, 22 nt, Human
caaagcugacgaggcugggcca

SEQ ID NO: 3646859 - RNA, 14 nt, Human
caaagcugagccug

SEQ ID NO: 3646860 - RNA, 17 nt, Human
caaagcugagccugcag

SEQ ID NO: 3646861 - RNA, 24 nt, Human
caaagcugagccugcagggaagcc

SEQ ID NO: 3646862 - RNA, 11 nt, Human
caaagcugccu

SEQ ID NO: 3646863 - RNA, 12 nt, Human
caaagcugccug

SEQ ID NO: 3646864 - RNA, 12 nt, Human
caaagcuguuaa

SEQ ID NO: 3646865 - RNA, 13 nt, Human
caaagcuguuaaa

SEQ ID NO: 3646866 - RNA, 17 nt, Human
caaagcuguuaaacugu

SEQ ID NO: 3646867 - RNA, 18 nt, Human
caaagcuguuaaacuguu

SEQ ID NO: 3646868 - RNA, 16 nt, Human
caaagcuguucuuccu

SEQ ID NO: 3646869 - RNA, 16 nt, Human
caaagcuuagcaggag

SEQ ID NO: 3646870 - RNA, 18 nt, Human
caaagcuucuaucccagg

SEQ ID NO: 3646871 - RNA, 19 nt, Human
caaagcuucuaucccagga

SEQ ID NO: 3646872 - RNA, 19 nt, Human
caaagcuugaagaucguua

SEQ ID NO: 3646873 - RNA, 20 nt, Human
caaagcuuggauuaaauaca

SEQ ID NO: 3646874 - RNA, 16 nt, Human
caaagcuuguuaagau

SEQ ID NO: 3646875 - RNA, 13 nt, Human
caaagcuuuccug

SEQ ID NO: 3646876 - RNA, 16 nt, Human
caaagcuuuccuggag

SEQ ID NO: 3646877 - RNA, 17 nt, Human
caaagcuuuccuggaga

SEQ ID NO: 3646878 - RNA, 16 nt, Human
caaagcuuuuagaaau

SEQ ID NO: 3646879 - RNA, 22 nt, Human
caaaggaaaaagcacaagaagc

SEQ ID NO: 3646880 - RNA, 19 nt, Human
caaaggaacauugugucua

SEQ ID NO: 3646881 - RNA, 19 nt, Human
caaaggaagucuaaauauu

SEQ ID NO: 3646882 - RNA, 19 nt, Human
caaaggaagugcccccucc

SEQ ID NO: 3646883 - RNA, 17 nt, Human
caaaggacauuaugugu

SEQ ID NO: 3646884 - RNA, 18 nt, Human
caaaggacauuaugugug

SEQ ID NO: 3646885 - RNA, 16 nt, Human
caaaggacgcacugag

SEQ ID NO: 3646886 - RNA, 15 nt, Human
caaaggacuccaccc

SEQ ID NO: 3646887 - RNA, 23 nt, Human
caaaggacuguuuuuuccugagc

SEQ ID NO: 3646888 - RNA, 18 nt, Human
caaaggagcgagcauguc

SEQ ID NO: 3646889 - RNA, 13 nt, Human
caaaggaugugau

SEQ ID NO: 3646890 - RNA, 21 nt, Human
caaaggcauuauaaaaagaau

SEQ ID NO: 3646891 - RNA, 15 nt, Human
caaaggccaaacugc

SEQ ID NO: 3646892 - RNA, 19 nt, Human
caaaggccaaacugcugga

SEQ ID NO: 3646893 - RNA, 15 nt, Human
caaaggccaggguca

SEQ ID NO: 3646894 - RNA, 20 nt, Human
caaaggccauggagagcugg

SEQ ID NO: 3646895 - RNA, 23 nt, Human
caaaggccauggagagcuggagc

SEQ ID NO: 3646896 - RNA, 21 nt, Human
caaaggcuuugcccugcugcc

SEQ ID NO: 3646897 - RNA, 23 nt, Human
caaaggcuuugcccugcugcccu

SEQ ID NO: 3646898 - RNA, 17 nt, Human
caaagggagucugccag

SEQ ID NO: 3646899 - RNA, 17 nt, Human
caaagggcugaaagcca

SEQ ID NO: 3646900 - RNA, 21 nt, Human
caaaggggaaagaacauaaag

SEQ ID NO: 3646901 - RNA, 13 nt, Human
caaaggggacagc

SEQ ID NO: 3646902 - RNA, 18 nt, Human
caaaggggacagcugugu

SEQ ID NO: 3646903 - RNA, 13 nt, Human
aucccaugagccu

SEQ ID NO: 3646904 - RNA, 17 nt, Human
aucccaugagccucagc

SEQ ID NO: 3646905 - RNA, 15 nt, Human
aucccauguauuuau

SEQ ID NO: 3646906 - RNA, 21 nt, Human
aucccauuaaucauuucccca

SEQ ID NO: 3646907 - RNA, 15 nt, Human
aucccauuauucaaa

SEQ ID NO: 3646908 - RNA, 12 nt, Human
aucccauuccag

SEQ ID NO: 3646909 - RNA, 14 nt, Human
aucccauugcccug

SEQ ID NO: 3646910 - RNA, 14 nt, Human
aucccauuuaaaaa

SEQ ID NO: 3646911 - RNA, 20 nt, Human
auccccaaaacaaagucuuu

SEQ ID NO: 3646912 - RNA, 18 nt, Human
auccccaagccuggcaag

SEQ ID NO: 3646913 - RNA, 17 nt, Human
auccccaaggcacuuga

SEQ ID NO: 3646914 - RNA, 12 nt, Human
auccccaauaau

SEQ ID NO: 3646915 - RNA, 19 nt, Human
auccccaauaauugcagaa

SEQ ID NO: 3646916 - RNA, 22 nt, Human
auccccaauaauugcagaacua

SEQ ID NO: 3646917 - RNA, 17 nt, Human
auccccacgccacagcc

SEQ ID NO: 3646918 - RNA, 20 nt, Human
auccccacgccacagcccuu

SEQ ID NO: 3646919 - RNA, 21 nt, Human
auccccacgccacagcccuuu

SEQ ID NO: 3646920 - RNA, 19 nt, Human
auccccacugggaccaacc

SEQ ID NO: 3646921 - RNA, 20 nt, Human
auccccagacuucauagaau

SEQ ID NO: 3646922 - RNA, 22 nt, Human
auccccagggggcaugaccaga

SEQ ID NO: 3646923 - RNA, 19 nt, Human
auccccaggggucccagcc

SEQ ID NO: 3646924 - RNA, 21 nt, Human
auccccaguaaaauugccaua

SEQ ID NO: 3646925 - RNA, 14 nt, Human
auccccagucccaa

SEQ ID NO: 3646926 - RNA, 22 nt, Human
auccccaguucgccuggagccc

SEQ ID NO: 3646927 - RNA, 20 nt, Human
auccccauccuccagcuucu

SEQ ID NO: 3646928 - RNA, 15 nt, Human
auccccaucucccug

SEQ ID NO: 3646929 - RNA, 19 nt, Human
auccccaucucccugccug

SEQ ID NO: 3646930 - RNA, 18 nt, Human
auccccaugccuguggcu

SEQ ID NO: 3646931 - RNA, 14 nt, Human
auccccccucacca

SEQ ID NO: 3646932 - RNA, 22 nt, Human
auccccgcagugugcacuaagg

SEQ ID NO: 3646933 - RNA, 17 nt, Human
auccccgccuggccagg

SEQ ID NO: 3646934 - RNA, 21 nt, Human
auccccgccuggccaggagca

SEQ ID NO: 3646935 - RNA, 13 nt, Human
auccccgcuggcu

SEQ ID NO: 3646936 - RNA, 16 nt, Human
auccccgcuggcuggg

SEQ ID NO: 3646937 - RNA, 20 nt, Human
aucucuuaucuuacgaaaaa

SEQ ID NO: 3646938 - RNA, 19 nt, Human
aucucuuauuuuacaauaa

SEQ ID NO: 3646939 - RNA, 13 nt, Human
aucucuucagucu

SEQ ID NO: 3646940 - RNA, 13 nt, Human
aucucuucauuau

SEQ ID NO: 3646941 - RNA, 20 nt, Human
aucucuucauuauucucugc

SEQ ID NO: 3646942 - RNA, 12 nt, Human
aucucuuccugu

SEQ ID NO: 3646943 - RNA, 11 nt, Human
aucucuuccuu

SEQ ID NO: 3646944 - RNA, 13 nt, Human
aucucuucugugu

SEQ ID NO: 3646945 - RNA, 18 nt, Human
aucucuucuuaauguaca

SEQ ID NO: 3646946 - RNA, 20 nt, Human
aucucuucuuaauguacaua

SEQ ID NO: 3646947 - RNA, 15 nt, Human
aucucuucuuauaca

SEQ ID NO: 3646948 - RNA, 17 nt, Human
aucucuucuuauacaga

SEQ ID NO: 3646949 - RNA, 18 nt, Human
aucucuugagccugggag

SEQ ID NO: 3646950 - RNA, 16 nt, Human
aucucuuguuuaaauu

SEQ ID NO: 3646951 - RNA, 20 nt, Human
aucucuuuguacaggaacug

SEQ ID NO: 3646952 - RNA, 20 nt, Human
aucucuuuuauauuuguagg

SEQ ID NO: 3646953 - RNA, 23 nt, Human
aucucuuuuccacuccauugucg

SEQ ID NO: 3646954 - RNA, 16 nt, Human
aucugaaaauguaugu

SEQ ID NO: 3646955 - RNA, 14 nt, Human
aucugaaaauguga

SEQ ID NO: 3646956 - RNA, 13 nt, Human
aucugaaauguga

SEQ ID NO: 3646957 - RNA, 13 nt, Human
aucugaaauguua

SEQ ID NO: 3646958 - RNA, 16 nt, Human
aucugaaauguuacaa

SEQ ID NO: 3646959 - RNA, 19 nt, Human
caauaaaaaaaagaaauga

SEQ ID NO: 3646960 - RNA, 22 nt, Human
caauaaaaauggcucagaugcc

SEQ ID NO: 3646961 - RNA, 17 nt, Human
caauaaaaauguuuaac

SEQ ID NO: 3646962 - RNA, 22 nt, Human
caauaaaagcaauuccaaccuu

SEQ ID NO: 3646963 - RNA, 14 nt, Human
caauaaaagcccag

SEQ ID NO: 3646964 - RNA, 16 nt, Human
caauaaaagcccagga

SEQ ID NO: 3646965 - RNA, 14 nt, Human
caauaaaauauuau

SEQ ID NO: 3646966 - RNA, 13 nt, Human
caauaaaaucaug

SEQ ID NO: 3646967 - RNA, 14 nt, Human
caauaaaaucaugu

SEQ ID NO: 3646968 - RNA, 20 nt, Human
caauaaaauccauacauuug

SEQ ID NO: 3646969 - RNA, 20 nt, Human
caauaaaaucuugaaaaugc

SEQ ID NO: 3646970 - RNA, 16 nt, Human
caauaaaaugugauuu

SEQ ID NO: 3646971 - RNA, 20 nt, Human
caauaaaauuauagcucuaa

SEQ ID NO: 3646972 - RNA, 23 nt, Human
caauaaaauuauagcucuaaugu

SEQ ID NO: 3646973 - RNA, 22 nt, Human
caauaaaauuauuugcaggucu

SEQ ID NO: 3646974 - RNA, 14 nt, Human
caauaaaauuuaaa

SEQ ID NO: 3646975 - RNA, 17 nt, Human
caauaaaauuucuaaga

SEQ ID NO: 3646976 - RNA, 18 nt, Human
caauaaaauuuuuuuaaa

SEQ ID NO: 3646977 - RNA, 22 nt, Human
caauaaaauuuuuuuucauguu

SEQ ID NO: 3646978 - RNA, 20 nt, Human
caauaaaccaaugaacgaag

SEQ ID NO: 3646979 - RNA, 19 nt, Human
caauaaacccucagagccu

SEQ ID NO: 3646980 - RNA, 17 nt, Human
caauaaaccucuuuucu

SEQ ID NO: 3646981 - RNA, 12 nt, Human
caauaaacgauu

SEQ ID NO: 3646982 - RNA, 17 nt, Human
caauaaacgauuuaauu

SEQ ID NO: 3646983 - RNA, 11 nt, Human
caauaaacuau

SEQ ID NO: 3646984 - RNA, 13 nt, Human
caauaaagcaaug

SEQ ID NO: 3646985 - RNA, 15 nt, Human
caauaaagcacugag

SEQ ID NO: 3646986 - RNA, 17 nt, Human
caauaaagcacugagca

SEQ ID NO: 3646987 - RNA, 19 nt, Human
caauaaagcagcguuucua

SEQ ID NO: 3646988 - RNA, 16 nt, Human
caauaaagcauuuaua

SEQ ID NO: 3646989 - RNA, 19 nt, Human
caauaaagcauuuauaaau

SEQ ID NO: 3646990 - RNA, 22 nt, Human
caauaaagcugcugagaaucua

SEQ ID NO: 3646991 - RNA, 13 nt, Human
caauaaagcuugu

SEQ ID NO: 3646992 - RNA, 17 nt, Human
caauaaagcuuguugac

SEQ ID NO: 3646993 - RNA, 18 nt, Human
caauaaaguauaauguuu

SEQ ID NO: 3646994 - RNA, 20 nt, Human
caauaaaguauuuaauuagu

SEQ ID NO: 3646995 - RNA, 21 nt, Human
caauaaagugacccugcucuc

SEQ ID NO: 3646996 - RNA, 19 nt, Human
caauaaaguugagcaaaca

SEQ ID NO: 3646997 - RNA, 20 nt, Human
caauaaaguuugaucuuccu

SEQ ID NO: 3646998 - RNA, 15 nt, Human
caauaaauguauuca

SEQ ID NO: 3646999 - RNA, 18 nt, Human
caauaaauguauucaaau

SEQ ID NO: 3647000 - RNA, 14 nt, Human
caauaaaugucugu

SEQ ID NO: 3647001 - RNA, 15 nt, Human
caauaaaugucuguu

SEQ ID NO: 3647002 - RNA, 15 nt, Human
caauaaauugcuaau

SEQ ID NO: 3647003 - RNA, 20 nt, Human
caauaaauugcuaauguugc

SEQ ID NO: 3647004 - RNA, 22 nt, Human
caauaaauugcuaauguugcug

SEQ ID NO: 3647005 - RNA, 15 nt, Human
caauaacacacagcu

SEQ ID NO: 3647006 - RNA, 13 nt, Human
caauaacacuguc

SEQ ID NO: 3647007 - RNA, 14 nt, Human
caauaacuacugug

SEQ ID NO: 3647008 - RNA, 17 nt, Human
caauaacuacuguguuc

SEQ ID NO: 3647009 - RNA, 18 nt, Human
caauaacuacuguguucc

SEQ ID NO: 3647010 - RNA, 20 nt, Human
caauaacuacuguguuccug

SEQ ID NO: 3647011 - RNA, 19 nt, Human
caauaacuccucccagggu

SEQ ID NO: 3647012 - RNA, 21 nt, Human
caauaagagcguuugcccaaa

SEQ ID NO: 3647013 - RNA, 12 nt, Human
caauaagcaaaa

SEQ ID NO: 3647014 - RNA, 13 nt, Human
caauaagccuugu

SEQ ID NO: 3647015 - RNA, 23 nt, Human
caauaagugugugguagaaacaa

SEQ ID NO: 3647016 - RNA, 13 nt, Human
caauaauauauuu

SEQ ID NO: 3647017 - RNA, 16 nt, Human
caauaauauauuuucu

SEQ ID NO: 3647018 - RNA, 18 nt, Human
caauaauauauuuucugu

SEQ ID NO: 3647019 - RNA, 20 nt, Human
caauaauauauuuucuguuu

SEQ ID NO: 3647020 - RNA, 20 nt, Human
caauaaugcaguaugguaca

SEQ ID NO: 3647021 - RNA, 16 nt, Human
caauaauggaaaaaaa

SEQ ID NO: 3647022 - RNA, 16 nt, Human
caauaauucauauucu

SEQ ID NO: 3647023 - RNA, 20 nt, Human
caauaauuuguggugauuug

SEQ ID NO: 3647024 - RNA, 19 nt, Human
caauacaaacaaucucuua

SEQ ID NO: 3647025 - RNA, 16 nt, Human
caauacaaauggauuu

SEQ ID NO: 3647026 - RNA, 18 nt, Human
caauacagauaacauuag

SEQ ID NO: 3647027 - RNA, 17 nt, Human
caauacaugcugcuaau

SEQ ID NO: 3647028 - RNA, 22 nt, Human
caauacccaaauccucuccagc

SEQ ID NO: 3647029 - RNA, 18 nt, Human
caauacucauaaugugaa

SEQ ID NO: 3647030 - RNA, 22 nt, Human
caauacucauaaugugaagugu

SEQ ID NO: 3647031 - RNA, 23 nt, Human
caauagaaggauguacauuucca

SEQ ID NO: 3647032 - RNA, 14 nt, Human
caauagagacugua

SEQ ID NO: 3647033 - RNA, 15 nt, Human
caauagaucuccagc

SEQ ID NO: 3647034 - RNA, 16 nt, Human
caauagcacauaugga

SEQ ID NO: 3647035 - RNA, 20 nt, Human
caauagcauggauagaguau

SEQ ID NO: 3647036 - RNA, 17 nt, Human
caauagccacuaaccuu

SEQ ID NO: 3647037 - RNA, 22 nt, Human
caauagccacuaaccuugccug

SEQ ID NO: 3647038 - RNA, 18 nt, Human
caauagcguguguagaua

SEQ ID NO: 3647039 - RNA, 12 nt, Human
caauagcugccc

SEQ ID NO: 3647040 - RNA, 18 nt, Human
caauagcugcccauuucg

SEQ ID NO: 3647041 - RNA, 21 nt, Human
caauagcuuuacccucaggca

SEQ ID NO: 3647042 - RNA, 13 nt, Human
caauaggaaaaac

SEQ ID NO: 3647043 - RNA, 14 nt, Human
caauaggaaaaacu

SEQ ID NO: 3647044 - RNA, 20 nt, Human
caauaggaaaaacugauuuu

SEQ ID NO: 3647045 - RNA, 16 nt, Human
caauaggaaugcuaac

SEQ ID NO: 3647046 - RNA, 22 nt, Human
caauaggcagacuggguuucua

SEQ ID NO: 3647047 - RNA, 15 nt, Human
caauaggcuguuccc

SEQ ID NO: 3647048 - RNA, 18 nt, Human
caauaguaauucucaggc

SEQ ID NO: 3647049 - RNA, 16 nt, Human
caauagucaagaaaaa

SEQ ID NO: 3647050 - RNA, 16 nt, Human
caauaguguguucuga

SEQ ID NO: 3647051 - RNA, 15 nt, Human
caauaguugaauuag

SEQ ID NO: 3647052 - RNA, 18 nt, Human
caauauaaaacuguacuu

SEQ ID NO: 3647053 - RNA, 22 nt, Human
caauauaaaaggcaaaugugua

SEQ ID NO: 3647054 - RNA, 20 nt, Human
caauauacuggaaagcuuuu

SEQ ID NO: 3647055 - RNA, 14 nt, Human
caauauagaaacac

SEQ ID NO: 3647056 - RNA, 20 nt, Human
caauauauaaaaauauauau

SEQ ID NO: 3647057 - RNA, 20 nt, Human
caauauaucuaaauugaaua

SEQ ID NO: 3647058 - RNA, 14 nt, Human
caauauauugaacu

SEQ ID NO: 3647059 - RNA, 13 nt, Human
caauauauuuugu

SEQ ID NO: 3647060 - RNA, 14 nt, Human
caauauauuuugua

SEQ ID NO: 3647061 - RNA, 15 nt, Human
caauauauuuuguau

SEQ ID NO: 3647062 - RNA, 23 nt, Human
caauaucauaucaucacauugag

SEQ ID NO: 3647063 - RNA, 16 nt, Human
caauauccuaauaaaa

SEQ ID NO: 3647064 - RNA, 18 nt, Human
caauauccuaauaaaaag

SEQ ID NO: 3647065 - RNA, 21 nt, Human
caauauccuaauaaaaaggug

SEQ ID NO: 3647066 - RNA, 22 nt, Human
caauauccuaauaaaaagguga

SEQ ID NO: 3647067 - RNA, 15 nt, Human
caauaucuaauauau

SEQ ID NO: 3647068 - RNA, 15 nt, Human
caauaucuugcuuga

SEQ ID NO: 3647069 - RNA, 22 nt, Human
caauaucuugcuugaacuuaca

SEQ ID NO: 3647070 - RNA, 21 nt, Human
caauaucuuuuuuuuaauaaa

SEQ ID NO: 3647071 - RNA, 21 nt, Human
caauauguaaauagugcagaa

SEQ ID NO: 3647072 - RNA, 22 nt, Human
caauauguauuaauauucauug

SEQ ID NO: 3647073 - RNA, 15 nt, Human
caauauguauuguaa

SEQ ID NO: 3647074 - RNA, 22 nt, Human
caauauguauuguaaacaugug

SEQ ID NO: 3647075 - RNA, 17 nt, Human
caauaugugagugccuu

SEQ ID NO: 3647076 - RNA, 18 nt, Human
caauauguguuuacuuua

SEQ ID NO: 3647077 - RNA, 14 nt, Human
caauauuaaauaca

SEQ ID NO: 3647078 - RNA, 15 nt, Human
caauauuaaauacag

SEQ ID NO: 3647079 - RNA, 14 nt, Human
caauauuaaaucug

SEQ ID NO: 3647080 - RNA, 14 nt, Human
caauauuauacuaa

SEQ ID NO: 3647081 - RNA, 19 nt, Human
caauauuauacuaagaaaa

SEQ ID NO: 3647082 - RNA, 20 nt, Human
caagcccaguucagcuuggg

SEQ ID NO: 3647083 - RNA, 13 nt, Human
caagccccaggca

SEQ ID NO: 3647084 - RNA, 18 nt, Human
caagccccaggcaggcug

SEQ ID NO: 3647085 - RNA, 13 nt, Human
caagccccauccu

SEQ ID NO: 3647086 - RNA, 18 nt, Human
caagccccugcccaucug

SEQ ID NO: 3647087 - RNA, 21 nt, Human
caagccccugcuccagaagau

SEQ ID NO: 3647088 - RNA, 21 nt, Human
caagcccuggagccaacugcu

SEQ ID NO: 3647089 - RNA, 13 nt, Human
caagccuccacag

SEQ ID NO: 3647090 - RNA, 13 nt, Human
caagccugaggga

SEQ ID NO: 3647091 - RNA, 17 nt, Human
caagccugagggaaagg

SEQ ID NO: 3647092 - RNA, 22 nt, Human
caagccugcagucaucuugacc

SEQ ID NO: 3647093 - RNA, 17 nt, Human
caagccuggucagccca

SEQ ID NO: 3647094 - RNA, 18 nt, Human
caagccuguaaucccagc

SEQ ID NO: 3647095 - RNA, 16 nt, Human
caagccugugcaaaaa

SEQ ID NO: 3647096 - RNA, 21 nt, Human
caagccugugcaaaaaaauua

SEQ ID NO: 3647097 - RNA, 15 nt, Human
caagcgauucuucug

SEQ ID NO: 3647098 - RNA, 17 nt, Human
caagcgauucuucugcu

SEQ ID NO: 3647099 - RNA, 20 nt, Human
caagcgauucuucugcuuca

SEQ ID NO: 3647100 - RNA, 15 nt, Human
caagcgcccuggccc

SEQ ID NO: 3647101 - RNA, 22 nt, Human
caagcuaagcacugccacuggg

SEQ ID NO: 3647102 - RNA, 21 nt, Human
caagcuaauaaaauaucauuc

SEQ ID NO: 3647103 - RNA, 18 nt, Human
caagcuagaaggccacau

SEQ ID NO: 3647104 - RNA, 21 nt, Human
caagcuaggugcuauuuguca

SEQ ID NO: 3647105 - RNA, 15 nt, Human
caagcuauccuggcu

SEQ ID NO: 3647106 - RNA, 15 nt, Human
caagcuaucuaaagu

SEQ ID NO: 3647107 - RNA, 21 nt, Human
caagcuaucuaaaguuuguua

SEQ ID NO: 3647108 - RNA, 15 nt, Human
caagcuauucaauuc

SEQ ID NO: 3647109 - RNA, 12 nt, Human
caagcucacagu

SEQ ID NO: 3647110 - RNA, 22 nt, Human
caagcucacaguuccucgcccu

SEQ ID NO: 3647111 - RNA, 18 nt, Human
caagcucacuugcuuuag

SEQ ID NO: 3647112 - RNA, 19 nt, Human
caagcuccaagcucccagg

SEQ ID NO: 3647113 - RNA, 17 nt, Human
caagcuccaucuccacu

SEQ ID NO: 3647114 - RNA, 13 nt, Human
caagcucccaagg

SEQ ID NO: 3647115 - RNA, 15 nt, Human
caagcucccaggcau

SEQ ID NO: 3647116 - RNA, 17 nt, Human
caagcucccaggcauuc

SEQ ID NO: 3647117 - RNA, 14 nt, Human
caagcucccaggcc

SEQ ID NO: 3647118 - RNA, 19 nt, Human
caagcucccugccccaaau

SEQ ID NO: 3647119 - RNA, 14 nt, Human
caagcuccgcagga

SEQ ID NO: 3647120 - RNA, 23 nt, Human
caagcuccuccucccugcaucug

SEQ ID NO: 3647121 - RNA, 16 nt, Human
caagcuccuccucgga

SEQ ID NO: 3647122 - RNA, 20 nt, Human
caagcuccuccucggaaccg

SEQ ID NO: 3647123 - RNA, 13 nt, Human
aucugaacauucu

SEQ ID NO: 3647124 - RNA, 21 nt, Human
aucugaagagcuauuauauaa

SEQ ID NO: 3647125 - RNA, 21 nt, Human
aucugaagauuguuuaucuag

SEQ ID NO: 3647126 - RNA, 13 nt, Human
aucugaaggagau

SEQ ID NO: 3647127 - RNA, 18 nt, Human
aucugaaggggcaaauuc

SEQ ID NO: 3647128 - RNA, 18 nt, Human
aucugaagucagaucugc

SEQ ID NO: 3647129 - RNA, 15 nt, Human
aucugaauguaauuu

SEQ ID NO: 3647130 - RNA, 17 nt, Human
aucugaauguaauuugu

SEQ ID NO: 3647131 - RNA, 18 nt, Human
aucugaauguaauuugug

SEQ ID NO: 3647132 - RNA, 19 nt, Human
aucugaauuuuuaaacaag

SEQ ID NO: 3647133 - RNA, 16 nt, Human
aucugacauccccacu

SEQ ID NO: 3647134 - RNA, 16 nt, Human
aucugacaucucugca

SEQ ID NO: 3647135 - RNA, 14 nt, Human
aucugaccagcagc

SEQ ID NO: 3647136 - RNA, 15 nt, Human
aucugaccagcagcg

SEQ ID NO: 3647137 - RNA, 20 nt, Human
aucugaccagcagcgccuuu

SEQ ID NO: 3647138 - RNA, 12 nt, Human
aucugacccagu

SEQ ID NO: 3647139 - RNA, 13 nt, Human
aucugacugcacg

SEQ ID NO: 3647140 - RNA, 18 nt, Human
aucugagaaaagcuuuga

SEQ ID NO: 3647141 - RNA, 14 nt, Human
aucugagaaucuuu

SEQ ID NO: 3647142 - RNA, 14 nt, Human
aucugagaaugaac

SEQ ID NO: 3647143 - RNA, 17 nt, Human
aucugagaaugaacaaa

SEQ ID NO: 3647144 - RNA, 21 nt, Human
aucugagagaggcuaaaaugu

SEQ ID NO: 3647145 - RNA, 20 nt, Human
aucugagaggccacagugca

SEQ ID NO: 3647146 - RNA, 15 nt, Human
aucugaggaauucug

SEQ ID NO: 3647147 - RNA, 14 nt, Human
aucugagggaaaug

SEQ ID NO: 3647148 - RNA, 15 nt, Human
aucugagggaaaugu

SEQ ID NO: 3647149 - RNA, 17 nt, Human
aucugagggaaauguuu

SEQ ID NO: 3647150 - RNA, 14 nt, Human
aucugagggaggag

SEQ ID NO: 3647151 - RNA, 19 nt, Human
aucugagggaggaggccac

SEQ ID NO: 3647152 - RNA, 20 nt, Human
aucugagggaggaggccacc

SEQ ID NO: 3647153 - RNA, 14 nt, Human
aucugauauguauu

SEQ ID NO: 3647154 - RNA, 16 nt, Human
aucugaucguucuuuc

SEQ ID NO: 3647155 - RNA, 23 nt, Human
aucugauggccuuaauuuccuuu

SEQ ID NO: 3647156 - RNA, 14 nt, Human
aucugauuccagca

SEQ ID NO: 3647157 - RNA, 18 nt, Human
aucugauuggacauuuuc

SEQ ID NO: 3647158 - RNA, 21 nt, Human
aucugauuuguaacccacuga

SEQ ID NO: 3647159 - RNA, 16 nt, Human
aucugcaaagcauguu

SEQ ID NO: 3647160 - RNA, 17 nt, Human
aucugcaccccuucucu

SEQ ID NO: 3647161 - RNA, 23 nt, Human
aucugcagaaggaaaaaugugua

SEQ ID NO: 3647162 - RNA, 14 nt, Human
aucugcaggcagac

SEQ ID NO: 3647163 - RNA, 19 nt, Human
aucugcaggcagacacgga

SEQ ID NO: 3647164 - RNA, 14 nt, Human
aucugcauuuagca

SEQ ID NO: 3647165 - RNA, 15 nt, Human
aucugcauuuagcac

SEQ ID NO: 3647166 - RNA, 16 nt, Human
aucugcauuuagcaca

SEQ ID NO: 3647167 - RNA, 15 nt, Human
aucugccacaaaaac

SEQ ID NO: 3647168 - RNA, 17 nt, Human
aucugccagacuuaaaa

SEQ ID NO: 3647169 - RNA, 15 nt, Human
aucugcccaccucag

SEQ ID NO: 3647170 - RNA, 16 nt, Human
aucugcccaggggugc

SEQ ID NO: 3647171 - RNA, 16 nt, Human
aucugccccuccccca

SEQ ID NO: 3647172 - RNA, 17 nt, Human
aucugccccucccccaa

SEQ ID NO: 3647173 - RNA, 15 nt, Human
aucugcccgccugcc

SEQ ID NO: 3647174 - RNA, 22 nt, Human
aucugcccgccugcccaccugc

SEQ ID NO: 3647175 - RNA, 18 nt, Human
aucugccuaaggacuucu

SEQ ID NO: 3647176 - RNA, 20 nt, Human
aucugccuaaggacuucuuu

SEQ ID NO: 3647177 - RNA, 21 nt, Human
aucugccuuuauuguguuugu

SEQ ID NO: 3647178 - RNA, 20 nt, Human
aucugcgggggcagugcuca

SEQ ID NO: 3647179 - RNA, 22 nt, Human
aucugcgugacaauaaaacauu

SEQ ID NO: 3647180 - RNA, 14 nt, Human
aucugcuaauaaaa

SEQ ID NO: 3647181 - RNA, 20 nt, Human
aucugcuagggaauaucaau

SEQ ID NO: 3647182 - RNA, 14 nt, Human
aucugcucacuuua

SEQ ID NO: 3647183 - RNA, 13 nt, Human
aucugcucagccc

SEQ ID NO: 3647184 - RNA, 15 nt, Human
aucugcucagcccug

SEQ ID NO: 3647185 - RNA, 17 nt, Human
aucugcucagcccugga

SEQ ID NO: 3647186 - RNA, 18 nt, Human
aucugcucagcccuggag

SEQ ID NO: 3647187 - RNA, 19 nt, Human
aucugcucagcccuggagg

SEQ ID NO: 3647188 - RNA, 20 nt, Human
aucugcucagcccuggaggu

SEQ ID NO: 3647189 - RNA, 13 nt, Human
aucugcucuccuu

SEQ ID NO: 3647190 - RNA, 18 nt, Human
aucugcuggaguuucaug

SEQ ID NO: 3647191 - RNA, 11 nt, Human
aucugcugucc

SEQ ID NO: 3647192 - RNA, 16 nt, Human
aucugcuguccagaca

SEQ ID NO: 3647193 - RNA, 21 nt, Human
aucuggaaaccucuacauauu

SEQ ID NO: 3647194 - RNA, 18 nt, Human
aucuggaaccaucagaaa

SEQ ID NO: 3647195 - RNA, 16 nt, Human
aucuggaacccagacu

SEQ ID NO: 3647196 - RNA, 21 nt, Human
aucuggaaccucagccuggcc

SEQ ID NO: 3647197 - RNA, 10 nt, Human
aucuggaagu

SEQ ID NO: 3647198 - RNA, 19 nt, Human
aucuggaccccaucuguga

SEQ ID NO: 3647199 - RNA, 15 nt, Human
aucuggacuccucug

SEQ ID NO: 3647200 - RNA, 17 nt, Human
aucuggacuccucuguc

SEQ ID NO: 3647201 - RNA, 21 nt, Human
aucuggagaccagggagccuu

SEQ ID NO: 3647202 - RNA, 15 nt, Human
aucuggagagcuaga

SEQ ID NO: 3647203 - RNA, 21 nt, Human
aucuggaggccuuccagcugc

SEQ ID NO: 3647204 - RNA, 23 nt, Human
aucuggaggccuuccagcugcug

SEQ ID NO: 3647205 - RNA, 18 nt, Human
aucuggagucuuugauaa

SEQ ID NO: 3647206 - RNA, 18 nt, Human
aucuggauaggagccugc

SEQ ID NO: 3647207 - RNA, 20 nt, Human
aucuggauaggagccugcug

SEQ ID NO: 3647208 - RNA, 22 nt, Human
aucuggauaggagccugcuggu

SEQ ID NO: 3647209 - RNA, 20 nt, Human
aucuggaugccucauuaugu

SEQ ID NO: 3647210 - RNA, 12 nt, Human
aucuggcagggu

SEQ ID NO: 3647211 - RNA, 23 nt, Human
aucuggccguugauguuggcugg

SEQ ID NO: 3647212 - RNA, 18 nt, Human
aucuggccuaaaaucuug

SEQ ID NO: 3647213 - RNA, 22 nt, Human
aucuggccuaaaaucuuggaag

SEQ ID NO: 3647214 - RNA, 23 nt, Human
aucuggccuaaaaucuuggaagu

SEQ ID NO: 3647215 - RNA, 18 nt, Human
aucuggccuggccuggcc

SEQ ID NO: 3647216 - RNA, 22 nt, Human
aucuggccuggccuggcccugc

SEQ ID NO: 3647217 - RNA, 21 nt, Human
aucuggcugcaguuuugcuau

SEQ ID NO: 3647218 - RNA, 17 nt, Human
aucuggcuuauuuuaau

SEQ ID NO: 3647219 - RNA, 19 nt, Human
aucuggcuuauuuuaaugu

SEQ ID NO: 3647220 - RNA, 21 nt, Human
aucuggcuuauuuuaauguga

SEQ ID NO: 3647221 - RNA, 14 nt, Human
aucugggaaagaca

SEQ ID NO: 3647222 - RNA, 16 nt, Human
aucugggaagauuucu

SEQ ID NO: 3647223 - RNA, 18 nt, Human
aucugggaguccccuuuu

SEQ ID NO: 3647224 - RNA, 16 nt, Human
aucugggccuuggccu

SEQ ID NO: 3647225 - RNA, 15 nt, Human
aucugggcuuccugg

SEQ ID NO: 3647226 - RNA, 16 nt, Human
aucugggggaguggaa

SEQ ID NO: 3647227 - RNA, 13 nt, Human
cacaggccugaga

SEQ ID NO: 3647228 - RNA, 15 nt, Human
cacaggccugagauu

SEQ ID NO: 3647229 - RNA, 20 nt, Human
cacaggccugagauuucauc

SEQ ID NO: 3647230 - RNA, 22 nt, Human
cacaggccugagauuucaucug

SEQ ID NO: 3647231 - RNA, 14 nt, Human
cacaggccugugua

SEQ ID NO: 3647232 - RNA, 22 nt, Human
cacaggccuguguagcugugac

SEQ ID NO: 3647233 - RNA, 24 nt, Human
cacaggccuguguagcugugaccu

SEQ ID NO: 3647234 - RNA, 14 nt, Human
cacaggcucaggca

SEQ ID NO: 3647235 - RNA, 18 nt, Human
cacaggcugagugcaggc

SEQ ID NO: 3647236 - RNA, 18 nt, Human
cacaggcugggcugggca

SEQ ID NO: 3647237 - RNA, 18 nt, Human
cacaggcuuagggacagg

SEQ ID NO: 3647238 - RNA, 22 nt, Human
cacaggcuuagggacaggaccc

SEQ ID NO: 3647239 - RNA, 17 nt, Human
cacaggcuucugagcag

SEQ ID NO: 3647240 - RNA, 18 nt, Human
cacaggcuucugagcagc

SEQ ID NO: 3647241 - RNA, 14 nt, Human
cacagggacuugaa

SEQ ID NO: 3647242 - RNA, 21 nt, Human
cacagggacuugaaguuguua

SEQ ID NO: 3647243 - RNA, 13 nt, Human
cacagggcagagc

SEQ ID NO: 3647244 - RNA, 17 nt, Human
cacagggcagagccggg

SEQ ID NO: 3647245 - RNA, 16 nt, Human
cacagggcagcugggc

SEQ ID NO: 3647246 - RNA, 17 nt, Human
cacagggcagcugggcc

SEQ ID NO: 3647247 - RNA, 18 nt, Human
cacagggcagcugggccc

SEQ ID NO: 3647248 - RNA, 21 nt, Human
cacagggcagcugggcccaac

SEQ ID NO: 3647249 - RNA, 11 nt, Human
cacagggcagu

SEQ ID NO: 3647250 - RNA, 18 nt, Human
cacagggcaguaccugag

SEQ ID NO: 3647251 - RNA, 20 nt, Human
cacagggcauccaacugaga

SEQ ID NO: 3647252 - RNA, 17 nt, Human
cacagggcaugaaauga

SEQ ID NO: 3647253 - RNA, 19 nt, Human
cacagggccuggcccaugu

SEQ ID NO: 3647254 - RNA, 17 nt, Human
cacaggggaaaagagga

SEQ ID NO: 3647255 - RNA, 17 nt, Human
cacaggggacacccaga

SEQ ID NO: 3647256 - RNA, 23 nt, Human
cacagguaugaccuucuaggaag

SEQ ID NO: 3647257 - RNA, 19 nt, Human
cacaggucaggggugacac

SEQ ID NO: 3647258 - RNA, 21 nt, Human
cacaggucccaaauggcccug

SEQ ID NO: 3647259 - RNA, 15 nt, Human
cacaggucccaccuc

SEQ ID NO: 3647260 - RNA, 19 nt, Human
cacaggucccaccuccagc

SEQ ID NO: 3647261 - RNA, 21 nt, Human
cacaggucccaccuccagccc

SEQ ID NO: 3647262 - RNA, 18 nt, Human
cacaggucgggcgcagga

SEQ ID NO: 3647263 - RNA, 13 nt, Human
cacaggucuagac

SEQ ID NO: 3647264 - RNA, 14 nt, Human
cacaggucuagacu

SEQ ID NO: 3647265 - RNA, 18 nt, Human
cacaggucuuuccuaagg

SEQ ID NO: 3647266 - RNA, 18 nt, Human
cacaggugcccgccacca

SEQ ID NO: 3647267 - RNA, 18 nt, Human
cacaggugggcuucccag

SEQ ID NO: 3647268 - RNA, 14 nt, Human
cacaggugucccca

SEQ ID NO: 3647269 - RNA, 20 nt, Human
cacagguguccccagcccac

SEQ ID NO: 3647270 - RNA, 14 nt, Human
cacaggugugagcc

SEQ ID NO: 3647271 - RNA, 19 nt, Human
cacaggugugguguaauuu

SEQ ID NO: 3647272 - RNA, 20 nt, Human
cacagguucacgugcagcuc

SEQ ID NO: 3647273 - RNA, 16 nt, Human
cacaguaaaaauaaaa

SEQ ID NO: 3647274 - RNA, 19 nt, Human
cacaguacagcaugugccu

SEQ ID NO: 3647275 - RNA, 17 nt, Human
cacaguagagccagcuu

SEQ ID NO: 3647276 - RNA, 19 nt, Human
cacaguauauuuuauuuca

SEQ ID NO: 3647277 - RNA, 16 nt, Human
cacaguauuacuucug

SEQ ID NO: 3647278 - RNA, 16 nt, Human
cacagucaaaauaauu

SEQ ID NO: 3647279 - RNA, 17 nt, Human
cacagucaaaauaauuc

SEQ ID NO: 3647280 - RNA, 16 nt, Human
cacagucacugaugua

SEQ ID NO: 3647281 - RNA, 17 nt, Human
cacagucagguugaaga

SEQ ID NO: 3647282 - RNA, 22 nt, Human
cacaguccaggaacaagcuaau

SEQ ID NO: 3647283 - RNA, 16 nt, Human
cacagucuaauuuuua

SEQ ID NO: 3647284 - RNA, 18 nt, Human
cacagucuccggccucuc

SEQ ID NO: 3647285 - RNA, 11 nt, Human
cacagugaccc

SEQ ID NO: 3647286 - RNA, 20 nt, Human
cacagugacucgggcuccug

SEQ ID NO: 3647287 - RNA, 23 nt, Human
cacagugacucgggcuccugugc

SEQ ID NO: 3647288 - RNA, 15 nt, Human
cacagugacuucuga

SEQ ID NO: 3647289 - RNA, 21 nt, Human
cacagugagucgaggacaggg

SEQ ID NO: 3647290 - RNA, 19 nt, Human
cacagugaucaaguuauuu

SEQ ID NO: 3647291 - RNA, 19 nt, Human
cacagugcaucucagccca

SEQ ID NO: 3647292 - RNA, 19 nt, Human
cacagugccuucaauaaau

SEQ ID NO: 3647293 - RNA, 19 nt, Human
cacaguggaaccagcccag

SEQ ID NO: 3647294 - RNA, 19 nt, Human
cacagugggaugaaccagc

SEQ ID NO: 3647295 - RNA, 19 nt, Human
cacagugguggcagggccu

SEQ ID NO: 3647296 - RNA, 19 nt, Human
cacaguguaccauuaaaau

SEQ ID NO: 3647297 - RNA, 22 nt, Human
cacaguguaccauuaaaauaug

SEQ ID NO: 3647298 - RNA, 16 nt, Human
cacaguguaugaaggg

SEQ ID NO: 3647299 - RNA, 21 nt, Human
cacaguguguggucaacauuu

SEQ ID NO: 3647300 - RNA, 16 nt, Human
cacaguguguuuguga

SEQ ID NO: 3647301 - RNA, 14 nt, Human
cacaguguugccca

SEQ ID NO: 3647302 - RNA, 17 nt, Human
cacaguguuuuuguaaa

SEQ ID NO: 3647303 - RNA, 19 nt, Human
cacaguguuuuuguaaagu

SEQ ID NO: 3647304 - RNA, 23 nt, Human
cacaguguuuuuguaaagugugg

SEQ ID NO: 3647305 - RNA, 23 nt, Human
cacaguucaaaauucuaaaugua

SEQ ID NO: 3647306 - RNA, 20 nt, Human
cacaguucaguggcagggcu

SEQ ID NO: 3647307 - RNA, 22 nt, Human
cacaguucaguggcagggcuca

SEQ ID NO: 3647308 - RNA, 20 nt, Human
cacaguuccucgcccugggu

SEQ ID NO: 3647309 - RNA, 14 nt, Human
cacaguuccuggga

SEQ ID NO: 3647310 - RNA, 19 nt, Human
cacaguucuuugggccaga

SEQ ID NO: 3647311 - RNA, 21 nt, Human
cacaguucuuugggccagaca

SEQ ID NO: 3647312 - RNA, 20 nt, Human
cacaguugccaccaccucug

SEQ ID NO: 3647313 - RNA, 22 nt, Human
cacaguugccaccaccucugug

SEQ ID NO: 3647314 - RNA, 12 nt, Human
cacaguuggccu

SEQ ID NO: 3647315 - RNA, 22 nt, Human
cacaguuggcuggaugaaauuu

SEQ ID NO: 3647316 - RNA, 21 nt, Human
cacaguuuccucaucugucca

SEQ ID NO: 3647317 - RNA, 20 nt, Human
cacaguuugaugucauuaau

SEQ ID NO: 3647318 - RNA, 15 nt, Human
cacaguuuucugaga

SEQ ID NO: 3647319 - RNA, 16 nt, Human
cacaguuuucugagaa

SEQ ID NO: 3647320 - RNA, 14 nt, Human
cacaguuuugaccu

SEQ ID NO: 3647321 - RNA, 14 nt, Human
cacauaaaggauaa

SEQ ID NO: 3647322 - RNA, 16 nt, Human
cacauaaaugcagccc

SEQ ID NO: 3647323 - RNA, 17 nt, Human
cacauaaaugcagccca

SEQ ID NO: 3647324 - RNA, 22 nt, Human
cacauaauuaaaguguccauug

SEQ ID NO: 3647325 - RNA, 23 nt, Human
cacauacaguuuuaugcucuuuu

SEQ ID NO: 3647326 - RNA, 21 nt, Human
cacauaccaacucaacuuuuu

SEQ ID NO: 3647327 - RNA, 22 nt, Human
cacauacccucuucauggaugg

SEQ ID NO: 3647328 - RNA, 20 nt, Human
cacauacgcaccacaucucu

SEQ ID NO: 3647329 - RNA, 18 nt, Human
cacauacucauuuuucau

SEQ ID NO: 3647330 - RNA, 15 nt, Human
cacauagacugugcg

SEQ ID NO: 3647331 - RNA, 21 nt, Human
caaugaucuagguuuaacuca

SEQ ID NO: 3647332 - RNA, 24 nt, Human
caaugaucuagguuuaacucagau

SEQ ID NO: 3647333 - RNA, 14 nt, Human
caaugaugaaugag

SEQ ID NO: 3647334 - RNA, 18 nt, Human
caaugaugcuauuugcaa

SEQ ID NO: 3647335 - RNA, 14 nt, Human
caaugauggucacc

SEQ ID NO: 3647336 - RNA, 15 nt, Human
caaugauuauuuuca

SEQ ID NO: 3647337 - RNA, 19 nt, Human
caaugcaaaccaucauuga

SEQ ID NO: 3647338 - RNA, 21 nt, Human
caaugcaaaccaucauugaaa

SEQ ID NO: 3647339 - RNA, 23 nt, Human
caaugcaaaccaucauugaaauc

SEQ ID NO: 3647340 - RNA, 21 nt, Human
caaugcaagagugauugcagc

SEQ ID NO: 3647341 - RNA, 16 nt, Human
caaugcacacaaaaca

SEQ ID NO: 3647342 - RNA, 13 nt, Human
caaugcacaucca

SEQ ID NO: 3647343 - RNA, 18 nt, Human
caaugcacauccauuccc

SEQ ID NO: 3647344 - RNA, 18 nt, Human
caaugcaccuaaagaaaa

SEQ ID NO: 3647345 - RNA, 23 nt, Human
caaugcacuuuguucuggcucuu

SEQ ID NO: 3647346 - RNA, 19 nt, Human
caaugcagaugccagagca

SEQ ID NO: 3647347 - RNA, 18 nt, Human
caaugcaguugucucugu

SEQ ID NO: 3647348 - RNA, 19 nt, Human
caaugcaguugucucuguu

SEQ ID NO: 3647349 - RNA, 20 nt, Human
caaugcaguugucucuguuu

SEQ ID NO: 3647350 - RNA, 22 nt, Human
caaugccaaaaaaagacagggc

SEQ ID NO: 3647351 - RNA, 22 nt, Human
caaugccacagcccugucagca

SEQ ID NO: 3647352 - RNA, 13 nt, Human
caaugccaucauc

SEQ ID NO: 3647353 - RNA, 14 nt, Human
caaugccaucaucu

SEQ ID NO: 3647354 - RNA, 16 nt, Human
caaugccucuugucuu

SEQ ID NO: 3647355 - RNA, 15 nt, Human
caaugcgaaugguag

SEQ ID NO: 3647356 - RNA, 19 nt, Human
caaugcgaaugguagucua

SEQ ID NO: 3647357 - RNA, 20 nt, Human
caaugcuauuuuuguuuuua

SEQ ID NO: 3647358 - RNA, 20 nt, Human
caaugcucuuuucacagcua

SEQ ID NO: 3647359 - RNA, 19 nt, Human
caaugcugaugaaucacug

SEQ ID NO: 3647360 - RNA, 23 nt, Human
caaugcugaugaaucacuguuuu

SEQ ID NO: 3647361 - RNA, 16 nt, Human
caaugcugauuuggug

SEQ ID NO: 3647362 - RNA, 13 nt, Human
caaugcuggcugu

SEQ ID NO: 3647363 - RNA, 23 nt, Human
caaugcuggcuguuggcuggggg

SEQ ID NO: 3647364 - RNA, 14 nt, Human
caaugcuguauuuu

SEQ ID NO: 3647365 - RNA, 16 nt, Human
caaugcuguauuuuaa

SEQ ID NO: 3647366 - RNA, 20 nt, Human
caaugcuuuauuuguaaauu

SEQ ID NO: 3647367 - RNA, 13 nt, Human
caauggaaacaau

SEQ ID NO: 3647368 - RNA, 14 nt, Human
caauggaaccuccu

SEQ ID NO: 3647369 - RNA, 14 nt, Human
caauggaagauuug

SEQ ID NO: 3647370 - RNA, 21 nt, Human
cacauccacacacgcaggaac

SEQ ID NO: 3647371 - RNA, 14 nt, Human
cacaucccagccca

SEQ ID NO: 3647372 - RNA, 22 nt, Human
cacauccgcgugugccugugug

SEQ ID NO: 3647373 - RNA, 19 nt, Human
cacauccggggccagcucc

SEQ ID NO: 3647374 - RNA, 22 nt, Human
cacauccuccacguucugcuca

SEQ ID NO: 3647375 - RNA, 17 nt, Human
cacauccuguguuucua

SEQ ID NO: 3647376 - RNA, 13 nt, Human
cacaucuaagccu

SEQ ID NO: 3647377 - RNA, 23 nt, Human
cacaucuaguaguuguucugaaa

SEQ ID NO: 3647378 - RNA, 23 nt, Human
cacaucucaacaggccucagggc

SEQ ID NO: 3647379 - RNA, 21 nt, Human
cacaucucugaaagcacagga

SEQ ID NO: 3647380 - RNA, 21 nt, Human
cacaucugcauuuucacccca

SEQ ID NO: 3647381 - RNA, 23 nt, Human
cacaucugugucuuguuuggaau

SEQ ID NO: 3647382 - RNA, 15 nt, Human
cacaucuguuuugua

SEQ ID NO: 3647383 - RNA, 12 nt, Human
cacaucuucccu

SEQ ID NO: 3647384 - RNA, 14 nt, Human
cacaucuugcucug

SEQ ID NO: 3647385 - RNA, 19 nt, Human
cacaucuugcucugcugac

SEQ ID NO: 3647386 - RNA, 20 nt, Human
cacaucuugcucugcugaca

SEQ ID NO: 3647387 - RNA, 12 nt, Human
cacaucuuucac

SEQ ID NO: 3647388 - RNA, 18 nt, Human
cacaucuuucacacuucc

SEQ ID NO: 3647389 - RNA, 19 nt, Human
cacaucuuucacacuucca

SEQ ID NO: 3647390 - RNA, 15 nt, Human
cacaucuuuccuguc

SEQ ID NO: 3647391 - RNA, 15 nt, Human
cacaucuuuuucacu

SEQ ID NO: 3647392 - RNA, 18 nt, Human
cacaugaaaccuuauuuu

SEQ ID NO: 3647393 - RNA, 21 nt, Human
cacaugaacuuagauuuuaca

SEQ ID NO: 3647394 - RNA, 23 nt, Human
cacaugaacuuagauuuuacaug

SEQ ID NO: 3647395 - RNA, 21 nt, Human
cacaugaacuuguaaaggaau

SEQ ID NO: 3647396 - RNA, 17 nt, Human
cacaugaaguccaagca

SEQ ID NO: 3647397 - RNA, 22 nt, Human
cacaugaauuauuacaguguuu

SEQ ID NO: 3647398 - RNA, 21 nt, Human
cacaugacaacuuugccagcu

SEQ ID NO: 3647399 - RNA, 20 nt, Human
cacaugacucgggggugggg

SEQ ID NO: 3647400 - RNA, 18 nt, Human
cacaugagcaucaggcca

SEQ ID NO: 3647401 - RNA, 20 nt, Human
cacaugagcaucaggccagg

SEQ ID NO: 3647402 - RNA, 15 nt, Human
cacaugagucccagu

SEQ ID NO: 3647403 - RNA, 17 nt, Human
cacaugagucccagugg

SEQ ID NO: 3647404 - RNA, 16 nt, Human
cacaugauuccagcca

SEQ ID NO: 3647405 - RNA, 12 nt, Human
cacaugauuuca

SEQ ID NO: 3647406 - RNA, 16 nt, Human
cacaugauuucacaaa

SEQ ID NO: 3647407 - RNA, 18 nt, Human
cacaugcacgugugugca

SEQ ID NO: 3647408 - RNA, 13 nt, Human
cacaugcauacac

SEQ ID NO: 3647409 - RNA, 16 nt, Human
cacaugcauacacaca

SEQ ID NO: 3647410 - RNA, 18 nt, Human
cacaugcauacacacaca

SEQ ID NO: 3647411 - RNA, 14 nt, Human
cacaugccccaucc

SEQ ID NO: 3647412 - RNA, 21 nt, Human
cacaugccccaucccaugcug

SEQ ID NO: 3647413 - RNA, 19 nt, Human
cacaugcccuaaugucugu

SEQ ID NO: 3647414 - RNA, 20 nt, Human
cacaugccucucucaggcca

SEQ ID NO: 3647415 - RNA, 17 nt, Human
cacaugcugagucuccc

SEQ ID NO: 3647416 - RNA, 22 nt, Human
cacaugcugagucucccaaggc

SEQ ID NO: 3647417 - RNA, 15 nt, Human
cacaugcuggacagg

SEQ ID NO: 3647418 - RNA, 12 nt, Human
cacaugcuggcc

SEQ ID NO: 3647419 - RNA, 18 nt, Human
cacaugcuggccagccug

SEQ ID NO: 3647420 - RNA, 12 nt, Human
cacaugcuucaa

SEQ ID NO: 3647421 - RNA, 17 nt, Human
cacauggaaacccauag

SEQ ID NO: 3647422 - RNA, 15 nt, Human
cacauggaaugaggg

SEQ ID NO: 3647423 - RNA, 14 nt, Human
cacauggcuuccuc

SEQ ID NO: 3647424 - RNA, 18 nt, Human
cacauggcuuccuccugc

SEQ ID NO: 3647425 - RNA, 20 nt, Human
cacauggcuuccuccugcgc

SEQ ID NO: 3647426 - RNA, 22 nt, Human
cacaugggagcaguccaugcau

SEQ ID NO: 3647427 - RNA, 17 nt, Human
cacauggggaaaaaaau

SEQ ID NO: 3647428 - RNA, 19 nt, Human
cacauggggcugggcagcu

SEQ ID NO: 3647429 - RNA, 20 nt, Human
cacauggggcugggcagcua

SEQ ID NO: 3647430 - RNA, 20 nt, Human
cacauggugcuacgccugca

SEQ ID NO: 3647431 - RNA, 22 nt, Human
cacauggugcuacgccugcaug

SEQ ID NO: 3647432 - RNA, 14 nt, Human
cacaugguuuuccu

SEQ ID NO: 3647433 - RNA, 17 nt, Human
cacauguaucuaugcau

SEQ ID NO: 3647434 - RNA, 22 nt, Human
cacaugucaccguggaccuucc

SEQ ID NO: 3647435 - RNA, 20 nt, Human
cacaugucaguaccuucaaa

SEQ ID NO: 3647436 - RNA, 16 nt, Human
cacauguccaagaagc

SEQ ID NO: 3647437 - RNA, 17 nt, Human
cacauguccaagaagcc

SEQ ID NO: 3647438 - RNA, 18 nt, Human
cacauguccaagaagccc

SEQ ID NO: 3647439 - RNA, 21 nt, Human
cacauguccaagaagcccagg

SEQ ID NO: 3647440 - RNA, 23 nt, Human
cacauguccaagaagcccaggaa

SEQ ID NO: 3647441 - RNA, 17 nt, Human
cacauguccuugugugu

SEQ ID NO: 3647442 - RNA, 16 nt, Human
cacaugucuuaaugaa

SEQ ID NO: 3647443 - RNA, 13 nt, Human
cacauguggacuu

SEQ ID NO: 3647444 - RNA, 16 nt, Human
cacauguguccauccc

SEQ ID NO: 3647445 - RNA, 14 nt, Human
cacauguuuccucu

SEQ ID NO: 3647446 - RNA, 12 nt, Human
cacauguuuuca

SEQ ID NO: 3647447 - RNA, 16 nt, Human
cacauuaaaaaaugaa

SEQ ID NO: 3647448 - RNA, 22 nt, Human
cacauuaaguaaucaauaaaga

SEQ ID NO: 3647449 - RNA, 18 nt, Human
cacauuaauauuugcuga

SEQ ID NO: 3647450 - RNA, 16 nt, Human
cacauuaucgggagca

SEQ ID NO: 3647451 - RNA, 17 nt, Human
cacauuaucgggagcag

SEQ ID NO: 3647452 - RNA, 13 nt, Human
cacauuauuucua

SEQ ID NO: 3647453 - RNA, 15 nt, Human
cacauuauuugcaug

SEQ ID NO: 3647454 - RNA, 12 nt, Human
cacauucaggaa

SEQ ID NO: 3647455 - RNA, 14 nt, Human
cacauucaggaaga

SEQ ID NO: 3647456 - RNA, 15 nt, Human
cacauuccccugggg

SEQ ID NO: 3647457 - RNA, 16 nt, Human
cacauuccugaacagg

SEQ ID NO: 3647458 - RNA, 21 nt, Human
cacauucggcucccuggagcc

SEQ ID NO: 3647459 - RNA, 16 nt, Human
cacauucuggcucagg

SEQ ID NO: 3647460 - RNA, 22 nt, Human
cacauucuuaacacauguccuu

SEQ ID NO: 3647461 - RNA, 19 nt, Human
cacauucuuauaaauauga

SEQ ID NO: 3647462 - RNA, 13 nt, Human
cacauugaagaau

SEQ ID NO: 3647463 - RNA, 23 nt, Human
cacauugaagaauguuagaguaa

SEQ ID NO: 3647464 - RNA, 15 nt, Human
cacauugcauucuau

SEQ ID NO: 3647465 - RNA, 21 nt, Human
cacauugccagugacaugaga

SEQ ID NO: 3647466 - RNA, 20 nt, Human
cacauugcugugaacaggaa

SEQ ID NO: 3647467 - RNA, 17 nt, Human
cacauuggaaacaaguc

SEQ ID NO: 3647468 - RNA, 16 nt, Human
cacauuggaaagcaca

SEQ ID NO: 3647469 - RNA, 23 nt, Human
cacauugggcagcgcccuuccuc

SEQ ID NO: 3647470 - RNA, 20 nt, Human
cacauuguuauuuucaguga

SEQ ID NO: 3647471 - RNA, 21 nt, Human
cacauuguuguuuuuuuaaua

SEQ ID NO: 3647472 - RNA, 19 nt, Human
cacauuguuugcugcuauu

SEQ ID NO: 3647473 - RNA, 15 nt, Human
cacauuguuuuaaaa

SEQ ID NO: 3647474 - RNA, 16 nt, Human
cacauuuaagagacag

SEQ ID NO: 3647475 - RNA, 11 nt, Human
cacauuuaagg

SEQ ID NO: 3647476 - RNA, 14 nt, Human
cacauuuaaggaug

SEQ ID NO: 3647477 - RNA, 13 nt, Human
cacauuucuaaaa

SEQ ID NO: 3647478 - RNA, 17 nt, Human
cacauuucuaaaaucuu

SEQ ID NO: 3647479 - RNA, 21 nt, Human
cacauuugcuacuguuguaag

SEQ ID NO: 3647480 - RNA, 20 nt, Human
cacauuugguaauguuuuua

SEQ ID NO: 3647481 - RNA, 11 nt, Human
cacauuuguac

SEQ ID NO: 3647482 - RNA, 20 nt, Human
cacauuugugccgacacugu

SEQ ID NO: 3647483 - RNA, 19 nt, Human
cacauuuuaaaaaauuugu

SEQ ID NO: 3647484 - RNA, 16 nt, Human
cacauuuuguauaauu

SEQ ID NO: 3647485 - RNA, 22 nt, Human
cacauuuuguauaauuguaucg

SEQ ID NO: 3647486 - RNA, 17 nt, Human
cacauuuuuauaccugu

SEQ ID NO: 3647487 - RNA, 14 nt, Human
cacauuuuuuucua

SEQ ID NO: 3647488 - RNA, 22 nt, Human
cacauuuuuuuuuuuaauuuug

SEQ ID NO: 3647489 - RNA, 13 nt, Human
caccaaaaaauau

SEQ ID NO: 3647490 - RNA, 12 nt, Human
caccaaaauaag

SEQ ID NO: 3647491 - RNA, 17 nt, Human
caccaaaauaagaaaag

SEQ ID NO: 3647492 - RNA, 19 nt, Human
caccaaaauaagaaaagau

SEQ ID NO: 3647493 - RNA, 17 nt, Human
caccaaagaugcagccg

SEQ ID NO: 3647494 - RNA, 12 nt, Human
caccaaaguucu

SEQ ID NO: 3647495 - RNA, 16 nt, Human
caccaaaguucuaaua

SEQ ID NO: 3647496 - RNA, 22 nt, Human
augaguagauaauuucagggug

SEQ ID NO: 3647497 - RNA, 18 nt, Human
augaguagcuuauacaau

SEQ ID NO: 3647498 - RNA, 14 nt, Human
augaguauacaaua

SEQ ID NO: 3647499 - RNA, 22 nt, Human
augagucacuaugggaugagaa

SEQ ID NO: 3647500 - RNA, 16 nt, Human
augagugaauaaaugu

SEQ ID NO: 3647501 - RNA, 16 nt, Human
augagugcgugcucag

SEQ ID NO: 3647502 - RNA, 23 nt, Human
augagugcuucagaaugugauuu

SEQ ID NO: 3647503 - RNA, 19 nt, Human
augaguguaacaagaaagg

SEQ ID NO: 3647504 - RNA, 23 nt, Human
augaguguaacaagaaaggagag

SEQ ID NO: 3647505 - RNA, 18 nt, Human
augaguuccagaaaguaa

SEQ ID NO: 3647506 - RNA, 19 nt, Human
augaguuguuuucagacuc

SEQ ID NO: 3647507 - RNA, 20 nt, Human
augaguuguuuucagacuca

SEQ ID NO: 3647508 - RNA, 23 nt, Human
augaguuguuuucagacucagac

SEQ ID NO: 3647509 - RNA, 14 nt, Human
augaguuucuuaga

SEQ ID NO: 3647510 - RNA, 15 nt, Human
augaguuucuuagac

SEQ ID NO: 3647511 - RNA, 13 nt, Human
augaguuuuggga

SEQ ID NO: 3647512 - RNA, 20 nt, Human
augaguuuugggaaguuaaa

SEQ ID NO: 3647513 - RNA, 19 nt, Human
augaguuuuugauagcuuu

SEQ ID NO: 3647514 - RNA, 14 nt, Human
cacaugaagaaaua

SEQ ID NO: 3647515 - RNA, 16 nt, Human
cacaugaaguccaagc

SEQ ID NO: 3647516 - RNA, 18 nt, Human
cacaugaaucugcacauc

SEQ ID NO: 3647517 - RNA, 20 nt, Human
cacaugaaucugcacaucug

SEQ ID NO: 3647518 - RNA, 17 nt, Human
cacaugagcaucaggcc

SEQ ID NO: 3647519 - RNA, 19 nt, Human
cacaugagcaucaggccag

SEQ ID NO: 3647520 - RNA, 21 nt, Human
cacaugagcaucaggccaggc

SEQ ID NO: 3647521 - RNA, 14 nt, Human
cacaugagucccag

SEQ ID NO: 3647522 - RNA, 14 nt, Human
cacaugauuucaca

SEQ ID NO: 3647523 - RNA, 17 nt, Human
cacaugauuucacaaau

SEQ ID NO: 3647524 - RNA, 18 nt, Human
cacaugauuucacaaaua

SEQ ID NO: 3647525 - RNA, 15 nt, Human
cacaugcauacacac

SEQ ID NO: 3647526 - RNA, 14 nt, Human
cacaugccaggggc

SEQ ID NO: 3647527 - RNA, 22 nt, Human
cacaugcccuuggugacagcug

SEQ ID NO: 3647528 - RNA, 13 nt, Human
cacaugccucucu

SEQ ID NO: 3647529 - RNA, 17 nt, Human
cacaugccucucucagg

SEQ ID NO: 3647530 - RNA, 18 nt, Human
cacaugcggagaacaaau

SEQ ID NO: 3647531 - RNA, 21 nt, Human
cacaugcuaggaugcggaaau

SEQ ID NO: 3647532 - RNA, 20 nt, Human
cacaugcucaggcuacuaua

SEQ ID NO: 3647533 - RNA, 18 nt, Human
cacaugcugagucuccca

SEQ ID NO: 3647534 - RNA, 14 nt, Human
cacaugcuggacag

SEQ ID NO: 3647535 - RNA, 13 nt, Human
cacaugcuggcca

SEQ ID NO: 3647536 - RNA, 14 nt, Human
cacaugcuggccag

SEQ ID NO: 3647537 - RNA, 15 nt, Human
cacaugcuggccagc

SEQ ID NO: 3647538 - RNA, 17 nt, Human
cacaugcuggccagccu

SEQ ID NO: 3647539 - RNA, 19 nt, Human
cacauggaaugaggguuug

SEQ ID NO: 3647540 - RNA, 18 nt, Human
cacauggcuauguuuuag

SEQ ID NO: 3647541 - RNA, 21 nt, Human
cacaugggagcaguccaugca

SEQ ID NO: 3647542 - RNA, 12 nt, Human
cacauggugaug

SEQ ID NO: 3647543 - RNA, 15 nt, Human
cacauggugauguug

SEQ ID NO: 3647544 - RNA, 18 nt, Human
cacauggugccccuagcu

SEQ ID NO: 3647545 - RNA, 19 nt, Human
cacauguauguuuugguau

SEQ ID NO: 3647546 - RNA, 12 nt, Human
cacaugucaccg

SEQ ID NO: 3647547 - RNA, 19 nt, Human
cacaugucaccguggaccu

SEQ ID NO: 3647548 - RNA, 19 nt, Human
cacauguccaagaagccca

SEQ ID NO: 3647549 - RNA, 16 nt, Human
cacauguccagcaccu

SEQ ID NO: 3647550 - RNA, 12 nt, Human
cacaugucuuaa

SEQ ID NO: 3647551 - RNA, 23 nt, Human
caccguggaccuuccugccacca

SEQ ID NO: 3647552 - RNA, 13 nt, Human
caccgugggcucc

SEQ ID NO: 3647553 - RNA, 17 nt, Human
caccgugggcucccuga

SEQ ID NO: 3647554 - RNA, 18 nt, Human
caccgugggcucccugac

SEQ ID NO: 3647555 - RNA, 14 nt, Human
caccguucugugca

SEQ ID NO: 3647556 - RNA, 12 nt, Human
caccuaaagaaa

SEQ ID NO: 3647557 - RNA, 15 nt, Human
caccuaaagcagcca

SEQ ID NO: 3647558 - RNA, 22 nt, Human
caccuaaauaaccaaucuacaa

SEQ ID NO: 3647559 - RNA, 15 nt, Human
caccuaacucuucuu

SEQ ID NO: 3647560 - RNA, 18 nt, Human
caccuaagagauucugau

SEQ ID NO: 3647561 - RNA, 22 nt, Human
caccuaauucgaugaaggcugc

SEQ ID NO: 3647562 - RNA, 23 nt, Human
caccuaauucgaugaaggcugcc

SEQ ID NO: 3647563 - RNA, 23 nt, Human
caccuacaguguacagucuugua

SEQ ID NO: 3647564 - RNA, 21 nt, Human
caccuacaugagguacugaga

SEQ ID NO: 3647565 - RNA, 20 nt, Human
caccuaccaccacgcccggc

SEQ ID NO: 3647566 - RNA, 21 nt, Human
caccuaccaccacgcccggcu

SEQ ID NO: 3647567 - RNA, 18 nt, Human
caccuaccaucagggaca

SEQ ID NO: 3647568 - RNA, 23 nt, Human
caccuacccauacacccccucuu

SEQ ID NO: 3647569 - RNA, 18 nt, Human
caccuaccuucaaagcug

SEQ ID NO: 3647570 - RNA, 21 nt, Human
caccuacuacaucgcccucca

SEQ ID NO: 3647571 - RNA, 16 nt, Human
caccuagaauuggcug

SEQ ID NO: 3647572 - RNA, 13 nt, Human
caccuagaucaga

SEQ ID NO: 3647573 - RNA, 14 nt, Human
caccuagcagcacc

SEQ ID NO: 3647574 - RNA, 14 nt, Human
caccuagcugaaug

SEQ ID NO: 3647575 - RNA, 18 nt, Human
caccuagcugaauguuuu

SEQ ID NO: 3647576 - RNA, 22 nt, Human
caccuagcugaauguuuuucua

SEQ ID NO: 3647577 - RNA, 23 nt, Human
caccuagcugaauguuuuucuaa

SEQ ID NO: 3647578 - RNA, 19 nt, Human
caccuaggaagccucagau

SEQ ID NO: 3647579 - RNA, 14 nt, Human
caccuauaauacca

SEQ ID NO: 3647580 - RNA, 21 nt, Human
caccuaucucgugggagagcc

SEQ ID NO: 3647581 - RNA, 14 nt, Human
caccuaugugccaa

SEQ ID NO: 3647582 - RNA, 23 nt, Human
caccucaaaauaccaugccauuu

SEQ ID NO: 3647583 - RNA, 21 nt, Human
caccucacagaaaugagauca

SEQ ID NO: 3647584 - RNA, 14 nt, Human
caccucacucagca

SEQ ID NO: 3647585 - RNA, 21 nt, Human
caccucacugaaaacaucugg

SEQ ID NO: 3647586 - RNA, 12 nt, Human
caccucagagcc

SEQ ID NO: 3647587 - RNA, 20 nt, Human
caccucagauggcagcuuuu

SEQ ID NO: 3647588 - RNA, 12 nt, Human
caccucagccuc

SEQ ID NO: 3647589 - RNA, 12 nt, Human
caccucagccuu

SEQ ID NO: 3647590 - RNA, 13 nt, Human
caccucagccuug

SEQ ID NO: 3647591 - RNA, 17 nt, Human
caccucaguucccuugg

SEQ ID NO: 3647592 - RNA, 21 nt, Human
caccucaguucccuuggccuc

SEQ ID NO: 3647593 - RNA, 14 nt, Human
caccucaugcccac

SEQ ID NO: 3647594 - RNA, 18 nt, Human
caccucaugcccaccccc

SEQ ID NO: 3647595 - RNA, 21 nt, Human
caccucaugcccacccccugc

SEQ ID NO: 3647596 - RNA, 14 nt, Human
caccuccacaguuc

SEQ ID NO: 3647597 - RNA, 16 nt, Human
caccuccacauccucc

SEQ ID NO: 3647598 - RNA, 12 nt, Human
caccuccagccc

SEQ ID NO: 3647599 - RNA, 18 nt, Human
caccuccagcccgggagc

SEQ ID NO: 3647600 - RNA, 14 nt, Human
caccucccagcccc

SEQ ID NO: 3647601 - RNA, 11 nt, Human
caccucccagg

SEQ ID NO: 3647602 - RNA, 16 nt, Human
caccucccauccuaau

SEQ ID NO: 3647603 - RNA, 17 nt, Human
caccucccccacuccca

SEQ ID NO: 3647604 - RNA, 14 nt, Human
caccuccccccacu

SEQ ID NO: 3647605 - RNA, 15 nt, Human
caccuccccccacug

SEQ ID NO: 3647606 - RNA, 17 nt, Human
caccuccccccacugca

SEQ ID NO: 3647607 - RNA, 20 nt, Human
caccucccccucccccuucu

SEQ ID NO: 3647608 - RNA, 13 nt, Human
caccuccccuauc

SEQ ID NO: 3647609 - RNA, 11 nt, Human
caccuccccuc

SEQ ID NO: 3647610 - RNA, 14 nt, Human
caccuccccuccuu

SEQ ID NO: 3647611 - RNA, 23 nt, Human
caccuccccuccuugccuccugu

SEQ ID NO: 3647612 - RNA, 18 nt, Human
caccuccccuugccagcu

SEQ ID NO: 3647613 - RNA, 20 nt, Human
caccuccccuugccagcugc

SEQ ID NO: 3647614 - RNA, 16 nt, Human
caccucccucccggca

SEQ ID NO: 3647615 - RNA, 10 nt, Human
caccucccug

SEQ ID NO: 3647616 - RNA, 13 nt, Human
caccucccugcaa

SEQ ID NO: 3647617 - RNA, 14 nt, Human
caccucccugcaau

SEQ ID NO: 3647618 - RNA, 16 nt, Human
caccucccugcccagg

SEQ ID NO: 3647619 - RNA, 16 nt, Human
caccuccuaaaacaac

SEQ ID NO: 3647620 - RNA, 22 nt, Human
caccuccuaaaaggcccagaga

SEQ ID NO: 3647621 - RNA, 16 nt, Human
caccuccucagccuga

SEQ ID NO: 3647622 - RNA, 14 nt, Human
caccuccucaugua

SEQ ID NO: 3647623 - RNA, 13 nt, Human
caccuccucucac

SEQ ID NO: 3647624 - RNA, 18 nt, Human
caccuccucucacucccc

SEQ ID NO: 3647625 - RNA, 19 nt, Human
caccuccugacacccuucu

SEQ ID NO: 3647626 - RNA, 14 nt, Human
caccuccugcuggg

SEQ ID NO: 3647627 - RNA, 15 nt, Human
caccuccugcugggc

SEQ ID NO: 3647628 - RNA, 17 nt, Human
caccuccugcugggcag

SEQ ID NO: 3647629 - RNA, 22 nt, Human
caccuccuggguucaagcgauu

SEQ ID NO: 3647630 - RNA, 13 nt, Human
caccuccuucccu

SEQ ID NO: 3647631 - RNA, 20 nt, Human
caccucgaauuuuguuuucu

SEQ ID NO: 3647632 - RNA, 22 nt, Human
caccucuaacagcaccaaauca

SEQ ID NO: 3647633 - RNA, 16 nt, Human
caccucuacccaaacc

SEQ ID NO: 3647634 - RNA, 18 nt, Human
caccucuacccaaacccu

SEQ ID NO: 3647635 - RNA, 22 nt, Human
caccucuaucccggcuuuggug

SEQ ID NO: 3647636 - RNA, 22 nt, Human
caccucucaauauucaauaaag

SEQ ID NO: 3647637 - RNA, 14 nt, Human
caccucucccuugg

SEQ ID NO: 3647638 - RNA, 18 nt, Human
caccucucucacuccuug

SEQ ID NO: 3647639 - RNA, 19 nt, Human
caccucucucacuccuuga

SEQ ID NO: 3647640 - RNA, 19 nt, Human
caccucugccagaagaucc

SEQ ID NO: 3647641 - RNA, 22 nt, Human
caccucugcggaccccagcugu

SEQ ID NO: 3647642 - RNA, 16 nt, Human
caccucugcuuucuga

SEQ ID NO: 3647643 - RNA, 13 nt, Human
caccucuguaauu

SEQ ID NO: 3647644 - RNA, 14 nt, Human
caccucuguaauuu

SEQ ID NO: 3647645 - RNA, 17 nt, Human
caccucugugaccucag

SEQ ID NO: 3647646 - RNA, 19 nt, Human
caccucugugaccucaggc

SEQ ID NO: 3647647 - RNA, 20 nt, Human
caccucugugaccucaggca

SEQ ID NO: 3647648 - RNA, 20 nt, Human
caccucuguggcauugaaau

SEQ ID NO: 3647649 - RNA, 19 nt, Human
caccucuuuguguuuuauu

SEQ ID NO: 3647650 - RNA, 19 nt, Human
caccugaacugaacaccau

SEQ ID NO: 3647651 - RNA, 20 nt, Human
caccugacacaccaggcgcu

SEQ ID NO: 3647652 - RNA, 16 nt, Human
caccugagcaggaccu

SEQ ID NO: 3647653 - RNA, 21 nt, Human
caccugagcaggaccucugaa

SEQ ID NO: 3647654 - RNA, 14 nt, Human
caccugagcuuugg

SEQ ID NO: 3647655 - RNA, 18 nt, Human
caccugagcuuuggacac

SEQ ID NO: 3647656 - RNA, 18 nt, Human
caccugaggugggcccag

SEQ ID NO: 3647657 - RNA, 24 nt, Human
caccugaggugggcccaggaccag

SEQ ID NO: 3647658 - RNA, 11 nt, Human
caccugaugug

SEQ ID NO: 3647659 - RNA, 23 nt, Human
cacccaccucccugccuccagga

SEQ ID NO: 3647660 - RNA, 14 nt, Human
cacccacuucugca

SEQ ID NO: 3647661 - RNA, 16 nt, Human
cacccacuucugcacu

SEQ ID NO: 3647662 - RNA, 21 nt, Human
cacccagaagaagauggcugu

SEQ ID NO: 3647663 - RNA, 20 nt, Human
cacccagacauaaaggaaaa

SEQ ID NO: 3647664 - RNA, 12 nt, Human
cacccagcccau

SEQ ID NO: 3647665 - RNA, 13 nt, Human
cacccagcccauu

SEQ ID NO: 3647666 - RNA, 11 nt, Human
cacccagccuc

SEQ ID NO: 3647667 - RNA, 12 nt, Human
cacccagccuca

SEQ ID NO: 3647668 - RNA, 19 nt, Human
cacccagccucaguccucc

SEQ ID NO: 3647669 - RNA, 20 nt, Human
cacccaggagccccgaggcc

SEQ ID NO: 3647670 - RNA, 22 nt, Human
cacccaggaggggaacacugcc

SEQ ID NO: 3647671 - RNA, 12 nt, Human
cacccaggccag

SEQ ID NO: 3647672 - RNA, 20 nt, Human
cacccaggcuggaguacagu

SEQ ID NO: 3647673 - RNA, 11 nt, Human
cacccagggaa

SEQ ID NO: 3647674 - RNA, 14 nt, Human
cacccauaucaugc

SEQ ID NO: 3647675 - RNA, 22 nt, Human
cacccauccuaccaaugcaugc

SEQ ID NO: 3647676 - RNA, 18 nt, Human
cacccaugaaagaaaacu

SEQ ID NO: 3647677 - RNA, 15 nt, Human
cacccaugaagacag

SEQ ID NO: 3647678 - RNA, 19 nt, Human
cacccaugcaagcagagga

SEQ ID NO: 3647679 - RNA, 22 nt, Human
cacccaugcaagcagaggacca

SEQ ID NO: 3647680 - RNA, 13 nt, Human
cacccaugggcuc

SEQ ID NO: 3647681 - RNA, 18 nt, Human
cacccaugggcucugaca

SEQ ID NO: 3647682 - RNA, 19 nt, Human
cacccaugggcucugacag

SEQ ID NO: 3647683 - RNA, 13 nt, Human
cacccaugugcca

SEQ ID NO: 3647684 - RNA, 15 nt, Human
cacccauuuucacau

SEQ ID NO: 3647685 - RNA, 15 nt, Human
caccccaaccugcuc

SEQ ID NO: 3647686 - RNA, 16 nt, Human
caccccaaccugcucu

SEQ ID NO: 3647687 - RNA, 20 nt, Human
caccccaaccugcucuccuc

SEQ ID NO: 3647688 - RNA, 21 nt, Human
caccccaaguagucugcucac

SEQ ID NO: 3647689 - RNA, 22 nt, Human
caccccacccccuucagugccc

SEQ ID NO: 3647690 - RNA, 19 nt, Human
caccccacccucccuggag

SEQ ID NO: 3647691 - RNA, 11 nt, Human
caccccaccug

SEQ ID NO: 3647692 - RNA, 12 nt, Human
caccccaccugc

SEQ ID NO: 3647693 - RNA, 13 nt, Human
caccccaccugcg

SEQ ID NO: 3647694 - RNA, 16 nt, Human
caccccaccugcgcuu

SEQ ID NO: 3647695 - RNA, 17 nt, Human
caccccacucacagaga

SEQ ID NO: 3647696 - RNA, 10 nt, Human
caccccacug

SEQ ID NO: 3647697 - RNA, 22 nt, Human
caccccacugcaauccugucuu

SEQ ID NO: 3647698 - RNA, 12 nt, Human
caccccagagcc

SEQ ID NO: 3647699 - RNA, 14 nt, Human
caccccagagccac

SEQ ID NO: 3647700 - RNA, 15 nt, Human
caccccagagccaca

SEQ ID NO: 3647701 - RNA, 16 nt, Human
caccccagagccacac

SEQ ID NO: 3647702 - RNA, 22 nt, Human
caccccagagccacacaugggc

SEQ ID NO: 3647703 - RNA, 16 nt, Human
caccccagcaauuaug

SEQ ID NO: 3647704 - RNA, 11 nt, Human
caccccagccc

SEQ ID NO: 3647705 - RNA, 13 nt, Human
caccccagcccca

SEQ ID NO: 3647706 - RNA, 13 nt, Human
caccccagcugcu

SEQ ID NO: 3647707 - RNA, 11 nt, Human
caccccaggac

SEQ ID NO: 3647708 - RNA, 20 nt, Human
caccccaggacgccacucau

SEQ ID NO: 3647709 - RNA, 13 nt, Human
caccccagggcag

SEQ ID NO: 3647710 - RNA, 18 nt, Human
caccccagggcagccagg

SEQ ID NO: 3647711 - RNA, 19 nt, Human
caccccagggcagccaggg

SEQ ID NO: 3647712 - RNA, 22 nt, Human
caccccagggccugagccuggc

SEQ ID NO: 3647713 - RNA, 18 nt, Human
caccccagugcacccacu

SEQ ID NO: 3647714 - RNA, 21 nt, Human
caccccaucccacacccugga

SEQ ID NO: 3647715 - RNA, 17 nt, Human
caccccaugccaaagcu

SEQ ID NO: 3647716 - RNA, 16 nt, Human
caccccaugcuguuga

SEQ ID NO: 3647717 - RNA, 13 nt, Human
caccccauucccg

SEQ ID NO: 3647718 - RNA, 17 nt, Human
caccccauucccgcagu

SEQ ID NO: 3647719 - RNA, 19 nt, Human
caccccauucccgcagugg

SEQ ID NO: 3647720 - RNA, 12 nt, Human
cacccccaaggg

SEQ ID NO: 3647721 - RNA, 14 nt, Human
cacccccaccccca

SEQ ID NO: 3647722 - RNA, 19 nt, Human
auggagauucaguuuucau

SEQ ID NO: 3647723 - RNA, 20 nt, Human
auggagauugaccuggaugg

SEQ ID NO: 3647724 - RNA, 15 nt, Human
auggagccagcuccc

SEQ ID NO: 3647725 - RNA, 23 nt, Human
auggagccagcucccucuauuua

SEQ ID NO: 3647726 - RNA, 21 nt, Human
auggagccagcucugcauuau

SEQ ID NO: 3647727 - RNA, 13 nt, Human
auggagcccaggc

SEQ ID NO: 3647728 - RNA, 14 nt, Human
auggagcccaggcg

SEQ ID NO: 3647729 - RNA, 23 nt, Human
auggagcccaggcgggagcggug

SEQ ID NO: 3647730 - RNA, 16 nt, Human
auggagccccagcccc

SEQ ID NO: 3647731 - RNA, 17 nt, Human
auggagcgcaccugccc

SEQ ID NO: 3647732 - RNA, 16 nt, Human
auggaggaaaaccaag

SEQ ID NO: 3647733 - RNA, 19 nt, Human
auggaggacuccaggcagc

SEQ ID NO: 3647734 - RNA, 15 nt, Human
auggaggagaagaau

SEQ ID NO: 3647735 - RNA, 19 nt, Human
auggaggcacacagcugca

SEQ ID NO: 3647736 - RNA, 16 nt, Human
auggaggcccuccugu

SEQ ID NO: 3647737 - RNA, 20 nt, Human
auggaggcccuccugugcug

SEQ ID NO: 3647738 - RNA, 16 nt, Human
auggagggaauaauac

SEQ ID NO: 3647739 - RNA, 16 nt, Human
auggagguucuaaggc

SEQ ID NO: 3647740 - RNA, 18 nt, Human
auggaguagaccccuggc

SEQ ID NO: 3647741 - RNA, 21 nt, Human
auggaguagaccccuggcugg

SEQ ID NO: 3647742 - RNA, 13 nt, Human
auggaguagaggu

SEQ ID NO: 3647743 - RNA, 11 nt, Human
auggagugacg

SEQ ID NO: 3647744 - RNA, 18 nt, Human
auggaguggcagcccagc

SEQ ID NO: 3647745 - RNA, 20 nt, Human
auggaguuaaacuuuagugc

SEQ ID NO: 3647746 - RNA, 18 nt, Human
auggaguuggaguucauu

SEQ ID NO: 3647747 - RNA, 14 nt, Human
auggaguuucuaag

SEQ ID NO: 3647748 - RNA, 18 nt, Human
auggauaaauauugguug

SEQ ID NO: 3647749 - RNA, 14 nt, Human
auggauacauaaag

SEQ ID NO: 3647750 - RNA, 16 nt, Human
auggauauuagucaua

SEQ ID NO: 3647751 - RNA, 16 nt, Human
auggauccuggaggau

SEQ ID NO: 3647752 - RNA, 19 nt, Human
auggaugcaaaguacaaug

SEQ ID NO: 3647753 - RNA, 21 nt, Human
auggauggaaaacgcucucua

SEQ ID NO: 3647754 - RNA, 12 nt, Human
auggaugugcuu

SEQ ID NO: 3647755 - RNA, 20 nt, Human
auggaugugggguccccauc

SEQ ID NO: 3647756 - RNA, 19 nt, Human
auggauuacuucucuauaa

SEQ ID NO: 3647757 - RNA, 19 nt, Human
auggauucaguuucuaaaa

SEQ ID NO: 3647758 - RNA, 12 nt, Human
auggauucuaaa

SEQ ID NO: 3647759 - RNA, 18 nt, Human
auggauucuaaaaugccu

SEQ ID NO: 3647760 - RNA, 14 nt, Human
auggauucucagau

SEQ ID NO: 3647761 - RNA, 18 nt, Human
auggauucucagauauuu

SEQ ID NO: 3647762 - RNA, 19 nt, Human
auggauucucagauauuua

SEQ ID NO: 3647763 - RNA, 22 nt, Human
auggauucucagauauuuauau

SEQ ID NO: 3647764 - RNA, 18 nt, Human
auggauugauaauugcau

SEQ ID NO: 3647765 - RNA, 20 nt, Human
auggauuggauuauuuaaua

SEQ ID NO: 3647766 - RNA, 14 nt, Human
auggauuucagaag

SEQ ID NO: 3647767 - RNA, 18 nt, Human
auggauuuucuauuguua

SEQ ID NO: 3647768 - RNA, 21 nt, Human
auggauuuucuauuguuacuc

SEQ ID NO: 3647769 - RNA, 19 nt, Human
auggauuuuucuuuaacug

SEQ ID NO: 3647770 - RNA, 20 nt, Human
auggauuuuucuuuaacugc

SEQ ID NO: 3647771 - RNA, 19 nt, Human
auggcaacaaacugcacau

SEQ ID NO: 3647772 - RNA, 22 nt, Human
auggcaacaaacugcacaugau

SEQ ID NO: 3647773 - RNA, 20 nt, Human
auggcaaguugcaucagaaa

SEQ ID NO: 3647774 - RNA, 23 nt, Human
auggcaaguuuugauaugaguau

SEQ ID NO: 3647775 - RNA, 22 nt, Human
auggcaaucaaacauuuucugg

SEQ ID NO: 3647776 - RNA, 16 nt, Human
auggcaauuuuguaac

SEQ ID NO: 3647777 - RNA, 22 nt, Human
auggcacaaucucggcucacug

SEQ ID NO: 3647778 - RNA, 15 nt, Human
auggcacagggcaug

SEQ ID NO: 3647779 - RNA, 19 nt, Human
auggcaccaaagccaccag

SEQ ID NO: 3647780 - RNA, 16 nt, Human
auggcacuaguauuuc

SEQ ID NO: 3647781 - RNA, 15 nt, Human
auggcacucccucca

SEQ ID NO: 3647782 - RNA, 16 nt, Human
auggcacucccuccag

SEQ ID NO: 3647783 - RNA, 20 nt, Human
auggcacucccuccagcaca

SEQ ID NO: 3647784 - RNA, 20 nt, Human
auggcagaagacaccagagc

SEQ ID NO: 3647785 - RNA, 21 nt, Human
auggcagaagacaccagagca

SEQ ID NO: 3647786 - RNA, 24 nt, Human
auggcagaagacaccagagcagau

SEQ ID NO: 3647787 - RNA, 15 nt, Human
auggcagaaggcaaa

SEQ ID NO: 3647788 - RNA, 21 nt, Human
auggcagaguuguaaauauau

SEQ ID NO: 3647789 - RNA, 11 nt, Human
auggcagcagg

SEQ ID NO: 3647790 - RNA, 18 nt, Human
auggcagcuuuuaaaaga

SEQ ID NO: 3647791 - RNA, 17 nt, Human
auggcaggaaggcuugu

SEQ ID NO: 3647792 - RNA, 19 nt, Human
auggcagggggcugcugcu

SEQ ID NO: 3647793 - RNA, 15 nt, Human
auggcagugucuuuc

SEQ ID NO: 3647794 - RNA, 20 nt, Human
auggcauauuuuucacauau

SEQ ID NO: 3647795 - RNA, 22 nt, Human
auggcauauuuuucacauaucu

SEQ ID NO: 3647796 - RNA, 17 nt, Human
auggcauccaagagugc

SEQ ID NO: 3647797 - RNA, 21 nt, Human
auggcaucccuuuuucauaaa

SEQ ID NO: 3647798 - RNA, 14 nt, Human
auggcauuugcaga

SEQ ID NO: 3647799 - RNA, 14 nt, Human
auggccaaacccaa

SEQ ID NO: 3647800 - RNA, 18 nt, Human
auggccacacugugacac

SEQ ID NO: 3647801 - RNA, 22 nt, Human
auggccacacugugacacacua

SEQ ID NO: 3647802 - RNA, 23 nt, Human
auggccacacugugacacacuac

SEQ ID NO: 3647803 - RNA, 14 nt, Human
auggccacauuuaa

SEQ ID NO: 3647804 - RNA, 20 nt, Human
cacgccuguaaucccagcag

SEQ ID NO: 3647805 - RNA, 12 nt, Human
cacgccugugca

SEQ ID NO: 3647806 - RNA, 22 nt, Human
cacgcgccccccucccagaggc

SEQ ID NO: 3647807 - RNA, 17 nt, Human
cacgcgcccuuucuacc

SEQ ID NO: 3647808 - RNA, 13 nt, Human
cacgcgcgcacac

SEQ ID NO: 3647809 - RNA, 19 nt, Human
cacgcgcuucgacuuuucu

SEQ ID NO: 3647810 - RNA, 14 nt, Human
cacgcguauuuaca

SEQ ID NO: 3647811 - RNA, 18 nt, Human
cacgcuccagcugccccg

SEQ ID NO: 3647812 - RNA, 19 nt, Human
cacgcuccagcugccccgg

SEQ ID NO: 3647813 - RNA, 21 nt, Human
cacgcuccccgccuguucccc

SEQ ID NO: 3647814 - RNA, 18 nt, Human
cacgcuccucccucugag

SEQ ID NO: 3647815 - RNA, 23 nt, Human
cacgcuccucccucugaggcugu

SEQ ID NO: 3647816 - RNA, 12 nt, Human
cacgcuccuuuc

SEQ ID NO: 3647817 - RNA, 15 nt, Human
cacgcuccuuucuga

SEQ ID NO: 3647818 - RNA, 19 nt, Human
cacgcugacuacagggccg

SEQ ID NO: 3647819 - RNA, 20 nt, Human
cacgcuggaccuugaacugg

SEQ ID NO: 3647820 - RNA, 13 nt, Human
cacgcugucucca

SEQ ID NO: 3647821 - RNA, 15 nt, Human
cacgcugucuccaga

SEQ ID NO: 3647822 - RNA, 19 nt, Human
cacgcuugacaggacagca

SEQ ID NO: 3647823 - RNA, 14 nt, Human
cacgcuuuccugaa

SEQ ID NO: 3647824 - RNA, 17 nt, Human
cacgcuuucuagcuguu

SEQ ID NO: 3647825 - RNA, 20 nt, Human
cacggaaaaugccaaucucu

SEQ ID NO: 3647826 - RNA, 15 nt, Human
cacggaaguuuucaa

SEQ ID NO: 3647827 - RNA, 23 nt, Human
cacggaccaaagggagucugcca

SEQ ID NO: 3647828 - RNA, 16 nt, Human
cacggacgcuggcucc

SEQ ID NO: 3647829 - RNA, 18 nt, Human
cacggacguuuccaucag

SEQ ID NO: 3647830 - RNA, 19 nt, Human
cacggagccacuccucuga

SEQ ID NO: 3647831 - RNA, 21 nt, Human
cacggaggcaucugcacccuc

SEQ ID NO: 3647832 - RNA, 20 nt, Human
cacggauccauguagcagga

SEQ ID NO: 3647833 - RNA, 18 nt, Human
cacggaucugagaaucuu

SEQ ID NO: 3647834 - RNA, 17 nt, Human
cacggauuugugucugu

SEQ ID NO: 3647835 - RNA, 19 nt, Human
cacggcaccugggcccugg

SEQ ID NO: 3647836 - RNA, 20 nt, Human
cacggcaccugggcccuggg

SEQ ID NO: 3647837 - RNA, 14 nt, Human
cacggccacuggcc

SEQ ID NO: 3647838 - RNA, 15 nt, Human
cacggccagccccgc

SEQ ID NO: 3647839 - RNA, 22 nt, Human
cacggccagcugcaucuacuca

SEQ ID NO: 3647840 - RNA, 14 nt, Human
cacggccaggccag

SEQ ID NO: 3647841 - RNA, 14 nt, Human
cacggccaugacca

SEQ ID NO: 3647842 - RNA, 16 nt, Human
cacggccgcuccaggg

SEQ ID NO: 3647843 - RNA, 19 nt, Human
cacggccgcuccaggggug

SEQ ID NO: 3647844 - RNA, 12 nt, Human
cacggccuccuu

SEQ ID NO: 3647845 - RNA, 12 nt, Human
cacggccuuucu

SEQ ID NO: 3647846 - RNA, 14 nt, Human
cacggcucacugca

SEQ ID NO: 3647847 - RNA, 17 nt, Human
cacggcucacugcagcc

SEQ ID NO: 3647848 - RNA, 20 nt, Human
cacggcuccucgagauccca

SEQ ID NO: 3647849 - RNA, 17 nt, Human
cacggcucuguccccag

SEQ ID NO: 3647850 - RNA, 18 nt, Human
cacggcucuguccccagc

SEQ ID NO: 3647851 - RNA, 20 nt, Human
cacggcucuguccccagccu

SEQ ID NO: 3647852 - RNA, 17 nt, Human
cacggcugcgcacugug

SEQ ID NO: 3647853 - RNA, 12 nt, Human
cacggcugcuga

SEQ ID NO: 3647854 - RNA, 18 nt, Human
cacgggacaucacagggu

SEQ ID NO: 3647855 - RNA, 22 nt, Human
cacgggcagccuggcucccagg

SEQ ID NO: 3647856 - RNA, 22 nt, Human
cacggggccgacauugucuccc

SEQ ID NO: 3647857 - RNA, 15 nt, Human
cacgggggcagcuga

SEQ ID NO: 3647858 - RNA, 13 nt, Human
cacgggugguccc

SEQ ID NO: 3647859 - RNA, 15 nt, Human
cacgguagugccuga

SEQ ID NO: 3647860 - RNA, 22 nt, Human
cacgguauuuauagagagagac

SEQ ID NO: 3647861 - RNA, 22 nt, Human
cacggucggggcaucuggccug

SEQ ID NO: 3647862 - RNA, 14 nt, Human
cacggucuguucuu

SEQ ID NO: 3647863 - RNA, 17 nt, Human
cacgguuugaagccugg

SEQ ID NO: 3647864 - RNA, 20 nt, Human
cacguaaguuaauaagcaaa

SEQ ID NO: 3647865 - RNA, 19 nt, Human
cacguacacacacauacac

SEQ ID NO: 3647866 - RNA, 16 nt, Human
cacguacuuaaaugaa

SEQ ID NO: 3647867 - RNA, 19 nt, Human
cacguaguagggucaggcc

SEQ ID NO: 3647868 - RNA, 23 nt, Human
cacguccugucagugccgccgcc

SEQ ID NO: 3647869 - RNA, 19 nt, Human
cacgucuauuucaucagaa

SEQ ID NO: 3647870 - RNA, 17 nt, Human
cacgucugacccucucc

SEQ ID NO: 3647871 - RNA, 15 nt, Human
cacgucugucuucac

SEQ ID NO: 3647872 - RNA, 16 nt, Human
cacgucuuccuucugc

SEQ ID NO: 3647873 - RNA, 18 nt, Human
cacgugacagugccuggg

SEQ ID NO: 3647874 - RNA, 21 nt, Human
cacgugcagcagcaacacaau

SEQ ID NO: 3647875 - RNA, 14 nt, Human
cacgugccaggccc

SEQ ID NO: 3647876 - RNA, 15 nt, Human
cacgugccaggcccg

SEQ ID NO: 3647877 - RNA, 13 nt, Human
cacguggagagcu

SEQ ID NO: 3647878 - RNA, 15 nt, Human
cacguggagagcugg

SEQ ID NO: 3647879 - RNA, 13 nt, Human
cacguggccucuu

SEQ ID NO: 3647880 - RNA, 22 nt, Human
cacguggcugcgugccccugcu

SEQ ID NO: 3647881 - RNA, 15 nt, Human
cacguggcuucugau

SEQ ID NO: 3647882 - RNA, 16 nt, Human
cacguggcuucugaug

SEQ ID NO: 3647883 - RNA, 16 nt, Human
cacgugggcuccccuc

SEQ ID NO: 3647884 - RNA, 19 nt, Human
cacgugguccuaaucuucu

SEQ ID NO: 3647885 - RNA, 16 nt, Human
cacguguacuggcucc

SEQ ID NO: 3647886 - RNA, 11 nt, Human
cacguguguga

SEQ ID NO: 3647887 - RNA, 12 nt, Human
cacgugugugac

SEQ ID NO: 3647888 - RNA, 15 nt, Human
cacguguguuuuucu

SEQ ID NO: 3647889 - RNA, 23 nt, Human
cacguguuuuauuccuguauguu

SEQ ID NO: 3647890 - RNA, 18 nt, Human
cacguuaugguguuucuc

SEQ ID NO: 3647891 - RNA, 19 nt, Human
cacguuccuuacugcagaa

SEQ ID NO: 3647892 - RNA, 20 nt, Human
cacguuccuucccccgcaau

SEQ ID NO: 3647893 - RNA, 18 nt, Human
cacguucucacacccacc

SEQ ID NO: 3647894 - RNA, 22 nt, Human
cacguucucacacccaccgucc

SEQ ID NO: 3647895 - RNA, 21 nt, Human
cacguuggggugauuuaaucc

SEQ ID NO: 3647896 - RNA, 23 nt, Human
cacguuucuaaaggcuaccuuug

SEQ ID NO: 3647897 - RNA, 13 nt, Human
cacguuuuaagga

SEQ ID NO: 3647898 - RNA, 15 nt, Human
cacguuuuaaggacu

SEQ ID NO: 3647899 - RNA, 18 nt, Human
cacguuuucaucucuagg

SEQ ID NO: 3647900 - RNA, 18 nt, Human
cacguuuuguuuugugcc

SEQ ID NO: 3647901 - RNA, 22 nt, Human
cacuaaaaauauuguuucugca

SEQ ID NO: 3647902 - RNA, 12 nt, Human
cacuaaacucug

SEQ ID NO: 3647903 - RNA, 16 nt, Human
cacuaaacucugaaua

SEQ ID NO: 3647904 - RNA, 21 nt, Human
cacuaaagcaggccuuuugau

SEQ ID NO: 3647905 - RNA, 13 nt, Human
cacuaaagcagug

SEQ ID NO: 3647906 - RNA, 17 nt, Human
cacuaaagccagccuga

SEQ ID NO: 3647907 - RNA, 16 nt, Human
cacuaaaguauguaaa

SEQ ID NO: 3647908 - RNA, 22 nt, Human
cacuaaaguauguaaaguaugu

SEQ ID NO: 3647909 - RNA, 11 nt, Human
cacuaaauguu

SEQ ID NO: 3647910 - RNA, 14 nt, Human
cacuaaauguuaaa

SEQ ID NO: 3647911 - RNA, 18 nt, Human
cacuaacauuauauugca

SEQ ID NO: 3647912 - RNA, 22 nt, Human
cacuaaccaagcugaguuuccu

SEQ ID NO: 3647913 - RNA, 14 nt, Human
cacuaaccacgcug

SEQ ID NO: 3647914 - RNA, 13 nt, Human
cacuaaccugacc

SEQ ID NO: 3647915 - RNA, 14 nt, Human
cacuaaccugaccg

SEQ ID NO: 3647916 - RNA, 23 nt, Human
cacuaaccuugccugguacagua

SEQ ID NO: 3647917 - RNA, 14 nt, Human
cacuaacucaccag

SEQ ID NO: 3647918 - RNA, 18 nt, Human
cacuaacucaccagcccc

SEQ ID NO: 3647919 - RNA, 13 nt, Human
cacuaagaacaaa

SEQ ID NO: 3647920 - RNA, 17 nt, Human
cacuaagaacaccugca

SEQ ID NO: 3647921 - RNA, 17 nt, Human
cacuaagagagaaugag

SEQ ID NO: 3647922 - RNA, 14 nt, Human
cacuaagcagagga

SEQ ID NO: 3647923 - RNA, 15 nt, Human
cacuaagcagaggag

SEQ ID NO: 3647924 - RNA, 18 nt, Human
cacuaagcagaggagggg

SEQ ID NO: 3647925 - RNA, 21 nt, Human
cacuaagcagaggaggggccg

SEQ ID NO: 3647926 - RNA, 23 nt, Human
cacuaaggggcccggccagccau

SEQ ID NO: 3647927 - RNA, 20 nt, Human
cacuaagucucuuuuuuaca

SEQ ID NO: 3647928 - RNA, 21 nt, Human
cacuaauauauuuaaaaauaa

SEQ ID NO: 3647929 - RNA, 17 nt, Human
cacuaauugguacuuuu

SEQ ID NO: 3647930 - RNA, 17 nt, Human
cacuaauuugauguuua

SEQ ID NO: 3647931 - RNA, 21 nt, Human
cacuaauuuuaguauucauuc

SEQ ID NO: 3647932 - RNA, 19 nt, Human
cacuaauuuuuguauuauu

SEQ ID NO: 3647933 - RNA, 20 nt, Human
cacuaauuuuuguauuauuu

SEQ ID NO: 3647934 - RNA, 13 nt, Human
augucauuuccuu

SEQ ID NO: 3647935 - RNA, 15 nt, Human
auguccaaagaggcu

SEQ ID NO: 3647936 - RNA, 20 nt, Human
auguccaaagaggcugcccc

SEQ ID NO: 3647937 - RNA, 21 nt, Human
auguccaaagaggcugccccu

SEQ ID NO: 3647938 - RNA, 17 nt, Human
auguccaagaagcccag

SEQ ID NO: 3647939 - RNA, 18 nt, Human
auguccaagaagcccagg

SEQ ID NO: 3647940 - RNA, 16 nt, Human
auguccacugguucuu

SEQ ID NO: 3647941 - RNA, 17 nt, Human
auguccacugguucuuc

SEQ ID NO: 3647942 - RNA, 22 nt, Human
auguccagaagaauauucagga

SEQ ID NO: 3647943 - RNA, 23 nt, Human
auguccagaagaauauucaggac

SEQ ID NO: 3647944 - RNA, 16 nt, Human
auguccagcaccuugu

SEQ ID NO: 3647945 - RNA, 21 nt, Human
auguccagcaccuugugccug

SEQ ID NO: 3647946 - RNA, 16 nt, Human
auguccaguaagauca

SEQ ID NO: 3647947 - RNA, 16 nt, Human
auguccauaaaagaga

SEQ ID NO: 3647948 - RNA, 18 nt, Human
auguccauaaaagagacc

SEQ ID NO: 3647949 - RNA, 17 nt, Human
auuaaauuuuuuuguau

SEQ ID NO: 3647950 - RNA, 23 nt, Human
auuaaauuuuuuuguaugaaaac

SEQ ID NO: 3647951 - RNA, 17 nt, Human
auuaaauuuuuuuuaca

SEQ ID NO: 3647952 - RNA, 19 nt, Human
auuaaauuuuuuuuacauu

SEQ ID NO: 3647953 - RNA, 12 nt, Human
auuaacaaauau

SEQ ID NO: 3647954 - RNA, 15 nt, Human
auuaacaaauaugcu

SEQ ID NO: 3647955 - RNA, 16 nt, Human
auuaacaaauaugcua

SEQ ID NO: 3647956 - RNA, 17 nt, Human
auuaacaaauaugcuaa

SEQ ID NO: 3647957 - RNA, 20 nt, Human
auuaacaaauuauguuacau

SEQ ID NO: 3647958 - RNA, 18 nt, Human
auuaacaacaauaacacu

SEQ ID NO: 3647959 - RNA, 12 nt, Human
auuaacaguuuu

SEQ ID NO: 3647960 - RNA, 23 nt, Human
auuaacauaccuaagaaguacau

SEQ ID NO: 3647961 - RNA, 18 nt, Human
auuaacauaggugaaagu

SEQ ID NO: 3647962 - RNA, 17 nt, Human
auuaacauauaauauau

SEQ ID NO: 3647963 - RNA, 21 nt, Human
auuaacaugcuuaugacaaug

SEQ ID NO: 3647964 - RNA, 15 nt, Human
auuaaccaagguaga

SEQ ID NO: 3647965 - RNA, 18 nt, Human
auuaaccacuucagcuga

SEQ ID NO: 3647966 - RNA, 20 nt, Human
auuaaccacuucagcugacu

SEQ ID NO: 3647967 - RNA, 18 nt, Human
auuaaccccauaauuaga

SEQ ID NO: 3647968 - RNA, 15 nt, Human
auuaaccgaugcuuu

SEQ ID NO: 3647969 - RNA, 13 nt, Human
auuaaccucucac

SEQ ID NO: 3647970 - RNA, 22 nt, Human
auuaaccugccagggagacaga

SEQ ID NO: 3647971 - RNA, 15 nt, Human
auuaacgauguccaa

SEQ ID NO: 3647972 - RNA, 12 nt, Human
auuaacucauua

SEQ ID NO: 3647973 - RNA, 19 nt, Human
auuaacuggguaaugaaac

SEQ ID NO: 3647974 - RNA, 22 nt, Human
auuaacuggguaaugaaacaaa

SEQ ID NO: 3647975 - RNA, 16 nt, Human
auuaacuuaauaauca

SEQ ID NO: 3647976 - RNA, 15 nt, Human
auuaacuuauuuaga

SEQ ID NO: 3647977 - RNA, 13 nt, Human
auuaacuuuaaug

SEQ ID NO: 3647978 - RNA, 15 nt, Human
auuaagaaaaucaua

SEQ ID NO: 3647979 - RNA, 12 nt, Human
auuaagaaagga

SEQ ID NO: 3647980 - RNA, 17 nt, Human
auuaagaaaggaagcau

SEQ ID NO: 3647981 - RNA, 12 nt, Human
auuaagaaauag

SEQ ID NO: 3647982 - RNA, 20 nt, Human
auuaagaaugaaauacuguu

SEQ ID NO: 3647983 - RNA, 21 nt, Human
auuaagaaugaaauacuguuu

SEQ ID NO: 3647984 - RNA, 12 nt, Human
auuaagaauguu

SEQ ID NO: 3647985 - RNA, 18 nt, Human
auuaagaauguucucaau

SEQ ID NO: 3647986 - RNA, 20 nt, Human
auuaagagagucuauuuacg

SEQ ID NO: 3647987 - RNA, 17 nt, Human
auuaagauacaaauuaa

SEQ ID NO: 3647988 - RNA, 21 nt, Human
auuaagauaugggacauuuuu

SEQ ID NO: 3647989 - RNA, 16 nt, Human
auuaagaucucagugg

SEQ ID NO: 3647990 - RNA, 15 nt, Human
auuaagauggauucu

SEQ ID NO: 3647991 - RNA, 13 nt, Human
auuaagauuauaa

SEQ ID NO: 3647992 - RNA, 14 nt, Human
auuaagcaucacaa

SEQ ID NO: 3647993 - RNA, 17 nt, Human
auuaagcaucagaaacu

SEQ ID NO: 3647994 - RNA, 22 nt, Human
auuaagcaugacagaaaauaug

SEQ ID NO: 3647995 - RNA, 15 nt, Human
auuaagccuuccaca

SEQ ID NO: 3647996 - RNA, 20 nt, Human
aaaagugccucaagaggaau

SEQ ID NO: 3647997 - RNA, 23 nt, Human
aaaaguggaauuucuuguuucuc

SEQ ID NO: 3647998 - RNA, 19 nt, Human
aaaaguggcaagaccaaaa

SEQ ID NO: 3647999 - RNA, 18 nt, Human
aaaagugggcuugauucu

SEQ ID NO: 3648000 - RNA, 13 nt, Human
aaaaguggggcag

SEQ ID NO: 3648001 - RNA, 15 nt, Human
aaaaguggggcagag

SEQ ID NO: 3648002 - RNA, 18 nt, Human
aaaagugucaccuuuucu

SEQ ID NO: 3648003 - RNA, 13 nt, Human
aaaaguguccuuc

SEQ ID NO: 3648004 - RNA, 21 nt, Human
aaaaguguuuauuuuucauau

SEQ ID NO: 3648005 - RNA, 16 nt, Human
aaaaguuaaaaaaaau

SEQ ID NO: 3648006 - RNA, 22 nt, Human
aaaaguuaaaaaaaauaauaaa

SEQ ID NO: 3648007 - RNA, 23 nt, Human
aaaaguuaaugcuuaagagggaa

SEQ ID NO: 3648008 - RNA, 15 nt, Human
aaaaguuacagaaau

SEQ ID NO: 3648009 - RNA, 17 nt, Human
aaaaguuauuaauauuu

SEQ ID NO: 3648010 - RNA, 22 nt, Human
aaaaguucauaacagugccauu

SEQ ID NO: 3648011 - RNA, 18 nt, Human
aaaaguucugcagauaaa

SEQ ID NO: 3648012 - RNA, 11 nt, Human
aaaaguucuuu

SEQ ID NO: 3648013 - RNA, 14 nt, Human
aaaaguugaaauua

SEQ ID NO: 3648014 - RNA, 15 nt, Human
aaaaguugcagcugu

SEQ ID NO: 3648015 - RNA, 22 nt, Human
aaaaguugcuauuugaacuuuu

SEQ ID NO: 3648016 - RNA, 21 nt, Human
aaaaguuuaauauuaaagcca

SEQ ID NO: 3648017 - RNA, 22 nt, Human
aaaaguuuaauauuaaagccau

SEQ ID NO: 3648018 - RNA, 23 nt, Human
aaaaguuuaauauuaaagccaug

SEQ ID NO: 3648019 - RNA, 23 nt, Human
aaaaguuuacaacauaaucuagu

SEQ ID NO: 3648020 - RNA, 12 nt, Human
aaaaguuucaau

SEQ ID NO: 3648021 - RNA, 12 nt, Human
aaaaguuuccau

SEQ ID NO: 3648022 - RNA, 23 nt, Human
aaaaguuugaaaagcaauauugu

SEQ ID NO: 3648023 - RNA, 16 nt, Human
aaaaguuugccagaag

SEQ ID NO: 3648024 - RNA, 17 nt, Human
aaaaguuugccagaagu

SEQ ID NO: 3648025 - RNA, 17 nt, Human
aaaaguuuuauuuuucu

SEQ ID NO: 3648026 - RNA, 20 nt, Human
aaaaguuuuuuauuaugcau

SEQ ID NO: 3648027 - RNA, 16 nt, Human
aaaauaaaaaagaucc

SEQ ID NO: 3648028 - RNA, 21 nt, Human
aaaauaaaaaagaucccaaau

SEQ ID NO: 3648029 - RNA, 11 nt, Human
aaaauaaaaac

SEQ ID NO: 3648030 - RNA, 21 nt, Human
aaaauaaaaacccacaaaaau

SEQ ID NO: 3648031 - RNA, 18 nt, Human
aaaauaaaaacuauucga

SEQ ID NO: 3648032 - RNA, 21 nt, Human
aaaauaaaaagcgggcacggg

SEQ ID NO: 3648033 - RNA, 12 nt, Human
aaaauaaaaagu

SEQ ID NO: 3648034 - RNA, 13 nt, Human
aaaauaaaaaguu

SEQ ID NO: 3648035 - RNA, 13 nt, Human
aaaauaaaaaugg

SEQ ID NO: 3648036 - RNA, 13 nt, Human
aaaauaaaacaaa

SEQ ID NO: 3648037 - RNA, 13 nt, Human
aaaauaaaacaua

SEQ ID NO: 3648038 - RNA, 13 nt, Human
aaaauaaaacauu

SEQ ID NO: 3648039 - RNA, 12 nt, Human
aaaauaaaacug

SEQ ID NO: 3648040 - RNA, 17 nt, Human
aaaauaaaacuuuuuaa

SEQ ID NO: 3648041 - RNA, 15 nt, Human
aaaauaaaaggucua

SEQ ID NO: 3648042 - RNA, 13 nt, Human
aaaauaaaauuaa

SEQ ID NO: 3648043 - RNA, 20 nt, Human
aaaauaaacaggucaaugaa

SEQ ID NO: 3648044 - RNA, 21 nt, Human
aaaauaaacuauaaaacaaaa

SEQ ID NO: 3648045 - RNA, 20 nt, Human
aaaauaaagacaaccauauu

SEQ ID NO: 3648046 - RNA, 12 nt, Human
aaaauaaauaaa

SEQ ID NO: 3648047 - RNA, 20 nt, Human
aaaauaaauagcuuaaaauu

SEQ ID NO: 3648048 - RNA, 11 nt, Human
aaaauaaauau

SEQ ID NO: 3648049 - RNA, 14 nt, Human
aaaauaaauauaua

SEQ ID NO: 3648050 - RNA, 15 nt, Human
aaaauaaauauauau

SEQ ID NO: 3648051 - RNA, 12 nt, Human
aaaauaaauuau

SEQ ID NO: 3648052 - RNA, 12 nt, Human
aaaauaaauuga

SEQ ID NO: 3648053 - RNA, 14 nt, Human
aaaauaacacacau

SEQ ID NO: 3648054 - RNA, 20 nt, Human
aaaauaacccuuugguuuuu

SEQ ID NO: 3648055 - RNA, 19 nt, Human
aaaauaaccggauauauac

SEQ ID NO: 3648056 - RNA, 18 nt, Human
aaaauaaccuugcagaag

SEQ ID NO: 3648057 - RNA, 13 nt, Human
aaaauaacuguaa

SEQ ID NO: 3648058 - RNA, 14 nt, Human
aaaauaacuguaau

SEQ ID NO: 3648059 - RNA, 14 nt, Human
aaaauaagaaaaga

SEQ ID NO: 3648060 - RNA, 13 nt, Human
aaaauaagugaau

SEQ ID NO: 3648061 - RNA, 12 nt, Human
aaaauaauaauu

SEQ ID NO: 3648062 - RNA, 21 nt, Human
aaaauaaucuauuucuaugag

SEQ ID NO: 3648063 - RNA, 23 nt, Human
aaaauaaucuauuucuaugagaa

SEQ ID NO: 3648064 - RNA, 18 nt, Human
aaaauaaugucuuguuaa

SEQ ID NO: 3648065 - RNA, 19 nt, Human
aaaauaauuauuuauuaca

SEQ ID NO: 3648066 - RNA, 22 nt, Human
aaaauaauugauuucaagaccu

SEQ ID NO: 3648067 - RNA, 17 nt, Human
aaaauaauuucucuaca

SEQ ID NO: 3648068 - RNA, 18 nt, Human
aaaauaauuuuaaaaaug

SEQ ID NO: 3648069 - RNA, 18 nt, Human
aaaauaauuuuaugaacu

SEQ ID NO: 3648070 - RNA, 13 nt, Human
aaaauaauuuugu

SEQ ID NO: 3648071 - RNA, 21 nt, Human
aaaauaauuuuuauauuugaa

SEQ ID NO: 3648072 - RNA, 16 nt, Human
aaaauacaaaaauuug

SEQ ID NO: 3648073 - RNA, 17 nt, Human
aaaauacaaaaauuugc

SEQ ID NO: 3648074 - RNA, 14 nt, Human
aaaauacaagacug

SEQ ID NO: 3648075 - RNA, 15 nt, Human
aaaauacaauaaacu

SEQ ID NO: 3648076 - RNA, 14 nt, Human
aaaauaccagccag

SEQ ID NO: 3648077 - RNA, 16 nt, Human
aaaauaccucaggaaa

SEQ ID NO: 3648078 - RNA, 20 nt, Human
aaaauaccucaggaaagaau

SEQ ID NO: 3648079 - RNA, 15 nt, Human
aaaauacuauucuga

SEQ ID NO: 3648080 - RNA, 21 nt, Human
aaaauacuauuuaagauguga

SEQ ID NO: 3648081 - RNA, 22 nt, Human
aaaauacuauuuaagaugugaa

SEQ ID NO: 3648082 - RNA, 17 nt, Human
aaaauacucuaauucua

SEQ ID NO: 3648083 - RNA, 20 nt, Human
aaaauacucuaauucuaacc

SEQ ID NO: 3648084 - RNA, 23 nt, Human
aaaauacucuaauucuaaccaga

SEQ ID NO: 3648085 - RNA, 15 nt, Human
aaaauacuguagaua

SEQ ID NO: 3648086 - RNA, 12 nt, Human
aaaauacuucuu

SEQ ID NO: 3648087 - RNA, 18 nt, Human
aaaauacuuugaguuuug

SEQ ID NO: 3648088 - RNA, 11 nt, Human
aaaauacuuuu

SEQ ID NO: 3648089 - RNA, 22 nt, Human
aaaauacuuuuacucugccuac

SEQ ID NO: 3648090 - RNA, 15 nt, Human
aaaauacuuuuccuu

SEQ ID NO: 3648091 - RNA, 15 nt, Human
aaaauagaaaaguua

SEQ ID NO: 3648092 - RNA, 21 nt, Human
aaaauagaaauuuuguaagaa

SEQ ID NO: 3648093 - RNA, 15 nt, Human
aaaauagaagcugua

SEQ ID NO: 3648094 - RNA, 17 nt, Human
aaaauagagaugagcuu

SEQ ID NO: 3648095 - RNA, 23 nt, Human
auuagugauauuucucuaguagu

SEQ ID NO: 3648096 - RNA, 21 nt, Human
auuagugccacuuaauguaug

SEQ ID NO: 3648097 - RNA, 22 nt, Human
auuagugccacuuaauguaugu

SEQ ID NO: 3648098 - RNA, 22 nt, Human
auuagugccagaauuuuaggaa

SEQ ID NO: 3648099 - RNA, 19 nt, Human
auuaguuccccaaauacaa

SEQ ID NO: 3648100 - RNA, 20 nt, Human
auuaguuccccaaauacaaa

SEQ ID NO: 3648101 - RNA, 17 nt, Human
auuaguucuauuucuau

SEQ ID NO: 3648102 - RNA, 13 nt, Human
auuaguugcuuug

SEQ ID NO: 3648103 - RNA, 13 nt, Human
auuaguuuagaac

SEQ ID NO: 3648104 - RNA, 17 nt, Human
auuaguuuagaacaggu

SEQ ID NO: 3648105 - RNA, 18 nt, Human
auuaguuuccuuuuuaau

SEQ ID NO: 3648106 - RNA, 15 nt, Human
auuaguuuucuuguu

SEQ ID NO: 3648107 - RNA, 21 nt, Human
auuaguuuucuuguugcuuug

SEQ ID NO: 3648108 - RNA, 11 nt, Human
auuauaaaaau

SEQ ID NO: 3648109 - RNA, 18 nt, Human
auuauaaaggauaaagaa

SEQ ID NO: 3648110 - RNA, 17 nt, Human
auuauaaauauauauaa

SEQ ID NO: 3648111 - RNA, 19 nt, Human
auuauaaauauauauaaag

SEQ ID NO: 3648112 - RNA, 15 nt, Human
auuauaaaugacaac

SEQ ID NO: 3648113 - RNA, 15 nt, Human
auuauaaauuauguu

SEQ ID NO: 3648114 - RNA, 14 nt, Human
auuauaaccuuaau

SEQ ID NO: 3648115 - RNA, 17 nt, Human
auuauaacuggaaagaa

SEQ ID NO: 3648116 - RNA, 16 nt, Human
auuauaacuuaaaaua

SEQ ID NO: 3648117 - RNA, 22 nt, Human
auuauaacuugucuaaauaagu

SEQ ID NO: 3648118 - RNA, 18 nt, Human
auuauaagcauugaaauu

SEQ ID NO: 3648119 - RNA, 15 nt, Human
auuauaaggacugca

SEQ ID NO: 3648120 - RNA, 18 nt, Human
auuauaaggacugcaugg

SEQ ID NO: 3648121 - RNA, 23 nt, Human
auuauaagggcaaauuggagaaa

SEQ ID NO: 3648122 - RNA, 15 nt, Human
auuauaagucacaaa

SEQ ID NO: 3648123 - RNA, 19 nt, Human
auuauaauaaauauauaca

SEQ ID NO: 3648124 - RNA, 14 nt, Human
auuauaauguauuc

SEQ ID NO: 3648125 - RNA, 19 nt, Human
auuauaauguauucauauu

SEQ ID NO: 3648126 - RNA, 21 nt, Human
auuauaauguauucauauuug

SEQ ID NO: 3648127 - RNA, 15 nt, Human
auuauaauuguugca

SEQ ID NO: 3648128 - RNA, 15 nt, Human
auuauaauuuaaugc

SEQ ID NO: 3648129 - RNA, 13 nt, Human
auuauacaggaaa

SEQ ID NO: 3648130 - RNA, 16 nt, Human
auuauaccaaaauguu

SEQ ID NO: 3648131 - RNA, 19 nt, Human
auuauaccaaaauguugcu

SEQ ID NO: 3648132 - RNA, 14 nt, Human
auuauacgcuggca

SEQ ID NO: 3648133 - RNA, 12 nt, Human
auuauacuguau

SEQ ID NO: 3648134 - RNA, 18 nt, Human
auuauacuguauuaagag

SEQ ID NO: 3648135 - RNA, 13 nt, Human
auuauacugugug

SEQ ID NO: 3648136 - RNA, 20 nt, Human
auuauacuuguaauuaugga

SEQ ID NO: 3648137 - RNA, 17 nt, Human
auuauagagcagaaauu

SEQ ID NO: 3648138 - RNA, 14 nt, Human
auuauagauucuaa

SEQ ID NO: 3648139 - RNA, 17 nt, Human
auuauagauucuaaaga

SEQ ID NO: 3648140 - RNA, 21 nt, Human
auuauagcucuaauguuugca

SEQ ID NO: 3648141 - RNA, 23 nt, Human
auuauagcucuaauguuugcaua

SEQ ID NO: 3648142 - RNA, 21 nt, Human
auuauaggaauaucaauauaa

SEQ ID NO: 3648143 - RNA, 17 nt, Human
auuauaggaucauuugu

SEQ ID NO: 3648144 - RNA, 16 nt, Human
auuauaggccaaacug

SEQ ID NO: 3648145 - RNA, 14 nt, Human
auuauaguguagaa

SEQ ID NO: 3648146 - RNA, 15 nt, Human
auuauaguguagaaa

SEQ ID NO: 3648147 - RNA, 16 nt, Human
auuauaguuucugagg

SEQ ID NO: 3648148 - RNA, 14 nt, Human
auuauauaaguauu

SEQ ID NO: 3648149 - RNA, 20 nt, Human
auuauauacauacugcaucu

SEQ ID NO: 3648150 - RNA, 17 nt, Human
auuauauagcaguaaaa

SEQ ID NO: 3648151 - RNA, 12 nt, Human
auuauauauaua

SEQ ID NO: 3648152 - RNA, 17 nt, Human
auuauauauauaauaua

SEQ ID NO: 3648153 - RNA, 16 nt, Human
auuauaucaagguaaa

SEQ ID NO: 3648154 - RNA, 20 nt, Human
auuauaucugaggaauucug

SEQ ID NO: 3648155 - RNA, 23 nt, Human
auuauauggagacgcuaagaaau

SEQ ID NO: 3648156 - RNA, 20 nt, Human
auuauauggcuugaguuuaa

SEQ ID NO: 3648157 - RNA, 16 nt, Human
auuauauucauucuuu

SEQ ID NO: 3648158 - RNA, 21 nt, Human
auuauauugagacaaaaauua

SEQ ID NO: 3648159 - RNA, 14 nt, Human
auuauauugcaaug

SEQ ID NO: 3648160 - RNA, 18 nt, Human
auuauauuuauuacugua

SEQ ID NO: 3648161 - RNA, 21 nt, Human
auuaucaaguagacuacuguu

SEQ ID NO: 3648162 - RNA, 15 nt, Human
auuaucaauaucuaa

SEQ ID NO: 3648163 - RNA, 19 nt, Human
auuaucaauuaccacacca

SEQ ID NO: 3648164 - RNA, 16 nt, Human
auuaucagcaaagaaa

SEQ ID NO: 3648165 - RNA, 17 nt, Human
auuaucauguguaauca

SEQ ID NO: 3648166 - RNA, 16 nt, Human
cagagacaccugcacc

SEQ ID NO: 3648167 - RNA, 18 nt, Human
cagagacaccugcaccuc

SEQ ID NO: 3648168 - RNA, 20 nt, Human
cagagacaccugcaccuccc

SEQ ID NO: 3648169 - RNA, 22 nt, Human
cagagacaccugcaccuccccc

SEQ ID NO: 3648170 - RNA, 16 nt, Human
cagagacagaaagcag

SEQ ID NO: 3648171 - RNA, 14 nt, Human
cagagacagcugau

SEQ ID NO: 3648172 - RNA, 21 nt, Human
cagagacagcugauacuucau

SEQ ID NO: 3648173 - RNA, 14 nt, Human
cagagacaggaaaa

SEQ ID NO: 3648174 - RNA, 21 nt, Human
cagagacaggaaaauccucug

SEQ ID NO: 3648175 - RNA, 23 nt, Human
cagagacaggaaaauccucuggc

SEQ ID NO: 3648176 - RNA, 16 nt, Human
cagagacauacuugaa

SEQ ID NO: 3648177 - RNA, 19 nt, Human
cagagacauuccuccgagc

SEQ ID NO: 3648178 - RNA, 13 nt, Human
cagagaccagggc

SEQ ID NO: 3648179 - RNA, 21 nt, Human
cagagaccagggcuccagccc

SEQ ID NO: 3648180 - RNA, 12 nt, Human
cagagacccagc

SEQ ID NO: 3648181 - RNA, 15 nt, Human
cagagacccagcgga

SEQ ID NO: 3648182 - RNA, 22 nt, Human
cagagacccagcggacacacgc

SEQ ID NO: 3648183 - RNA, 16 nt, Human
cagagaccguccucac

SEQ ID NO: 3648184 - RNA, 16 nt, Human
cagagaccuccugccu

SEQ ID NO: 3648185 - RNA, 17 nt, Human
cagagaccuuccagaaa

SEQ ID NO: 3648186 - RNA, 21 nt, Human
cagagacucagggccccagca

SEQ ID NO: 3648187 - RNA, 23 nt, Human
cagagacucagggccccagcacu

SEQ ID NO: 3648188 - RNA, 13 nt, Human
cagagacuccugc

SEQ ID NO: 3648189 - RNA, 16 nt, Human
cagagacuccugcagg

SEQ ID NO: 3648190 - RNA, 21 nt, Human
cagagacuccugcaggcagcc

SEQ ID NO: 3648191 - RNA, 22 nt, Human
cagagacuccugcaggcagcca

SEQ ID NO: 3648192 - RNA, 19 nt, Human
cagagagaagagccccacu

SEQ ID NO: 3648193 - RNA, 23 nt, Human
cagagagaagagccccacucuca

SEQ ID NO: 3648194 - RNA, 11 nt, Human
cagagagacag

SEQ ID NO: 3648195 - RNA, 15 nt, Human
cagagagacagacuu

SEQ ID NO: 3648196 - RNA, 17 nt, Human
cagagagacagacuuga

SEQ ID NO: 3648197 - RNA, 12 nt, Human
cagagagaccga

SEQ ID NO: 3648198 - RNA, 21 nt, Human
cagagagagaagugccccugc

SEQ ID NO: 3648199 - RNA, 22 nt, Human
cagagagagaagugccccugcu

SEQ ID NO: 3648200 - RNA, 13 nt, Human
cagagagagagaa

SEQ ID NO: 3648201 - RNA, 20 nt, Human
cagagagcaacucugagauc

SEQ ID NO: 3648202 - RNA, 14 nt, Human
cagagagcagugcu

SEQ ID NO: 3648203 - RNA, 15 nt, Human
cagagagccauuuug

SEQ ID NO: 3648204 - RNA, 23 nt, Human
cagagagccauuuugugaaugga

SEQ ID NO: 3648205 - RNA, 18 nt, Human
cagagagcggucucaggc

SEQ ID NO: 3648206 - RNA, 13 nt, Human
cagagaggaauca

SEQ ID NO: 3648207 - RNA, 18 nt, Human
cagagaggacgugggcgg

SEQ ID NO: 3648208 - RNA, 16 nt, Human
cagagaggagaaacac

SEQ ID NO: 3648209 - RNA, 22 nt, Human
cagagaggagaaacacaucuuc

SEQ ID NO: 3648210 - RNA, 17 nt, Human
cagagaggagucagaga

SEQ ID NO: 3648211 - RNA, 20 nt, Human
cagagaggccuuuuggaaug

SEQ ID NO: 3648212 - RNA, 14 nt, Human
cagagagggcaggc

SEQ ID NO: 3648213 - RNA, 15 nt, Human
cagagagggcaggca

SEQ ID NO: 3648214 - RNA, 17 nt, Human
cagagagggugacaaga

SEQ ID NO: 3648215 - RNA, 22 nt, Human
cagagagggugggagugggccc

SEQ ID NO: 3648216 - RNA, 17 nt, Human
cagagaggguggugacc

SEQ ID NO: 3648217 - RNA, 20 nt, Human
cagagagguuaaggugggua

SEQ ID NO: 3648218 - RNA, 20 nt, Human
cagagagguuugcaguccca

SEQ ID NO: 3648219 - RNA, 18 nt, Human
cagagaguccucuggaug

SEQ ID NO: 3648220 - RNA, 16 nt, Human
cagagauaaagaccuu

SEQ ID NO: 3648221 - RNA, 22 nt, Human
cagagauaguggggagacuucu

SEQ ID NO: 3648222 - RNA, 20 nt, Human
cagagauccaaaagaagccc

SEQ ID NO: 3648223 - RNA, 21 nt, Human
cagagauccaaaagaagcccc

SEQ ID NO: 3648224 - RNA, 13 nt, Human
cagagaugccucc

SEQ ID NO: 3648225 - RNA, 18 nt, Human
cagagaugccuccaccgc

SEQ ID NO: 3648226 - RNA, 14 nt, Human
cagagaugccuccc

SEQ ID NO: 3648227 - RNA, 16 nt, Human
cagagaugccucccug

SEQ ID NO: 3648228 - RNA, 18 nt, Human
cagagaugggacugggag

SEQ ID NO: 3648229 - RNA, 20 nt, Human
cagagauggucauauuuaaa

SEQ ID NO: 3648230 - RNA, 14 nt, Human
cagagaugugcacc

SEQ ID NO: 3648231 - RNA, 16 nt, Human
cagagaugugcaccca

SEQ ID NO: 3648232 - RNA, 14 nt, Human
cagagauucauuuu

SEQ ID NO: 3648233 - RNA, 19 nt, Human
cagagauucauuuucuaga

SEQ ID NO: 3648234 - RNA, 22 nt, Human
cagagauuggaaugggcagcuc

SEQ ID NO: 3648235 - RNA, 19 nt, Human
cagagauuuauauaaaugu

SEQ ID NO: 3648236 - RNA, 20 nt, Human
cagagauuucucauugacuu

SEQ ID NO: 3648237 - RNA, 15 nt, Human
cagagcaaccccugg

SEQ ID NO: 3648238 - RNA, 23 nt, Human
cagagcaaccccuggaccccagc

SEQ ID NO: 3648239 - RNA, 23 nt, Human
cagauuggauuuuauguugacau

SEQ ID NO: 3648240 - RNA, 17 nt, Human
cagauuggcucacacug

SEQ ID NO: 3648241 - RNA, 20 nt, Human
cagauuggcucacacugaga

SEQ ID NO: 3648242 - RNA, 20 nt, Human
cagauuguggaauguuggau

SEQ ID NO: 3648243 - RNA, 17 nt, Human
cagauuguuucuauaca

SEQ ID NO: 3648244 - RNA, 13 nt, Human
cagauuguuugca

SEQ ID NO: 3648245 - RNA, 17 nt, Human
cagauuuagugaaagcu

SEQ ID NO: 3648246 - RNA, 16 nt, Human
cagauuuauuccuuug

SEQ ID NO: 3648247 - RNA, 13 nt, Human
cagauuucacucu

SEQ ID NO: 3648248 - RNA, 18 nt, Human
cagauuucacucuccuug

SEQ ID NO: 3648249 - RNA, 16 nt, Human
cagauuuccagucucc

SEQ ID NO: 3648250 - RNA, 14 nt, Human
cagauuucugagga

SEQ ID NO: 3648251 - RNA, 15 nt, Human
cagauuucugaggaa

SEQ ID NO: 3648252 - RNA, 13 nt, Human
cagauuugcacaa

SEQ ID NO: 3648253 - RNA, 14 nt, Human
cagauuugcacaaa

SEQ ID NO: 3648254 - RNA, 20 nt, Human
cagauuugcacaaaaagaua

SEQ ID NO: 3648255 - RNA, 14 nt, Human
cagauuugucuuuu

SEQ ID NO: 3648256 - RNA, 15 nt, Human
cagauuugugaacuc

SEQ ID NO: 3648257 - RNA, 16 nt, Human
cagauuugugaacuca

SEQ ID NO: 3648258 - RNA, 22 nt, Human
cagauuuuaaaaagucuucacu

SEQ ID NO: 3648259 - RNA, 15 nt, Human
cagauuuuaauuguc

SEQ ID NO: 3648260 - RNA, 15 nt, Human
cagauuuuauuaugu

SEQ ID NO: 3648261 - RNA, 18 nt, Human
cagauuuuauuauguaaa

SEQ ID NO: 3648262 - RNA, 20 nt, Human
cagauuuuauuauguaaauc

SEQ ID NO: 3648263 - RNA, 15 nt, Human
cagauuuucagcaaa

SEQ ID NO: 3648264 - RNA, 19 nt, Human
cagauuuucagcaaacucu

SEQ ID NO: 3648265 - RNA, 15 nt, Human
cagauuuuccugaaa

SEQ ID NO: 3648266 - RNA, 12 nt, Human
cagauuuugaua

SEQ ID NO: 3648267 - RNA, 15 nt, Human
cagauuuugauaacu

SEQ ID NO: 3648268 - RNA, 18 nt, Human
cagauuuugauagcaaag

SEQ ID NO: 3648269 - RNA, 17 nt, Human
cagauuuuggccaugaa

SEQ ID NO: 3648270 - RNA, 21 nt, Human
cagauuuugggguuguguugu

SEQ ID NO: 3648271 - RNA, 17 nt, Human
cagauuuuucggaggcc

SEQ ID NO: 3648272 - RNA, 23 nt, Human
cagauuuuuugaaccauccacuu

SEQ ID NO: 3648273 - RNA, 20 nt, Human
cagcaaaaagcaaaaucauu

SEQ ID NO: 3648274 - RNA, 14 nt, Human
cagcaaaaauauaa

SEQ ID NO: 3648275 - RNA, 13 nt, Human
cagcaaaaccauu

SEQ ID NO: 3648276 - RNA, 17 nt, Human
cagcaaaaccauugcuu

SEQ ID NO: 3648277 - RNA, 19 nt, Human
cagcaaaaccauugcuuca

SEQ ID NO: 3648278 - RNA, 18 nt, Human
cagcaaaagaugcuucuc

SEQ ID NO: 3648279 - RNA, 14 nt, Human
cagcaaacaggugc

SEQ ID NO: 3648280 - RNA, 20 nt, Human
cagcaaacucuuuucccacu

SEQ ID NO: 3648281 - RNA, 13 nt, Human
cagcaaagcccca

SEQ ID NO: 3648282 - RNA, 14 nt, Human
cagcaaagccccca

SEQ ID NO: 3648283 - RNA, 17 nt, Human
cagcaaagcccccagag

SEQ ID NO: 3648284 - RNA, 14 nt, Human
cagcaaaggaaacu

SEQ ID NO: 3648285 - RNA, 23 nt, Human
cagcaaaggaaacuuugcagaug

SEQ ID NO: 3648286 - RNA, 14 nt, Human
cagcaaagugguuc

SEQ ID NO: 3648287 - RNA, 16 nt, Human
cagcaaauccuuugug

SEQ ID NO: 3648288 - RNA, 17 nt, Human
cagcaaauuaauuggca

SEQ ID NO: 3648289 - RNA, 19 nt, Human
cagcaaauuuauaauuuua

SEQ ID NO: 3648290 - RNA, 14 nt, Human
cagcaacaauaaau

SEQ ID NO: 3648291 - RNA, 20 nt, Human
cagcaacaauaaauagacac

SEQ ID NO: 3648292 - RNA, 16 nt, Human
cagcaacacaagcugg

SEQ ID NO: 3648293 - RNA, 17 nt, Human
cagcaacacaagcugga

SEQ ID NO: 3648294 - RNA, 21 nt, Human
cagcaacacaagcuggaagca

SEQ ID NO: 3648295 - RNA, 16 nt, Human
cagcaacacagccugg

SEQ ID NO: 3648296 - RNA, 14 nt, Human
cagcaacagaaaaa

SEQ ID NO: 3648297 - RNA, 15 nt, Human
cagcaaccagagcac

SEQ ID NO: 3648298 - RNA, 20 nt, Human
cagcaaccagagcacuguau

SEQ ID NO: 3648299 - RNA, 13 nt, Human
cagcaaccccagg

SEQ ID NO: 3648300 - RNA, 17 nt, Human
cagcaaccccaggcuga

SEQ ID NO: 3648301 - RNA, 13 nt, Human
cagcaaccuguaa

SEQ ID NO: 3648302 - RNA, 19 nt, Human
cagcaaccuguaagacuga

SEQ ID NO: 3648303 - RNA, 20 nt, Human
cagcaacgaucacaaaugac

SEQ ID NO: 3648304 - RNA, 22 nt, Human
cagcaacgaucacaaaugacuu

SEQ ID NO: 3648305 - RNA, 20 nt, Human
cagcaacuaucagacuaagc

SEQ ID NO: 3648306 - RNA, 21 nt, Human
cagcaacuaucagacuaagcc

SEQ ID NO: 3648307 - RNA, 12 nt, Human
cagcaacugaau

SEQ ID NO: 3648308 - RNA, 14 nt, Human
cagcaacugaauaa

SEQ ID NO: 3648309 - RNA, 20 nt, Human
cagcaacugaauaaauaccu

SEQ ID NO: 3648310 - RNA, 21 nt, Human
cagcaacugaauaaauaccuc

SEQ ID NO: 3648311 - RNA, 20 nt, Human
cagcaacuucuucuccaucc

SEQ ID NO: 3648312 - RNA, 17 nt, Human
cagcaacuuguccuagc

SEQ ID NO: 3648313 - RNA, 20 nt, Human
cagcaacuugucuuuuucug

SEQ ID NO: 3648314 - RNA, 21 nt, Human
cagcaagaaaaaaaaaugcca

SEQ ID NO: 3648315 - RNA, 16 nt, Human
cagcaagaauaaaaaa

SEQ ID NO: 3648316 - RNA, 12 nt, Human
cagcaagagaga

SEQ ID NO: 3648317 - RNA, 15 nt, Human
cagcaagagagaacc

SEQ ID NO: 3648318 - RNA, 17 nt, Human
cagcaagagagaaccua

SEQ ID NO: 3648319 - RNA, 20 nt, Human
cagcaaggaggcuggcuggg

SEQ ID NO: 3648320 - RNA, 21 nt, Human
cagcaaggaggcuggcugggg

SEQ ID NO: 3648321 - RNA, 23 nt, Human
cagcaaggcaccugcagguuggg

SEQ ID NO: 3648322 - RNA, 16 nt, Human
cagcaaggcccgagca

SEQ ID NO: 3648323 - RNA, 21 nt, Human
cagcaaggcccgagcagcuga

SEQ ID NO: 3648324 - RNA, 23 nt, Human
cagcaaggcccgagcagcugagc

SEQ ID NO: 3648325 - RNA, 12 nt, Human
cagcaaggcccu

SEQ ID NO: 3648326 - RNA, 19 nt, Human
cagcaagggugaugggaaa

SEQ ID NO: 3648327 - RNA, 15 nt, Human
cagcaaggucuugcu

SEQ ID NO: 3648328 - RNA, 14 nt, Human
cagcaagugagagc

SEQ ID NO: 3648329 - RNA, 20 nt, Human
cagcaaguuagagaaucugg

SEQ ID NO: 3648330 - RNA, 21 nt, Human
cagcaauaaagcagcguuucu

SEQ ID NO: 3648331 - RNA, 22 nt, Human
cagcaauaaagcagcguuucua

SEQ ID NO: 3648332 - RNA, 15 nt, Human
cagcaauagagacgg

SEQ ID NO: 3648333 - RNA, 19 nt, Human
cagcaauauauuaccagca

SEQ ID NO: 3648334 - RNA, 22 nt, Human
cagcaauauauuaccagcaaga

SEQ ID NO: 3648335 - RNA, 13 nt, Human
cagcaauauuuaa

SEQ ID NO: 3648336 - RNA, 18 nt, Human
cagcaaugauguccagaa

SEQ ID NO: 3648337 - RNA, 15 nt, Human
cagcaauucuccugc

SEQ ID NO: 3648338 - RNA, 16 nt, Human
cagcaauucuccugcc

SEQ ID NO: 3648339 - RNA, 17 nt, Human
cagcaauucuccugccu

SEQ ID NO: 3648340 - RNA, 18 nt, Human
cagcaauucuccugccuc

SEQ ID NO: 3648341 - RNA, 19 nt, Human
cagcaauucuccugccuca

SEQ ID NO: 3648342 - RNA, 20 nt, Human
cagcaauucuccugccucag

SEQ ID NO: 3648343 - RNA, 14 nt, Human
cagcacaaacacaa

SEQ ID NO: 3648344 - RNA, 15 nt, Human
cagcacaaacacaag

SEQ ID NO: 3648345 - RNA, 19 nt, Human
cagcacaaggaaauaaaau

SEQ ID NO: 3648346 - RNA, 14 nt, Human
cagcacacagggca

SEQ ID NO: 3648347 - RNA, 16 nt, Human
cagcacagagaagaca

SEQ ID NO: 3648348 - RNA, 17 nt, Human
cagcacagagaagacaa

SEQ ID NO: 3648349 - RNA, 20 nt, Human
cagcacagagagggggccac

SEQ ID NO: 3648350 - RNA, 19 nt, Human
cagcacagcaaggaggcug

SEQ ID NO: 3648351 - RNA, 13 nt, Human
cagcacagccaac

SEQ ID NO: 3648352 - RNA, 17 nt, Human
cagcacagcuuagauuu

SEQ ID NO: 3648353 - RNA, 16 nt, Human
cagcacagcuugaccu

SEQ ID NO: 3648354 - RNA, 20 nt, Human
cagcacagcuugaccugagg

SEQ ID NO: 3648355 - RNA, 22 nt, Human
cagcacagcuugaccugaggcu

SEQ ID NO: 3648356 - RNA, 16 nt, Human
cagcacaggagggcgg

SEQ ID NO: 3648357 - RNA, 14 nt, Human
cagcacauauuuuc

SEQ ID NO: 3648358 - RNA, 16 nt, Human
cagcacaucucaacag

SEQ ID NO: 3648359 - RNA, 16 nt, Human
cagcacaugcuggcca

SEQ ID NO: 3648360 - RNA, 17 nt, Human
cagcacaugcuggccag

SEQ ID NO: 3648361 - RNA, 21 nt, Human
cagcaccaccaggucucccgg

SEQ ID NO: 3648362 - RNA, 17 nt, Human
cagcaccacccuccuuc

SEQ ID NO: 3648363 - RNA, 19 nt, Human
cagcaccacccuccuuccc

SEQ ID NO: 3648364 - RNA, 20 nt, Human
cagcaccauccgccagggcc

SEQ ID NO: 3648365 - RNA, 22 nt, Human
cagcacccccuucucugcccau

SEQ ID NO: 3648366 - RNA, 13 nt, Human
cagcaccccuucc

SEQ ID NO: 3648367 - RNA, 14 nt, Human
cagcaccccuucca

SEQ ID NO: 3648368 - RNA, 13 nt, Human
cagcaccgccucu

SEQ ID NO: 3648369 - RNA, 15 nt, Human
cagcaccggaccagc

SEQ ID NO: 3648370 - RNA, 20 nt, Human
cagcaccggaccagccuggc

SEQ ID NO: 3648371 - RNA, 21 nt, Human
cagcaccggaccagccuggcc

SEQ ID NO: 3648372 - RNA, 16 nt, Human
cagcaccguucugugc

SEQ ID NO: 3648373 - RNA, 17 nt, Human
cagcaccguucugugca

SEQ ID NO: 3648374 - RNA, 22 nt, Human
auucauggaccacuguuucuug

SEQ ID NO: 3648375 - RNA, 20 nt, Human
auucauggcaugcuuaaauu

SEQ ID NO: 3648376 - RNA, 12 nt, Human
auucauguuucu

SEQ ID NO: 3648377 - RNA, 15 nt, Human
auucauuagcuguga

SEQ ID NO: 3648378 - RNA, 16 nt, Human
auucauuauuugucaa

SEQ ID NO: 3648379 - RNA, 20 nt, Human
auucauuauuuuuccacuuu

SEQ ID NO: 3648380 - RNA, 22 nt, Human
auucauucucauaauuccuaca

SEQ ID NO: 3648381 - RNA, 19 nt, Human
auucauucuggucucucua

SEQ ID NO: 3648382 - RNA, 15 nt, Human
auucauucuuuuuga

SEQ ID NO: 3648383 - RNA, 20 nt, Human
auucauugugguuauuuuua

SEQ ID NO: 3648384 - RNA, 12 nt, Human
cagcauucccag

SEQ ID NO: 3648385 - RNA, 13 nt, Human
cagcauucccagg

SEQ ID NO: 3648386 - RNA, 14 nt, Human
cagcauucccaggu

SEQ ID NO: 3648387 - RNA, 15 nt, Human
cagcauucucacucc

SEQ ID NO: 3648388 - RNA, 22 nt, Human
auucguagauauuggacaaaga

SEQ ID NO: 3648389 - RNA, 12 nt, Human
auucgugaaaac

SEQ ID NO: 3648390 - RNA, 23 nt, Human
auucguggugaucaauuaaaugu

SEQ ID NO: 3648391 - RNA, 22 nt, Human
auucguuguguuuuuuaagaua

SEQ ID NO: 3648392 - RNA, 14 nt, Human
auucuaaaaugccu

SEQ ID NO: 3648393 - RNA, 15 nt, Human
auucuaaagauucua

SEQ ID NO: 3648394 - RNA, 19 nt, Human
auucuaaagauucuauagu

SEQ ID NO: 3648395 - RNA, 12 nt, Human
auucuaaaugua

SEQ ID NO: 3648396 - RNA, 19 nt, Human
auucuaaccagagcaagcu

SEQ ID NO: 3648397 - RNA, 22 nt, Human
auucuaagacuuacucuaagau

SEQ ID NO: 3648398 - RNA, 14 nt, Human
auucuaauaagcua

SEQ ID NO: 3648399 - RNA, 13 nt, Human
auucuaaucuaac

SEQ ID NO: 3648400 - RNA, 23 nt, Human
auucuaaugaugaucaauuauag

SEQ ID NO: 3648401 - RNA, 12 nt, Human
auucuaaugucu

SEQ ID NO: 3648402 - RNA, 13 nt, Human
auucuaaugucuu

SEQ ID NO: 3648403 - RNA, 16 nt, Human
auucuaaugucuucau

SEQ ID NO: 3648404 - RNA, 12 nt, Human
auucuacuugcu

SEQ ID NO: 3648405 - RNA, 19 nt, Human
auucuacuugcucuggacc

SEQ ID NO: 3648406 - RNA, 20 nt, Human
auucuacuugcucuggaccu

SEQ ID NO: 3648407 - RNA, 20 nt, Human
auucuagaugcaagucucuu

SEQ ID NO: 3648408 - RNA, 15 nt, Human
auucuagcuuugagc

SEQ ID NO: 3648409 - RNA, 18 nt, Human
auucuaggccuccuggcc

SEQ ID NO: 3648410 - RNA, 24 nt, Human
auucuauaaaacucugcauguaga

SEQ ID NO: 3648411 - RNA, 15 nt, Human
auucuauaguucuag

SEQ ID NO: 3648412 - RNA, 16 nt, Human
auucuauaguucuaga

SEQ ID NO: 3648413 - RNA, 15 nt, Human
auucuauaugaauuu

SEQ ID NO: 3648414 - RNA, 16 nt, Human
auucuaucucucuuua

SEQ ID NO: 3648415 - RNA, 20 nt, Human
auucuaucuuuuguuuccuu

SEQ ID NO: 3648416 - RNA, 13 nt, Human
auucuauugccuu

SEQ ID NO: 3648417 - RNA, 18 nt, Human
auucuauugccuucuuug

SEQ ID NO: 3648418 - RNA, 19 nt, Human
auucuauugccuucuuuga

SEQ ID NO: 3648419 - RNA, 21 nt, Human
auucuauugccuucuuugaag

SEQ ID NO: 3648420 - RNA, 23 nt, Human
auucuauugccuucuuugaagaa

SEQ ID NO: 3648421 - RNA, 21 nt, Human
auucuauuucaacuucaggaa

SEQ ID NO: 3648422 - RNA, 16 nt, Human
auucuauuuuagaaua

SEQ ID NO: 3648423 - RNA, 14 nt, Human
auucucaaagcagg

SEQ ID NO: 3648424 - RNA, 17 nt, Human
auucucaaaggagcgag

SEQ ID NO: 3648425 - RNA, 15 nt, Human
auucucaagcccugc

SEQ ID NO: 3648426 - RNA, 20 nt, Human
auucucaagccgcaucccag

SEQ ID NO: 3648427 - RNA, 21 nt, Human
auucucaagccgcaucccaga

SEQ ID NO: 3648428 - RNA, 19 nt, Human
auucucacagcuccaagaa

SEQ ID NO: 3648429 - RNA, 15 nt, Human
auucucacuccacca

SEQ ID NO: 3648430 - RNA, 16 nt, Human
auucucacuccaccac

SEQ ID NO: 3648431 - RNA, 14 nt, Human
auucucagaaucuc

SEQ ID NO: 3648432 - RNA, 20 nt, Human
auucucagaaucucaaauaa

SEQ ID NO: 3648433 - RNA, 16 nt, Human
auucucagcagagugc

SEQ ID NO: 3648434 - RNA, 16 nt, Human
auucucagggucucug

SEQ ID NO: 3648435 - RNA, 20 nt, Human
auucucagggucucugcugc

SEQ ID NO: 3648436 - RNA, 22 nt, Human
auucucagggucucugcugccg

SEQ ID NO: 3648437 - RNA, 14 nt, Human
auucucagugccaa

SEQ ID NO: 3648438 - RNA, 15 nt, Human
auucucagugccaac

SEQ ID NO: 3648439 - RNA, 13 nt, Human
auucucaguuuuu

SEQ ID NO: 3648440 - RNA, 17 nt, Human
auucucauaauuccuac

SEQ ID NO: 3648441 - RNA, 18 nt, Human
auucucauaauuccuaca

SEQ ID NO: 3648442 - RNA, 19 nt, Human
auucucauaauuccuacag

SEQ ID NO: 3648443 - RNA, 20 nt, Human
auucucaucugcacccuucu

SEQ ID NO: 3648444 - RNA, 21 nt, Human
auucucaucugcacccuucuu

SEQ ID NO: 3648445 - RNA, 22 nt, Human
auucucaucugcacccuucuuu

SEQ ID NO: 3648446 - RNA, 22 nt, Human
auucucaugccucagccuccug

SEQ ID NO: 3648447 - RNA, 16 nt, Human
auucucauugcagaau

SEQ ID NO: 3648448 - RNA, 21 nt, Human
auucucauuggaaauuuagca

SEQ ID NO: 3648449 - RNA, 13 nt, Human
auucuccacagca

SEQ ID NO: 3648450 - RNA, 13 nt, Human
auucuccaccugc

SEQ ID NO: 3648451 - RNA, 13 nt, Human
auucuccacugug

SEQ ID NO: 3648452 - RNA, 23 nt, Human
auucuccagccaucaagagacug

SEQ ID NO: 3648453 - RNA, 21 nt, Human
auucucccagguaccagcugc

SEQ ID NO: 3648454 - RNA, 18 nt, Human
auucucccgggacucugc

SEQ ID NO: 3648455 - RNA, 15 nt, Human
auucucccuugcucu

SEQ ID NO: 3648456 - RNA, 11 nt, Human
auucuccuccu

SEQ ID NO: 3648457 - RNA, 20 nt, Human
auucuccugccucagccucc

SEQ ID NO: 3648458 - RNA, 19 nt, Human
auucuccuggaugcuuaga

SEQ ID NO: 3648459 - RNA, 13 nt, Human
auucuccuucagc

SEQ ID NO: 3648460 - RNA, 14 nt, Human
auucuccuucagcc

SEQ ID NO: 3648461 - RNA, 17 nt, Human
auucuccuucagcccuc

SEQ ID NO: 3648462 - RNA, 23 nt, Human
auucuccuucagcccucaccccu

SEQ ID NO: 3648463 - RNA, 16 nt, Human
auucuccuuguguuac

SEQ ID NO: 3648464 - RNA, 17 nt, Human
auucuccuuguguuacu

SEQ ID NO: 3648465 - RNA, 22 nt, Human
auucuccuuguguuacuaaguu

SEQ ID NO: 3648466 - RNA, 17 nt, Human
auucuccuuuuaugugu

SEQ ID NO: 3648467 - RNA, 19 nt, Human
auucuccuuuuauguguag

SEQ ID NO: 3648468 - RNA, 21 nt, Human
auucuccuuuuuaccccucua

SEQ ID NO: 3648469 - RNA, 17 nt, Human
auucucuaauaagaaaa

SEQ ID NO: 3648470 - RNA, 17 nt, Human
auucucuaguuugauua

SEQ ID NO: 3648471 - RNA, 20 nt, Human
auucucuaguuugauuaaau

SEQ ID NO: 3648472 - RNA, 20 nt, Human
auucucuauuugaauuauuu

SEQ ID NO: 3648473 - RNA, 22 nt, Human
auucucuauuugaauuauuucu

SEQ ID NO: 3648474 - RNA, 19 nt, Human
auucucuccaaaaaugcac

SEQ ID NO: 3648475 - RNA, 22 nt, Human
auucucuccucagacugcucaa

SEQ ID NO: 3648476 - RNA, 16 nt, Human
auucucuccuguaccu

SEQ ID NO: 3648477 - RNA, 12 nt, Human
auucucucuccu

SEQ ID NO: 3648478 - RNA, 15 nt, Human
auucucucuccuguc

SEQ ID NO: 3648479 - RNA, 17 nt, Human
auucucucuccugucca

SEQ ID NO: 3648480 - RNA, 21 nt, Human
auucucuggcuguaaggcucu

SEQ ID NO: 3648481 - RNA, 17 nt, Human
auucucuguacauauua

SEQ ID NO: 3648482 - RNA, 14 nt, Human
auucucugucucau

SEQ ID NO: 3648483 - RNA, 19 nt, Human
auucucugucucauccauc

SEQ ID NO: 3648484 - RNA, 21 nt, Human
auucucugugucuaagauucu

SEQ ID NO: 3648485 - RNA, 23 nt, Human
auucucugugucuaagauucuag

SEQ ID NO: 3648486 - RNA, 15 nt, Human
auucucuuauccaac

SEQ ID NO: 3648487 - RNA, 17 nt, Human
auucucuugccucagcu

SEQ ID NO: 3648488 - RNA, 14 nt, Human
auucucuuucaaag

SEQ ID NO: 3648489 - RNA, 20 nt, Human
auucucuuugguguacaaaa

SEQ ID NO: 3648490 - RNA, 19 nt, Human
auucucuuuuaucuguuua

SEQ ID NO: 3648491 - RNA, 17 nt, Human
auucugaagccauuguc

SEQ ID NO: 3648492 - RNA, 20 nt, Human
auucugaaguuauauuuccu

SEQ ID NO: 3648493 - RNA, 14 nt, Human
auucugaauuugca

SEQ ID NO: 3648494 - RNA, 17 nt, Human
auucugaauuugcaaag

SEQ ID NO: 3648495 - RNA, 20 nt, Human
auucugaauuugcaaaguac

SEQ ID NO: 3648496 - RNA, 20 nt, Human
auucugacucgguuucucca

SEQ ID NO: 3648497 - RNA, 14 nt, Human
auucugagaccaaa

SEQ ID NO: 3648498 - RNA, 14 nt, Human
auucugagagcugu

SEQ ID NO: 3648499 - RNA, 22 nt, Human
auucugaguuuuguguuuguug

SEQ ID NO: 3648500 - RNA, 14 nt, Human
auucugauuacaca

SEQ ID NO: 3648501 - RNA, 21 nt, Human
auucugauucgaaugacacug

SEQ ID NO: 3648502 - RNA, 14 nt, Human
auucugcaaguaua

SEQ ID NO: 3648503 - RNA, 20 nt, Human
auucugcaguaaaucuuuua

SEQ ID NO: 3648504 - RNA, 22 nt, Human
auucugcauugcuagauaaaag

SEQ ID NO: 3648505 - RNA, 13 nt, Human
auucugcccugug

SEQ ID NO: 3648506 - RNA, 20 nt, Human
auucugccgcccccuccuga

SEQ ID NO: 3648507 - RNA, 22 nt, Human
auucugccgcccccuccugaac

SEQ ID NO: 3648508 - RNA, 15 nt, Human
auucugccucucuag

SEQ ID NO: 3648509 - RNA, 16 nt, Human
auucugccucucuagg

SEQ ID NO: 3648510 - RNA, 13 nt, Human
auucugccugccc

SEQ ID NO: 3648511 - RNA, 15 nt, Human
auucugccugcccag

SEQ ID NO: 3648512 - RNA, 19 nt, Human
auucugccugcccaggccc

SEQ ID NO: 3648513 - RNA, 16 nt, Human
auucugccuuugccag

SEQ ID NO: 3648514 - RNA, 22 nt, Human
auucugcgucaugcuuguguua

SEQ ID NO: 3648515 - RNA, 19 nt, Human
auucugcucacauaucugu

SEQ ID NO: 3648516 - RNA, 20 nt, Human
auucugcucacauaucuguc

SEQ ID NO: 3648517 - RNA, 13 nt, Human
auucugcuggccu

SEQ ID NO: 3648518 - RNA, 18 nt, Human
auucugcuggccucugcg

SEQ ID NO: 3648519 - RNA, 19 nt, Human
auucugcuggccucugcga

SEQ ID NO: 3648520 - RNA, 14 nt, Human
auucugcugucuca

SEQ ID NO: 3648521 - RNA, 13 nt, Human
auucugcuugaga

SEQ ID NO: 3648522 - RNA, 15 nt, Human
auucuggacaggaug

SEQ ID NO: 3648523 - RNA, 18 nt, Human
auucuggacagucagcuc

SEQ ID NO: 3648524 - RNA, 22 nt, Human
auucuggacagucagcucuuca

SEQ ID NO: 3648525 - RNA, 12 nt, Human
auucuggaguca

SEQ ID NO: 3648526 - RNA, 14 nt, Human
auucuggccagacu

SEQ ID NO: 3648527 - RNA, 23 nt, Human
auucuggccuagucccuuccaca

SEQ ID NO: 3648528 - RNA, 22 nt, Human
cagauguuuuacgucugggaga

SEQ ID NO: 3648529 - RNA, 23 nt, Human
cagauguuuuggucaaguaguuu

SEQ ID NO: 3648530 - RNA, 14 nt, Human
cagauuacugccca

SEQ ID NO: 3648531 - RNA, 16 nt, Human
cagauuauuuuggaaa

SEQ ID NO: 3648532 - RNA, 13 nt, Human
cagauucaauuuu

SEQ ID NO: 3648533 - RNA, 14 nt, Human
cagauucacacugu

SEQ ID NO: 3648534 - RNA, 17 nt, Human
cagauucagaaaugagg

SEQ ID NO: 3648535 - RNA, 20 nt, Human
cagauucagucuugccuuac

SEQ ID NO: 3648536 - RNA, 14 nt, Human
cagauucccagagc

SEQ ID NO: 3648537 - RNA, 18 nt, Human
cagauucccagagcaaaa

SEQ ID NO: 3648538 - RNA, 14 nt, Human
cagauuccuuuccc

SEQ ID NO: 3648539 - RNA, 16 nt, Human
cagauuccuuucccuu

SEQ ID NO: 3648540 - RNA, 20 nt, Human
cagauuccuuucccuuuagc

SEQ ID NO: 3648541 - RNA, 15 nt, Human
cagauucuuuccuga

SEQ ID NO: 3648542 - RNA, 19 nt, Human
cagauucuuuccugaggcu

SEQ ID NO: 3648543 - RNA, 12 nt, Human
cagauucuuuua

SEQ ID NO: 3648544 - RNA, 14 nt, Human
cagauugaaaagga

SEQ ID NO: 3648545 - RNA, 23 nt, Human
cagauugagaccuacaggcugac

SEQ ID NO: 3648546 - RNA, 19 nt, Human
cagauugcaacaggcuggg

SEQ ID NO: 3648547 - RNA, 16 nt, Human
cagauugcaugugacu

SEQ ID NO: 3648548 - RNA, 15 nt, Human
cagauuggauuuuau

SEQ ID NO: 3648549 - RNA, 18 nt, Human
cagauuggcucacacuga

SEQ ID NO: 3648550 - RNA, 22 nt, Human
cagauuggcucacacugagaau

SEQ ID NO: 3648551 - RNA, 17 nt, Human
cagauuguggaauguug

SEQ ID NO: 3648552 - RNA, 18 nt, Human
cagauuguggaauguugg

SEQ ID NO: 3648553 - RNA, 13 nt, Human
cagauuuaauaca

SEQ ID NO: 3648554 - RNA, 13 nt, Human
cagauuuacacug

SEQ ID NO: 3648555 - RNA, 14 nt, Human
cagauuuacacugg

SEQ ID NO: 3648556 - RNA, 17 nt, Human
cagauuuacacugggag

SEQ ID NO: 3648557 - RNA, 18 nt, Human
cagauuuacacugggaga

SEQ ID NO: 3648558 - RNA, 20 nt, Human
cagauuuagugaaagcuaga

SEQ ID NO: 3648559 - RNA, 13 nt, Human
cagauuuaugcau

SEQ ID NO: 3648560 - RNA, 22 nt, Human
cagauuuauuccuuuguuacuu

SEQ ID NO: 3648561 - RNA, 19 nt, Human
cagauuucacucuccuugg

SEQ ID NO: 3648562 - RNA, 16 nt, Human
cagauuucucuuugaa

SEQ ID NO: 3648563 - RNA, 17 nt, Human
cagauuucugaggaaau

SEQ ID NO: 3648564 - RNA, 19 nt, Human
cagauuugaacucuucaau

SEQ ID NO: 3648565 - RNA, 16 nt, Human
cagauuugagcucagc

SEQ ID NO: 3648566 - RNA, 17 nt, Human
cagauuugcacaaaaag

SEQ ID NO: 3648567 - RNA, 12 nt, Human
cagauuugugaa

SEQ ID NO: 3648568 - RNA, 14 nt, Human
cagauuugugaacu

SEQ ID NO: 3648569 - RNA, 17 nt, Human
cagauuugugaacucag

SEQ ID NO: 3648570 - RNA, 14 nt, Human
cagauuuguguuau

SEQ ID NO: 3648571 - RNA, 23 nt, Human
cagauuuuaauuuugaauaaaua

SEQ ID NO: 3648572 - RNA, 14 nt, Human
cagauuuuacaaaa

SEQ ID NO: 3648573 - RNA, 17 nt, Human
cagauuuuacaaaagau

SEQ ID NO: 3648574 - RNA, 18 nt, Human
cagauuuuacaaaagaug

SEQ ID NO: 3648575 - RNA, 18 nt, Human
cagauuuuaggaaaugaa

SEQ ID NO: 3648576 - RNA, 15 nt, Human
cagauuuuaguuuua

SEQ ID NO: 3648577 - RNA, 17 nt, Human
cagauuuuaguuuuauu

SEQ ID NO: 3648578 - RNA, 22 nt, Human
cagauuuuaguuuuauuuucua

SEQ ID NO: 3648579 - RNA, 16 nt, Human
cagauuuuauuaugua

SEQ ID NO: 3648580 - RNA, 13 nt, Human
cagauuuucagca

SEQ ID NO: 3648581 - RNA, 18 nt, Human
cagauuuugauaacuguu

SEQ ID NO: 3648582 - RNA, 19 nt, Human
cagauuuugauagcaaagc

SEQ ID NO: 3648583 - RNA, 20 nt, Human
cagauuuugauagcaaagcg

SEQ ID NO: 3648584 - RNA, 19 nt, Human
cagauuuugcuguauauuu

SEQ ID NO: 3648585 - RNA, 23 nt, Human
cagauuuugcuguauauuuguga

SEQ ID NO: 3648586 - RNA, 20 nt, Human
cagauuuugggguuguguug

SEQ ID NO: 3648587 - RNA, 23 nt, Human
cagauuuuguuggcauagcucug

SEQ ID NO: 3648588 - RNA, 15 nt, Human
cagauuuuuacaaau

SEQ ID NO: 3648589 - RNA, 16 nt, Human
cagauuuuuacacaug

SEQ ID NO: 3648590 - RNA, 23 nt, Human
cagauuuuuauauuaguugcuuu

SEQ ID NO: 3648591 - RNA, 20 nt, Human
cagauuuuuuuuggacuguu

SEQ ID NO: 3648592 - RNA, 13 nt, Human
cagcaaaaagcaa

SEQ ID NO: 3648593 - RNA, 15 nt, Human
cagcaaaaagcaaaa

SEQ ID NO: 3648594 - RNA, 16 nt, Human
cagcucccucugccug

SEQ ID NO: 3648595 - RNA, 19 nt, Human
cagcucccugccaaacuga

SEQ ID NO: 3648596 - RNA, 14 nt, Human
cagcucccugugcc

SEQ ID NO: 3648597 - RNA, 19 nt, Human
cagcucccugugcccccag

SEQ ID NO: 3648598 - RNA, 22 nt, Human
cagcuccggcguguguucagug

SEQ ID NO: 3648599 - RNA, 15 nt, Human
cagcuccucauccag

SEQ ID NO: 3648600 - RNA, 20 nt, Human
cagcuccucauccagggcuc

SEQ ID NO: 3648601 - RNA, 15 nt, Human
cagcuccucugucuc

SEQ ID NO: 3648602 - RNA, 18 nt, Human
cagcuccucugucucgag

SEQ ID NO: 3648603 - RNA, 15 nt, Human
cagcuccugaccagu

SEQ ID NO: 3648604 - RNA, 20 nt, Human
cagcuccugaccaguugcag

SEQ ID NO: 3648605 - RNA, 15 nt, Human
cagcuccuuccuagc

SEQ ID NO: 3648606 - RNA, 20 nt, Human
cagcuccuuccuagccuugc

SEQ ID NO: 3648607 - RNA, 21 nt, Human
cagcuccuucuguccuacucu

SEQ ID NO: 3648608 - RNA, 23 nt, Human
cagcuccuucuguccuacucugu

SEQ ID NO: 3648609 - RNA, 16 nt, Human
cagcuccuugggagga

SEQ ID NO: 3648610 - RNA, 16 nt, Human
cagcuccuuuuccaga

SEQ ID NO: 3648611 - RNA, 21 nt, Human
cagcuccuuuuccagagcauu

SEQ ID NO: 3648612 - RNA, 18 nt, Human
cagcucgauccaaauugu

SEQ ID NO: 3648613 - RNA, 20 nt, Human
cagcucgauccaaauugugc

SEQ ID NO: 3648614 - RNA, 22 nt, Human
cagcucgauccaaauugugcuu

SEQ ID NO: 3648615 - RNA, 13 nt, Human
cagcucggcucag

SEQ ID NO: 3648616 - RNA, 15 nt, Human
cagcucggcucagcu

SEQ ID NO: 3648617 - RNA, 17 nt, Human
cagcucuagacaacccu

SEQ ID NO: 3648618 - RNA, 20 nt, Human
cagcucuagacacugccaca

SEQ ID NO: 3648619 - RNA, 19 nt, Human
cagcucucaugcugccccu

SEQ ID NO: 3648620 - RNA, 16 nt, Human
cagcucuccccuucuc

SEQ ID NO: 3648621 - RNA, 16 nt, Human
cagcucucccucuggc

SEQ ID NO: 3648622 - RNA, 20 nt, Human
cagcucucccucuggcccug

SEQ ID NO: 3648623 - RNA, 13 nt, Human
cagcucucuguau

SEQ ID NO: 3648624 - RNA, 12 nt, Human
cagcucugaaag

SEQ ID NO: 3648625 - RNA, 18 nt, Human
cagcucugacuuuacacu

SEQ ID NO: 3648626 - RNA, 18 nt, Human
cagcucuggaggggaggg

SEQ ID NO: 3648627 - RNA, 13 nt, Human
cagcucuggcuca

SEQ ID NO: 3648628 - RNA, 12 nt, Human
cagcucugggcc

SEQ ID NO: 3648629 - RNA, 22 nt, Human
cagcucugggccauucuccaca

SEQ ID NO: 3648630 - RNA, 10 nt, Human
cagcucuggu

SEQ ID NO: 3648631 - RNA, 16 nt, Human
cagcucugguccauag

SEQ ID NO: 3648632 - RNA, 17 nt, Human
cagcucugguccauaga

SEQ ID NO: 3648633 - RNA, 18 nt, Human
cagcucugguccauagag

SEQ ID NO: 3648634 - RNA, 21 nt, Human
cagcucugguccauagagagc

SEQ ID NO: 3648635 - RNA, 23 nt, Human
cagcucugguccauagagagcaa

SEQ ID NO: 3648636 - RNA, 12 nt, Human
cagcucuguccu

SEQ ID NO: 3648637 - RNA, 13 nt, Human
cagcucuguccug

SEQ ID NO: 3648638 - RNA, 14 nt, Human
cagcucuguccugg

SEQ ID NO: 3648639 - RNA, 23 nt, Human
cagcucuguucuuccucagccag

SEQ ID NO: 3648640 - RNA, 15 nt, Human
cagcucuuaaaugua

SEQ ID NO: 3648641 - RNA, 10 nt, Human
cagcucuuau

SEQ ID NO: 3648642 - RNA, 21 nt, Human
cagcucuuauauugccauuuc

SEQ ID NO: 3648643 - RNA, 19 nt, Human
cagcucuucaucugcccaa

SEQ ID NO: 3648644 - RNA, 20 nt, Human
cagcucuuccuagcuggaga

SEQ ID NO: 3648645 - RNA, 16 nt, Human
cagcucuucuccaggc

SEQ ID NO: 3648646 - RNA, 13 nt, Human
cagcucuucugcc

SEQ ID NO: 3648647 - RNA, 22 nt, Human
cagcucuucugccggcccuggg

SEQ ID NO: 3648648 - RNA, 18 nt, Human
cagcucuugcccuucccu

SEQ ID NO: 3648649 - RNA, 19 nt, Human
cagcucuugcccuucccug

SEQ ID NO: 3648650 - RNA, 24 nt, Human
cagcucuugcuaaucagugucuca

SEQ ID NO: 3648651 - RNA, 18 nt, Human
cagcucuuuccuccuucc

SEQ ID NO: 3648652 - RNA, 21 nt, Human
cagcucuuuccuccuuccaug

SEQ ID NO: 3648653 - RNA, 11 nt, Human
cagcucuuuuu

SEQ ID NO: 3648654 - RNA, 19 nt, Human
cagcugaaauaugcuggcu

SEQ ID NO: 3648655 - RNA, 21 nt, Human
cagcugaaauaugcuggcugg

SEQ ID NO: 3648656 - RNA, 21 nt, Human
cagcugaaugccuccuguggg

SEQ ID NO: 3648657 - RNA, 23 nt, Human
cagcugaaugccuccugugggga

SEQ ID NO: 3648658 - RNA, 15 nt, Human
cagcugacaguccuc

SEQ ID NO: 3648659 - RNA, 21 nt, Human
cagcugacaguccucuccacc

SEQ ID NO: 3648660 - RNA, 14 nt, Human
cagcugacaucuug

SEQ ID NO: 3648661 - RNA, 17 nt, Human
cagcugaccucuguugu

SEQ ID NO: 3648662 - RNA, 18 nt, Human
cagcugaccucuguuguc

SEQ ID NO: 3648663 - RNA, 16 nt, Human
cagcugaccuuuguca

SEQ ID NO: 3648664 - RNA, 22 nt, Human
cagcugagaaaaugagugacua

SEQ ID NO: 3648665 - RNA, 21 nt, Human
cagcugagagacuuuuaauca

SEQ ID NO: 3648666 - RNA, 14 nt, Human
cagcugagaggcug

SEQ ID NO: 3648667 - RNA, 22 nt, Human
cagcugagcacauucuggcuca

SEQ ID NO: 3648668 - RNA, 13 nt, Human
cagcugagcaggg

SEQ ID NO: 3648669 - RNA, 18 nt, Human
cagcugagccuucugagc

SEQ ID NO: 3648670 - RNA, 18 nt, Human
cagcugagcgccaggaug

SEQ ID NO: 3648671 - RNA, 12 nt, Human
cagcugaggcug

SEQ ID NO: 3648672 - RNA, 23 nt, Human
cagcugaggcugggggagagccg

SEQ ID NO: 3648673 - RNA, 17 nt, Human
cagcaguuugggagguc

SEQ ID NO: 3648674 - RNA, 20 nt, Human
cagcaguuuucaagucaaau

SEQ ID NO: 3648675 - RNA, 12 nt, Human
cagcauaaagaa

SEQ ID NO: 3648676 - RNA, 14 nt, Human
cagcauaagggagc

SEQ ID NO: 3648677 - RNA, 13 nt, Human
cagcauaauacuu

SEQ ID NO: 3648678 - RNA, 17 nt, Human
cagcauagaaguaacuu

SEQ ID NO: 3648679 - RNA, 22 nt, Human
cagcauauucaggaagcucagg

SEQ ID NO: 3648680 - RNA, 14 nt, Human
cagcaucaccugcc

SEQ ID NO: 3648681 - RNA, 16 nt, Human
cagcaucaccugccug

SEQ ID NO: 3648682 - RNA, 13 nt, Human
cagcaucacuccc

SEQ ID NO: 3648683 - RNA, 19 nt, Human
cagcaucacuccccaagga

SEQ ID NO: 3648684 - RNA, 19 nt, Human
cagcauccccuugaacucu

SEQ ID NO: 3648685 - RNA, 23 nt, Human
cagcaucccuugaccaggccugg

SEQ ID NO: 3648686 - RNA, 12 nt, Human
cagcauccgcag

SEQ ID NO: 3648687 - RNA, 17 nt, Human
cagcauccuggcacccg

SEQ ID NO: 3648688 - RNA, 23 nt, Human
cagcauccuuuucugcagagggg

SEQ ID NO: 3648689 - RNA, 21 nt, Human
cagcaucuccaagcagcuuag

SEQ ID NO: 3648690 - RNA, 22 nt, Human
cagcaucuccaagcagcuuaga

SEQ ID NO: 3648691 - RNA, 23 nt, Human
cagcaucucuaccuucuccccag

SEQ ID NO: 3648692 - RNA, 24 nt, Human
cagcaucuggaagagcuaggcagg

SEQ ID NO: 3648693 - RNA, 13 nt, Human
cagcaucugggcc

SEQ ID NO: 3648694 - RNA, 16 nt, Human
cagcaucugggccuug

SEQ ID NO: 3648695 - RNA, 19 nt, Human
cagcaucugggccuuggcc

SEQ ID NO: 3648696 - RNA, 22 nt, Human
cagcaucugggccuuggccugg

SEQ ID NO: 3648697 - RNA, 21 nt, Human
cagcaucuuaccuucauaugc

SEQ ID NO: 3648698 - RNA, 12 nt, Human
cagcaugaaaau

SEQ ID NO: 3648699 - RNA, 18 nt, Human
cagcaugaauuuguaaug

SEQ ID NO: 3648700 - RNA, 20 nt, Human
cagcaugacauaacagugca

SEQ ID NO: 3648701 - RNA, 15 nt, Human
cagcaugaggacaga

SEQ ID NO: 3648702 - RNA, 22 nt, Human
cagcaugaggacagaccacaga

SEQ ID NO: 3648703 - RNA, 16 nt, Human
cagcaugcaauacaua

SEQ ID NO: 3648704 - RNA, 18 nt, Human
cagcauggucccugccuu

SEQ ID NO: 3648705 - RNA, 21 nt, Human
cagcauguacggauuuucagu

SEQ ID NO: 3648706 - RNA, 14 nt, Human
cagcaugugcccuc

SEQ ID NO: 3648707 - RNA, 17 nt, Human
cagcauguugcugagga

SEQ ID NO: 3648708 - RNA, 18 nt, Human
cagcauguugcugaggag

SEQ ID NO: 3648709 - RNA, 23 nt, Human
cagcauucccagguaggccaagg

SEQ ID NO: 3648710 - RNA, 14 nt, Human
cagcauucccuccc

SEQ ID NO: 3648711 - RNA, 14 nt, Human
cagcauucucacuc

SEQ ID NO: 3648712 - RNA, 18 nt, Human
cagcauucuuagccugug

SEQ ID NO: 3648713 - RNA, 21 nt, Human
cagcauucuuagccuguggca

SEQ ID NO: 3648714 - RNA, 19 nt, Human
cagcauucuugucacaaua

SEQ ID NO: 3648715 - RNA, 22 nt, Human
cagcauucuugucacaauaaau

SEQ ID NO: 3648716 - RNA, 21 nt, Human
cagcauugauauuugugcauu

SEQ ID NO: 3648717 - RNA, 15 nt, Human
cagcauugcugguuc

SEQ ID NO: 3648718 - RNA, 16 nt, Human
cagcauugcugguucu

SEQ ID NO: 3648719 - RNA, 12 nt, Human
cagcauugcuuu

SEQ ID NO: 3648720 - RNA, 13 nt, Human
cagcauugcuuuc

SEQ ID NO: 3648721 - RNA, 14 nt, Human
cagcauugcuuucu

SEQ ID NO: 3648722 - RNA, 21 nt, Human
cagcauuuagcuggccacaug

SEQ ID NO: 3648723 - RNA, 13 nt, Human
cagcauuucacuu

SEQ ID NO: 3648724 - RNA, 20 nt, Human
cagcauuuccacaccaagca

SEQ ID NO: 3648725 - RNA, 15 nt, Human
cagcauuucccuucc

SEQ ID NO: 3648726 - RNA, 16 nt, Human
cagcauuucugaagug

SEQ ID NO: 3648727 - RNA, 16 nt, Human
cagcauuucuuuucug

SEQ ID NO: 3648728 - RNA, 16 nt, Human
cagcauuuguguguua

SEQ ID NO: 3648729 - RNA, 19 nt, Human
cagccaaacacacagaagg

SEQ ID NO: 3648730 - RNA, 16 nt, Human
cagccaaacccugucu

SEQ ID NO: 3648731 - RNA, 21 nt, Human
cagccaaagccuccuccagcc

SEQ ID NO: 3648732 - RNA, 15 nt, Human
cagccaaaggcuggc

SEQ ID NO: 3648733 - RNA, 20 nt, Human
cagccaacagcuacaacagc

SEQ ID NO: 3648734 - RNA, 18 nt, Human
cagccaacagguggcagg

SEQ ID NO: 3648735 - RNA, 19 nt, Human
cagccaacagguggcagga

SEQ ID NO: 3648736 - RNA, 16 nt, Human
cagccaaccccugugg

SEQ ID NO: 3648737 - RNA, 17 nt, Human
cagccaacuagccccug

SEQ ID NO: 3648738 - RNA, 13 nt, Human
cagccaagcacag

SEQ ID NO: 3648739 - RNA, 21 nt, Human
cagccaaggccgaagcucugg

SEQ ID NO: 3648740 - RNA, 22 nt, Human
cagccaaggccgaagcucuggc

SEQ ID NO: 3648741 - RNA, 23 nt, Human
cagccaaggccgaagcucuggcu

SEQ ID NO: 3648742 - RNA, 23 nt, Human
cagccaagguuuuauaaggcuga

SEQ ID NO: 3648743 - RNA, 12 nt, Human
cagccacacaca

SEQ ID NO: 3648744 - RNA, 13 nt, Human
cagccacacacac

SEQ ID NO: 3648745 - RNA, 19 nt, Human
cagccacacacacagaaaa

SEQ ID NO: 3648746 - RNA, 22 nt, Human
cagccacacacacagaaaauau

SEQ ID NO: 3648747 - RNA, 15 nt, Human
cagccacacccaggc

SEQ ID NO: 3648748 - RNA, 19 nt, Human
cagccacacccaggcacuu

SEQ ID NO: 3648749 - RNA, 19 nt, Human
cagccacacuucucaggac

SEQ ID NO: 3648750 - RNA, 20 nt, Human
cagccacacuucucaggaca

SEQ ID NO: 3648751 - RNA, 21 nt, Human
cagccacacuucucaggacac

SEQ ID NO: 3648752 - RNA, 21 nt, Human
cagccaccccgggcucucugc

SEQ ID NO: 3648753 - RNA, 18 nt, Human
cagccacccugaggaguc

SEQ ID NO: 3648754 - RNA, 21 nt, Human
cagccaccgaagccgccugug

SEQ ID NO: 3648755 - RNA, 16 nt, Human
cagccaccuaaacggu

SEQ ID NO: 3648756 - RNA, 15 nt, Human
cagccaccucucuuu

SEQ ID NO: 3648757 - RNA, 16 nt, Human
cagccaccucucuuuu

SEQ ID NO: 3648758 - RNA, 18 nt, Human
cagccacgaggugcaaca

SEQ ID NO: 3648759 - RNA, 16 nt, Human
cagccacggccaggcc

SEQ ID NO: 3648760 - RNA, 19 nt, Human
cagccacggccaggccaga

SEQ ID NO: 3648761 - RNA, 19 nt, Human
cagccacuaagaaccccuc

SEQ ID NO: 3648762 - RNA, 14 nt, Human
cagccacucagaaa

SEQ ID NO: 3648763 - RNA, 14 nt, Human
cagccacuccccag

SEQ ID NO: 3648764 - RNA, 15 nt, Human
caggaaaaggccugg

SEQ ID NO: 3648765 - RNA, 18 nt, Human
caggaaaaggccuggggu

SEQ ID NO: 3648766 - RNA, 16 nt, Human
caggaaaauccucugg

SEQ ID NO: 3648767 - RNA, 13 nt, Human
caggaaaccaaca

SEQ ID NO: 3648768 - RNA, 22 nt, Human
caggaaacuccacaucugccuu

SEQ ID NO: 3648769 - RNA, 23 nt, Human
caggaaacuccacaucugccuua

SEQ ID NO: 3648770 - RNA, 20 nt, Human
caggaaagcgccuccaaccc

SEQ ID NO: 3648771 - RNA, 15 nt, Human
caggaaaggcuccag

SEQ ID NO: 3648772 - RNA, 21 nt, Human
caggaaaggcuccaggagcag

SEQ ID NO: 3648773 - RNA, 21 nt, Human
caggaaagggaaggccccaca

SEQ ID NO: 3648774 - RNA, 16 nt, Human
caggaaaguggccaag

SEQ ID NO: 3648775 - RNA, 18 nt, Human
caggaaaguguuauuuuu

SEQ ID NO: 3648776 - RNA, 16 nt, Human
caggaaaguucagagu

SEQ ID NO: 3648777 - RNA, 18 nt, Human
caggaaaguucagaguuu

SEQ ID NO: 3648778 - RNA, 13 nt, Human
caggaaauauaua

SEQ ID NO: 3648779 - RNA, 15 nt, Human
caggaaauauauaug

SEQ ID NO: 3648780 - RNA, 22 nt, Human
caggaaaucaaauaugcaaagc

SEQ ID NO: 3648781 - RNA, 21 nt, Human
caggaaaugaaaaugucuugu

SEQ ID NO: 3648782 - RNA, 23 nt, Human
caggaaaugcugacccaugggca

SEQ ID NO: 3648783 - RNA, 21 nt, Human
caggaacaaucgauggccuug

SEQ ID NO: 3648784 - RNA, 12 nt, Human
caggaacagaag

SEQ ID NO: 3648785 - RNA, 14 nt, Human
caggaacagaagga

SEQ ID NO: 3648786 - RNA, 18 nt, Human
caggaacagaaggaugaa

SEQ ID NO: 3648787 - RNA, 22 nt, Human
caggaacagcuaugggagcccc

SEQ ID NO: 3648788 - RNA, 23 nt, Human
caggaacagcuaugggagcccca

SEQ ID NO: 3648789 - RNA, 18 nt, Human
caggaaccacaagacugc

SEQ ID NO: 3648790 - RNA, 23 nt, Human
caggaaccauaguugacaguucc

SEQ ID NO: 3648791 - RNA, 19 nt, Human
caggaaccucgaguacugu

SEQ ID NO: 3648792 - RNA, 20 nt, Human
caggaaccucgaguacugug

SEQ ID NO: 3648793 - RNA, 15 nt, Human
caggaacucccagca

SEQ ID NO: 3648794 - RNA, 14 nt, Human
caggaagaaaucac

SEQ ID NO: 3648795 - RNA, 17 nt, Human
caggaagaucccccaga

SEQ ID NO: 3648796 - RNA, 19 nt, Human
caggaagaucccccagaaa

SEQ ID NO: 3648797 - RNA, 18 nt, Human
caggaagaucuuaaauuu

SEQ ID NO: 3648798 - RNA, 16 nt, Human
caggaagcaccccaug

SEQ ID NO: 3648799 - RNA, 14 nt, Human
caggaagcagcuuu

SEQ ID NO: 3648800 - RNA, 18 nt, Human
caggaagcauucagagag

SEQ ID NO: 3648801 - RNA, 14 nt, Human
caggaagccagcag

SEQ ID NO: 3648802 - RNA, 16 nt, Human
caggaagccagcaggc

SEQ ID NO: 3648803 - RNA, 16 nt, Human
caggaagcccaauugc

SEQ ID NO: 3648804 - RNA, 19 nt, Human
caggaagcccccaaguuga

SEQ ID NO: 3648805 - RNA, 23 nt, Human
caggaagcucagggccuggcuca

SEQ ID NO: 3648806 - RNA, 13 nt, Human
caggaaggagagc

SEQ ID NO: 3648807 - RNA, 17 nt, Human
caggaaggagagccugc

SEQ ID NO: 3648808 - RNA, 18 nt, Human
caggaaggagagccugcu

SEQ ID NO: 3648809 - RNA, 13 nt, Human
caggaaggagcug

SEQ ID NO: 3648810 - RNA, 18 nt, Human
caggaaggagcugccugg

SEQ ID NO: 3648811 - RNA, 20 nt, Human
caggaaggagcugccuggac

SEQ ID NO: 3648812 - RNA, 22 nt, Human
caggaaggagcugccuggaccc

SEQ ID NO: 3648813 - RNA, 12 nt, Human
caggaaggccug

SEQ ID NO: 3648814 - RNA, 15 nt, Human
caggaaggccugggu

SEQ ID NO: 3648815 - RNA, 19 nt, Human
caggaaggcugagaggaga

SEQ ID NO: 3648816 - RNA, 22 nt, Human
caggaaggcuuguugugcuuuu

SEQ ID NO: 3648817 - RNA, 19 nt, Human
cagcucucugcccugugua

SEQ ID NO: 3648818 - RNA, 16 nt, Human
cagcucucuguauaaa

SEQ ID NO: 3648819 - RNA, 18 nt, Human
cagcucucuguauaaaca

SEQ ID NO: 3648820 - RNA, 19 nt, Human
cagcucugaaaccaguguu

SEQ ID NO: 3648821 - RNA, 14 nt, Human
cagcucugacauuc

SEQ ID NO: 3648822 - RNA, 16 nt, Human
cagcucugcaagaauu

SEQ ID NO: 3648823 - RNA, 21 nt, Human
cagcucugcaagaauugaagc

SEQ ID NO: 3648824 - RNA, 21 nt, Human
cagcucugcaggcuuaauaaa

SEQ ID NO: 3648825 - RNA, 16 nt, Human
auuucugguucugaug

SEQ ID NO: 3648826 - RNA, 17 nt, Human
auuucugguucugaugc

SEQ ID NO: 3648827 - RNA, 21 nt, Human
auuucugucacaguaaaaaua

SEQ ID NO: 3648828 - RNA, 13 nt, Human
auuucugugggag

SEQ ID NO: 3648829 - RNA, 16 nt, Human
auuucugugggagaau

SEQ ID NO: 3648830 - RNA, 15 nt, Human
auuucuguguugcca

SEQ ID NO: 3648831 - RNA, 23 nt, Human
auuucuguguugccaagcuccaa

SEQ ID NO: 3648832 - RNA, 19 nt, Human
auuucuguuuagauaauac

SEQ ID NO: 3648833 - RNA, 20 nt, Human
auuucuguuuagauaauaca

SEQ ID NO: 3648834 - RNA, 21 nt, Human
auuucuguuuagauaauacac

SEQ ID NO: 3648835 - RNA, 13 nt, Human
auuucuuaaacaa

SEQ ID NO: 3648836 - RNA, 23 nt, Human
auuucuuaaauaaugcuucagau

SEQ ID NO: 3648837 - RNA, 19 nt, Human
auuucuuaacuucuugcuu

SEQ ID NO: 3648838 - RNA, 19 nt, Human
auuucuuaauuauuauaaa

SEQ ID NO: 3648839 - RNA, 21 nt, Human
auuucuuauauaugugaacau

SEQ ID NO: 3648840 - RNA, 18 nt, Human
auuucuuaugugacauua

SEQ ID NO: 3648841 - RNA, 21 nt, Human
auuucuucagucagaaaacuu

SEQ ID NO: 3648842 - RNA, 23 nt, Human
auuucuuccacaagagcccaggc

SEQ ID NO: 3648843 - RNA, 13 nt, Human
auuucuucucaaa

SEQ ID NO: 3648844 - RNA, 22 nt, Human
auuucuucuccuggaguugcau

SEQ ID NO: 3648845 - RNA, 21 nt, Human
auuucuugaguuuuguuuuaa

SEQ ID NO: 3648846 - RNA, 21 nt, Human
auuucuugcucuaucucucaa

SEQ ID NO: 3648847 - RNA, 14 nt, Human
auuucuugggcccu

SEQ ID NO: 3648848 - RNA, 16 nt, Human
auuucuugggcccucc

SEQ ID NO: 3648849 - RNA, 17 nt, Human
auuucuugggcccuccu

SEQ ID NO: 3648850 - RNA, 19 nt, Human
auuucuuuauauuuaucca

SEQ ID NO: 3648851 - RNA, 17 nt, Human
auuucuuugccuguuca

SEQ ID NO: 3648852 - RNA, 14 nt, Human
auuucuuugcugua

SEQ ID NO: 3648853 - RNA, 20 nt, Human
auuucuuuucuuuuuacaua

SEQ ID NO: 3648854 - RNA, 23 nt, Human
auuucuuuuugggagagacuugu

SEQ ID NO: 3648855 - RNA, 21 nt, Human
auuucuuuuuuaaaugaagaa

SEQ ID NO: 3648856 - RNA, 16 nt, Human
auuucuuuuuuuccuu

SEQ ID NO: 3648857 - RNA, 16 nt, Human
auuugaaaaaaacuuc

SEQ ID NO: 3648858 - RNA, 22 nt, Human
auuugaaaaaaacuucauucuc

SEQ ID NO: 3648859 - RNA, 14 nt, Human
auuugaaaaauaua

SEQ ID NO: 3648860 - RNA, 20 nt, Human
auuugaaaacagaaauuggu

SEQ ID NO: 3648861 - RNA, 16 nt, Human
auuugaaaauuuugau

SEQ ID NO: 3648862 - RNA, 14 nt, Human
auuugaaacacugg

SEQ ID NO: 3648863 - RNA, 17 nt, Human
auuugaaacacugguuu

SEQ ID NO: 3648864 - RNA, 19 nt, Human
auuugaaacauugcuuuua

SEQ ID NO: 3648865 - RNA, 20 nt, Human
auuugaaacauugcuuuuaa

SEQ ID NO: 3648866 - RNA, 20 nt, Human
auuugaaagugccuuugcag

SEQ ID NO: 3648867 - RNA, 15 nt, Human
auuugaaauuuagcu

SEQ ID NO: 3648868 - RNA, 17 nt, Human
auuugaacaaugaaguu

SEQ ID NO: 3648869 - RNA, 18 nt, Human
auuugaacaaugaaguug

SEQ ID NO: 3648870 - RNA, 22 nt, Human
auuugaacauguggcuugaauu

SEQ ID NO: 3648871 - RNA, 15 nt, Human
auuugaaccaaaaca

SEQ ID NO: 3648872 - RNA, 20 nt, Human
auuugaacuuuuuauugauu

SEQ ID NO: 3648873 - RNA, 21 nt, Human
auuugaagacaaaaauacucu

SEQ ID NO: 3648874 - RNA, 13 nt, Human
auuugaaggccag

SEQ ID NO: 3648875 - RNA, 14 nt, Human
auuugaaucagccu

SEQ ID NO: 3648876 - RNA, 16 nt, Human
auuugaaucuugucuc

SEQ ID NO: 3648877 - RNA, 11 nt, Human
auuugaaugaa

SEQ ID NO: 3648878 - RNA, 17 nt, Human
auuugaaugauuuuucu

SEQ ID NO: 3648879 - RNA, 15 nt, Human
auuugaaugcauuuu

SEQ ID NO: 3648880 - RNA, 16 nt, Human
auuugaaugcauuuug

SEQ ID NO: 3648881 - RNA, 17 nt, Human
auuugaauguaugcuuc

SEQ ID NO: 3648882 - RNA, 18 nt, Human
auuugaauguaugcuuca

SEQ ID NO: 3648883 - RNA, 16 nt, Human
auuugacauagucugg

SEQ ID NO: 3648884 - RNA, 13 nt, Human
auuugacuaauuu

SEQ ID NO: 3648885 - RNA, 14 nt, Human
auuugacuaauuuu

SEQ ID NO: 3648886 - RNA, 15 nt, Human
auuugacuaauuuua

SEQ ID NO: 3648887 - RNA, 13 nt, Human
auuugacuauucu

SEQ ID NO: 3648888 - RNA, 18 nt, Human
auuugacuguuuuuaccc

SEQ ID NO: 3648889 - RNA, 18 nt, Human
auuugacuugcaugaaga

SEQ ID NO: 3648890 - RNA, 13 nt, Human
auuugacuugugg

SEQ ID NO: 3648891 - RNA, 15 nt, Human
auuugacuuuucugu

SEQ ID NO: 3648892 - RNA, 19 nt, Human
auuugagaaaauaaagcua

SEQ ID NO: 3648893 - RNA, 12 nt, Human
auuugagaaaug

SEQ ID NO: 3648894 - RNA, 14 nt, Human
auuugagaauauaa

SEQ ID NO: 3648895 - RNA, 22 nt, Human
auuugaggagcagcuucaguug

SEQ ID NO: 3648896 - RNA, 20 nt, Human
auuugaggauuuagaagugu

SEQ ID NO: 3648897 - RNA, 22 nt, Human
auuugaggauuuagaaguguca

SEQ ID NO: 3648898 - RNA, 22 nt, Human
auuugaggucaaguaagaagac

SEQ ID NO: 3648899 - RNA, 15 nt, Human
auuugaggucuguuc

SEQ ID NO: 3648900 - RNA, 17 nt, Human
auuugaggucuguucuu

SEQ ID NO: 3648901 - RNA, 22 nt, Human
auuugaguaaucugaucguucu

SEQ ID NO: 3648902 - RNA, 23 nt, Human
auuugaguaaucugaucguucuu

SEQ ID NO: 3648903 - RNA, 12 nt, Human
auuugaguguuu

SEQ ID NO: 3648904 - RNA, 13 nt, Human
auuugauacuuau

SEQ ID NO: 3648905 - RNA, 19 nt, Human
auuugauacuuauauuuuc

SEQ ID NO: 3648906 - RNA, 15 nt, Human
auuugaugaaagcug

SEQ ID NO: 3648907 - RNA, 21 nt, Human
auuugaugaaagcugauuacu

SEQ ID NO: 3648908 - RNA, 16 nt, Human
auuugaugcuggagag

SEQ ID NO: 3648909 - RNA, 18 nt, Human
auuugauguaauacuucu

SEQ ID NO: 3648910 - RNA, 14 nt, Human
auuugauuaacaaa

SEQ ID NO: 3648911 - RNA, 16 nt, Human
auuugauuaacaaaua

SEQ ID NO: 3648912 - RNA, 15 nt, Human
auuugauucaaaaua

SEQ ID NO: 3648913 - RNA, 20 nt, Human
auuugauucaaaauauuuaa

SEQ ID NO: 3648914 - RNA, 18 nt, Human
auuugauuuauuaacuua

SEQ ID NO: 3648915 - RNA, 13 nt, Human
auuugauuucuau

SEQ ID NO: 3648916 - RNA, 22 nt, Human
auuugauuuuucuaaccuugaa

SEQ ID NO: 3648917 - RNA, 15 nt, Human
auuugcaaaguacug

SEQ ID NO: 3648918 - RNA, 19 nt, Human
auuugcaaaguacuguaag

SEQ ID NO: 3648919 - RNA, 14 nt, Human
auuugcaacauuua

SEQ ID NO: 3648920 - RNA, 15 nt, Human
auuugcaagggaaaa

SEQ ID NO: 3648921 - RNA, 20 nt, Human
auuugcaagggaaaagucuc

SEQ ID NO: 3648922 - RNA, 16 nt, Human
auuugcaauaacagcu

SEQ ID NO: 3648923 - RNA, 23 nt, Human
auuugcacagaagcacaugcacc

SEQ ID NO: 3648924 - RNA, 15 nt, Human
auuugcacauuaaau

SEQ ID NO: 3648925 - RNA, 17 nt, Human
auuugcauacauucuuc

SEQ ID NO: 3648926 - RNA, 15 nt, Human
auuugcauauguaug

SEQ ID NO: 3648927 - RNA, 21 nt, Human
auuugcauggcuccagaaaug

SEQ ID NO: 3648928 - RNA, 14 nt, Human
auuugcauguuaug

SEQ ID NO: 3648929 - RNA, 15 nt, Human
auuugcauguuaugu

SEQ ID NO: 3648930 - RNA, 18 nt, Human
auuugcauuaaauucaca

SEQ ID NO: 3648931 - RNA, 23 nt, Human
auuugcauuaaauucacaaacuu

SEQ ID NO: 3648932 - RNA, 12 nt, Human
auuugcauuugu

SEQ ID NO: 3648933 - RNA, 22 nt, Human
auuugcauuuguuuauguaauu

SEQ ID NO: 3648934 - RNA, 23 nt, Human
auuugcauuuguuuauguaauuu

SEQ ID NO: 3648935 - RNA, 17 nt, Human
auuugccaaaauaaugu

SEQ ID NO: 3648936 - RNA, 20 nt, Human
auuugccaaaauaaugucuu

SEQ ID NO: 3648937 - RNA, 21 nt, Human
auuugccauagaguacacugc

SEQ ID NO: 3648938 - RNA, 19 nt, Human
auuugccaugggcuucacu

SEQ ID NO: 3648939 - RNA, 15 nt, Human
auuugcccauuuaca

SEQ ID NO: 3648940 - RNA, 13 nt, Human
auuugccuguaac

SEQ ID NO: 3648941 - RNA, 16 nt, Human
auuugccuguaacaag

SEQ ID NO: 3648942 - RNA, 21 nt, Human
auuugccuguuucugcuugcu

SEQ ID NO: 3648943 - RNA, 13 nt, Human
auuugccuugcag

SEQ ID NO: 3648944 - RNA, 17 nt, Human
auuugccuugcagaacu

SEQ ID NO: 3648945 - RNA, 19 nt, Human
auuugccuugcagaacugc

SEQ ID NO: 3648946 - RNA, 21 nt, Human
auuugccuugcagaacugcca

SEQ ID NO: 3648947 - RNA, 15 nt, Human
auuugccuugcugga

SEQ ID NO: 3648948 - RNA, 23 nt, Human
auuugcggcgucagucuuuuucu

SEQ ID NO: 3648949 - RNA, 23 nt, Human
auuugcuaaucaaagccaggguc

SEQ ID NO: 3648950 - RNA, 16 nt, Human
auuugcuacuguugua

SEQ ID NO: 3648951 - RNA, 17 nt, Human
auuugcuaucaaaauaa

SEQ ID NO: 3648952 - RNA, 15 nt, Human
auuugcucauaugaa

SEQ ID NO: 3648953 - RNA, 18 nt, Human
auuugcucuucagaugcc

SEQ ID NO: 3648954 - RNA, 23 nt, Human
auuugcugacaaccauuaaaguc

SEQ ID NO: 3648955 - RNA, 14 nt, Human
auuugcugccaaau

SEQ ID NO: 3648956 - RNA, 13 nt, Human
auuugcugccauu

SEQ ID NO: 3648957 - RNA, 12 nt, Human
auuugcugcuga

SEQ ID NO: 3648958 - RNA, 12 nt, Human
auuugcuucauu

SEQ ID NO: 3648959 - RNA, 14 nt, Human
auuugcuucauugu

SEQ ID NO: 3648960 - RNA, 11 nt, Human
auuugcuuuuu

SEQ ID NO: 3648961 - RNA, 17 nt, Human
caggacuaacacucaga

SEQ ID NO: 3648962 - RNA, 16 nt, Human
caggacuauagcccag

SEQ ID NO: 3648963 - RNA, 17 nt, Human
caggacuauagcccagg

SEQ ID NO: 3648964 - RNA, 22 nt, Human
caggacucacagguuggaagag

SEQ ID NO: 3648965 - RNA, 19 nt, Human
caggacuccccaggccagg

SEQ ID NO: 3648966 - RNA, 15 nt, Human
caggacucccuccuc

SEQ ID NO: 3648967 - RNA, 22 nt, Human
caggacucccuccucaccucug

SEQ ID NO: 3648968 - RNA, 16 nt, Human
caggacuccuccccac

SEQ ID NO: 3648969 - RNA, 17 nt, Human
caggacucugcagccuc

SEQ ID NO: 3648970 - RNA, 19 nt, Human
caggacugaauugucccca

SEQ ID NO: 3648971 - RNA, 17 nt, Human
caggacugaugucuccu

SEQ ID NO: 3648972 - RNA, 13 nt, Human
caggacugcacag

SEQ ID NO: 3648973 - RNA, 13 nt, Human
caggacugggagc

SEQ ID NO: 3648974 - RNA, 14 nt, Human
caggacugggagcc

SEQ ID NO: 3648975 - RNA, 13 nt, Human
caggacugggcca

SEQ ID NO: 3648976 - RNA, 15 nt, Human
caggacugggccacu

SEQ ID NO: 3648977 - RNA, 14 nt, Human
caggacuguccccu

SEQ ID NO: 3648978 - RNA, 15 nt, Human
caggacuguuucaaa

SEQ ID NO: 3648979 - RNA, 17 nt, Human
caggacuguuucaaaca

SEQ ID NO: 3648980 - RNA, 15 nt, Human
caggacuuaaaauga

SEQ ID NO: 3648981 - RNA, 23 nt, Human
caggacuuaacggcuccaggauu

SEQ ID NO: 3648982 - RNA, 21 nt, Human
caggacuuccccggagggcug

SEQ ID NO: 3648983 - RNA, 20 nt, Human
caggacuuggucugauuuca

SEQ ID NO: 3648984 - RNA, 20 nt, Human
caggagaagaaagaggugac

SEQ ID NO: 3648985 - RNA, 19 nt, Human
caggagaagaaccugaaga

SEQ ID NO: 3648986 - RNA, 15 nt, Human
caggagaagcucagc

SEQ ID NO: 3648987 - RNA, 21 nt, Human
caggagaaggccaauuccuau

SEQ ID NO: 3648988 - RNA, 23 nt, Human
caggagacacugugcuauaaauc

SEQ ID NO: 3648989 - RNA, 15 nt, Human
caggagacaggaagg

SEQ ID NO: 3648990 - RNA, 12 nt, Human
caggagacaucc

SEQ ID NO: 3648991 - RNA, 18 nt, Human
caggagagagaaagccag

SEQ ID NO: 3648992 - RNA, 20 nt, Human
caggagagagaaagccaggc

SEQ ID NO: 3648993 - RNA, 20 nt, Human
caggagagauuauuuacaag

SEQ ID NO: 3648994 - RNA, 16 nt, Human
caggagagccagcccu

SEQ ID NO: 3648995 - RNA, 21 nt, Human
caggagagccagcccucccug

SEQ ID NO: 3648996 - RNA, 22 nt, Human
caggagagcuuagggucucagg

SEQ ID NO: 3648997 - RNA, 15 nt, Human
caggagaggagagcc

SEQ ID NO: 3648998 - RNA, 18 nt, Human
caggagaggagagccaga

SEQ ID NO: 3648999 - RNA, 19 nt, Human
caggagaggagagccagag

SEQ ID NO: 3649000 - RNA, 20 nt, Human
caggagaggagagccagaga

SEQ ID NO: 3649001 - RNA, 20 nt, Human
caggagaggagcgggaccug

SEQ ID NO: 3649002 - RNA, 12 nt, Human
caggagagggaa

SEQ ID NO: 3649003 - RNA, 17 nt, Human
caggagaggggcagaac

SEQ ID NO: 3649004 - RNA, 16 nt, Human
caggagaugcugugcc

SEQ ID NO: 3649005 - RNA, 19 nt, Human
caggagaugcugugccccu

SEQ ID NO: 3649006 - RNA, 20 nt, Human
caggagauugagaaggagag

SEQ ID NO: 3649007 - RNA, 21 nt, Human
caggagauugagaaggagaga

SEQ ID NO: 3649008 - RNA, 19 nt, Human
caggagcaaauguuucugc

SEQ ID NO: 3649009 - RNA, 19 nt, Human
caggagcacacccagcccc

SEQ ID NO: 3649010 - RNA, 23 nt, Human
caggagcacaggcagcuggauga

SEQ ID NO: 3649011 - RNA, 23 nt, Human
caggagcagccucagaacaaagu

SEQ ID NO: 3649012 - RNA, 15 nt, Human
caggagccccgaggc

SEQ ID NO: 3649013 - RNA, 18 nt, Human
caggagccgaagcccagg

SEQ ID NO: 3649014 - RNA, 12 nt, Human
caggagccuggc

SEQ ID NO: 3649015 - RNA, 11 nt, Human
caggagccugu

SEQ ID NO: 3649016 - RNA, 16 nt, Human
caggagccugugccuc

SEQ ID NO: 3649017 - RNA, 15 nt, Human
caggagcgcaagaua

SEQ ID NO: 3649018 - RNA, 23 nt, Human
caggagcuccaguguccugagcu

SEQ ID NO: 3649019 - RNA, 19 nt, Human
caggagcuccauacacacg

SEQ ID NO: 3649020 - RNA, 18 nt, Human
caggagcucuucaggccu

SEQ ID NO: 3649021 - RNA, 23 nt, Human
caggagcugggcagaaggccaag

SEQ ID NO: 3649022 - RNA, 21 nt, Human
caggagcugucaccaaggaaa

SEQ ID NO: 3649023 - RNA, 12 nt, Human
caggagcuuccu

SEQ ID NO: 3649024 - RNA, 15 nt, Human
caggaggacccaggg

SEQ ID NO: 3649025 - RNA, 20 nt, Human
caggaggacccagggcucug

SEQ ID NO: 3649026 - RNA, 21 nt, Human
caggaggacugccccgugcag

SEQ ID NO: 3649027 - RNA, 15 nt, Human
caggaggaggugcca

SEQ ID NO: 3649028 - RNA, 18 nt, Human
caggaggcaagcaagcuc

SEQ ID NO: 3649029 - RNA, 15 nt, Human
caggaggcaggcaug

SEQ ID NO: 3649030 - RNA, 20 nt, Human
caggaggcagggaggcagcc

SEQ ID NO: 3649031 - RNA, 17 nt, Human
caggaggccaagguggg

SEQ ID NO: 3649032 - RNA, 13 nt, Human
auuuuuguaucua

SEQ ID NO: 3649033 - RNA, 16 nt, Human
auuuuugucucagaag

SEQ ID NO: 3649034 - RNA, 22 nt, Human
auuuuugugauuuugugauuga

SEQ ID NO: 3649035 - RNA, 22 nt, Human
auuuuuguuggagccacucugu

SEQ ID NO: 3649036 - RNA, 16 nt, Human
auuuuuguuucuaccu

SEQ ID NO: 3649037 - RNA, 22 nt, Human
auuuuuguuucuuccaaagcac

SEQ ID NO: 3649038 - RNA, 17 nt, Human
auuuuuguuuguuuugu

SEQ ID NO: 3649039 - RNA, 21 nt, Human
auuuuuguuuuuauuaaaagg

SEQ ID NO: 3649040 - RNA, 14 nt, Human
auuuuuuaaaaaag

SEQ ID NO: 3649041 - RNA, 17 nt, Human
auuuuuuaaaaaagcuu

SEQ ID NO: 3649042 - RNA, 19 nt, Human
auuuuuuaaaaaagcuuaa

SEQ ID NO: 3649043 - RNA, 16 nt, Human
auuuuuuaaaaagcaa

SEQ ID NO: 3649044 - RNA, 15 nt, Human
auuuuuuaaaacaag

SEQ ID NO: 3649045 - RNA, 17 nt, Human
auuuuuuaaaacaagaa

SEQ ID NO: 3649046 - RNA, 21 nt, Human
auuuuuuaaaagagacaaacu

SEQ ID NO: 3649047 - RNA, 17 nt, Human
auuuuuuaaguauuuau

SEQ ID NO: 3649048 - RNA, 19 nt, Human
auuuuuuaaguauuuauau

SEQ ID NO: 3649049 - RNA, 22 nt, Human
auuuuuuaaguauuuauauauu

SEQ ID NO: 3649050 - RNA, 15 nt, Human
auuuuuuaauuauua

SEQ ID NO: 3649051 - RNA, 20 nt, Human
auuuuuuaauuauuauuuau

SEQ ID NO: 3649052 - RNA, 19 nt, Human
auuuuuuaauuuaaagcuu

SEQ ID NO: 3649053 - RNA, 13 nt, Human
auuuuuuaggaaa

SEQ ID NO: 3649054 - RNA, 17 nt, Human
auuuuuuauaaaauaca

SEQ ID NO: 3649055 - RNA, 20 nt, Human
auuuuuuauauauaugcaua

SEQ ID NO: 3649056 - RNA, 13 nt, Human
auuuuuuauugcu

SEQ ID NO: 3649057 - RNA, 14 nt, Human
auuuuuuauugcua

SEQ ID NO: 3649058 - RNA, 12 nt, Human
auuuuuuauugu

SEQ ID NO: 3649059 - RNA, 13 nt, Human
auuuuuuauuguu

SEQ ID NO: 3649060 - RNA, 12 nt, Human
auuuuuucagac

SEQ ID NO: 3649061 - RNA, 14 nt, Human
auuuuuucaguugu

SEQ ID NO: 3649062 - RNA, 21 nt, Human
auuuuuucauuucaaaaugcu

SEQ ID NO: 3649063 - RNA, 13 nt, Human
auuuuuucccaaa

SEQ ID NO: 3649064 - RNA, 14 nt, Human
auuuuuuccuguuu

SEQ ID NO: 3649065 - RNA, 20 nt, Human
auuuuuuccuucaaaguuua

SEQ ID NO: 3649066 - RNA, 23 nt, Human
auuuuuuccuucaaaguuuaaua

SEQ ID NO: 3649067 - RNA, 20 nt, Human
auuuuuucucuaggaaauau

SEQ ID NO: 3649068 - RNA, 16 nt, Human
auuuuuugaaaagcag

SEQ ID NO: 3649069 - RNA, 13 nt, Human
auuuuuugaaagu

SEQ ID NO: 3649070 - RNA, 12 nt, Human
auuuuuugacuu

SEQ ID NO: 3649071 - RNA, 18 nt, Human
auuuuuugcaucaguauu

SEQ ID NO: 3649072 - RNA, 23 nt, Human
auuuuuuguaaugugugaaaaag

SEQ ID NO: 3649073 - RNA, 14 nt, Human
auuuuuuguugaca

SEQ ID NO: 3649074 - RNA, 22 nt, Human
auuuuuuuaaaaucacuaacau

SEQ ID NO: 3649075 - RNA, 15 nt, Human
auuuuuuuaaccaaa

SEQ ID NO: 3649076 - RNA, 18 nt, Human
auuuuuuuaaccaaaggu

SEQ ID NO: 3649077 - RNA, 12 nt, Human
auuuuuuuaagc

SEQ ID NO: 3649078 - RNA, 13 nt, Human
auuuuuuuaagcu

SEQ ID NO: 3649079 - RNA, 13 nt, Human
auuuuuuuaaguc

SEQ ID NO: 3649080 - RNA, 16 nt, Human
auuuuuuuaauuuugu

SEQ ID NO: 3649081 - RNA, 15 nt, Human
auuuuuuuagauuga

SEQ ID NO: 3649082 - RNA, 15 nt, Human
auuuuuuucaauauu

SEQ ID NO: 3649083 - RNA, 19 nt, Human
auuuuuuucccaauugaga

SEQ ID NO: 3649084 - RNA, 19 nt, Human
auuuuuuuccuuacauaaa

SEQ ID NO: 3649085 - RNA, 16 nt, Human
auuuuuuuccuugcaa

SEQ ID NO: 3649086 - RNA, 13 nt, Human
auuuuuuucuacc

SEQ ID NO: 3649087 - RNA, 20 nt, Human
auuuuuuucuaccuugaggu

SEQ ID NO: 3649088 - RNA, 16 nt, Human
auuuuuuucugaaauu

SEQ ID NO: 3649089 - RNA, 15 nt, Human
auuuuuuucugauug

SEQ ID NO: 3649090 - RNA, 16 nt, Human
auuuuuuucugauugu

SEQ ID NO: 3649091 - RNA, 23 nt, Human
auuuuuuugaacucuucucauua

SEQ ID NO: 3649092 - RNA, 17 nt, Human
auuuuuuugcaagugaa

SEQ ID NO: 3649093 - RNA, 20 nt, Human
auuuuuuugcaagugaaggu

SEQ ID NO: 3649094 - RNA, 23 nt, Human
auuuuuuugcaugcaugcaaaug

SEQ ID NO: 3649095 - RNA, 22 nt, Human
auuuuuuugguaccuauuugac

SEQ ID NO: 3649096 - RNA, 18 nt, Human
auuuuuuuguuguuuguu

SEQ ID NO: 3649097 - RNA, 19 nt, Human
auuuuuuuuaaaauagaaa

SEQ ID NO: 3649098 - RNA, 15 nt, Human
auuuuuuuuaaacaa

SEQ ID NO: 3649099 - RNA, 18 nt, Human
auuuuuuuuaauuguauu

SEQ ID NO: 3649100 - RNA, 14 nt, Human
auuuuuuuuacauu

SEQ ID NO: 3649101 - RNA, 19 nt, Human
auuuuuuuuuaagcucuga

SEQ ID NO: 3649102 - RNA, 15 nt, Human
auuuuuuuuuagaac

SEQ ID NO: 3649103 - RNA, 21 nt, Human
auuuuuuuuucauacacuuau

SEQ ID NO: 3649104 - RNA, 13 nt, Human
auuuuuuuuuccu

SEQ ID NO: 3649105 - RNA, 17 nt, Human
auuuuuuuuuccuucag

SEQ ID NO: 3649106 - RNA, 13 nt, Human
caguggagcccag

SEQ ID NO: 3649107 - RNA, 17 nt, Human
caguggagcccaggagu

SEQ ID NO: 3649108 - RNA, 15 nt, Human
caguggagguuuguc

SEQ ID NO: 3649109 - RNA, 16 nt, Human
caguggcagcugcuuu

SEQ ID NO: 3649110 - RNA, 20 nt, Human
caguggcaggcagaggccca

SEQ ID NO: 3649111 - RNA, 14 nt, Human
caguggcagggcac

SEQ ID NO: 3649112 - RNA, 15 nt, Human
caguggcagggcuca

SEQ ID NO: 3649113 - RNA, 15 nt, Human
caguggcauggcucc

SEQ ID NO: 3649114 - RNA, 14 nt, Human
caguggccacucag

SEQ ID NO: 3649115 - RNA, 21 nt, Human
caguggcccauggcauuuuau

SEQ ID NO: 3649116 - RNA, 23 nt, Human
caguggccuacaaaucaguaauu

SEQ ID NO: 3649117 - RNA, 19 nt, Human
caguggccucaacccuccc

SEQ ID NO: 3649118 - RNA, 14 nt, Human
caguggccuggcuc

SEQ ID NO: 3649119 - RNA, 15 nt, Human
caguggccuggcucc

SEQ ID NO: 3649120 - RNA, 11 nt, Human
caguggccuua

SEQ ID NO: 3649121 - RNA, 19 nt, Human
caguggccuuaccccugcc

SEQ ID NO: 3649122 - RNA, 21 nt, Human
caguggccuuaccccugccuu

SEQ ID NO: 3649123 - RNA, 23 nt, Human
caguggcgaaaucccugcucacu

SEQ ID NO: 3649124 - RNA, 20 nt, Human
caguggcgcauucuaggcuc

SEQ ID NO: 3649125 - RNA, 19 nt, Human
caguggcguuguugcaugu

SEQ ID NO: 3649126 - RNA, 23 nt, Human
caguggcugaguagcucugccuu

SEQ ID NO: 3649127 - RNA, 13 nt, Human
caguggcugcugc

SEQ ID NO: 3649128 - RNA, 14 nt, Human
caguggcugcugcc

SEQ ID NO: 3649129 - RNA, 15 nt, Human
caguggcugcugccc

SEQ ID NO: 3649130 - RNA, 16 nt, Human
caguggcuggaucugu

SEQ ID NO: 3649131 - RNA, 18 nt, Human
cagugggaaaaauguagg

SEQ ID NO: 3649132 - RNA, 19 nt, Human
cagugggaaaaauguagga

SEQ ID NO: 3649133 - RNA, 20 nt, Human
cagugggaacgugacugccc

SEQ ID NO: 3649134 - RNA, 21 nt, Human
cagugggaacgugacugcccc

SEQ ID NO: 3649135 - RNA, 11 nt, Human
cagugggaacu

SEQ ID NO: 3649136 - RNA, 19 nt, Human
cagugggacagggcauggc

SEQ ID NO: 3649137 - RNA, 13 nt, Human
cagugggagaaaa

SEQ ID NO: 3649138 - RNA, 13 nt, Human
cagugggagccag

SEQ ID NO: 3649139 - RNA, 17 nt, Human
cagugggagccagggcu

SEQ ID NO: 3649140 - RNA, 11 nt, Human
cagugggagcu

SEQ ID NO: 3649141 - RNA, 12 nt, Human
cagugggagggg

SEQ ID NO: 3649142 - RNA, 18 nt, Human
cagugggaggggcaggcu

SEQ ID NO: 3649143 - RNA, 22 nt, Human
cagugggaggguaccagcagaa

SEQ ID NO: 3649144 - RNA, 22 nt, Human
cagugggaggugagaccaccuc

SEQ ID NO: 3649145 - RNA, 21 nt, Human
cagugggaugaaccagccggg

SEQ ID NO: 3649146 - RNA, 15 nt, Human
cagugggauuuggua

SEQ ID NO: 3649147 - RNA, 17 nt, Human
cagugggccccgcugca

SEQ ID NO: 3649148 - RNA, 15 nt, Human
cagugggcuccuggc

SEQ ID NO: 3649149 - RNA, 14 nt, Human
caguggggaaugaa

SEQ ID NO: 3649150 - RNA, 21 nt, Human
caguggggcagaggcaguacc

SEQ ID NO: 3649151 - RNA, 20 nt, Human
caguggggcucucugagucc

SEQ ID NO: 3649152 - RNA, 15 nt, Human
caguggguaaaauua

SEQ ID NO: 3649153 - RNA, 21 nt, Human
caguggguuaacaucaguuuu

SEQ ID NO: 3649154 - RNA, 17 nt, Human
cagugguaagaauagua

SEQ ID NO: 3649155 - RNA, 21 nt, Human
cagugguaugaucacggcuca

SEQ ID NO: 3649156 - RNA, 14 nt, Human
caguggugaagaaa

SEQ ID NO: 3649157 - RNA, 17 nt, Human
caguggugaagaaaacu

SEQ ID NO: 3649158 - RNA, 21 nt, Human
caguggugcgaucauggcuca

SEQ ID NO: 3649159 - RNA, 14 nt, Human
cagugguggcaggg

SEQ ID NO: 3649160 - RNA, 19 nt, Human
cagugguggcagggccuag

SEQ ID NO: 3649161 - RNA, 11 nt, Human
caguggugguu

SEQ ID NO: 3649162 - RNA, 18 nt, Human
caguggugguuuucuguu

SEQ ID NO: 3649163 - RNA, 11 nt, Human
cagugguuaag

SEQ ID NO: 3649164 - RNA, 14 nt, Human
cagugguuauuuag

SEQ ID NO: 3649165 - RNA, 22 nt, Human
cagugguuccuaauccucuagg

SEQ ID NO: 3649166 - RNA, 21 nt, Human
cagugguucuacaaucuauuu

SEQ ID NO: 3649167 - RNA, 14 nt, Human
caguguaauuucuu

SEQ ID NO: 3649168 - RNA, 23 nt, Human
caguguacauggaauaacaugua

SEQ ID NO: 3649169 - RNA, 17 nt, Human
caguguaccauuaaaau

SEQ ID NO: 3649170 - RNA, 22 nt, Human
caguguaccauuaaaauaugca

SEQ ID NO: 3649171 - RNA, 17 nt, Human
caguguacccccgccca

SEQ ID NO: 3649172 - RNA, 21 nt, Human
caguguagccccaagaaggcu

SEQ ID NO: 3649173 - RNA, 19 nt, Human
caguguagccuugcccgga

SEQ ID NO: 3649174 - RNA, 21 nt, Human
caguguaguuaauuuaucuaa

SEQ ID NO: 3649175 - RNA, 15 nt, Human
caguguauuucaguu

SEQ ID NO: 3649176 - RNA, 18 nt, Human
cagugucaaauaaacacu

SEQ ID NO: 3649177 - RNA, 19 nt, Human
cagugucaaauaaacacug

SEQ ID NO: 3649178 - RNA, 16 nt, Human
caguguccaaagcagg

SEQ ID NO: 3649179 - RNA, 22 nt, Human
caguguccaaagcagggucugg

SEQ ID NO: 3649180 - RNA, 14 nt, Human
cagugucccgggcc

SEQ ID NO: 3649181 - RNA, 20 nt, Human
caguguccuccccucaagga

SEQ ID NO: 3649182 - RNA, 14 nt, Human
caguguccugagcu

SEQ ID NO: 3649183 - RNA, 16 nt, Human
caguguccuuagaaca

SEQ ID NO: 3649184 - RNA, 14 nt, Human
cagugucucggagg

SEQ ID NO: 3649185 - RNA, 17 nt, Human
cagugucuggcugcaga

SEQ ID NO: 3649186 - RNA, 19 nt, Human
cagugucuggcugcagagc

SEQ ID NO: 3649187 - RNA, 23 nt, Human
cagugucuguaucggagacagug

SEQ ID NO: 3649188 - RNA, 16 nt, Human
cagugucuuccauaau

SEQ ID NO: 3649189 - RNA, 17 nt, Human
cagugucuuccauaaug

SEQ ID NO: 3649190 - RNA, 23 nt, Human
cagugucuuccauaauguauaaa

SEQ ID NO: 3649191 - RNA, 15 nt, Human
cagugucuuccugug

SEQ ID NO: 3649192 - RNA, 15 nt, Human
cagugucuuucuuug

SEQ ID NO: 3649193 - RNA, 23 nt, Human
cagugucuuuuuuuguauaguua

SEQ ID NO: 3649194 - RNA, 14 nt, Human
cagugugacaagga

SEQ ID NO: 3649195 - RNA, 17 nt, Human
cagugugaggccagggc

SEQ ID NO: 3649196 - RNA, 19 nt, Human
cagugugaggccagggcag

SEQ ID NO: 3649197 - RNA, 21 nt, Human
cagugugcaaggcagccgugg

SEQ ID NO: 3649198 - RNA, 21 nt, Human
cagugugcacgagugggaagg

SEQ ID NO: 3649199 - RNA, 23 nt, Human
cagugugcacuaaggggcccggc

SEQ ID NO: 3649200 - RNA, 15 nt, Human
cagugugccccccau

SEQ ID NO: 3649201 - RNA, 18 nt, Human
caguguggaggccacugu

SEQ ID NO: 3649202 - RNA, 19 nt, Human
caguguggaggccacuguu

SEQ ID NO: 3649203 - RNA, 13 nt, Human
caguguggagugg

SEQ ID NO: 3649204 - RNA, 15 nt, Human
caguguggccaggcu

SEQ ID NO: 3649205 - RNA, 16 nt, Human
caguguggccaggcug

SEQ ID NO: 3649206 - RNA, 15 nt, Human
cagugugguaguuaa

SEQ ID NO: 3649207 - RNA, 22 nt, Human
caaacaacagaaagucauuccu

SEQ ID NO: 3649208 - RNA, 20 nt, Human
caaacaaccccccaucacaa

SEQ ID NO: 3649209 - RNA, 18 nt, Human
caaacaagcauauaaaau

SEQ ID NO: 3649210 - RNA, 21 nt, Human
caaacaaggccugucagcuaa

SEQ ID NO: 3649211 - RNA, 22 nt, Human
caaacaauaccugaaugcucug

SEQ ID NO: 3649212 - RNA, 18 nt, Human
caaacaauugaagucaau

SEQ ID NO: 3649213 - RNA, 14 nt, Human
caaacaauuuaaaa

SEQ ID NO: 3649214 - RNA, 16 nt, Human
caaacaauuuaaaaau

SEQ ID NO: 3649215 - RNA, 15 nt, Human
caaacacaaaugcag

SEQ ID NO: 3649216 - RNA, 16 nt, Human
caaacacacacaaaag

SEQ ID NO: 3649217 - RNA, 12 nt, Human
caaacacaggca

SEQ ID NO: 3649218 - RNA, 16 nt, Human
caaacaccaacauaaa

SEQ ID NO: 3649219 - RNA, 14 nt, Human
caaacaccucccag

SEQ ID NO: 3649220 - RNA, 22 nt, Human
caaacaccugcugauguggcaa

SEQ ID NO: 3649221 - RNA, 12 nt, Human
caaacaccuucc

SEQ ID NO: 3649222 - RNA, 21 nt, Human
caaacaccuucuuauuauaua

SEQ ID NO: 3649223 - RNA, 18 nt, Human
caaacacuccacccucca

SEQ ID NO: 3649224 - RNA, 15 nt, Human
caaacagaacagggu

SEQ ID NO: 3649225 - RNA, 14 nt, Human
caaacagcaaacca

SEQ ID NO: 3649226 - RNA, 16 nt, Human
caaacagcaaaccaag

SEQ ID NO: 3649227 - RNA, 20 nt, Human
caaacagccaacuagccccu

SEQ ID NO: 3649228 - RNA, 18 nt, Human
caaacagccaagauuuuc

SEQ ID NO: 3649229 - RNA, 16 nt, Human
caaacagcucaggcug

SEQ ID NO: 3649230 - RNA, 15 nt, Human
caaacaggcucagag

SEQ ID NO: 3649231 - RNA, 12 nt, Human
caaacagggccu

SEQ ID NO: 3649232 - RNA, 15 nt, Human
caaacagggccucug

SEQ ID NO: 3649233 - RNA, 16 nt, Human
caaacauaugcacauu

SEQ ID NO: 3649234 - RNA, 19 nt, Human
caaacauccucuuccauau

SEQ ID NO: 3649235 - RNA, 21 nt, Human
caaacaugaaguguguuuccu

SEQ ID NO: 3649236 - RNA, 21 nt, Human
caaacaugacccuaaaucuug

SEQ ID NO: 3649237 - RNA, 23 nt, Human
caaacaugggguuggcugggccc

SEQ ID NO: 3649238 - RNA, 16 nt, Human
caaacauguauuuaug

SEQ ID NO: 3649239 - RNA, 20 nt, Human
caaacaugugguuaaugcca

SEQ ID NO: 3649240 - RNA, 18 nt, Human
caaacauuaauguugauu

SEQ ID NO: 3649241 - RNA, 15 nt, Human
caaacauuucaaagu

SEQ ID NO: 3649242 - RNA, 21 nt, Human
caaacauuuucucuuagaaaa

SEQ ID NO: 3649243 - RNA, 12 nt, Human
caaacauuuuga

SEQ ID NO: 3649244 - RNA, 15 nt, Human
caaaccaaauaaaaa

SEQ ID NO: 3649245 - RNA, 21 nt, Human
caaaccacaacugacacagga

SEQ ID NO: 3649246 - RNA, 23 nt, Human
caaaccagauacggacagagacc

SEQ ID NO: 3649247 - RNA, 17 nt, Human
caaaccaguaucgcuca

SEQ ID NO: 3649248 - RNA, 15 nt, Human
caaaccauaaacuuc

SEQ ID NO: 3649249 - RNA, 22 nt, Human
caaacccacgauuuucuccagc

SEQ ID NO: 3649250 - RNA, 22 nt, Human
cauauuagacuucuguuuucaa

SEQ ID NO: 3649251 - RNA, 20 nt, Human
cauauuagcgacaacagauu

SEQ ID NO: 3649252 - RNA, 17 nt, Human
cauauuccauauuuauu

SEQ ID NO: 3649253 - RNA, 21 nt, Human
cauauuccugcagccuggagg

SEQ ID NO: 3649254 - RNA, 15 nt, Human
cauauucuugugcuu

SEQ ID NO: 3649255 - RNA, 21 nt, Human
cauauugagcacuugcuguau

SEQ ID NO: 3649256 - RNA, 13 nt, Human
cauauugaugaaa

SEQ ID NO: 3649257 - RNA, 17 nt, Human
cauauugcacaugucuu

SEQ ID NO: 3649258 - RNA, 20 nt, Human
cauauugcacaugucuuaau

SEQ ID NO: 3649259 - RNA, 22 nt, Human
cauauugcacaugucuuaauga

SEQ ID NO: 3649260 - RNA, 23 nt, Human
cauauugcacaugucuuaaugaa

SEQ ID NO: 3649261 - RNA, 21 nt, Human
cauauugcauacuauuaaaca

SEQ ID NO: 3649262 - RNA, 16 nt, Human
cauauugcugagagaa

SEQ ID NO: 3649263 - RNA, 13 nt, Human
caaauuaauuuua

SEQ ID NO: 3649264 - RNA, 18 nt, Human
caaauuacuuugugaaua

SEQ ID NO: 3649265 - RNA, 19 nt, Human
caaauuagaagacauuuau

SEQ ID NO: 3649266 - RNA, 15 nt, Human
caaauuagggcaauu

SEQ ID NO: 3649267 - RNA, 15 nt, Human
caaauuaguuauaua

SEQ ID NO: 3649268 - RNA, 16 nt, Human
caaauuaucaagcuaa

SEQ ID NO: 3649269 - RNA, 20 nt, Human
caaauuaugcuaagaauuuu

SEQ ID NO: 3649270 - RNA, 17 nt, Human
caaauuauuaaugaaaa

SEQ ID NO: 3649271 - RNA, 15 nt, Human
caaauuauuugugua

SEQ ID NO: 3649272 - RNA, 16 nt, Human
caaauuauuuguguaa

SEQ ID NO: 3649273 - RNA, 12 nt, Human
caaauucaguuu

SEQ ID NO: 3649274 - RNA, 15 nt, Human
caaauucaguuucau

SEQ ID NO: 3649275 - RNA, 16 nt, Human
caaauucaguuucaua

SEQ ID NO: 3649276 - RNA, 18 nt, Human
caaauucaguuucauaaa

SEQ ID NO: 3649277 - RNA, 14 nt, Human
caaauucauuuuuu

SEQ ID NO: 3649278 - RNA, 20 nt, Human
caaauucccagauuugaaga

SEQ ID NO: 3649279 - RNA, 21 nt, Human
caaauucccagauuugaagac

SEQ ID NO: 3649280 - RNA, 20 nt, Human
caaauuccuauuuuuaaaua

SEQ ID NO: 3649281 - RNA, 20 nt, Human
caaauucuacaacuuuuccu

SEQ ID NO: 3649282 - RNA, 15 nt, Human
caaauucucaccaaa

SEQ ID NO: 3649283 - RNA, 22 nt, Human
caaauucugcuugcuugcuuuu

SEQ ID NO: 3649284 - RNA, 18 nt, Human
caaauucugucucuggau

SEQ ID NO: 3649285 - RNA, 14 nt, Human
caaauucuucugaa

SEQ ID NO: 3649286 - RNA, 21 nt, Human
caaauucuuuugaauuguuac

SEQ ID NO: 3649287 - RNA, 14 nt, Human
caaauugagacagu

SEQ ID NO: 3649288 - RNA, 21 nt, Human
caaauuggacuuucaaaauua

SEQ ID NO: 3649289 - RNA, 20 nt, Human
caaauuguaauuaauaauag

SEQ ID NO: 3649290 - RNA, 14 nt, Human
caaauugucagcaa

SEQ ID NO: 3649291 - RNA, 22 nt, Human
caaauugucuuuugucaugugg

SEQ ID NO: 3649292 - RNA, 22 nt, Human
caaauugugcuucuccccagaa

SEQ ID NO: 3649293 - RNA, 23 nt, Human
caaauugugcuucuccccagaau

SEQ ID NO: 3649294 - RNA, 15 nt, Human
caaauugugugaaag

SEQ ID NO: 3649295 - RNA, 23 nt, Human
caaauugugugugcucugcuuca

SEQ ID NO: 3649296 - RNA, 19 nt, Human
caaauuuaaaacuguugga

SEQ ID NO: 3649297 - RNA, 23 nt, Human
caaauuuacagagacagaaagca

SEQ ID NO: 3649298 - RNA, 22 nt, Human
caaauuuagaaacuaauugacu

SEQ ID NO: 3649299 - RNA, 15 nt, Human
caaauuuauaauuuu

SEQ ID NO: 3649300 - RNA, 17 nt, Human
caaauuuaucaaagcau

SEQ ID NO: 3649301 - RNA, 17 nt, Human
caaauuucaaaagacau

SEQ ID NO: 3649302 - RNA, 15 nt, Human
caaauuucacuuaua

SEQ ID NO: 3649303 - RNA, 11 nt, Human
caaauuucuaa

SEQ ID NO: 3649304 - RNA, 15 nt, Human
caaauuucuaaaucu

SEQ ID NO: 3649305 - RNA, 19 nt, Human
caaauuuggggguuucuca

SEQ ID NO: 3649306 - RNA, 19 nt, Human
caaauuuguaggguuucua

SEQ ID NO: 3649307 - RNA, 22 nt, Human
caaauuugucugguuaaaaaau

SEQ ID NO: 3649308 - RNA, 17 nt, Human
caaauuuuauuuguagg

SEQ ID NO: 3649309 - RNA, 15 nt, Human
caaauuuuuugacuu

SEQ ID NO: 3649310 - RNA, 16 nt, Human
caacaaaaagcuuccc

SEQ ID NO: 3649311 - RNA, 12 nt, Human
caacaaaaauuu

SEQ ID NO: 3649312 - RNA, 13 nt, Human
caacaaaaauuug

SEQ ID NO: 3649313 - RNA, 12 nt, Human
caacaaaauaca

SEQ ID NO: 3649314 - RNA, 13 nt, Human
caacaaaauacau

SEQ ID NO: 3649315 - RNA, 16 nt, Human
caacaaacugcacaug

SEQ ID NO: 3649316 - RNA, 14 nt, Human
caacaaagaaauau

SEQ ID NO: 3649317 - RNA, 12 nt, Human
caacaaagcugu

SEQ ID NO: 3649318 - RNA, 12 nt, Human
caacaaaggaag

SEQ ID NO: 3649319 - RNA, 23 nt, Human
caacaaaggauuaauugcugcaa

SEQ ID NO: 3649320 - RNA, 20 nt, Human
caacaaaggguuuuaaugua

SEQ ID NO: 3649321 - RNA, 22 nt, Human
caacaaaucuaggaaaauauuu

SEQ ID NO: 3649322 - RNA, 15 nt, Human
caacaacaauuggua

SEQ ID NO: 3649323 - RNA, 18 nt, Human
caacaagaaugcauugau

SEQ ID NO: 3649324 - RNA, 14 nt, Human
caacaagaguuuau

SEQ ID NO: 3649325 - RNA, 21 nt, Human
caacaagauuuccuugugcaa

SEQ ID NO: 3649326 - RNA, 19 nt, Human
caacaagggcaguggaggu

SEQ ID NO: 3649327 - RNA, 16 nt, Human
caacaauaaaauuuuu

SEQ ID NO: 3649328 - RNA, 12 nt, Human
caacaauaaaua

SEQ ID NO: 3649329 - RNA, 17 nt, Human
caacaaucccaaggccc

SEQ ID NO: 3649330 - RNA, 18 nt, Human
caacaaugugaggggucc

SEQ ID NO: 3649331 - RNA, 18 nt, Human
caacaauugguaaaacuc

SEQ ID NO: 3649332 - RNA, 18 nt, Human
caacaauuucuacuuuga

SEQ ID NO: 3649333 - RNA, 19 nt, Human
caacaauuucuacuuugaa

SEQ ID NO: 3649334 - RNA, 20 nt, Human
caacaauuucuacuuugaag

SEQ ID NO: 3649335 - RNA, 13 nt, Human
caacacaaagaga

SEQ ID NO: 3649336 - RNA, 14 nt, Human
caacacaagguggg

SEQ ID NO: 3649337 - RNA, 16 nt, Human
caacacaauaacacua

SEQ ID NO: 3649338 - RNA, 18 nt, Human
caacacaauguuauucgu

SEQ ID NO: 3649339 - RNA, 14 nt, Human
caacacacacacuc

SEQ ID NO: 3649340 - RNA, 15 nt, Human
caacacacacaugcu

SEQ ID NO: 3649341 - RNA, 16 nt, Human
caacacaccuggugaa

SEQ ID NO: 3649342 - RNA, 13 nt, Human
caacacagccugg

SEQ ID NO: 3649343 - RNA, 16 nt, Human
caacacagccugggcc

SEQ ID NO: 3649344 - RNA, 13 nt, Human
caacaccaagcac

SEQ ID NO: 3649345 - RNA, 12 nt, Human
caacaccacaga

SEQ ID NO: 3649346 - RNA, 14 nt, Human
caacaccacagaca

SEQ ID NO: 3649347 - RNA, 17 nt, Human
caacaccagccccugcc

SEQ ID NO: 3649348 - RNA, 18 nt, Human
caacaccagccccugccc

SEQ ID NO: 3649349 - RNA, 22 nt, Human
caacaccagccccugccccagc

SEQ ID NO: 3649350 - RNA, 18 nt, Human
caacaccaucacagcuug

SEQ ID NO: 3649351 - RNA, 17 nt, Human
caacaccaugauuccuu

SEQ ID NO: 3649352 - RNA, 13 nt, Human
caacacguuacua

SEQ ID NO: 3649353 - RNA, 21 nt, Human
caacacugauuuccccuuuug

SEQ ID NO: 3649354 - RNA, 14 nt, Human
caacacugccagca

SEQ ID NO: 3649355 - RNA, 18 nt, Human
caacacuggucugcuguu

SEQ ID NO: 3649356 - RNA, 22 nt, Human
caacacuggucugcuguuccag

SEQ ID NO: 3649357 - RNA, 13 nt, Human
caacacuggugug

SEQ ID NO: 3649358 - RNA, 22 nt, Human
caacacuguaguaaauaaugcu

SEQ ID NO: 3649359 - RNA, 17 nt, Human
caacacugugcccuggu

SEQ ID NO: 3649360 - RNA, 14 nt, Human
caacagaaaaaugg

SEQ ID NO: 3649361 - RNA, 14 nt, Human
caacagaaagucau

SEQ ID NO: 3649362 - RNA, 16 nt, Human
caacagaacuaaaugu

SEQ ID NO: 3649363 - RNA, 15 nt, Human
caacagaagaacugu

SEQ ID NO: 3649364 - RNA, 12 nt, Human
caacagaagcag

SEQ ID NO: 3649365 - RNA, 15 nt, Human
caacagaagcauuug

SEQ ID NO: 3649366 - RNA, 19 nt, Human
caacagaagcauuuguauu

SEQ ID NO: 3649367 - RNA, 22 nt, Human
caacagaagucaugaagcccaa

SEQ ID NO: 3649368 - RNA, 14 nt, Human
caacagaaugaaaa

SEQ ID NO: 3649369 - RNA, 20 nt, Human
caacagaaugaaaaaugaaa

SEQ ID NO: 3649370 - RNA, 21 nt, Human
caacagaaugaaaaaugaaag

SEQ ID NO: 3649371 - RNA, 22 nt, Human
caacagaaugaaaaaugaaaga

SEQ ID NO: 3649372 - RNA, 23 nt, Human
caacagagugagacccugucucu

SEQ ID NO: 3649373 - RNA, 14 nt, Human
caacagauacugga

SEQ ID NO: 3649374 - RNA, 17 nt, Human
caacagaucaauuugua

SEQ ID NO: 3649375 - RNA, 13 nt, Human
caacagaucugga

SEQ ID NO: 3649376 - RNA, 20 nt, Human
caacagauuggauuuuaugu

SEQ ID NO: 3649377 - RNA, 21 nt, Human
caacagauuggauuuuauguu

SEQ ID NO: 3649378 - RNA, 17 nt, Human
caacagauuugugaacu

SEQ ID NO: 3649379 - RNA, 23 nt, Human
caacagauuugugaacucagcca

SEQ ID NO: 3649380 - RNA, 15 nt, Human
caacagcacuggcuc

SEQ ID NO: 3649381 - RNA, 16 nt, Human
caacagccaacagcua

SEQ ID NO: 3649382 - RNA, 19 nt, Human
caacagccaauauuuaaaa

SEQ ID NO: 3649383 - RNA, 12 nt, Human
caacagccaugc

SEQ ID NO: 3649384 - RNA, 21 nt, Human
caacagcgacauagcccaucc

SEQ ID NO: 3649385 - RNA, 16 nt, Human
caacagcuacaacagc

SEQ ID NO: 3649386 - RNA, 20 nt, Human
caacagcuacaacagccuca

SEQ ID NO: 3649387 - RNA, 23 nt, Human
caacagcuggugcccugcuuuca

SEQ ID NO: 3649388 - RNA, 19 nt, Human
caacaggaaucaagagcug

SEQ ID NO: 3649389 - RNA, 21 nt, Human
caacaggaaucaagagcugcc

SEQ ID NO: 3649390 - RNA, 14 nt, Human
caacaggagcuggg

SEQ ID NO: 3649391 - RNA, 22 nt, Human
caacaggaggacaauucaugaa

SEQ ID NO: 3649392 - RNA, 23 nt, Human
caacaggaggacaauucaugaac

SEQ ID NO: 3649393 - RNA, 19 nt, Human
caacaggccucagggcucc

SEQ ID NO: 3649394 - RNA, 20 nt, Human
caacaggcuuaugaauauau

SEQ ID NO: 3649395 - RNA, 21 nt, Human
caagagggugacagcuuccuu

SEQ ID NO: 3649396 - RNA, 15 nt, Human
caagagucuaaagau

SEQ ID NO: 3649397 - RNA, 16 nt, Human
caagagucuggggacc

SEQ ID NO: 3649398 - RNA, 15 nt, Human
caagaguggccccac

SEQ ID NO: 3649399 - RNA, 16 nt, Human
caagaguggccccacc

SEQ ID NO: 3649400 - RNA, 19 nt, Human
caagaguggccccaccugg

SEQ ID NO: 3649401 - RNA, 22 nt, Human
caagaguggccccaccuggccc

SEQ ID NO: 3649402 - RNA, 14 nt, Human
caagauaaaggaca

SEQ ID NO: 3649403 - RNA, 18 nt, Human
caagauagauuuggaaua

SEQ ID NO: 3649404 - RNA, 18 nt, Human
caagauaggaccuugggc

SEQ ID NO: 3649405 - RNA, 15 nt, Human
caagauauggacaca

SEQ ID NO: 3649406 - RNA, 15 nt, Human
caagauauuguacau

SEQ ID NO: 3649407 - RNA, 16 nt, Human
caagauauuuauauau

SEQ ID NO: 3649408 - RNA, 21 nt, Human
caagauauuuuaaaaucuguc

SEQ ID NO: 3649409 - RNA, 15 nt, Human
caagaucauucagug

SEQ ID NO: 3649410 - RNA, 15 nt, Human
caagaucccauuuga

SEQ ID NO: 3649411 - RNA, 20 nt, Human
caagaucugugcagccccgc

SEQ ID NO: 3649412 - RNA, 15 nt, Human
caagaucuuucagga

SEQ ID NO: 3649413 - RNA, 18 nt, Human
caagaugaaggagaggca

SEQ ID NO: 3649414 - RNA, 16 nt, Human
caagaugacuggggug

SEQ ID NO: 3649415 - RNA, 21 nt, Human
caagaugagauuggcauggcu

SEQ ID NO: 3649416 - RNA, 18 nt, Human
caagaugccaucuguguc

SEQ ID NO: 3649417 - RNA, 17 nt, Human
caagaugggcaucuuuu

SEQ ID NO: 3649418 - RNA, 20 nt, Human
caagaugggcaucuuuugua

SEQ ID NO: 3649419 - RNA, 20 nt, Human
caagaugggggcagggcugu

SEQ ID NO: 3649420 - RNA, 16 nt, Human
caagaugguucuagca

SEQ ID NO: 3649421 - RNA, 16 nt, Human
caagaugucagacugg

SEQ ID NO: 3649422 - RNA, 19 nt, Human
caagaugugaauuauugac

SEQ ID NO: 3649423 - RNA, 22 nt, Human
caagaugugaauuauugacacu

SEQ ID NO: 3649424 - RNA, 17 nt, Human
caagauuauaauauuuu

SEQ ID NO: 3649425 - RNA, 18 nt, Human
caagauucacaccugacu

SEQ ID NO: 3649426 - RNA, 19 nt, Human
caagauucacaccugacuc

SEQ ID NO: 3649427 - RNA, 17 nt, Human
caagauucccagagaca

SEQ ID NO: 3649428 - RNA, 16 nt, Human
caagauucccaggagu

SEQ ID NO: 3649429 - RNA, 20 nt, Human
caagauucccaggaguucug

SEQ ID NO: 3649430 - RNA, 10 nt, Human
caagauuccg

SEQ ID NO: 3649431 - RNA, 18 nt, Human
caagauuccggauccuaa

SEQ ID NO: 3649432 - RNA, 13 nt, Human
caagauucuagau

SEQ ID NO: 3649433 - RNA, 17 nt, Human
caagauucuagaugauu

SEQ ID NO: 3649434 - RNA, 12 nt, Human
caagauugaaaa

SEQ ID NO: 3649435 - RNA, 20 nt, Human
caagauugagcucucugccc

SEQ ID NO: 3649436 - RNA, 13 nt, Human
caagauugcuuaa

SEQ ID NO: 3649437 - RNA, 18 nt, Human
caagauugcuuaaaauag

SEQ ID NO: 3649438 - RNA, 20 nt, Human
caagauugguguuuuuuucu

SEQ ID NO: 3649439 - RNA, 15 nt, Human
caagauuuagaaaaa

SEQ ID NO: 3649440 - RNA, 17 nt, Human
caagauuuuccacaaga

SEQ ID NO: 3649441 - RNA, 12 nt, Human
caagauuuuccu

SEQ ID NO: 3649442 - RNA, 18 nt, Human
caagauuuuccucuugug

SEQ ID NO: 3649443 - RNA, 22 nt, Human
caagauuuugaaugcuuccuga

SEQ ID NO: 3649444 - RNA, 23 nt, Human
caagauuuugggagaguaaagcu

SEQ ID NO: 3649445 - RNA, 19 nt, Human
caagauuuuuuaauuguuu

SEQ ID NO: 3649446 - RNA, 21 nt, Human
caagauuuuuuaauuguuuaa

SEQ ID NO: 3649447 - RNA, 16 nt, Human
caagcaaaaggagaga

SEQ ID NO: 3649448 - RNA, 17 nt, Human
caagcaaacccagacgg

SEQ ID NO: 3649449 - RNA, 15 nt, Human
caagcaaauguuaca

SEQ ID NO: 3649450 - RNA, 17 nt, Human
caagcaaccugggucca

SEQ ID NO: 3649451 - RNA, 18 nt, Human
caagcaagaaacacuggg

SEQ ID NO: 3649452 - RNA, 13 nt, Human
caagcaagacuga

SEQ ID NO: 3649453 - RNA, 12 nt, Human
caagcaagcucc

SEQ ID NO: 3649454 - RNA, 23 nt, Human
caagcaagcucccaagggauggu

SEQ ID NO: 3649455 - RNA, 12 nt, Human
caagcacagcag

SEQ ID NO: 3649456 - RNA, 13 nt, Human
caagcacagcagc

SEQ ID NO: 3649457 - RNA, 14 nt, Human
caagcacagcccuu

SEQ ID NO: 3649458 - RNA, 13 nt, Human
caagcacagucag

SEQ ID NO: 3649459 - RNA, 19 nt, Human
caagcacagugguggcagg

SEQ ID NO: 3649460 - RNA, 20 nt, Human
caagcacaucugcauuuuca

SEQ ID NO: 3649461 - RNA, 22 nt, Human
caagcaccaccaaacacagugu

SEQ ID NO: 3649462 - RNA, 13 nt, Human
caagcaccauccc

SEQ ID NO: 3649463 - RNA, 17 nt, Human
caagcaccauccccucc

SEQ ID NO: 3649464 - RNA, 13 nt, Human
caagcaccuccug

SEQ ID NO: 3649465 - RNA, 18 nt, Human
caagcaccuccugccucg

SEQ ID NO: 3649466 - RNA, 17 nt, Human
caagcacuaaacaaaga

SEQ ID NO: 3649467 - RNA, 22 nt, Human
caagcacuucaggccuauguuu

SEQ ID NO: 3649468 - RNA, 18 nt, Human
caagcagaggaccagggc

SEQ ID NO: 3649469 - RNA, 21 nt, Human
caagcagaggaccagggccuu

SEQ ID NO: 3649470 - RNA, 22 nt, Human
caagcagaggaccagggccuuu

SEQ ID NO: 3649471 - RNA, 20 nt, Human
caagcagagugcacagcugu

SEQ ID NO: 3649472 - RNA, 13 nt, Human
caagcagccaagc

SEQ ID NO: 3649473 - RNA, 22 nt, Human
caagcagcgaccgcccccuccu

SEQ ID NO: 3649474 - RNA, 21 nt, Human
caugccaacaagaaugcauug

SEQ ID NO: 3649475 - RNA, 22 nt, Human
caugccaaccccgcccuaggcc

SEQ ID NO: 3649476 - RNA, 18 nt, Human
caugccaagcacugugcu

SEQ ID NO: 3649477 - RNA, 17 nt, Human
caugccacaaggacuuc

SEQ ID NO: 3649478 - RNA, 21 nt, Human
caugccaccauggccagccaa

SEQ ID NO: 3649479 - RNA, 13 nt, Human
caugccaggaacc

SEQ ID NO: 3649480 - RNA, 20 nt, Human
caugccagggccaugucaga

SEQ ID NO: 3649481 - RNA, 14 nt, Human
caugccaguauuuu

SEQ ID NO: 3649482 - RNA, 19 nt, Human
caugccaguauuuuuaaag

SEQ ID NO: 3649483 - RNA, 13 nt, Human
caugcccaccccc

SEQ ID NO: 3649484 - RNA, 18 nt, Human
caugcccacccccugccc

SEQ ID NO: 3649485 - RNA, 20 nt, Human
caugcccacccccugcccug

SEQ ID NO: 3649486 - RNA, 21 nt, Human
caugcccacccccugcccugc

SEQ ID NO: 3649487 - RNA, 17 nt, Human
caugcccagagacccag

SEQ ID NO: 3649488 - RNA, 22 nt, Human
caugcccagucgauaucucacu

SEQ ID NO: 3649489 - RNA, 14 nt, Human
caugccccccucaa

SEQ ID NO: 3649490 - RNA, 19 nt, Human
caugccccccucaaaccuc

SEQ ID NO: 3649491 - RNA, 21 nt, Human
caugccccccucaaaccuccu

SEQ ID NO: 3649492 - RNA, 15 nt, Human
caugcccccucgugc

SEQ ID NO: 3649493 - RNA, 17 nt, Human
caugcccccucgugcca

SEQ ID NO: 3649494 - RNA, 11 nt, Human
caugcccccug

SEQ ID NO: 3649495 - RNA, 14 nt, Human
caugcccccugcag

SEQ ID NO: 3649496 - RNA, 15 nt, Human
caugccccuggcugg

SEQ ID NO: 3649497 - RNA, 18 nt, Human
caugcccggucccacccc

SEQ ID NO: 3649498 - RNA, 13 nt, Human
caugcccucccuu

SEQ ID NO: 3649499 - RNA, 17 nt, Human
caugcccuccucuccca

SEQ ID NO: 3649500 - RNA, 13 nt, Human
caugcccucucag

SEQ ID NO: 3649501 - RNA, 14 nt, Human
caugcccugugcaa

SEQ ID NO: 3649502 - RNA, 18 nt, Human
caugcccugugcaaccuc

SEQ ID NO: 3649503 - RNA, 23 nt, Human
caugcccugugcaaccucuuggc

SEQ ID NO: 3649504 - RNA, 14 nt, Human
caugccgggcgcag

SEQ ID NO: 3649505 - RNA, 18 nt, Human
caugccucacuaauuuuu

SEQ ID NO: 3649506 - RNA, 18 nt, Human
caugccucagaagugcau

SEQ ID NO: 3649507 - RNA, 14 nt, Human
caugccucagcccu

SEQ ID NO: 3649508 - RNA, 20 nt, Human
caugccucagcccugacccu

SEQ ID NO: 3649509 - RNA, 18 nt, Human
caugccucucucaggcca

SEQ ID NO: 3649510 - RNA, 15 nt, Human
caugccucugaggcc

SEQ ID NO: 3649511 - RNA, 17 nt, Human
caugccucugaggccag

SEQ ID NO: 3649512 - RNA, 19 nt, Human
caugccucugaggccagcc

SEQ ID NO: 3649513 - RNA, 14 nt, Human
caugccugagagac

SEQ ID NO: 3649514 - RNA, 11 nt, Human
caugccugagg

SEQ ID NO: 3649515 - RNA, 13 nt, Human
caugccugagggu

SEQ ID NO: 3649516 - RNA, 15 nt, Human
caugccugagggugg

SEQ ID NO: 3649517 - RNA, 16 nt, Human
caugccugagggugga

SEQ ID NO: 3649518 - RNA, 20 nt, Human
caugccugaggguggagacu

SEQ ID NO: 3649519 - RNA, 20 nt, Human
caugccugccccaaacaaau

SEQ ID NO: 3649520 - RNA, 18 nt, Human
caugccuggauggggcug

SEQ ID NO: 3649521 - RNA, 16 nt, Human
caugccuguccagccu

SEQ ID NO: 3649522 - RNA, 17 nt, Human
caugccuguccagccug

SEQ ID NO: 3649523 - RNA, 20 nt, Human
caugccuguccagccugggc

SEQ ID NO: 3649524 - RNA, 19 nt, Human
caugccuuaaaccuaccuc

SEQ ID NO: 3649525 - RNA, 13 nt, Human
caugccuuccagc

SEQ ID NO: 3649526 - RNA, 15 nt, Human
caugccuuccagcac

SEQ ID NO: 3649527 - RNA, 20 nt, Human
caugccuuccagcacccugc

SEQ ID NO: 3649528 - RNA, 13 nt, Human
caugcgcacaagg

SEQ ID NO: 3649529 - RNA, 23 nt, Human
caugcgcucagggccaugcugag

SEQ ID NO: 3649530 - RNA, 14 nt, Human
caugcggagaacaa

SEQ ID NO: 3649531 - RNA, 16 nt, Human
caugcggagaacaaau

SEQ ID NO: 3649532 - RNA, 13 nt, Human
caugcggcccagc

SEQ ID NO: 3649533 - RNA, 18 nt, Human
caugcggcccagcccggc

SEQ ID NO: 3649534 - RNA, 19 nt, Human
caugcggcccagcccggcu

SEQ ID NO: 3649535 - RNA, 13 nt, Human
caugcggucgggc

SEQ ID NO: 3649536 - RNA, 16 nt, Human
caugcguguuucugac

SEQ ID NO: 3649537 - RNA, 17 nt, Human
caugcguguuucugacu

SEQ ID NO: 3649538 - RNA, 20 nt, Human
caugcuaccugaucccacuc

SEQ ID NO: 3649539 - RNA, 18 nt, Human
caugcuauucacaauuau

SEQ ID NO: 3649540 - RNA, 12 nt, Human
cagugucuuuuu

SEQ ID NO: 3649541 - RNA, 17 nt, Human
cagugucuuuuuuugua

SEQ ID NO: 3649542 - RNA, 13 nt, Human
cagugugaaguua

SEQ ID NO: 3649543 - RNA, 21 nt, Human
cagugugaaguuagaauuccu

SEQ ID NO: 3649544 - RNA, 17 nt, Human
cagugugagggaaagag

SEQ ID NO: 3649545 - RNA, 18 nt, Human
cagugugaucccaagugc

SEQ ID NO: 3649546 - RNA, 12 nt, Human
cagugugauuuu

SEQ ID NO: 3649547 - RNA, 20 nt, Human
cagugugcaaggcagccgug

SEQ ID NO: 3649548 - RNA, 14 nt, Human
cagugugcccccca

SEQ ID NO: 3649549 - RNA, 23 nt, Human
cagugugccccccauccuggccc

SEQ ID NO: 3649550 - RNA, 11 nt, Human
caguguggaac

SEQ ID NO: 3649551 - RNA, 14 nt, Human
cagugugucuaaau

SEQ ID NO: 3649552 - RNA, 15 nt, Human
cagugugucuccugc

SEQ ID NO: 3649553 - RNA, 21 nt, Human
caguguguggucaacauuucu

SEQ ID NO: 3649554 - RNA, 17 nt, Human
caguguguuugugauug

SEQ ID NO: 3649555 - RNA, 14 nt, Human
caguguuaaaaaau

SEQ ID NO: 3649556 - RNA, 17 nt, Human
caguguuaaaugaaauu

SEQ ID NO: 3649557 - RNA, 18 nt, Human
caguguuaccugugugcu

SEQ ID NO: 3649558 - RNA, 16 nt, Human
caguguuaggccuggc

SEQ ID NO: 3649559 - RNA, 17 nt, Human
caguguuaggccuggca

SEQ ID NO: 3649560 - RNA, 18 nt, Human
caguguuccgugguuaaa

SEQ ID NO: 3649561 - RNA, 17 nt, Human
caguguucgcuuggcuc

SEQ ID NO: 3649562 - RNA, 23 nt, Human
caguguucgcuuggcuccaugcu

SEQ ID NO: 3649563 - RNA, 17 nt, Human
caguguucuaugaacaa

SEQ ID NO: 3649564 - RNA, 12 nt, Human
caguguugagau

SEQ ID NO: 3649565 - RNA, 18 nt, Human
caguguuggggaugccuu

SEQ ID NO: 3649566 - RNA, 16 nt, Human
caguguugguauauuu

SEQ ID NO: 3649567 - RNA, 20 nt, Human
caguguuguggauuuaacag

SEQ ID NO: 3649568 - RNA, 15 nt, Human
caguguuguuuguaa

SEQ ID NO: 3649569 - RNA, 16 nt, Human
caguguuguuuguaaa

SEQ ID NO: 3649570 - RNA, 19 nt, Human
caguguuguuuguaaauaa

SEQ ID NO: 3649571 - RNA, 11 nt, Human
caguguuuaug

SEQ ID NO: 3649572 - RNA, 23 nt, Human
caguguuuaugugcuauuaauau

SEQ ID NO: 3649573 - RNA, 14 nt, Human
caguguuucccaua

SEQ ID NO: 3649574 - RNA, 15 nt, Human
caguguuucccauaa

SEQ ID NO: 3649575 - RNA, 17 nt, Human
caguguuucccauaauu

SEQ ID NO: 3649576 - RNA, 20 nt, Human
caguguuucccauaauuuuc

SEQ ID NO: 3649577 - RNA, 13 nt, Human
caguguuuggugc

SEQ ID NO: 3649578 - RNA, 14 nt, Human
caguguuuuaaauu

SEQ ID NO: 3649579 - RNA, 16 nt, Human
caguguuuuaaauucu

SEQ ID NO: 3649580 - RNA, 19 nt, Human
caguguuuucagaagaaau

SEQ ID NO: 3649581 - RNA, 22 nt, Human
caguguuuucugggauaaguaa

SEQ ID NO: 3649582 - RNA, 18 nt, Human
caguguuuugcaagugcu

SEQ ID NO: 3649583 - RNA, 20 nt, Human
caguguuuuggacuccaucu

SEQ ID NO: 3649584 - RNA, 21 nt, Human
caguguuuuuagaccuguguu

SEQ ID NO: 3649585 - RNA, 16 nt, Human
caguuaaaaaaaauuu

SEQ ID NO: 3649586 - RNA, 21 nt, Human
caguuaacuauugcauuuaua

SEQ ID NO: 3649587 - RNA, 13 nt, Human
caguuaagagaaa

SEQ ID NO: 3649588 - RNA, 19 nt, Human
caguuaagcagccgccaca

SEQ ID NO: 3649589 - RNA, 22 nt, Human
caguuaauuacucagcagaaug

SEQ ID NO: 3649590 - RNA, 19 nt, Human
caguuaauuuuuccaacua

SEQ ID NO: 3649591 - RNA, 19 nt, Human
caguuacaaauuauaaugu

SEQ ID NO: 3649592 - RNA, 13 nt, Human
caguuacagaaag

SEQ ID NO: 3649593 - RNA, 17 nt, Human
caguuacagaaaguggu

SEQ ID NO: 3649594 - RNA, 20 nt, Human
caguuaccauuaaaccaucu

SEQ ID NO: 3649595 - RNA, 21 nt, Human
caguuaccucugccucagaaa

SEQ ID NO: 3649596 - RNA, 22 nt, Human
caguuaucuaaguuaauuuaaa

SEQ ID NO: 3649597 - RNA, 13 nt, Human
caguuaugaauca

SEQ ID NO: 3649598 - RNA, 20 nt, Human
caguuauggcuauaggugcu

SEQ ID NO: 3649599 - RNA, 23 nt, Human
caguuauugucccuggcuuccuu

SEQ ID NO: 3649600 - RNA, 17 nt, Human
caguuauuuugauaaca

SEQ ID NO: 3649601 - RNA, 22 nt, Human
caguucaauaaacuuaacuuua

SEQ ID NO: 3649602 - RNA, 22 nt, Human
caguucaaucucccgcugcugc

SEQ ID NO: 3649603 - RNA, 23 nt, Human
caguucaaucucccgcugcugcu

SEQ ID NO: 3649604 - RNA, 17 nt, Human
caguucacacccugcaa

SEQ ID NO: 3649605 - RNA, 19 nt, Human
caguucacacccugcaagg

SEQ ID NO: 3649606 - RNA, 20 nt, Human
caguucacacccugcaaggc

SEQ ID NO: 3649607 - RNA, 13 nt, Human
caguucacccuga

SEQ ID NO: 3649608 - RNA, 23 nt, Human
caguucaccuauuucaaaaauuu

SEQ ID NO: 3649609 - RNA, 16 nt, Human
caguucagagcugccc

SEQ ID NO: 3649610 - RNA, 17 nt, Human
caguucaggagucccaa

SEQ ID NO: 3649611 - RNA, 15 nt, Human
caguucaguaccugg

SEQ ID NO: 3649612 - RNA, 19 nt, Human
caguucaguaccuggagga

SEQ ID NO: 3649613 - RNA, 20 nt, Human
caguucaguaccuggaggag

SEQ ID NO: 3649614 - RNA, 18 nt, Human
caguucaguggcagggcu

SEQ ID NO: 3649615 - RNA, 23 nt, Human
caguucaguggcagggcucagga

SEQ ID NO: 3649616 - RNA, 18 nt, Human
caguucauguuugcuuca

SEQ ID NO: 3649617 - RNA, 17 nt, Human
caguucauuagaaauau

SEQ ID NO: 3649618 - RNA, 20 nt, Human
caguucauuagaaauauuuu

SEQ ID NO: 3649619 - RNA, 16 nt, Human
caguuccaagaaagau

SEQ ID NO: 3649620 - RNA, 18 nt, Human
caguucccacauuaaaga

SEQ ID NO: 3649621 - RNA, 14 nt, Human
caguucccagaauc

SEQ ID NO: 3649622 - RNA, 16 nt, Human
caguucccagaaucaa

SEQ ID NO: 3649623 - RNA, 13 nt, Human
caguucccuuggc

SEQ ID NO: 3649624 - RNA, 16 nt, Human
caguucccuuggccuc

SEQ ID NO: 3649625 - RNA, 17 nt, Human
caguuccgauuucccag

SEQ ID NO: 3649626 - RNA, 18 nt, Human
caguuccgauuucccagg

SEQ ID NO: 3649627 - RNA, 15 nt, Human
caguuccucuuugca

SEQ ID NO: 3649628 - RNA, 23 nt, Human
caguuccucuuugcauggaauuu

SEQ ID NO: 3649629 - RNA, 13 nt, Human
caguucgcagcca

SEQ ID NO: 3649630 - RNA, 16 nt, Human
caguucgcagccaccc

SEQ ID NO: 3649631 - RNA, 18 nt, Human
caguucgcagccacccug

SEQ ID NO: 3649632 - RNA, 19 nt, Human
caguucgcagccacccuga

SEQ ID NO: 3649633 - RNA, 11 nt, Human
caguucuagga

SEQ ID NO: 3649634 - RNA, 12 nt, Human
caguucuaggaa

SEQ ID NO: 3649635 - RNA, 19 nt, Human
caguucuaguuugcauucc

SEQ ID NO: 3649636 - RNA, 14 nt, Human
caguucucuccuuc

SEQ ID NO: 3649637 - RNA, 15 nt, Human
caguucucuccuucu

SEQ ID NO: 3649638 - RNA, 16 nt, Human
caguucucuucacuca

SEQ ID NO: 3649639 - RNA, 12 nt, Human
caguucugaaga

SEQ ID NO: 3649640 - RNA, 16 nt, Human
caguucugaagaagau

SEQ ID NO: 3649641 - RNA, 22 nt, Human
caguucugaagaagaugguacc

SEQ ID NO: 3649642 - RNA, 11 nt, Human
caguucugcaa

SEQ ID NO: 3649643 - RNA, 20 nt, Human
caguucugcaaauagaaaac

SEQ ID NO: 3649644 - RNA, 13 nt, Human
caguucugcagcu

SEQ ID NO: 3649645 - RNA, 22 nt, Human
cauggaccacuguuucuugcuu

SEQ ID NO: 3649646 - RNA, 14 nt, Human
cauggaccaugcug

SEQ ID NO: 3649647 - RNA, 15 nt, Human
cauggacccggagcu

SEQ ID NO: 3649648 - RNA, 15 nt, Human
cauggaccuaacauu

SEQ ID NO: 3649649 - RNA, 17 nt, Human
cauggacucuguccuga

SEQ ID NO: 3649650 - RNA, 22 nt, Human
cauggacuucugccagcauaau

SEQ ID NO: 3649651 - RNA, 17 nt, Human
cauggacuuuauaagcc

SEQ ID NO: 3649652 - RNA, 11 nt, Human
cauggagaaac

SEQ ID NO: 3649653 - RNA, 15 nt, Human
cauggagaaacccug

SEQ ID NO: 3649654 - RNA, 20 nt, Human
cauggagaaacccugucucu

SEQ ID NO: 3649655 - RNA, 15 nt, Human
cauggagaaagcuga

SEQ ID NO: 3649656 - RNA, 23 nt, Human
cauggagaaagcugacuuggcug

SEQ ID NO: 3649657 - RNA, 16 nt, Human
cauggagacuccugcc

SEQ ID NO: 3649658 - RNA, 14 nt, Human
cauggagagcugga

SEQ ID NO: 3649659 - RNA, 20 nt, Human
cauggagagcuggagccugg

SEQ ID NO: 3649660 - RNA, 21 nt, Human
cauggagagcuggagccuggu

SEQ ID NO: 3649661 - RNA, 13 nt, Human
cauggagcuggcc

SEQ ID NO: 3649662 - RNA, 14 nt, Human
cauggagcuggccg

SEQ ID NO: 3649663 - RNA, 14 nt, Human
cauggaggagcuug

SEQ ID NO: 3649664 - RNA, 13 nt, Human
cauggaggcacac

SEQ ID NO: 3649665 - RNA, 17 nt, Human
cauggaggcccuccugu

SEQ ID NO: 3649666 - RNA, 18 nt, Human
cauggagggagggagugg

SEQ ID NO: 3649667 - RNA, 22 nt, Human
cauggagggagggagugguuug

SEQ ID NO: 3649668 - RNA, 17 nt, Human
cauggagguucuaaggc

SEQ ID NO: 3649669 - RNA, 18 nt, Human
cauggagguucuaaggcc

SEQ ID NO: 3649670 - RNA, 17 nt, Human
cauggagguuugaagau

SEQ ID NO: 3649671 - RNA, 22 nt, Human
cauggaguagagguacuagaau

SEQ ID NO: 3649672 - RNA, 14 nt, Human
cauggaguggcagc

SEQ ID NO: 3649673 - RNA, 17 nt, Human
cauggaguggcagccca

SEQ ID NO: 3649674 - RNA, 20 nt, Human
cauggaguggcagcccagcc

SEQ ID NO: 3649675 - RNA, 22 nt, Human
cauggaguggcagcccagccag

SEQ ID NO: 3649676 - RNA, 18 nt, Human
cauggaguguguauuguu

SEQ ID NO: 3649677 - RNA, 22 nt, Human
cauggaguguguauuguuccca

SEQ ID NO: 3649678 - RNA, 19 nt, Human
cauggauuacuucucuaua

SEQ ID NO: 3649679 - RNA, 22 nt, Human
cauggcacagagauucugaacu

SEQ ID NO: 3649680 - RNA, 23 nt, Human
cauggcaccuucagacuuugcuu

SEQ ID NO: 3649681 - RNA, 16 nt, Human
cauggcacucccucca

SEQ ID NO: 3649682 - RNA, 17 nt, Human
cauggcacucccuccag

SEQ ID NO: 3649683 - RNA, 19 nt, Human
cauggcacucccuccagca

SEQ ID NO: 3649684 - RNA, 16 nt, Human
cauggcacuugcaucu

SEQ ID NO: 3649685 - RNA, 20 nt, Human
caucacucuagguuuuacag

SEQ ID NO: 3649686 - RNA, 16 nt, Human
caucacugaguuuucc

SEQ ID NO: 3649687 - RNA, 20 nt, Human
caucacuguucaugcuggcg

SEQ ID NO: 3649688 - RNA, 15 nt, Human
caucacuuaaaacac

SEQ ID NO: 3649689 - RNA, 14 nt, Human
caucacuuguacaa

SEQ ID NO: 3649690 - RNA, 19 nt, Human
caucacuuguacaaaauaa

SEQ ID NO: 3649691 - RNA, 15 nt, Human
caucacuuugaccua

SEQ ID NO: 3649692 - RNA, 17 nt, Human
caucacuuuucagugau

SEQ ID NO: 3649693 - RNA, 17 nt, Human
caucagaaacacccuca

SEQ ID NO: 3649694 - RNA, 19 nt, Human
caucagaaacacccucaca

SEQ ID NO: 3649695 - RNA, 15 nt, Human
caucagaaagcuuua

SEQ ID NO: 3649696 - RNA, 12 nt, Human
caucagaaaggg

SEQ ID NO: 3649697 - RNA, 17 nt, Human
caucagaaagggagggc

SEQ ID NO: 3649698 - RNA, 20 nt, Human
caucagaaagggagggcucu

SEQ ID NO: 3649699 - RNA, 22 nt, Human
caucagaaagggagggcucuga

SEQ ID NO: 3649700 - RNA, 13 nt, Human
caucagaagauaa

SEQ ID NO: 3649701 - RNA, 20 nt, Human
caucagaggccuagucagcc

SEQ ID NO: 3649702 - RNA, 16 nt, Human
caaugugacuuugaaa

SEQ ID NO: 3649703 - RNA, 18 nt, Human
caaugugaggggucccua

SEQ ID NO: 3649704 - RNA, 12 nt, Human
caaugugcagug

SEQ ID NO: 3649705 - RNA, 21 nt, Human
caaugugguugcaaggccgcu

SEQ ID NO: 3649706 - RNA, 22 nt, Human
caaugugucuuucuaagaaauc

SEQ ID NO: 3649707 - RNA, 20 nt, Human
caaugugucuuucuuuuugg

SEQ ID NO: 3649708 - RNA, 20 nt, Human
caauguguggcugaagacuu

SEQ ID NO: 3649709 - RNA, 18 nt, Human
caauguguguauauggac

SEQ ID NO: 3649710 - RNA, 14 nt, Human
caauguguuuuucu

SEQ ID NO: 3649711 - RNA, 11 nt, Human
caauguuaagg

SEQ ID NO: 3649712 - RNA, 19 nt, Human
caauguuaaggaaacucuu

SEQ ID NO: 3649713 - RNA, 17 nt, Human
caauguuagagacuuuu

SEQ ID NO: 3649714 - RNA, 14 nt, Human
caauguucauugua

SEQ ID NO: 3649715 - RNA, 23 nt, Human
caauguuuaaaaaaguuuaaaau

SEQ ID NO: 3649716 - RNA, 23 nt, Human
caauguuuaugcaaggaaggaaa

SEQ ID NO: 3649717 - RNA, 12 nt, Human
caauguuucaag

SEQ ID NO: 3649718 - RNA, 13 nt, Human
caauguuucuuuu

SEQ ID NO: 3649719 - RNA, 22 nt, Human
caauguuuuccuuugucaucau

SEQ ID NO: 3649720 - RNA, 17 nt, Human
caauguuuuuaaaaauc

SEQ ID NO: 3649721 - RNA, 23 nt, Human
caauuaaaaaaaaagaucuguuu

SEQ ID NO: 3649722 - RNA, 13 nt, Human
caauuaaacggau

SEQ ID NO: 3649723 - RNA, 17 nt, Human
caauuaaacggauuauu

SEQ ID NO: 3649724 - RNA, 18 nt, Human
caauuaaacggauuauuu

SEQ ID NO: 3649725 - RNA, 19 nt, Human
caauuaaacggauuauuuu

SEQ ID NO: 3649726 - RNA, 19 nt, Human
caauuaaacuuccaaagaa

SEQ ID NO: 3649727 - RNA, 17 nt, Human
caauuaaagaaauaauu

SEQ ID NO: 3649728 - RNA, 13 nt, Human
caauuaaauguag

SEQ ID NO: 3649729 - RNA, 13 nt, Human
caauuaaggauuu

SEQ ID NO: 3649730 - RNA, 22 nt, Human
caauuaaggauuuuaugcuuua

SEQ ID NO: 3649731 - RNA, 15 nt, Human
caauuaauaaaaaau

SEQ ID NO: 3649732 - RNA, 18 nt, Human
caauuaauaaaaaaugga

SEQ ID NO: 3649733 - RNA, 19 nt, Human
caauuaauaguuugucuau

SEQ ID NO: 3649734 - RNA, 20 nt, Human
caauuaauauuaauuuucua

SEQ ID NO: 3649735 - RNA, 14 nt, Human
caauuaauugucuu

SEQ ID NO: 3649736 - RNA, 22 nt, Human
caauuaauuuuuuuauuguuua

SEQ ID NO: 3649737 - RNA, 15 nt, Human
caauuacuuuagaaa

SEQ ID NO: 3649738 - RNA, 16 nt, Human
caauuaggaaguguaa

SEQ ID NO: 3649739 - RNA, 20 nt, Human
caauuaggaaguguaacagc

SEQ ID NO: 3649740 - RNA, 17 nt, Human
caauuaguaacauucau

SEQ ID NO: 3649741 - RNA, 17 nt, Human
caauuaguuuccuuuuu

SEQ ID NO: 3649742 - RNA, 18 nt, Human
caauuauaguuucugagg

SEQ ID NO: 3649743 - RNA, 22 nt, Human
caauuauaguuucugaggcuuu

SEQ ID NO: 3649744 - RNA, 11 nt, Human
caauuaugaaa

SEQ ID NO: 3649745 - RNA, 13 nt, Human
caauuauguuaaa

SEQ ID NO: 3649746 - RNA, 17 nt, Human
caauuauugauauauau

SEQ ID NO: 3649747 - RNA, 17 nt, Human
caauuauuguuacacau

SEQ ID NO: 3649748 - RNA, 13 nt, Human
caauuauuucccc

SEQ ID NO: 3649749 - RNA, 21 nt, Human
caauuccaacaguuuaaugaa

SEQ ID NO: 3649750 - RNA, 16 nt, Human
caauuccaauauuucu

SEQ ID NO: 3649751 - RNA, 17 nt, Human
caauuccaauauuucug

SEQ ID NO: 3649752 - RNA, 21 nt, Human
caauuccaauauuucugcuuu

SEQ ID NO: 3649753 - RNA, 16 nt, Human
caauuccacucugaua

SEQ ID NO: 3649754 - RNA, 11 nt, Human
caauuccccuc

SEQ ID NO: 3649755 - RNA, 14 nt, Human
caauuccccucugc

SEQ ID NO: 3649756 - RNA, 15 nt, Human
caauucccugcuguc

SEQ ID NO: 3649757 - RNA, 20 nt, Human
caauuccguagccagcugcu

SEQ ID NO: 3649758 - RNA, 15 nt, Human
caauuccuagauaaa

SEQ ID NO: 3649759 - RNA, 16 nt, Human
caauuccugggcccca

SEQ ID NO: 3649760 - RNA, 23 nt, Human
caauucuaucuuuuguuuccuuu

SEQ ID NO: 3649761 - RNA, 19 nt, Human
caauucuccugccucagcc

SEQ ID NO: 3649762 - RNA, 16 nt, Human
caauucuccugccuuu

SEQ ID NO: 3649763 - RNA, 13 nt, Human
caauucuccuuua

SEQ ID NO: 3649764 - RNA, 17 nt, Human
caauucucuuuaguucu

SEQ ID NO: 3649765 - RNA, 19 nt, Human
caauucuguagguuaaaaa

SEQ ID NO: 3649766 - RNA, 14 nt, Human
caauucuguuuuag

SEQ ID NO: 3649767 - RNA, 22 nt, Human
caauucuguuuuagguuaaaaa

SEQ ID NO: 3649768 - RNA, 23 nt, Human
caauucuguuuuuaaugcuauuu

SEQ ID NO: 3649769 - RNA, 18 nt, Human
caauucuuacaaacaugu

SEQ ID NO: 3649770 - RNA, 12 nt, Human
caauucuuuaua

SEQ ID NO: 3649771 - RNA, 13 nt, Human
caauucuuucaag

SEQ ID NO: 3649772 - RNA, 19 nt, Human
caauucuuuuaacuguugu

SEQ ID NO: 3649773 - RNA, 14 nt, Human
caauugaaaugcau

SEQ ID NO: 3649774 - RNA, 18 nt, Human
caauugaacuuaaauaaa

SEQ ID NO: 3649775 - RNA, 15 nt, Human
caauugaauggucag

SEQ ID NO: 3649776 - RNA, 23 nt, Human
caauugagaaaaauauauacuaa

SEQ ID NO: 3649777 - RNA, 14 nt, Human
caauugcugcaucu

SEQ ID NO: 3649778 - RNA, 12 nt, Human
caauuggaggaa

SEQ ID NO: 3649779 - RNA, 19 nt, Human
caauuggcaccgaagccca

SEQ ID NO: 3649780 - RNA, 20 nt, Human
caauuggcaccgaagcccag

SEQ ID NO: 3649781 - RNA, 21 nt, Human
caauugggagcugccaagagu

SEQ ID NO: 3649782 - RNA, 14 nt, Human
caauuguaaauuga

SEQ ID NO: 3649783 - RNA, 15 nt, Human
caauugucauuuaua

SEQ ID NO: 3649784 - RNA, 17 nt, Human
caauugucauuuauaaa

SEQ ID NO: 3649785 - RNA, 21 nt, Human
caauugucgaaaagagucuuc

SEQ ID NO: 3649786 - RNA, 16 nt, Human
caauugugcugccauu

SEQ ID NO: 3649787 - RNA, 17 nt, Human
caauuguguagccuuuu

SEQ ID NO: 3649788 - RNA, 17 nt, Human
caauuguguggucagug

SEQ ID NO: 3649789 - RNA, 24 nt, Human
caauuguugacaguucugaagaau

SEQ ID NO: 3649790 - RNA, 21 nt, Human
caauuguuuuaaucugaaauu

SEQ ID NO: 3649791 - RNA, 17 nt, Human
caauuguuuuuguugug

SEQ ID NO: 3649792 - RNA, 16 nt, Human
caauuuaaacccauuu

SEQ ID NO: 3649793 - RNA, 11 nt, Human
caauuuagaaa

SEQ ID NO: 3649794 - RNA, 14 nt, Human
caauuuaugaauug

SEQ ID NO: 3649795 - RNA, 13 nt, Human
caauuuauuaugg

SEQ ID NO: 3649796 - RNA, 21 nt, Human
caauuuauugcacaaaauaua

SEQ ID NO: 3649797 - RNA, 23 nt, Human
caauuuauuugaaugauuuuucu

SEQ ID NO: 3649798 - RNA, 15 nt, Human
caauuucaagguucu

SEQ ID NO: 3649799 - RNA, 13 nt, Human
caauuucggauuu

SEQ ID NO: 3649800 - RNA, 17 nt, Human
caauuucuaauuuuuaa

SEQ ID NO: 3649801 - RNA, 19 nt, Human
caauuucuaauuuuuaaga

SEQ ID NO: 3649802 - RNA, 15 nt, Human
caauuucuguguugc

SEQ ID NO: 3649803 - RNA, 20 nt, Human
caauuugauacauaauaaaa

SEQ ID NO: 3649804 - RNA, 22 nt, Human
caauuugauacauaauaaaaaa

SEQ ID NO: 3649805 - RNA, 18 nt, Human
caauuuggcaauuuugug

SEQ ID NO: 3649806 - RNA, 16 nt, Human
caauuugggagauaua

SEQ ID NO: 3649807 - RNA, 18 nt, Human
caauuugggagauauauu

SEQ ID NO: 3649808 - RNA, 17 nt, Human
caauuugggcuuccugu

SEQ ID NO: 3649809 - RNA, 16 nt, Human
caauuugucauuuuga

SEQ ID NO: 3649810 - RNA, 23 nt, Human
caauuuguucagucuuucauuua

SEQ ID NO: 3649811 - RNA, 22 nt, Human
caauuuguucauccuauuguug

SEQ ID NO: 3649812 - RNA, 12 nt, Human
caauuuuaaaca

SEQ ID NO: 3649813 - RNA, 15 nt, Human
caauuuuaaagacau

SEQ ID NO: 3649814 - RNA, 22 nt, Human
caauuuuaauuuaguaaauguu

SEQ ID NO: 3649815 - RNA, 15 nt, Human
caauuuuaucuguuu

SEQ ID NO: 3649816 - RNA, 14 nt, Human
caauuuucagauuu

SEQ ID NO: 3649817 - RNA, 16 nt, Human
caauuuucagauuugc

SEQ ID NO: 3649818 - RNA, 16 nt, Human
caauuuuccuugaagc

SEQ ID NO: 3649819 - RNA, 20 nt, Human
caauuuucuggaauacauga

SEQ ID NO: 3649820 - RNA, 12 nt, Human
caauuuucuugu

SEQ ID NO: 3649821 - RNA, 11 nt, Human
caauuuuguaa

SEQ ID NO: 3649822 - RNA, 22 nt, Human
caauuuuuacacaaaccugaaa

SEQ ID NO: 3649823 - RNA, 14 nt, Human
caauuuuuaggaag

SEQ ID NO: 3649824 - RNA, 13 nt, Human
caauuuuuauuuc

SEQ ID NO: 3649825 - RNA, 18 nt, Human
caauuuuuauuucuuuua

SEQ ID NO: 3649826 - RNA, 13 nt, Human
caauuuuucugca

SEQ ID NO: 3649827 - RNA, 13 nt, Human
caauuuuugccuu

SEQ ID NO: 3649828 - RNA, 18 nt, Human
caauuuuugguugaauaa

SEQ ID NO: 3649829 - RNA, 19 nt, Human
caauuuuugguugaauaaa

SEQ ID NO: 3649830 - RNA, 23 nt, Human
caucuaaacuuuaauauguauuu

SEQ ID NO: 3649831 - RNA, 15 nt, Human
caucuaaauaccugc

SEQ ID NO: 3649832 - RNA, 18 nt, Human
caucuaaccucaucuucu

SEQ ID NO: 3649833 - RNA, 15 nt, Human
caucuaagcugcagc

SEQ ID NO: 3649834 - RNA, 13 nt, Human
caucuaauucuga

SEQ ID NO: 3649835 - RNA, 14 nt, Human
caucuacaaaacau

SEQ ID NO: 3649836 - RNA, 16 nt, Human
caucuaccccuggaug

SEQ ID NO: 3649837 - RNA, 15 nt, Human
caucuacccuccgau

SEQ ID NO: 3649838 - RNA, 20 nt, Human
caucuaccuagauuuaauau

SEQ ID NO: 3649839 - RNA, 16 nt, Human
caucuaccuuuucucu

SEQ ID NO: 3649840 - RNA, 18 nt, Human
caucuaccuuuucucuuc

SEQ ID NO: 3649841 - RNA, 19 nt, Human
caucuacucccaaguaugg

SEQ ID NO: 3649842 - RNA, 19 nt, Human
caucuagagcuugaugcca

SEQ ID NO: 3649843 - RNA, 19 nt, Human
caucuagaggcuuccuuca

SEQ ID NO: 3649844 - RNA, 21 nt, Human
caucuagaggcuuccuucauu

SEQ ID NO: 3649845 - RNA, 18 nt, Human
caucuagcaaauguuaug

SEQ ID NO: 3649846 - RNA, 19 nt, Human
caucuaggggagccuugau

SEQ ID NO: 3649847 - RNA, 17 nt, Human
caucuagguaauuuuua

SEQ ID NO: 3649848 - RNA, 18 nt, Human
caucuaguacuugaaaaa

SEQ ID NO: 3649849 - RNA, 14 nt, Human
caucuagugagcag

SEQ ID NO: 3649850 - RNA, 23 nt, Human
caucuaguuccccuguuuauuca

SEQ ID NO: 3649851 - RNA, 15 nt, Human
caucuaucucaaucc

SEQ ID NO: 3649852 - RNA, 13 nt, Human
caucuauucucuc

SEQ ID NO: 3649853 - RNA, 14 nt, Human
caucuauuucugag

SEQ ID NO: 3649854 - RNA, 16 nt, Human
caucuauuucugagaa

SEQ ID NO: 3649855 - RNA, 21 nt, Human
caucuauuuugaugcagcauu

SEQ ID NO: 3649856 - RNA, 23 nt, Human
caucuauuuugaugcagcauuug

SEQ ID NO: 3649857 - RNA, 22 nt, Human
caucucaacaggccucagggcu

SEQ ID NO: 3649858 - RNA, 20 nt, Human
caucucacacaugagcauca

SEQ ID NO: 3649859 - RNA, 19 nt, Human
caucucacuggaugcaaag

SEQ ID NO: 3649860 - RNA, 13 nt, Human
caucucagcccac

SEQ ID NO: 3649861 - RNA, 20 nt, Human
caucucagcucacugcaacc

SEQ ID NO: 3649862 - RNA, 14 nt, Human
caucucaggccaga

SEQ ID NO: 3649863 - RNA, 12 nt, Human
caucucaggggc

SEQ ID NO: 3649864 - RNA, 16 nt, Human
caucucaggggccaga

SEQ ID NO: 3649865 - RNA, 16 nt, Human
caucucaguccucaaa

SEQ ID NO: 3649866 - RNA, 18 nt, Human
caucucagugcuguaaaa

SEQ ID NO: 3649867 - RNA, 12 nt, Human
caucucaucaug

SEQ ID NO: 3649868 - RNA, 18 nt, Human
caucucaugaggggagag

SEQ ID NO: 3649869 - RNA, 18 nt, Human
caucucauuuaagggaaa

SEQ ID NO: 3649870 - RNA, 21 nt, Human
caucucauuuaagggaaaaau

SEQ ID NO: 3649871 - RNA, 22 nt, Human
caucucauuuaagggaaaaaua

SEQ ID NO: 3649872 - RNA, 23 nt, Human
caucucauuuaagggaaaaauau

SEQ ID NO: 3649873 - RNA, 16 nt, Human
caucuccaagaaugcu

SEQ ID NO: 3649874 - RNA, 19 nt, Human
caucuccaagaaugcugaa

SEQ ID NO: 3649875 - RNA, 14 nt, Human
caucuccacuccag

SEQ ID NO: 3649876 - RNA, 17 nt, Human
caucuccagggaguccc

SEQ ID NO: 3649877 - RNA, 20 nt, Human
caucuccagggaguccccuc

SEQ ID NO: 3649878 - RNA, 17 nt, Human
cauugcuagauaaaagc

SEQ ID NO: 3649879 - RNA, 15 nt, Human
cauugcugagccucu

SEQ ID NO: 3649880 - RNA, 16 nt, Human
cauugcugagccucug

SEQ ID NO: 3649881 - RNA, 17 nt, Human
cauugcugagccucugc

SEQ ID NO: 3649882 - RNA, 18 nt, Human
cauugcugggcuugucug

SEQ ID NO: 3649883 - RNA, 17 nt, Human
cauugcuggucuuguaa

SEQ ID NO: 3649884 - RNA, 19 nt, Human
cauugcugucugcagccuu

SEQ ID NO: 3649885 - RNA, 20 nt, Human
cauugcugucugcagccuug

SEQ ID NO: 3649886 - RNA, 21 nt, Human
cauugcugucugcagccuuga

SEQ ID NO: 3649887 - RNA, 22 nt, Human
cauugcugugaauuagcucacu

SEQ ID NO: 3649888 - RNA, 14 nt, Human
cauugcuguuaugu

SEQ ID NO: 3649889 - RNA, 17 nt, Human
cauugcuguucuacuuu

SEQ ID NO: 3649890 - RNA, 13 nt, Human
cauugcuucuucu

SEQ ID NO: 3649891 - RNA, 16 nt, Human
cauugcuucuucugag

SEQ ID NO: 3649892 - RNA, 23 nt, Human
cauugcuuugaagcaguuguguc

SEQ ID NO: 3649893 - RNA, 21 nt, Human
cauugcuuuuaaaacuacuua

SEQ ID NO: 3649894 - RNA, 18 nt, Human
cauugcuuuuauuuugaa

SEQ ID NO: 3649895 - RNA, 21 nt, Human
cauugcuuuuauuuugaaaag

SEQ ID NO: 3649896 - RNA, 12 nt, Human
cauuggaaauua

SEQ ID NO: 3649897 - RNA, 21 nt, Human
cauuggaaauuuagcauugua

SEQ ID NO: 3649898 - RNA, 13 nt, Human
cauuggaaauuuc

SEQ ID NO: 3649899 - RNA, 14 nt, Human
cauuggaacuggag

SEQ ID NO: 3649900 - RNA, 16 nt, Human
cauuggaacuggaggc

SEQ ID NO: 3649901 - RNA, 16 nt, Human
cauuggaagaccccac

SEQ ID NO: 3649902 - RNA, 18 nt, Human
cauuggaagaccccaccc

SEQ ID NO: 3649903 - RNA, 17 nt, Human
cauuggacccuuccaug

SEQ ID NO: 3649904 - RNA, 14 nt, Human
cauuggauacagca

SEQ ID NO: 3649905 - RNA, 17 nt, Human
cauuggauacagcagua

SEQ ID NO: 3649906 - RNA, 11 nt, Human
cauuggauauu

SEQ ID NO: 3649907 - RNA, 18 nt, Human
cauuggauauuuuuuacu

SEQ ID NO: 3649908 - RNA, 16 nt, Human
cauuggauuauccuga

SEQ ID NO: 3649909 - RNA, 17 nt, Human
cauuggauuauccugag

SEQ ID NO: 3649910 - RNA, 21 nt, Human
cauuggcaccuaauccaggca

SEQ ID NO: 3649911 - RNA, 16 nt, Human
cauuggcagcaggugc

SEQ ID NO: 3649912 - RNA, 19 nt, Human
cauuggcuauuuaaaacuu

SEQ ID NO: 3649913 - RNA, 22 nt, Human
cauuggcucuugaacugagcuu

SEQ ID NO: 3649914 - RNA, 15 nt, Human
cauuggcugagagac

SEQ ID NO: 3649915 - RNA, 13 nt, Human
cauuggcuuuauc

SEQ ID NO: 3649916 - RNA, 20 nt, Human
cauugggcagcgcccuuccu

SEQ ID NO: 3649917 - RNA, 22 nt, Human
cauuggggcucccagccaggcc

SEQ ID NO: 3649918 - RNA, 21 nt, Human
cauuggguccugggucuuuca

SEQ ID NO: 3649919 - RNA, 17 nt, Human
cauugggucuauuccag

SEQ ID NO: 3649920 - RNA, 21 nt, Human
cauugggucuauuccagcuca

SEQ ID NO: 3649921 - RNA, 18 nt, Human
cauuggguggguaaauuc

SEQ ID NO: 3649922 - RNA, 15 nt, Human
cauugguucuuguau

SEQ ID NO: 3649923 - RNA, 21 nt, Human
cauuguaaaagcauuuuguaa

SEQ ID NO: 3649924 - RNA, 23 nt, Human
cauuguaaaagcauuuuguaaua

SEQ ID NO: 3649925 - RNA, 13 nt, Human
cauuguaaaauaa

SEQ ID NO: 3649926 - RNA, 14 nt, Human
cauuguaaaauaau

SEQ ID NO: 3649927 - RNA, 13 nt, Human
cauuguaaacaaa

SEQ ID NO: 3649928 - RNA, 15 nt, Human
cauuguaaacaaacu

SEQ ID NO: 3649929 - RNA, 15 nt, Human
cauuguaauguuacu

SEQ ID NO: 3649930 - RNA, 14 nt, Human
cauuguaauguugu

SEQ ID NO: 3649931 - RNA, 23 nt, Human
cauuguaauguugugaauaauua

SEQ ID NO: 3649932 - RNA, 21 nt, Human
cauuguacaguuuguuuacac

SEQ ID NO: 3649933 - RNA, 22 nt, Human
cauuguacaguuuguuuacaca

SEQ ID NO: 3649934 - RNA, 20 nt, Human
cauuguaccaugaaauaucc

SEQ ID NO: 3649935 - RNA, 19 nt, Human
cauuguacgaagaguauuu

SEQ ID NO: 3649936 - RNA, 16 nt, Human
cauuguacuaccugug

SEQ ID NO: 3649937 - RNA, 15 nt, Human
cauuguagagcuucu

SEQ ID NO: 3649938 - RNA, 21 nt, Human
cauuguagagcuucuggcacu

SEQ ID NO: 3649939 - RNA, 18 nt, Human
cauuguagcgucuuucuu

SEQ ID NO: 3649940 - RNA, 15 nt, Human
cauuguauaaaaaua

SEQ ID NO: 3649941 - RNA, 19 nt, Human
cauuguauagauauaauga

SEQ ID NO: 3649942 - RNA, 20 nt, Human
cauuguauagauauaaugaa

SEQ ID NO: 3649943 - RNA, 22 nt, Human
cauuguauaguuggaaucauau

SEQ ID NO: 3649944 - RNA, 22 nt, Human
cauuguauauauguguguuuaa

SEQ ID NO: 3649945 - RNA, 14 nt, Human
cauuguauauguga

SEQ ID NO: 3649946 - RNA, 15 nt, Human
cauuguaucugucuu

SEQ ID NO: 3649947 - RNA, 16 nt, Human
cauuguaucugucuuu

SEQ ID NO: 3649948 - RNA, 17 nt, Human
cauuguaucugucuuuc

SEQ ID NO: 3649949 - RNA, 18 nt, Human
cauuguaugauguguugu

SEQ ID NO: 3649950 - RNA, 22 nt, Human
cauuguauggauaguaaaauuc

SEQ ID NO: 3649951 - RNA, 16 nt, Human
cauuguccagagcugc

SEQ ID NO: 3649952 - RNA, 20 nt, Human
cauuguccagagcugcuucc

SEQ ID NO: 3649953 - RNA, 19 nt, Human
cauuguccccaaugaauau

SEQ ID NO: 3649954 - RNA, 14 nt, Human
cauugucccucugc

SEQ ID NO: 3649955 - RNA, 21 nt, Human
cauugucccucugccccaucc

SEQ ID NO: 3649956 - RNA, 17 nt, Human
cauugucccucuucacu

SEQ ID NO: 3649957 - RNA, 18 nt, Human
cauugucccucuucacuc

SEQ ID NO: 3649958 - RNA, 13 nt, Human
cauuguccucuuu

SEQ ID NO: 3649959 - RNA, 22 nt, Human
cauugucguauaggcauguaaa

SEQ ID NO: 3649960 - RNA, 14 nt, Human
cauugucucagagc

SEQ ID NO: 3649961 - RNA, 13 nt, Human
cauugucuuguuc

SEQ ID NO: 3649962 - RNA, 15 nt, Human
cauugucuuuauaug

SEQ ID NO: 3649963 - RNA, 17 nt, Human
cauugucuuuauaugaa

SEQ ID NO: 3649964 - RNA, 15 nt, Human
cauugugaaccaaug

SEQ ID NO: 3649965 - RNA, 18 nt, Human
cauugugaacugacaggc

SEQ ID NO: 3649966 - RNA, 22 nt, Human
cauugugauguauauuccuuug

SEQ ID NO: 3649967 - RNA, 22 nt, Human
cauugugccaugucaaacaaau

SEQ ID NO: 3649968 - RNA, 21 nt, Human
cauuguggugugagcuucaga

SEQ ID NO: 3649969 - RNA, 15 nt, Human
cauuguguugacauu

SEQ ID NO: 3649970 - RNA, 14 nt, Human
cauuguuaccucua

SEQ ID NO: 3649971 - RNA, 22 nt, Human
cauuguuagcacuaggcaccca

SEQ ID NO: 3649972 - RNA, 16 nt, Human
cauuguuauuuauaca

SEQ ID NO: 3649973 - RNA, 16 nt, Human
cauuguucaaaaggaa

SEQ ID NO: 3649974 - RNA, 20 nt, Human
caugcugaagccaaagccaa

SEQ ID NO: 3649975 - RNA, 19 nt, Human
caugcugaaggcugaaaga

SEQ ID NO: 3649976 - RNA, 19 nt, Human
caugcugaagggaccuuga

SEQ ID NO: 3649977 - RNA, 16 nt, Human
caugcugaggccuggg

SEQ ID NO: 3649978 - RNA, 18 nt, Human
caugcugaggccugggcc

SEQ ID NO: 3649979 - RNA, 21 nt, Human
caugcugagucucccaaggcu

SEQ ID NO: 3649980 - RNA, 21 nt, Human
caugcugccaauauccuaaua

SEQ ID NO: 3649981 - RNA, 12 nt, Human
caugcugcccug

SEQ ID NO: 3649982 - RNA, 15 nt, Human
caugcugcccuguga

SEQ ID NO: 3649983 - RNA, 18 nt, Human
caugcugcccugugagua

SEQ ID NO: 3649984 - RNA, 12 nt, Human
caugcugccucc

SEQ ID NO: 3649985 - RNA, 19 nt, Human
caugcugcuggacaguauc

SEQ ID NO: 3649986 - RNA, 14 nt, Human
caugcugcuuuaau

SEQ ID NO: 3649987 - RNA, 18 nt, Human
caugcugcuuuaauugug

SEQ ID NO: 3649988 - RNA, 21 nt, Human
caugcugcuuuaauugugaau

SEQ ID NO: 3649989 - RNA, 17 nt, Human
caugcuggaaaauaaua

SEQ ID NO: 3649990 - RNA, 22 nt, Human
caugcuggaaaauaauacugcu

SEQ ID NO: 3649991 - RNA, 22 nt, Human
caugcuggaaccugcaaaaaau

SEQ ID NO: 3649992 - RNA, 13 nt, Human
caugcuggagccu

SEQ ID NO: 3649993 - RNA, 14 nt, Human
caugcuggagccug

SEQ ID NO: 3649994 - RNA, 17 nt, Human
caugcuggagccugugu

SEQ ID NO: 3649995 - RNA, 15 nt, Human
caugcuggccagccu

SEQ ID NO: 3649996 - RNA, 17 nt, Human
caugcuggccagccugg

SEQ ID NO: 3649997 - RNA, 19 nt, Human
caugcuggcucccagggcc

SEQ ID NO: 3649998 - RNA, 20 nt, Human
caugcuggcucccagggcca

SEQ ID NO: 3649999 - RNA, 20 nt, Human
caugcuggggcaagucccug

SEQ ID NO: 3650000 - RNA, 16 nt, Human
caugcuggguucugca

SEQ ID NO: 3650001 - RNA, 19 nt, Human
caugcuggguucugcacag

SEQ ID NO: 3650002 - RNA, 13 nt, Human
caugcuguacaua

SEQ ID NO: 3650003 - RNA, 21 nt, Human
caugcuguacauacuuuuugg

SEQ ID NO: 3650004 - RNA, 12 nt, Human
caugcugucugg

SEQ ID NO: 3650005 - RNA, 17 nt, Human
caugcugucuggcacag

SEQ ID NO: 3650006 - RNA, 23 nt, Human
caugcugucuggcacagccugca

SEQ ID NO: 3650007 - RNA, 18 nt, Human
caugcuguguaagcugug

SEQ ID NO: 3650008 - RNA, 20 nt, Human
caugcuguucaugaaagauu

SEQ ID NO: 3650009 - RNA, 18 nt, Human
caugcuguugauugcuaa

SEQ ID NO: 3650010 - RNA, 22 nt, Human
caugcuguugauugcuaaaugu

SEQ ID NO: 3650011 - RNA, 23 nt, Human
caugcuguugauugcuaaaugua

SEQ ID NO: 3650012 - RNA, 23 nt, Human
caugcuuagcaguccccuucccu

SEQ ID NO: 3650013 - RNA, 16 nt, Human
caugcuuauuccauga

SEQ ID NO: 3650014 - RNA, 16 nt, Human
caugcuucuuccuuac

SEQ ID NO: 3650015 - RNA, 19 nt, Human
caugcuuguguuucuuagu

SEQ ID NO: 3650016 - RNA, 18 nt, Human
caugcuuuaaaguguaau

SEQ ID NO: 3650017 - RNA, 22 nt, Human
caugcuuugaaaaaucacuuga

SEQ ID NO: 3650018 - RNA, 23 nt, Human
cauggaaacaagaugaaauucca

SEQ ID NO: 3650019 - RNA, 19 nt, Human
cauggaaauauuaugcaaa

SEQ ID NO: 3650020 - RNA, 21 nt, Human
cauggaaauucccuucaucug

SEQ ID NO: 3650021 - RNA, 19 nt, Human
cauggaaauuuaaagcagg

SEQ ID NO: 3650022 - RNA, 18 nt, Human
cauggaacgcguugaaau

SEQ ID NO: 3650023 - RNA, 19 nt, Human
cauggaacucauuccugcc

SEQ ID NO: 3650024 - RNA, 21 nt, Human
cauggaacucauuccugccug

SEQ ID NO: 3650025 - RNA, 13 nt, Human
cauggaaggcaag

SEQ ID NO: 3650026 - RNA, 14 nt, Human
cauggaaggcaaga

SEQ ID NO: 3650027 - RNA, 23 nt, Human
cauggaaggcaagauuguguccc

SEQ ID NO: 3650028 - RNA, 22 nt, Human
cauggaaguacuauaauuuacc

SEQ ID NO: 3650029 - RNA, 15 nt, Human
cauggaaugcuugaa

SEQ ID NO: 3650030 - RNA, 15 nt, Human
cauggaaugguuaua

SEQ ID NO: 3650031 - RNA, 19 nt, Human
cauggaauucacaaaguaa

SEQ ID NO: 3650032 - RNA, 20 nt, Human
cauggaauuggagcucgugg

SEQ ID NO: 3650033 - RNA, 19 nt, Human
cauggaauuuguaaguuua

SEQ ID NO: 3650034 - RNA, 14 nt, Human
cauggacaauggac

SEQ ID NO: 3650035 - RNA, 15 nt, Human
cauggacaauggacc

SEQ ID NO: 3650036 - RNA, 14 nt, Human
cauggacaccccuu

SEQ ID NO: 3650037 - RNA, 21 nt, Human
cauggacaccccuuauccagg

SEQ ID NO: 3650038 - RNA, 21 nt, Human
cauggacagaagaaggcagca

SEQ ID NO: 3650039 - RNA, 15 nt, Human
cauggacauuuagaa

SEQ ID NO: 3650040 - RNA, 20 nt, Human
cauggacauuuagaagaaag

SEQ ID NO: 3650041 - RNA, 23 nt, Human
cauggaccacuguuucuugcuug

SEQ ID NO: 3650042 - RNA, 12 nt, Human
cauggacccgga

SEQ ID NO: 3650043 - RNA, 16 nt, Human
cauggaccuaacauuc

SEQ ID NO: 3650044 - RNA, 16 nt, Human
cauggacuaagaacga

SEQ ID NO: 3650045 - RNA, 19 nt, Human
cauggacucuguccugaag

SEQ ID NO: 3650046 - RNA, 14 nt, Human
cauggacuucacau

SEQ ID NO: 3650047 - RNA, 16 nt, Human
cauggacuuguauauu

SEQ ID NO: 3650048 - RNA, 17 nt, Human
cauggagaaacccuguc

SEQ ID NO: 3650049 - RNA, 17 nt, Human
cauggagaaagcugacu

SEQ ID NO: 3650050 - RNA, 19 nt, Human
cauggagaaagcugacuug

SEQ ID NO: 3650051 - RNA, 12 nt, Human
cauggagaaguu

SEQ ID NO: 3650052 - RNA, 17 nt, Human
cauggagaaguuaucag

SEQ ID NO: 3650053 - RNA, 15 nt, Human
cauggagacuccugc

SEQ ID NO: 3650054 - RNA, 20 nt, Human
cauggagacuccugcccugu

SEQ ID NO: 3650055 - RNA, 14 nt, Human
cauggagagcuaga

SEQ ID NO: 3650056 - RNA, 14 nt, Human
cauggagccccagc

SEQ ID NO: 3650057 - RNA, 18 nt, Human
cauggagccccagccccc

SEQ ID NO: 3650058 - RNA, 22 nt, Human
cauggagcuauaacuaagcauc

SEQ ID NO: 3650059 - RNA, 16 nt, Human
cauggaggcacacagc

SEQ ID NO: 3650060 - RNA, 13 nt, Human
cauggaggcccuc

SEQ ID NO: 3650061 - RNA, 20 nt, Human
cauggaggcccuccugugcu

SEQ ID NO: 3650062 - RNA, 21 nt, Human
cauggaguggcagcccagcca

SEQ ID NO: 3650063 - RNA, 17 nt, Human
cauggaguguguauugu

SEQ ID NO: 3650064 - RNA, 21 nt, Human
cauggauuucugucuucucua

SEQ ID NO: 3650065 - RNA, 20 nt, Human
cauggcaccaaagccaccag

SEQ ID NO: 3650066 - RNA, 21 nt, Human
cauggcaccugucgcccagug

SEQ ID NO: 3650067 - RNA, 22 nt, Human
cauggcaccuucagacuuugcu

SEQ ID NO: 3650068 - RNA, 13 nt, Human
cauggcacucccu

SEQ ID NO: 3650069 - RNA, 18 nt, Human
cauggcacucccuccagc

SEQ ID NO: 3650070 - RNA, 21 nt, Human
cauggcacucccuccagcaca

SEQ ID NO: 3650071 - RNA, 21 nt, Human
cauggcagauguaggagggac

SEQ ID NO: 3650072 - RNA, 23 nt, Human
cauggcagauguaggagggacug

SEQ ID NO: 3650073 - RNA, 19 nt, Human
cauggcagggggcugcugc

SEQ ID NO: 3650074 - RNA, 20 nt, Human
cauggcagggggcugcugcu

SEQ ID NO: 3650075 - RNA, 23 nt, Human
cauggcagugggaaaaauguagg

SEQ ID NO: 3650076 - RNA, 14 nt, Human
cauggcauccucca

SEQ ID NO: 3650077 - RNA, 23 nt, Human
cacauauaaauugucuuaaugga

SEQ ID NO: 3650078 - RNA, 15 nt, Human
cacauauacacacac

SEQ ID NO: 3650079 - RNA, 18 nt, Human
cacauauaccuauaaugu

SEQ ID NO: 3650080 - RNA, 14 nt, Human
cacauauauauuac

SEQ ID NO: 3650081 - RNA, 20 nt, Human
cacauaugcaccuugugucu

SEQ ID NO: 3650082 - RNA, 21 nt, Human
cacauauuagugcagccaagu

SEQ ID NO: 3650083 - RNA, 15 nt, Human
cacauauuugauagu

SEQ ID NO: 3650084 - RNA, 12 nt, Human
cacauauuuuaa

SEQ ID NO: 3650085 - RNA, 13 nt, Human
cacaucaaagagg

SEQ ID NO: 3650086 - RNA, 14 nt, Human
cacaucaaauaaga

SEQ ID NO: 3650087 - RNA, 14 nt, Human
cacaucacagauga

SEQ ID NO: 3650088 - RNA, 10 nt, Human
cacaucagau

SEQ ID NO: 3650089 - RNA, 19 nt, Human
cacaucagcacgauuucug

SEQ ID NO: 3650090 - RNA, 19 nt, Human
cacaucagcuagcaaaaga

SEQ ID NO: 3650091 - RNA, 23 nt, Human
cacaucagcuugcccuguuaaaa

SEQ ID NO: 3650092 - RNA, 12 nt, Human
cacauccaacuc

SEQ ID NO: 3650093 - RNA, 16 nt, Human
cacauccaacuccagc

SEQ ID NO: 3650094 - RNA, 19 nt, Human
cacauccaacuccagcaac

SEQ ID NO: 3650095 - RNA, 18 nt, Human
cacauccacagucucccc

SEQ ID NO: 3650096 - RNA, 18 nt, Human
cacauccaggcaauggcc

SEQ ID NO: 3650097 - RNA, 13 nt, Human
cacauccauuccc

SEQ ID NO: 3650098 - RNA, 14 nt, Human
cacauccauuccca

SEQ ID NO: 3650099 - RNA, 12 nt, Human
cacaucccagcc

SEQ ID NO: 3650100 - RNA, 22 nt, Human
cacaucccaggcuucacccuga

SEQ ID NO: 3650101 - RNA, 18 nt, Human
cacauccccgcuggcugg

SEQ ID NO: 3650102 - RNA, 13 nt, Human
cacaucccugggc

SEQ ID NO: 3650103 - RNA, 14 nt, Human
cacaucccugggcc

SEQ ID NO: 3650104 - RNA, 15 nt, Human
cacaucccugggccu

SEQ ID NO: 3650105 - RNA, 17 nt, Human
cacaucccugggccugc

SEQ ID NO: 3650106 - RNA, 20 nt, Human
cacaucccugggccugcugc

SEQ ID NO: 3650107 - RNA, 17 nt, Human
cacauccgccuuuugua

SEQ ID NO: 3650108 - RNA, 21 nt, Human
cacauccgccuuuuguauaca

SEQ ID NO: 3650109 - RNA, 20 nt, Human
cacauccggggccagcuccg

SEQ ID NO: 3650110 - RNA, 21 nt, Human
cacauccggggccagcuccgg

SEQ ID NO: 3650111 - RNA, 19 nt, Human
cacauccuaugcaauauau

SEQ ID NO: 3650112 - RNA, 19 nt, Human
cacaucgcagauucucccu

SEQ ID NO: 3650113 - RNA, 17 nt, Human
cacaucuaaccucaucu

SEQ ID NO: 3650114 - RNA, 22 nt, Human
cacaucuaagccugaaggggcg

SEQ ID NO: 3650115 - RNA, 22 nt, Human
cacaucuaguaguuguucugaa

SEQ ID NO: 3650116 - RNA, 14 nt, Human
cacaucucaacagg

SEQ ID NO: 3650117 - RNA, 20 nt, Human
cacaucucaacaggccucag

SEQ ID NO: 3650118 - RNA, 20 nt, Human
cauguccugugucaguuuau

SEQ ID NO: 3650119 - RNA, 14 nt, Human
caugucgccucugc

SEQ ID NO: 3650120 - RNA, 17 nt, Human
caugucgcgcucagcau

SEQ ID NO: 3650121 - RNA, 19 nt, Human
caugucgcgcucagcaugc

SEQ ID NO: 3650122 - RNA, 22 nt, Human
caugucgcgcucagcaugcauc

SEQ ID NO: 3650123 - RNA, 21 nt, Human
caugucgcuagccagugcucc

SEQ ID NO: 3650124 - RNA, 16 nt, Human
caugucuauucagcuu

SEQ ID NO: 3650125 - RNA, 18 nt, Human
caugucuccuacugagga

SEQ ID NO: 3650126 - RNA, 14 nt, Human
caugucucgacuca

SEQ ID NO: 3650127 - RNA, 16 nt, Human
caugucuuaaugaagu

SEQ ID NO: 3650128 - RNA, 20 nt, Human
caugucuuaaugaaguuuga

SEQ ID NO: 3650129 - RNA, 14 nt, Human
caugucuucucccu

SEQ ID NO: 3650130 - RNA, 14 nt, Human
caugucuuguacau

SEQ ID NO: 3650131 - RNA, 23 nt, Human
caugucuuguacauguguagccu

SEQ ID NO: 3650132 - RNA, 20 nt, Human
caugucuuucuccaaaguua

SEQ ID NO: 3650133 - RNA, 18 nt, Human
caugucuuucuccaggga

SEQ ID NO: 3650134 - RNA, 19 nt, Human
caugucuuuucuugcauga

SEQ ID NO: 3650135 - RNA, 21 nt, Human
caugucuuuucuugcaugagg

SEQ ID NO: 3650136 - RNA, 22 nt, Human
caugugaaaaggcaaaaagcau

SEQ ID NO: 3650137 - RNA, 19 nt, Human
caugugaaaaucaaauaca

SEQ ID NO: 3650138 - RNA, 14 nt, Human
caugugaaaccuuu

SEQ ID NO: 3650139 - RNA, 22 nt, Human
caugugaaaccuuuuuuaagau

SEQ ID NO: 3650140 - RNA, 16 nt, Human
caugugaaaucauuca

SEQ ID NO: 3650141 - RNA, 13 nt, Human
caugugacacaua

SEQ ID NO: 3650142 - RNA, 15 nt, Human
caugugacacauaug

SEQ ID NO: 3650143 - RNA, 12 nt, Human
caugugacauuu

SEQ ID NO: 3650144 - RNA, 18 nt, Human
caugugaccacucugucu

SEQ ID NO: 3650145 - RNA, 14 nt, Human
caugugagcucuuc

SEQ ID NO: 3650146 - RNA, 16 nt, Human
caugugagcucuuccu

SEQ ID NO: 3650147 - RNA, 18 nt, Human
caugugagcugcugccau

SEQ ID NO: 3650148 - RNA, 22 nt, Human
caugugauacauuuuuuaagcu

SEQ ID NO: 3650149 - RNA, 16 nt, Human
caugugaucacgccug

SEQ ID NO: 3650150 - RNA, 16 nt, Human
caugugauccuuuuau

SEQ ID NO: 3650151 - RNA, 22 nt, Human
caugugauccuuuuauguuauu

SEQ ID NO: 3650152 - RNA, 16 nt, Human
caugugaugagaggaa

SEQ ID NO: 3650153 - RNA, 21 nt, Human
caugugauggacacuccaggg

SEQ ID NO: 3650154 - RNA, 21 nt, Human
caugugcaaacccacucagag

SEQ ID NO: 3650155 - RNA, 14 nt, Human
caugugcacaugca

SEQ ID NO: 3650156 - RNA, 18 nt, Human
caugugcauaguuucuuu

SEQ ID NO: 3650157 - RNA, 19 nt, Human
caugugcauuauuuuccag

SEQ ID NO: 3650158 - RNA, 22 nt, Human
caugugccagguuuuuggucug

SEQ ID NO: 3650159 - RNA, 17 nt, Human
caugugcccccucuacc

SEQ ID NO: 3650160 - RNA, 18 nt, Human
caugugcccuccugaggg

SEQ ID NO: 3650161 - RNA, 14 nt, Human
caugugccugaucc

SEQ ID NO: 3650162 - RNA, 20 nt, Human
caugugccugauccagccuc

SEQ ID NO: 3650163 - RNA, 18 nt, Human
caugugccugcaccagga

SEQ ID NO: 3650164 - RNA, 23 nt, Human
caugugccugcaccaggagacag

SEQ ID NO: 3650165 - RNA, 20 nt, Human
caugugcuaguaauuggaaa

SEQ ID NO: 3650166 - RNA, 24 nt, Human
caugugcugcccuacagcacccug

SEQ ID NO: 3650167 - RNA, 18 nt, Human
cauguggaaagugaauuu

SEQ ID NO: 3650168 - RNA, 20 nt, Human
cauguggaaagugaauuuga

SEQ ID NO: 3650169 - RNA, 23 nt, Human
cauguggaaagugaauuugaaug

SEQ ID NO: 3650170 - RNA, 20 nt, Human
cauguggaaggcaagccagg

SEQ ID NO: 3650171 - RNA, 17 nt, Human
cauguggaauauaaaga

SEQ ID NO: 3650172 - RNA, 17 nt, Human
cauguggagacuucauc

SEQ ID NO: 3650173 - RNA, 13 nt, Human
cauguggcuggaa

SEQ ID NO: 3650174 - RNA, 15 nt, Human
cauguggcuggaaga

SEQ ID NO: 3650175 - RNA, 20 nt, Human
cauguggcuugaauuaagaa

SEQ ID NO: 3650176 - RNA, 22 nt, Human
caugugggaaaaaaaugaauga

SEQ ID NO: 3650177 - RNA, 15 nt, Human
cauguggggccaggu

SEQ ID NO: 3650178 - RNA, 19 nt, Human
caugugggucuuccagggg

SEQ ID NO: 3650179 - RNA, 23 nt, Human
caugugguggcacaggcccccuu

SEQ ID NO: 3650180 - RNA, 21 nt, Human
caugugguuugguuccucucu

SEQ ID NO: 3650181 - RNA, 22 nt, Human
cauguguaaucaauaaacgauu

SEQ ID NO: 3650182 - RNA, 15 nt, Human
cauguguagccuaug

SEQ ID NO: 3650183 - RNA, 14 nt, Human
cauguguagccugu

SEQ ID NO: 3650184 - RNA, 18 nt, Human
cauguguagccugugcau

SEQ ID NO: 3650185 - RNA, 13 nt, Human
cauguguauaaaa

SEQ ID NO: 3650186 - RNA, 22 nt, Human
caugugucacuugugcuuugcu

SEQ ID NO: 3650187 - RNA, 21 nt, Human
cauguguccaucccagcggcu

SEQ ID NO: 3650188 - RNA, 13 nt, Human
caugugucccaga

SEQ ID NO: 3650189 - RNA, 17 nt, Human
caugugucccagaagau

SEQ ID NO: 3650190 - RNA, 15 nt, Human
cauguguccugguuc

SEQ ID NO: 3650191 - RNA, 15 nt, Human
caugugugagugugu

SEQ ID NO: 3650192 - RNA, 17 nt, Human
caugugugagugugugc

SEQ ID NO: 3650193 - RNA, 17 nt, Human
caugugugcgagugugu

SEQ ID NO: 3650194 - RNA, 14 nt, Human
caugugugcugaac

SEQ ID NO: 3650195 - RNA, 11 nt, Human
cauguguguau

SEQ ID NO: 3650196 - RNA, 12 nt, Human
cauguguguaua

SEQ ID NO: 3650197 - RNA, 15 nt, Human
cauguguguauauau

SEQ ID NO: 3650198 - RNA, 18 nt, Human
cauguguguauauaugug

SEQ ID NO: 3650199 - RNA, 20 nt, Human
cauguguguauauaugugua

SEQ ID NO: 3650200 - RNA, 21 nt, Human
cauguguguccacgacugucu

SEQ ID NO: 3650201 - RNA, 21 nt, Human
caugugugugcaagugugugc

SEQ ID NO: 3650202 - RNA, 22 nt, Human
cauguguguuaacccagugcuu

SEQ ID NO: 3650203 - RNA, 16 nt, Human
cauguguuauguuuuc

SEQ ID NO: 3650204 - RNA, 14 nt, Human
cauguguucccuuu

SEQ ID NO: 3650205 - RNA, 18 nt, Human
cauguguuggcagccucu

SEQ ID NO: 3650206 - RNA, 18 nt, Human
cauguguuuacuuuaugu

SEQ ID NO: 3650207 - RNA, 17 nt, Human
cauguuaauccuagcug

SEQ ID NO: 3650208 - RNA, 17 nt, Human
cauguuacauaagauaa

SEQ ID NO: 3650209 - RNA, 21 nt, Human
cauguuacauaagauaaaugu

SEQ ID NO: 3650210 - RNA, 14 nt, Human
cauguuaguuaccu

SEQ ID NO: 3650211 - RNA, 22 nt, Human
cauguuaguuaccuuauaguua

SEQ ID NO: 3650212 - RNA, 12 nt, Human
cauguuauguuu

SEQ ID NO: 3650213 - RNA, 13 nt, Human
cauguucaauuau

SEQ ID NO: 3650214 - RNA, 20 nt, Human
cauguucaauuauuuccccc

SEQ ID NO: 3650215 - RNA, 20 nt, Human
cauguucacaccgcugcacu

SEQ ID NO: 3650216 - RNA, 14 nt, Human
cauguuccaauaaa

SEQ ID NO: 3650217 - RNA, 17 nt, Human
cauguuccaauaaacag

SEQ ID NO: 3650218 - RNA, 15 nt, Human
cauguuccacuaacc

SEQ ID NO: 3650219 - RNA, 21 nt, Human
cauguucccacuucaaaacaa

SEQ ID NO: 3650220 - RNA, 21 nt, Human
cauguuccucaaaagcacccu

SEQ ID NO: 3650221 - RNA, 14 nt, Human
cauguuccuucaag

SEQ ID NO: 3650222 - RNA, 16 nt, Human
cauguuccuucaagau

SEQ ID NO: 3650223 - RNA, 15 nt, Human
cauguucucugagga

SEQ ID NO: 3650224 - RNA, 18 nt, Human
cauguucugcccccagcc

SEQ ID NO: 3650225 - RNA, 21 nt, Human
cauguucugcccccagcccaa

SEQ ID NO: 3650226 - RNA, 13 nt, Human
cauguucuuaauu

SEQ ID NO: 3650227 - RNA, 19 nt, Human
cauguugaagccacugccu

SEQ ID NO: 3650228 - RNA, 22 nt, Human
cauguugaagccacugccuuca

SEQ ID NO: 3650229 - RNA, 21 nt, Human
cauguugaucauguacuuuuu

SEQ ID NO: 3650230 - RNA, 22 nt, Human
cauguugccccuuucucuuuuc

SEQ ID NO: 3650231 - RNA, 14 nt, Human
cauguugcugagga

SEQ ID NO: 3650232 - RNA, 14 nt, Human
cauguuggccaggc

SEQ ID NO: 3650233 - RNA, 16 nt, Human
cauguuggccaggcug

SEQ ID NO: 3650234 - RNA, 17 nt, Human
cauguuggccaggcugg

SEQ ID NO: 3650235 - RNA, 19 nt, Human
cauguuggccaggcugguc

SEQ ID NO: 3650236 - RNA, 15 nt, Human
cauguugggaaacuu

SEQ ID NO: 3650237 - RNA, 19 nt, Human
cauguugggaaacuuggcu

SEQ ID NO: 3650238 - RNA, 20 nt, Human
cauguugggaaacuuggcuc

SEQ ID NO: 3650239 - RNA, 16 nt, Human
cauguugguugcacuu

SEQ ID NO: 3650240 - RNA, 15 nt, Human
cauguuguaaugcug

SEQ ID NO: 3650241 - RNA, 18 nt, Human
caccaagcacagcagccu

SEQ ID NO: 3650242 - RNA, 19 nt, Human
caccaagcacagcagccug

SEQ ID NO: 3650243 - RNA, 14 nt, Human
caccaagcccacag

SEQ ID NO: 3650244 - RNA, 13 nt, Human
caccaagcccagu

SEQ ID NO: 3650245 - RNA, 19 nt, Human
caccaagccuggucagccc

SEQ ID NO: 3650246 - RNA, 20 nt, Human
caccaagccuggucagccca

SEQ ID NO: 3650247 - RNA, 21 nt, Human
caccaagccuggucagcccaa

SEQ ID NO: 3650248 - RNA, 22 nt, Human
caccaagccuggucagcccaaa

SEQ ID NO: 3650249 - RNA, 13 nt, Human
caccaagcucaaa

SEQ ID NO: 3650250 - RNA, 14 nt, Human
caccaagcucacag

SEQ ID NO: 3650251 - RNA, 20 nt, Human
caccaaggaaacgcuaccuc

SEQ ID NO: 3650252 - RNA, 10 nt, Human
caccaagggc

SEQ ID NO: 3650253 - RNA, 16 nt, Human
caccaagugcgggucc

SEQ ID NO: 3650254 - RNA, 22 nt, Human
caccaaguuggaacauccuugg

SEQ ID NO: 3650255 - RNA, 17 nt, Human
caccaaucuuacuuugu

SEQ ID NO: 3650256 - RNA, 22 nt, Human
caccaaucuuacuuuguaaauu

SEQ ID NO: 3650257 - RNA, 15 nt, Human
caccacacacaacag

SEQ ID NO: 3650258 - RNA, 17 nt, Human
caccacacacaacagcc

SEQ ID NO: 3650259 - RNA, 14 nt, Human
caccacacauccca

SEQ ID NO: 3650260 - RNA, 19 nt, Human
caccacacaucccagccca

SEQ ID NO: 3650261 - RNA, 13 nt, Human
caccacacccagc

SEQ ID NO: 3650262 - RNA, 17 nt, Human
ccaccgccccuggccgc

SEQ ID NO: 3650263 - RNA, 16 nt, Human
ccaccgccuugcccag

SEQ ID NO: 3650264 - RNA, 14 nt, Human
ccaccgcgggugug

SEQ ID NO: 3650265 - RNA, 13 nt, Human
ccaccgcugcucc

SEQ ID NO: 3650266 - RNA, 13 nt, Human
ccaccgggccacu

SEQ ID NO: 3650267 - RNA, 18 nt, Human
ccaccgggccacuccuuc

SEQ ID NO: 3650268 - RNA, 23 nt, Human
ccaccgggcugggagcucugcag

SEQ ID NO: 3650269 - RNA, 15 nt, Human
ccaccgguccagcug

SEQ ID NO: 3650270 - RNA, 13 nt, Human
ccaccguccgccc

SEQ ID NO: 3650271 - RNA, 17 nt, Human
ccaccguccgcccugcu

SEQ ID NO: 3650272 - RNA, 16 nt, Human
ccaccguggaggagga

SEQ ID NO: 3650273 - RNA, 15 nt, Human
ccaccguugucucau

SEQ ID NO: 3650274 - RNA, 19 nt, Human
ccaccguugucucaugcca

SEQ ID NO: 3650275 - RNA, 17 nt, Human
ccaccuaaucaggcuga

SEQ ID NO: 3650276 - RNA, 19 nt, Human
ccaccuacaauacaucuga

SEQ ID NO: 3650277 - RNA, 18 nt, Human
ccaccuagaacacuaacu

SEQ ID NO: 3650278 - RNA, 21 nt, Human
ccaccuaguggcuguccagug

SEQ ID NO: 3650279 - RNA, 14 nt, Human
ccaccucaccccac

SEQ ID NO: 3650280 - RNA, 13 nt, Human
ccaccucagccuc

SEQ ID NO: 3650281 - RNA, 14 nt, Human
ccaccucagccucc

SEQ ID NO: 3650282 - RNA, 15 nt, Human
ccaccucagccuccc

SEQ ID NO: 3650283 - RNA, 15 nt, Human
ccaccucagccuugg

SEQ ID NO: 3650284 - RNA, 13 nt, Human
ccaccuccagaaa

SEQ ID NO: 3650285 - RNA, 14 nt, Human
ccaccuccagaaac

SEQ ID NO: 3650286 - RNA, 13 nt, Human
ccaccuccagccc

SEQ ID NO: 3650287 - RNA, 23 nt, Human
ccaccuccagcccgggagccuag

SEQ ID NO: 3650288 - RNA, 21 nt, Human
ccaccuccaggcuuucccacu

SEQ ID NO: 3650289 - RNA, 17 nt, Human
ccaccucccacaaagga

SEQ ID NO: 3650290 - RNA, 18 nt, Human
ccaccucccccacuccca

SEQ ID NO: 3650291 - RNA, 20 nt, Human
ccaccucccccucccccuuc

SEQ ID NO: 3650292 - RNA, 16 nt, Human
caccucaugcccaccc

SEQ ID NO: 3650293 - RNA, 14 nt, Human
caccucauggaauu

SEQ ID NO: 3650294 - RNA, 18 nt, Human
caccuccacaguucagug

SEQ ID NO: 3650295 - RNA, 20 nt, Human
caccuccacaguucaguggc

SEQ ID NO: 3650296 - RNA, 21 nt, Human
caccuccacauaccuggcccu

SEQ ID NO: 3650297 - RNA, 14 nt, Human
caccuccagccuga

SEQ ID NO: 3650298 - RNA, 13 nt, Human
caccuccaggccu

SEQ ID NO: 3650299 - RNA, 14 nt, Human
caccuccaggccug

SEQ ID NO: 3650300 - RNA, 10 nt, Human
caccucccag

SEQ ID NO: 3650301 - RNA, 13 nt, Human
caccucccagccc

SEQ ID NO: 3650302 - RNA, 18 nt, Human
caccucccagccccugcc

SEQ ID NO: 3650303 - RNA, 13 nt, Human
caccucccauccu

SEQ ID NO: 3650304 - RNA, 9 nt, Human
caccucccc

SEQ ID NO: 3650305 - RNA, 16 nt, Human
caccuccccagcauuc

SEQ ID NO: 3650306 - RNA, 14 nt, Human
caccuccccagccu

SEQ ID NO: 3650307 - RNA, 14 nt, Human
caccuccccaggcc

SEQ ID NO: 3650308 - RNA, 21 nt, Human
caccuccccaggccguggcug

SEQ ID NO: 3650309 - RNA, 11 nt, Human
caccuccccca

SEQ ID NO: 3650310 - RNA, 14 nt, Human
caccucccccaucu

SEQ ID NO: 3650311 - RNA, 22 nt, Human
caccuccccccacugcaggccc

SEQ ID NO: 3650312 - RNA, 16 nt, Human
caccucccccugcccc

SEQ ID NO: 3650313 - RNA, 19 nt, Human
caccuccccuauccaccca

SEQ ID NO: 3650314 - RNA, 20 nt, Human
caccuccccuauccacccag

SEQ ID NO: 3650315 - RNA, 19 nt, Human
caccuccccuugccagcug

SEQ ID NO: 3650316 - RNA, 21 nt, Human
caccucccuauacugcuugga

SEQ ID NO: 3650317 - RNA, 17 nt, Human
caccucccucaaccuca

SEQ ID NO: 3650318 - RNA, 12 nt, Human
caccucccugcc

SEQ ID NO: 3650319 - RNA, 13 nt, Human
caccucccugccc

SEQ ID NO: 3650320 - RNA, 14 nt, Human
caccucccugccca

SEQ ID NO: 3650321 - RNA, 15 nt, Human
caccucccugcccag

SEQ ID NO: 3650322 - RNA, 17 nt, Human
caccucccugcccaggc

SEQ ID NO: 3650323 - RNA, 15 nt, Human
caccucccugccucc

SEQ ID NO: 3650324 - RNA, 14 nt, Human
caccuccucagccu

SEQ ID NO: 3650325 - RNA, 13 nt, Human
caccuccugccuc

SEQ ID NO: 3650326 - RNA, 20 nt, Human
caccuccuggguucaagcga

SEQ ID NO: 3650327 - RNA, 17 nt, Human
caccuccuucccucucu

SEQ ID NO: 3650328 - RNA, 22 nt, Human
caccuccuucccucucuggaga

SEQ ID NO: 3650329 - RNA, 23 nt, Human
caccuccuuucaagguaacugua

SEQ ID NO: 3650330 - RNA, 15 nt, Human
caccucuacccaaac

SEQ ID NO: 3650331 - RNA, 13 nt, Human
caccucucaauau

SEQ ID NO: 3650332 - RNA, 23 nt, Human
caccucucaauauucaauaaagc

SEQ ID NO: 3650333 - RNA, 15 nt, Human
caccucuccaagggc

SEQ ID NO: 3650334 - RNA, 22 nt, Human
caccucuccaagggcuucugca

SEQ ID NO: 3650335 - RNA, 23 nt, Human
caccucucccucaacaagggaga

SEQ ID NO: 3650336 - RNA, 13 nt, Human
caccucucccuug

SEQ ID NO: 3650337 - RNA, 19 nt, Human
caccucuccuacucacuua

SEQ ID NO: 3650338 - RNA, 17 nt, Human
caccucucucacuccuu

SEQ ID NO: 3650339 - RNA, 22 nt, Human
caccucugaaaacggcccucuu

SEQ ID NO: 3650340 - RNA, 22 nt, Human
caccucugaccuaucacuucca

SEQ ID NO: 3650341 - RNA, 18 nt, Human
caccucugcacaagcugc

SEQ ID NO: 3650342 - RNA, 14 nt, Human
caccucugccucaa

SEQ ID NO: 3650343 - RNA, 12 nt, Human
caccucugcgga

SEQ ID NO: 3650344 - RNA, 20 nt, Human
caccucugcggaccccagcu

SEQ ID NO: 3650345 - RNA, 21 nt, Human
caccucugcggaccccagcug

SEQ ID NO: 3650346 - RNA, 12 nt, Human
caccucugcuuu

SEQ ID NO: 3650347 - RNA, 13 nt, Human
caccucuggacug

SEQ ID NO: 3650348 - RNA, 17 nt, Human
caccucuggacuggcua

SEQ ID NO: 3650349 - RNA, 19 nt, Human
caccucuggacuggcuaga

SEQ ID NO: 3650350 - RNA, 13 nt, Human
caccucugugacc

SEQ ID NO: 3650351 - RNA, 14 nt, Human
caccucugugaccu

SEQ ID NO: 3650352 - RNA, 15 nt, Human
caccucugugaccuc

SEQ ID NO: 3650353 - RNA, 22 nt, Human
caccucugugaccucaggcacu

SEQ ID NO: 3650354 - RNA, 12 nt, Human
caccucugugcc

SEQ ID NO: 3650355 - RNA, 18 nt, Human
caccucuucucuuccugu

SEQ ID NO: 3650356 - RNA, 22 nt, Human
caccucuucucuuccuguaaca

SEQ ID NO: 3650357 - RNA, 17 nt, Human
caccugaacugaacacc

SEQ ID NO: 3650358 - RNA, 15 nt, Human
caccugacucugaaa

SEQ ID NO: 3650359 - RNA, 19 nt, Human
caccugagcaggaccucug

SEQ ID NO: 3650360 - RNA, 20 nt, Human
caccugagcaggaccucuga

SEQ ID NO: 3650361 - RNA, 23 nt, Human
caccugagcccggaugcuucucc

SEQ ID NO: 3650362 - RNA, 10 nt, Human
caccugagcu

SEQ ID NO: 3650363 - RNA, 20 nt, Human
caccugagcuuuggacgcac

SEQ ID NO: 3650364 - RNA, 11 nt, Human
caccugaggaa

SEQ ID NO: 3650365 - RNA, 14 nt, Human
caccugaggaacug

SEQ ID NO: 3650366 - RNA, 15 nt, Human
caccugaggugggcc

SEQ ID NO: 3650367 - RNA, 20 nt, Human
caccugaggugggcccagga

SEQ ID NO: 3650368 - RNA, 21 nt, Human
caccugaggugggcccaggac

SEQ ID NO: 3650369 - RNA, 18 nt, Human
caccugagguuaggaguu

SEQ ID NO: 3650370 - RNA, 19 nt, Human
caccugagucacccuaccu

SEQ ID NO: 3650371 - RNA, 15 nt, Human
caccugauucaacua

SEQ ID NO: 3650372 - RNA, 17 nt, Human
caccugcaaagcucugu

SEQ ID NO: 3650373 - RNA, 11 nt, Human
caccugcaccu

SEQ ID NO: 3650374 - RNA, 14 nt, Human
caccugcaccuccc

SEQ ID NO: 3650375 - RNA, 15 nt, Human
caccugcacuaacag

SEQ ID NO: 3650376 - RNA, 21 nt, Human
caccugcacuaacagaguggc

SEQ ID NO: 3650377 - RNA, 15 nt, Human
caccugcagggcugc

SEQ ID NO: 3650378 - RNA, 18 nt, Human
caccugcagguugggcca

SEQ ID NO: 3650379 - RNA, 22 nt, Human
caccugcagguugggccauacu

SEQ ID NO: 3650380 - RNA, 23 nt, Human
caccugcagguugggccauacug

SEQ ID NO: 3650381 - RNA, 13 nt, Human
caccugccagccu

SEQ ID NO: 3650382 - RNA, 13 nt, Human
caccugccaggga

SEQ ID NO: 3650383 - RNA, 14 nt, Human
caccugccagggac

SEQ ID NO: 3650384 - RNA, 22 nt, Human
caccugccauuugcacccuccg

SEQ ID NO: 3650385 - RNA, 13 nt, Human
caccugcccaacc

SEQ ID NO: 3650386 - RNA, 19 nt, Human
caccugcccaaccugcucu

SEQ ID NO: 3650387 - RNA, 15 nt, Human
caccugcccccuggu

SEQ ID NO: 3650388 - RNA, 17 nt, Human
caccugcccccuucucc

SEQ ID NO: 3650389 - RNA, 19 nt, Human
caccugcccccuucuccca

SEQ ID NO: 3650390 - RNA, 23 nt, Human
caccugcccccuucucccacacu

SEQ ID NO: 3650391 - RNA, 12 nt, Human
caccugcccugc

SEQ ID NO: 3650392 - RNA, 13 nt, Human
caccugcccuuuu

SEQ ID NO: 3650393 - RNA, 23 nt, Human
caccugcccuuuuuucugccucc

SEQ ID NO: 3650394 - RNA, 13 nt, Human
caccugccgaccu

SEQ ID NO: 3650395 - RNA, 13 nt, Human
caccugccucagg

SEQ ID NO: 3650396 - RNA, 20 nt, Human
caccugccucaggacugcga

SEQ ID NO: 3650397 - RNA, 10 nt, Human
caccugccug

SEQ ID NO: 3650398 - RNA, 23 nt, Human
caccugccugcgucuuccgcccc

SEQ ID NO: 3650399 - RNA, 14 nt, Human
caccugccuggccg

SEQ ID NO: 3650400 - RNA, 24 nt, Human
caccugccuguugggccaggagcc

SEQ ID NO: 3650401 - RNA, 15 nt, Human
caccugcgcuucacu

SEQ ID NO: 3650402 - RNA, 16 nt, Human
caccugcggugcuauc

SEQ ID NO: 3650403 - RNA, 19 nt, Human
caccugcggugcuaucucc

SEQ ID NO: 3650404 - RNA, 20 nt, Human
caccugcggugcuaucuccc

SEQ ID NO: 3650405 - RNA, 12 nt, Human
caccugcucugc

SEQ ID NO: 3650406 - RNA, 13 nt, Human
caccugcugcugc

SEQ ID NO: 3650407 - RNA, 12 nt, Human
caccugcugcuu

SEQ ID NO: 3650408 - RNA, 20 nt, Human
caccugcuggccccucaccu

SEQ ID NO: 3650409 - RNA, 14 nt, Human
cacgcacacacaca

SEQ ID NO: 3650410 - RNA, 15 nt, Human
cacgcacacugucug

SEQ ID NO: 3650411 - RNA, 21 nt, Human
cacgcacaugcgaccccgagg

SEQ ID NO: 3650412 - RNA, 12 nt, Human
cacgcaccuccc

SEQ ID NO: 3650413 - RNA, 16 nt, Human
cacgcaccugccucag

SEQ ID NO: 3650414 - RNA, 20 nt, Human
cacgcagauuagcaggccaa

SEQ ID NO: 3650415 - RNA, 13 nt, Human
cacgcagccagga

SEQ ID NO: 3650416 - RNA, 16 nt, Human
cacgcagccaggacac

SEQ ID NO: 3650417 - RNA, 19 nt, Human
cacgcagccaggacaccgg

SEQ ID NO: 3650418 - RNA, 13 nt, Human
cacgcaggaacuc

SEQ ID NO: 3650419 - RNA, 19 nt, Human
cacgcaggaacucccagca

SEQ ID NO: 3650420 - RNA, 15 nt, Human
cacgcaugcaguguu

SEQ ID NO: 3650421 - RNA, 11 nt, Human
cacgccacagc

SEQ ID NO: 3650422 - RNA, 12 nt, Human
cacgccacagcc

SEQ ID NO: 3650423 - RNA, 22 nt, Human
cacgccacugcacuccagccug

SEQ ID NO: 3650424 - RNA, 16 nt, Human
cacgccagauucuuuc

SEQ ID NO: 3650425 - RNA, 23 nt, Human
cacgccagauucuuuccugaggc

SEQ ID NO: 3650426 - RNA, 18 nt, Human
cacgcccccacuggugac

SEQ ID NO: 3650427 - RNA, 14 nt, Human
cacgcccguccugc

SEQ ID NO: 3650428 - RNA, 19 nt, Human
cacgcccguccugccugug

SEQ ID NO: 3650429 - RNA, 13 nt, Human
cacgcccuccccu

SEQ ID NO: 3650430 - RNA, 16 nt, Human
cacgccuagccucacg

SEQ ID NO: 3650431 - RNA, 17 nt, Human
cacgccuagccucacgc

SEQ ID NO: 3650432 - RNA, 18 nt, Human
cacgccuagccucacgcu

SEQ ID NO: 3650433 - RNA, 19 nt, Human
cacgccuaugaucccagca

SEQ ID NO: 3650434 - RNA, 15 nt, Human
cacgccucccacugg

SEQ ID NO: 3650435 - RNA, 17 nt, Human
cacgccugcaaacgcug

SEQ ID NO: 3650436 - RNA, 21 nt, Human
cacgccugcaaacgcugccug

SEQ ID NO: 3650437 - RNA, 22 nt, Human
cacgccugcaaacgcugccugc

SEQ ID NO: 3650438 - RNA, 16 nt, Human
cacgccuggcuaauuu

SEQ ID NO: 3650439 - RNA, 23 nt, Human
cacgccuguaaucccagcaauuu

SEQ ID NO: 3650440 - RNA, 21 nt, Human
cacgccuguaaucccagcacu

SEQ ID NO: 3650441 - RNA, 19 nt, Human
cacgccuguaauccuagca

SEQ ID NO: 3650442 - RNA, 23 nt, Human
cacgcgccccccucccagaggcg

SEQ ID NO: 3650443 - RNA, 23 nt, Human
cacgcgcgcacacacacacauac

SEQ ID NO: 3650444 - RNA, 15 nt, Human
cacgcgggggccuug

SEQ ID NO: 3650445 - RNA, 17 nt, Human
cacgcgugccguggcac

SEQ ID NO: 3650446 - RNA, 12 nt, Human
cacgcuccagcu

SEQ ID NO: 3650447 - RNA, 13 nt, Human
cacgcuccagcug

SEQ ID NO: 3650448 - RNA, 15 nt, Human
cacgcuccagcugcc

SEQ ID NO: 3650449 - RNA, 19 nt, Human
cacgcuccccgccuguucc

SEQ ID NO: 3650450 - RNA, 20 nt, Human
cacgcuccccgccuguuccc

SEQ ID NO: 3650451 - RNA, 22 nt, Human
cacgcuccuuucugaucuucac

SEQ ID NO: 3650452 - RNA, 19 nt, Human
cacgcucucuccaggcagg

SEQ ID NO: 3650453 - RNA, 23 nt, Human
cacgcucucuccaggcaggucug

SEQ ID NO: 3650454 - RNA, 16 nt, Human
cacgcugcucugcccc

SEQ ID NO: 3650455 - RNA, 17 nt, Human
cacgcuggagugcagug

SEQ ID NO: 3650456 - RNA, 20 nt, Human
cacgcuggagugcagugagc

SEQ ID NO: 3650457 - RNA, 21 nt, Human
cacgcuggagugcagugagcc

SEQ ID NO: 3650458 - RNA, 19 nt, Human
cacgcugucuccagacccc

SEQ ID NO: 3650459 - RNA, 14 nt, Human
ccacucccaguccc

SEQ ID NO: 3650460 - RNA, 14 nt, Human
ccacucccucacaa

SEQ ID NO: 3650461 - RNA, 12 nt, Human
ccacucccugca

SEQ ID NO: 3650462 - RNA, 13 nt, Human
ccacucccugcaa

SEQ ID NO: 3650463 - RNA, 18 nt, Human
ccacucccuugcuggccc

SEQ ID NO: 3650464 - RNA, 16 nt, Human
ccacuccgagaggugg

SEQ ID NO: 3650465 - RNA, 11 nt, Human
ccacuccuccc

SEQ ID NO: 3650466 - RNA, 14 nt, Human
ccacuccucccucc

SEQ ID NO: 3650467 - RNA, 15 nt, Human
ccacuccucccuccg

SEQ ID NO: 3650468 - RNA, 13 nt, Human
ccacuccucugac

SEQ ID NO: 3650469 - RNA, 20 nt, Human
ccacuccucugacucagggc

SEQ ID NO: 3650470 - RNA, 15 nt, Human
ccacuccucugcuga

SEQ ID NO: 3650471 - RNA, 13 nt, Human
ccacuccugcucu

SEQ ID NO: 3650472 - RNA, 17 nt, Human
ccacuccugcucugcuc

SEQ ID NO: 3650473 - RNA, 14 nt, Human
ccacuccuguacac

SEQ ID NO: 3650474 - RNA, 22 nt, Human
ccacuccuuccugccaccugcu

SEQ ID NO: 3650475 - RNA, 13 nt, Human
ccacucgcuuccc

SEQ ID NO: 3650476 - RNA, 21 nt, Human
ccacucgcuucccccauagcc

SEQ ID NO: 3650477 - RNA, 18 nt, Human
ccacucgugcaucccuga

SEQ ID NO: 3650478 - RNA, 15 nt, Human
ccacucuaccagugc

SEQ ID NO: 3650479 - RNA, 16 nt, Human
ccacucuacccuccca

SEQ ID NO: 3650480 - RNA, 19 nt, Human
ccacucuagggcaguggag

SEQ ID NO: 3650481 - RNA, 22 nt, Human
ccacucuaggggucaggcucca

SEQ ID NO: 3650482 - RNA, 13 nt, Human
ccacucucagagg

SEQ ID NO: 3650483 - RNA, 17 nt, Human
ccacucucagaggcccc

SEQ ID NO: 3650484 - RNA, 18 nt, Human
ccacucucagaggcccca

SEQ ID NO: 3650485 - RNA, 14 nt, Human
ccacucucauuccc

SEQ ID NO: 3650486 - RNA, 18 nt, Human
ccacucucauuccccagg

SEQ ID NO: 3650487 - RNA, 23 nt, Human
ccacucucuucccuuuccccagc

SEQ ID NO: 3650488 - RNA, 15 nt, Human
ccacucugauagaau

SEQ ID NO: 3650489 - RNA, 16 nt, Human
ccacucugccucugcc

SEQ ID NO: 3650490 - RNA, 18 nt, Human
ccacucugcucugaugca

SEQ ID NO: 3650491 - RNA, 13 nt, Human
ccacucugcuucu

SEQ ID NO: 3650492 - RNA, 14 nt, Human
ccacucugcuucuc

SEQ ID NO: 3650493 - RNA, 21 nt, Human
ccacucugcuuugacugagca

SEQ ID NO: 3650494 - RNA, 11 nt, Human
ccacucuggau

SEQ ID NO: 3650495 - RNA, 21 nt, Human
ccacucuggauucagccuucu

SEQ ID NO: 3650496 - RNA, 19 nt, Human
ccacucuggcagccacacu

SEQ ID NO: 3650497 - RNA, 19 nt, Human
ccacucuguaauugcaaaa

SEQ ID NO: 3650498 - RNA, 15 nt, Human
ccacugaaaaaauau

SEQ ID NO: 3650499 - RNA, 14 nt, Human
ccacugaaaucugu

SEQ ID NO: 3650500 - RNA, 11 nt, Human
ccacugaagag

SEQ ID NO: 3650501 - RNA, 21 nt, Human
ccacugaaguagugugcaguu

SEQ ID NO: 3650502 - RNA, 16 nt, Human
ccacugaaucuguaca

SEQ ID NO: 3650503 - RNA, 15 nt, Human
ccacugacagccucc

SEQ ID NO: 3650504 - RNA, 17 nt, Human
ccacugacagccuccca

SEQ ID NO: 3650505 - RNA, 17 nt, Human
ccacugagaggacagag

SEQ ID NO: 3650506 - RNA, 18 nt, Human
ccacugagaggacagaga

SEQ ID NO: 3650507 - RNA, 13 nt, Human
ccacugcacacac

SEQ ID NO: 3650508 - RNA, 18 nt, Human
ccacugcacacaccucag

SEQ ID NO: 3650509 - RNA, 20 nt, Human
ccacugcacagagcucucca

SEQ ID NO: 3650510 - RNA, 18 nt, Human
ccacugcacccccuccug

SEQ ID NO: 3650511 - RNA, 19 nt, Human
ccacugcacccccuccugc

SEQ ID NO: 3650512 - RNA, 23 nt, Human
ccacugcacccccuccugcugca

SEQ ID NO: 3650513 - RNA, 13 nt, Human
ccacugcaccggg

SEQ ID NO: 3650514 - RNA, 19 nt, Human
ccacugcaccgggccacag

SEQ ID NO: 3650515 - RNA, 20 nt, Human
ccacugcacuccagccuggc

SEQ ID NO: 3650516 - RNA, 21 nt, Human
ccacugcacuccagccugggc

SEQ ID NO: 3650517 - RNA, 21 nt, Human
ccacugcacuccagccugggu

SEQ ID NO: 3650518 - RNA, 19 nt, Human
ccacugcacucuagccgga

SEQ ID NO: 3650519 - RNA, 13 nt, Human
ccacugcagaaga

SEQ ID NO: 3650520 - RNA, 18 nt, Human
ccacugcauaccaaccug

SEQ ID NO: 3650521 - RNA, 23 nt, Human
ccacugccagcagcagcagguga

SEQ ID NO: 3650522 - RNA, 17 nt, Human
ccacugcccccugcugc

SEQ ID NO: 3650523 - RNA, 19 nt, Human
ccacugcccccugcugcca

SEQ ID NO: 3650524 - RNA, 16 nt, Human
ccacugcccgagcugg

SEQ ID NO: 3650525 - RNA, 14 nt, Human
ccacugcccucugu

SEQ ID NO: 3650526 - RNA, 16 nt, Human
ccacugcccuucucau

SEQ ID NO: 3650527 - RNA, 11 nt, Human
ccacugccucu

SEQ ID NO: 3650528 - RNA, 19 nt, Human
ccacugccucucccucugg

SEQ ID NO: 3650529 - RNA, 14 nt, Human
ccacugccucugcc

SEQ ID NO: 3650530 - RNA, 15 nt, Human
ccacugccucugccu

SEQ ID NO: 3650531 - RNA, 18 nt, Human
ccacugccucugccuuag

SEQ ID NO: 3650532 - RNA, 23 nt, Human
ccacugccugcccacccguggag

SEQ ID NO: 3650533 - RNA, 23 nt, Human
ccacugccuucgcuucuugccuc

SEQ ID NO: 3650534 - RNA, 22 nt, Human
ccacugccuuugaccugccucc

SEQ ID NO: 3650535 - RNA, 13 nt, Human
ccacugcguuguc

SEQ ID NO: 3650536 - RNA, 19 nt, Human
ccacugcuccguggaggag

SEQ ID NO: 3650537 - RNA, 19 nt, Human
ccacugcucuccagccugg

SEQ ID NO: 3650538 - RNA, 15 nt, Human
ccacugcucugguua

SEQ ID NO: 3650539 - RNA, 20 nt, Human
ccacugcuuuuggucugugu

SEQ ID NO: 3650540 - RNA, 20 nt, Human
ccacuggacuugagcuuggc

SEQ ID NO: 3650541 - RNA, 11 nt, Human
ccacuggagca

SEQ ID NO: 3650542 - RNA, 17 nt, Human
ccacuggaucagaaaga

SEQ ID NO: 3650543 - RNA, 12 nt, Human
ccacuggccacc

SEQ ID NO: 3650544 - RNA, 17 nt, Human
ccacuggccaccaggcu

SEQ ID NO: 3650545 - RNA, 18 nt, Human
ccacuggccaccaggcug

SEQ ID NO: 3650546 - RNA, 15 nt, Human
ccacuggcugcuaac

SEQ ID NO: 3650547 - RNA, 16 nt, Human
ccacugggaccaaccc

SEQ ID NO: 3650548 - RNA, 23 nt, Human
ccacugggaccaacccuggggaa

SEQ ID NO: 3650549 - RNA, 18 nt, Human
ccacuggggcucagagcc

SEQ ID NO: 3650550 - RNA, 22 nt, Human
ccacugggguccagggagcagg

SEQ ID NO: 3650551 - RNA, 21 nt, Human
ccacugggguggccugacucc

SEQ ID NO: 3650552 - RNA, 20 nt, Human
ccacugguccccaacaaugu

SEQ ID NO: 3650553 - RNA, 19 nt, Human
ccacuguacuugcucuuga

SEQ ID NO: 3650554 - RNA, 21 nt, Human
ccagcggacaguggcaggaca

SEQ ID NO: 3650555 - RNA, 23 nt, Human
ccagcguauauauaagaaagaca

SEQ ID NO: 3650556 - RNA, 21 nt, Human
ccagcgucccagucucuggca

SEQ ID NO: 3650557 - RNA, 13 nt, Human
ccagcguccuccu

SEQ ID NO: 3650558 - RNA, 14 nt, Human
ccagcuaaauaauc

SEQ ID NO: 3650559 - RNA, 17 nt, Human
ccagcuaagaaccugga

SEQ ID NO: 3650560 - RNA, 18 nt, Human
ccagcuaagaaccuggaa

SEQ ID NO: 3650561 - RNA, 22 nt, Human
ccagcuaaucuguagggcugga

SEQ ID NO: 3650562 - RNA, 15 nt, Human
ccagcuaauuuuugu

SEQ ID NO: 3650563 - RNA, 18 nt, Human
ccagcuacaccuuucucc

SEQ ID NO: 3650564 - RNA, 20 nt, Human
ccagcuacucaagaggcuga

SEQ ID NO: 3650565 - RNA, 17 nt, Human
ccagcuacucagaagcc

SEQ ID NO: 3650566 - RNA, 19 nt, Human
ccagcuacucaggaggcug

SEQ ID NO: 3650567 - RNA, 21 nt, Human
ccagcuacuccggaggcugag

SEQ ID NO: 3650568 - RNA, 16 nt, Human
ccagcuacuugggaag

SEQ ID NO: 3650569 - RNA, 20 nt, Human
ccagcuacuugggaggcuga

SEQ ID NO: 3650570 - RNA, 23 nt, Human
ccagcuaggaagagcaggacucc

SEQ ID NO: 3650571 - RNA, 22 nt, Human
ccagcuagugacccacaugcca

SEQ ID NO: 3650572 - RNA, 14 nt, Human
ccagcuauaccugu

SEQ ID NO: 3650573 - RNA, 18 nt, Human
ccagcuauaccugugccu

SEQ ID NO: 3650574 - RNA, 19 nt, Human
ccagcuauaccugugccuc

SEQ ID NO: 3650575 - RNA, 21 nt, Human
ccagcuauuuuuacuagaaca

SEQ ID NO: 3650576 - RNA, 15 nt, Human
ccagcucaccagccc

SEQ ID NO: 3650577 - RNA, 14 nt, Human
ccagcucaccccug

SEQ ID NO: 3650578 - RNA, 19 nt, Human
ccagcucaccccuggagga

SEQ ID NO: 3650579 - RNA, 18 nt, Human
ccagcucagaacccaggg

SEQ ID NO: 3650580 - RNA, 11 nt, Human
ccagcucagca

SEQ ID NO: 3650581 - RNA, 19 nt, Human
ccagcuccaagaccuguug

SEQ ID NO: 3650582 - RNA, 22 nt, Human
ccagcuccaaggggaaucagaa

SEQ ID NO: 3650583 - RNA, 15 nt, Human
ccagcuccagggcca

SEQ ID NO: 3650584 - RNA, 15 nt, Human
ccagcucccaccucc

SEQ ID NO: 3650585 - RNA, 22 nt, Human
ccagcucccaccuccccuuggg

SEQ ID NO: 3650586 - RNA, 13 nt, Human
ccagcucccagga

SEQ ID NO: 3650587 - RNA, 14 nt, Human
ccagcuccccaaga

SEQ ID NO: 3650588 - RNA, 14 nt, Human
ccagcuccccccac

SEQ ID NO: 3650589 - RNA, 15 nt, Human
ccagcucccccuccc

SEQ ID NO: 3650590 - RNA, 14 nt, Human
ccagcucccuagga

SEQ ID NO: 3650591 - RNA, 16 nt, Human
ccagcucccucuauuu

SEQ ID NO: 3650592 - RNA, 14 nt, Human
ccagcuccucccuu

SEQ ID NO: 3650593 - RNA, 11 nt, Human
ccagcuccuga

SEQ ID NO: 3650594 - RNA, 14 nt, Human
ccagcuccuucgcu

SEQ ID NO: 3650595 - RNA, 13 nt, Human
ccagcuccuuugg

SEQ ID NO: 3650596 - RNA, 17 nt, Human
ccagcucgcaccccccu

SEQ ID NO: 3650597 - RNA, 13 nt, Human
ccagcucuaaguc

SEQ ID NO: 3650598 - RNA, 17 nt, Human
ccagcucuagacaaccc

SEQ ID NO: 3650599 - RNA, 22 nt, Human
ccagcucuagacaacccugcaa

SEQ ID NO: 3650600 - RNA, 18 nt, Human
ccagcucucccucuggcc

SEQ ID NO: 3650601 - RNA, 20 nt, Human
ccagcucucccucuggcccu

SEQ ID NO: 3650602 - RNA, 21 nt, Human
ccagcucucccucuggcccug

SEQ ID NO: 3650603 - RNA, 15 nt, Human
ccagcucugcuugcc

SEQ ID NO: 3650604 - RNA, 14 nt, Human
ccagcucuggaggg

SEQ ID NO: 3650605 - RNA, 14 nt, Human
ccagcucuggucca

SEQ ID NO: 3650606 - RNA, 13 nt, Human
ccagcucuguucu

SEQ ID NO: 3650607 - RNA, 16 nt, Human
ccagcucuguucuucc

SEQ ID NO: 3650608 - RNA, 21 nt, Human
ccagcucuguucuuccucagc

SEQ ID NO: 3650609 - RNA, 15 nt, Human
ccagcugacaguccu

SEQ ID NO: 3650610 - RNA, 20 nt, Human
ccagcugacaguccucucca

SEQ ID NO: 3650611 - RNA, 21 nt, Human
ccagcugacaguccucuccac

SEQ ID NO: 3650612 - RNA, 20 nt, Human
ccagcugagcgccaggaugg

SEQ ID NO: 3650613 - RNA, 23 nt, Human
ccagcugaugacucaagauuccc

SEQ ID NO: 3650614 - RNA, 13 nt, Human
ccagcugcaaagu

SEQ ID NO: 3650615 - RNA, 14 nt, Human
ccagcugcaaagug

SEQ ID NO: 3650616 - RNA, 13 nt, Human
ccagcugcacccc

SEQ ID NO: 3650617 - RNA, 23 nt, Human
ccagcugcaccugccagccuggc

SEQ ID NO: 3650618 - RNA, 13 nt, Human
ccagcugcacuga

SEQ ID NO: 3650619 - RNA, 16 nt, Human
ccagcugccccagcca

SEQ ID NO: 3650620 - RNA, 18 nt, Human
ccagcugccccggccccu

SEQ ID NO: 3650621 - RNA, 22 nt, Human
ccagcugccuagauucagggaa

SEQ ID NO: 3650622 - RNA, 18 nt, Human
ccagcugccuaggauuca

SEQ ID NO: 3650623 - RNA, 17 nt, Human
ccagcugcgcuugcuuu

SEQ ID NO: 3650624 - RNA, 12 nt, Human
ccagcugcuccc

SEQ ID NO: 3650625 - RNA, 16 nt, Human
ccagcugcuccccucc

SEQ ID NO: 3650626 - RNA, 19 nt, Human
ccagcugcuccccucccuc

SEQ ID NO: 3650627 - RNA, 14 nt, Human
ccagcugcucugcc

SEQ ID NO: 3650628 - RNA, 21 nt, Human
ccagcugcugagauccuggac

SEQ ID NO: 3650629 - RNA, 15 nt, Human
ccagcugcugagccg

SEQ ID NO: 3650630 - RNA, 17 nt, Human
ccagcugcugagccgca

SEQ ID NO: 3650631 - RNA, 23 nt, Human
ccagcugcugagccgcagagaag

SEQ ID NO: 3650632 - RNA, 16 nt, Human
ccagcugcugcucuga

SEQ ID NO: 3650633 - RNA, 13 nt, Human
ccagcugcugucu

SEQ ID NO: 3650634 - RNA, 16 nt, Human
ccagcugcuugggcuu

SEQ ID NO: 3650635 - RNA, 20 nt, Human
ccagcugcuugggcuucauc

SEQ ID NO: 3650636 - RNA, 20 nt, Human
ccagcuggcagcagagugug

SEQ ID NO: 3650637 - RNA, 16 nt, Human
ccagcuggccuggaca

SEQ ID NO: 3650638 - RNA, 16 nt, Human
ccagcugggaggcaag

SEQ ID NO: 3650639 - RNA, 12 nt, Human
ccagcugggcuc

SEQ ID NO: 3650640 - RNA, 15 nt, Human
ccagcugggcucugc

SEQ ID NO: 3650641 - RNA, 16 nt, Human
ccagcugggcucugcc

SEQ ID NO: 3650642 - RNA, 23 nt, Human
ccagcugggcucugccacccuac

SEQ ID NO: 3650643 - RNA, 20 nt, Human
ccagcuggggcguggggagg

SEQ ID NO: 3650644 - RNA, 21 nt, Human
ccagcuggugagugaugcggc

SEQ ID NO: 3650645 - RNA, 15 nt, Human
ccagcugucccccca

SEQ ID NO: 3650646 - RNA, 22 nt, Human
ccagcugucugugucagccugu

SEQ ID NO: 3650647 - RNA, 18 nt, Human
ccagcugugcucuggaca

SEQ ID NO: 3650648 - RNA, 13 nt, Human
ccagcugugguuu

SEQ ID NO: 3650649 - RNA, 15 nt, Human
ccagcugugguuuuc

SEQ ID NO: 3650650 - RNA, 13 nt, Human
ccagcugugucca

SEQ ID NO: 3650651 - RNA, 20 nt, Human
ccagcuuauagucauauaua

SEQ ID NO: 3650652 - RNA, 14 nt, Human
ccagcuucacuucu

SEQ ID NO: 3650653 - RNA, 15 nt, Human
ccagcuuccagcagg

SEQ ID NO: 3650654 - RNA, 17 nt, Human
ccagcuuccagcaggag

SEQ ID NO: 3650655 - RNA, 14 nt, Human
ccagcuugcucuuc

SEQ ID NO: 3650656 - RNA, 13 nt, Human
ccagcuugggcag

SEQ ID NO: 3650657 - RNA, 22 nt, Human
ccagcuugggcccagcugggcu

SEQ ID NO: 3650658 - RNA, 22 nt, Human
ccagcuuggggccaccaaagcu

SEQ ID NO: 3650659 - RNA, 22 nt, Human
ccagcuuguggagccccacacu

SEQ ID NO: 3650660 - RNA, 17 nt, Human
ccagcuuguuauuuaua

SEQ ID NO: 3650661 - RNA, 14 nt, Human
ccagcuuguuuaca

SEQ ID NO: 3650662 - RNA, 14 nt, Human
ccagcuuucccugc

SEQ ID NO: 3650663 - RNA, 18 nt, Human
ccagcuuucccugccucu

SEQ ID NO: 3650664 - RNA, 21 nt, Human
ccagcuuuuaaccaucugaua

SEQ ID NO: 3650665 - RNA, 12 nt, Human
ccaauccugccc

SEQ ID NO: 3650666 - RNA, 19 nt, Human
ccaaucuauugcuucacca

SEQ ID NO: 3650667 - RNA, 21 nt, Human
ccaaucuuacuuuguaaauuc

SEQ ID NO: 3650668 - RNA, 23 nt, Human
ccaaugaaauacacaaguaaaca

SEQ ID NO: 3650669 - RNA, 23 nt, Human
ccaaugagacucuaggguccagu

SEQ ID NO: 3650670 - RNA, 15 nt, Human
ccaaugagcuuucug

SEQ ID NO: 3650671 - RNA, 18 nt, Human
ccaaugagcuuucugaac

SEQ ID NO: 3650672 - RNA, 22 nt, Human
ccaaugagcuuucugaacagcu

SEQ ID NO: 3650673 - RNA, 21 nt, Human
ccaaugccacauacuugcagc

SEQ ID NO: 3650674 - RNA, 14 nt, Human
ccaaugcugauguc

SEQ ID NO: 3650675 - RNA, 17 nt, Human
ccaaugcugauguccuc

SEQ ID NO: 3650676 - RNA, 14 nt, Human
ccaauggaaaccuc

SEQ ID NO: 3650677 - RNA, 17 nt, Human
ccaauggaaccuccuuu

SEQ ID NO: 3650678 - RNA, 20 nt, Human
ccaauggaaugugauguuca

SEQ ID NO: 3650679 - RNA, 21 nt, Human
ccaauggagacugucucaaga

SEQ ID NO: 3650680 - RNA, 23 nt, Human
ccaauggaguagaccccuggcug

SEQ ID NO: 3650681 - RNA, 20 nt, Human
ccaauggguuuuucccugua

SEQ ID NO: 3650682 - RNA, 16 nt, Human
ccaaugguguuuuucu

SEQ ID NO: 3650683 - RNA, 15 nt, Human
ccaauguaggagcug

SEQ ID NO: 3650684 - RNA, 11 nt, Human
ccaaugucugc

SEQ ID NO: 3650685 - RNA, 18 nt, Human
ccaaugucugccacacaa

SEQ ID NO: 3650686 - RNA, 15 nt, Human
ccaaugucuggagac

SEQ ID NO: 3650687 - RNA, 15 nt, Human
ccaauuaaccagaaa

SEQ ID NO: 3650688 - RNA, 22 nt, Human
ccaauuaaggauuuuaugcuuu

SEQ ID NO: 3650689 - RNA, 17 nt, Human
ccaauuaggaaguguaa

SEQ ID NO: 3650690 - RNA, 20 nt, Human
ccaauuauugauauauauua

SEQ ID NO: 3650691 - RNA, 18 nt, Human
ccaauuauuguuacacau

SEQ ID NO: 3650692 - RNA, 22 nt, Human
ccaauuauuuucauccuugucu

SEQ ID NO: 3650693 - RNA, 19 nt, Human
ccaauucgaacuuuuucca

SEQ ID NO: 3650694 - RNA, 18 nt, Human
ccaauucucgagcuuggg

SEQ ID NO: 3650695 - RNA, 12 nt, Human
ccaauugaguuu

SEQ ID NO: 3650696 - RNA, 16 nt, Human
ccaauugugcugccau

SEQ ID NO: 3650697 - RNA, 20 nt, Human
ccaauuguugacaguucuga

SEQ ID NO: 3650698 - RNA, 21 nt, Human
ccaauuguugacaguucugaa

SEQ ID NO: 3650699 - RNA, 15 nt, Human
ccaggaagccagcag

SEQ ID NO: 3650700 - RNA, 18 nt, Human
ccaggaagcccaggagcc

SEQ ID NO: 3650701 - RNA, 11 nt, Human
ccaggaagccg

SEQ ID NO: 3650702 - RNA, 18 nt, Human
ccaggaaggcggggcuuc

SEQ ID NO: 3650703 - RNA, 18 nt, Human
ccaggaaggggcuggacu

SEQ ID NO: 3650704 - RNA, 14 nt, Human
ccaggaagggucaa

SEQ ID NO: 3650705 - RNA, 18 nt, Human
ccaggaaguagcacaggc

SEQ ID NO: 3650706 - RNA, 22 nt, Human
ccaggaaguagcacaggcugag

SEQ ID NO: 3650707 - RNA, 14 nt, Human
ccaggaagucucau

SEQ ID NO: 3650708 - RNA, 20 nt, Human
ccaggaagucucaucugggg

SEQ ID NO: 3650709 - RNA, 19 nt, Human
ccaggaaugccuccucccu

SEQ ID NO: 3650710 - RNA, 16 nt, Human
ccaggaauuucccagg

SEQ ID NO: 3650711 - RNA, 20 nt, Human
ccaggaauuucccaggaccc

SEQ ID NO: 3650712 - RNA, 17 nt, Human
ccaggacaagcaugguc

SEQ ID NO: 3650713 - RNA, 21 nt, Human
ccaggacaccacacccagccu

SEQ ID NO: 3650714 - RNA, 14 nt, Human
ccaggacaccgggc

SEQ ID NO: 3650715 - RNA, 13 nt, Human
ccaggacaggacc

SEQ ID NO: 3650716 - RNA, 13 nt, Human
ccaggacaggcug

SEQ ID NO: 3650717 - RNA, 14 nt, Human
ccaggaccaagcca

SEQ ID NO: 3650718 - RNA, 13 nt, Human
ccaggaccacagg

SEQ ID NO: 3650719 - RNA, 19 nt, Human
ccaggaccacaggcucagg

SEQ ID NO: 3650720 - RNA, 14 nt, Human
ccaggaccagcugg

SEQ ID NO: 3650721 - RNA, 15 nt, Human
ccaggaccagcuggg

SEQ ID NO: 3650722 - RNA, 18 nt, Human
ccaggaccagcuggggcg

SEQ ID NO: 3650723 - RNA, 23 nt, Human
ccaggaccagucaaccugggcaa

SEQ ID NO: 3650724 - RNA, 19 nt, Human
ccaggacccugaaggggcc

SEQ ID NO: 3650725 - RNA, 14 nt, Human
ccaggacccugcca

SEQ ID NO: 3650726 - RNA, 15 nt, Human
ccaggacccugccag

SEQ ID NO: 3650727 - RNA, 19 nt, Human
ccaggacccugccaggcac

SEQ ID NO: 3650728 - RNA, 20 nt, Human
ccaggacccugccaggcaca

SEQ ID NO: 3650729 - RNA, 23 nt, Human
ccaggacccugccaggcacaggc

SEQ ID NO: 3650730 - RNA, 18 nt, Human
ccaggaccuggcugccau

SEQ ID NO: 3650731 - RNA, 21 nt, Human
ccaggacgccacucauuucau

SEQ ID NO: 3650732 - RNA, 17 nt, Human
ccaggacgcuucugaau

SEQ ID NO: 3650733 - RNA, 22 nt, Human
ccaggacgcuucugaaugcugc

SEQ ID NO: 3650734 - RNA, 18 nt, Human
ccaggacggggccggcca

SEQ ID NO: 3650735 - RNA, 19 nt, Human
ccaggacggggccggccag

SEQ ID NO: 3650736 - RNA, 19 nt, Human
ccaggacuauagcccaggu

SEQ ID NO: 3650737 - RNA, 22 nt, Human
ccaggacuccccaggccaggcc

SEQ ID NO: 3650738 - RNA, 14 nt, Human
ccaggacucccucc

SEQ ID NO: 3650739 - RNA, 17 nt, Human
ccaggacucccuccuca

SEQ ID NO: 3650740 - RNA, 14 nt, Human
ccaggacuccuccc

SEQ ID NO: 3650741 - RNA, 11 nt, Human
ccaggacucug

SEQ ID NO: 3650742 - RNA, 13 nt, Human
ccaggacucugca

SEQ ID NO: 3650743 - RNA, 15 nt, Human
ccaggacucugcagc

SEQ ID NO: 3650744 - RNA, 18 nt, Human
ccaggacucugcagccuc

SEQ ID NO: 3650745 - RNA, 19 nt, Human
ccaggacucugcagccuca

SEQ ID NO: 3650746 - RNA, 15 nt, Human
ccaggacugagcccc

SEQ ID NO: 3650747 - RNA, 19 nt, Human
ccaggacugagccccgcag

SEQ ID NO: 3650748 - RNA, 19 nt, Human
ccaggagaaccacuacaug

SEQ ID NO: 3650749 - RNA, 15 nt, Human
ccaggagaagaaaga

SEQ ID NO: 3650750 - RNA, 20 nt, Human
ccaggagaauaaaagaaauu

SEQ ID NO: 3650751 - RNA, 15 nt, Human
ccaggagagagaaag

SEQ ID NO: 3650752 - RNA, 17 nt, Human
ccaggagagccagcccu

SEQ ID NO: 3650753 - RNA, 19 nt, Human
ccaggagagccagcccucc

SEQ ID NO: 3650754 - RNA, 23 nt, Human
ccaggagagccagcccucccugu

SEQ ID NO: 3650755 - RNA, 21 nt, Human
ccaggagaggagcgggaccug

SEQ ID NO: 3650756 - RNA, 23 nt, Human
ccaggagcaaauguuucugcagu

SEQ ID NO: 3650757 - RNA, 13 nt, Human
ccaggagcagcca

SEQ ID NO: 3650758 - RNA, 14 nt, Human
ccaggagcagccac

SEQ ID NO: 3650759 - RNA, 15 nt, Human
ccaggagcagccaca

SEQ ID NO: 3650760 - RNA, 15 nt, Human
ccaggagcaggcacg

SEQ ID NO: 3650761 - RNA, 16 nt, Human
ccaggagcaggcacgg

SEQ ID NO: 3650762 - RNA, 18 nt, Human
ccaggagcauccaccucc

SEQ ID NO: 3650763 - RNA, 13 nt, Human
ccaggagccucac

SEQ ID NO: 3650764 - RNA, 12 nt, Human
ccaggagccucc

SEQ ID NO: 3650765 - RNA, 17 nt, Human
ccaggagcuccaguguc

SEQ ID NO: 3650766 - RNA, 20 nt, Human
ccaggagcuccaguguccug

SEQ ID NO: 3650767 - RNA, 19 nt, Human
ccaggagcuccccucccca

SEQ ID NO: 3650768 - RNA, 18 nt, Human
ccaggagcucuucaggcc

SEQ ID NO: 3650769 - RNA, 21 nt, Human
ccaggagcucuucaggccucc

SEQ ID NO: 3650770 - RNA, 23 nt, Human
ccaggagcucuucaggccucccu

SEQ ID NO: 3650771 - RNA, 23 nt, Human
ccaggagcugucaccaaggaaac

SEQ ID NO: 3650772 - RNA, 15 nt, Human
ccaggaggacccagg

SEQ ID NO: 3650773 - RNA, 19 nt, Human
ccaggaggacccagggcuc

SEQ ID NO: 3650774 - RNA, 20 nt, Human
ccaggaggacccagggcucu

SEQ ID NO: 3650775 - RNA, 14 nt, Human
ccaggaggacugcc

SEQ ID NO: 3650776 - RNA, 15 nt, Human
ccaggaggccagccu

SEQ ID NO: 3650777 - RNA, 20 nt, Human
ccaggaggccagccuugacc

SEQ ID NO: 3650778 - RNA, 21 nt, Human
ccaggagggaggcaggggagg

SEQ ID NO: 3650779 - RNA, 20 nt, Human
ccaggagggcacuggagcug

SEQ ID NO: 3650780 - RNA, 21 nt, Human
ccaggaggggaacacugcccu

SEQ ID NO: 3650781 - RNA, 19 nt, Human
ccaggaggugccacuggag

SEQ ID NO: 3650782 - RNA, 21 nt, Human
ccaggaggugccacuggagug

SEQ ID NO: 3650783 - RNA, 22 nt, Human
ccaggagguggcuauggccacc

SEQ ID NO: 3650784 - RNA, 23 nt, Human
ccaggagucccacuccaagccag

SEQ ID NO: 3650785 - RNA, 21 nt, Human
ccaggaguuuaagaccagccu

SEQ ID NO: 3650786 - RNA, 17 nt, Human
ccaggaguuugaggcug

SEQ ID NO: 3650787 - RNA, 14 nt, Human
ccaggaguuuggcc

SEQ ID NO: 3650788 - RNA, 16 nt, Human
ccaggaguuuggccag

SEQ ID NO: 3650789 - RNA, 17 nt, Human
ccaggauacuggcacag

SEQ ID NO: 3650790 - RNA, 20 nt, Human
ccaggauacuggcacagagg

SEQ ID NO: 3650791 - RNA, 23 nt, Human
ccaggauauauuuuauuuuuaga

SEQ ID NO: 3650792 - RNA, 14 nt, Human
ccaggaucagauug

SEQ ID NO: 3650793 - RNA, 14 nt, Human
ccaggaucagccag

SEQ ID NO: 3650794 - RNA, 14 nt, Human
ccaggauggagggg

SEQ ID NO: 3650795 - RNA, 18 nt, Human
ccaggauuccucuuuucu

SEQ ID NO: 3650796 - RNA, 16 nt, Human
ccaggauugaagagca

SEQ ID NO: 3650797 - RNA, 19 nt, Human
ccaggcaaauaaaauuccc

SEQ ID NO: 3650798 - RNA, 14 nt, Human
ccaggcaaggcugu

SEQ ID NO: 3650799 - RNA, 23 nt, Human
ccaggcaauggccuaaacuucag

SEQ ID NO: 3650800 - RNA, 22 nt, Human
ccaggcacacacugugcuuucu

SEQ ID NO: 3650801 - RNA, 17 nt, Human
ccaggcaccaggacuag

SEQ ID NO: 3650802 - RNA, 15 nt, Human
ccaggcaccaggcag

SEQ ID NO: 3650803 - RNA, 21 nt, Human
ccaggcacccccuggagagaa

SEQ ID NO: 3650804 - RNA, 13 nt, Human
ccaggcaccuccc

SEQ ID NO: 3650805 - RNA, 21 nt, Human
ccaggcacgaacccaccugcu

SEQ ID NO: 3650806 - RNA, 23 nt, Human
ccaggcacgaacccaccugcuga

SEQ ID NO: 3650807 - RNA, 16 nt, Human
ccaggcacgguuugga

SEQ ID NO: 3650808 - RNA, 16 nt, Human
ccaggcacugcuaggc

SEQ ID NO: 3650809 - RNA, 18 nt, Human
ccaggcacugcugcccag

SEQ ID NO: 3650810 - RNA, 15 nt, Human
ccaggcagcacccag

SEQ ID NO: 3650811 - RNA, 17 nt, Human
ccaggcagcagacacau

SEQ ID NO: 3650812 - RNA, 14 nt, Human
ccaggcagccucug

SEQ ID NO: 3650813 - RNA, 20 nt, Human
ccaggcaggcuaaggcgugg

SEQ ID NO: 3650814 - RNA, 22 nt, Human
ccaggcagggguggggguggag

SEQ ID NO: 3650815 - RNA, 18 nt, Human
ccaggcagguagccaggg

SEQ ID NO: 3650816 - RNA, 19 nt, Human
ccaggcagguagccagggg

SEQ ID NO: 3650817 - RNA, 23 nt, Human
ccaggcaggucuugaacuccugg

SEQ ID NO: 3650818 - RNA, 19 nt, Human
ccaggcagucgggggcugg

SEQ ID NO: 3650819 - RNA, 24 nt, Human
ccaggcagucgggggcuggccuag

SEQ ID NO: 3650820 - RNA, 20 nt, Human
ccaggcauccuccacaauag

SEQ ID NO: 3650821 - RNA, 14 nt, Human
ccaggcauucccca

SEQ ID NO: 3650822 - RNA, 17 nt, Human
ccaggcauuccccagga

SEQ ID NO: 3650823 - RNA, 21 nt, Human
ccaggcauuccccaggaggcc

SEQ ID NO: 3650824 - RNA, 22 nt, Human
ccaggcauuccccaggaggcca

SEQ ID NO: 3650825 - RNA, 23 nt, Human
ccaggcauuccccaggaggccag

SEQ ID NO: 3650826 - RNA, 24 nt, Human
ccaggcauuccccaggaggccagc

SEQ ID NO: 3650827 - RNA, 12 nt, Human
ccacccccacac

SEQ ID NO: 3650828 - RNA, 12 nt, Human
ccacccccacca

SEQ ID NO: 3650829 - RNA, 14 nt, Human
ccacccccagcccc

SEQ ID NO: 3650830 - RNA, 16 nt, Human
ccacccccagccccga

SEQ ID NO: 3650831 - RNA, 13 nt, Human
ccacccccagcuc

SEQ ID NO: 3650832 - RNA, 16 nt, Human
ccacccccaggacccc

SEQ ID NO: 3650833 - RNA, 21 nt, Human
ccaccccccagaaccuguccu

SEQ ID NO: 3650834 - RNA, 22 nt, Human
ccaccccccagaaccuguccuu

SEQ ID NO: 3650835 - RNA, 13 nt, Human
ccaccccccucau

SEQ ID NO: 3650836 - RNA, 14 nt, Human
ccacccccggcagc

SEQ ID NO: 3650837 - RNA, 16 nt, Human
ccacccccuccccagg

SEQ ID NO: 3650838 - RNA, 18 nt, Human
ccacccccuccccagggg

SEQ ID NO: 3650839 - RNA, 19 nt, Human
ccacccccuccccagggga

SEQ ID NO: 3650840 - RNA, 15 nt, Human
ccacccccugcccug

SEQ ID NO: 3650841 - RNA, 16 nt, Human
ccacccccugcccugc

SEQ ID NO: 3650842 - RNA, 18 nt, Human
ccacccccuucagugccc

SEQ ID NO: 3650843 - RNA, 22 nt, Human
aaagcccugucgggcuuugugu

SEQ ID NO: 3650844 - RNA, 23 nt, Human
aaagcccuuccaugucgccucug

SEQ ID NO: 3650845 - RNA, 21 nt, Human
aaagccguuguuuacuuaaag

SEQ ID NO: 3650846 - RNA, 13 nt, Human
aaagccucaacca

SEQ ID NO: 3650847 - RNA, 19 nt, Human
aaagccugaguacuccaca

SEQ ID NO: 3650848 - RNA, 12 nt, Human
aaagccugcuca

SEQ ID NO: 3650849 - RNA, 23 nt, Human
aaagccuggguuugguguauggu

SEQ ID NO: 3650850 - RNA, 13 nt, Human
aaagccuguuccc

SEQ ID NO: 3650851 - RNA, 18 nt, Human
aaagccuguuuaagagac

SEQ ID NO: 3650852 - RNA, 19 nt, Human
aaagccuuagggaagcugg

SEQ ID NO: 3650853 - RNA, 12 nt, Human
aaagccuugugu

SEQ ID NO: 3650854 - RNA, 16 nt, Human
aaagcgaaaaaaucag

SEQ ID NO: 3650855 - RNA, 19 nt, Human
aaagcggacaucagcuggu

SEQ ID NO: 3650856 - RNA, 18 nt, Human
aaagcggguuauaaugaa

SEQ ID NO: 3650857 - RNA, 21 nt, Human
aaagcgugagcuuaaaauaca

SEQ ID NO: 3650858 - RNA, 22 nt, Human
aaagcgugagcuuaaaauacaa

SEQ ID NO: 3650859 - RNA, 23 nt, Human
aaagcgugagcuuaaaauacaag

SEQ ID NO: 3650860 - RNA, 18 nt, Human
aaagcguuggauguagca

SEQ ID NO: 3650861 - RNA, 21 nt, Human
aaagcuaaaauaaagaaauag

SEQ ID NO: 3650862 - RNA, 17 nt, Human
aaagcuaaaaugauuuu

SEQ ID NO: 3650863 - RNA, 23 nt, Human
aaagcuaaaaugauuuuaucugu

SEQ ID NO: 3650864 - RNA, 16 nt, Human
aaagcuaacccagguc

SEQ ID NO: 3650865 - RNA, 16 nt, Human
aaagcuacuuauugua

SEQ ID NO: 3650866 - RNA, 14 nt, Human
aaagcuagaauuga

SEQ ID NO: 3650867 - RNA, 15 nt, Human
aaagcuauggugaga

SEQ ID NO: 3650868 - RNA, 20 nt, Human
aaagcuauuagccaggauca

SEQ ID NO: 3650869 - RNA, 22 nt, Human
aaagcuauuagccaggaucaug

SEQ ID NO: 3650870 - RNA, 19 nt, Human
aaagcucaaaugaaaugua

SEQ ID NO: 3650871 - RNA, 13 nt, Human
aaagcucauauuu

SEQ ID NO: 3650872 - RNA, 20 nt, Human
aaagcucauuucaugcucug

SEQ ID NO: 3650873 - RNA, 17 nt, Human
aaagcuccuagcagaga

SEQ ID NO: 3650874 - RNA, 14 nt, Human
aaagcucugaccac

SEQ ID NO: 3650875 - RNA, 13 nt, Human
aaagcucuguggc

SEQ ID NO: 3650876 - RNA, 23 nt, Human
aaagcugaacacauuucuuuuua

SEQ ID NO: 3650877 - RNA, 15 nt, Human
aaagcugaagccgcc

SEQ ID NO: 3650878 - RNA, 18 nt, Human
aaagcugacauugccaaa

SEQ ID NO: 3650879 - RNA, 19 nt, Human
aaagcugacauugccaaaa

SEQ ID NO: 3650880 - RNA, 18 nt, Human
aaagcugagaacuccuga

SEQ ID NO: 3650881 - RNA, 20 nt, Human
aaagcugagaacuccugacu

SEQ ID NO: 3650882 - RNA, 14 nt, Human
ccauaaacuucaug

SEQ ID NO: 3650883 - RNA, 16 nt, Human
ccauaaacuucauggu

SEQ ID NO: 3650884 - RNA, 20 nt, Human
ccauaaagaagauguuuaac

SEQ ID NO: 3650885 - RNA, 13 nt, Human
ccauaaagaagca

SEQ ID NO: 3650886 - RNA, 13 nt, Human
ccauaacagccaa

SEQ ID NO: 3650887 - RNA, 15 nt, Human
ccauaacagccaaca

SEQ ID NO: 3650888 - RNA, 22 nt, Human
ccauaaccgcugauucucaggg

SEQ ID NO: 3650889 - RNA, 20 nt, Human
ccauaagcaacaauuuucag

SEQ ID NO: 3650890 - RNA, 15 nt, Human
ccauaaggaauguag

SEQ ID NO: 3650891 - RNA, 19 nt, Human
ccauaauguauaaagaaca

SEQ ID NO: 3650892 - RNA, 12 nt, Human
ccauacacacgc

SEQ ID NO: 3650893 - RNA, 24 nt, Human
ccauaccuuccuucccugggcugu

SEQ ID NO: 3650894 - RNA, 13 nt, Human
ccauacucagccu

SEQ ID NO: 3650895 - RNA, 14 nt, Human
ccauacucagccug

SEQ ID NO: 3650896 - RNA, 15 nt, Human
ccauacucagccugc

SEQ ID NO: 3650897 - RNA, 21 nt, Human
ccauacucagccugcugccca

SEQ ID NO: 3650898 - RNA, 15 nt, Human
ccauacucauuucua

SEQ ID NO: 3650899 - RNA, 20 nt, Human
ccauacuggccucgccuggc

SEQ ID NO: 3650900 - RNA, 22 nt, Human
ccauacuggccucgccuggccu

SEQ ID NO: 3650901 - RNA, 17 nt, Human
ccauacuuaucucucug

SEQ ID NO: 3650902 - RNA, 13 nt, Human
ccauagaaacaug

SEQ ID NO: 3650903 - RNA, 16 nt, Human
ccauagaguuuaacac

SEQ ID NO: 3650904 - RNA, 14 nt, Human
ccauagaucuucug

SEQ ID NO: 3650905 - RNA, 15 nt, Human
ccauagcuguggugu

SEQ ID NO: 3650906 - RNA, 15 nt, Human
ccauagcuuccauga

SEQ ID NO: 3650907 - RNA, 13 nt, Human
ccauaggcccagu

SEQ ID NO: 3650908 - RNA, 13 nt, Human
ccauaguaacuga

SEQ ID NO: 3650909 - RNA, 15 nt, Human
ccauaguaacugaca

SEQ ID NO: 3650910 - RNA, 16 nt, Human
ccauaguaacugacau

SEQ ID NO: 3650911 - RNA, 19 nt, Human
ccauaguaccauuuauaca

SEQ ID NO: 3650912 - RNA, 20 nt, Human
ccauaguauauuaaaaaugg

SEQ ID NO: 3650913 - RNA, 15 nt, Human
ccauagucacauggc

SEQ ID NO: 3650914 - RNA, 13 nt, Human
ccauagucccugc

SEQ ID NO: 3650915 - RNA, 19 nt, Human
ccauauaaguuugaaggaa

SEQ ID NO: 3650916 - RNA, 16 nt, Human
ccauauauaacagaua

SEQ ID NO: 3650917 - RNA, 18 nt, Human
ccauaucaaaagacacag

SEQ ID NO: 3650918 - RNA, 19 nt, Human
ccauaucagaacugugcca

SEQ ID NO: 3650919 - RNA, 18 nt, Human
ccauauccuuacccuccu

SEQ ID NO: 3650920 - RNA, 21 nt, Human
ccauaucuuaaagaaacagcu

SEQ ID NO: 3650921 - RNA, 22 nt, Human
ccauaucuugcgaauccaagcu

SEQ ID NO: 3650922 - RNA, 18 nt, Human
ccauaugaccucaugcau

SEQ ID NO: 3650923 - RNA, 19 nt, Human
ccauaugaccucaugcauc

SEQ ID NO: 3650924 - RNA, 15 nt, Human
ccauaugccugggca

SEQ ID NO: 3650925 - RNA, 17 nt, Human
ccauaugcuaccaccag

SEQ ID NO: 3650926 - RNA, 18 nt, Human
ccauaugcuaccaccagc

SEQ ID NO: 3650927 - RNA, 22 nt, Human
ccauaugcuaccaccagcugug

SEQ ID NO: 3650928 - RNA, 23 nt, Human
ccauauuaaauuuuuuguugaca

SEQ ID NO: 3650929 - RNA, 15 nt, Human
ccauauucuguuggc

SEQ ID NO: 3650930 - RNA, 21 nt, Human
ccauauugcacaugucuuaau

SEQ ID NO: 3650931 - RNA, 18 nt, Human
ccauauuuaccucagccu

SEQ ID NO: 3650932 - RNA, 17 nt, Human
ccauauuuagcagugca

SEQ ID NO: 3650933 - RNA, 21 nt, Human
ccauauuuauccauuuguaau

SEQ ID NO: 3650934 - RNA, 18 nt, Human
ccauauuuuacuuggaaa

SEQ ID NO: 3650935 - RNA, 23 nt, Human
ccauauuuucacagguguggugu

SEQ ID NO: 3650936 - RNA, 16 nt, Human
ccauauuuuuuuccuu

SEQ ID NO: 3650937 - RNA, 22 nt, Human
ccauauuuuuuuccuuacauaa

SEQ ID NO: 3650938 - RNA, 15 nt, Human
ccaucaaaaauauuc

SEQ ID NO: 3650939 - RNA, 16 nt, Human
ccaucaaaguggcaaa

SEQ ID NO: 3650940 - RNA, 22 nt, Human
ccaucaacuaaaguuguacuuu

SEQ ID NO: 3650941 - RNA, 14 nt, Human
ccaucaagccacca

SEQ ID NO: 3650942 - RNA, 20 nt, Human
ccaucaauaaaaaauuauga

SEQ ID NO: 3650943 - RNA, 20 nt, Human
ccaucacaggguugggccca

SEQ ID NO: 3650944 - RNA, 17 nt, Human
ccaucaccucagauggc

SEQ ID NO: 3650945 - RNA, 14 nt, Human
ccaucacugcgcca

SEQ ID NO: 3650946 - RNA, 21 nt, Human
ccaucacugcgccacugcucc

SEQ ID NO: 3650947 - RNA, 19 nt, Human
ccaucagcuguaagaagag

SEQ ID NO: 3650948 - RNA, 24 nt, Human
ccaucagcuguaagaagagacugg

SEQ ID NO: 3650949 - RNA, 18 nt, Human
ccaucaguguacccccgc

SEQ ID NO: 3650950 - RNA, 16 nt, Human
ccaucaguuagagcug

SEQ ID NO: 3650951 - RNA, 14 nt, Human
ccaucauaauucua

SEQ ID NO: 3650952 - RNA, 13 nt, Human
ccaucauccucug

SEQ ID NO: 3650953 - RNA, 15 nt, Human
ccaucauccucuggc

SEQ ID NO: 3650954 - RNA, 20 nt, Human
ccaucaucuauagaaagcua

SEQ ID NO: 3650955 - RNA, 23 nt, Human
ccaucauggggggagcacccuga

SEQ ID NO: 3650956 - RNA, 14 nt, Human
ccaucaugucuggc

SEQ ID NO: 3650957 - RNA, 20 nt, Human
ccaucauguggccccaccca

SEQ ID NO: 3650958 - RNA, 22 nt, Human
ccaucauguuuacagaggacag

SEQ ID NO: 3650959 - RNA, 22 nt, Human
ccaucauuuuccauauccuggu

SEQ ID NO: 3650960 - RNA, 20 nt, Human
ccauccaaauaagaaaccua

SEQ ID NO: 3650961 - RNA, 21 nt, Human
ccauccaccguccccucccag

SEQ ID NO: 3650962 - RNA, 17 nt, Human
ccauccaccuuucccaa

SEQ ID NO: 3650963 - RNA, 23 nt, Human
ccauccacuggguguaaacacau

SEQ ID NO: 3650964 - RNA, 15 nt, Human
ccauccagcuugcca

SEQ ID NO: 3650965 - RNA, 18 nt, Human
ccauccagguucagcuug

SEQ ID NO: 3650966 - RNA, 19 nt, Human
ccauccagugucucacagc

SEQ ID NO: 3650967 - RNA, 21 nt, Human
ccauccauaaauccaguucua

SEQ ID NO: 3650968 - RNA, 13 nt, Human
ccauccauggcca

SEQ ID NO: 3650969 - RNA, 14 nt, Human
ccauccauggccag

SEQ ID NO: 3650970 - RNA, 16 nt, Human
ccauccauggccagca

SEQ ID NO: 3650971 - RNA, 18 nt, Human
ccauccauggccagcagc

SEQ ID NO: 3650972 - RNA, 20 nt, Human
ccaucccaaacccuucagug

SEQ ID NO: 3650973 - RNA, 16 nt, Human
ccaucccaaccagugc

SEQ ID NO: 3650974 - RNA, 20 nt, Human
ccaucccaaccagugccaag

SEQ ID NO: 3650975 - RNA, 20 nt, Human
ccaucccacugcucccccaa

SEQ ID NO: 3650976 - RNA, 12 nt, Human
ccaucccagccc

SEQ ID NO: 3650977 - RNA, 13 nt, Human
ccaucccagcccc

SEQ ID NO: 3650978 - RNA, 23 nt, Human
ccaucccaggacaccacacccag

SEQ ID NO: 3650979 - RNA, 20 nt, Human
ccaucccauaugccugggca

SEQ ID NO: 3650980 - RNA, 12 nt, Human
ccaucccauccc

SEQ ID NO: 3650981 - RNA, 13 nt, Human
ccaucccaucccg

SEQ ID NO: 3650982 - RNA, 19 nt, Human
ccaucccaugaacacacug

SEQ ID NO: 3650983 - RNA, 18 nt, Human
ccauccccauccuccagc

SEQ ID NO: 3650984 - RNA, 14 nt, Human
ccauccccccucac

SEQ ID NO: 3650985 - RNA, 21 nt, Human
ccauccccccucaccaggggc

SEQ ID NO: 3650986 - RNA, 22 nt, Human
ccauccccccucaccaggggca

SEQ ID NO: 3650987 - RNA, 21 nt, Human
ccaugagggagaugccaugag

SEQ ID NO: 3650988 - RNA, 23 nt, Human
ccaugagggagaugccaugagcc

SEQ ID NO: 3650989 - RNA, 13 nt, Human
ccaugaguccccu

SEQ ID NO: 3650990 - RNA, 17 nt, Human
ccaugaguccuugaaaa

SEQ ID NO: 3650991 - RNA, 22 nt, Human
ccaugaguuggggucuggcagc

SEQ ID NO: 3650992 - RNA, 18 nt, Human
ccaugaguuugcccuggu

SEQ ID NO: 3650993 - RNA, 22 nt, Human
ccaugaucccuguguugucucu

SEQ ID NO: 3650994 - RNA, 21 nt, Human
ccaugaugacuuaguacaaag

SEQ ID NO: 3650995 - RNA, 12 nt, Human
ccaugaugcugg

SEQ ID NO: 3650996 - RNA, 16 nt, Human
ccaugauggcaacaga

SEQ ID NO: 3650997 - RNA, 18 nt, Human
ccaugauggccaggcuga

SEQ ID NO: 3650998 - RNA, 17 nt, Human
ccaugauguggaguggg

SEQ ID NO: 3650999 - RNA, 22 nt, Human
ccaugauguggaguggggcagu

SEQ ID NO: 3651000 - RNA, 19 nt, Human
ccaugauuaaccacuucag

SEQ ID NO: 3651001 - RNA, 15 nt, Human
ccaugauuucaugua

SEQ ID NO: 3651002 - RNA, 18 nt, Human
ccaugauuucauguacug

SEQ ID NO: 3651003 - RNA, 21 nt, Human
ccaugauuucauguacugcau

SEQ ID NO: 3651004 - RNA, 16 nt, Human
ccaugcaagcagagga

SEQ ID NO: 3651005 - RNA, 19 nt, Human
ccaugcaagcagaggacca

SEQ ID NO: 3651006 - RNA, 20 nt, Human
ccaugcaagcagaggaccag

SEQ ID NO: 3651007 - RNA, 13 nt, Human
ccaugcaaggugc

SEQ ID NO: 3651008 - RNA, 17 nt, Human
ccaugcaauucauccca

SEQ ID NO: 3651009 - RNA, 15 nt, Human
ccaugcacugugaag

SEQ ID NO: 3651010 - RNA, 12 nt, Human
ccaugcagagcg

SEQ ID NO: 3651011 - RNA, 13 nt, Human
ccaugcaggcccu

SEQ ID NO: 3651012 - RNA, 12 nt, Human
ccaugcaggggg

SEQ ID NO: 3651013 - RNA, 19 nt, Human
ccaugcagggggcuccugg

SEQ ID NO: 3651014 - RNA, 18 nt, Human
ccaugccacguuccacag

SEQ ID NO: 3651015 - RNA, 15 nt, Human
ccaugccaggaaccu

SEQ ID NO: 3651016 - RNA, 12 nt, Human
ccaugccucagc

SEQ ID NO: 3651017 - RNA, 16 nt, Human
ccaugccuccucagga

SEQ ID NO: 3651018 - RNA, 14 nt, Human
ccaugccugagggu

SEQ ID NO: 3651019 - RNA, 13 nt, Human
ccaugccugucca

SEQ ID NO: 3651020 - RNA, 19 nt, Human
ccaugccuguccagccugg

SEQ ID NO: 3651021 - RNA, 15 nt, Human
ccaugccuguggcug

SEQ ID NO: 3651022 - RNA, 18 nt, Human
ccaugccuguggcugcgc

SEQ ID NO: 3651023 - RNA, 16 nt, Human
ccaugcgacacuggga

SEQ ID NO: 3651024 - RNA, 21 nt, Human
ccaugcgacacugggaggcca

SEQ ID NO: 3651025 - RNA, 22 nt, Human
ccaugcgacacugggaggccag

SEQ ID NO: 3651026 - RNA, 20 nt, Human
ccaugcgcccccuccgcccu

SEQ ID NO: 3651027 - RNA, 22 nt, Human
ccaugcgcccccuccgcccugc

SEQ ID NO: 3651028 - RNA, 16 nt, Human
ccaugcgcucagggcc

SEQ ID NO: 3651029 - RNA, 22 nt, Human
ccaugcgcucagggccaugcug

SEQ ID NO: 3651030 - RNA, 16 nt, Human
ccaugcucaucugcug

SEQ ID NO: 3651031 - RNA, 17 nt, Human
ccaugcucaucugcugg

SEQ ID NO: 3651032 - RNA, 15 nt, Human
ccaugcuccucacug

SEQ ID NO: 3651033 - RNA, 17 nt, Human
ccaugcuccucacugcc

SEQ ID NO: 3651034 - RNA, 21 nt, Human
ccaugcuccucacugcccgca

SEQ ID NO: 3651035 - RNA, 13 nt, Human
ccaugcuccucuu

SEQ ID NO: 3651036 - RNA, 17 nt, Human
ccaugcugaggccuggg

SEQ ID NO: 3651037 - RNA, 20 nt, Human
ccaugcugaggccugggccg

SEQ ID NO: 3651038 - RNA, 13 nt, Human
ccaugcugcccug

SEQ ID NO: 3651039 - RNA, 17 nt, Human
ccaugcugcccugugag

SEQ ID NO: 3651040 - RNA, 19 nt, Human
ccaugcugcuggggaagac

SEQ ID NO: 3651041 - RNA, 14 nt, Human
ccaugcuggagccu

SEQ ID NO: 3651042 - RNA, 24 nt, Human
ccaugcuggagccuguguaacagc

SEQ ID NO: 3651043 - RNA, 21 nt, Human
ccaugcugggaagacgccuga

SEQ ID NO: 3651044 - RNA, 16 nt, Human
ccaugcugucuggcac

SEQ ID NO: 3651045 - RNA, 20 nt, Human
ccaugcugucuggcacagcc

SEQ ID NO: 3651046 - RNA, 19 nt, Human
ccaugcugugcgcccaggg

SEQ ID NO: 3651047 - RNA, 14 nt, Human
ccagagcugccagu

SEQ ID NO: 3651048 - RNA, 14 nt, Human
ccagagcuggguga

SEQ ID NO: 3651049 - RNA, 21 nt, Human
ccagagcuguuuauggccuca

SEQ ID NO: 3651050 - RNA, 22 nt, Human
ccagagcuguuuauggccucag

SEQ ID NO: 3651051 - RNA, 22 nt, Human
ccagaggaacuguccagagagc

SEQ ID NO: 3651052 - RNA, 17 nt, Human
ccagaggaaggggccag

SEQ ID NO: 3651053 - RNA, 22 nt, Human
ccagaggaaggggccagaggcu

SEQ ID NO: 3651054 - RNA, 21 nt, Human
ccagaggaauccuggcagccc

SEQ ID NO: 3651055 - RNA, 22 nt, Human
ccagaggaauccuggcagccca

SEQ ID NO: 3651056 - RNA, 20 nt, Human
ccagaggacugugaugcccu

SEQ ID NO: 3651057 - RNA, 22 nt, Human
ccagaggacugugaugcccugc

SEQ ID NO: 3651058 - RNA, 21 nt, Human
ccagaggagagaggacccccu

SEQ ID NO: 3651059 - RNA, 13 nt, Human
ccagaggagccuu

SEQ ID NO: 3651060 - RNA, 15 nt, Human
ccagaggagccuuuu

SEQ ID NO: 3651061 - RNA, 17 nt, Human
ccagaggagccuuuuua

SEQ ID NO: 3651062 - RNA, 20 nt, Human
ccagaggagcugggagccgg

SEQ ID NO: 3651063 - RNA, 17 nt, Human
ccagaggcagaacccug

SEQ ID NO: 3651064 - RNA, 19 nt, Human
ccagaggccaacacugugg

SEQ ID NO: 3651065 - RNA, 14 nt, Human
ccagaggcccccag

SEQ ID NO: 3651066 - RNA, 21 nt, Human
ccagaggcccccagcccaggg

SEQ ID NO: 3651067 - RNA, 17 nt, Human
ccagaggcgucccgcac

SEQ ID NO: 3651068 - RNA, 13 nt, Human
ccagaggcugagu

SEQ ID NO: 3651069 - RNA, 15 nt, Human
ccagaggcugcccca

SEQ ID NO: 3651070 - RNA, 18 nt, Human
ccagagggagugacagag

SEQ ID NO: 3651071 - RNA, 20 nt, Human
ccagagggagugacagaggc

SEQ ID NO: 3651072 - RNA, 18 nt, Human
ccagagggccugcaaggg

SEQ ID NO: 3651073 - RNA, 17 nt, Human
ccagaggggccugccac

SEQ ID NO: 3651074 - RNA, 22 nt, Human
ccagaggggccugccaccugga

SEQ ID NO: 3651075 - RNA, 19 nt, Human
ccagagguaacagaacagc

SEQ ID NO: 3651076 - RNA, 23 nt, Human
ccagagguaacagaacagcuuca

SEQ ID NO: 3651077 - RNA, 15 nt, Human
ccagagguccagccc

SEQ ID NO: 3651078 - RNA, 16 nt, Human
ccagagguccagccca

SEQ ID NO: 3651079 - RNA, 12 nt, Human
ccagaggugcuu

SEQ ID NO: 3651080 - RNA, 22 nt, Human
ccagaggugggcaggugguggc

SEQ ID NO: 3651081 - RNA, 23 nt, Human
ccagaguccccccacucccagca

SEQ ID NO: 3651082 - RNA, 17 nt, Human
ccagaguggccuggcca

SEQ ID NO: 3651083 - RNA, 21 nt, Human
ccagaguggccuggccaggag

SEQ ID NO: 3651084 - RNA, 19 nt, Human
ccagaguuccccaugcaga

SEQ ID NO: 3651085 - RNA, 11 nt, Human
ccagaguugcu

SEQ ID NO: 3651086 - RNA, 12 nt, Human
ccagaguugcug

SEQ ID NO: 3651087 - RNA, 21 nt, Human
ccagaguugcugggagcugaa

SEQ ID NO: 3651088 - RNA, 12 nt, Human
ccagauaacuua

SEQ ID NO: 3651089 - RNA, 14 nt, Human
ccagauaagaaugc

SEQ ID NO: 3651090 - RNA, 13 nt, Human
ccagauaccagcc

SEQ ID NO: 3651091 - RNA, 17 nt, Human
ccagauaguguagcuga

SEQ ID NO: 3651092 - RNA, 20 nt, Human
ccagauaguguagcugagga

SEQ ID NO: 3651093 - RNA, 19 nt, Human
ccagauauucaagucaccu

SEQ ID NO: 3651094 - RNA, 15 nt, Human
ccagaucaaggaugu

SEQ ID NO: 3651095 - RNA, 18 nt, Human
ccagaucaccagcccggc

SEQ ID NO: 3651096 - RNA, 20 nt, Human
ccagaucacugccacacucu

SEQ ID NO: 3651097 - RNA, 16 nt, Human
ccagaucagccagaag

SEQ ID NO: 3651098 - RNA, 16 nt, Human
ccagaucccagaagga

SEQ ID NO: 3651099 - RNA, 18 nt, Human
ccagaucccaggccccug

SEQ ID NO: 3651100 - RNA, 16 nt, Human
ccagauccucucuggg

SEQ ID NO: 3651101 - RNA, 14 nt, Human
ccagauccucuugg

SEQ ID NO: 3651102 - RNA, 15 nt, Human
ccagauccuggaaau

SEQ ID NO: 3651103 - RNA, 22 nt, Human
ccagaucggaucuguugcaaac

SEQ ID NO: 3651104 - RNA, 23 nt, Human
ccagaucuacuugguugucaagu

SEQ ID NO: 3651105 - RNA, 21 nt, Human
ccagaugagcagaagcucucg

SEQ ID NO: 3651106 - RNA, 16 nt, Human
ccagaugcagcucaag

SEQ ID NO: 3651107 - RNA, 18 nt, Human
ccagaugcagggcaguca

SEQ ID NO: 3651108 - RNA, 17 nt, Human
ccagaugccccuuucug

SEQ ID NO: 3651109 - RNA, 14 nt, Human
ccagaugcugaaaa

SEQ ID NO: 3651110 - RNA, 19 nt, Human
ccagaugcugauguucagu

SEQ ID NO: 3651111 - RNA, 21 nt, Human
ccagaugcugauguucagugu

SEQ ID NO: 3651112 - RNA, 22 nt, Human
ccagaugcugauguucagugua

SEQ ID NO: 3651113 - RNA, 14 nt, Human
ccagaugcugcaga

SEQ ID NO: 3651114 - RNA, 19 nt, Human
ccagaugcugcagagucac

SEQ ID NO: 3651115 - RNA, 14 nt, Human
ccagauggggccuc

SEQ ID NO: 3651116 - RNA, 13 nt, Human
ccagauggucauc

SEQ ID NO: 3651117 - RNA, 16 nt, Human
ccagauggugggaugu

SEQ ID NO: 3651118 - RNA, 15 nt, Human
ccagauuaaacuuca

SEQ ID NO: 3651119 - RNA, 16 nt, Human
ccagauuccccugugu

SEQ ID NO: 3651120 - RNA, 20 nt, Human
ccagauucuauccucaucuu

SEQ ID NO: 3651121 - RNA, 19 nt, Human
ccagauucuuuccugaggc

SEQ ID NO: 3651122 - RNA, 21 nt, Human
ccagauucuuuccugaggcug

SEQ ID NO: 3651123 - RNA, 22 nt, Human
ccagauucuuuccugaggcugg

SEQ ID NO: 3651124 - RNA, 23 nt, Human
ccagauucuuuccugaggcuggg

SEQ ID NO: 3651125 - RNA, 14 nt, Human
ccagauugcaacag

SEQ ID NO: 3651126 - RNA, 18 nt, Human
ccagauugcaacaggcug

SEQ ID NO: 3651127 - RNA, 19 nt, Human
ccagauugcaacaggcugg

SEQ ID NO: 3651128 - RNA, 13 nt, Human
ccagauuuacacu

SEQ ID NO: 3651129 - RNA, 13 nt, Human
ccagauuuaugca

SEQ ID NO: 3651130 - RNA, 12 nt, Human
ccagauuucacu

SEQ ID NO: 3651131 - RNA, 21 nt, Human
ccaggaugauaaguuccuuuc

SEQ ID NO: 3651132 - RNA, 18 nt, Human
ccaggaugcuggguggcc

SEQ ID NO: 3651133 - RNA, 21 nt, Human
ccaggauggaacacggccaca

SEQ ID NO: 3651134 - RNA, 20 nt, Human
ccaggauggcccuucccacu

SEQ ID NO: 3651135 - RNA, 23 nt, Human
ccaggauggcccuucccacugga

SEQ ID NO: 3651136 - RNA, 15 nt, Human
ccaggauuccucuuu

SEQ ID NO: 3651137 - RNA, 18 nt, Human
ccaggauuugcugggaga

SEQ ID NO: 3651138 - RNA, 20 nt, Human
ccaggauuuuaacaaaagca

SEQ ID NO: 3651139 - RNA, 16 nt, Human
ccaggcaaauaaaauu

SEQ ID NO: 3651140 - RNA, 18 nt, Human
ccaggcaaauaaaauucc

SEQ ID NO: 3651141 - RNA, 12 nt, Human
ccaggcaaauca

SEQ ID NO: 3651142 - RNA, 19 nt, Human
ccaggcaaaucaguuacua

SEQ ID NO: 3651143 - RNA, 15 nt, Human
ccaggcaaggcugug

SEQ ID NO: 3651144 - RNA, 13 nt, Human
ccaggcaauggcc

SEQ ID NO: 3651145 - RNA, 19 nt, Human
ccaggcaauggccuaaacu

SEQ ID NO: 3651146 - RNA, 13 nt, Human
ccaggcacaggca

SEQ ID NO: 3651147 - RNA, 18 nt, Human
ccaggcacaggcagggca

SEQ ID NO: 3651148 - RNA, 19 nt, Human
ccaggcacaggcagggcag

SEQ ID NO: 3651149 - RNA, 16 nt, Human
ccaggcacccccugga

SEQ ID NO: 3651150 - RNA, 18 nt, Human
ccaggcacccccuggaga

SEQ ID NO: 3651151 - RNA, 13 nt, Human
ccaggcacccuuc

SEQ ID NO: 3651152 - RNA, 18 nt, Human
ccaggcacgaacccaccu

SEQ ID NO: 3651153 - RNA, 19 nt, Human
ccaggcacgaacccaccug

SEQ ID NO: 3651154 - RNA, 15 nt, Human
ccaggcacugucuua

SEQ ID NO: 3651155 - RNA, 13 nt, Human
ccaggcagaucca

SEQ ID NO: 3651156 - RNA, 16 nt, Human
ccaggcagauccagga

SEQ ID NO: 3651157 - RNA, 17 nt, Human
ccaggcagauccaggac

SEQ ID NO: 3651158 - RNA, 19 nt, Human
ccaggcagauccaggacua

SEQ ID NO: 3651159 - RNA, 21 nt, Human
ccaggcagaucugugccccau

SEQ ID NO: 3651160 - RNA, 14 nt, Human
ccaggcaggcugug

SEQ ID NO: 3651161 - RNA, 12 nt, Human
ccaggcagggag

SEQ ID NO: 3651162 - RNA, 12 nt, Human
ccaggcaggucu

SEQ ID NO: 3651163 - RNA, 17 nt, Human
ccaggcaggucugaagc

SEQ ID NO: 3651164 - RNA, 14 nt, Human
ccaggcaggucuug

SEQ ID NO: 3651165 - RNA, 19 nt, Human
ccaggcaggugccuggaca

SEQ ID NO: 3651166 - RNA, 12 nt, Human
ccaggcagucgg

SEQ ID NO: 3651167 - RNA, 13 nt, Human
ccaggcauggugg

SEQ ID NO: 3651168 - RNA, 18 nt, Human
ccaggcauguggcagggg

SEQ ID NO: 3651169 - RNA, 23 nt, Human
ccaggccaaaggggaccuggaag

SEQ ID NO: 3651170 - RNA, 21 nt, Human
ccaggccacaagacccuugug

SEQ ID NO: 3651171 - RNA, 19 nt, Human
ccaggccacauggggcugg

SEQ ID NO: 3651172 - RNA, 21 nt, Human
ccaggccaccuccccagcauu

SEQ ID NO: 3651173 - RNA, 16 nt, Human
ccaggccacuggcccc

SEQ ID NO: 3651174 - RNA, 23 nt, Human
ccaggccacuggccccugagauc

SEQ ID NO: 3651175 - RNA, 15 nt, Human
ccaggccagccuccg

SEQ ID NO: 3651176 - RNA, 19 nt, Human
ccaggccagccuccgagag

SEQ ID NO: 3651177 - RNA, 20 nt, Human
ccaggccagccuccgagagg

SEQ ID NO: 3651178 - RNA, 23 nt, Human
ccaggccagccuccgagagggag

SEQ ID NO: 3651179 - RNA, 20 nt, Human
ccaggccaggacucugcagc

SEQ ID NO: 3651180 - RNA, 12 nt, Human
ccaggccaggcc

SEQ ID NO: 3651181 - RNA, 15 nt, Human
ccaggccauucugcc

SEQ ID NO: 3651182 - RNA, 17 nt, Human
ccaggccauucugccgc

SEQ ID NO: 3651183 - RNA, 19 nt, Human
ccaggcccaaggcucccgg

SEQ ID NO: 3651184 - RNA, 16 nt, Human
ccaggcccacucaggg

SEQ ID NO: 3651185 - RNA, 17 nt, Human
ccaggcccacugugccu

SEQ ID NO: 3651186 - RNA, 15 nt, Human
ccaggccccaugacc

SEQ ID NO: 3651187 - RNA, 22 nt, Human
ccaggccccaugaccuccagcu

SEQ ID NO: 3651188 - RNA, 23 nt, Human
ccaggccccaugaccuccagcuu

SEQ ID NO: 3651189 - RNA, 21 nt, Human
ccaggcccccaccacacaucc

SEQ ID NO: 3651190 - RNA, 12 nt, Human
ccaggccccucc

SEQ ID NO: 3651191 - RNA, 16 nt, Human
ccaggccccucccucu

SEQ ID NO: 3651192 - RNA, 18 nt, Human
ccaggccccucccucucc

SEQ ID NO: 3651193 - RNA, 23 nt, Human
ccaggccccugccacccugggga

SEQ ID NO: 3651194 - RNA, 16 nt, Human
ccaggcccggggcugg

SEQ ID NO: 3651195 - RNA, 17 nt, Human
ccaggcccgucugucca

SEQ ID NO: 3651196 - RNA, 18 nt, Human
ccaggcccgucuguccau

SEQ ID NO: 3651197 - RNA, 14 nt, Human
ccaggcccucugcc

SEQ ID NO: 3651198 - RNA, 16 nt, Human
ccaggcccucugccca

SEQ ID NO: 3651199 - RNA, 20 nt, Human
ccaggcccucugcccacucc

SEQ ID NO: 3651200 - RNA, 22 nt, Human
ccaggcccucugcccacucccu

SEQ ID NO: 3651201 - RNA, 14 nt, Human
ccaggccgcagcuc

SEQ ID NO: 3651202 - RNA, 19 nt, Human
ccaggccgcagcucuugcc

SEQ ID NO: 3651203 - RNA, 16 nt, Human
ccaggccgccccagcc

SEQ ID NO: 3651204 - RNA, 18 nt, Human
ccaggccgccccagccuc

SEQ ID NO: 3651205 - RNA, 15 nt, Human
ccaggccggccagcc

SEQ ID NO: 3651206 - RNA, 22 nt, Human
ccaggccggugugggcuguguc

SEQ ID NO: 3651207 - RNA, 14 nt, Human
ccaggccguggcug

SEQ ID NO: 3651208 - RNA, 18 nt, Human
ccaggccguggcugccca

SEQ ID NO: 3651209 - RNA, 21 nt, Human
ccaggccuacuccugucuucu

SEQ ID NO: 3651210 - RNA, 23 nt, Human
ccaggccuacuccugucuucugc

SEQ ID NO: 3651211 - RNA, 24 nt, Human
ccaggccuauguugauccauccag

SEQ ID NO: 3651212 - RNA, 16 nt, Human
ccaggccuccagcuca

SEQ ID NO: 3651213 - RNA, 18 nt, Human
ccaggccuccuacagcuu

SEQ ID NO: 3651214 - RNA, 15 nt, Human
ccaggccucuguguc

SEQ ID NO: 3651215 - RNA, 16 nt, Human
ccaggccucuuggcag

SEQ ID NO: 3651216 - RNA, 18 nt, Human
ccaggccucuuggcaguc

SEQ ID NO: 3651217 - RNA, 19 nt, Human
ccaggccucuuggcaguca

SEQ ID NO: 3651218 - RNA, 13 nt, Human
ccaggccugcagc

SEQ ID NO: 3651219 - RNA, 14 nt, Human
ccaggccugcagca

SEQ ID NO: 3651220 - RNA, 16 nt, Human
ccaggccugcagcagg

SEQ ID NO: 3651221 - RNA, 18 nt, Human
ccaggccugcagcaggag

SEQ ID NO: 3651222 - RNA, 20 nt, Human
ccaggccugggucugugucu

SEQ ID NO: 3651223 - RNA, 22 nt, Human
ccaggcgagagacuuguggccu

SEQ ID NO: 3651224 - RNA, 16 nt, Human
ccaggcgcuaauucaa

SEQ ID NO: 3651225 - RNA, 14 nt, Human
ccaggcgggcucaa

SEQ ID NO: 3651226 - RNA, 16 nt, Human
ccaggcgggcucaagg

SEQ ID NO: 3651227 - RNA, 22 nt, Human
ccaggcgggcucaaggaaaggg

SEQ ID NO: 3651228 - RNA, 19 nt, Human
ccaggcuaguccggaccca

SEQ ID NO: 3651229 - RNA, 19 nt, Human
ccaggcuauguauaaaaua

SEQ ID NO: 3651230 - RNA, 20 nt, Human
ccaggcuauguauaaaauac

SEQ ID NO: 3651231 - RNA, 22 nt, Human
ccaggcuauguauaaaauacau

SEQ ID NO: 3651232 - RNA, 13 nt, Human
ccaggcucacuca

SEQ ID NO: 3651233 - RNA, 18 nt, Human
ccaggcuccgcccuuagu

SEQ ID NO: 3651234 - RNA, 23 nt, Human
ccaggcuccuuccugucuuccug

SEQ ID NO: 3651235 - RNA, 20 nt, Human
ccaggcuccuuuagcgccca

SEQ ID NO: 3651236 - RNA, 21 nt, Human
ccaggcucguggacugagugg

SEQ ID NO: 3651237 - RNA, 23 nt, Human
ccaggcucguggacugaguggga

SEQ ID NO: 3651238 - RNA, 23 nt, Human
ccaggcucucgcacaccucugca

SEQ ID NO: 3651239 - RNA, 20 nt, Human
ccaggcucucuuugcccagu

SEQ ID NO: 3651240 - RNA, 15 nt, Human
ccaggcucugugcug

SEQ ID NO: 3651241 - RNA, 20 nt, Human
ccaggcucugugcugacccu

SEQ ID NO: 3651242 - RNA, 15 nt, Human
ccaggcugaccacag

SEQ ID NO: 3651243 - RNA, 17 nt, Human
ccaggcugaccacagca

SEQ ID NO: 3651244 - RNA, 20 nt, Human
ccaggcugaccacagcacag

SEQ ID NO: 3651245 - RNA, 23 nt, Human
ccaggcugaccacagcacagcca

SEQ ID NO: 3651246 - RNA, 14 nt, Human
ccaggcugagccuc

SEQ ID NO: 3651247 - RNA, 16 nt, Human
ccaggcugagccucag

SEQ ID NO: 3651248 - RNA, 15 nt, Human
ccaggcugagguccu

SEQ ID NO: 3651249 - RNA, 14 nt, Human
ccaggcugccgucc

SEQ ID NO: 3651250 - RNA, 21 nt, Human
cccagaccuuuuauccacuua

SEQ ID NO: 3651251 - RNA, 20 nt, Human
cccagacgccugauauugaa

SEQ ID NO: 3651252 - RNA, 19 nt, Human
cccagacgccuggcugcug

SEQ ID NO: 3651253 - RNA, 21 nt, Human
cccagacggcuccacuaggac

SEQ ID NO: 3651254 - RNA, 17 nt, Human
cccagacuacuauuuuc

SEQ ID NO: 3651255 - RNA, 18 nt, Human
cccagacuacuauuuucu

SEQ ID NO: 3651256 - RNA, 20 nt, Human
cccagacucagacauuggca

SEQ ID NO: 3651257 - RNA, 10 nt, Human
cccagacuug

SEQ ID NO: 3651258 - RNA, 23 nt, Human
cccagacuuguuggcguaggcua

SEQ ID NO: 3651259 - RNA, 22 nt, Human
cccagagaaaggggagcccacu

SEQ ID NO: 3651260 - RNA, 13 nt, Human
cccagagaacagc

SEQ ID NO: 3651261 - RNA, 16 nt, Human
cccagagacaggaaaa

SEQ ID NO: 3651262 - RNA, 17 nt, Human
cccagagacaggaaaau

SEQ ID NO: 3651263 - RNA, 23 nt, Human
cccagagacauacuugaagggcc

SEQ ID NO: 3651264 - RNA, 13 nt, Human
cccagagacccag

SEQ ID NO: 3651265 - RNA, 19 nt, Human
cccagagacuuuguagauc

SEQ ID NO: 3651266 - RNA, 17 nt, Human
cccagagagaagagccc

SEQ ID NO: 3651267 - RNA, 19 nt, Human
cccagagagaagagcccca

SEQ ID NO: 3651268 - RNA, 15 nt, Human
cccagagaggaauca

SEQ ID NO: 3651269 - RNA, 21 nt, Human
cccagagaggaaucagacuuc

SEQ ID NO: 3651270 - RNA, 16 nt, Human
cccagagaugccucca

SEQ ID NO: 3651271 - RNA, 19 nt, Human
cccagagaugccuccaccg

SEQ ID NO: 3651272 - RNA, 21 nt, Human
cccagagaugccuccaccgcu

SEQ ID NO: 3651273 - RNA, 23 nt, Human
cccagagaugccuccaccgcugc

SEQ ID NO: 3651274 - RNA, 20 nt, Human
ccagguauucguuaucuaau

SEQ ID NO: 3651275 - RNA, 14 nt, Human
ccaggucaacagaa

SEQ ID NO: 3651276 - RNA, 22 nt, Human
ccaggucaacagaaugaaaaau

SEQ ID NO: 3651277 - RNA, 14 nt, Human
ccaggucacacgac

SEQ ID NO: 3651278 - RNA, 16 nt, Human
ccagguccacggucug

SEQ ID NO: 3651279 - RNA, 14 nt, Human
ccagguccagcucu

SEQ ID NO: 3651280 - RNA, 19 nt, Human
ccagguccagcucuggagg

SEQ ID NO: 3651281 - RNA, 16 nt, Human
ccaggucccccugcag

SEQ ID NO: 3651282 - RNA, 12 nt, Human
ccaggucccucu

SEQ ID NO: 3651283 - RNA, 14 nt, Human
ccagguccucugau

SEQ ID NO: 3651284 - RNA, 13 nt, Human
ccagguccuggug

SEQ ID NO: 3651285 - RNA, 14 nt, Human
ccagguccuggugg

SEQ ID NO: 3651286 - RNA, 14 nt, Human
ccaggucgggcuca

SEQ ID NO: 3651287 - RNA, 15 nt, Human
ccaggucucacgggc

SEQ ID NO: 3651288 - RNA, 16 nt, Human
ccaggucucacgggca

SEQ ID NO: 3651289 - RNA, 23 nt, Human
ccaggucucacgggcaugggcac

SEQ ID NO: 3651290 - RNA, 13 nt, Human
ccaggucucccgg

SEQ ID NO: 3651291 - RNA, 20 nt, Human
ccaggucucccuggaucaga

SEQ ID NO: 3651292 - RNA, 14 nt, Human
ccaggucuccucca

SEQ ID NO: 3651293 - RNA, 15 nt, Human
ccaggucuccuccac

SEQ ID NO: 3651294 - RNA, 19 nt, Human
ccaggucuccuccaccgcc

SEQ ID NO: 3651295 - RNA, 23 nt, Human
ccaggucugggaagcugagggca

SEQ ID NO: 3651296 - RNA, 23 nt, Human
ccaggugaacaaaguuuaccaga

SEQ ID NO: 3651297 - RNA, 15 nt, Human
ccaggugaggucagc

SEQ ID NO: 3651298 - RNA, 19 nt, Human
ccaggugcacaagcuccaa

SEQ ID NO: 3651299 - RNA, 13 nt, Human
ccaggugcagagg

SEQ ID NO: 3651300 - RNA, 20 nt, Human
ccaggugcagagguacccug

SEQ ID NO: 3651301 - RNA, 22 nt, Human
ccaggugcagagguacccuggg

SEQ ID NO: 3651302 - RNA, 23 nt, Human
ccaggugcagagguacccugggu

SEQ ID NO: 3651303 - RNA, 15 nt, Human
ccaggugcagccaga

SEQ ID NO: 3651304 - RNA, 12 nt, Human
ccaggugccagu

SEQ ID NO: 3651305 - RNA, 17 nt, Human
ccaggugccaguuaugg

SEQ ID NO: 3651306 - RNA, 15 nt, Human
ccaggugcccagcua

SEQ ID NO: 3651307 - RNA, 15 nt, Human
ccaggugccuccuga

SEQ ID NO: 3651308 - RNA, 16 nt, Human
ccaggugccuuucaaa

SEQ ID NO: 3651309 - RNA, 21 nt, Human
ccaggugcuaggaacacuccu

SEQ ID NO: 3651310 - RNA, 20 nt, Human
ccagguggagguggcauccc

SEQ ID NO: 3651311 - RNA, 16 nt, Human
ccagguggcugaccca

SEQ ID NO: 3651312 - RNA, 19 nt, Human
ccagguguuaacauuccaa

SEQ ID NO: 3651313 - RNA, 21 nt, Human
ccagguguuacuguaauuccu

SEQ ID NO: 3651314 - RNA, 16 nt, Human
ccagguuaucugggca

SEQ ID NO: 3651315 - RNA, 21 nt, Human
ccagguucuccguuagcuccu

SEQ ID NO: 3651316 - RNA, 22 nt, Human
ccagguucuccguuagcuccug

SEQ ID NO: 3651317 - RNA, 16 nt, Human
ccagguugaaagaccu

SEQ ID NO: 3651318 - RNA, 18 nt, Human
ccagguuggagugcagug

SEQ ID NO: 3651319 - RNA, 18 nt, Human
ccagguuggcucugccag

SEQ ID NO: 3651320 - RNA, 19 nt, Human
ccagguuggcucugccagu

SEQ ID NO: 3651321 - RNA, 16 nt, Human
ccagguuuucugggug

SEQ ID NO: 3651322 - RNA, 19 nt, Human
ccagguuuucugggugucc

SEQ ID NO: 3651323 - RNA, 20 nt, Human
ccagguuuuguuccgcccag

SEQ ID NO: 3651324 - RNA, 19 nt, Human
ccaguaaaauugccauauu

SEQ ID NO: 3651325 - RNA, 12 nt, Human
ccaguaaacaga

SEQ ID NO: 3651326 - RNA, 21 nt, Human
ccaguaaaugggggugcauuu

SEQ ID NO: 3651327 - RNA, 22 nt, Human
ccaguaaaugggggugcauuug

SEQ ID NO: 3651328 - RNA, 20 nt, Human
ccaguaacacaggccacccu

SEQ ID NO: 3651329 - RNA, 19 nt, Human
ccaguaacgcgucuuccug

SEQ ID NO: 3651330 - RNA, 21 nt, Human
ccaguaacgcgucuuccugag

SEQ ID NO: 3651331 - RNA, 15 nt, Human
ccaguaacucaucug

SEQ ID NO: 3651332 - RNA, 18 nt, Human
ccaguaagggaaauagaa

SEQ ID NO: 3651333 - RNA, 14 nt, Human
ccaguaauccugua

SEQ ID NO: 3651334 - RNA, 17 nt, Human
ccaguacauucucaguu

SEQ ID NO: 3651335 - RNA, 22 nt, Human
ccaguacauucucaguuuuucu

SEQ ID NO: 3651336 - RNA, 19 nt, Human
ccaguaccuggguccccag

SEQ ID NO: 3651337 - RNA, 23 nt, Human
ccaguaccuggguccccagcccu

SEQ ID NO: 3651338 - RNA, 16 nt, Human
ccaguaccuuugucac

SEQ ID NO: 3651339 - RNA, 17 nt, Human
ccaguaccuuugucaca

SEQ ID NO: 3651340 - RNA, 15 nt, Human
ccaguagcaggcccg

SEQ ID NO: 3651341 - RNA, 23 nt, Human
ccaguagcugggaccacaggugc

SEQ ID NO: 3651342 - RNA, 21 nt, Human
ccaguagcuugggacaaauca

SEQ ID NO: 3651343 - RNA, 22 nt, Human
ccaguauaaaacaccuaaauaa

SEQ ID NO: 3651344 - RNA, 18 nt, Human
ccaguaucucuucagucu

SEQ ID NO: 3651345 - RNA, 14 nt, Human
ccaguauucuuguc

SEQ ID NO: 3651346 - RNA, 20 nt, Human
ccaguauuguacaaaguauu

SEQ ID NO: 3651347 - RNA, 17 nt, Human
ccaguauuuagaagcca

SEQ ID NO: 3651348 - RNA, 14 nt, Human
ccagucacaugacc

SEQ ID NO: 3651349 - RNA, 18 nt, Human
ccagucaccccggccacc

SEQ ID NO: 3651350 - RNA, 13 nt, Human
ccagucagccucu

SEQ ID NO: 3651351 - RNA, 19 nt, Human
ccagucagguaguugcaau

SEQ ID NO: 3651352 - RNA, 17 nt, Human
ccagucauaccaacuuu

SEQ ID NO: 3651353 - RNA, 19 nt, Human
ccagucauaccaacuuuag

SEQ ID NO: 3651354 - RNA, 14 nt, Human
ccaguccaaggaaa

SEQ ID NO: 3651355 - RNA, 16 nt, Human
ccaguccacccugccu

SEQ ID NO: 3651356 - RNA, 17 nt, Human
ccaguccaccugaggaa

SEQ ID NO: 3651357 - RNA, 14 nt, Human
ccaguccaggcugc

SEQ ID NO: 3651358 - RNA, 14 nt, Human
ccaguccaguccua

SEQ ID NO: 3651359 - RNA, 13 nt, Human
ccagucccagcag

SEQ ID NO: 3651360 - RNA, 14 nt, Human
ccagucccagcagc

SEQ ID NO: 3651361 - RNA, 15 nt, Human
ccaguccccaccccu

SEQ ID NO: 3651362 - RNA, 18 nt, Human
ccaguccccaccccugcc

SEQ ID NO: 3651363 - RNA, 19 nt, Human
ccaguccccaccccugccc

SEQ ID NO: 3651364 - RNA, 20 nt, Human
ccagucccccaaccccagcc

SEQ ID NO: 3651365 - RNA, 23 nt, Human
ccagucccccaaccccagccgcu

SEQ ID NO: 3651366 - RNA, 15 nt, Human
ccaguccccccaccc

SEQ ID NO: 3651367 - RNA, 18 nt, Human
ccagucccccugccccag

SEQ ID NO: 3651368 - RNA, 14 nt, Human
ccaguccccuuccc

SEQ ID NO: 3651369 - RNA, 18 nt, Human
ccaguccccuucccguga

SEQ ID NO: 3651370 - RNA, 13 nt, Human
ccagucccugggg

SEQ ID NO: 3651371 - RNA, 17 nt, Human
ccaguccuaucugggcu

SEQ ID NO: 3651372 - RNA, 18 nt, Human
ccaguccuaucugggcuu

SEQ ID NO: 3651373 - RNA, 22 nt, Human
ccaguccucucccaaguccaca

SEQ ID NO: 3651374 - RNA, 13 nt, Human
ccaguccugcccg

SEQ ID NO: 3651375 - RNA, 15 nt, Human
ccaguccugcccgcc

SEQ ID NO: 3651376 - RNA, 16 nt, Human
ccaguccugccuggcc

SEQ ID NO: 3651377 - RNA, 14 nt, Human
ccaguccugcucuc

SEQ ID NO: 3651378 - RNA, 13 nt, Human
ccaguccuguccu

SEQ ID NO: 3651379 - RNA, 13 nt, Human
ccaguccuuccac

SEQ ID NO: 3651380 - RNA, 15 nt, Human
ccagucgcgcugccu

SEQ ID NO: 3651381 - RNA, 19 nt, Human
ccagucgcgcugccugugu

SEQ ID NO: 3651382 - RNA, 17 nt, Human
ccagucucucuuaaagu

SEQ ID NO: 3651383 - RNA, 12 nt, Human
ccagucugaccc

SEQ ID NO: 3651384 - RNA, 13 nt, Human
ccagucugacccu

SEQ ID NO: 3651385 - RNA, 17 nt, Human
ccagucugcugcccucc

SEQ ID NO: 3651386 - RNA, 16 nt, Human
ccagucugggcugccg

SEQ ID NO: 3651387 - RNA, 19 nt, Human
ccagucugggcugccgggu

SEQ ID NO: 3651388 - RNA, 19 nt, Human
ccagucuuuaaaggcccag

SEQ ID NO: 3651389 - RNA, 15 nt, Human
ccagucuuuuguccu

SEQ ID NO: 3651390 - RNA, 20 nt, Human
ccagugaaaucaguuacucu

SEQ ID NO: 3651391 - RNA, 16 nt, Human
ccagugaaccaaagag

SEQ ID NO: 3651392 - RNA, 22 nt, Human
ccagugaagagccacugccauu

SEQ ID NO: 3651393 - RNA, 23 nt, Human
ccagugaauucuugaaggaaaau

SEQ ID NO: 3651394 - RNA, 18 nt, Human
ccagugaauuuuugcaau

SEQ ID NO: 3651395 - RNA, 11 nt, Human
ccagugacacu

SEQ ID NO: 3651396 - RNA, 20 nt, Human
ccagugacacuucagagagc

SEQ ID NO: 3651397 - RNA, 15 nt, Human
ccagugacagacagg

SEQ ID NO: 3651398 - RNA, 21 nt, Human
ccagugacagacaggcucuua

SEQ ID NO: 3651399 - RNA, 14 nt, Human
ccagugacagcuag

SEQ ID NO: 3651400 - RNA, 18 nt, Human
ccagugaccugaggaagc

SEQ ID NO: 3651401 - RNA, 12 nt, Human
ccagugaccugg

SEQ ID NO: 3651402 - RNA, 23 nt, Human
ccagugaccuggaaggcccagca

SEQ ID NO: 3651403 - RNA, 12 nt, Human
ccagugacucca

SEQ ID NO: 3651404 - RNA, 15 nt, Human
ccagugacuccagga

SEQ ID NO: 3651405 - RNA, 17 nt, Human
ccagugacuuuuucuaa

SEQ ID NO: 3651406 - RNA, 17 nt, Human
ccagugagaugcauucu

SEQ ID NO: 3651407 - RNA, 20 nt, Human
ccagugagcgcuugggcgcc

SEQ ID NO: 3651408 - RNA, 18 nt, Human
ccagugaggcucugcccu

SEQ ID NO: 3651409 - RNA, 20 nt, Human
ccagugaggcucugcccuug

SEQ ID NO: 3651410 - RNA, 18 nt, Human
ccagugagggacgucaga

SEQ ID NO: 3651411 - RNA, 17 nt, Human
ccagugcaaaugcaugc

SEQ ID NO: 3651412 - RNA, 14 nt, Human
ccagugcaacagca

SEQ ID NO: 3651413 - RNA, 14 nt, Human
ccagugcacugaaa

SEQ ID NO: 3651414 - RNA, 17 nt, Human
cagaggccaacacugug

SEQ ID NO: 3651415 - RNA, 14 nt, Human
cagaggccauggca

SEQ ID NO: 3651416 - RNA, 16 nt, Human
cagaggcccaggcugc

SEQ ID NO: 3651417 - RNA, 17 nt, Human
cagaggcccaggcugcc

SEQ ID NO: 3651418 - RNA, 19 nt, Human
cagaggcccaggcugccgu

SEQ ID NO: 3651419 - RNA, 21 nt, Human
ccauugcuaucuauugauaau

SEQ ID NO: 3651420 - RNA, 11 nt, Human
ccauugcugcu

SEQ ID NO: 3651421 - RNA, 23 nt, Human
ccauugcugcuccuuagcugcca

SEQ ID NO: 3651422 - RNA, 17 nt, Human
ccauugcuuauuaugua

SEQ ID NO: 3651423 - RNA, 12 nt, Human
ccauugcuucac

SEQ ID NO: 3651424 - RNA, 14 nt, Human
ccauuggaaauuuc

SEQ ID NO: 3651425 - RNA, 20 nt, Human
ccauuggcuauuuaaaacuu

SEQ ID NO: 3651426 - RNA, 21 nt, Human
ccauuggcuauuuaaaacuug

SEQ ID NO: 3651427 - RNA, 15 nt, Human
ccauuggggcuccca

SEQ ID NO: 3651428 - RNA, 16 nt, Human
ccauuggggcucccag

SEQ ID NO: 3651429 - RNA, 21 nt, Human
ccauuggggcucccagccagg

SEQ ID NO: 3651430 - RNA, 14 nt, Human
ccauugguccaaga

SEQ ID NO: 3651431 - RNA, 13 nt, Human
ccauugguguuga

SEQ ID NO: 3651432 - RNA, 19 nt, Human
ccauuguagcgucuuucuu

SEQ ID NO: 3651433 - RNA, 19 nt, Human
ccauuguccaauccuaugu

SEQ ID NO: 3651434 - RNA, 22 nt, Human
ccauugucccucugccccaucc

SEQ ID NO: 3651435 - RNA, 16 nt, Human
ccauugucuuguucug

SEQ ID NO: 3651436 - RNA, 17 nt, Human
ccauugucuuguucugu

SEQ ID NO: 3651437 - RNA, 20 nt, Human
ccauugucuuguucugugau

SEQ ID NO: 3651438 - RNA, 14 nt, Human
ccauugucuuuaua

SEQ ID NO: 3651439 - RNA, 18 nt, Human
ccauugucuuuauaugaa

SEQ ID NO: 3651440 - RNA, 23 nt, Human
ccauugucuuuauaugaacauag

SEQ ID NO: 3651441 - RNA, 20 nt, Human
ccauugugccuaaguccagu

SEQ ID NO: 3651442 - RNA, 15 nt, Human
ccauuguuugaaaca

SEQ ID NO: 3651443 - RNA, 22 nt, Human
ccauuguuugaaacaaagaagg

SEQ ID NO: 3651444 - RNA, 15 nt, Human
ccauuuaaaaacagg

SEQ ID NO: 3651445 - RNA, 22 nt, Human
ccauuuaaagcuuauuaaaacu

SEQ ID NO: 3651446 - RNA, 17 nt, Human
ccauuuacauguuuuaa

SEQ ID NO: 3651447 - RNA, 20 nt, Human
ccauuuacauguuuuaaaga

SEQ ID NO: 3651448 - RNA, 18 nt, Human
ccauuuacgugucugaau

SEQ ID NO: 3651449 - RNA, 17 nt, Human
ccauuuacuuaagacuu

SEQ ID NO: 3651450 - RNA, 13 nt, Human
ccauuuagaaugg

SEQ ID NO: 3651451 - RNA, 22 nt, Human
ccauuuagaauggugauuuuaa

SEQ ID NO: 3651452 - RNA, 14 nt, Human
ccauuuagccacca

SEQ ID NO: 3651453 - RNA, 19 nt, Human
ccauuuaguucuuuguuau

SEQ ID NO: 3651454 - RNA, 18 nt, Human
ccauuuauacaaauuaga

SEQ ID NO: 3651455 - RNA, 18 nt, Human
ccauuuauauaugaaaac

SEQ ID NO: 3651456 - RNA, 22 nt, Human
ccauuucaguaaaccugucuga

SEQ ID NO: 3651457 - RNA, 19 nt, Human
ccauuucauauucuuucaa

SEQ ID NO: 3651458 - RNA, 22 nt, Human
ccauuucauuugugccagaaug

SEQ ID NO: 3651459 - RNA, 13 nt, Human
ccauuucccaucu

SEQ ID NO: 3651460 - RNA, 13 nt, Human
ccauuuccuuaug

SEQ ID NO: 3651461 - RNA, 13 nt, Human
ccauuucuaauua

SEQ ID NO: 3651462 - RNA, 14 nt, Human
ccauuucuaauuau

SEQ ID NO: 3651463 - RNA, 23 nt, Human
ccauuucuaauuauguagcucuu

SEQ ID NO: 3651464 - RNA, 13 nt, Human
ccauuucucacug

SEQ ID NO: 3651465 - RNA, 12 nt, Human
ccauuucucaug

SEQ ID NO: 3651466 - RNA, 15 nt, Human
ccauuucucuccuca

SEQ ID NO: 3651467 - RNA, 15 nt, Human
ccauuucucucucca

SEQ ID NO: 3651468 - RNA, 19 nt, Human
ccauuucugaggugcacug

SEQ ID NO: 3651469 - RNA, 13 nt, Human
ccccaaacaguga

SEQ ID NO: 3651470 - RNA, 14 nt, Human
ccccaaagagccug

SEQ ID NO: 3651471 - RNA, 15 nt, Human
ccccaaagagccugg

SEQ ID NO: 3651472 - RNA, 19 nt, Human
ccccaaagagccuggagaa

SEQ ID NO: 3651473 - RNA, 20 nt, Human
ccccaaagagccuggagaag

SEQ ID NO: 3651474 - RNA, 12 nt, Human
ccccaaagcccc

SEQ ID NO: 3651475 - RNA, 16 nt, Human
ccccaaagcuuuccug

SEQ ID NO: 3651476 - RNA, 18 nt, Human
ccccaaagcuuuccugcc

SEQ ID NO: 3651477 - RNA, 19 nt, Human
ccccaaaggaaaaagcaca

SEQ ID NO: 3651478 - RNA, 15 nt, Human
ccccaaaguaaaaga

SEQ ID NO: 3651479 - RNA, 18 nt, Human
ccccaaaguaaaagaaac

SEQ ID NO: 3651480 - RNA, 12 nt, Human
ccccaaauauag

SEQ ID NO: 3651481 - RNA, 16 nt, Human
ccccaacacugugccc

SEQ ID NO: 3651482 - RNA, 18 nt, Human
ccccaacacugugcccug

SEQ ID NO: 3651483 - RNA, 15 nt, Human
ccccaacagcgccca

SEQ ID NO: 3651484 - RNA, 13 nt, Human
ccccaacagcugg

SEQ ID NO: 3651485 - RNA, 21 nt, Human
ccccaacagcuggacccugac

SEQ ID NO: 3651486 - RNA, 22 nt, Human
ccccaacagcuggacccugacc

SEQ ID NO: 3651487 - RNA, 22 nt, Human
ccccaacaucucccucccacau

SEQ ID NO: 3651488 - RNA, 23 nt, Human
ccccaaccauuuccucagacucu

SEQ ID NO: 3651489 - RNA, 13 nt, Human
ccccaacccugcc

SEQ ID NO: 3651490 - RNA, 23 nt, Human
ccccaacccugccccugccccgu

SEQ ID NO: 3651491 - RNA, 13 nt, Human
ccccaacccuucu

SEQ ID NO: 3651492 - RNA, 21 nt, Human
ccccaaccucagggcucccag

SEQ ID NO: 3651493 - RNA, 15 nt, Human
ccccaaccugcucuc

SEQ ID NO: 3651494 - RNA, 14 nt, Human
ccccaaccugcuga

SEQ ID NO: 3651495 - RNA, 22 nt, Human
ccccaacuccuuccagcuagug

SEQ ID NO: 3651496 - RNA, 18 nt, Human
ccccaagaaggcuggggc

SEQ ID NO: 3651497 - RNA, 23 nt, Human
ccccaagacuugguguccuuucc

SEQ ID NO: 3651498 - RNA, 20 nt, Human
ccccaagaggaaguucagau

SEQ ID NO: 3651499 - RNA, 14 nt, Human
ccccaagccuggca

SEQ ID NO: 3651500 - RNA, 16 nt, Human
ccccaagcuguuuucu

SEQ ID NO: 3651501 - RNA, 17 nt, Human
ccccaagcuguuuucuu

SEQ ID NO: 3651502 - RNA, 15 nt, Human
ccccaaggagggaga

SEQ ID NO: 3651503 - RNA, 22 nt, Human
ccccaagggcaaaauucccagg

SEQ ID NO: 3651504 - RNA, 19 nt, Human
ccccaaguagucugcucac

SEQ ID NO: 3651505 - RNA, 20 nt, Human
ccccaaguagucugcucaca

SEQ ID NO: 3651506 - RNA, 22 nt, Human
ccccaauauccucgcucccggg

SEQ ID NO: 3651507 - RNA, 19 nt, Human
ccccaaugagacuugccuu

SEQ ID NO: 3651508 - RNA, 18 nt, Human
ccccacaagugcccucca

SEQ ID NO: 3651509 - RNA, 17 nt, Human
ccccacacagcuacagc

SEQ ID NO: 3651510 - RNA, 14 nt, Human
ccccacaccaggcc

SEQ ID NO: 3651511 - RNA, 17 nt, Human
ccccacacuucccuggc

SEQ ID NO: 3651512 - RNA, 11 nt, Human
ccccacagccc

SEQ ID NO: 3651513 - RNA, 12 nt, Human
ccccacagccca

SEQ ID NO: 3651514 - RNA, 13 nt, Human
ccccacagcccac

SEQ ID NO: 3651515 - RNA, 16 nt, Human
ccccacagcccacguc

SEQ ID NO: 3651516 - RNA, 21 nt, Human
ccccacagcccacguccuguc

SEQ ID NO: 3651517 - RNA, 18 nt, Human
ccccacagccccaucugc

SEQ ID NO: 3651518 - RNA, 22 nt, Human
ccccacagucuccggccucucc

SEQ ID NO: 3651519 - RNA, 14 nt, Human
ccccaccaccccag

SEQ ID NO: 3651520 - RNA, 23 nt, Human
ccccaccacgauguggcccuggc

SEQ ID NO: 3651521 - RNA, 17 nt, Human
ccccaccagugccucuc

SEQ ID NO: 3651522 - RNA, 22 nt, Human
ccccaccagugccucucccugc

SEQ ID NO: 3651523 - RNA, 16 nt, Human
ccccacccaagcuugg

SEQ ID NO: 3651524 - RNA, 18 nt, Human
ccccacccaagcuuggca

SEQ ID NO: 3651525 - RNA, 20 nt, Human
ccccacccaagcuuggcagc

SEQ ID NO: 3651526 - RNA, 14 nt, Human
ccccacccacuucu

SEQ ID NO: 3651527 - RNA, 16 nt, Human
ccccacccacuucugc

SEQ ID NO: 3651528 - RNA, 18 nt, Human
ccccacccaggccaggca

SEQ ID NO: 3651529 - RNA, 17 nt, Human
ccccaccccaaaauuag

SEQ ID NO: 3651530 - RNA, 14 nt, Human
ccccaccccacacu

SEQ ID NO: 3651531 - RNA, 16 nt, Human
ccccaccccacacuug

SEQ ID NO: 3651532 - RNA, 13 nt, Human
ccccaccccagcc

SEQ ID NO: 3651533 - RNA, 16 nt, Human
ccccaccccagggcag

SEQ ID NO: 3651534 - RNA, 20 nt, Human
ccccacccccagcucaaugg

SEQ ID NO: 3651535 - RNA, 23 nt, Human
ccccacccccuccccaggggaga

SEQ ID NO: 3651536 - RNA, 19 nt, Human
ccccaccccugggggcucu

SEQ ID NO: 3651537 - RNA, 15 nt, Human
ccccaccccuucccc

SEQ ID NO: 3651538 - RNA, 12 nt, Human
ccccacccucau

SEQ ID NO: 3651539 - RNA, 15 nt, Human
ccccacccuccacuc

SEQ ID NO: 3651540 - RNA, 17 nt, Human
ccccacccuccacucag

SEQ ID NO: 3651541 - RNA, 12 nt, Human
ccccacccuccu

SEQ ID NO: 3651542 - RNA, 22 nt, Human
ccccacccucguggacaccugc

SEQ ID NO: 3651543 - RNA, 14 nt, Human
ccccacccuggccu

SEQ ID NO: 3651544 - RNA, 20 nt, Human
ccccacccugggcccugggc

SEQ ID NO: 3651545 - RNA, 20 nt, Human
ccccacccuggugggccaac

SEQ ID NO: 3651546 - RNA, 14 nt, Human
ccccacccuguucc

SEQ ID NO: 3651547 - RNA, 21 nt, Human
ccccacccuguuccugcugcu

SEQ ID NO: 3651548 - RNA, 13 nt, Human
ccccacccuguuu

SEQ ID NO: 3651549 - RNA, 20 nt, Human
ccccacccuguuuggauuuu

SEQ ID NO: 3651550 - RNA, 17 nt, Human
ccccaccgguccagcug

SEQ ID NO: 3651551 - RNA, 22 nt, Human
ccccaccgguccagcuggccug

SEQ ID NO: 3651552 - RNA, 13 nt, Human
ccccaccuccugc

SEQ ID NO: 3651553 - RNA, 17 nt, Human
ccccaccucucccugac

SEQ ID NO: 3651554 - RNA, 12 nt, Human
ccccaccugcag

SEQ ID NO: 3651555 - RNA, 11 nt, Human
ccccaccuggg

SEQ ID NO: 3651556 - RNA, 15 nt, Human
ccccacgagggcugg

SEQ ID NO: 3651557 - RNA, 13 nt, Human
ccccacgccacag

SEQ ID NO: 3651558 - RNA, 14 nt, Human
ccccacgccacagc

SEQ ID NO: 3651559 - RNA, 16 nt, Human
ccccacgccacagccc

SEQ ID NO: 3651560 - RNA, 18 nt, Human
ccccacggccgcuccagg

SEQ ID NO: 3651561 - RNA, 22 nt, Human
ccccacggggccucgggaccuc

SEQ ID NO: 3651562 - RNA, 19 nt, Human
ccccacuacugcagcaccu

SEQ ID NO: 3651563 - RNA, 21 nt, Human
ccccacuacugcagcaccucc

SEQ ID NO: 3651564 - RNA, 13 nt, Human
cagcccacgcuga

SEQ ID NO: 3651565 - RNA, 17 nt, Human
cagcccacgucacgugu

SEQ ID NO: 3651566 - RNA, 18 nt, Human
cagcccacguccugucag

SEQ ID NO: 3651567 - RNA, 16 nt, Human
cagcccacugagaagu

SEQ ID NO: 3651568 - RNA, 19 nt, Human
cagcccagaagaaaauucu

SEQ ID NO: 3651569 - RNA, 17 nt, Human
cagcccagaagugcaga

SEQ ID NO: 3651570 - RNA, 22 nt, Human
cagcccagagacauacuugaag

SEQ ID NO: 3651571 - RNA, 13 nt, Human
cagcccagagacu

SEQ ID NO: 3651572 - RNA, 14 nt, Human
cagcccagagacuu

SEQ ID NO: 3651573 - RNA, 17 nt, Human
cagcccagagacuuugu

SEQ ID NO: 3651574 - RNA, 21 nt, Human
cagcccagagacuuuguagau

SEQ ID NO: 3651575 - RNA, 19 nt, Human
cagcccagauuccccugug

SEQ ID NO: 3651576 - RNA, 22 nt, Human
cagcccagauuccccuguguca

SEQ ID NO: 3651577 - RNA, 15 nt, Human
cagcccagccagcgu

SEQ ID NO: 3651578 - RNA, 19 nt, Human
cagcccagcugcucugccc

SEQ ID NO: 3651579 - RNA, 12 nt, Human
cagcccaggaag

SEQ ID NO: 3651580 - RNA, 23 nt, Human
cagcccaggaagucucaucuggg

SEQ ID NO: 3651581 - RNA, 20 nt, Human
cagcccaggauacuggcaca

SEQ ID NO: 3651582 - RNA, 17 nt, Human
cagcccaggccuccagc

SEQ ID NO: 3651583 - RNA, 17 nt, Human
cagcccaggguuccccc

SEQ ID NO: 3651584 - RNA, 19 nt, Human
cagcccaggguucccccag

SEQ ID NO: 3651585 - RNA, 17 nt, Human
cagcccaucuugccucc

SEQ ID NO: 3651586 - RNA, 15 nt, Human
cagcccaugcccacc

SEQ ID NO: 3651587 - RNA, 19 nt, Human
cagcccaugcccaccugcc

SEQ ID NO: 3651588 - RNA, 20 nt, Human
cagcccauucucucuccugu

SEQ ID NO: 3651589 - RNA, 22 nt, Human
cagcccauucucucuccugucc

SEQ ID NO: 3651590 - RNA, 18 nt, Human
cagcccauuucuccagaa

SEQ ID NO: 3651591 - RNA, 21 nt, Human
cagccccaaaacucuccucug

SEQ ID NO: 3651592 - RNA, 22 nt, Human
cagccccaaaacucuccucugc

SEQ ID NO: 3651593 - RNA, 22 nt, Human
cagccccaaauugucaccugcu

SEQ ID NO: 3651594 - RNA, 15 nt, Human
cagccccacaacuuu

SEQ ID NO: 3651595 - RNA, 14 nt, Human
cagccccacaccag

SEQ ID NO: 3651596 - RNA, 21 nt, Human
cagccccacaccagggccagc

SEQ ID NO: 3651597 - RNA, 12 nt, Human
cagccccacagc

SEQ ID NO: 3651598 - RNA, 16 nt, Human
cagccccacagcccac

SEQ ID NO: 3651599 - RNA, 18 nt, Human
cagccccacagcccacgu

SEQ ID NO: 3651600 - RNA, 20 nt, Human
cagccccacagcccacgucc

SEQ ID NO: 3651601 - RNA, 11 nt, Human
cagccccaccc

SEQ ID NO: 3651602 - RNA, 21 nt, Human
cagccccaccccagggcagcc

SEQ ID NO: 3651603 - RNA, 18 nt, Human
cagccccacccuggccua

SEQ ID NO: 3651604 - RNA, 18 nt, Human
cagccccacuccucugcu

SEQ ID NO: 3651605 - RNA, 18 nt, Human
cagccccacugccagcag

SEQ ID NO: 3651606 - RNA, 19 nt, Human
cagccccacugccagcagc

SEQ ID NO: 3651607 - RNA, 14 nt, Human
cagccccagcccag

SEQ ID NO: 3651608 - RNA, 16 nt, Human
cagccccagcccagcc

SEQ ID NO: 3651609 - RNA, 19 nt, Human
cagccccagccugcuagcu

SEQ ID NO: 3651610 - RNA, 13 nt, Human
cagccccagugcc

SEQ ID NO: 3651611 - RNA, 22 nt, Human
cagccccaucccaaacccuuca

SEQ ID NO: 3651612 - RNA, 13 nt, Human
cagccccauccuc

SEQ ID NO: 3651613 - RNA, 14 nt, Human
cagccccauccucu

SEQ ID NO: 3651614 - RNA, 22 nt, Human
cagccccauccucuguacagag

SEQ ID NO: 3651615 - RNA, 13 nt, Human
cagccccaucugu

SEQ ID NO: 3651616 - RNA, 13 nt, Human
cagccccauucug

SEQ ID NO: 3651617 - RNA, 19 nt, Human
cagccccauucugccugcc

SEQ ID NO: 3651618 - RNA, 22 nt, Human
cagcccccacauccugugccuc

SEQ ID NO: 3651619 - RNA, 19 nt, Human
cagcccccuaaaagcacuc

SEQ ID NO: 3651620 - RNA, 14 nt, Human
cagcccccuccugg

SEQ ID NO: 3651621 - RNA, 22 nt, Human
cagcccccuccuggugccaccu

SEQ ID NO: 3651622 - RNA, 12 nt, Human
cagcccccugac

SEQ ID NO: 3651623 - RNA, 20 nt, Human
cagcccccugaccacucaga

SEQ ID NO: 3651624 - RNA, 22 nt, Human
cagcccccugaccacucagaga

SEQ ID NO: 3651625 - RNA, 22 nt, Human
cagcccccuuugggcccaggga

SEQ ID NO: 3651626 - RNA, 15 nt, Human
cagccccgacuccag

SEQ ID NO: 3651627 - RNA, 19 nt, Human
cagccccgacuccagccag

SEQ ID NO: 3651628 - RNA, 16 nt, Human
cagccccgagcugucc

SEQ ID NO: 3651629 - RNA, 15 nt, Human
cagccccggcccugg

SEQ ID NO: 3651630 - RNA, 16 nt, Human
cagccccggcccuggg

SEQ ID NO: 3651631 - RNA, 19 nt, Human
cagccccggcccugggcuc

SEQ ID NO: 3651632 - RNA, 19 nt, Human
cagccccgguggcugggca

SEQ ID NO: 3651633 - RNA, 16 nt, Human
cagccccuacugcugu

SEQ ID NO: 3651634 - RNA, 24 nt, Human
cagccccuagaaacccaagcuccu

SEQ ID NO: 3651635 - RNA, 12 nt, Human
cagccccuagcc

SEQ ID NO: 3651636 - RNA, 15 nt, Human
cagccccuagcccag

SEQ ID NO: 3651637 - RNA, 12 nt, Human
cccccagcuggc

SEQ ID NO: 3651638 - RNA, 14 nt, Human
cccccagcuuccag

SEQ ID NO: 3651639 - RNA, 18 nt, Human
cccccagcuuugcccaac

SEQ ID NO: 3651640 - RNA, 13 nt, Human
cccccaggaagcc

SEQ ID NO: 3651641 - RNA, 21 nt, Human
cccccaggacaggcugcggcc

SEQ ID NO: 3651642 - RNA, 14 nt, Human
cccccaggaccaga

SEQ ID NO: 3651643 - RNA, 15 nt, Human
cccccaggaccagaa

SEQ ID NO: 3651644 - RNA, 11 nt, Human
cccccaggacu

SEQ ID NO: 3651645 - RNA, 15 nt, Human
cccccaggacugggc

SEQ ID NO: 3651646 - RNA, 16 nt, Human
cccccaggcugcugga

SEQ ID NO: 3651647 - RNA, 11 nt, Human
cccccaggucu

SEQ ID NO: 3651648 - RNA, 20 nt, Human
cccccaguccccaccccugc

SEQ ID NO: 3651649 - RNA, 22 nt, Human
cccccauccccauccuccagcu

SEQ ID NO: 3651650 - RNA, 13 nt, Human
cccccauccuggc

SEQ ID NO: 3651651 - RNA, 15 nt, Human
cccccauccuggccc

SEQ ID NO: 3651652 - RNA, 21 nt, Human
cccccaucuucgggaccagga

SEQ ID NO: 3651653 - RNA, 18 nt, Human
cccccaugcacugugaag

SEQ ID NO: 3651654 - RNA, 19 nt, Human
ccccccaagggaggcugcu

SEQ ID NO: 3651655 - RNA, 13 nt, Human
ccccccacuccca

SEQ ID NO: 3651656 - RNA, 12 nt, Human
ccccccacugca

SEQ ID NO: 3651657 - RNA, 18 nt, Human
ccccccagaaccuguccu

SEQ ID NO: 3651658 - RNA, 14 nt, Human
ccccccagauauca

SEQ ID NO: 3651659 - RNA, 12 nt, Human
ccccccagcacu

SEQ ID NO: 3651660 - RNA, 12 nt, Human
ccccccagcuuc

SEQ ID NO: 3651661 - RNA, 12 nt, Human
cccccccuucca

SEQ ID NO: 3651662 - RNA, 14 nt, Human
ccccccucaccagg

SEQ ID NO: 3651663 - RNA, 12 nt, Human
ccccccuggccu

SEQ ID NO: 3651664 - RNA, 13 nt, Human
ccccccuguacac

SEQ ID NO: 3651665 - RNA, 12 nt, Human
ccccccuuccac

SEQ ID NO: 3651666 - RNA, 15 nt, Human
cccccgcauccccug

SEQ ID NO: 3651667 - RNA, 18 nt, Human
cccccgcauccccugccu

SEQ ID NO: 3651668 - RNA, 18 nt, Human
cccccgcccaggcuggcc

SEQ ID NO: 3651669 - RNA, 12 nt, Human
cccccgcccccu

SEQ ID NO: 3651670 - RNA, 13 nt, Human
cccccgcccccug

SEQ ID NO: 3651671 - RNA, 16 nt, Human
cccccgcccccugccc

SEQ ID NO: 3651672 - RNA, 11 nt, Human
cccccgccccg

SEQ ID NO: 3651673 - RNA, 23 nt, Human
cccccgcuguaaugaaacaccuu

SEQ ID NO: 3651674 - RNA, 20 nt, Human
cccccgggaggggcccgcuu

SEQ ID NO: 3651675 - RNA, 17 nt, Human
cccccguggggcaggga

SEQ ID NO: 3651676 - RNA, 18 nt, Human
cccccucaggacccucgc

SEQ ID NO: 3651677 - RNA, 21 nt, Human
cccccucaucucauucaaacc

SEQ ID NO: 3651678 - RNA, 13 nt, Human
cccccucccaggg

SEQ ID NO: 3651679 - RNA, 19 nt, Human
cccccucccccagccacuc

SEQ ID NO: 3651680 - RNA, 14 nt, Human
cccccuccucuccc

SEQ ID NO: 3651681 - RNA, 22 nt, Human
cccccuccucucccaucccccu

SEQ ID NO: 3651682 - RNA, 13 nt, Human
cccccuccucucu

SEQ ID NO: 3651683 - RNA, 14 nt, Human
cccccuccugcugc

SEQ ID NO: 3651684 - RNA, 22 nt, Human
cccccucgggucuccucacucc

SEQ ID NO: 3651685 - RNA, 18 nt, Human
cccccucgugccagucgc

SEQ ID NO: 3651686 - RNA, 14 nt, Human
cccccucugcccug

SEQ ID NO: 3651687 - RNA, 13 nt, Human
cccccucugccgc

SEQ ID NO: 3651688 - RNA, 12 nt, Human
cccccucuggcu

SEQ ID NO: 3651689 - RNA, 19 nt, Human
cccccucuggcuccagcug

SEQ ID NO: 3651690 - RNA, 21 nt, Human
cccccucuggcuccagcuggc

SEQ ID NO: 3651691 - RNA, 17 nt, Human
cccccugaccacucaga

SEQ ID NO: 3651692 - RNA, 19 nt, Human
cccccugcaaagcccagcu

SEQ ID NO: 3651693 - RNA, 12 nt, Human
cccccugcagga

SEQ ID NO: 3651694 - RNA, 16 nt, Human
cccccugccccccagc

SEQ ID NO: 3651695 - RNA, 16 nt, Human
cccccugcccucgugg

SEQ ID NO: 3651696 - RNA, 14 nt, Human
cccccugcugccau

SEQ ID NO: 3651697 - RNA, 12 nt, Human
cccccugcuggc

SEQ ID NO: 3651698 - RNA, 13 nt, Human
cccccugcuucag

SEQ ID NO: 3651699 - RNA, 18 nt, Human
cccccugcuucagucccu

SEQ ID NO: 3651700 - RNA, 12 nt, Human
cccccuggagag

SEQ ID NO: 3651701 - RNA, 10 nt, Human
cccccugggc

SEQ ID NO: 3651702 - RNA, 11 nt, Human
cccccugggcu

SEQ ID NO: 3651703 - RNA, 15 nt, Human
cccccuggucucugg

SEQ ID NO: 3651704 - RNA, 19 nt, Human
cccccugguggacaguccu

SEQ ID NO: 3651705 - RNA, 12 nt, Human
cccccuguacac

SEQ ID NO: 3651706 - RNA, 14 nt, Human
cccccuucagugcc

SEQ ID NO: 3651707 - RNA, 15 nt, Human
cccccuucucugcuc

SEQ ID NO: 3651708 - RNA, 22 nt, Human
cccccuucucugcuccaccaca

SEQ ID NO: 3651709 - RNA, 14 nt, Human
cccccuucugggca

SEQ ID NO: 3651710 - RNA, 21 nt, Human
cccccuuuagaucucugaagc

SEQ ID NO: 3651711 - RNA, 13 nt, Human
cccagguccucac

SEQ ID NO: 3651712 - RNA, 21 nt, Human
cccaggucucccuggaucaga

SEQ ID NO: 3651713 - RNA, 20 nt, Human
cccaggugaguccuagagcu

SEQ ID NO: 3651714 - RNA, 16 nt, Human
cccaggugccagccug

SEQ ID NO: 3651715 - RNA, 19 nt, Human
cccagguggcugacccagu

SEQ ID NO: 3651716 - RNA, 12 nt, Human
cccaguaaaauu

SEQ ID NO: 3651717 - RNA, 19 nt, Human
cccaguacaccccaccucu

SEQ ID NO: 3651718 - RNA, 21 nt, Human
cccaguaccuagcuggcucug

SEQ ID NO: 3651719 - RNA, 20 nt, Human
cccaguaccuccugucucug

SEQ ID NO: 3651720 - RNA, 15 nt, Human
cccaguaucucuuca

SEQ ID NO: 3651721 - RNA, 16 nt, Human
cccaguaucucuucag

SEQ ID NO: 3651722 - RNA, 23 nt, Human
cccaguauucuagguagugcccu

SEQ ID NO: 3651723 - RNA, 14 nt, Human
cccagucagccucu

SEQ ID NO: 3651724 - RNA, 13 nt, Human
cccagucccagca

SEQ ID NO: 3651725 - RNA, 15 nt, Human
cccagucccagcagc

SEQ ID NO: 3651726 - RNA, 15 nt, Human
cccaguccccacccc

SEQ ID NO: 3651727 - RNA, 14 nt, Human
cccagucccccaac

SEQ ID NO: 3651728 - RNA, 20 nt, Human
cccagucccccaaccccagc

SEQ ID NO: 3651729 - RNA, 22 nt, Human
cccagucccccaaccccagccg

SEQ ID NO: 3651730 - RNA, 23 nt, Human
cccaguccccgugccccgccucc

SEQ ID NO: 3651731 - RNA, 13 nt, Human
cccagucccuggg

SEQ ID NO: 3651732 - RNA, 23 nt, Human
cccagucccugggggaagcccug

SEQ ID NO: 3651733 - RNA, 14 nt, Human
cccaguccuuccac

SEQ ID NO: 3651734 - RNA, 16 nt, Human
cccaguccuuccaccu

SEQ ID NO: 3651735 - RNA, 17 nt, Human
cccagucuacccagaga

SEQ ID NO: 3651736 - RNA, 19 nt, Human
cccagugaaaacuagagcu

SEQ ID NO: 3651737 - RNA, 19 nt, Human
cccagugagcacucccaag

SEQ ID NO: 3651738 - RNA, 15 nt, Human
cccagugcacccacu

SEQ ID NO: 3651739 - RNA, 14 nt, Human
cccagugcauggug

SEQ ID NO: 3651740 - RNA, 21 nt, Human
cccagugcaugguggccagag

SEQ ID NO: 3651741 - RNA, 13 nt, Human
cccagugcccaca

SEQ ID NO: 3651742 - RNA, 15 nt, Human
cccagugcccacagg

SEQ ID NO: 3651743 - RNA, 20 nt, Human
cccagugcccacaggaucag

SEQ ID NO: 3651744 - RNA, 20 nt, Human
cccagugcccccacugacca

SEQ ID NO: 3651745 - RNA, 22 nt, Human
cccagugcccccacugaccaga

SEQ ID NO: 3651746 - RNA, 13 nt, Human
cccaguggcaggg

SEQ ID NO: 3651747 - RNA, 22 nt, Human
cccaguggccacucagcuuccu

SEQ ID NO: 3651748 - RNA, 13 nt, Human
cccaguggccuca

SEQ ID NO: 3651749 - RNA, 18 nt, Human
cccaguggccucaacccu

SEQ ID NO: 3651750 - RNA, 19 nt, Human
cccaguggccucaacccuc

SEQ ID NO: 3651751 - RNA, 14 nt, Human
cccaguggcugcug

SEQ ID NO: 3651752 - RNA, 15 nt, Human
cccaguggcugcugc

SEQ ID NO: 3651753 - RNA, 18 nt, Human
cccaguggcuguucugga

SEQ ID NO: 3651754 - RNA, 16 nt, Human
cccagugggaggcgcg

SEQ ID NO: 3651755 - RNA, 14 nt, Human
cccagugggagggg

SEQ ID NO: 3651756 - RNA, 16 nt, Human
cccagugggaggggca

SEQ ID NO: 3651757 - RNA, 19 nt, Human
cccaguguaugucuuguau

SEQ ID NO: 3651758 - RNA, 18 nt, Human
cccagugucuuccugugg

SEQ ID NO: 3651759 - RNA, 12 nt, Human
cccaguguggcu

SEQ ID NO: 3651760 - RNA, 21 nt, Human
cccaguguuguuuguaaauaa

SEQ ID NO: 3651761 - RNA, 14 nt, Human
cccaguuaaucuug

SEQ ID NO: 3651762 - RNA, 22 nt, Human
cccaguucaacucauggagaug

SEQ ID NO: 3651763 - RNA, 16 nt, Human
cccaguuccuguggcu

SEQ ID NO: 3651764 - RNA, 18 nt, Human
cccaguuccuguggcucc

SEQ ID NO: 3651765 - RNA, 21 nt, Human
cccaguucgccuggagcccuc

SEQ ID NO: 3651766 - RNA, 23 nt, Human
cccaguucucuagggaaggccac

SEQ ID NO: 3651767 - RNA, 21 nt, Human
cccaguucugcuccucuccag

SEQ ID NO: 3651768 - RNA, 22 nt, Human
cccaguucugcuccucuccagg

SEQ ID NO: 3651769 - RNA, 16 nt, Human
cccaguuggagcucca

SEQ ID NO: 3651770 - RNA, 22 nt, Human
cccaguuggagcuccagccuga

SEQ ID NO: 3651771 - RNA, 20 nt, Human
cccaguuucuaaacuggaga

SEQ ID NO: 3651772 - RNA, 20 nt, Human
cccaguuucugccucugagg

SEQ ID NO: 3651773 - RNA, 21 nt, Human
cccaguuuuuugaacauggaa

SEQ ID NO: 3651774 - RNA, 22 nt, Human
cccauaauuuuuuuuuuccuuu

SEQ ID NO: 3651775 - RNA, 15 nt, Human
cccauacucagccug

SEQ ID NO: 3651776 - RNA, 22 nt, Human
cccauacucagccugcugccca

SEQ ID NO: 3651777 - RNA, 18 nt, Human
cccauacucugucucccu

SEQ ID NO: 3651778 - RNA, 21 nt, Human
cccauagaaacaugacacuga

SEQ ID NO: 3651779 - RNA, 23 nt, Human
cccauagaaacaugacacugacc

SEQ ID NO: 3651780 - RNA, 19 nt, Human
cccauaggcccacacacag

SEQ ID NO: 3651781 - RNA, 22 nt, Human
cccauaggcccacacacaggug

SEQ ID NO: 3651782 - RNA, 15 nt, Human
cccauagucccugcc

SEQ ID NO: 3651783 - RNA, 21 nt, Human
cccauaugcuaccaccagcug

SEQ ID NO: 3651784 - RNA, 18 nt, Human
cccauauuguaaaacagg

SEQ ID NO: 3651785 - RNA, 21 nt, Human
cccaucaccuacucacacagg

SEQ ID NO: 3651786 - RNA, 23 nt, Human
cccaucaccuacucacacaggca

SEQ ID NO: 3651787 - RNA, 20 nt, Human
cccaucacguguacuggcuc

SEQ ID NO: 3651788 - RNA, 13 nt, Human
cccaucacuggag

SEQ ID NO: 3651789 - RNA, 17 nt, Human
cccaucaggacucuugu

SEQ ID NO: 3651790 - RNA, 19 nt, Human
cccaucaggacucuuguga

SEQ ID NO: 3651791 - RNA, 20 nt, Human
cccaucaguguacccccgcc

SEQ ID NO: 3651792 - RNA, 22 nt, Human
cccaucaugcccggucccaccc

SEQ ID NO: 3651793 - RNA, 14 nt, Human
cccaucauguggcc

SEQ ID NO: 3651794 - RNA, 20 nt, Human
cccaucauucaugcuacugc

SEQ ID NO: 3651795 - RNA, 22 nt, Human
cccauccaccguccccucccag

SEQ ID NO: 3651796 - RNA, 14 nt, Human
cccauccaguucau

SEQ ID NO: 3651797 - RNA, 15 nt, Human
cccauccauuaggcc

SEQ ID NO: 3651798 - RNA, 15 nt, Human
cccaucccacacccu

SEQ ID NO: 3651799 - RNA, 12 nt, Human
cccaucccaucc

SEQ ID NO: 3651800 - RNA, 12 nt, Human
cccauccccccu

SEQ ID NO: 3651801 - RNA, 15 nt, Human
cccaucccccugccc

SEQ ID NO: 3651802 - RNA, 21 nt, Human
cccauccccuggacugggagg

SEQ ID NO: 3651803 - RNA, 14 nt, Human
cccaucccugccug

SEQ ID NO: 3651804 - RNA, 15 nt, Human
cccaucccugccugg

SEQ ID NO: 3651805 - RNA, 17 nt, Human
cccaucccugccugguc

SEQ ID NO: 3651806 - RNA, 13 nt, Human
cccaucccugucu

SEQ ID NO: 3651807 - RNA, 14 nt, Human
cccauccuacccuc

SEQ ID NO: 3651808 - RNA, 14 nt, Human
cccauccuccagca

SEQ ID NO: 3651809 - RNA, 15 nt, Human
cccauccuccagcag

SEQ ID NO: 3651810 - RNA, 16 nt, Human
cccauccuccagcagg

SEQ ID NO: 3651811 - RNA, 14 nt, Human
cccauccuccagcu

SEQ ID NO: 3651812 - RNA, 17 nt, Human
cccauccuccagcuucu

SEQ ID NO: 3651813 - RNA, 19 nt, Human
cccauccuccagcuucugg

SEQ ID NO: 3651814 - RNA, 15 nt, Human
cccauccucuguaca

SEQ ID NO: 3651815 - RNA, 19 nt, Human
cccauccucuguacagagc

SEQ ID NO: 3651816 - RNA, 13 nt, Human
cccauccuggccc

SEQ ID NO: 3651817 - RNA, 18 nt, Human
cccauccuggcccaucag

SEQ ID NO: 3651818 - RNA, 17 nt, Human
cccaucgccacaaacuc

SEQ ID NO: 3651819 - RNA, 21 nt, Human
cccaucgccagcugaugacuc

SEQ ID NO: 3651820 - RNA, 23 nt, Human
cccaucgccagcugaugacucaa

SEQ ID NO: 3651821 - RNA, 18 nt, Human
cccaucgugaagaagccu

SEQ ID NO: 3651822 - RNA, 18 nt, Human
cccaucuaagcugcagcu

SEQ ID NO: 3651823 - RNA, 21 nt, Human
cccaucuaagcugcagcuucc

SEQ ID NO: 3651824 - RNA, 22 nt, Human
cccaucuaagcugcagcuuccu

SEQ ID NO: 3651825 - RNA, 21 nt, Human
cccaucuaugucccuugcugu

SEQ ID NO: 3651826 - RNA, 11 nt, Human
cccaucucagg

SEQ ID NO: 3651827 - RNA, 21 nt, Human
cccaucucaugccccuggcug

SEQ ID NO: 3651828 - RNA, 23 nt, Human
cccaucucccacccuguaccuca

SEQ ID NO: 3651829 - RNA, 13 nt, Human
cccaucucccccu

SEQ ID NO: 3651830 - RNA, 14 nt, Human
cccaucucccugcc

SEQ ID NO: 3651831 - RNA, 15 nt, Human
cccaucucccugccu

SEQ ID NO: 3651832 - RNA, 15 nt, Human
cccaucucccugcuu

SEQ ID NO: 3651833 - RNA, 18 nt, Human
cccaucucggagcauccc

SEQ ID NO: 3651834 - RNA, 18 nt, Human
cccaucucuuccuaccca

SEQ ID NO: 3651835 - RNA, 14 nt, Human
cccaucucuucugg

SEQ ID NO: 3651836 - RNA, 16 nt, Human
cccaucugucggccua

SEQ ID NO: 3651837 - RNA, 14 nt, Human
cccaucugucuaaa

SEQ ID NO: 3651838 - RNA, 20 nt, Human
cccaucugugaaaggaaaga

SEQ ID NO: 3651839 - RNA, 17 nt, Human
cccaucuucgggaccag

SEQ ID NO: 3651840 - RNA, 21 nt, Human
cccaucuucgggaccaggauu

SEQ ID NO: 3651841 - RNA, 16 nt, Human
cccaugaagccacagc

SEQ ID NO: 3651842 - RNA, 12 nt, Human
cccaugaagccu

SEQ ID NO: 3651843 - RNA, 14 nt, Human
cccuccuggggcca

SEQ ID NO: 3651844 - RNA, 17 nt, Human
cccuccuggugccaccu

SEQ ID NO: 3651845 - RNA, 20 nt, Human
cccuccuggugucaccccag

SEQ ID NO: 3651846 - RNA, 23 nt, Human
cccuccuggugucaccccagagc

SEQ ID NO: 3651847 - RNA, 12 nt, Human
cccuccugucuu

SEQ ID NO: 3651848 - RNA, 14 nt, Human
cccuccugucuucc

SEQ ID NO: 3651849 - RNA, 15 nt, Human
cccuccugucuuccc

SEQ ID NO: 3651850 - RNA, 23 nt, Human
cccuccugugcugggggaaugag

SEQ ID NO: 3651851 - RNA, 13 nt, Human
cccuccuucccaa

SEQ ID NO: 3651852 - RNA, 11 nt, Human
cccuccuuccu

SEQ ID NO: 3651853 - RNA, 18 nt, Human
cccuccuuccuugaccag

SEQ ID NO: 3651854 - RNA, 18 nt, Human
cccuccuugccuccugug

SEQ ID NO: 3651855 - RNA, 18 nt, Human
cagcucucaucugaggca

SEQ ID NO: 3651856 - RNA, 15 nt, Human
cagcucucaugcugc

SEQ ID NO: 3651857 - RNA, 11 nt, Human
cagcucuccag

SEQ ID NO: 3651858 - RNA, 12 nt, Human
cagcucuccccu

SEQ ID NO: 3651859 - RNA, 20 nt, Human
ccccaccccugggggcucuc

SEQ ID NO: 3651860 - RNA, 18 nt, Human
ccccaccccuuccccacu

SEQ ID NO: 3651861 - RNA, 22 nt, Human
ccccaccccuuccccacugccu

SEQ ID NO: 3651862 - RNA, 13 nt, Human
ccccaccccuugc

SEQ ID NO: 3651863 - RNA, 18 nt, Human
ccccacccucccuggagu

SEQ ID NO: 3651864 - RNA, 15 nt, Human
ccccacccuccuggc

SEQ ID NO: 3651865 - RNA, 22 nt, Human
ccccacccuccuggccucagac

SEQ ID NO: 3651866 - RNA, 21 nt, Human
ccccacccucggggauguguc

SEQ ID NO: 3651867 - RNA, 21 nt, Human
ccccacccucguggacaccug

SEQ ID NO: 3651868 - RNA, 14 nt, Human
ccccacccugggcu

SEQ ID NO: 3651869 - RNA, 16 nt, Human
ccccacccugggcucu

SEQ ID NO: 3651870 - RNA, 20 nt, Human
ccccacccugggcucuggga

SEQ ID NO: 3651871 - RNA, 19 nt, Human
ccccacccuguuccugcug

SEQ ID NO: 3651872 - RNA, 19 nt, Human
ccccaccgcagacaggacc

SEQ ID NO: 3651873 - RNA, 22 nt, Human
ccccaccguugucucaugccag

SEQ ID NO: 3651874 - RNA, 12 nt, Human
ccccaccucucc

SEQ ID NO: 3651875 - RNA, 12 nt, Human
ccccaccugcca

SEQ ID NO: 3651876 - RNA, 14 nt, Human
ccccaccugccacu

SEQ ID NO: 3651877 - RNA, 22 nt, Human
ccccaccugccacuaggcuggg

SEQ ID NO: 3651878 - RNA, 11 nt, Human
ccccaccugcg

SEQ ID NO: 3651879 - RNA, 17 nt, Human
ccccaccugcgcuucac

SEQ ID NO: 3651880 - RNA, 14 nt, Human
ccccaccuggcuca

SEQ ID NO: 3651881 - RNA, 14 nt, Human
ccccacgagggcug

SEQ ID NO: 3651882 - RNA, 16 nt, Human
ccccacgagggcuggc

SEQ ID NO: 3651883 - RNA, 22 nt, Human
ccccacggccgcuccaggggug

SEQ ID NO: 3651884 - RNA, 21 nt, Human
ccccacggggccucgggaccu

SEQ ID NO: 3651885 - RNA, 21 nt, Human
ccccacucacagagacacagg

SEQ ID NO: 3651886 - RNA, 18 nt, Human
ccccacucaccagugucc

SEQ ID NO: 3651887 - RNA, 14 nt, Human
ccccacucccucac

SEQ ID NO: 3651888 - RNA, 23 nt, Human
ccccacucccuggcucucagaag

SEQ ID NO: 3651889 - RNA, 12 nt, Human
ccccacuccucu

SEQ ID NO: 3651890 - RNA, 12 nt, Human
ccccacucuccc

SEQ ID NO: 3651891 - RNA, 12 nt, Human
ccccacucugcu

SEQ ID NO: 3651892 - RNA, 13 nt, Human
ccccacucugcuc

SEQ ID NO: 3651893 - RNA, 19 nt, Human
ccccacucugcucugaugc

SEQ ID NO: 3651894 - RNA, 15 nt, Human
ccccacugaugcugu

SEQ ID NO: 3651895 - RNA, 16 nt, Human
ccccacugccuacugc

SEQ ID NO: 3651896 - RNA, 17 nt, Human
ccccacugccugcccac

SEQ ID NO: 3651897 - RNA, 20 nt, Human
ccccacuggacugaccuggu

SEQ ID NO: 3651898 - RNA, 13 nt, Human
ccccacuggagca

SEQ ID NO: 3651899 - RNA, 14 nt, Human
ccccacuggagcag

SEQ ID NO: 3651900 - RNA, 12 nt, Human
ccccacuggcug

SEQ ID NO: 3651901 - RNA, 20 nt, Human
ccccacuggcugugggcucc

SEQ ID NO: 3651902 - RNA, 12 nt, Human
ccccacugguga

SEQ ID NO: 3651903 - RNA, 21 nt, Human
ccccacuugccucuuccuuga

SEQ ID NO: 3651904 - RNA, 20 nt, Human
ccccagaaccuguccuugca

SEQ ID NO: 3651905 - RNA, 17 nt, Human
ccccagaacucugccug

SEQ ID NO: 3651906 - RNA, 16 nt, Human
ccccagaaggcaggga

SEQ ID NO: 3651907 - RNA, 18 nt, Human
ccccagacaccgccacau

SEQ ID NO: 3651908 - RNA, 13 nt, Human
ccccagacacugg

SEQ ID NO: 3651909 - RNA, 15 nt, Human
ccccagaccugagcu

SEQ ID NO: 3651910 - RNA, 19 nt, Human
ccccagaccugagcucccc

SEQ ID NO: 3651911 - RNA, 15 nt, Human
ccccagacuagaugu

SEQ ID NO: 3651912 - RNA, 20 nt, Human
ccccagacuccaccaagccu

SEQ ID NO: 3651913 - RNA, 21 nt, Human
ccccagacuccaccaagccug

SEQ ID NO: 3651914 - RNA, 14 nt, Human
ccccagagccacac

SEQ ID NO: 3651915 - RNA, 18 nt, Human
ccccagagccacacaugg

SEQ ID NO: 3651916 - RNA, 12 nt, Human
ccccagagcugu

SEQ ID NO: 3651917 - RNA, 21 nt, Human
ccccagagcuguuuauggccu

SEQ ID NO: 3651918 - RNA, 17 nt, Human
ccccagaggcuggguga

SEQ ID NO: 3651919 - RNA, 15 nt, Human
ccccagauaccagcc

SEQ ID NO: 3651920 - RNA, 18 nt, Human
ccccagauaccagccccu

SEQ ID NO: 3651921 - RNA, 11 nt, Human
ccccagauauc

SEQ ID NO: 3651922 - RNA, 20 nt, Human
ccccagauugcaacaggcug

SEQ ID NO: 3651923 - RNA, 22 nt, Human
ccccagauugcaacaggcuggg

SEQ ID NO: 3651924 - RNA, 23 nt, Human
ccccagauugcaacaggcugggc

SEQ ID NO: 3651925 - RNA, 17 nt, Human
ccccagcaagugagagc

SEQ ID NO: 3651926 - RNA, 22 nt, Human
ccccagcaagugguccuagagg

SEQ ID NO: 3651927 - RNA, 16 nt, Human
ccccagcacugaggaa

SEQ ID NO: 3651928 - RNA, 12 nt, Human
ccccagccacuc

SEQ ID NO: 3651929 - RNA, 16 nt, Human
ccccagccagccuggc

SEQ ID NO: 3651930 - RNA, 20 nt, Human
ccccagccaugccagcuggc

SEQ ID NO: 3651931 - RNA, 13 nt, Human
ccccagcccaagu

SEQ ID NO: 3651932 - RNA, 14 nt, Human
ccccagcccaaguc

SEQ ID NO: 3651933 - RNA, 19 nt, Human
ccccagcccacccuccugu

SEQ ID NO: 3651934 - RNA, 22 nt, Human
ccccagcccacccuccugucuu

SEQ ID NO: 3651935 - RNA, 11 nt, Human
ccccagcccag

SEQ ID NO: 3651936 - RNA, 12 nt, Human
ccccagcccaga

SEQ ID NO: 3651937 - RNA, 17 nt, Human
ccccagcccagcccagc

SEQ ID NO: 3651938 - RNA, 14 nt, Human
ccccagcccagggc

SEQ ID NO: 3651939 - RNA, 20 nt, Human
ccccagcccagggcuccugc

SEQ ID NO: 3651940 - RNA, 21 nt, Human
ccccagcccagggcuccugca

SEQ ID NO: 3651941 - RNA, 23 nt, Human
ccccagcccauccauuaggccag

SEQ ID NO: 3651942 - RNA, 12 nt, Human
ccccagccccaa

SEQ ID NO: 3651943 - RNA, 14 nt, Human
ccccagccccaaaa

SEQ ID NO: 3651944 - RNA, 17 nt, Human
ccccagccccgacucca

SEQ ID NO: 3651945 - RNA, 15 nt, Human
ccccagccccuagcc

SEQ ID NO: 3651946 - RNA, 18 nt, Human
ccccagccccuagcccag

SEQ ID NO: 3651947 - RNA, 20 nt, Human
ccccagccccuagcccagga

SEQ ID NO: 3651948 - RNA, 22 nt, Human
ccccagccccuagcccaggaga

SEQ ID NO: 3651949 - RNA, 20 nt, Human
ccccagccccucccccaucu

SEQ ID NO: 3651950 - RNA, 14 nt, Human
ccccagcccugcug

SEQ ID NO: 3651951 - RNA, 12 nt, Human
ccccagcccugu

SEQ ID NO: 3651952 - RNA, 14 nt, Human
ccccagcccugugg

SEQ ID NO: 3651953 - RNA, 15 nt, Human
ccccagcccugugga

SEQ ID NO: 3651954 - RNA, 18 nt, Human
ccccagcccuuccucugc

SEQ ID NO: 3651955 - RNA, 22 nt, Human
ccccagccuaugagcauccuga

SEQ ID NO: 3651956 - RNA, 22 nt, Human
ccccagccucaaauccaggacc

SEQ ID NO: 3651957 - RNA, 15 nt, Human
ccccagccucccuga

SEQ ID NO: 3651958 - RNA, 11 nt, Human
ccccagccugg

SEQ ID NO: 3651959 - RNA, 21 nt, Human
ccccagccuggccacgcagcc

SEQ ID NO: 3651960 - RNA, 15 nt, Human
ccccagccuggccca

SEQ ID NO: 3651961 - RNA, 16 nt, Human
ccccagccuggcccag

SEQ ID NO: 3651962 - RNA, 17 nt, Human
ccccagccuggcccagc

SEQ ID NO: 3651963 - RNA, 21 nt, Human
ccccagccugggcccaucucc

SEQ ID NO: 3651964 - RNA, 18 nt, Human
ccccagcgucccagucuc

SEQ ID NO: 3651965 - RNA, 23 nt, Human
ccccagcgucccagucucuggca

SEQ ID NO: 3651966 - RNA, 14 nt, Human
ccccagcucaaugg

SEQ ID NO: 3651967 - RNA, 10 nt, Human
ccccagcucc

SEQ ID NO: 3651968 - RNA, 10 nt, Human
ccccagcuga

SEQ ID NO: 3651969 - RNA, 13 nt, Human
ccccagcuggccc

SEQ ID NO: 3651970 - RNA, 21 nt, Human
ccccagcuggcccgugacaga

SEQ ID NO: 3651971 - RNA, 21 nt, Human
ccccagcugggaggcaagagg

SEQ ID NO: 3651972 - RNA, 22 nt, Human
ccccagcugucaucaauuaaag

SEQ ID NO: 3651973 - RNA, 23 nt, Human
ccccagcugucaucaauuaaagg

SEQ ID NO: 3651974 - RNA, 15 nt, Human
ccccagcugugagcc

SEQ ID NO: 3651975 - RNA, 16 nt, Human
ccccagcuuccagcag

SEQ ID NO: 3651976 - RNA, 21 nt, Human
ccccagcuucucagcucgcug

SEQ ID NO: 3651977 - RNA, 13 nt, Human
ccccagcuuugcc

SEQ ID NO: 3651978 - RNA, 20 nt, Human
ccccaggaauuugggacccu

SEQ ID NO: 3651979 - RNA, 18 nt, Human
ccccaggaccagaagcuc

SEQ ID NO: 3651980 - RNA, 20 nt, Human
ccccaggaccagaagcuccc

SEQ ID NO: 3651981 - RNA, 13 nt, Human
ccccaggaccagc

SEQ ID NO: 3651982 - RNA, 21 nt, Human
ccccaggaccagcucaggaca

SEQ ID NO: 3651983 - RNA, 15 nt, Human
ccccaggaccuggcu

SEQ ID NO: 3651984 - RNA, 12 nt, Human
ccccaggaggcc

SEQ ID NO: 3651985 - RNA, 15 nt, Human
ccccaggaggccagc

SEQ ID NO: 3651986 - RNA, 17 nt, Human
ccccaggaggccagccu

SEQ ID NO: 3651987 - RNA, 18 nt, Human
ccccaggagggaggcagg

SEQ ID NO: 3651988 - RNA, 19 nt, Human
ccccaggagggaggcaggg

SEQ ID NO: 3651989 - RNA, 18 nt, Human
ccccaggcaggcugugcg

SEQ ID NO: 3651990 - RNA, 23 nt, Human
ccccaggcaggcugugcgcugac

SEQ ID NO: 3651991 - RNA, 22 nt, Human
ccccaggcccacucagggguca

SEQ ID NO: 3651992 - RNA, 11 nt, Human
ccccaggcccc

SEQ ID NO: 3651993 - RNA, 12 nt, Human
ccccaggccccg

SEQ ID NO: 3651994 - RNA, 15 nt, Human
ccccaggccucugug

SEQ ID NO: 3651995 - RNA, 21 nt, Human
ccccaggccugaaagaggcug

SEQ ID NO: 3651996 - RNA, 18 nt, Human
ccccagggaagcagcagc

SEQ ID NO: 3651997 - RNA, 12 nt, Human
ccccagggagag

SEQ ID NO: 3651998 - RNA, 21 nt, Human
ccccagggcacuucacagagu

SEQ ID NO: 3651999 - RNA, 14 nt, Human
ccccagggccugag

SEQ ID NO: 3652000 - RNA, 16 nt, Human
ccccagggccugagcc

SEQ ID NO: 3652001 - RNA, 21 nt, Human
cccucaaggccucccacagug

SEQ ID NO: 3652002 - RNA, 23 nt, Human
cccucaagucuuucucuuucccu

SEQ ID NO: 3652003 - RNA, 10 nt, Human
cccucacacu

SEQ ID NO: 3652004 - RNA, 13 nt, Human
cccucacagccuc

SEQ ID NO: 3652005 - RNA, 16 nt, Human
cccucacagccucuga

SEQ ID NO: 3652006 - RNA, 18 nt, Human
cccucacagccucugacc

SEQ ID NO: 3652007 - RNA, 12 nt, Human
cccucaccaaca

SEQ ID NO: 3652008 - RNA, 17 nt, Human
cccucacccauccuaga

SEQ ID NO: 3652009 - RNA, 22 nt, Human
cccucacccugagccccuuccu

SEQ ID NO: 3652010 - RNA, 13 nt, Human
cccucacccugcc

SEQ ID NO: 3652011 - RNA, 15 nt, Human
cccucacccuggggc

SEQ ID NO: 3652012 - RNA, 21 nt, Human
cccucaccuguagcagccagu

SEQ ID NO: 3652013 - RNA, 13 nt, Human
cccucacucugcc

SEQ ID NO: 3652014 - RNA, 14 nt, Human
cccucacuggauga

SEQ ID NO: 3652015 - RNA, 21 nt, Human
cccucagaacccuuggcuugc

SEQ ID NO: 3652016 - RNA, 23 nt, Human
cccucagaacccuuggcuugccc

SEQ ID NO: 3652017 - RNA, 15 nt, Human
cccucagacuggggc

SEQ ID NO: 3652018 - RNA, 14 nt, Human
cccucagcaccccu

SEQ ID NO: 3652019 - RNA, 15 nt, Human
cccucagcaccccuu

SEQ ID NO: 3652020 - RNA, 17 nt, Human
cccucagcaccccuucc

SEQ ID NO: 3652021 - RNA, 19 nt, Human
cccucagccccaccccagg

SEQ ID NO: 3652022 - RNA, 12 nt, Human
cccucagccccu

SEQ ID NO: 3652023 - RNA, 14 nt, Human
cccucagccccucu

SEQ ID NO: 3652024 - RNA, 21 nt, Human
cccucagccccucuugccccc

SEQ ID NO: 3652025 - RNA, 23 nt, Human
cccucagccucuccccugccugc

SEQ ID NO: 3652026 - RNA, 12 nt, Human
cccucagcucca

SEQ ID NO: 3652027 - RNA, 15 nt, Human
cccucaggacccucg

SEQ ID NO: 3652028 - RNA, 17 nt, Human
cccucaggacccucgcu

SEQ ID NO: 3652029 - RNA, 18 nt, Human
cccucaggacccucgcug

SEQ ID NO: 3652030 - RNA, 20 nt, Human
cccucaggacccucgcuggc

SEQ ID NO: 3652031 - RNA, 18 nt, Human
cccucaggcauaggccug

SEQ ID NO: 3652032 - RNA, 10 nt, Human
cccucagggc

SEQ ID NO: 3652033 - RNA, 20 nt, Human
cccucagggcaaagccaggu

SEQ ID NO: 3652034 - RNA, 21 nt, Human
cccucagggucccugguggca

SEQ ID NO: 3652035 - RNA, 22 nt, Human
cccucaucaccaacgucugugc

SEQ ID NO: 3652036 - RNA, 17 nt, Human
cccucauccucauaccc

SEQ ID NO: 3652037 - RNA, 21 nt, Human
cccucaucgcguccuccuacc

SEQ ID NO: 3652038 - RNA, 14 nt, Human
cccucaucugucug

SEQ ID NO: 3652039 - RNA, 23 nt, Human
cccucaucuugaagggcccagga

SEQ ID NO: 3652040 - RNA, 14 nt, Human
cccucaugccaacc

SEQ ID NO: 3652041 - RNA, 21 nt, Human
cccucauggccccucugaccu

SEQ ID NO: 3652042 - RNA, 16 nt, Human
cccucauuucaggagc

SEQ ID NO: 3652043 - RNA, 17 nt, Human
cccuccaaaagcacuua

SEQ ID NO: 3652044 - RNA, 10 nt, Human
cccuccaagg

SEQ ID NO: 3652045 - RNA, 16 nt, Human
cccuccaauccugccc

SEQ ID NO: 3652046 - RNA, 15 nt, Human
cccuccacaccugcg

SEQ ID NO: 3652047 - RNA, 22 nt, Human
cccuccacccugucccccagcu

SEQ ID NO: 3652048 - RNA, 18 nt, Human
cccuccaccgcagaagga

SEQ ID NO: 3652049 - RNA, 15 nt, Human
cccuccaccucccug

SEQ ID NO: 3652050 - RNA, 15 nt, Human
cccuccaccuuccau

SEQ ID NO: 3652051 - RNA, 12 nt, Human
cccuccacuguc

SEQ ID NO: 3652052 - RNA, 18 nt, Human
cccuccagaaccaccccg

SEQ ID NO: 3652053 - RNA, 13 nt, Human
cccuccagagccc

SEQ ID NO: 3652054 - RNA, 18 nt, Human
cccuccagagccccacag

SEQ ID NO: 3652055 - RNA, 21 nt, Human
cccuccagagccccacagccc

SEQ ID NO: 3652056 - RNA, 15 nt, Human
cccuccagcucccug

SEQ ID NO: 3652057 - RNA, 15 nt, Human
cccuccagcuugugg

SEQ ID NO: 3652058 - RNA, 15 nt, Human
cccuccaucccgaca

SEQ ID NO: 3652059 - RNA, 12 nt, Human
cccuccaucccu

SEQ ID NO: 3652060 - RNA, 13 nt, Human
cccuccaucccug

SEQ ID NO: 3652061 - RNA, 17 nt, Human
cccuccaucccuggccc

SEQ ID NO: 3652062 - RNA, 15 nt, Human
cccucccaagcuggc

SEQ ID NO: 3652063 - RNA, 12 nt, Human
cccucccacaca

SEQ ID NO: 3652064 - RNA, 13 nt, Human
cccucccacacac

SEQ ID NO: 3652065 - RNA, 14 nt, Human
cccucccacagcgc

SEQ ID NO: 3652066 - RNA, 17 nt, Human
cccucccaccacagcag

SEQ ID NO: 3652067 - RNA, 12 nt, Human
cccucccaccca

SEQ ID NO: 3652068 - RNA, 12 nt, Human
caggagcucuuc

SEQ ID NO: 3652069 - RNA, 15 nt, Human
caggagcucuucagg

SEQ ID NO: 3652070 - RNA, 22 nt, Human
caggagcucuucaggccucccu

SEQ ID NO: 3652071 - RNA, 23 nt, Human
caggagcucuucaggccucccuc

SEQ ID NO: 3652072 - RNA, 14 nt, Human
caggagcugggauc

SEQ ID NO: 3652073 - RNA, 22 nt, Human
caggagcugucaccaaggaaac

SEQ ID NO: 3652074 - RNA, 17 nt, Human
caggagcuuuggaccua

SEQ ID NO: 3652075 - RNA, 13 nt, Human
caggaggaagggg

SEQ ID NO: 3652076 - RNA, 16 nt, Human
caggaggaauacugaa

SEQ ID NO: 3652077 - RNA, 13 nt, Human
caggaggacaauu

SEQ ID NO: 3652078 - RNA, 19 nt, Human
caggaggacaauucaugaa

SEQ ID NO: 3652079 - RNA, 22 nt, Human
caggaggacaauucaugaacuu

SEQ ID NO: 3652080 - RNA, 18 nt, Human
caggaggacccagggcuc

SEQ ID NO: 3652081 - RNA, 19 nt, Human
caggaggacccagggcucu

SEQ ID NO: 3652082 - RNA, 19 nt, Human
caggaggacugccccgugc

SEQ ID NO: 3652083 - RNA, 23 nt, Human
caggaggagacuagauuuaugaa

SEQ ID NO: 3652084 - RNA, 19 nt, Human
caggaggaggugccaacag

SEQ ID NO: 3652085 - RNA, 19 nt, Human
caggaggaucacuugaguc

SEQ ID NO: 3652086 - RNA, 20 nt, Human
caggaggcagagguugcagu

SEQ ID NO: 3652087 - RNA, 18 nt, Human
caggaggcaggcauggcc

SEQ ID NO: 3652088 - RNA, 23 nt, Human
caggaggcagggaggcagccgcc

SEQ ID NO: 3652089 - RNA, 18 nt, Human
caggaggccagccuugac

SEQ ID NO: 3652090 - RNA, 22 nt, Human
caggaggccagccuugaccauu

SEQ ID NO: 3652091 - RNA, 17 nt, Human
caggaggccccuggccc

SEQ ID NO: 3652092 - RNA, 18 nt, Human
caggaggccccuggccca

SEQ ID NO: 3652093 - RNA, 17 nt, Human
caggaggcgcccuuggc

SEQ ID NO: 3652094 - RNA, 18 nt, Human
caggaggcugaggcagga

SEQ ID NO: 3652095 - RNA, 21 nt, Human
caggaggcugaggcaggagga

SEQ ID NO: 3652096 - RNA, 15 nt, Human
caggaggcugagggg

SEQ ID NO: 3652097 - RNA, 14 nt, Human
caggaggcugaggu

SEQ ID NO: 3652098 - RNA, 15 nt, Human
caggaggcuggagga

SEQ ID NO: 3652099 - RNA, 22 nt, Human
caggaggcugggacgcucugcu

SEQ ID NO: 3652100 - RNA, 16 nt, Human
caggagggacaaagga

SEQ ID NO: 3652101 - RNA, 20 nt, Human
caggagggacaaaggagccu

SEQ ID NO: 3652102 - RNA, 12 nt, Human
caggagggacag

SEQ ID NO: 3652103 - RNA, 17 nt, Human
caggagggacagucuca

SEQ ID NO: 3652104 - RNA, 11 nt, Human
caggagggagg

SEQ ID NO: 3652105 - RNA, 12 nt, Human
caggagggaggu

SEQ ID NO: 3652106 - RNA, 23 nt, Human
caggagggagguuugugagagcg

SEQ ID NO: 3652107 - RNA, 16 nt, Human
caggaggggaaacauc

SEQ ID NO: 3652108 - RNA, 13 nt, Human
caggaggggagug

SEQ ID NO: 3652109 - RNA, 15 nt, Human
caggaggggggaggg

SEQ ID NO: 3652110 - RNA, 21 nt, Human
caggagggggucguggagagc

SEQ ID NO: 3652111 - RNA, 17 nt, Human
caggaggugccacugga

SEQ ID NO: 3652112 - RNA, 20 nt, Human
caggagguggaggcugcagu

SEQ ID NO: 3652113 - RNA, 20 nt, Human
caggagguggagguugcagu

SEQ ID NO: 3652114 - RNA, 18 nt, Human
caggaguagcugagcuca

SEQ ID NO: 3652115 - RNA, 14 nt, Human
caggaguccacuuu

SEQ ID NO: 3652116 - RNA, 18 nt, Human
caggaguccacuuuguuu

SEQ ID NO: 3652117 - RNA, 15 nt, Human
caggagucccaagga

SEQ ID NO: 3652118 - RNA, 19 nt, Human
caggagucccaaggaaagc

SEQ ID NO: 3652119 - RNA, 15 nt, Human
caggagucccuggua

SEQ ID NO: 3652120 - RNA, 22 nt, Human
caggagugggaaaacacugcca

SEQ ID NO: 3652121 - RNA, 17 nt, Human
caggaguggguggggag

SEQ ID NO: 3652122 - RNA, 20 nt, Human
caggaguggugcagacagaa

SEQ ID NO: 3652123 - RNA, 21 nt, Human
caggaguguccucuucccucu

SEQ ID NO: 3652124 - RNA, 19 nt, Human
caggaguuaaaaagggcag

SEQ ID NO: 3652125 - RNA, 16 nt, Human
caggaguuagaggcca

SEQ ID NO: 3652126 - RNA, 18 nt, Human
caggaguuagaggccagc

SEQ ID NO: 3652127 - RNA, 22 nt, Human
caggaguuagaggccagccugg

SEQ ID NO: 3652128 - RNA, 23 nt, Human
caggaguucaauaaaugucuguu

SEQ ID NO: 3652129 - RNA, 23 nt, Human
caggaguucgagaccagccuggg

SEQ ID NO: 3652130 - RNA, 14 nt, Human
caggaguucugcuc

SEQ ID NO: 3652131 - RNA, 16 nt, Human
caggaguucugcucau

SEQ ID NO: 3652132 - RNA, 22 nt, Human
caggaguuugagaccaaccugg

SEQ ID NO: 3652133 - RNA, 23 nt, Human
caggaguuugagaccaaccuggg

SEQ ID NO: 3652134 - RNA, 18 nt, Human
caggaguuugaggcugca

SEQ ID NO: 3652135 - RNA, 20 nt, Human
caggaguuugaggcugcagc

SEQ ID NO: 3652136 - RNA, 15 nt, Human
caggaguuuggccag

SEQ ID NO: 3652137 - RNA, 20 nt, Human
caggauacucugucagaugg

SEQ ID NO: 3652138 - RNA, 23 nt, Human
caggauacucugucagaugggaa

SEQ ID NO: 3652139 - RNA, 17 nt, Human
caggauacuggcacaga

SEQ ID NO: 3652140 - RNA, 19 nt, Human
caggauacuggcacagagg

SEQ ID NO: 3652141 - RNA, 16 nt, Human
caggauauauuuuauu

SEQ ID NO: 3652142 - RNA, 20 nt, Human
caggauauccuuaucagagc

SEQ ID NO: 3652143 - RNA, 18 nt, Human
caggaucaagcaugaaag

SEQ ID NO: 3652144 - RNA, 20 nt, Human
caggaucagauugcauguga

SEQ ID NO: 3652145 - RNA, 23 nt, Human
caggaucagauugcaugugacuc

SEQ ID NO: 3652146 - RNA, 21 nt, Human
ccgcagaccuccccagccccu

SEQ ID NO: 3652147 - RNA, 15 nt, Human
ccgcagaccucugga

SEQ ID NO: 3652148 - RNA, 13 nt, Human
ccgcagagcuggc

SEQ ID NO: 3652149 - RNA, 15 nt, Human
ccgcagagcuggccg

SEQ ID NO: 3652150 - RNA, 15 nt, Human
ccgcagcccccaccc

SEQ ID NO: 3652151 - RNA, 14 nt, Human
ccgcagcccugcag

SEQ ID NO: 3652152 - RNA, 18 nt, Human
ccgcagcccugcagaggg

SEQ ID NO: 3652153 - RNA, 14 nt, Human
ccgcagcccuggca

SEQ ID NO: 3652154 - RNA, 14 nt, Human
ccgcagccucccuc

SEQ ID NO: 3652155 - RNA, 13 nt, Human
ccgcaggaagcug

SEQ ID NO: 3652156 - RNA, 21 nt, Human
ccgcagucgucgcacagucuc

SEQ ID NO: 3652157 - RNA, 15 nt, Human
ccgcagugugcacua

SEQ ID NO: 3652158 - RNA, 11 nt, Human
ccgcaguguuu

SEQ ID NO: 3652159 - RNA, 19 nt, Human
ccgcaucagcugcucagau

SEQ ID NO: 3652160 - RNA, 14 nt, Human
ccgcauccccugcc

SEQ ID NO: 3652161 - RNA, 16 nt, Human
ccgcauccccugccuc

SEQ ID NO: 3652162 - RNA, 12 nt, Human
ccgcaucuucuc

SEQ ID NO: 3652163 - RNA, 20 nt, Human
ccgcaucuucuccaucuggc

SEQ ID NO: 3652164 - RNA, 20 nt, Human
ccgcaugcagcagcuugcug

SEQ ID NO: 3652165 - RNA, 19 nt, Human
ccgcaugcccccucgugcc

SEQ ID NO: 3652166 - RNA, 21 nt, Human
ccgcaugcccccucgugccag

SEQ ID NO: 3652167 - RNA, 17 nt, Human
ccgcaugcggcccagga

SEQ ID NO: 3652168 - RNA, 16 nt, Human
ccgcauuccaggcucc

SEQ ID NO: 3652169 - RNA, 14 nt, Human
ccgcauucccugag

SEQ ID NO: 3652170 - RNA, 21 nt, Human
ccgccaaaagcugcucaggga

SEQ ID NO: 3652171 - RNA, 23 nt, Human
ccgccaagguagccaucccauga

SEQ ID NO: 3652172 - RNA, 16 nt, Human
ccgccacacagaccac

SEQ ID NO: 3652173 - RNA, 23 nt, Human
ccgccacauggcuuccuccugcg

SEQ ID NO: 3652174 - RNA, 17 nt, Human
ccgccaccuaucucgug

SEQ ID NO: 3652175 - RNA, 12 nt, Human
ccgccagccucc

SEQ ID NO: 3652176 - RNA, 13 nt, Human
ccgccagcucugu

SEQ ID NO: 3652177 - RNA, 14 nt, Human
ccgccagcucuguu

SEQ ID NO: 3652178 - RNA, 15 nt, Human
ccgccagcucuguuc

SEQ ID NO: 3652179 - RNA, 12 nt, Human
ccgccaggcgag

SEQ ID NO: 3652180 - RNA, 20 nt, Human
ccgccagggagaccuggaca

SEQ ID NO: 3652181 - RNA, 16 nt, Human
ccgccaugcuccuggc

SEQ ID NO: 3652182 - RNA, 15 nt, Human
ccgccauggcuucca

SEQ ID NO: 3652183 - RNA, 14 nt, Human
ccgccauugccacc

SEQ ID NO: 3652184 - RNA, 12 nt, Human
ccgcccaaggcc

SEQ ID NO: 3652185 - RNA, 13 nt, Human
ccgcccacugucc

SEQ ID NO: 3652186 - RNA, 18 nt, Human
ccgcccacuguccugggc

SEQ ID NO: 3652187 - RNA, 22 nt, Human
ccgcccagagacccaagcugcc

SEQ ID NO: 3652188 - RNA, 14 nt, Human
ccgcccaggcuggc

SEQ ID NO: 3652189 - RNA, 17 nt, Human
ccgcccaggcuggccag

SEQ ID NO: 3652190 - RNA, 13 nt, Human
ccgcccaugcacu

SEQ ID NO: 3652191 - RNA, 14 nt, Human
ccgcccaugcacug

SEQ ID NO: 3652192 - RNA, 13 nt, Human
ccgcccccagucc

SEQ ID NO: 3652193 - RNA, 16 nt, Human
ccgcccccugcccucc

SEQ ID NO: 3652194 - RNA, 14 nt, Human
ccgccccgccccac

SEQ ID NO: 3652195 - RNA, 15 nt, Human
ccgccccugagccca

SEQ ID NO: 3652196 - RNA, 16 nt, Human
ccgccccugagcccac

SEQ ID NO: 3652197 - RNA, 16 nt, Human
ccgccccugcagcacg

SEQ ID NO: 3652198 - RNA, 14 nt, Human
ccgcccgggcccag

SEQ ID NO: 3652199 - RNA, 13 nt, Human
ccgcccugccacu

SEQ ID NO: 3652200 - RNA, 14 nt, Human
ccgcccugccacuc

SEQ ID NO: 3652201 - RNA, 15 nt, Human
ccgcccugccacuca

SEQ ID NO: 3652202 - RNA, 21 nt, Human
ccgcccugcuccucccuggcu

SEQ ID NO: 3652203 - RNA, 15 nt, Human
ccgccgacuuuguac

SEQ ID NO: 3652204 - RNA, 20 nt, Human
ccgccgacuuuguacccccc

SEQ ID NO: 3652205 - RNA, 18 nt, Human
ccgccggccagcugggau

SEQ ID NO: 3652206 - RNA, 15 nt, Human
ccgccuagcugcugu

SEQ ID NO: 3652207 - RNA, 23 nt, Human
ccgccuccccacggccgcuccag

SEQ ID NO: 3652208 - RNA, 21 nt, Human
ccgccucccuccccugcccuc

SEQ ID NO: 3652209 - RNA, 14 nt, Human
ccgccucgcccacc

SEQ ID NO: 3652210 - RNA, 11 nt, Human
ccgccucugcu

SEQ ID NO: 3652211 - RNA, 12 nt, Human
ccgccucuuccc

SEQ ID NO: 3652212 - RNA, 15 nt, Human
ccgccugccaguccu

SEQ ID NO: 3652213 - RNA, 13 nt, Human
ccgccugcccacc

SEQ ID NO: 3652214 - RNA, 16 nt, Human
ccgccugcccaccugc

SEQ ID NO: 3652215 - RNA, 17 nt, Human
ccgccugcccaccugcc

SEQ ID NO: 3652216 - RNA, 22 nt, Human
ccgccugcccaccugccuggcc

SEQ ID NO: 3652217 - RNA, 22 nt, Human
ccgccuggaugcggauggccgg

SEQ ID NO: 3652218 - RNA, 12 nt, Human
ccgccuggcaga

SEQ ID NO: 3652219 - RNA, 13 nt, Human
ccgccuggccagg

SEQ ID NO: 3652220 - RNA, 22 nt, Human
ccgccugguacucaagcccgcg

SEQ ID NO: 3652221 - RNA, 15 nt, Human
ccgccuguggacagc

SEQ ID NO: 3652222 - RNA, 17 nt, Human
ccgccuguucccccgcc

SEQ ID NO: 3652223 - RNA, 22 nt, Human
ccgccuuccuugaccuuccucu

SEQ ID NO: 3652224 - RNA, 15 nt, Human
ccgccuugcccagcc

SEQ ID NO: 3652225 - RNA, 18 nt, Human
ccgcgaccauguggccac

SEQ ID NO: 3652226 - RNA, 16 nt, Human
ccgcgcccgcgcccuc

SEQ ID NO: 3652227 - RNA, 16 nt, Human
ccgcgccuccuuccuu

SEQ ID NO: 3652228 - RNA, 14 nt, Human
ccgcgcguccagcu

SEQ ID NO: 3652229 - RNA, 15 nt, Human
ccgcggcgggcccug

SEQ ID NO: 3652230 - RNA, 17 nt, Human
ccgcgucuggugacaac

SEQ ID NO: 3652231 - RNA, 22 nt, Human
ccgcgugaucaaagccacacuc

SEQ ID NO: 3652232 - RNA, 13 nt, Human
ccgcguuguaaaa

SEQ ID NO: 3652233 - RNA, 23 nt, Human
ccgcuaagagggagggagggcuc

SEQ ID NO: 3652234 - RNA, 15 nt, Human
caggcacugcuaggc

SEQ ID NO: 3652235 - RNA, 23 nt, Human
caggcacugcugcccagccucca

SEQ ID NO: 3652236 - RNA, 14 nt, Human
caggcagaaagagu

SEQ ID NO: 3652237 - RNA, 19 nt, Human
caggcagacacggaucuga

SEQ ID NO: 3652238 - RNA, 22 nt, Human
caggcagacacggaucugagaa

SEQ ID NO: 3652239 - RNA, 15 nt, Human
caggcagagaaucau

SEQ ID NO: 3652240 - RNA, 22 nt, Human
caggcagaggcccaggcugccg

SEQ ID NO: 3652241 - RNA, 18 nt, Human
caggcagauccaggacua

SEQ ID NO: 3652242 - RNA, 15 nt, Human
caggcagaucugugc

SEQ ID NO: 3652243 - RNA, 16 nt, Human
caggcagaucugugcc

SEQ ID NO: 3652244 - RNA, 17 nt, Human
caggcagaucugugccc

SEQ ID NO: 3652245 - RNA, 18 nt, Human
caggcagaucugugcccc

SEQ ID NO: 3652246 - RNA, 15 nt, Human
caggcagcagacaca

SEQ ID NO: 3652247 - RNA, 13 nt, Human
caggcagccagca

SEQ ID NO: 3652248 - RNA, 14 nt, Human
caggcagccagcau

SEQ ID NO: 3652249 - RNA, 18 nt, Human
caggcagccagcaucugg

SEQ ID NO: 3652250 - RNA, 19 nt, Human
caggcagccagugcccuga

SEQ ID NO: 3652251 - RNA, 12 nt, Human
caggcagcccua

SEQ ID NO: 3652252 - RNA, 19 nt, Human
caggcagccucuggggggu

SEQ ID NO: 3652253 - RNA, 15 nt, Human
caggcagcuggauga

SEQ ID NO: 3652254 - RNA, 19 nt, Human
caggcagcuuuuucucucc

SEQ ID NO: 3652255 - RNA, 19 nt, Human
caggcaggaagggcaggaa

SEQ ID NO: 3652256 - RNA, 14 nt, Human
caggcagggcagga

SEQ ID NO: 3652257 - RNA, 17 nt, Human
caggcagggcaggacca

SEQ ID NO: 3652258 - RNA, 20 nt, Human
caggcagggccaacccuucu

SEQ ID NO: 3652259 - RNA, 22 nt, Human
caggcagggccaacccuucucc

SEQ ID NO: 3652260 - RNA, 15 nt, Human
caggcagggcucucc

SEQ ID NO: 3652261 - RNA, 17 nt, Human
caggcagggcucuccug

SEQ ID NO: 3652262 - RNA, 19 nt, Human
caggcagggcucuccuggc

SEQ ID NO: 3652263 - RNA, 21 nt, Human
caggcagggcucuccuggcuu

SEQ ID NO: 3652264 - RNA, 23 nt, Human
caggcagggcucuccuggcuucc

SEQ ID NO: 3652265 - RNA, 22 nt, Human
caggcaggggcccugcagcucu

SEQ ID NO: 3652266 - RNA, 15 nt, Human
caggcaggggccucc

SEQ ID NO: 3652267 - RNA, 17 nt, Human
caggcaggggugggggu

SEQ ID NO: 3652268 - RNA, 23 nt, Human
caggcagggguggggguggaggc

SEQ ID NO: 3652269 - RNA, 15 nt, Human
caggcagggugcagu

SEQ ID NO: 3652270 - RNA, 13 nt, Human
caggcagguccag

SEQ ID NO: 3652271 - RNA, 20 nt, Human
caggcaggucugaagcucaa

SEQ ID NO: 3652272 - RNA, 22 nt, Human
caggcaggucuugaacuccugg

SEQ ID NO: 3652273 - RNA, 15 nt, Human
caggcaggugggaug

SEQ ID NO: 3652274 - RNA, 22 nt, Human
caggcagucgggggcuggccua

SEQ ID NO: 3652275 - RNA, 23 nt, Human
caggcagucgggggcuggccuag

SEQ ID NO: 3652276 - RNA, 13 nt, Human
caggcagucucuc

SEQ ID NO: 3652277 - RNA, 14 nt, Human
caggcaucacagcu

SEQ ID NO: 3652278 - RNA, 12 nt, Human
caggcaugaagu

SEQ ID NO: 3652279 - RNA, 15 nt, Human
caggcaugccugugu

SEQ ID NO: 3652280 - RNA, 16 nt, Human
caggcaugccugugug

SEQ ID NO: 3652281 - RNA, 14 nt, Human
caggcauggcccug

SEQ ID NO: 3652282 - RNA, 17 nt, Human
caggcauggcccugggc

SEQ ID NO: 3652283 - RNA, 16 nt, Human
caggcauuccccagga

SEQ ID NO: 3652284 - RNA, 18 nt, Human
caggcauuccccaggagg

SEQ ID NO: 3652285 - RNA, 19 nt, Human
caggcauuccccaggaggc

SEQ ID NO: 3652286 - RNA, 23 nt, Human
caggcauuccccaggaggccagc

SEQ ID NO: 3652287 - RNA, 15 nt, Human
caggcauugaggaag

SEQ ID NO: 3652288 - RNA, 20 nt, Human
caggcauugaggaagagucu

SEQ ID NO: 3652289 - RNA, 14 nt, Human
caggcauuuccugg

SEQ ID NO: 3652290 - RNA, 15 nt, Human
caggcauuuccuggg

SEQ ID NO: 3652291 - RNA, 16 nt, Human
caggcauuuucccccu

SEQ ID NO: 3652292 - RNA, 21 nt, Human
cagggccggucgggggggacc

SEQ ID NO: 3652293 - RNA, 12 nt, Human
cagggccucugc

SEQ ID NO: 3652294 - RNA, 14 nt, Human
cagggccucugcgg

SEQ ID NO: 3652295 - RNA, 15 nt, Human
cagggccucugcgga

SEQ ID NO: 3652296 - RNA, 17 nt, Human
cagggccugagccuggc

SEQ ID NO: 3652297 - RNA, 22 nt, Human
cagggccugcaggaccugccug

SEQ ID NO: 3652298 - RNA, 12 nt, Human
cagggccuggaa

SEQ ID NO: 3652299 - RNA, 17 nt, Human
cagggccuggaagacag

SEQ ID NO: 3652300 - RNA, 12 nt, Human
cagggccuggcc

SEQ ID NO: 3652301 - RNA, 14 nt, Human
cagggccuggccca

SEQ ID NO: 3652302 - RNA, 17 nt, Human
cagggccuggcccaugu

SEQ ID NO: 3652303 - RNA, 14 nt, Human
cagggccuggcuca

SEQ ID NO: 3652304 - RNA, 22 nt, Human
cagggccuggggagauggagga

SEQ ID NO: 3652305 - RNA, 13 nt, Human
cagggccuggggc

SEQ ID NO: 3652306 - RNA, 17 nt, Human
cagggccuggggccuga

SEQ ID NO: 3652307 - RNA, 21 nt, Human
cagggccuggggccugagaga

SEQ ID NO: 3652308 - RNA, 12 nt, Human
cagggccugguu

SEQ ID NO: 3652309 - RNA, 19 nt, Human
cagggccugguugaagaag

SEQ ID NO: 3652310 - RNA, 20 nt, Human
cagggccuugcccagagaug

SEQ ID NO: 3652311 - RNA, 15 nt, Human
cagggccuugcuaau

SEQ ID NO: 3652312 - RNA, 13 nt, Human
cagggcgagacuc

SEQ ID NO: 3652313 - RNA, 15 nt, Human
cagggcggggguggc

SEQ ID NO: 3652314 - RNA, 14 nt, Human
cagggcuacccuga

SEQ ID NO: 3652315 - RNA, 19 nt, Human
cagggcuacccugagcuga

SEQ ID NO: 3652316 - RNA, 23 nt, Human
cagggcuacccugagcugaggca

SEQ ID NO: 3652317 - RNA, 14 nt, Human
cagggcuagugacu

SEQ ID NO: 3652318 - RNA, 15 nt, Human
cagggcuagugacuu

SEQ ID NO: 3652319 - RNA, 19 nt, Human
cagggcucacgugggaacc

SEQ ID NO: 3652320 - RNA, 12 nt, Human
cagggcucagcc

SEQ ID NO: 3652321 - RNA, 13 nt, Human
cagggcucagccu

SEQ ID NO: 3652322 - RNA, 12 nt, Human
cagggcucagcg

SEQ ID NO: 3652323 - RNA, 15 nt, Human
cagggcucagcgggg

SEQ ID NO: 3652324 - RNA, 12 nt, Human
cagggcucagga

SEQ ID NO: 3652325 - RNA, 19 nt, Human
cagggcucccacagagaca

SEQ ID NO: 3652326 - RNA, 12 nt, Human
cagggcucccag

SEQ ID NO: 3652327 - RNA, 14 nt, Human
cagggcuccuccca

SEQ ID NO: 3652328 - RNA, 13 nt, Human
cagggcuccugcc

SEQ ID NO: 3652329 - RNA, 12 nt, Human
cagggcuccugg

SEQ ID NO: 3652330 - RNA, 14 nt, Human
cagggcuccuugug

SEQ ID NO: 3652331 - RNA, 16 nt, Human
cagggcucuccuggcu

SEQ ID NO: 3652332 - RNA, 21 nt, Human
cagggcucucuuuccuucuug

SEQ ID NO: 3652333 - RNA, 13 nt, Human
cagggcucugccc

SEQ ID NO: 3652334 - RNA, 15 nt, Human
cagggcucugcccca

SEQ ID NO: 3652335 - RNA, 16 nt, Human
cagggcucugccccag

SEQ ID NO: 3652336 - RNA, 17 nt, Human
cagggcugcccugagaa

SEQ ID NO: 3652337 - RNA, 15 nt, Human
cagggcuggacugag

SEQ ID NO: 3652338 - RNA, 18 nt, Human
cagggcuggacugaggcc

SEQ ID NO: 3652339 - RNA, 19 nt, Human
cagggcuggacugaggccu

SEQ ID NO: 3652340 - RNA, 12 nt, Human
cagggcuggaga

SEQ ID NO: 3652341 - RNA, 12 nt, Human
cagggcuggccc

SEQ ID NO: 3652342 - RNA, 13 nt, Human
cagggcuggccca

SEQ ID NO: 3652343 - RNA, 14 nt, Human
cagggcuggcccag

SEQ ID NO: 3652344 - RNA, 15 nt, Human
cagggcuggcccagc

SEQ ID NO: 3652345 - RNA, 20 nt, Human
cagggcuggcccagcccugc

SEQ ID NO: 3652346 - RNA, 23 nt, Human
cagggcuggcccagcccugcugg

SEQ ID NO: 3652347 - RNA, 15 nt, Human
cagggcuggggcagc

SEQ ID NO: 3652348 - RNA, 19 nt, Human
cagggcuggggcagccucu

SEQ ID NO: 3652349 - RNA, 19 nt, Human
cagggcuguaacugccagg

SEQ ID NO: 3652350 - RNA, 21 nt, Human
cagggcuguaacugccaggcu

SEQ ID NO: 3652351 - RNA, 15 nt, Human
cagggcugucaucug

SEQ ID NO: 3652352 - RNA, 13 nt, Human
cagggcuuuaaaa

SEQ ID NO: 3652353 - RNA, 15 nt, Human
cagggcuuuaaaauu

SEQ ID NO: 3652354 - RNA, 18 nt, Human
caggggaaaacuguuacc

SEQ ID NO: 3652355 - RNA, 21 nt, Human
caggggaacacuggggacuug

SEQ ID NO: 3652356 - RNA, 15 nt, Human
caggggaaccugcca

SEQ ID NO: 3652357 - RNA, 16 nt, Human
caggggaauauuuuau

SEQ ID NO: 3652358 - RNA, 18 nt, Human
caggggacacccagaaac

SEQ ID NO: 3652359 - RNA, 16 nt, Human
caggggacaggagucc

SEQ ID NO: 3652360 - RNA, 22 nt, Human
caggggacaggaguccacuuug

SEQ ID NO: 3652361 - RNA, 15 nt, Human
caggggaccacaccu

SEQ ID NO: 3652362 - RNA, 17 nt, Human
caggggacucagcccug

SEQ ID NO: 3652363 - RNA, 17 nt, Human
caggggagagggucugg

SEQ ID NO: 3652364 - RNA, 21 nt, Human
caggggagagggucuggagaa

SEQ ID NO: 3652365 - RNA, 21 nt, Human
caggggagcagaggggcagag

SEQ ID NO: 3652366 - RNA, 21 nt, Human
caggggagcccuccacgccgg

SEQ ID NO: 3652367 - RNA, 14 nt, Human
caggggaggccauc

SEQ ID NO: 3652368 - RNA, 17 nt, Human
caggggaggccaucugg

SEQ ID NO: 3652369 - RNA, 19 nt, Human
caggggaggcggcacucca

SEQ ID NO: 3652370 - RNA, 13 nt, Human
caggggaggggug

SEQ ID NO: 3652371 - RNA, 14 nt, Human
caggggaggguaga

SEQ ID NO: 3652372 - RNA, 20 nt, Human
caggggauuucaccacucaa

SEQ ID NO: 3652373 - RNA, 17 nt, Human
caggggcaaacaccugc

SEQ ID NO: 3652374 - RNA, 14 nt, Human
caggggcaggagga

SEQ ID NO: 3652375 - RNA, 14 nt, Human
caggggccagagga

SEQ ID NO: 3652376 - RNA, 21 nt, Human
caggggcccaaggcggccccu

SEQ ID NO: 3652377 - RNA, 11 nt, Human
caggggccccg

SEQ ID NO: 3652378 - RNA, 16 nt, Human
caggggccccuccagc

SEQ ID NO: 3652379 - RNA, 22 nt, Human
caggggcccgcgauguggaacu

SEQ ID NO: 3652380 - RNA, 15 nt, Human
caggggcccugcagc

SEQ ID NO: 3652381 - RNA, 17 nt, Human
caggggcccugcagcuc

SEQ ID NO: 3652382 - RNA, 19 nt, Human
caggggcccugcagcucuc

SEQ ID NO: 3652383 - RNA, 18 nt, Human
caggggcccuggagcagc

SEQ ID NO: 3652384 - RNA, 22 nt, Human
caggggccggccaguggccuuc

SEQ ID NO: 3652385 - RNA, 13 nt, Human
caggggccuggag

SEQ ID NO: 3652386 - RNA, 14 nt, Human
caggggccuggaga

SEQ ID NO: 3652387 - RNA, 15 nt, Human
caggggccuggagau

SEQ ID NO: 3652388 - RNA, 22 nt, Human
caggggccuggagauccuccug

SEQ ID NO: 3652389 - RNA, 22 nt, Human
caggggcgugaggucccaggaa

SEQ ID NO: 3652390 - RNA, 19 nt, Human
caggggcuacaagagggaa

SEQ ID NO: 3652391 - RNA, 18 nt, Human
caggggcucuggagagaa

SEQ ID NO: 3652392 - RNA, 19 nt, Human
caggggcucuggagagaaa

SEQ ID NO: 3652393 - RNA, 19 nt, Human
caggggcugacacuucaag

SEQ ID NO: 3652394 - RNA, 19 nt, Human
caggggcugcccgcuccca

SEQ ID NO: 3652395 - RNA, 15 nt, Human
caggggcuggcuuca

SEQ ID NO: 3652396 - RNA, 19 nt, Human
caggggcuggcuucaggag

SEQ ID NO: 3652397 - RNA, 18 nt, Human
caggggcugucccggagg

SEQ ID NO: 3652398 - RNA, 16 nt, Human
caggggcuuccuggug

SEQ ID NO: 3652399 - RNA, 20 nt, Human
caggggcuuccuggugcugg

SEQ ID NO: 3652400 - RNA, 16 nt, Human
cagggggagaaugggu

SEQ ID NO: 3652401 - RNA, 18 nt, Human
cagggggagcugggccug

SEQ ID NO: 3652402 - RNA, 17 nt, Human
cagggggcaugaccaga

SEQ ID NO: 3652403 - RNA, 16 nt, Human
cagggggccaggugca

SEQ ID NO: 3652404 - RNA, 22 nt, Human
cagggggccagucccugaggca

SEQ ID NO: 3652405 - RNA, 21 nt, Human
cagggggcccaccagagcugu

SEQ ID NO: 3652406 - RNA, 14 nt, Human
cagggggcugcugc

SEQ ID NO: 3652407 - RNA, 20 nt, Human
cagggggcugcugcugggcu

SEQ ID NO: 3652408 - RNA, 21 nt, Human
cagggggcugcugcugggcuc

SEQ ID NO: 3652409 - RNA, 23 nt, Human
cagggggcugcugcugggcucag

SEQ ID NO: 3652410 - RNA, 13 nt, Human
cagggggcuuccu

SEQ ID NO: 3652411 - RNA, 15 nt, Human
cagggggcuuccuga

SEQ ID NO: 3652412 - RNA, 17 nt, Human
cagggggucuggcuggu

SEQ ID NO: 3652413 - RNA, 21 nt, Human
caggggguggacaaacuggag

SEQ ID NO: 3652414 - RNA, 16 nt, Human
caggggucacugaggc

SEQ ID NO: 3652415 - RNA, 18 nt, Human
caggggucgucaccaccu

SEQ ID NO: 3652416 - RNA, 14 nt, Human
caggggucucccug

SEQ ID NO: 3652417 - RNA, 16 nt, Human
caggggucucccugga

SEQ ID NO: 3652418 - RNA, 18 nt, Human
caggggucucccuggcuc

SEQ ID NO: 3652419 - RNA, 21 nt, Human
caggggucucccuggcucccu

SEQ ID NO: 3652420 - RNA, 22 nt, Human
caggggugcccccuccucuccc

SEQ ID NO: 3652421 - RNA, 18 nt, Human
cagggguggaggagagcc

SEQ ID NO: 3652422 - RNA, 14 nt, Human
caggggugggacac

SEQ ID NO: 3652423 - RNA, 15 nt, Human
caggggugggacacc

SEQ ID NO: 3652424 - RNA, 19 nt, Human
cagggguuccuucugggca

SEQ ID NO: 3652425 - RNA, 17 nt, Human
cagggguucgagaccag

SEQ ID NO: 3652426 - RNA, 12 nt, Human
caggguaacuaa

SEQ ID NO: 3652427 - RNA, 19 nt, Human
caggguaacuaacuaaaac

SEQ ID NO: 3652428 - RNA, 22 nt, Human
caggguaacuaacuaaaacaaa

SEQ ID NO: 3652429 - RNA, 13 nt, Human
caggguagcccgc

SEQ ID NO: 3652430 - RNA, 15 nt, Human
caggguagcccgccu

SEQ ID NO: 3652431 - RNA, 20 nt, Human
caggguagcccgccugccag

SEQ ID NO: 3652432 - RNA, 23 nt, Human
caggguauggacuaucugucugg

SEQ ID NO: 3652433 - RNA, 18 nt, Human
caggguauugcuugccac

SEQ ID NO: 3652434 - RNA, 21 nt, Human
cagggucaaaguguuuucucu

SEQ ID NO: 3652435 - RNA, 16 nt, Human
cagggucagaaacagg

SEQ ID NO: 3652436 - RNA, 19 nt, Human
cagggucagaaacaggacc

SEQ ID NO: 3652437 - RNA, 13 nt, Human
cagggucccacag

SEQ ID NO: 3652438 - RNA, 20 nt, Human
ccucauucaaagggacgguc

SEQ ID NO: 3652439 - RNA, 13 nt, Human
ccucauucaggaa

SEQ ID NO: 3652440 - RNA, 16 nt, Human
ccucauucaggaaaac

SEQ ID NO: 3652441 - RNA, 15 nt, Human
ccucauucccucguc

SEQ ID NO: 3652442 - RNA, 22 nt, Human
ccucauucccucgucuuuccca

SEQ ID NO: 3652443 - RNA, 13 nt, Human
ccucauuccugaa

SEQ ID NO: 3652444 - RNA, 16 nt, Human
ccucauuuaucccuca

SEQ ID NO: 3652445 - RNA, 20 nt, Human
ccucauuugggguagcuaga

SEQ ID NO: 3652446 - RNA, 17 nt, Human
ccuccaaaggcccccua

SEQ ID NO: 3652447 - RNA, 22 nt, Human
ccuccaaauggagaagcugcag

SEQ ID NO: 3652448 - RNA, 23 nt, Human
ccuccaaauggagaagcugcagg

SEQ ID NO: 3652449 - RNA, 18 nt, Human
ccuccaacccuagcaaaa

SEQ ID NO: 3652450 - RNA, 19 nt, Human
ccuccaacccuagcaaaag

SEQ ID NO: 3652451 - RNA, 15 nt, Human
ccuccaacccugccg

SEQ ID NO: 3652452 - RNA, 18 nt, Human
ccuccaacccugccguca

SEQ ID NO: 3652453 - RNA, 22 nt, Human
ccuccaagcuccaucuccacuc

SEQ ID NO: 3652454 - RNA, 17 nt, Human
ccgcccagcugcaccug

SEQ ID NO: 3652455 - RNA, 12 nt, Human
ccgcccaggcuu

SEQ ID NO: 3652456 - RNA, 20 nt, Human
ccgcccaggcuuagucacug

SEQ ID NO: 3652457 - RNA, 19 nt, Human
ccgcccaugcacuggggac

SEQ ID NO: 3652458 - RNA, 19 nt, Human
ccgccccaaaguaaaagaa

SEQ ID NO: 3652459 - RNA, 13 nt, Human
ccgcccccagccu

SEQ ID NO: 3652460 - RNA, 14 nt, Human
ccgcccccagguag

SEQ ID NO: 3652461 - RNA, 21 nt, Human
ccgccccccacacuucccugg

SEQ ID NO: 3652462 - RNA, 23 nt, Human
ccgccccccacacuucccuggcg

SEQ ID NO: 3652463 - RNA, 11 nt, Human
ccgcccccugc

SEQ ID NO: 3652464 - RNA, 19 nt, Human
ccgccccucugaccccugc

SEQ ID NO: 3652465 - RNA, 13 nt, Human
ccgccccugagcc

SEQ ID NO: 3652466 - RNA, 17 nt, Human
ccgccccugccugccau

SEQ ID NO: 3652467 - RNA, 23 nt, Human
ccgccccuggccgcgcuccgggc

SEQ ID NO: 3652468 - RNA, 13 nt, Human
ccgcccucuuccu

SEQ ID NO: 3652469 - RNA, 15 nt, Human
ccgcccucuuccuga

SEQ ID NO: 3652470 - RNA, 11 nt, Human
ccgcccugcca

SEQ ID NO: 3652471 - RNA, 12 nt, Human
ccgcccugccac

SEQ ID NO: 3652472 - RNA, 22 nt, Human
ccgcccugcuccucccuggcug

SEQ ID NO: 3652473 - RNA, 21 nt, Human
ccgcccuugccgaaccaggag

SEQ ID NO: 3652474 - RNA, 16 nt, Human
ccgccgccucgcccac

SEQ ID NO: 3652475 - RNA, 17 nt, Human
ccgccgccucgcccacc

SEQ ID NO: 3652476 - RNA, 21 nt, Human
ccgccggcaauaaaagcccag

SEQ ID NO: 3652477 - RNA, 16 nt, Human
ccgccuaguuuacugu

SEQ ID NO: 3652478 - RNA, 15 nt, Human
ccgccucaaaaugug

SEQ ID NO: 3652479 - RNA, 23 nt, Human
ccgccucaaugugguugcaaggc

SEQ ID NO: 3652480 - RNA, 14 nt, Human
ccgccucccagccu

SEQ ID NO: 3652481 - RNA, 21 nt, Human
ccgccuccgggacccccagga

SEQ ID NO: 3652482 - RNA, 22 nt, Human
ccgccuccgggacccccaggac

SEQ ID NO: 3652483 - RNA, 23 nt, Human
ccgccuccgggacccccaggaca

SEQ ID NO: 3652484 - RNA, 15 nt, Human
ccgccucgcccaccg

SEQ ID NO: 3652485 - RNA, 17 nt, Human
ccgccucgcccaccgca

SEQ ID NO: 3652486 - RNA, 18 nt, Human
ccgccucgcccaccgcau

SEQ ID NO: 3652487 - RNA, 13 nt, Human
ccgccucucccgu

SEQ ID NO: 3652488 - RNA, 17 nt, Human
ccgccugacagaaacca

SEQ ID NO: 3652489 - RNA, 14 nt, Human
ccgccugccagucc

SEQ ID NO: 3652490 - RNA, 21 nt, Human
ccgccugccaguccuagcugc

SEQ ID NO: 3652491 - RNA, 22 nt, Human
ccgccugccaguccuagcugca

SEQ ID NO: 3652492 - RNA, 12 nt, Human
ccgccugcccac

SEQ ID NO: 3652493 - RNA, 14 nt, Human
ccgccugcccucau

SEQ ID NO: 3652494 - RNA, 16 nt, Human
ccgccugcccucaugg

SEQ ID NO: 3652495 - RNA, 21 nt, Human
ccgccuggccaggagcaggca

SEQ ID NO: 3652496 - RNA, 17 nt, Human
ccgccugggucuccuaa

SEQ ID NO: 3652497 - RNA, 14 nt, Human
ccgccugguacuca

SEQ ID NO: 3652498 - RNA, 12 nt, Human
ccgccuuccuug

SEQ ID NO: 3652499 - RNA, 23 nt, Human
ccgccuuccuugaccuuccucug

SEQ ID NO: 3652500 - RNA, 21 nt, Human
ccgcgaugggucagguagggg

SEQ ID NO: 3652501 - RNA, 23 nt, Human
ccgcgauguggaacugcugccac

SEQ ID NO: 3652502 - RNA, 18 nt, Human
ccgcgcgcgucccccugc

SEQ ID NO: 3652503 - RNA, 23 nt, Human
ccgcgcguccagcugcccuuccg

SEQ ID NO: 3652504 - RNA, 20 nt, Human
ccgcgcucgccccaccggcg

SEQ ID NO: 3652505 - RNA, 17 nt, Human
ccgcggggcacccgccg

SEQ ID NO: 3652506 - RNA, 19 nt, Human
ccgcggggcacccgccgga

SEQ ID NO: 3652507 - RNA, 19 nt, Human
ccgcgucgcccucccaggc

SEQ ID NO: 3652508 - RNA, 17 nt, Human
ccgcgugugccugugug

SEQ ID NO: 3652509 - RNA, 13 nt, Human
ccgcuaaggaaga

SEQ ID NO: 3652510 - RNA, 18 nt, Human
ccgcuagaggccugagga

SEQ ID NO: 3652511 - RNA, 15 nt, Human
ccgcucaccuagagc

SEQ ID NO: 3652512 - RNA, 13 nt, Human
ccgcucagcccuc

SEQ ID NO: 3652513 - RNA, 15 nt, Human
ccgcuccagagucag

SEQ ID NO: 3652514 - RNA, 23 nt, Human
ccgcuccagguaccuugaccuuu

SEQ ID NO: 3652515 - RNA, 12 nt, Human
ccgcucccagug

SEQ ID NO: 3652516 - RNA, 13 nt, Human
ccgcuccccagcc

SEQ ID NO: 3652517 - RNA, 15 nt, Human
ccgcuccccagccca

SEQ ID NO: 3652518 - RNA, 21 nt, Human
ccgcuccugcggaggaggugu

SEQ ID NO: 3652519 - RNA, 22 nt, Human
ccgcucggaggccccaaaggaa

SEQ ID NO: 3652520 - RNA, 17 nt, Human
ccgcucuccugccacau

SEQ ID NO: 3652521 - RNA, 21 nt, Human
ccgcucucuuuucuguacuuc

SEQ ID NO: 3652522 - RNA, 20 nt, Human
ccgcucugcaugcggcccag

SEQ ID NO: 3652523 - RNA, 21 nt, Human
ccgcucuuggggacauggguc

SEQ ID NO: 3652524 - RNA, 12 nt, Human
ccgcugccaccc

SEQ ID NO: 3652525 - RNA, 23 nt, Human
ccgcugcccggcgcccucugucc

SEQ ID NO: 3652526 - RNA, 17 nt, Human
ccgcugcuccacgcgcu

SEQ ID NO: 3652527 - RNA, 18 nt, Human
ccgcugcuccuuggcuua

SEQ ID NO: 3652528 - RNA, 18 nt, Human
ccgcuggcugggggccuc

SEQ ID NO: 3652529 - RNA, 14 nt, Human
ccgcuggggccagu

SEQ ID NO: 3652530 - RNA, 18 nt, Human
ccgcugugagccccuggu

SEQ ID NO: 3652531 - RNA, 19 nt, Human
ccgcugugagccccugguc

SEQ ID NO: 3652532 - RNA, 14 nt, Human
ccgcuguucaccca

SEQ ID NO: 3652533 - RNA, 15 nt, Human
ccgcuguucacccac

SEQ ID NO: 3652534 - RNA, 16 nt, Human
ccgcuucccuccugcc

SEQ ID NO: 3652535 - RNA, 13 nt, Human
ccgcuugccucgg

SEQ ID NO: 3652536 - RNA, 20 nt, Human
ccgcuugccucggcuccugc

SEQ ID NO: 3652537 - RNA, 17 nt, Human
ccgcuuggagcagaggg

SEQ ID NO: 3652538 - RNA, 18 nt, Human
ccgcuuggagcagagggg

SEQ ID NO: 3652539 - RNA, 20 nt, Human
ccgcuuggcgaugccagcca

SEQ ID NO: 3652540 - RNA, 18 nt, Human
ccgcuuguccagcgccua

SEQ ID NO: 3652541 - RNA, 19 nt, Human
ccgcuuguccagcgccuag

SEQ ID NO: 3652542 - RNA, 20 nt, Human
ccgcuuguggggacccaggc

SEQ ID NO: 3652543 - RNA, 12 nt, Human
ccgcuuucuacc

SEQ ID NO: 3652544 - RNA, 14 nt, Human
ccgcuuuggccuga

SEQ ID NO: 3652545 - RNA, 11 nt, Human
ccggaagccaa

SEQ ID NO: 3652546 - RNA, 22 nt, Human
ccggaagccaaaccucugugag

SEQ ID NO: 3652547 - RNA, 20 nt, Human
ccggaauccuguccucagcu

SEQ ID NO: 3652548 - RNA, 15 nt, Human
ccggaccagccuggc

SEQ ID NO: 3652549 - RNA, 18 nt, Human
ccggaccagccuggccca

SEQ ID NO: 3652550 - RNA, 17 nt, Human
ccggacccucuaaccuc

SEQ ID NO: 3652551 - RNA, 21 nt, Human
ccggacccucuaaccucgccc

SEQ ID NO: 3652552 - RNA, 20 nt, Human
ccggacugcaagcagggcuc

SEQ ID NO: 3652553 - RNA, 16 nt, Human
ccggacuggugcccuc

SEQ ID NO: 3652554 - RNA, 13 nt, Human
ccggagagccagc

SEQ ID NO: 3652555 - RNA, 19 nt, Human
ccggagaggccucgaccca

SEQ ID NO: 3652556 - RNA, 14 nt, Human
ccggagaguggggg

SEQ ID NO: 3652557 - RNA, 17 nt, Human
ccggagcaaacucugcu

SEQ ID NO: 3652558 - RNA, 18 nt, Human
ccggagcaaacucugcug

SEQ ID NO: 3652559 - RNA, 16 nt, Human
ccggagccuccagcug

SEQ ID NO: 3652560 - RNA, 19 nt, Human
ccggagcuaacacuggccc

SEQ ID NO: 3652561 - RNA, 22 nt, Human
ccggagcuaacacuggccccua

SEQ ID NO: 3652562 - RNA, 20 nt, Human
ccggagcugccccucucugg

SEQ ID NO: 3652563 - RNA, 17 nt, Human
ccggagggaagggacgg

SEQ ID NO: 3652564 - RNA, 12 nt, Human
ccggagggcccu

SEQ ID NO: 3652565 - RNA, 17 nt, Human
ccggaggggccuggcag

SEQ ID NO: 3652566 - RNA, 17 nt, Human
ccggaguccacucccag

SEQ ID NO: 3652567 - RNA, 13 nt, Human
ccggaucagagca

SEQ ID NO: 3652568 - RNA, 19 nt, Human
ccggaucagagcaggaccu

SEQ ID NO: 3652569 - RNA, 17 nt, Human
ccggcaaccccaguucu

SEQ ID NO: 3652570 - RNA, 20 nt, Human
ccggcaaccccaguucugcu

SEQ ID NO: 3652571 - RNA, 22 nt, Human
ccggcaaccccaguucugcucc

SEQ ID NO: 3652572 - RNA, 20 nt, Human
ccggcacagggucugcucuu

SEQ ID NO: 3652573 - RNA, 14 nt, Human
ccggcacccccugc

SEQ ID NO: 3652574 - RNA, 15 nt, Human
ccggcacccccugca

SEQ ID NO: 3652575 - RNA, 16 nt, Human
ccggcacccccugcag

SEQ ID NO: 3652576 - RNA, 18 nt, Human
ccggcacccccugcagcu

SEQ ID NO: 3652577 - RNA, 18 nt, Human
ccggcagccccagccugc

SEQ ID NO: 3652578 - RNA, 18 nt, Human
ccggcagcuucugccccc

SEQ ID NO: 3652579 - RNA, 20 nt, Human
ccggcagcuucugcccccug

SEQ ID NO: 3652580 - RNA, 15 nt, Human
ccggcaggcccugca

SEQ ID NO: 3652581 - RNA, 18 nt, Human
ccggcaggcccugcagug

SEQ ID NO: 3652582 - RNA, 19 nt, Human
ccucucguaagauuuccuu

SEQ ID NO: 3652583 - RNA, 19 nt, Human
ccucucuaaccuccuuuac

SEQ ID NO: 3652584 - RNA, 17 nt, Human
ccucucuauccucucuu

SEQ ID NO: 3652585 - RNA, 13 nt, Human
ccucucucacucc

SEQ ID NO: 3652586 - RNA, 14 nt, Human
ccucucucacuccu

SEQ ID NO: 3652587 - RNA, 15 nt, Human
ccucucucauccacu

SEQ ID NO: 3652588 - RNA, 15 nt, Human
ccucucucccagucu

SEQ ID NO: 3652589 - RNA, 12 nt, Human
ccucucucuccg

SEQ ID NO: 3652590 - RNA, 13 nt, Human
ccucucucugacu

SEQ ID NO: 3652591 - RNA, 15 nt, Human
ccucucucugacucu

SEQ ID NO: 3652592 - RNA, 15 nt, Human
ccucucucuggaaag

SEQ ID NO: 3652593 - RNA, 22 nt, Human
ccucucucuucugcuccacccu

SEQ ID NO: 3652594 - RNA, 22 nt, Human
ccucucugaaggaggccaccuc

SEQ ID NO: 3652595 - RNA, 13 nt, Human
ccucucugcaggu

SEQ ID NO: 3652596 - RNA, 17 nt, Human
ccucucugcaggucccu

SEQ ID NO: 3652597 - RNA, 13 nt, Human
ccucucugcccua

SEQ ID NO: 3652598 - RNA, 12 nt, Human
ccucucuggaga

SEQ ID NO: 3652599 - RNA, 18 nt, Human
ccucucuggccucccacc

SEQ ID NO: 3652600 - RNA, 13 nt, Human
ccucucugggccu

SEQ ID NO: 3652601 - RNA, 16 nt, Human
ccucucugggccucag

SEQ ID NO: 3652602 - RNA, 18 nt, Human
ccucucuggggcuguguu

SEQ ID NO: 3652603 - RNA, 17 nt, Human
ccucucuuccuauccca

SEQ ID NO: 3652604 - RNA, 21 nt, Human
ccucucuuccuaucccauccc

SEQ ID NO: 3652605 - RNA, 22 nt, Human
ccucucuuccuaucccauccca

SEQ ID NO: 3652606 - RNA, 12 nt, Human
ccucucuuccuc

SEQ ID NO: 3652607 - RNA, 14 nt, Human
ccucucuugcaccc

SEQ ID NO: 3652608 - RNA, 18 nt, Human
ccucucuugguuuccuuc

SEQ ID NO: 3652609 - RNA, 21 nt, Human
ccucucuugguuuccuuccuu

SEQ ID NO: 3652610 - RNA, 23 nt, Human
ccucugaaaaccaauguucucuc

SEQ ID NO: 3652611 - RNA, 18 nt, Human
ccucugaaaacggcccuc

SEQ ID NO: 3652612 - RNA, 14 nt, Human
ccucugaaacagcu

SEQ ID NO: 3652613 - RNA, 18 nt, Human
ccucugaaacagcugccu

SEQ ID NO: 3652614 - RNA, 19 nt, Human
ccucugaaacagcugccuu

SEQ ID NO: 3652615 - RNA, 20 nt, Human
ccucugaaacagcugccuua

SEQ ID NO: 3652616 - RNA, 19 nt, Human
ccucugaaaguuguacaug

SEQ ID NO: 3652617 - RNA, 20 nt, Human
ccucugaaguuggacagcaa

SEQ ID NO: 3652618 - RNA, 13 nt, Human
ccucugaccccuc

SEQ ID NO: 3652619 - RNA, 14 nt, Human
ccucugaccccucc

SEQ ID NO: 3652620 - RNA, 12 nt, Human
ccucugaccuau

SEQ ID NO: 3652621 - RNA, 14 nt, Human
ccucugaccugcac

SEQ ID NO: 3652622 - RNA, 15 nt, Human
ccucugaccugcagg

SEQ ID NO: 3652623 - RNA, 20 nt, Human
ccucugaccugcaggccaag

SEQ ID NO: 3652624 - RNA, 12 nt, Human
ccucugacucag

SEQ ID NO: 3652625 - RNA, 22 nt, Human
ccucugacucagggcuccuggg

SEQ ID NO: 3652626 - RNA, 14 nt, Human
ccucugacucccaa

SEQ ID NO: 3652627 - RNA, 22 nt, Human
ccucugacucccaaagagcugc

SEQ ID NO: 3652628 - RNA, 20 nt, Human
ccucugagaagcucugaaga

SEQ ID NO: 3652629 - RNA, 16 nt, Human
ccucugagacuccaga

SEQ ID NO: 3652630 - RNA, 13 nt, Human
ccucugagaggcg

SEQ ID NO: 3652631 - RNA, 12 nt, Human
ccucugaggcca

SEQ ID NO: 3652632 - RNA, 14 nt, Human
ccucugaggccagc

SEQ ID NO: 3652633 - RNA, 19 nt, Human
ccucugauacccagagcau

SEQ ID NO: 3652634 - RNA, 18 nt, Human
ccucugauaugggacuga

SEQ ID NO: 3652635 - RNA, 21 nt, Human
ccucugauguauuuugugagu

SEQ ID NO: 3652636 - RNA, 11 nt, Human
ccucugcacaa

SEQ ID NO: 3652637 - RNA, 19 nt, Human
ccucugcacaagcugcacc

SEQ ID NO: 3652638 - RNA, 20 nt, Human
ccucugcacaagcugcaccc

SEQ ID NO: 3652639 - RNA, 19 nt, Human
ccucugcacacccuccaga

SEQ ID NO: 3652640 - RNA, 20 nt, Human
ccucugcacacccuccagag

SEQ ID NO: 3652641 - RNA, 16 nt, Human
ccucugcacucccacc

SEQ ID NO: 3652642 - RNA, 14 nt, Human
ccucugcacucccc

SEQ ID NO: 3652643 - RNA, 21 nt, Human
ccucugcacuccccugcuggg

SEQ ID NO: 3652644 - RNA, 13 nt, Human
ccucugcagcuga

SEQ ID NO: 3652645 - RNA, 17 nt, Human
ccucugcagcugaccuc

SEQ ID NO: 3652646 - RNA, 19 nt, Human
ccucugcagcugaccucug

SEQ ID NO: 3652647 - RNA, 23 nt, Human
ccucugcagucucuauaccaaua

SEQ ID NO: 3652648 - RNA, 16 nt, Human
ccucugcagugccuug

SEQ ID NO: 3652649 - RNA, 16 nt, Human
ccucugcauccucugg

SEQ ID NO: 3652650 - RNA, 18 nt, Human
ccucugcauccucuggag

SEQ ID NO: 3652651 - RNA, 19 nt, Human
ccucugccaaaggauguga

SEQ ID NO: 3652652 - RNA, 13 nt, Human
ccucugccacacu

SEQ ID NO: 3652653 - RNA, 20 nt, Human
ccucugccaccuccccuauc

SEQ ID NO: 3652654 - RNA, 16 nt, Human
ccucugcccacucccu

SEQ ID NO: 3652655 - RNA, 19 nt, Human
ccucugcccacucccugca

SEQ ID NO: 3652656 - RNA, 13 nt, Human
ccucugcccagcu

SEQ ID NO: 3652657 - RNA, 17 nt, Human
ccucugcccagcuuggg

SEQ ID NO: 3652658 - RNA, 23 nt, Human
ccucugcccagcuugggcccagc

SEQ ID NO: 3652659 - RNA, 22 nt, Human
ccucugccccauccuccagcag

SEQ ID NO: 3652660 - RNA, 14 nt, Human
ccucugccccgucu

SEQ ID NO: 3652661 - RNA, 18 nt, Human
ccucugccccucccccag

SEQ ID NO: 3652662 - RNA, 11 nt, Human
ccucugccuca

SEQ ID NO: 3652663 - RNA, 12 nt, Human
ccucugccucaa

SEQ ID NO: 3652664 - RNA, 14 nt, Human
ccucugccucaaug

SEQ ID NO: 3652665 - RNA, 22 nt, Human
ccucugccugaagucacacagu

SEQ ID NO: 3652666 - RNA, 12 nt, Human
ccucugccuguc

SEQ ID NO: 3652667 - RNA, 20 nt, Human
ccucugcggaccccagcugu

SEQ ID NO: 3652668 - RNA, 19 nt, Human
ccucugcgucuauccugug

SEQ ID NO: 3652669 - RNA, 15 nt, Human
cagugccaagcacag

SEQ ID NO: 3652670 - RNA, 22 nt, Human
cagugccaauaaaauuuaggaa

SEQ ID NO: 3652671 - RNA, 21 nt, Human
cagugccagcaaugacaucuc

SEQ ID NO: 3652672 - RNA, 18 nt, Human
cagugccaggaacccuua

SEQ ID NO: 3652673 - RNA, 18 nt, Human
cagugccauugucuuuau

SEQ ID NO: 3652674 - RNA, 13 nt, Human
cagugcccacagg

SEQ ID NO: 3652675 - RNA, 16 nt, Human
cagugcccaccaacau

SEQ ID NO: 3652676 - RNA, 14 nt, Human
cagugcccaggugg

SEQ ID NO: 3652677 - RNA, 18 nt, Human
cagugcccauuccucacc

SEQ ID NO: 3652678 - RNA, 21 nt, Human
cagugcccccacugaccagaa

SEQ ID NO: 3652679 - RNA, 17 nt, Human
cagugcccucauuuuau

SEQ ID NO: 3652680 - RNA, 14 nt, Human
cagugcccuccagc

SEQ ID NO: 3652681 - RNA, 13 nt, Human
cagugcccucucc

SEQ ID NO: 3652682 - RNA, 13 nt, Human
cagugcccugagc

SEQ ID NO: 3652683 - RNA, 17 nt, Human
cagugccgccgccucgc

SEQ ID NO: 3652684 - RNA, 12 nt, Human
cagugccucucc

SEQ ID NO: 3652685 - RNA, 21 nt, Human
cagugccucucccugcugcuc

SEQ ID NO: 3652686 - RNA, 20 nt, Human
cagugccugggaauguauua

SEQ ID NO: 3652687 - RNA, 19 nt, Human
cagugccuuaccuccugcc

SEQ ID NO: 3652688 - RNA, 11 nt, Human
cagugccuuau

SEQ ID NO: 3652689 - RNA, 16 nt, Human
cagugccuuauggaac

SEQ ID NO: 3652690 - RNA, 18 nt, Human
cagugccuuauggaacac

SEQ ID NO: 3652691 - RNA, 20 nt, Human
cagugccuuauggaacacuc

SEQ ID NO: 3652692 - RNA, 22 nt, Human
cagugccuuauggaacacucug

SEQ ID NO: 3652693 - RNA, 22 nt, Human
cagugccuuggggaauuuccuc

SEQ ID NO: 3652694 - RNA, 14 nt, Human
cagugcuaaaaaug

SEQ ID NO: 3652695 - RNA, 20 nt, Human
cagugcuaaaaaugggacuu

SEQ ID NO: 3652696 - RNA, 15 nt, Human
cagugcuacugaaag

SEQ ID NO: 3652697 - RNA, 17 nt, Human
cagugcucacccacacc

SEQ ID NO: 3652698 - RNA, 13 nt, Human
cagugcuccagcc

SEQ ID NO: 3652699 - RNA, 19 nt, Human
cagugcucgcuguugcuga

SEQ ID NO: 3652700 - RNA, 22 nt, Human
cagugcucgcuguugcugaaua

SEQ ID NO: 3652701 - RNA, 19 nt, Human
cagugcugauguagcaugc

SEQ ID NO: 3652702 - RNA, 19 nt, Human
cagugcugcagcucccugg

SEQ ID NO: 3652703 - RNA, 13 nt, Human
cagugcugccugu

SEQ ID NO: 3652704 - RNA, 14 nt, Human
cagugcugccuguc

SEQ ID NO: 3652705 - RNA, 15 nt, Human
cagugcugccugucc

SEQ ID NO: 3652706 - RNA, 16 nt, Human
cagugcugugcugugc

SEQ ID NO: 3652707 - RNA, 19 nt, Human
cagugcugugcugugcuau

SEQ ID NO: 3652708 - RNA, 14 nt, Human
cagugcuuagcaaa

SEQ ID NO: 3652709 - RNA, 16 nt, Human
cagugcuuagcaaaaa

SEQ ID NO: 3652710 - RNA, 14 nt, Human
cagugcuucagccu

SEQ ID NO: 3652711 - RNA, 20 nt, Human
cagugcuucagccugaggcu

SEQ ID NO: 3652712 - RNA, 15 nt, Human
cagugcuucccgagu

SEQ ID NO: 3652713 - RNA, 12 nt, Human
cagugcuuggcc

SEQ ID NO: 3652714 - RNA, 21 nt, Human
cagugcuuuuggcggggagga

SEQ ID NO: 3652715 - RNA, 16 nt, Human
caguggaaccagccca

SEQ ID NO: 3652716 - RNA, 20 nt, Human
caguggacucagaaagccaa

SEQ ID NO: 3652717 - RNA, 13 nt, Human
caguggagaauua

SEQ ID NO: 3652718 - RNA, 15 nt, Human
caguggaggaagagg

SEQ ID NO: 3652719 - RNA, 20 nt, Human
caguggaggaagagggacag

SEQ ID NO: 3652720 - RNA, 15 nt, Human
caguggaggugcugc

SEQ ID NO: 3652721 - RNA, 19 nt, Human
caguggagugcaaaaggcu

SEQ ID NO: 3652722 - RNA, 17 nt, Human
caguggauuguuuauac

SEQ ID NO: 3652723 - RNA, 19 nt, Human
caguggcacucaacaugag

SEQ ID NO: 3652724 - RNA, 14 nt, Human
caguggcagcugcu

SEQ ID NO: 3652725 - RNA, 17 nt, Human
caguggcaggacaggaa

SEQ ID NO: 3652726 - RNA, 21 nt, Human
caguggcaggcagaggcccag

SEQ ID NO: 3652727 - RNA, 15 nt, Human
caguggcagggcaca

SEQ ID NO: 3652728 - RNA, 13 nt, Human
ccucauccucaga

SEQ ID NO: 3652729 - RNA, 17 nt, Human
ccucauccucagaugcu

SEQ ID NO: 3652730 - RNA, 20 nt, Human
ccucauccucauacccaccc

SEQ ID NO: 3652731 - RNA, 16 nt, Human
ccucaucuaugaggaa

SEQ ID NO: 3652732 - RNA, 14 nt, Human
ccucaucugucugg

SEQ ID NO: 3652733 - RNA, 16 nt, Human
ccucaucuugaagggc

SEQ ID NO: 3652734 - RNA, 21 nt, Human
ccucaucuugaagggcccagg

SEQ ID NO: 3652735 - RNA, 16 nt, Human
ccucaugaauguaaau

SEQ ID NO: 3652736 - RNA, 19 nt, Human
ccucaugaauguaaauuug

SEQ ID NO: 3652737 - RNA, 13 nt, Human
ccucaugcaucuc

SEQ ID NO: 3652738 - RNA, 15 nt, Human
ccucaugcaucucca

SEQ ID NO: 3652739 - RNA, 14 nt, Human
ccucaugccaaccc

SEQ ID NO: 3652740 - RNA, 14 nt, Human
ccucaugcccaccc

SEQ ID NO: 3652741 - RNA, 23 nt, Human
ccucaugcccacccccugcccug

SEQ ID NO: 3652742 - RNA, 24 nt, Human
ccucaugcccacccccugcccugc

SEQ ID NO: 3652743 - RNA, 20 nt, Human
ccucaugcugccaauauccu

SEQ ID NO: 3652744 - RNA, 15 nt, Human
ccucauguccacugg

SEQ ID NO: 3652745 - RNA, 20 nt, Human
ccucauguccacugguucuu

SEQ ID NO: 3652746 - RNA, 13 nt, Human
ccucauguucuua

SEQ ID NO: 3652747 - RNA, 13 nt, Human
ccucauguuuaug

SEQ ID NO: 3652748 - RNA, 15 nt, Human
ccucauuaaugacac

SEQ ID NO: 3652749 - RNA, 17 nt, Human
ccucauucaggaaaacu

SEQ ID NO: 3652750 - RNA, 22 nt, Human
ccucauuucaggagcagccuca

SEQ ID NO: 3652751 - RNA, 11 nt, Human
ccucauuucuc

SEQ ID NO: 3652752 - RNA, 17 nt, Human
ccucauuugggguagcu

SEQ ID NO: 3652753 - RNA, 23 nt, Human
ccucauuuuugaauacaggcaua

SEQ ID NO: 3652754 - RNA, 18 nt, Human
ccucauuuuuuuccuugc

SEQ ID NO: 3652755 - RNA, 22 nt, Human
ccuccaaaaugugccuauugcu

SEQ ID NO: 3652756 - RNA, 13 nt, Human
ccuccaacccugc

SEQ ID NO: 3652757 - RNA, 22 nt, Human
ccuccaaucccaccaacccuca

SEQ ID NO: 3652758 - RNA, 23 nt, Human
ccuccaaucccaccaacccucag

SEQ ID NO: 3652759 - RNA, 15 nt, Human
ccuccaauccugccc

SEQ ID NO: 3652760 - RNA, 19 nt, Human
ccuccacacccgcgccccg

SEQ ID NO: 3652761 - RNA, 15 nt, Human
ccuccacagcgaggg

SEQ ID NO: 3652762 - RNA, 21 nt, Human
ccuccacagcgagggcagcug

SEQ ID NO: 3652763 - RNA, 22 nt, Human
ccuccacagcgagggcagcugc

SEQ ID NO: 3652764 - RNA, 17 nt, Human
ccuccacaguucagugg

SEQ ID NO: 3652765 - RNA, 12 nt, Human
ccuccacauccu

SEQ ID NO: 3652766 - RNA, 14 nt, Human
ccuccacauccucc

SEQ ID NO: 3652767 - RNA, 18 nt, Human
ccuccaccaccacuggcc

SEQ ID NO: 3652768 - RNA, 23 nt, Human
ccuccaccaccacuggccaccag

SEQ ID NO: 3652769 - RNA, 13 nt, Human
ccuccaccccagg

SEQ ID NO: 3652770 - RNA, 17 nt, Human
ccuccaccccccagaac

SEQ ID NO: 3652771 - RNA, 20 nt, Human
ccuccacccucugagcuuug

SEQ ID NO: 3652772 - RNA, 14 nt, Human
ccuccacccugucc

SEQ ID NO: 3652773 - RNA, 16 nt, Human
ccuccacccugucccc

SEQ ID NO: 3652774 - RNA, 17 nt, Human
ccuccaccgccauggcu

SEQ ID NO: 3652775 - RNA, 14 nt, Human
ccuccaccgcugcc

SEQ ID NO: 3652776 - RNA, 14 nt, Human
ccuccaccucccug

SEQ ID NO: 3652777 - RNA, 17 nt, Human
ccuccaccucccugcaa

SEQ ID NO: 3652778 - RNA, 23 nt, Human
ccuccaccucuucaccccccacu

SEQ ID NO: 3652779 - RNA, 17 nt, Human
ccuccacguucaccccu

SEQ ID NO: 3652780 - RNA, 17 nt, Human
ccuccacguucugcuca

SEQ ID NO: 3652781 - RNA, 21 nt, Human
ccuccacucagcuguccugca

SEQ ID NO: 3652782 - RNA, 13 nt, Human
ccuccacucccac

SEQ ID NO: 3652783 - RNA, 14 nt, Human
ccuccacucccacu

SEQ ID NO: 3652784 - RNA, 20 nt, Human
ccuccacucccacuucccug

SEQ ID NO: 3652785 - RNA, 15 nt, Human
ccuccacuccuuccu

SEQ ID NO: 3652786 - RNA, 16 nt, Human
ccuccacuccuuccug

SEQ ID NO: 3652787 - RNA, 19 nt, Human
ccuccacucucccccaccc

SEQ ID NO: 3652788 - RNA, 13 nt, Human
ccuccacucuccu

SEQ ID NO: 3652789 - RNA, 16 nt, Human
ccuccacugcccucug

SEQ ID NO: 3652790 - RNA, 12 nt, Human
ccuccagaacuc

SEQ ID NO: 3652791 - RNA, 19 nt, Human
ccuccagaagcacugggau

SEQ ID NO: 3652792 - RNA, 12 nt, Human
ccuccagaagcc

SEQ ID NO: 3652793 - RNA, 19 nt, Human
ccuccagaagccucuggcu

SEQ ID NO: 3652794 - RNA, 22 nt, Human
ccuccagaagccucuggcuaga

SEQ ID NO: 3652795 - RNA, 12 nt, Human
ccuccagagccc

SEQ ID NO: 3652796 - RNA, 19 nt, Human
ccuccagagccccacagcc

SEQ ID NO: 3652797 - RNA, 12 nt, Human
ccuccagcacaa

SEQ ID NO: 3652798 - RNA, 17 nt, Human
ccuccagcacaaacaca

SEQ ID NO: 3652799 - RNA, 20 nt, Human
ccuccagccccgcgaccaug

SEQ ID NO: 3652800 - RNA, 14 nt, Human
ccuccagccccugu

SEQ ID NO: 3652801 - RNA, 17 nt, Human
ccuccagcccgggagcc

SEQ ID NO: 3652802 - RNA, 23 nt, Human
ccuccagcccgggagccuaggac

SEQ ID NO: 3652803 - RNA, 22 nt, Human
ccuccagcccucucacuguguc

SEQ ID NO: 3652804 - RNA, 11 nt, Human
ccuccagccuc

SEQ ID NO: 3652805 - RNA, 15 nt, Human
ccuccagccucuguu

SEQ ID NO: 3652806 - RNA, 16 nt, Human
ccuccagccugaacag

SEQ ID NO: 3652807 - RNA, 22 nt, Human
ccuccagccuuuggccuuggcu

SEQ ID NO: 3652808 - RNA, 11 nt, Human
ccuccagcuca

SEQ ID NO: 3652809 - RNA, 15 nt, Human
ccuccagcucagcag

SEQ ID NO: 3652810 - RNA, 18 nt, Human
ccuccagcucccugugcc

SEQ ID NO: 3652811 - RNA, 21 nt, Human
ccuccagcucccugugccccc

SEQ ID NO: 3652812 - RNA, 16 nt, Human
ccuccagcucuuuccu

SEQ ID NO: 3652813 - RNA, 18 nt, Human
ccuccagcugcaccagag

SEQ ID NO: 3652814 - RNA, 17 nt, Human
ccuccagcuuuccugua

SEQ ID NO: 3652815 - RNA, 22 nt, Human
ccuccaggaaugaucucuucuu

SEQ ID NO: 3652816 - RNA, 18 nt, Human
ccuccaggagcuucuugu

SEQ ID NO: 3652817 - RNA, 13 nt, Human
ccuccaggcaaaa

SEQ ID NO: 3652818 - RNA, 13 nt, Human
ccuccaggccugc

SEQ ID NO: 3652819 - RNA, 19 nt, Human
ccuccaggccugccuccca

SEQ ID NO: 3652820 - RNA, 14 nt, Human
ccuccagggccacg

SEQ ID NO: 3652821 - RNA, 16 nt, Human
ccuccagggccacgug

SEQ ID NO: 3652822 - RNA, 22 nt, Human
ccuccagggcucaacacuguga

SEQ ID NO: 3652823 - RNA, 21 nt, Human
ccuccagggcuggacugaggc

SEQ ID NO: 3652824 - RNA, 22 nt, Human
ccuccagggcuggacugaggcc

SEQ ID NO: 3652825 - RNA, 11 nt, Human
ccuccaggugc

SEQ ID NO: 3652826 - RNA, 19 nt, Human
ccuccaggugugcacgugg

SEQ ID NO: 3652827 - RNA, 16 nt, Human
ccuccagguuuuucaa

SEQ ID NO: 3652828 - RNA, 18 nt, Human
ccuccagguuuuucaauu

SEQ ID NO: 3652829 - RNA, 21 nt, Human
ccuccagguuuuucaauuaaa

SEQ ID NO: 3652830 - RNA, 17 nt, Human
ccuccaguaccuugcuu

SEQ ID NO: 3652831 - RNA, 16 nt, Human
ccuccagugugggcuu

SEQ ID NO: 3652832 - RNA, 12 nt, Human
ccuccaucccug

SEQ ID NO: 3652833 - RNA, 18 nt, Human
ccuccaucuaaacugccc

SEQ ID NO: 3652834 - RNA, 18 nt, Human
ccuccaucuucuuugcag

SEQ ID NO: 3652835 - RNA, 17 nt, Human
cagugugggcuugacca

SEQ ID NO: 3652836 - RNA, 13 nt, Human
caguguguaaaca

SEQ ID NO: 3652837 - RNA, 16 nt, Human
caguguguaaacaaaa

SEQ ID NO: 3652838 - RNA, 21 nt, Human
cagugugucgagucaaaaugu

SEQ ID NO: 3652839 - RNA, 23 nt, Human
cagugugucuaaauuugaauguu

SEQ ID NO: 3652840 - RNA, 17 nt, Human
cagugugucuccugcau

SEQ ID NO: 3652841 - RNA, 19 nt, Human
cagugugucuccugcaugc

SEQ ID NO: 3652842 - RNA, 15 nt, Human
caguguuaaaugaaa

SEQ ID NO: 3652843 - RNA, 18 nt, Human
caguguuaaaugaaauug

SEQ ID NO: 3652844 - RNA, 14 nt, Human
caguguuaaaugug

SEQ ID NO: 3652845 - RNA, 14 nt, Human
caguguuaccugug

SEQ ID NO: 3652846 - RNA, 19 nt, Human
caguguuaccugugugcuu

SEQ ID NO: 3652847 - RNA, 19 nt, Human
caguguuaggccuggcaca

SEQ ID NO: 3652848 - RNA, 21 nt, Human
caguguuaggccuggcacagu

SEQ ID NO: 3652849 - RNA, 21 nt, Human
caguguuccccaucugggucc

SEQ ID NO: 3652850 - RNA, 14 nt, Human
caguguucgcuugg

SEQ ID NO: 3652851 - RNA, 18 nt, Human
caguguucuaugaacaac

SEQ ID NO: 3652852 - RNA, 13 nt, Human
caguguucuguuu

SEQ ID NO: 3652853 - RNA, 16 nt, Human
caguguucuguuuaau

SEQ ID NO: 3652854 - RNA, 22 nt, Human
caguguucuguuuaauacucau

SEQ ID NO: 3652855 - RNA, 13 nt, Human
caguguugccuaa

SEQ ID NO: 3652856 - RNA, 14 nt, Human
caguguugccuaag

SEQ ID NO: 3652857 - RNA, 24 nt, Human
caguguuggccaugaugacaacua

SEQ ID NO: 3652858 - RNA, 20 nt, Human
caguguugucaccagaucug

SEQ ID NO: 3652859 - RNA, 23 nt, Human
caguguuguugcucuaggaagac

SEQ ID NO: 3652860 - RNA, 21 nt, Human
caguguuucccauaauuuucu

SEQ ID NO: 3652861 - RNA, 13 nt, Human
caguguuuucaga

SEQ ID NO: 3652862 - RNA, 23 nt, Human
caguguuuucagaagaaauaaau

SEQ ID NO: 3652863 - RNA, 15 nt, Human
caguguuuucuggga

SEQ ID NO: 3652864 - RNA, 21 nt, Human
caguguuuugcaagugcugga

SEQ ID NO: 3652865 - RNA, 14 nt, Human
caguguuuuuguaa

SEQ ID NO: 3652866 - RNA, 24 nt, Human
caguuaacuauugcauuuauaugu

SEQ ID NO: 3652867 - RNA, 16 nt, Human
caguuaacuuucagaa

SEQ ID NO: 3652868 - RNA, 16 nt, Human
caguuaagaaauuuca

SEQ ID NO: 3652869 - RNA, 14 nt, Human
caguuaagagaaau

SEQ ID NO: 3652870 - RNA, 20 nt, Human
caguuaagagaaaugagcuu

SEQ ID NO: 3652871 - RNA, 14 nt, Human
caguuaagccuuug

SEQ ID NO: 3652872 - RNA, 15 nt, Human
caguuaagccuuugg

SEQ ID NO: 3652873 - RNA, 23 nt, Human
ccugccagugccuuaccuccugc

SEQ ID NO: 3652874 - RNA, 15 nt, Human
ccugccaucuuccca

SEQ ID NO: 3652875 - RNA, 16 nt, Human
ccugccaucuucccag

SEQ ID NO: 3652876 - RNA, 18 nt, Human
ccugcccaagcccaggcc

SEQ ID NO: 3652877 - RNA, 21 nt, Human
ccugcccacaagucccagcgc

SEQ ID NO: 3652878 - RNA, 19 nt, Human
ccugcccacaccuccuggg

SEQ ID NO: 3652879 - RNA, 18 nt, Human
ccugcccaccugccuggc

SEQ ID NO: 3652880 - RNA, 19 nt, Human
ccugcccaccuggccucug

SEQ ID NO: 3652881 - RNA, 15 nt, Human
ccugcccagacaaga

SEQ ID NO: 3652882 - RNA, 12 nt, Human
ccugcccaggcc

SEQ ID NO: 3652883 - RNA, 18 nt, Human
ccugcccaggccccugcc

SEQ ID NO: 3652884 - RNA, 21 nt, Human
ccugcccaggccccugccacc

SEQ ID NO: 3652885 - RNA, 22 nt, Human
ccugcccaggccggccagccuc

SEQ ID NO: 3652886 - RNA, 23 nt, Human
ccugcccaggccggccagccuca

SEQ ID NO: 3652887 - RNA, 16 nt, Human
ccugcccaguccccca

SEQ ID NO: 3652888 - RNA, 21 nt, Human
ccugcccagucccccaacccc

SEQ ID NO: 3652889 - RNA, 16 nt, Human
ccugcccaucugggaa

SEQ ID NO: 3652890 - RNA, 15 nt, Human
cauaugugaucuguc

SEQ ID NO: 3652891 - RNA, 16 nt, Human
cauaugugaucugucu

SEQ ID NO: 3652892 - RNA, 20 nt, Human
cauaugugaucugucuugua

SEQ ID NO: 3652893 - RNA, 22 nt, Human
cauaugugaucugucuuguaau

SEQ ID NO: 3652894 - RNA, 18 nt, Human
cauauguugaauacuuuu

SEQ ID NO: 3652895 - RNA, 16 nt, Human
cauauguugcucaguc

SEQ ID NO: 3652896 - RNA, 15 nt, Human
cauauuaauauauuu

SEQ ID NO: 3652897 - RNA, 17 nt, Human
cauauuacaauauuugu

SEQ ID NO: 3652898 - RNA, 22 nt, Human
cauauuacaauauuugugugcu

SEQ ID NO: 3652899 - RNA, 20 nt, Human
cauauuaccacagacauacu

SEQ ID NO: 3652900 - RNA, 15 nt, Human
cauauuagaaaacuu

SEQ ID NO: 3652901 - RNA, 17 nt, Human
cauauuagaaaacuuug

SEQ ID NO: 3652902 - RNA, 18 nt, Human
cauauuagacuucuguuu

SEQ ID NO: 3652903 - RNA, 20 nt, Human
cauauuagaggggaaaagcu

SEQ ID NO: 3652904 - RNA, 14 nt, Human
cauauuaggaaaau

SEQ ID NO: 3652905 - RNA, 17 nt, Human
cauauuauaaaggauaa

SEQ ID NO: 3652906 - RNA, 22 nt, Human
cauauuauaaaggauaaagaag

SEQ ID NO: 3652907 - RNA, 14 nt, Human
cauauuauaucaga

SEQ ID NO: 3652908 - RNA, 16 nt, Human
cauauuauaucagacu

SEQ ID NO: 3652909 - RNA, 14 nt, Human
cauauucaggaagc

SEQ ID NO: 3652910 - RNA, 17 nt, Human
cauauuccugcagccug

SEQ ID NO: 3652911 - RNA, 16 nt, Human
cauauucuguuggaag

SEQ ID NO: 3652912 - RNA, 16 nt, Human
cauauugaauguuucc

SEQ ID NO: 3652913 - RNA, 12 nt, Human
cauauugacuuu

SEQ ID NO: 3652914 - RNA, 15 nt, Human
cauauugaugaaaag

SEQ ID NO: 3652915 - RNA, 17 nt, Human
cauauugauuuccguua

SEQ ID NO: 3652916 - RNA, 16 nt, Human
cauauugcacaugucu

SEQ ID NO: 3652917 - RNA, 19 nt, Human
cauauugcauacuauuaaa

SEQ ID NO: 3652918 - RNA, 22 nt, Human
cauauugcauacuauuaaacau

SEQ ID NO: 3652919 - RNA, 20 nt, Human
cauauugguauauccuuuuc

SEQ ID NO: 3652920 - RNA, 13 nt, Human
cauauuguaaaac

SEQ ID NO: 3652921 - RNA, 16 nt, Human
cauauuguaaaacagg

SEQ ID NO: 3652922 - RNA, 13 nt, Human
cauauuguacacu

SEQ ID NO: 3652923 - RNA, 20 nt, Human
cauauugugauucugccuuu

SEQ ID NO: 3652924 - RNA, 21 nt, Human
cauauugugcuucacaguaga

SEQ ID NO: 3652925 - RNA, 17 nt, Human
cauauuguggcacaagc

SEQ ID NO: 3652926 - RNA, 14 nt, Human
cauauuguguguaa

SEQ ID NO: 3652927 - RNA, 19 nt, Human
cauauuguuacugguacca

SEQ ID NO: 3652928 - RNA, 14 nt, Human
cauauuguuauuau

SEQ ID NO: 3652929 - RNA, 13 nt, Human
cauauuguugaaa

SEQ ID NO: 3652930 - RNA, 10 nt, Human
cauauuuaau

SEQ ID NO: 3652931 - RNA, 22 nt, Human
cauauuuaauguuuuaaaugua

SEQ ID NO: 3652932 - RNA, 18 nt, Human
cauauuuaccucagccug

SEQ ID NO: 3652933 - RNA, 17 nt, Human
cauauuuacuucuuaua

SEQ ID NO: 3652934 - RNA, 22 nt, Human
cauauuuauagcaauccauguu

SEQ ID NO: 3652935 - RNA, 10 nt, Human
cauauuugag

SEQ ID NO: 3652936 - RNA, 19 nt, Human
cauauuugcauauguauga

SEQ ID NO: 3652937 - RNA, 16 nt, Human
cauauuuguaaaauga

SEQ ID NO: 3652938 - RNA, 18 nt, Human
cauauuuguaaaaugaca

SEQ ID NO: 3652939 - RNA, 14 nt, Human
cauauuuguacuuu

SEQ ID NO: 3652940 - RNA, 18 nt, Human
cauauuuguacuuucugu

SEQ ID NO: 3652941 - RNA, 18 nt, Human
cauauuuguauaguugcu

SEQ ID NO: 3652942 - RNA, 23 nt, Human
cauauuuguuuaugguaaaaaau

SEQ ID NO: 3652943 - RNA, 17 nt, Human
cauauuuuaaacagagg

SEQ ID NO: 3652944 - RNA, 15 nt, Human
cauauuuuaauuuca

SEQ ID NO: 3652945 - RNA, 18 nt, Human
cauauuuuacuuggaaau

SEQ ID NO: 3652946 - RNA, 23 nt, Human
cauauuuuacuuggaaauauuaa

SEQ ID NO: 3652947 - RNA, 17 nt, Human
cauauuuuauagaacuu

SEQ ID NO: 3652948 - RNA, 19 nt, Human
cauauuuuuuauaucugga

SEQ ID NO: 3652949 - RNA, 15 nt, Human
cauauuuuuuuccuu

SEQ ID NO: 3652950 - RNA, 18 nt, Human
caucaaaccuuugaguag

SEQ ID NO: 3652951 - RNA, 23 nt, Human
caucaaagaggcugaggcuggca

SEQ ID NO: 3652952 - RNA, 19 nt, Human
caucaaauggaagacacau

SEQ ID NO: 3652953 - RNA, 16 nt, Human
caucaacaaagaaaua

SEQ ID NO: 3652954 - RNA, 10 nt, Human
caucaacuga

SEQ ID NO: 3652955 - RNA, 14 nt, Human
caucaacugaauga

SEQ ID NO: 3652956 - RNA, 16 nt, Human
caucaagaagggcugc

SEQ ID NO: 3652957 - RNA, 19 nt, Human
caucaagaagguagcuuga

SEQ ID NO: 3652958 - RNA, 15 nt, Human
caucaagacuuugcu

SEQ ID NO: 3652959 - RNA, 12 nt, Human
caucaagagaau

SEQ ID NO: 3652960 - RNA, 14 nt, Human
caucaagaugugac

SEQ ID NO: 3652961 - RNA, 23 nt, Human
caucaagcacagaaggaggagga

SEQ ID NO: 3652962 - RNA, 16 nt, Human
caucaaggcacugccu

SEQ ID NO: 3652963 - RNA, 22 nt, Human
caucaauaguguccuaugcaau

SEQ ID NO: 3652964 - RNA, 23 nt, Human
caucaauaguguccuaugcaaua

SEQ ID NO: 3652965 - RNA, 19 nt, Human
caucaauauugucauuccu

SEQ ID NO: 3652966 - RNA, 11 nt, Human
caucaauguuc

SEQ ID NO: 3652967 - RNA, 14 nt, Human
caucaauguucauu

SEQ ID NO: 3652968 - RNA, 16 nt, Human
caucaauuaaaggcaa

SEQ ID NO: 3652969 - RNA, 16 nt, Human
caucaauuauagaaag

SEQ ID NO: 3652970 - RNA, 14 nt, Human
caucaauucccauu

SEQ ID NO: 3652971 - RNA, 11 nt, Human
caucacacaca

SEQ ID NO: 3652972 - RNA, 12 nt, Human
caucacacacac

SEQ ID NO: 3652973 - RNA, 12 nt, Human
caucacacacau

SEQ ID NO: 3652974 - RNA, 13 nt, Human
caucacacacaug

SEQ ID NO: 3652975 - RNA, 19 nt, Human
caucacacugggugguggc

SEQ ID NO: 3652976 - RNA, 19 nt, Human
caucacagcagccuccaac

SEQ ID NO: 3652977 - RNA, 22 nt, Human
caucacaggacacggggcagug

SEQ ID NO: 3652978 - RNA, 15 nt, Human
caucacagggcagag

SEQ ID NO: 3652979 - RNA, 21 nt, Human
caucacagggugggccucggc

SEQ ID NO: 3652980 - RNA, 22 nt, Human
caucacagggugggccucggcc

SEQ ID NO: 3652981 - RNA, 19 nt, Human
caucacaggguugggccca

SEQ ID NO: 3652982 - RNA, 22 nt, Human
caucacaggguugggcccagau

SEQ ID NO: 3652983 - RNA, 13 nt, Human
caucacaguuuug

SEQ ID NO: 3652984 - RNA, 13 nt, Human
caucaccacaguu

SEQ ID NO: 3652985 - RNA, 14 nt, Human
caucacccucuucc

SEQ ID NO: 3652986 - RNA, 21 nt, Human
caucacccucuuccugugauc

SEQ ID NO: 3652987 - RNA, 20 nt, Human
caucacccuuaccaugugcc

SEQ ID NO: 3652988 - RNA, 19 nt, Human
caucaccgacgcgucuccu

SEQ ID NO: 3652989 - RNA, 16 nt, Human
caucaccucagauggc

SEQ ID NO: 3652990 - RNA, 17 nt, Human
caucaccucagauggca

SEQ ID NO: 3652991 - RNA, 18 nt, Human
caucaccucaggccaggu

SEQ ID NO: 3652992 - RNA, 13 nt, Human
caucaccuccacc

SEQ ID NO: 3652993 - RNA, 23 nt, Human
caucaccuccccccccccgccac

SEQ ID NO: 3652994 - RNA, 14 nt, Human
caucaccugccugu

SEQ ID NO: 3652995 - RNA, 22 nt, Human
caucaccuuagaccaccaagcc

SEQ ID NO: 3652996 - RNA, 18 nt, Human
caucaccuuaggcaggga

SEQ ID NO: 3652997 - RNA, 20 nt, Human
caucacguguacuggcuccu

SEQ ID NO: 3652998 - RNA, 13 nt, Human
caucacuccccuc

SEQ ID NO: 3652999 - RNA, 18 nt, Human
caucacugcgccacugcu

SEQ ID NO: 3653000 - RNA, 19 nt, Human
caucacuggagcaccaggc

SEQ ID NO: 3653001 - RNA, 13 nt, Human
caucacuuaaaac

SEQ ID NO: 3653002 - RNA, 14 nt, Human
caucacuuaaaaca

SEQ ID NO: 3653003 - RNA, 12 nt, Human
caucacuucccu

SEQ ID NO: 3653004 - RNA, 20 nt, Human
caucacuugaauccuagggc

SEQ ID NO: 3653005 - RNA, 23 nt, Human
caucacuugaauccuagggccug

SEQ ID NO: 3653006 - RNA, 15 nt, Human
caucacuuuucagug

SEQ ID NO: 3653007 - RNA, 16 nt, Human
caucacuuuucaguga

SEQ ID NO: 3653008 - RNA, 22 nt, Human
caucagaaagcuuuauuuugag

SEQ ID NO: 3653009 - RNA, 11 nt, Human
caucagaaagg

SEQ ID NO: 3653010 - RNA, 16 nt, Human
caucagaaagggaggg

SEQ ID NO: 3653011 - RNA, 18 nt, Human
caucagaaagggagggcu

SEQ ID NO: 3653012 - RNA, 21 nt, Human
caucagaaagggagggcucug

SEQ ID NO: 3653013 - RNA, 24 nt, Human
caucagaaagggagggcucugagg

SEQ ID NO: 3653014 - RNA, 11 nt, Human
caucagaaaua

SEQ ID NO: 3653015 - RNA, 19 nt, Human
caucagaaauaauaaaaaa

SEQ ID NO: 3653016 - RNA, 14 nt, Human
caucagaacagcug

SEQ ID NO: 3653017 - RNA, 17 nt, Human
caucagaacagcuguug

SEQ ID NO: 3653018 - RNA, 14 nt, Human
ccuggucuguagaa

SEQ ID NO: 3653019 - RNA, 23 nt, Human
ccuggugacaucagguuuuuccc

SEQ ID NO: 3653020 - RNA, 17 nt, Human
ccuggugaccccuuuuc

SEQ ID NO: 3653021 - RNA, 17 nt, Human
ccuggugcacuggcccc

SEQ ID NO: 3653022 - RNA, 19 nt, Human
ccuggugcacuggccccac

SEQ ID NO: 3653023 - RNA, 12 nt, Human
ccuggugcccug

SEQ ID NO: 3653024 - RNA, 9 nt, Human
ccuggugcu

SEQ ID NO: 3653025 - RNA, 12 nt, Human
ccuggugcucuc

SEQ ID NO: 3653026 - RNA, 15 nt, Human
ccuggugcucucugc

SEQ ID NO: 3653027 - RNA, 17 nt, Human
ccuggugcucucugcca

SEQ ID NO: 3653028 - RNA, 20 nt, Human
ccuggugcugccucuaccug

SEQ ID NO: 3653029 - RNA, 12 nt, Human
ccuggugcugcu

SEQ ID NO: 3653030 - RNA, 15 nt, Human
ccuggugcuuccaaa

SEQ ID NO: 3653031 - RNA, 20 nt, Human
ccuggugcuucuccucuccu

SEQ ID NO: 3653032 - RNA, 12 nt, Human
ccugguggcagc

SEQ ID NO: 3653033 - RNA, 14 nt, Human
ccugguggcagcuc

SEQ ID NO: 3653034 - RNA, 15 nt, Human
ccugguggcagcugc

SEQ ID NO: 3653035 - RNA, 16 nt, Human
ccugguggcagcugcg

SEQ ID NO: 3653036 - RNA, 13 nt, Human
ccugguggcagug

SEQ ID NO: 3653037 - RNA, 18 nt, Human
ccugguggccaugcuccu

SEQ ID NO: 3653038 - RNA, 24 nt, Human
ccugguggccaugcuccucuuccc

SEQ ID NO: 3653039 - RNA, 23 nt, Human
ccugguggcccucuccccugccc

SEQ ID NO: 3653040 - RNA, 14 nt, Human
ccuggugggccaac

SEQ ID NO: 3653041 - RNA, 23 nt, Human
ccuggugggccaacaaagaacac

SEQ ID NO: 3653042 - RNA, 18 nt, Human
ccuggugggccuccucug

SEQ ID NO: 3653043 - RNA, 21 nt, Human
ccugguggggcagcuccucug

SEQ ID NO: 3653044 - RNA, 23 nt, Human
ccugguggguccaggggccccuc

SEQ ID NO: 3653045 - RNA, 21 nt, Human
ccuggugguggcucgggaggc

SEQ ID NO: 3653046 - RNA, 13 nt, Human
ccuggugguucac

SEQ ID NO: 3653047 - RNA, 21 nt, Human
ccuggugguugcuguuuuccu

SEQ ID NO: 3653048 - RNA, 20 nt, Human
ccuggugucaccccagagcc

SEQ ID NO: 3653049 - RNA, 23 nt, Human
ccuggugucaccccagagccaca

SEQ ID NO: 3653050 - RNA, 13 nt, Human
ccugguguggaag

SEQ ID NO: 3653051 - RNA, 20 nt, Human
ccugguuaaauaaggcaggg

SEQ ID NO: 3653052 - RNA, 23 nt, Human
ccugguuauugauguggcccugg

SEQ ID NO: 3653053 - RNA, 13 nt, Human
ccugguucccguu

SEQ ID NO: 3653054 - RNA, 21 nt, Human
ccugguuccggaauccugucc

SEQ ID NO: 3653055 - RNA, 13 nt, Human
ccugguucucauc

SEQ ID NO: 3653056 - RNA, 15 nt, Human
ccugguucucaucuu

SEQ ID NO: 3653057 - RNA, 16 nt, Human
ccugguucucaucuuu

SEQ ID NO: 3653058 - RNA, 14 nt, Human
ccugguugaagaag

SEQ ID NO: 3653059 - RNA, 16 nt, Human
ccugguuguguguccc

SEQ ID NO: 3653060 - RNA, 17 nt, Human
ccugguuucacuggccc

SEQ ID NO: 3653061 - RNA, 21 nt, Human
ccugguuucauaacuuccugu

SEQ ID NO: 3653062 - RNA, 16 nt, Human
ccugguuuccugcccu

SEQ ID NO: 3653063 - RNA, 19 nt, Human
ccugguuuccugcccuggg

SEQ ID NO: 3653064 - RNA, 22 nt, Human
ccugguuuccugcccugggagg

SEQ ID NO: 3653065 - RNA, 18 nt, Human
ccugguuuuuguagccuu

SEQ ID NO: 3653066 - RNA, 19 nt, Human
ccuguaaaaaaaaaaaagu

SEQ ID NO: 3653067 - RNA, 16 nt, Human
ccuguaaacacucagc

SEQ ID NO: 3653068 - RNA, 13 nt, Human
ccuguaaaccuga

SEQ ID NO: 3653069 - RNA, 19 nt, Human
ccuguaaaugguguacaua

SEQ ID NO: 3653070 - RNA, 13 nt, Human
ccuguaaauuauu

SEQ ID NO: 3653071 - RNA, 17 nt, Human
ccuguaaauuauuuuaa

SEQ ID NO: 3653072 - RNA, 23 nt, Human
ccuguaaauuauuuuaaauuaua

SEQ ID NO: 3653073 - RNA, 22 nt, Human
ccuguaacacaagccacagaag

SEQ ID NO: 3653074 - RNA, 17 nt, Human
ccuguaacacuccucug

SEQ ID NO: 3653075 - RNA, 18 nt, Human
ccuguaacacuccucugc

SEQ ID NO: 3653076 - RNA, 18 nt, Human
ccuguaacuugagaguag

SEQ ID NO: 3653077 - RNA, 17 nt, Human
ccuguaagccaaagaaa

SEQ ID NO: 3653078 - RNA, 19 nt, Human
ccuguaagccugcaagccu

SEQ ID NO: 3653079 - RNA, 15 nt, Human
ccuguaauaaauaug

SEQ ID NO: 3653080 - RNA, 16 nt, Human
ccuguaauaaauauga

SEQ ID NO: 3653081 - RNA, 14 nt, Human
ccuguaaucccagc

SEQ ID NO: 3653082 - RNA, 17 nt, Human
ccuguaaucccagcacu

SEQ ID NO: 3653083 - RNA, 20 nt, Human
ccuguaaucccagcacuuug

SEQ ID NO: 3653084 - RNA, 16 nt, Human
ccuguaaucccagcag

SEQ ID NO: 3653085 - RNA, 15 nt, Human
ccuguaaucccagcu

SEQ ID NO: 3653086 - RNA, 18 nt, Human
ccuguaaucccagcuacu

SEQ ID NO: 3653087 - RNA, 17 nt, Human
ccuguaauucaguguau

SEQ ID NO: 3653088 - RNA, 21 nt, Human
ccuguacaaaagggacaugaa

SEQ ID NO: 3653089 - RNA, 17 nt, Human
ccuguacacaacucacu

SEQ ID NO: 3653090 - RNA, 14 nt, Human
ccuguacagucugu

SEQ ID NO: 3653091 - RNA, 16 nt, Human
ccuguacagucugucu

SEQ ID NO: 3653092 - RNA, 17 nt, Human
ccuguacagucugucuu

SEQ ID NO: 3653093 - RNA, 17 nt, Human
ccuguaccccagcacuu

SEQ ID NO: 3653094 - RNA, 16 nt, Human
ccuguaccucauccca

SEQ ID NO: 3653095 - RNA, 12 nt, Human
ccuguaccucuu

SEQ ID NO: 3653096 - RNA, 23 nt, Human
ccuguaccuuuugaggagcccca

SEQ ID NO: 3653097 - RNA, 13 nt, Human
ccuguacucagga

SEQ ID NO: 3653098 - RNA, 14 nt, Human
ccuguacucaggag

SEQ ID NO: 3653099 - RNA, 22 nt, Human
ccuguacucaggaggcugaggg

SEQ ID NO: 3653100 - RNA, 18 nt, Human
ccuguacucgcuugugca

SEQ ID NO: 3653101 - RNA, 14 nt, Human
ccuguacugccugc

SEQ ID NO: 3653102 - RNA, 12 nt, Human
ccuguacuuuuu

SEQ ID NO: 3653103 - RNA, 20 nt, Human
ccuguagaauagccuguggc

SEQ ID NO: 3653104 - RNA, 23 nt, Human
ccuguagaccuagggaggaccuu

SEQ ID NO: 3653105 - RNA, 15 nt, Human
ccuguagagugggag

SEQ ID NO: 3653106 - RNA, 16 nt, Human
ccuguagagugggagc

SEQ ID NO: 3653107 - RNA, 19 nt, Human
caucuuuccugauggcagg

SEQ ID NO: 3653108 - RNA, 20 nt, Human
caucuuucucuuuucuaaaa

SEQ ID NO: 3653109 - RNA, 17 nt, Human
caucuuucugcuccuga

SEQ ID NO: 3653110 - RNA, 23 nt, Human
caucuuucuucuauuuuauuccc

SEQ ID NO: 3653111 - RNA, 11 nt, Human
caucuuugaaa

SEQ ID NO: 3653112 - RNA, 13 nt, Human
caucuuugaugug

SEQ ID NO: 3653113 - RNA, 14 nt, Human
caucuuugaugugu

SEQ ID NO: 3653114 - RNA, 22 nt, Human
caucuuugccuugggcugcucc

SEQ ID NO: 3653115 - RNA, 12 nt, Human
caucuuugggga

SEQ ID NO: 3653116 - RNA, 13 nt, Human
caucuuugugaag

SEQ ID NO: 3653117 - RNA, 14 nt, Human
caucuuugugaagg

SEQ ID NO: 3653118 - RNA, 14 nt, Human
caucuuuucuugcc

SEQ ID NO: 3653119 - RNA, 21 nt, Human
caucuuuugaggcuucuguuc

SEQ ID NO: 3653120 - RNA, 18 nt, Human
caucuuuuguauuaagaa

SEQ ID NO: 3653121 - RNA, 22 nt, Human
caucuuuuguauuaagaaagga

SEQ ID NO: 3653122 - RNA, 16 nt, Human
caucuuuugugagaug

SEQ ID NO: 3653123 - RNA, 23 nt, Human
caucuuuuguuacucuugggaca

SEQ ID NO: 3653124 - RNA, 18 nt, Human
caucuuuuuuguuaacug

SEQ ID NO: 3653125 - RNA, 18 nt, Human
caugaaaaaaggacaauu

SEQ ID NO: 3653126 - RNA, 12 nt, Human
caugaaaaagca

SEQ ID NO: 3653127 - RNA, 13 nt, Human
caugaaaacacau

SEQ ID NO: 3653128 - RNA, 16 nt, Human
caugaaaacacauuuu

SEQ ID NO: 3653129 - RNA, 21 nt, Human
caugaaaacacauuuuucuua

SEQ ID NO: 3653130 - RNA, 16 nt, Human
caugaaaacguuuuau

SEQ ID NO: 3653131 - RNA, 15 nt, Human
caugaaaaugcaaca

SEQ ID NO: 3653132 - RNA, 16 nt, Human
caugaaaauguguguu

SEQ ID NO: 3653133 - RNA, 14 nt, Human
caugaaaauuuuaa

SEQ ID NO: 3653134 - RNA, 17 nt, Human
caugaaaauuuuaaaaa

SEQ ID NO: 3653135 - RNA, 19 nt, Human
caugaaaauuuuaaaaaua

SEQ ID NO: 3653136 - RNA, 13 nt, Human
caugaaacaaagc

SEQ ID NO: 3653137 - RNA, 14 nt, Human
caugaaacuccacc

SEQ ID NO: 3653138 - RNA, 22 nt, Human
caugaaauauagaucaguuaua

SEQ ID NO: 3653139 - RNA, 15 nt, Human
caugaaauaugcauc

SEQ ID NO: 3653140 - RNA, 19 nt, Human
caugaaaugaacacaaauu

SEQ ID NO: 3653141 - RNA, 19 nt, Human
caugaaaugugaauuuuua

SEQ ID NO: 3653142 - RNA, 23 nt, Human
caugaaaugugaauuuuuauugu

SEQ ID NO: 3653143 - RNA, 14 nt, Human
caugaaauuacuua

SEQ ID NO: 3653144 - RNA, 17 nt, Human
caugaaauuuuuguaaa

SEQ ID NO: 3653145 - RNA, 17 nt, Human
caugaacacacuguguc

SEQ ID NO: 3653146 - RNA, 19 nt, Human
caugaacacaucagcuagc

SEQ ID NO: 3653147 - RNA, 23 nt, Human
caugaacagaaaacauucugauu

SEQ ID NO: 3653148 - RNA, 17 nt, Human
caugaacuuagauuuua

SEQ ID NO: 3653149 - RNA, 15 nt, Human
caugaagaauagaaa

SEQ ID NO: 3653150 - RNA, 14 nt, Human
caugaagacaggac

SEQ ID NO: 3653151 - RNA, 16 nt, Human
caugaagacaggacag

SEQ ID NO: 3653152 - RNA, 15 nt, Human
caugaagaccuuuuu

SEQ ID NO: 3653153 - RNA, 17 nt, Human
caugaagaccuuuuucu

SEQ ID NO: 3653154 - RNA, 22 nt, Human
caugaagaccuuuuucugcacu

SEQ ID NO: 3653155 - RNA, 15 nt, Human
caugaagagaagcaa

SEQ ID NO: 3653156 - RNA, 15 nt, Human
caugaagagcaaaaa

SEQ ID NO: 3653157 - RNA, 17 nt, Human
caugaagagcaaaaaua

SEQ ID NO: 3653158 - RNA, 19 nt, Human
caugaagagcaaaaauauc

SEQ ID NO: 3653159 - RNA, 20 nt, Human
caugaagauaaacacagcug

SEQ ID NO: 3653160 - RNA, 22 nt, Human
caugaagcccaagugaaaucaa

SEQ ID NO: 3653161 - RNA, 12 nt, Human
caugaagccugu

SEQ ID NO: 3653162 - RNA, 11 nt, Human
caugaagccuu

SEQ ID NO: 3653163 - RNA, 15 nt, Human
ccuggaagacagaga

SEQ ID NO: 3653164 - RNA, 22 nt, Human
ccuggaagacagagaccuccug

SEQ ID NO: 3653165 - RNA, 20 nt, Human
ccuggaagagcccagucugu

SEQ ID NO: 3653166 - RNA, 15 nt, Human
ccuggaagcagugcc

SEQ ID NO: 3653167 - RNA, 17 nt, Human
ccuggaagcagugccca

SEQ ID NO: 3653168 - RNA, 19 nt, Human
ccuggaagcagugcccagg

SEQ ID NO: 3653169 - RNA, 13 nt, Human
ccuggaagcugug

SEQ ID NO: 3653170 - RNA, 17 nt, Human
ccuggaagcuguguccu

SEQ ID NO: 3653171 - RNA, 23 nt, Human
ccuggaagcuguguccuugcacc

SEQ ID NO: 3653172 - RNA, 17 nt, Human
ccuggaagggagguggg

SEQ ID NO: 3653173 - RNA, 11 nt, Human
ccuggaagggc

SEQ ID NO: 3653174 - RNA, 12 nt, Human
ccuggaagggcu

SEQ ID NO: 3653175 - RNA, 24 nt, Human
ccuggaagggcuagaaccuguaga

SEQ ID NO: 3653176 - RNA, 20 nt, Human
ccuggaaugaguugaggcca

SEQ ID NO: 3653177 - RNA, 22 nt, Human
ccuggaauuagcuuggggccag

SEQ ID NO: 3653178 - RNA, 15 nt, Human
ccuggaauugccagc

SEQ ID NO: 3653179 - RNA, 17 nt, Human
ccuggaauugccagcug

SEQ ID NO: 3653180 - RNA, 13 nt, Human
ccuggacaaaccc

SEQ ID NO: 3653181 - RNA, 15 nt, Human
ccuggacagcugugc

SEQ ID NO: 3653182 - RNA, 18 nt, Human
ccuggacagcugugccuc

SEQ ID NO: 3653183 - RNA, 22 nt, Human
ccuggacagcugugccucgcuc

SEQ ID NO: 3653184 - RNA, 18 nt, Human
ccuggacauagagaggga

SEQ ID NO: 3653185 - RNA, 21 nt, Human
ccuggacaugaagauucuuuc

SEQ ID NO: 3653186 - RNA, 20 nt, Human
ccuggacauuugccuugcug

SEQ ID NO: 3653187 - RNA, 12 nt, Human
ccuggaccccag

SEQ ID NO: 3653188 - RNA, 14 nt, Human
ccuggaccccagcc

SEQ ID NO: 3653189 - RNA, 15 nt, Human
ccuggaccccagccu

SEQ ID NO: 3653190 - RNA, 16 nt, Human
ccuggaccccagccuc

SEQ ID NO: 3653191 - RNA, 16 nt, Human
ccuggacccccagcuu

SEQ ID NO: 3653192 - RNA, 22 nt, Human
ccuggacccguucaugggggag

SEQ ID NO: 3653193 - RNA, 14 nt, Human
ccuggacccugugg

SEQ ID NO: 3653194 - RNA, 17 nt, Human
ccuggaccucugacagc

SEQ ID NO: 3653195 - RNA, 18 nt, Human
ccuggaccucugacagca

SEQ ID NO: 3653196 - RNA, 16 nt, Human
ccuggaccugccuccu

SEQ ID NO: 3653197 - RNA, 22 nt, Human
ccuggaccugccuccugccugc

SEQ ID NO: 3653198 - RNA, 23 nt, Human
ccuggaccugccuccugccugcc

SEQ ID NO: 3653199 - RNA, 15 nt, Human
ccuggacuagaggga

SEQ ID NO: 3653200 - RNA, 22 nt, Human
ccuggacuagagggaccucucc

SEQ ID NO: 3653201 - RNA, 17 nt, Human
ccuggacucccguguag

SEQ ID NO: 3653202 - RNA, 13 nt, Human
ccuggacugggag

SEQ ID NO: 3653203 - RNA, 17 nt, Human
ccuggacugggagguag

SEQ ID NO: 3653204 - RNA, 18 nt, Human
ccuggacugggagguaga

SEQ ID NO: 3653205 - RNA, 20 nt, Human
ccuggacugugugcucagga

SEQ ID NO: 3653206 - RNA, 14 nt, Human
ccuggacuguuuuc

SEQ ID NO: 3653207 - RNA, 24 nt, Human
ccuggacuuaagcaucuggcucua

SEQ ID NO: 3653208 - RNA, 16 nt, Human
ccuggacuugccucug

SEQ ID NO: 3653209 - RNA, 13 nt, Human
ccuggacuuuccu

SEQ ID NO: 3653210 - RNA, 15 nt, Human
ccuggacuuuccugc

SEQ ID NO: 3653211 - RNA, 17 nt, Human
ccuggacuuuccugcaa

SEQ ID NO: 3653212 - RNA, 19 nt, Human
ccuggacuuuccugcaacu

SEQ ID NO: 3653213 - RNA, 16 nt, Human
ccuggagaacuagaga

SEQ ID NO: 3653214 - RNA, 17 nt, Human
ccuggagacguggaacc

SEQ ID NO: 3653215 - RNA, 18 nt, Human
ccuggagacugcccagcu

SEQ ID NO: 3653216 - RNA, 19 nt, Human
ccuggagacuuagggcacc

SEQ ID NO: 3653217 - RNA, 23 nt, Human
ccuggagacuuagggcaccaggg

SEQ ID NO: 3653218 - RNA, 21 nt, Human
ccuggagagccagaaccugga

SEQ ID NO: 3653219 - RNA, 22 nt, Human
ccuggagagccagaaccuggag

SEQ ID NO: 3653220 - RNA, 19 nt, Human
ccuggagagcuagaaccua

SEQ ID NO: 3653221 - RNA, 17 nt, Human
ccuggagagucucacuc

SEQ ID NO: 3653222 - RNA, 22 nt, Human
ccuggagaguucaauggcugcu

SEQ ID NO: 3653223 - RNA, 16 nt, Human
ccuggagauccuccug

SEQ ID NO: 3653224 - RNA, 16 nt, Human
ccuggagauggggaga

SEQ ID NO: 3653225 - RNA, 16 nt, Human
ccuggagcacaaagac

SEQ ID NO: 3653226 - RNA, 13 nt, Human
ccuggagcagaag

SEQ ID NO: 3653227 - RNA, 17 nt, Human
ccuggagcagaagcagc

SEQ ID NO: 3653228 - RNA, 13 nt, Human
ccuggagcaggcc

SEQ ID NO: 3653229 - RNA, 14 nt, Human
ccuggagcaggccu

SEQ ID NO: 3653230 - RNA, 19 nt, Human
ccuggagcaggccuugcgc

SEQ ID NO: 3653231 - RNA, 13 nt, Human
ccuggagcccaga

SEQ ID NO: 3653232 - RNA, 17 nt, Human
ccuggagcccagaggag

SEQ ID NO: 3653233 - RNA, 13 nt, Human
ccuggagccccac

SEQ ID NO: 3653234 - RNA, 16 nt, Human
ccuggagccccugggu

SEQ ID NO: 3653235 - RNA, 21 nt, Human
ccuggagcccuccgccuucac

SEQ ID NO: 3653236 - RNA, 22 nt, Human
ccuggagcguuucuagcaagug

SEQ ID NO: 3653237 - RNA, 14 nt, Human
ccuggagcuccugg

SEQ ID NO: 3653238 - RNA, 20 nt, Human
ccuggaggaccugagccugc

SEQ ID NO: 3653239 - RNA, 18 nt, Human
ccuggaggacggccggcu

SEQ ID NO: 3653240 - RNA, 18 nt, Human
ccuggaggauugcaggug

SEQ ID NO: 3653241 - RNA, 14 nt, Human
ccuggaggcccagu

SEQ ID NO: 3653242 - RNA, 17 nt, Human
ccuggaggcggugcggc

SEQ ID NO: 3653243 - RNA, 19 nt, Human
ccuggaggcucaaauuuug

SEQ ID NO: 3653244 - RNA, 20 nt, Human
ccuggaggcucaaauuuuga

SEQ ID NO: 3653245 - RNA, 21 nt, Human
ccuggagggaagaguggaggu

SEQ ID NO: 3653246 - RNA, 19 nt, Human
ccuggagggcuagaaccua

SEQ ID NO: 3653247 - RNA, 20 nt, Human
ccuggagggcuagaaccuag

SEQ ID NO: 3653248 - RNA, 21 nt, Human
ccuggagggcuagaaccugga

SEQ ID NO: 3653249 - RNA, 22 nt, Human
ccuggaggggcuagaaccuaga

SEQ ID NO: 3653250 - RNA, 19 nt, Human
ccuggaggggcuggggacu

SEQ ID NO: 3653251 - RNA, 21 nt, Human
ccuggagguggcugagccccu

SEQ ID NO: 3653252 - RNA, 15 nt, Human
ccuggaguauaauau

SEQ ID NO: 3653253 - RNA, 22 nt, Human
ccuggaguguaugacugcacau

SEQ ID NO: 3653254 - RNA, 16 nt, Human
ccuggaguucugguuc

SEQ ID NO: 3653255 - RNA, 17 nt, Human
ccuggaguucugguucc

SEQ ID NO: 3653256 - RNA, 18 nt, Human
ccuggauauuauucuugu

SEQ ID NO: 3653257 - RNA, 23 nt, Human
ccuggaucacgacgcugcagagc

SEQ ID NO: 3653258 - RNA, 17 nt, Human
ccuggaucagcguggcc

SEQ ID NO: 3653259 - RNA, 20 nt, Human
ccuggaucagcguggccuug

SEQ ID NO: 3653260 - RNA, 18 nt, Human
ccuggauccccucugucu

SEQ ID NO: 3653261 - RNA, 22 nt, Human
ccuggaucuaccagcauaaaua

SEQ ID NO: 3653262 - RNA, 14 nt, Human
ccuggaugccaucc

SEQ ID NO: 3653263 - RNA, 14 nt, Human
ccuggaugcccccu

SEQ ID NO: 3653264 - RNA, 18 nt, Human
ccuggaugcccccugugg

SEQ ID NO: 3653265 - RNA, 17 nt, Human
ccuggauucauuuccug

SEQ ID NO: 3653266 - RNA, 19 nt, Human
ccuggauucauuuccugcc

SEQ ID NO: 3653267 - RNA, 23 nt, Human
ccuggcaagcuagaaccuggagg

SEQ ID NO: 3653268 - RNA, 12 nt, Human
ccuggcacacau

SEQ ID NO: 3653269 - RNA, 15 nt, Human
ccuggcacaggacug

SEQ ID NO: 3653270 - RNA, 17 nt, Human
ccuggcacagggcagug

SEQ ID NO: 3653271 - RNA, 21 nt, Human
ccuggcacagugucugggcug

SEQ ID NO: 3653272 - RNA, 19 nt, Human
ccugugccagcccagaggc

SEQ ID NO: 3653273 - RNA, 14 nt, Human
ccugugccagguga

SEQ ID NO: 3653274 - RNA, 13 nt, Human
ccugugcccccag

SEQ ID NO: 3653275 - RNA, 16 nt, Human
ccugugccuccaucag

SEQ ID NO: 3653276 - RNA, 15 nt, Human
ccugugccuccucac

SEQ ID NO: 3653277 - RNA, 21 nt, Human
ccugugccuccucacccccag

SEQ ID NO: 3653278 - RNA, 20 nt, Human
ccugugccucugggacugga

SEQ ID NO: 3653279 - RNA, 17 nt, Human
ccugugccuuuugccau

SEQ ID NO: 3653280 - RNA, 17 nt, Human
ccugugcuacuuugccu

SEQ ID NO: 3653281 - RNA, 23 nt, Human
ccugugcuacuuugccuuuugca

SEQ ID NO: 3653282 - RNA, 20 nt, Human
ccugugcuccgugccuccac

SEQ ID NO: 3653283 - RNA, 22 nt, Human
ccugugcugcccgucuucagcc

SEQ ID NO: 3653284 - RNA, 18 nt, Human
ccugugcugguguccuga

SEQ ID NO: 3653285 - RNA, 23 nt, Human
ccugugcugguguccugaccacc

SEQ ID NO: 3653286 - RNA, 24 nt, Human
ccugugcugguguccugaccaccc

SEQ ID NO: 3653287 - RNA, 19 nt, Human
ccuguggaacauaaaaagg

SEQ ID NO: 3653288 - RNA, 23 nt, Human
ccuguggaacauaaaaaggacau

SEQ ID NO: 3653289 - RNA, 15 nt, Human
ccuguggaacccagc

SEQ ID NO: 3653290 - RNA, 19 nt, Human
ccuguggaagagugugugu

SEQ ID NO: 3653291 - RNA, 16 nt, Human
ccuguggaagggacua

SEQ ID NO: 3653292 - RNA, 21 nt, Human
ccuguggaaugagugugcaug

SEQ ID NO: 3653293 - RNA, 23 nt, Human
ccuguggaaugagugugcaugga

SEQ ID NO: 3653294 - RNA, 14 nt, Human
ccuguggagacugg

SEQ ID NO: 3653295 - RNA, 18 nt, Human
ccuguggagcucagcccc

SEQ ID NO: 3653296 - RNA, 18 nt, Human
ccuguggaucaaauccag

SEQ ID NO: 3653297 - RNA, 20 nt, Human
ccuguggaugagcccucaga

SEQ ID NO: 3653298 - RNA, 17 nt, Human
ccuguggaugcugcugc

SEQ ID NO: 3653299 - RNA, 23 nt, Human
ccuguggcaucuuugccuugggc

SEQ ID NO: 3653300 - RNA, 22 nt, Human
ccuguggccccacccugggccc

SEQ ID NO: 3653301 - RNA, 18 nt, Human
ccuguggccuguguccca

SEQ ID NO: 3653302 - RNA, 21 nt, Human
ccuguggccugugucccauga

SEQ ID NO: 3653303 - RNA, 23 nt, Human
ccuguggccugugucccaugacc

SEQ ID NO: 3653304 - RNA, 21 nt, Human
ccuguggcgccgucuccaggg

SEQ ID NO: 3653305 - RNA, 17 nt, Human
ccuguggcggugccugg

SEQ ID NO: 3653306 - RNA, 18 nt, Human
ccuuggacaacuuuucuc

SEQ ID NO: 3653307 - RNA, 17 nt, Human
ccuuggacauccuccuc

SEQ ID NO: 3653308 - RNA, 18 nt, Human
ccuuggacauuuuauguc

SEQ ID NO: 3653309 - RNA, 15 nt, Human
ccuuggacuguguuu

SEQ ID NO: 3653310 - RNA, 15 nt, Human
ccuuggacuugagga

SEQ ID NO: 3653311 - RNA, 16 nt, Human
ccuuggagcuuacaua

SEQ ID NO: 3653312 - RNA, 12 nt, Human
ccuuggaggcca

SEQ ID NO: 3653313 - RNA, 16 nt, Human
ccuuggaggccagcca

SEQ ID NO: 3653314 - RNA, 16 nt, Human
ccuuggcaccaaagau

SEQ ID NO: 3653315 - RNA, 15 nt, Human
ccuuggcaccagaca

SEQ ID NO: 3653316 - RNA, 20 nt, Human
ccuuggcaccagacacccag

SEQ ID NO: 3653317 - RNA, 21 nt, Human
ccuuggcaccagacacccagg

SEQ ID NO: 3653318 - RNA, 22 nt, Human
ccuuggcaccagacacccagga

SEQ ID NO: 3653319 - RNA, 16 nt, Human
ccuuggcauagacaug

SEQ ID NO: 3653320 - RNA, 19 nt, Human
ccuuggccggcugugcuca

SEQ ID NO: 3653321 - RNA, 20 nt, Human
ccuuggccggcugugcucag

SEQ ID NO: 3653322 - RNA, 21 nt, Human
ccuuggccggcugugcucaga

SEQ ID NO: 3653323 - RNA, 11 nt, Human
ccuuggccuca

SEQ ID NO: 3653324 - RNA, 13 nt, Human
ccuuggccucaga

SEQ ID NO: 3653325 - RNA, 13 nt, Human
ccuuggccuggag

SEQ ID NO: 3653326 - RNA, 12 nt, Human
ccugucccaccu

SEQ ID NO: 3653327 - RNA, 16 nt, Human
ccugucccaccucuuc

SEQ ID NO: 3653328 - RNA, 16 nt, Human
ccugucccauggacac

SEQ ID NO: 3653329 - RNA, 19 nt, Human
ccugucccauggacacucc

SEQ ID NO: 3653330 - RNA, 14 nt, Human
ccuguccccacccu

SEQ ID NO: 3653331 - RNA, 13 nt, Human
ccuguccccaugc

SEQ ID NO: 3653332 - RNA, 15 nt, Human
ccugucccccagcuc

SEQ ID NO: 3653333 - RNA, 16 nt, Human
ccugucccccagcucu

SEQ ID NO: 3653334 - RNA, 19 nt, Human
ccugucccccagcucuggu

SEQ ID NO: 3653335 - RNA, 16 nt, Human
ccugucccccugacaa

SEQ ID NO: 3653336 - RNA, 23 nt, Human
ccugucccccugagaucagaguc

SEQ ID NO: 3653337 - RNA, 12 nt, Human
ccuguccccgca

SEQ ID NO: 3653338 - RNA, 18 nt, Human
ccuguccccgcacugggc

SEQ ID NO: 3653339 - RNA, 14 nt, Human
ccuguccccgcagc

SEQ ID NO: 3653340 - RNA, 14 nt, Human
ccuguccccucagc

SEQ ID NO: 3653341 - RNA, 15 nt, Human
ccuguccccucagcu

SEQ ID NO: 3653342 - RNA, 16 nt, Human
ccuguccccucagcuc

SEQ ID NO: 3653343 - RNA, 14 nt, Human
ccuguccccugcua

SEQ ID NO: 3653344 - RNA, 16 nt, Human
ccugucccucccaccu

SEQ ID NO: 3653345 - RNA, 17 nt, Human
ccugucccucccaccuc

SEQ ID NO: 3653346 - RNA, 20 nt, Human
ccugucccucccaccucugu

SEQ ID NO: 3653347 - RNA, 15 nt, Human
ccugucccucucagg

SEQ ID NO: 3653348 - RNA, 16 nt, Human
ccugucccucucaggc

SEQ ID NO: 3653349 - RNA, 13 nt, Human
ccugucccugcgc

SEQ ID NO: 3653350 - RNA, 19 nt, Human
ccugucccuggccaucucu

SEQ ID NO: 3653351 - RNA, 15 nt, Human
ccuguccgcccucuu

SEQ ID NO: 3653352 - RNA, 18 nt, Human
ccuguccuaaggaaccuu

SEQ ID NO: 3653353 - RNA, 13 nt, Human
ccuguccucacug

SEQ ID NO: 3653354 - RNA, 22 nt, Human
ccuguccucacugcucccugaa

SEQ ID NO: 3653355 - RNA, 16 nt, Human
ccuguccucccauccc

SEQ ID NO: 3653356 - RNA, 14 nt, Human
ccuguccuccucgg

SEQ ID NO: 3653357 - RNA, 23 nt, Human
ccuguccuccucggaucaccgag

SEQ ID NO: 3653358 - RNA, 14 nt, Human
ccuguccuccuggu

SEQ ID NO: 3653359 - RNA, 17 nt, Human
ccuguccucuuucagcu

SEQ ID NO: 3653360 - RNA, 19 nt, Human
ccuguccugaccugucuca

SEQ ID NO: 3653361 - RNA, 19 nt, Human
ccuguccugccuaaggcug

SEQ ID NO: 3653362 - RNA, 16 nt, Human
ccuguccugggcuggu

SEQ ID NO: 3653363 - RNA, 19 nt, Human
ccuguccuuagccuaggcc

SEQ ID NO: 3653364 - RNA, 14 nt, Human
ccugucgagacacu

SEQ ID NO: 3653365 - RNA, 20 nt, Human
ccugucgagacacuugccuu

SEQ ID NO: 3653366 - RNA, 16 nt, Human
ccugucgauuagacug

SEQ ID NO: 3653367 - RNA, 21 nt, Human
ccugucggagcccugucuccu

SEQ ID NO: 3653368 - RNA, 22 nt, Human
ccugucggagcccugucuccuc

SEQ ID NO: 3653369 - RNA, 13 nt, Human
ccugucggccugg

SEQ ID NO: 3653370 - RNA, 16 nt, Human
ccugucgggcuuugug

SEQ ID NO: 3653371 - RNA, 22 nt, Human
ccugucgggcuuugugugaagg

SEQ ID NO: 3653372 - RNA, 22 nt, Human
ccugucuagucucuccuguaag

SEQ ID NO: 3653373 - RNA, 15 nt, Human
ccugucucaccugga

SEQ ID NO: 3653374 - RNA, 16 nt, Human
ccugucucagccuccc

SEQ ID NO: 3653375 - RNA, 14 nt, Human
ccugucuccccucu

SEQ ID NO: 3653376 - RNA, 17 nt, Human
ccugucuccccucugcu

SEQ ID NO: 3653377 - RNA, 13 nt, Human
ccugucuccuuuc

SEQ ID NO: 3653378 - RNA, 21 nt, Human
ccugucucuagccacuuuggu

SEQ ID NO: 3653379 - RNA, 19 nt, Human
ccugucucucagggccagg

SEQ ID NO: 3653380 - RNA, 21 nt, Human
ccugucugccagccagcagcc

SEQ ID NO: 3653381 - RNA, 14 nt, Human
ccugucugccccag

SEQ ID NO: 3653382 - RNA, 19 nt, Human
ccugucugccccagcccag

SEQ ID NO: 3653383 - RNA, 21 nt, Human
ccugucugucugucuguccca

SEQ ID NO: 3653384 - RNA, 22 nt, Human
ccugucugucugucugucccaa

SEQ ID NO: 3653385 - RNA, 19 nt, Human
ccugucugugaagagcaag

SEQ ID NO: 3653386 - RNA, 22 nt, Human
ccugucuuauccuccaccgucu

SEQ ID NO: 3653387 - RNA, 19 nt, Human
ccugucuucagagaaccca

SEQ ID NO: 3653388 - RNA, 14 nt, Human
ccugucuucccagg

SEQ ID NO: 3653389 - RNA, 22 nt, Human
ccugucuuccugcauucaccca

SEQ ID NO: 3653390 - RNA, 13 nt, Human
ccugucuucugcu

SEQ ID NO: 3653391 - RNA, 15 nt, Human
ccugucuucugcuuu

SEQ ID NO: 3653392 - RNA, 13 nt, Human
ccugucuuuccua

SEQ ID NO: 3653393 - RNA, 14 nt, Human
ccugugaaauacca

SEQ ID NO: 3653394 - RNA, 19 nt, Human
ccugugaaauaguucaaag

SEQ ID NO: 3653395 - RNA, 15 nt, Human
ccugugaacccagga

SEQ ID NO: 3653396 - RNA, 14 nt, Human
ccugugacaaaauu

SEQ ID NO: 3653397 - RNA, 17 nt, Human
ccugugacauggugccu

SEQ ID NO: 3653398 - RNA, 18 nt, Human
ccugugacauggugccug

SEQ ID NO: 3653399 - RNA, 15 nt, Human
ccugugaccacaaca

SEQ ID NO: 3653400 - RNA, 19 nt, Human
ccugugaccacaacaugag

SEQ ID NO: 3653401 - RNA, 17 nt, Human
ccugugaccagcacugu

SEQ ID NO: 3653402 - RNA, 19 nt, Human
ccugugaccagucugaccc

SEQ ID NO: 3653403 - RNA, 13 nt, Human
ccugugagccagu

SEQ ID NO: 3653404 - RNA, 15 nt, Human
ccugugagcccagcu

SEQ ID NO: 3653405 - RNA, 19 nt, Human
ccugugaggugcagagugc

SEQ ID NO: 3653406 - RNA, 19 nt, Human
ccugugagguuucccaaug

SEQ ID NO: 3653407 - RNA, 21 nt, Human
ccugugaucuuauuuuucuaa

SEQ ID NO: 3653408 - RNA, 16 nt, Human
ccugugaugcugggca

SEQ ID NO: 3653409 - RNA, 21 nt, Human
ccugugauggggcccugccuc

SEQ ID NO: 3653410 - RNA, 14 nt, Human
ccugugcacacaca

SEQ ID NO: 3653411 - RNA, 23 nt, Human
ccugugcacaccccacucccaca

SEQ ID NO: 3653412 - RNA, 12 nt, Human
ccugugcacagc

SEQ ID NO: 3653413 - RNA, 17 nt, Human
ccugugcauguaugucu

SEQ ID NO: 3653414 - RNA, 20 nt, Human
ccugugcauguaugucuugg

SEQ ID NO: 3653415 - RNA, 14 nt, Human
ccugugccagccca

SEQ ID NO: 3653416 - RNA, 18 nt, Human
ccugugccuaacaccagc

SEQ ID NO: 3653417 - RNA, 12 nt, Human
ccugugccuccu

SEQ ID NO: 3653418 - RNA, 20 nt, Human
ccugugccuccucaccccca

SEQ ID NO: 3653419 - RNA, 15 nt, Human
ccugugccuccuccc

SEQ ID NO: 3653420 - RNA, 15 nt, Human
ccugugccucuggga

SEQ ID NO: 3653421 - RNA, 19 nt, Human
ccugugccucugggacugg

SEQ ID NO: 3653422 - RNA, 15 nt, Human
ccugugcuacuuugc

SEQ ID NO: 3653423 - RNA, 14 nt, Human
ccugugcucagccc

SEQ ID NO: 3653424 - RNA, 17 nt, Human
ccugugcucagcccuga

SEQ ID NO: 3653425 - RNA, 14 nt, Human
ccugugcuggggga

SEQ ID NO: 3653426 - RNA, 14 nt, Human
ccugugcugguguc

SEQ ID NO: 3653427 - RNA, 21 nt, Human
ccugugcugguguccugacca

SEQ ID NO: 3653428 - RNA, 22 nt, Human
ccugugcugguguccugaccac

SEQ ID NO: 3653429 - RNA, 22 nt, Human
ccugugcuucgggcccuuccca

SEQ ID NO: 3653430 - RNA, 19 nt, Human
ccuguggaagggacuagga

SEQ ID NO: 3653431 - RNA, 20 nt, Human
ccuguggaagggacuaggag

SEQ ID NO: 3653432 - RNA, 11 nt, Human
ccuguggagac

SEQ ID NO: 3653433 - RNA, 17 nt, Human
ccuguggagcccgcacc

SEQ ID NO: 3653434 - RNA, 18 nt, Human
ccuguggagcccgcaccc

SEQ ID NO: 3653435 - RNA, 19 nt, Human
ccuguggagcucagccccg

SEQ ID NO: 3653436 - RNA, 15 nt, Human
ccuguggcaggcagc

SEQ ID NO: 3653437 - RNA, 21 nt, Human
ccuguggcaguaaagagaaac

SEQ ID NO: 3653438 - RNA, 22 nt, Human
ccuguggcaguaaagagaaacu

SEQ ID NO: 3653439 - RNA, 23 nt, Human
ccuguggcaguaaagagaaacuu

SEQ ID NO: 3653440 - RNA, 15 nt, Human
ccuguggcauaaauu

SEQ ID NO: 3653441 - RNA, 21 nt, Human
ccuguggcccuguccugccau

SEQ ID NO: 3653442 - RNA, 13 nt, Human
ccuguggccugug

SEQ ID NO: 3653443 - RNA, 14 nt, Human
ccuguggccugugu

SEQ ID NO: 3653444 - RNA, 19 nt, Human
ccuguggccugugucccau

SEQ ID NO: 3653445 - RNA, 22 nt, Human
ccuguggcgccgucuccagggg

SEQ ID NO: 3653446 - RNA, 16 nt, Human
ccuguggcggugccug

SEQ ID NO: 3653447 - RNA, 20 nt, Human
ccuguggcggugccugggug

SEQ ID NO: 3653448 - RNA, 12 nt, Human
ccuguggcugcg

SEQ ID NO: 3653449 - RNA, 16 nt, Human
ccugugggagccucgc

SEQ ID NO: 3653450 - RNA, 17 nt, Human
ccugugggagccucgca

SEQ ID NO: 3653451 - RNA, 20 nt, Human
ccugugggcccccaaaugga

SEQ ID NO: 3653452 - RNA, 13 nt, Human
ccuuccccauggg

SEQ ID NO: 3653453 - RNA, 13 nt, Human
ccuuccccgaggg

SEQ ID NO: 3653454 - RNA, 15 nt, Human
ccuuccccucccugg

SEQ ID NO: 3653455 - RNA, 18 nt, Human
ccuuccccucccuggcuc

SEQ ID NO: 3653456 - RNA, 19 nt, Human
ccuuccccucccuggcucc

SEQ ID NO: 3653457 - RNA, 22 nt, Human
ccuuccccucccuggcucccau

SEQ ID NO: 3653458 - RNA, 15 nt, Human
ccuuccccuuccuuc

SEQ ID NO: 3653459 - RNA, 16 nt, Human
ccuucccuaaagugau

SEQ ID NO: 3653460 - RNA, 17 nt, Human
ccuucccuaaagugaug

SEQ ID NO: 3653461 - RNA, 23 nt, Human
ccuucccucaccuuggcaccaga

SEQ ID NO: 3653462 - RNA, 13 nt, Human
ccuucccuccucc

SEQ ID NO: 3653463 - RNA, 12 nt, Human
ccuucccuccug

SEQ ID NO: 3653464 - RNA, 15 nt, Human
ccuucccuccugcuu

SEQ ID NO: 3653465 - RNA, 12 nt, Human
ccuucccugcac

SEQ ID NO: 3653466 - RNA, 13 nt, Human
ccuucccugcacu

SEQ ID NO: 3653467 - RNA, 15 nt, Human
ccuucccugggcugu

SEQ ID NO: 3653468 - RNA, 12 nt, Human
ccuucccugucc

SEQ ID NO: 3653469 - RNA, 13 nt, Human
ccuucccuguccc

SEQ ID NO: 3653470 - RNA, 18 nt, Human
ccuucccugucugccagg

SEQ ID NO: 3653471 - RNA, 17 nt, Human
ccuucccugugccuccu

SEQ ID NO: 3653472 - RNA, 20 nt, Human
ccuucccugugccuccuccc

SEQ ID NO: 3653473 - RNA, 12 nt, Human
ccuucccuugcc

SEQ ID NO: 3653474 - RNA, 16 nt, Human
ccuucccuugccacuu

SEQ ID NO: 3653475 - RNA, 19 nt, Human
ccuucccuugccacuuugc

SEQ ID NO: 3653476 - RNA, 18 nt, Human
ccuucccuuuucuguucu

SEQ ID NO: 3653477 - RNA, 22 nt, Human
ccuucccuuuucuguucuaguu

SEQ ID NO: 3653478 - RNA, 18 nt, Human
ccuuccgcaguguggcca

SEQ ID NO: 3653479 - RNA, 14 nt, Human
ccuuccgccacugg

SEQ ID NO: 3653480 - RNA, 18 nt, Human
ccuuccgccacuggggcu

SEQ ID NO: 3653481 - RNA, 16 nt, Human
ccuuccgccccuuccc

SEQ ID NO: 3653482 - RNA, 19 nt, Human
ccuuccgccccuucccuuc

SEQ ID NO: 3653483 - RNA, 20 nt, Human
ccuuccuacacccuuggacu

SEQ ID NO: 3653484 - RNA, 17 nt, Human
ccuuccucauccacccc

SEQ ID NO: 3653485 - RNA, 18 nt, Human
ccuuccucauccacccca

SEQ ID NO: 3653486 - RNA, 23 nt, Human
ccuuccuccauccuccuccuucc

SEQ ID NO: 3653487 - RNA, 22 nt, Human
ccuuccucccaccucccccucc

SEQ ID NO: 3653488 - RNA, 22 nt, Human
ccuuccucucauccuuuucucc

SEQ ID NO: 3653489 - RNA, 22 nt, Human
ccuuccucuccacccucccaga

SEQ ID NO: 3653490 - RNA, 15 nt, Human
ccuuccucuccacug

SEQ ID NO: 3653491 - RNA, 16 nt, Human
ccuuccucuccacugc

SEQ ID NO: 3653492 - RNA, 21 nt, Human
ccuuccucuccuuccuuguua

SEQ ID NO: 3653493 - RNA, 17 nt, Human
ccuuccucucuccagau

SEQ ID NO: 3653494 - RNA, 20 nt, Human
ccuuccucugagccuuggga

SEQ ID NO: 3653495 - RNA, 13 nt, Human
ccuuccucugagg

SEQ ID NO: 3653496 - RNA, 14 nt, Human
ccuuccucugaggc

SEQ ID NO: 3653497 - RNA, 17 nt, Human
ccuuccucugcagcuga

SEQ ID NO: 3653498 - RNA, 12 nt, Human
ccuuccucugcu

SEQ ID NO: 3653499 - RNA, 15 nt, Human
ccuuccucuggggcu

SEQ ID NO: 3653500 - RNA, 14 nt, Human
ccuuccucuuucca

SEQ ID NO: 3653501 - RNA, 16 nt, Human
ccuuccugccaccagu

SEQ ID NO: 3653502 - RNA, 18 nt, Human
cgaagaaaaaaaauaaca

SEQ ID NO: 3653503 - RNA, 15 nt, Human
cgaagaagagccaca

SEQ ID NO: 3653504 - RNA, 16 nt, Human
cgaagaagagccacag

SEQ ID NO: 3653505 - RNA, 17 nt, Human
cgaagaagagccacagu

SEQ ID NO: 3653506 - RNA, 14 nt, Human
cgaagaagaugcuc

SEQ ID NO: 3653507 - RNA, 17 nt, Human
cgaagaauggagaggaa

SEQ ID NO: 3653508 - RNA, 15 nt, Human
cgaagaguucccuug

SEQ ID NO: 3653509 - RNA, 18 nt, Human
cgaagauuucauccagaa

SEQ ID NO: 3653510 - RNA, 23 nt, Human
cgaagcgcgccacucgcuucccc

SEQ ID NO: 3653511 - RNA, 17 nt, Human
cgaagcuaacagggaag

SEQ ID NO: 3653512 - RNA, 17 nt, Human
cgaagcucagcccaccc

SEQ ID NO: 3653513 - RNA, 18 nt, Human
cgaagcucagcccacccc

SEQ ID NO: 3653514 - RNA, 23 nt, Human
cgaaggaaaagggcuuucucaau

SEQ ID NO: 3653515 - RNA, 13 nt, Human
cgaaggggcccug

SEQ ID NO: 3653516 - RNA, 21 nt, Human
cgaaguagcuugcucccugug

SEQ ID NO: 3653517 - RNA, 19 nt, Human
cgaagucauuaaacugguu

SEQ ID NO: 3653518 - RNA, 15 nt, Human
cgaaguccuauggaa

SEQ ID NO: 3653519 - RNA, 20 nt, Human
cgaaguccuauggaaacccg

SEQ ID NO: 3653520 - RNA, 19 nt, Human
cgaaguggacuggccccug

SEQ ID NO: 3653521 - RNA, 13 nt, Human
cgaaguguugcau

SEQ ID NO: 3653522 - RNA, 10 nt, Human
cgaauaaaug

SEQ ID NO: 3653523 - RNA, 19 nt, Human
cgaauacuuuugcccuuug

SEQ ID NO: 3653524 - RNA, 14 nt, Human
cgaauagacaucaa

SEQ ID NO: 3653525 - RNA, 14 nt, Human
cgaauagcugggac

SEQ ID NO: 3653526 - RNA, 15 nt, Human
cgaauagcugggacu

SEQ ID NO: 3653527 - RNA, 21 nt, Human
cgaauagcugggacuacaggu

SEQ ID NO: 3653528 - RNA, 14 nt, Human
cgaauauugcugau

SEQ ID NO: 3653529 - RNA, 15 nt, Human
cgaauauugcugaug

SEQ ID NO: 3653530 - RNA, 17 nt, Human
cgaauauugcugauggu

SEQ ID NO: 3653531 - RNA, 17 nt, Human
cgaaucauuuguucaaa

SEQ ID NO: 3653532 - RNA, 15 nt, Human
cgaaucucaaaauua

SEQ ID NO: 3653533 - RNA, 12 nt, Human
cgaaucucugug

SEQ ID NO: 3653534 - RNA, 12 nt, Human
cgaaugacacug

SEQ ID NO: 3653535 - RNA, 16 nt, Human
cgaaugacacuguuca

SEQ ID NO: 3653536 - RNA, 23 nt, Human
cgaauguguacaacuuaaguugg

SEQ ID NO: 3653537 - RNA, 18 nt, Human
cgaaugugucuuuagaua

SEQ ID NO: 3653538 - RNA, 22 nt, Human
cgaauuaauagcuuuuauugua

SEQ ID NO: 3653539 - RNA, 21 nt, Human
cgacaaagcugcuaaaucucc

SEQ ID NO: 3653540 - RNA, 12 nt, Human
cgacaaugcaaa

SEQ ID NO: 3653541 - RNA, 13 nt, Human
cgacaaugcaaac

SEQ ID NO: 3653542 - RNA, 18 nt, Human
cgacacggucucggauca

SEQ ID NO: 3653543 - RNA, 17 nt, Human
cgacacucucuggaagc

SEQ ID NO: 3653544 - RNA, 21 nt, Human
cgacacugcagccccacccag

SEQ ID NO: 3653545 - RNA, 17 nt, Human
cgacacugggaggccag

SEQ ID NO: 3653546 - RNA, 11 nt, Human
cgacagagcag

SEQ ID NO: 3653547 - RNA, 16 nt, Human
cgacagcauuuuccuc

SEQ ID NO: 3653548 - RNA, 15 nt, Human
cgacagcccccucug

SEQ ID NO: 3653549 - RNA, 14 nt, Human
cgacagccuggcac

SEQ ID NO: 3653550 - RNA, 14 nt, Human
cgacaggcccuggc

SEQ ID NO: 3653551 - RNA, 22 nt, Human
cgacauagcccaucccugccug

SEQ ID NO: 3653552 - RNA, 13 nt, Human
cgacauugucucc

SEQ ID NO: 3653553 - RNA, 14 nt, Human
cgaccaccugccca

SEQ ID NO: 3653554 - RNA, 12 nt, Human
cgaccagccagg

SEQ ID NO: 3653555 - RNA, 14 nt, Human
cgaccauguggcca

SEQ ID NO: 3653556 - RNA, 16 nt, Human
cgaccauguggccaca

SEQ ID NO: 3653557 - RNA, 16 nt, Human
cgaccccaucugccca

SEQ ID NO: 3653558 - RNA, 16 nt, Human
cgaccccccgugggcu

SEQ ID NO: 3653559 - RNA, 19 nt, Human
cgaccccccgugggcuccc

SEQ ID NO: 3653560 - RNA, 19 nt, Human
cgaccccgucacagccuca

SEQ ID NO: 3653561 - RNA, 18 nt, Human
cgacccucugggaaccuc

SEQ ID NO: 3653562 - RNA, 23 nt, Human
cgacccucugggaaccucccaga

SEQ ID NO: 3653563 - RNA, 19 nt, Human
cgacccugggggcacagga

SEQ ID NO: 3653564 - RNA, 23 nt, Human
cgacccugggggcacaggaggca

SEQ ID NO: 3653565 - RNA, 19 nt, Human
cgaccgaggcuggagcugg

SEQ ID NO: 3653566 - RNA, 12 nt, Human
cgaccucggugg

SEQ ID NO: 3653567 - RNA, 16 nt, Human
cgaccucguccucccc

SEQ ID NO: 3653568 - RNA, 20 nt, Human
cgaccucuccaucuucagcu

SEQ ID NO: 3653569 - RNA, 16 nt, Human
cgaccugccucggccu

SEQ ID NO: 3653570 - RNA, 17 nt, Human
cgaccuggccugucugu

SEQ ID NO: 3653571 - RNA, 15 nt, Human
cgacuagacacacaa

SEQ ID NO: 3653572 - RNA, 13 nt, Human
cgacuagccagga

SEQ ID NO: 3653573 - RNA, 10 nt, Human
cgacuccagc

SEQ ID NO: 3653574 - RNA, 14 nt, Human
cgacuccagccagc

SEQ ID NO: 3653575 - RNA, 16 nt, Human
cgacuccagccagcgc

SEQ ID NO: 3653576 - RNA, 20 nt, Human
cgacuccagccagcgccucc

SEQ ID NO: 3653577 - RNA, 21 nt, Human
cgacuccagccagcgccuccc

SEQ ID NO: 3653578 - RNA, 16 nt, Human
cgacuccguuggccac

SEQ ID NO: 3653579 - RNA, 13 nt, Human
cgacucugaccuc

SEQ ID NO: 3653580 - RNA, 23 nt, Human
cgacucugugccucccuccccag

SEQ ID NO: 3653581 - RNA, 20 nt, Human
cgacucugugcuggccagcg

SEQ ID NO: 3653582 - RNA, 17 nt, Human
cgacugccaucuuggac

SEQ ID NO: 3653583 - RNA, 17 nt, Human
cgacugcccggcagggu

SEQ ID NO: 3653584 - RNA, 11 nt, Human
cgacugucucc

SEQ ID NO: 3653585 - RNA, 17 nt, Human
cgacuugcauaccugcu

SEQ ID NO: 3653586 - RNA, 16 nt, Human
cgacuugcauuuuugc

SEQ ID NO: 3653587 - RNA, 13 nt, Human
cgacuuuauuuuc

SEQ ID NO: 3653588 - RNA, 13 nt, Human
cgacuuucugccu

SEQ ID NO: 3653589 - RNA, 17 nt, Human
cgagaaagaggcaccag

SEQ ID NO: 3653590 - RNA, 21 nt, Human
cgagaaagaggcaccaggaag

SEQ ID NO: 3653591 - RNA, 21 nt, Human
cgagaaauucguguguuuuuu

SEQ ID NO: 3653592 - RNA, 20 nt, Human
cgagaagcugcucuggaauu

SEQ ID NO: 3653593 - RNA, 14 nt, Human
cgagacacuugccu

SEQ ID NO: 3653594 - RNA, 17 nt, Human
cgagaccaaccugacca

SEQ ID NO: 3653595 - RNA, 16 nt, Human
cgagaccauccuggcu

SEQ ID NO: 3653596 - RNA, 22 nt, Human
cgagaccgggcccuggguuccu

SEQ ID NO: 3653597 - RNA, 14 nt, Human
cgagacuuuccauu

SEQ ID NO: 3653598 - RNA, 17 nt, Human
ccuuuguugaacuguua

SEQ ID NO: 3653599 - RNA, 20 nt, Human
ccuuuguugaacuguuagaa

SEQ ID NO: 3653600 - RNA, 19 nt, Human
ccuuuguuuuuaugaagaa

SEQ ID NO: 3653601 - RNA, 19 nt, Human
ccuuuguuuuuuuuuccug

SEQ ID NO: 3653602 - RNA, 22 nt, Human
ccuuuuaaauccuguugaaaag

SEQ ID NO: 3653603 - RNA, 11 nt, Human
ccuuuuacugg

SEQ ID NO: 3653604 - RNA, 12 nt, Human
ccuuuuacuggu

SEQ ID NO: 3653605 - RNA, 21 nt, Human
ccuuuuagccuaguucaucca

SEQ ID NO: 3653606 - RNA, 11 nt, Human
ccuuuuauagc

SEQ ID NO: 3653607 - RNA, 16 nt, Human
ccuuuuauagcuauua

SEQ ID NO: 3653608 - RNA, 16 nt, Human
ccuuuuauaucccauu

SEQ ID NO: 3653609 - RNA, 19 nt, Human
ccuuuuaucccaaaguugu

SEQ ID NO: 3653610 - RNA, 15 nt, Human
ccuuuucacuacacc

SEQ ID NO: 3653611 - RNA, 21 nt, Human
ccuuuucagcuucugcugggc

SEQ ID NO: 3653612 - RNA, 14 nt, Human
ccuuuucaggaaaa

SEQ ID NO: 3653613 - RNA, 10 nt, Human
ccuuuucaua

SEQ ID NO: 3653614 - RNA, 18 nt, Human
ccuuuucauaggucugaa

SEQ ID NO: 3653615 - RNA, 12 nt, Human
ccuuuuccaugc

SEQ ID NO: 3653616 - RNA, 16 nt, Human
ccuuuucccggggagg

SEQ ID NO: 3653617 - RNA, 20 nt, Human
ccuuuucgcaggauucuucc

SEQ ID NO: 3653618 - RNA, 15 nt, Human
ccuuuucuauuccuu

SEQ ID NO: 3653619 - RNA, 18 nt, Human
ccuuuucuccuaucuuca

SEQ ID NO: 3653620 - RNA, 18 nt, Human
ccuuuucugucucucucu

SEQ ID NO: 3653621 - RNA, 21 nt, Human
ccuuuucuuuuguuacuguuc

SEQ ID NO: 3653622 - RNA, 23 nt, Human
ccuuuugaggagccccagcuacc

SEQ ID NO: 3653623 - RNA, 22 nt, Human
ccuuuugagggacaaauuuaaa

SEQ ID NO: 3653624 - RNA, 15 nt, Human
ccuuuugagugccuu

SEQ ID NO: 3653625 - RNA, 15 nt, Human
ccuuuugcaccccuc

SEQ ID NO: 3653626 - RNA, 12 nt, Human
ccuuuugccaau

SEQ ID NO: 3653627 - RNA, 18 nt, Human
ccuuuugcuugaaaccaa

SEQ ID NO: 3653628 - RNA, 12 nt, Human
ccuuuuggcccc

SEQ ID NO: 3653629 - RNA, 21 nt, Human
ccuuuuggcccccgagcuggg

SEQ ID NO: 3653630 - RNA, 23 nt, Human
ccuuuuggcccccgagcuggggg

SEQ ID NO: 3653631 - RNA, 21 nt, Human
ccuuuuggugaaagcugagaa

SEQ ID NO: 3653632 - RNA, 19 nt, Human
ccuuuuguagaaugaacca

SEQ ID NO: 3653633 - RNA, 21 nt, Human
ccuuuuguauacauccugggu

SEQ ID NO: 3653634 - RNA, 12 nt, Human
ccuuuugucuuc

SEQ ID NO: 3653635 - RNA, 19 nt, Human
ccuuuuguucauuucaucc

SEQ ID NO: 3653636 - RNA, 15 nt, Human
ccuuuuuaaaacaca

SEQ ID NO: 3653637 - RNA, 17 nt, Human
ccuuuuuaaaacacaug

SEQ ID NO: 3653638 - RNA, 11 nt, Human
ccuuuuuaagg

SEQ ID NO: 3653639 - RNA, 15 nt, Human
ccuuuuuauaacuuu

SEQ ID NO: 3653640 - RNA, 21 nt, Human
ccuuuuuauaacuuuuuauau

SEQ ID NO: 3653641 - RNA, 12 nt, Human
ccuuuuuauuua

SEQ ID NO: 3653642 - RNA, 13 nt, Human
ccuuuuuauuuau

SEQ ID NO: 3653643 - RNA, 16 nt, Human
ccuuuuuauuuauaug

SEQ ID NO: 3653644 - RNA, 17 nt, Human
ccuuuuuauuugcaugu

SEQ ID NO: 3653645 - RNA, 18 nt, Human
ccuuuuuauuugcaugug

SEQ ID NO: 3653646 - RNA, 21 nt, Human
ccuuuuucaaugaauuuuaua

SEQ ID NO: 3653647 - RNA, 22 nt, Human
ccuuuuucauauguugcucagu

SEQ ID NO: 3653648 - RNA, 17 nt, Human
ccuuuuucauuauuuua

SEQ ID NO: 3653649 - RNA, 13 nt, Human
ccuuuuucauuua

SEQ ID NO: 3653650 - RNA, 17 nt, Human
ccuuuuucccaauaaau

SEQ ID NO: 3653651 - RNA, 21 nt, Human
ccuuuuuccccaaagucuuaa

SEQ ID NO: 3653652 - RNA, 13 nt, Human
ccuuuuuccuucc

SEQ ID NO: 3653653 - RNA, 14 nt, Human
ccuuuuucuccagc

SEQ ID NO: 3653654 - RNA, 23 nt, Human
ccuuuuugguacuuauuacugcu

SEQ ID NO: 3653655 - RNA, 14 nt, Human
ccuuuuuguauaaa

SEQ ID NO: 3653656 - RNA, 13 nt, Human
ccuuuuuuaaaaa

SEQ ID NO: 3653657 - RNA, 18 nt, Human
ccuuuuuuauacauaaac

SEQ ID NO: 3653658 - RNA, 15 nt, Human
ccuuuuuuauaucuu

SEQ ID NO: 3653659 - RNA, 22 nt, Human
ccuuuuuucacggaaguuuuca

SEQ ID NO: 3653660 - RNA, 11 nt, Human
ccuuuuuuccc

SEQ ID NO: 3653661 - RNA, 15 nt, Human
ccuuuuuuccccaga

SEQ ID NO: 3653662 - RNA, 20 nt, Human
ccuuuuuucugccuccuuua

SEQ ID NO: 3653663 - RNA, 17 nt, Human
ccuuuuuuggcugcuga

SEQ ID NO: 3653664 - RNA, 20 nt, Human
ccuuuuuuggcuuuagacac

SEQ ID NO: 3653665 - RNA, 16 nt, Human
ccuuuuuuuuuuuucc

SEQ ID NO: 3653666 - RNA, 19 nt, Human
cgaaaaauccucuuccucu

SEQ ID NO: 3653667 - RNA, 21 nt, Human
cgaaaaauccucuuccucuga

SEQ ID NO: 3653668 - RNA, 22 nt, Human
cgaaaaccaggccuuaucucca

SEQ ID NO: 3653669 - RNA, 19 nt, Human
cgaaaacguggcugcuuca

SEQ ID NO: 3653670 - RNA, 20 nt, Human
cgaaaacguggcugcuucaa

SEQ ID NO: 3653671 - RNA, 15 nt, Human
cgaaaagagucuucc

SEQ ID NO: 3653672 - RNA, 22 nt, Human
cgaaaaucauauaaucuuacaa

SEQ ID NO: 3653673 - RNA, 23 nt, Human
cgaaacacaaaccacaacugaca

SEQ ID NO: 3653674 - RNA, 22 nt, Human
cgaaacaggcuacucuccucgg

SEQ ID NO: 3653675 - RNA, 18 nt, Human
cgaaaccuugccuuucuc

SEQ ID NO: 3653676 - RNA, 16 nt, Human
cgaaacuggaaguuau

SEQ ID NO: 3653677 - RNA, 15 nt, Human
cgaaacuuguuauug

SEQ ID NO: 3653678 - RNA, 23 nt, Human
cgaaacuuguuauugugaaugau

SEQ ID NO: 3653679 - RNA, 21 nt, Human
cgaaagaacaguccauugaaa

SEQ ID NO: 3653680 - RNA, 11 nt, Human
cgaaagagaga

SEQ ID NO: 3653681 - RNA, 13 nt, Human
cgaaagagagaga

SEQ ID NO: 3653682 - RNA, 23 nt, Human
cgaaagagagagaaacaaacuuu

SEQ ID NO: 3653683 - RNA, 12 nt, Human
cgaaagcacaca

SEQ ID NO: 3653684 - RNA, 14 nt, Human
cgaaagcucuagaa

SEQ ID NO: 3653685 - RNA, 19 nt, Human
cgaaagcugggcaacaugc

SEQ ID NO: 3653686 - RNA, 15 nt, Human
cgaaaggucaccuca

SEQ ID NO: 3653687 - RNA, 21 nt, Human
cgaaaggucaccucacucagc

SEQ ID NO: 3653688 - RNA, 17 nt, Human
cgaaauaacaauguuaa

SEQ ID NO: 3653689 - RNA, 21 nt, Human
cgaaauaauuguuguucuguu

SEQ ID NO: 3653690 - RNA, 16 nt, Human
cgaaaucccugcucac

SEQ ID NO: 3653691 - RNA, 22 nt, Human
cgaaaucccugcucacugcagc

SEQ ID NO: 3653692 - RNA, 13 nt, Human
cgaaaugcugucu

SEQ ID NO: 3653693 - RNA, 22 nt, Human
cgaaauguuauuuuuuaauuau

SEQ ID NO: 3653694 - RNA, 22 nt, Human
cgaacacccucgaagcgcgcca

SEQ ID NO: 3653695 - RNA, 12 nt, Human
cgaaccaggagc

SEQ ID NO: 3653696 - RNA, 20 nt, Human
cgaacccacacugcaacagg

SEQ ID NO: 3653697 - RNA, 13 nt, Human
cgaaccccaagga

SEQ ID NO: 3653698 - RNA, 16 nt, Human
cgaaccuccucuguga

SEQ ID NO: 3653699 - RNA, 16 nt, Human
cgaacgacaauagcuu

SEQ ID NO: 3653700 - RNA, 14 nt, Human
cgaacuggcugcaa

SEQ ID NO: 3653701 - RNA, 18 nt, Human
cgaagaaggguccuuccc

SEQ ID NO: 3653702 - RNA, 20 nt, Human
cgaagacccucuugcccauc

SEQ ID NO: 3653703 - RNA, 23 nt, Human
cgaagacccucuugcccauccug

SEQ ID NO: 3653704 - RNA, 23 nt, Human
cgaagaguauuuuugacagaaua

SEQ ID NO: 3653705 - RNA, 23 nt, Human
cgaagcaugaacagugcaccugg

SEQ ID NO: 3653706 - RNA, 18 nt, Human
cgaagcccagagggucug

SEQ ID NO: 3653707 - RNA, 14 nt, Human
cgcuuggagcagag

SEQ ID NO: 3653708 - RNA, 21 nt, Human
cgcuuggcuccaugcuccuca

SEQ ID NO: 3653709 - RNA, 22 nt, Human
cgcuugggcgccgugcugggca

SEQ ID NO: 3653710 - RNA, 20 nt, Human
cgcuuguagaacucacucug

SEQ ID NO: 3653711 - RNA, 20 nt, Human
cgcuuguccagcgccuagug

SEQ ID NO: 3653712 - RNA, 20 nt, Human
cgcuugugcagaaaacauug

SEQ ID NO: 3653713 - RNA, 22 nt, Human
cgcuugugcagaaaacauuguu

SEQ ID NO: 3653714 - RNA, 22 nt, Human
cgcuuguggggacccaggcucc

SEQ ID NO: 3653715 - RNA, 14 nt, Human
cgcuuuccugaauc

SEQ ID NO: 3653716 - RNA, 16 nt, Human
cgcuuucuagcuguug

SEQ ID NO: 3653717 - RNA, 11 nt, Human
cgcuuuuccuu

SEQ ID NO: 3653718 - RNA, 14 nt, Human
cgcuuuuccuuggc

SEQ ID NO: 3653719 - RNA, 17 nt, Human
cgcuuuuguucucgcaa

SEQ ID NO: 3653720 - RNA, 11 nt, Human
cgcuuuuugaa

SEQ ID NO: 3653721 - RNA, 16 nt, Human
cgcuuuuugaaaaagc

SEQ ID NO: 3653722 - RNA, 17 nt, Human
cggaaaccuugguguag

SEQ ID NO: 3653723 - RNA, 20 nt, Human
cggaaagguauuugggaaac

SEQ ID NO: 3653724 - RNA, 20 nt, Human
cggaaccgcccaggaucaga

SEQ ID NO: 3653725 - RNA, 19 nt, Human
cggaaccugugagcugcac

SEQ ID NO: 3653726 - RNA, 16 nt, Human
cggaacguuggacuuu

SEQ ID NO: 3653727 - RNA, 14 nt, Human
cggaagcagugccu

SEQ ID NO: 3653728 - RNA, 20 nt, Human
cggaagccuuuuuccccaaa

SEQ ID NO: 3653729 - RNA, 15 nt, Human
cggaagcuccuggua

SEQ ID NO: 3653730 - RNA, 19 nt, Human
cggaaggaccuauguuugc

SEQ ID NO: 3653731 - RNA, 18 nt, Human
cggaaggcuggcugggca

SEQ ID NO: 3653732 - RNA, 17 nt, Human
cggaaggguaaacaaua

SEQ ID NO: 3653733 - RNA, 17 nt, Human
cggaagguuuuuaaaca

SEQ ID NO: 3653734 - RNA, 18 nt, Human
cggaaguuuucaaugaug

SEQ ID NO: 3653735 - RNA, 15 nt, Human
cggaauccuguccuc

SEQ ID NO: 3653736 - RNA, 17 nt, Human
cggaauccuguccucag

SEQ ID NO: 3653737 - RNA, 16 nt, Human
cggacaagacccccag

SEQ ID NO: 3653738 - RNA, 20 nt, Human
cggacaagacccccagcacu

SEQ ID NO: 3653739 - RNA, 14 nt, Human
cggacacuccuaga

SEQ ID NO: 3653740 - RNA, 22 nt, Human
cggacagccacggccaggccag

SEQ ID NO: 3653741 - RNA, 23 nt, Human
cggacaguuccagaagugugacu

SEQ ID NO: 3653742 - RNA, 14 nt, Human
cgacaaaucugucu

SEQ ID NO: 3653743 - RNA, 15 nt, Human
cgacaaaucugucug

SEQ ID NO: 3653744 - RNA, 20 nt, Human
cgacaacagauuggauuuua

SEQ ID NO: 3653745 - RNA, 15 nt, Human
cgacaaccgaugcuc

SEQ ID NO: 3653746 - RNA, 18 nt, Human
cgacaaccgaugcuccag

SEQ ID NO: 3653747 - RNA, 21 nt, Human
cgacaaccgaugcuccagcca

SEQ ID NO: 3653748 - RNA, 18 nt, Human
cgacacucaccaugaagc

SEQ ID NO: 3653749 - RNA, 18 nt, Human
cgacagagcaguugagag

SEQ ID NO: 3653750 - RNA, 16 nt, Human
cgacagagcgagacuu

SEQ ID NO: 3653751 - RNA, 12 nt, Human
cgacagccuggc

SEQ ID NO: 3653752 - RNA, 13 nt, Human
cgacagccuggca

SEQ ID NO: 3653753 - RNA, 16 nt, Human
cgacaggaguauuuuu

SEQ ID NO: 3653754 - RNA, 15 nt, Human
cgacagugagacucu

SEQ ID NO: 3653755 - RNA, 21 nt, Human
cgacaguggaugcugggucca

SEQ ID NO: 3653756 - RNA, 19 nt, Human
cgacauggacccggagcua

SEQ ID NO: 3653757 - RNA, 14 nt, Human
cgaccacagggucu

SEQ ID NO: 3653758 - RNA, 23 nt, Human
cgaccaccccugccuccacccuc

SEQ ID NO: 3653759 - RNA, 21 nt, Human
cgaccaccgccccuggccgcg

SEQ ID NO: 3653760 - RNA, 14 nt, Human
cgaccacuuccagg

SEQ ID NO: 3653761 - RNA, 23 nt, Human
cgaccagacaccuugacagggca

SEQ ID NO: 3653762 - RNA, 17 nt, Human
cgaccagaggagccuuu

SEQ ID NO: 3653763 - RNA, 15 nt, Human
cgaccccaucugccc

SEQ ID NO: 3653764 - RNA, 19 nt, Human
cgaccccuaguucccucug

SEQ ID NO: 3653765 - RNA, 14 nt, Human
cgacccucugggaa

SEQ ID NO: 3653766 - RNA, 22 nt, Human
cgacccucugggaaccucccag

SEQ ID NO: 3653767 - RNA, 17 nt, Human
cgacccugggggcacag

SEQ ID NO: 3653768 - RNA, 15 nt, Human
cgaccgaggcuggag

SEQ ID NO: 3653769 - RNA, 15 nt, Human
cgaccucagccuucc

SEQ ID NO: 3653770 - RNA, 14 nt, Human
cgaccucguccucc

SEQ ID NO: 3653771 - RNA, 22 nt, Human
cgaccucguccucccccugcca

SEQ ID NO: 3653772 - RNA, 15 nt, Human
cgaccugccucggcc

SEQ ID NO: 3653773 - RNA, 13 nt, Human
cgaccuggccgcg

SEQ ID NO: 3653774 - RNA, 19 nt, Human
cgaccuggccgcggagccu

SEQ ID NO: 3653775 - RNA, 14 nt, Human
cgaccuuggccgca

SEQ ID NO: 3653776 - RNA, 12 nt, Human
cgaccuuuaccu

SEQ ID NO: 3653777 - RNA, 15 nt, Human
cgacgcgucuccugu

SEQ ID NO: 3653778 - RNA, 13 nt, Human
cgacgcugcagag

SEQ ID NO: 3653779 - RNA, 21 nt, Human
cgacuaaacuagauuuucacu

SEQ ID NO: 3653780 - RNA, 16 nt, Human
cgacuagacacacaaa

SEQ ID NO: 3653781 - RNA, 20 nt, Human
cgacuagacacacaaagcag

SEQ ID NO: 3653782 - RNA, 11 nt, Human
cgacuccagcc

SEQ ID NO: 3653783 - RNA, 12 nt, Human
cgacuccagcca

SEQ ID NO: 3653784 - RNA, 18 nt, Human
cgacuccagccagcgccu

SEQ ID NO: 3653785 - RNA, 18 nt, Human
cgacucuauagacucuag

SEQ ID NO: 3653786 - RNA, 21 nt, Human
cgacucuuucugagugccuuc

SEQ ID NO: 3653787 - RNA, 22 nt, Human
cgacucuuucugagugccuucu

SEQ ID NO: 3653788 - RNA, 18 nt, Human
cgacugaaaauauuguuu

SEQ ID NO: 3653789 - RNA, 15 nt, Human
cgacuggccagggcc

SEQ ID NO: 3653790 - RNA, 17 nt, Human
cgacugugaccuguggg

SEQ ID NO: 3653791 - RNA, 19 nt, Human
cgacuguuguuaucuguuu

SEQ ID NO: 3653792 - RNA, 19 nt, Human
cgacuugaauuuucccacu

SEQ ID NO: 3653793 - RNA, 20 nt, Human
cgacuugaauuuucccacug

SEQ ID NO: 3653794 - RNA, 19 nt, Human
cgacuugugcacaggcaga

SEQ ID NO: 3653795 - RNA, 16 nt, Human
cgacuuucugccugga

SEQ ID NO: 3653796 - RNA, 23 nt, Human
cgacuuuguaccccccaaccccu

SEQ ID NO: 3653797 - RNA, 20 nt, Human
cgagaaauaaaguuugcuua

SEQ ID NO: 3653798 - RNA, 17 nt, Human
cgagaacuuucauuuuu

SEQ ID NO: 3653799 - RNA, 16 nt, Human
cgagaagcugcucugg

SEQ ID NO: 3653800 - RNA, 13 nt, Human
cgagaccagccug

SEQ ID NO: 3653801 - RNA, 15 nt, Human
cgagaccagccuggc

SEQ ID NO: 3653802 - RNA, 16 nt, Human
cgagaccagccuggcc

SEQ ID NO: 3653803 - RNA, 13 nt, Human
cgagaccagucug

SEQ ID NO: 3653804 - RNA, 17 nt, Human
cgagaccauccuggcua

SEQ ID NO: 3653805 - RNA, 16 nt, Human
cgagacggcacugaga

SEQ ID NO: 3653806 - RNA, 15 nt, Human
cgagagaggagccag

SEQ ID NO: 3653807 - RNA, 20 nt, Human
cgagagaggagccagacaga

SEQ ID NO: 3653808 - RNA, 21 nt, Human
cgagagaggagccagacagac

SEQ ID NO: 3653809 - RNA, 16 nt, Human
cgagagaucaaagaug

SEQ ID NO: 3653810 - RNA, 12 nt, Human
cgagagaugugu

SEQ ID NO: 3653811 - RNA, 13 nt, Human
cgagagaugugug

SEQ ID NO: 3653812 - RNA, 17 nt, Human
cgagagauguguguuga

SEQ ID NO: 3653813 - RNA, 13 nt, Human
cgagagccugcuc

SEQ ID NO: 3653814 - RNA, 14 nt, Human
cgagaggaggggcc

SEQ ID NO: 3653815 - RNA, 14 nt, Human
cgagaggcagagaa

SEQ ID NO: 3653816 - RNA, 14 nt, Human
cgagagggagagag

SEQ ID NO: 3653817 - RNA, 16 nt, Human
cgagagggagagagag

SEQ ID NO: 3653818 - RNA, 22 nt, Human
cgagaggggaagaguguacugg

SEQ ID NO: 3653819 - RNA, 21 nt, Human
cgagaggggccgaugcccaga

SEQ ID NO: 3653820 - RNA, 18 nt, Human
cgagagguaugccuguac

SEQ ID NO: 3653821 - RNA, 14 nt, Human
cgagaggugggcca

SEQ ID NO: 3653822 - RNA, 20 nt, Human
cgagaguagccgagagccug

SEQ ID NO: 3653823 - RNA, 19 nt, Human
cgagagucuggcccuagac

SEQ ID NO: 3653824 - RNA, 20 nt, Human
cgagaucacgccacugcacu

SEQ ID NO: 3653825 - RNA, 23 nt, Human
cgagauuaucguuuucuuaaagu

SEQ ID NO: 3653826 - RNA, 15 nt, Human
cgagcaaagaucaaa

SEQ ID NO: 3653827 - RNA, 20 nt, Human
cgagcaaagaucaaaauaaa

SEQ ID NO: 3653828 - RNA, 23 nt, Human
cgagcaaagaucaaaauaaaaag

SEQ ID NO: 3653829 - RNA, 19 nt, Human
cgagcaaagucuaaaguuu

SEQ ID NO: 3653830 - RNA, 20 nt, Human
cgagcaaagucuaaaguuua

SEQ ID NO: 3653831 - RNA, 14 nt, Human
cgagcaaccguggc

SEQ ID NO: 3653832 - RNA, 15 nt, Human
cgagcaaccguggcc

SEQ ID NO: 3653833 - RNA, 18 nt, Human
cgagcaccuccagccuga

SEQ ID NO: 3653834 - RNA, 11 nt, Human
cgagcagcuga

SEQ ID NO: 3653835 - RNA, 15 nt, Human
cgagcagcugagcag

SEQ ID NO: 3653836 - RNA, 20 nt, Human
cgagcaggcuucuucccccc

SEQ ID NO: 3653837 - RNA, 21 nt, Human
cgagcaguccugccucagccu

SEQ ID NO: 3653838 - RNA, 21 nt, Human
cgagcaucccccaaaguucac

SEQ ID NO: 3653839 - RNA, 13 nt, Human
cgagcaugccugg

SEQ ID NO: 3653840 - RNA, 16 nt, Human
cgagcaugccuggaug

SEQ ID NO: 3653841 - RNA, 17 nt, Human
cgagcaugccuggaugg

SEQ ID NO: 3653842 - RNA, 21 nt, Human
cgagcaugccuggauggggcu

SEQ ID NO: 3653843 - RNA, 16 nt, Human
cgagcccugguggcag

SEQ ID NO: 3653844 - RNA, 14 nt, Human
cgagccgggccugg

SEQ ID NO: 3653845 - RNA, 22 nt, Human
cgagccggggaguuucuuuccu

SEQ ID NO: 3653846 - RNA, 19 nt, Human
cgagccucugucacugcag

SEQ ID NO: 3653847 - RNA, 21 nt, Human
cgagccuuuucacccuucuac

SEQ ID NO: 3653848 - RNA, 15 nt, Human
cgagcgcccugcaga

SEQ ID NO: 3653849 - RNA, 16 nt, Human
cgagcgcccugcagac

SEQ ID NO: 3653850 - RNA, 19 nt, Human
cgagcgcccugcagacccu

SEQ ID NO: 3653851 - RNA, 20 nt, Human
cgagcgcccugcagacccug

SEQ ID NO: 3653852 - RNA, 18 nt, Human
cgagcgcuuucuggaaaa

SEQ ID NO: 3653853 - RNA, 23 nt, Human
cgagcgcuuucuggaaaagagga

SEQ ID NO: 3653854 - RNA, 12 nt, Human
cgagcugggggc

SEQ ID NO: 3653855 - RNA, 13 nt, Human
cgagcugggggcc

SEQ ID NO: 3653856 - RNA, 15 nt, Human
cgagcugggggccau

SEQ ID NO: 3653857 - RNA, 23 nt, Human
cgagcugggggccaugagcucca

SEQ ID NO: 3653858 - RNA, 13 nt, Human
cgagcuggugcau

SEQ ID NO: 3653859 - RNA, 22 nt, Human
cgaggaaacgaaacccacucua

SEQ ID NO: 3653860 - RNA, 19 nt, Human
cgaggaaccagagccaugg

SEQ ID NO: 3653861 - RNA, 13 nt, Human
cgaggacagggag

SEQ ID NO: 3653862 - RNA, 21 nt, Human
cgaggacaugaaacuccaccu

SEQ ID NO: 3653863 - RNA, 12 nt, Human
cgaggacccaga

SEQ ID NO: 3653864 - RNA, 13 nt, Human
cgaggacccagac

SEQ ID NO: 3653865 - RNA, 14 nt, Human
cgaggacccagacc

SEQ ID NO: 3653866 - RNA, 20 nt, Human
cgaggacuuugauugcacau

SEQ ID NO: 3653867 - RNA, 18 nt, Human
cgaggaggugucucaggc

SEQ ID NO: 3653868 - RNA, 19 nt, Human
ccaaauacuaaugaaaaca

SEQ ID NO: 3653869 - RNA, 15 nt, Human
ccaaauauguccugg

SEQ ID NO: 3653870 - RNA, 15 nt, Human
ccaaauccccuaagc

SEQ ID NO: 3653871 - RNA, 21 nt, Human
ccaaauccgaaccuccucugu

SEQ ID NO: 3653872 - RNA, 22 nt, Human
ccaaauccgaaccuccucugug

SEQ ID NO: 3653873 - RNA, 16 nt, Human
ccaaauccgcucucuu

SEQ ID NO: 3653874 - RNA, 22 nt, Human
ccaaauccgcucucuuccugcc

SEQ ID NO: 3653875 - RNA, 18 nt, Human
ccaaauccucuccagcua

SEQ ID NO: 3653876 - RNA, 13 nt, Human
ccaaaucugccua

SEQ ID NO: 3653877 - RNA, 14 nt, Human
ccaaaucuggaagc

SEQ ID NO: 3653878 - RNA, 21 nt, Human
ccaaaugaaauauauuuaaaa

SEQ ID NO: 3653879 - RNA, 16 nt, Human
ccaaaugaaugaccuu

SEQ ID NO: 3653880 - RNA, 22 nt, Human
ccaaaugagggucuugguucca

SEQ ID NO: 3653881 - RNA, 13 nt, Human
ccaaaugcagcuu

SEQ ID NO: 3653882 - RNA, 21 nt, Human
ccaaauggagaagcugcaggc

SEQ ID NO: 3653883 - RNA, 22 nt, Human
ccaaauuaucaagcuaauaaaa

SEQ ID NO: 3653884 - RNA, 18 nt, Human
ccaaauucaguuucauaa

SEQ ID NO: 3653885 - RNA, 23 nt, Human
ccaaauuccuuggcaugccuucc

SEQ ID NO: 3653886 - RNA, 21 nt, Human
ccaaauugucaccugcuucuc

SEQ ID NO: 3653887 - RNA, 19 nt, Human
cggagugaagaggggcagc

SEQ ID NO: 3653888 - RNA, 20 nt, Human
cggagugaagaggggcagcc

SEQ ID NO: 3653889 - RNA, 15 nt, Human
cggagugacagagua

SEQ ID NO: 3653890 - RNA, 18 nt, Human
cggagugucuggaauugu

SEQ ID NO: 3653891 - RNA, 22 nt, Human
cggaguuuugcucuuguagccc

SEQ ID NO: 3653892 - RNA, 13 nt, Human
cggaucagagcag

SEQ ID NO: 3653893 - RNA, 15 nt, Human
cggaucaucaacaag

SEQ ID NO: 3653894 - RNA, 13 nt, Human
cggauccagggag

SEQ ID NO: 3653895 - RNA, 21 nt, Human
cggauccagggaggcuggucc

SEQ ID NO: 3653896 - RNA, 22 nt, Human
cggauccagggaggcugguccu

SEQ ID NO: 3653897 - RNA, 19 nt, Human
cggauccuaagcaucuaag

SEQ ID NO: 3653898 - RNA, 21 nt, Human
cggauccugcacugacucugg

SEQ ID NO: 3653899 - RNA, 14 nt, Human
cggaucugagaauc

SEQ ID NO: 3653900 - RNA, 16 nt, Human
cggauuauuuuuucag

SEQ ID NO: 3653901 - RNA, 17 nt, Human
cggauuauuuuuucaga

SEQ ID NO: 3653902 - RNA, 22 nt, Human
cggauuauuuuuucagaccgaa

SEQ ID NO: 3653903 - RNA, 23 nt, Human
cggauuauuuuuucagaccgaaa

SEQ ID NO: 3653904 - RNA, 15 nt, Human
cggauugcguuccuc

SEQ ID NO: 3653905 - RNA, 21 nt, Human
cggcaaccccaguucugcucc

SEQ ID NO: 3653906 - RNA, 22 nt, Human
cggcaaccccaguucugcuccu

SEQ ID NO: 3653907 - RNA, 19 nt, Human
cggcaacuaagcagucccu

SEQ ID NO: 3653908 - RNA, 22 nt, Human
cggcaacuaagcagucccugag

SEQ ID NO: 3653909 - RNA, 18 nt, Human
cggcaauaaaagcccagg

SEQ ID NO: 3653910 - RNA, 19 nt, Human
cggcaauaaaagcccagga

SEQ ID NO: 3653911 - RNA, 20 nt, Human
cggcaauaaaagcccaggag

SEQ ID NO: 3653912 - RNA, 16 nt, Human
cggcaauuuccggcca

SEQ ID NO: 3653913 - RNA, 14 nt, Human
cggcacagggucug

SEQ ID NO: 3653914 - RNA, 15 nt, Human
cggcacccccugcag

SEQ ID NO: 3653915 - RNA, 17 nt, Human
cggcacccccugcagcu

SEQ ID NO: 3653916 - RNA, 15 nt, Human
cggcacccucuggcc

SEQ ID NO: 3653917 - RNA, 20 nt, Human
cggcacuccaaccuaaccug

SEQ ID NO: 3653918 - RNA, 11 nt, Human
cggcagagagg

SEQ ID NO: 3653919 - RNA, 13 nt, Human
cggcagagaggac

SEQ ID NO: 3653920 - RNA, 18 nt, Human
cggcagccccagccugcu

SEQ ID NO: 3653921 - RNA, 22 nt, Human
cggcagccccagccugcuagcu

SEQ ID NO: 3653922 - RNA, 21 nt, Human
cggcagcuucugcccccugca

SEQ ID NO: 3653923 - RNA, 22 nt, Human
cggcaggacaacgaggaagccc

SEQ ID NO: 3653924 - RNA, 12 nt, Human
cggcaggcccug

SEQ ID NO: 3653925 - RNA, 13 nt, Human
cggcaggcccugc

SEQ ID NO: 3653926 - RNA, 14 nt, Human
cggcaggcucacug

SEQ ID NO: 3653927 - RNA, 17 nt, Human
cggcaggcucacugcca

SEQ ID NO: 3653928 - RNA, 19 nt, Human
cggcaggcucacugccagg

SEQ ID NO: 3653929 - RNA, 22 nt, Human
ccacacugauccagcccugagu

SEQ ID NO: 3653930 - RNA, 18 nt, Human
ccacacugugacacacua

SEQ ID NO: 3653931 - RNA, 19 nt, Human
ccacacugugacacacuac

SEQ ID NO: 3653932 - RNA, 21 nt, Human
ccacacugugacacacuacac

SEQ ID NO: 3653933 - RNA, 13 nt, Human
ccacacuucccug

SEQ ID NO: 3653934 - RNA, 16 nt, Human
ccacacuucccuggcg

SEQ ID NO: 3653935 - RNA, 13 nt, Human
ccacacuuccugu

SEQ ID NO: 3653936 - RNA, 21 nt, Human
ccacacuuccuguccagagag

SEQ ID NO: 3653937 - RNA, 18 nt, Human
ccacacuucucaggacac

SEQ ID NO: 3653938 - RNA, 22 nt, Human
ccacacuucucaggacacaggc

SEQ ID NO: 3653939 - RNA, 16 nt, Human
ccacacuugaaaccuu

SEQ ID NO: 3653940 - RNA, 20 nt, Human
ccacacuuguuccagcucuu

SEQ ID NO: 3653941 - RNA, 12 nt, Human
ccacagaaagag

SEQ ID NO: 3653942 - RNA, 20 nt, Human
ccacagaagccaggagcaaa

SEQ ID NO: 3653943 - RNA, 21 nt, Human
ccacagaagccaggagcaaau

SEQ ID NO: 3653944 - RNA, 16 nt, Human
ccacagaagcuccagg

SEQ ID NO: 3653945 - RNA, 15 nt, Human
ccacagacaagguag

SEQ ID NO: 3653946 - RNA, 23 nt, Human
ccacagacaauacguuugauaau

SEQ ID NO: 3653947 - RNA, 11 nt, Human
ccacagacaca

SEQ ID NO: 3653948 - RNA, 22 nt, Human
ccacagacggaaggguaaacaa

SEQ ID NO: 3653949 - RNA, 22 nt, Human
ccacagagaaaguacuucucca

SEQ ID NO: 3653950 - RNA, 19 nt, Human
ccacagagagucccacugc

SEQ ID NO: 3653951 - RNA, 22 nt, Human
ccacagauuguuucuauacaaa

SEQ ID NO: 3653952 - RNA, 20 nt, Human
ccacagcaaggcaccugcag

SEQ ID NO: 3653953 - RNA, 14 nt, Human
ccacagcacagcca

SEQ ID NO: 3653954 - RNA, 20 nt, Human
ccacagcagccucugaaguu

SEQ ID NO: 3653955 - RNA, 14 nt, Human
ccacagcagcugaa

SEQ ID NO: 3653956 - RNA, 17 nt, Human
ccacagcaguugaaaag

SEQ ID NO: 3653957 - RNA, 18 nt, Human
ccacagcccacguccugu

SEQ ID NO: 3653958 - RNA, 18 nt, Human
ccacagcccagccacgga

SEQ ID NO: 3653959 - RNA, 16 nt, Human
ccacagcccaggccuc

SEQ ID NO: 3653960 - RNA, 21 nt, Human
ccacagcccaggccuccagcu

SEQ ID NO: 3653961 - RNA, 13 nt, Human
ccacagcccuguc

SEQ ID NO: 3653962 - RNA, 20 nt, Human
ccacagcccugucagcauga

SEQ ID NO: 3653963 - RNA, 20 nt, Human
ccacagcccugucagugcag

SEQ ID NO: 3653964 - RNA, 20 nt, Human
ccacagccuccccugccagg

SEQ ID NO: 3653965 - RNA, 15 nt, Human
ccacagcgagggcag

SEQ ID NO: 3653966 - RNA, 13 nt, Human
ccacagcgccagc

SEQ ID NO: 3653967 - RNA, 18 nt, Human
ccacagcgccagccucag

SEQ ID NO: 3653968 - RNA, 24 nt, Human
ccacagcgccagccucagacugga

SEQ ID NO: 3653969 - RNA, 17 nt, Human
ccacagcgucccuggcg

SEQ ID NO: 3653970 - RNA, 16 nt, Human
ccacagcucccacccc

SEQ ID NO: 3653971 - RNA, 17 nt, Human
ccacagcucccacccca

SEQ ID NO: 3653972 - RNA, 19 nt, Human
ccacagcucccaccccacc

SEQ ID NO: 3653973 - RNA, 17 nt, Human
ccacagcuuccccucuc

SEQ ID NO: 3653974 - RNA, 22 nt, Human
ccacaggaagccugcaguccug

SEQ ID NO: 3653975 - RNA, 17 nt, Human
ccacaggacacagucag

SEQ ID NO: 3653976 - RNA, 16 nt, Human
ccacaggacauuucuc

SEQ ID NO: 3653977 - RNA, 19 nt, Human
ccacaggaggcaagcaagc

SEQ ID NO: 3653978 - RNA, 12 nt, Human
ccacaggcagcu

SEQ ID NO: 3653979 - RNA, 15 nt, Human
ccacaggcccuuccu

SEQ ID NO: 3653980 - RNA, 23 nt, Human
ccacaggcccuuuccucaggcaa

SEQ ID NO: 3653981 - RNA, 16 nt, Human
ccacaggccgcccugc

SEQ ID NO: 3653982 - RNA, 12 nt, Human
ccacaggccucc

SEQ ID NO: 3653983 - RNA, 16 nt, Human
ccacaggccucccugu

SEQ ID NO: 3653984 - RNA, 19 nt, Human
ccacaggccugagauuuca

SEQ ID NO: 3653985 - RNA, 22 nt, Human
ccacaggccugagauuucaucu

SEQ ID NO: 3653986 - RNA, 15 nt, Human
ccacaggcucaggca

SEQ ID NO: 3653987 - RNA, 17 nt, Human
ccacaggcucaggcagg

SEQ ID NO: 3653988 - RNA, 19 nt, Human
ccacaggcucaggcagggg

SEQ ID NO: 3653989 - RNA, 15 nt, Human
ccacaggcuuaggga

SEQ ID NO: 3653990 - RNA, 21 nt, Human
ccacaggcuuagggacaggac

SEQ ID NO: 3653991 - RNA, 16 nt, Human
ccacagggucccacag

SEQ ID NO: 3653992 - RNA, 19 nt, Human
ccacagggucccacagcca

SEQ ID NO: 3653993 - RNA, 15 nt, Human
ccacaggucuagacu

SEQ ID NO: 3653994 - RNA, 14 nt, Human
ccacaggugcccgc

SEQ ID NO: 3653995 - RNA, 17 nt, Human
ccacaggugggaggagu

SEQ ID NO: 3653996 - RNA, 15 nt, Human
ccacaggugucccca

SEQ ID NO: 3653997 - RNA, 16 nt, Human
ccacagguguccccag

SEQ ID NO: 3653998 - RNA, 23 nt, Human
ccacagguguuuauacagcucag

SEQ ID NO: 3653999 - RNA, 22 nt, Human
ccacagguucaugccaccaugg

SEQ ID NO: 3654000 - RNA, 16 nt, Human
ccacagucaaagaagg

SEQ ID NO: 3654001 - RNA, 20 nt, Human
ccacagugccuaauaauacu

SEQ ID NO: 3654002 - RNA, 12 nt, Human
ccacagugcugu

SEQ ID NO: 3654003 - RNA, 20 nt, Human
ccacaguggaaccagcccag

SEQ ID NO: 3654004 - RNA, 13 nt, Human
ccacagugucagg

SEQ ID NO: 3654005 - RNA, 12 nt, Human
ccacagugucug

SEQ ID NO: 3654006 - RNA, 21 nt, Human
ccacaguguuggcgagaggag

SEQ ID NO: 3654007 - RNA, 23 nt, Human
ccacaguugccaccaccucugug

SEQ ID NO: 3654008 - RNA, 20 nt, Human
ccacaguuuccucaucuguc

SEQ ID NO: 3654009 - RNA, 22 nt, Human
ccacauaagggguuugccauuu

SEQ ID NO: 3654010 - RNA, 20 nt, Human
ccacauacaacacaaagaga

SEQ ID NO: 3654011 - RNA, 22 nt, Human
ccacauagugaugguuccccug

SEQ ID NO: 3654012 - RNA, 14 nt, Human
ccacaucaaaccuu

SEQ ID NO: 3654013 - RNA, 16 nt, Human
ccacaucaaauaagaa

SEQ ID NO: 3654014 - RNA, 16 nt, Human
ccacauccacagucuc

SEQ ID NO: 3654015 - RNA, 22 nt, Human
ccacaucccacucacaacagcu

SEQ ID NO: 3654016 - RNA, 16 nt, Human
ccacaucccaucgucu

SEQ ID NO: 3654017 - RNA, 21 nt, Human
ccacaucccucucugcuggac

SEQ ID NO: 3654018 - RNA, 18 nt, Human
ccacaucccugggccugc

SEQ ID NO: 3654019 - RNA, 19 nt, Human
ccacaucccugggccugcu

SEQ ID NO: 3654020 - RNA, 20 nt, Human
ccacaucccugggccugcug

SEQ ID NO: 3654021 - RNA, 21 nt, Human
ccacaucccugggccugcugc

SEQ ID NO: 3654022 - RNA, 15 nt, Human
ccacaucuaagccug

SEQ ID NO: 3654023 - RNA, 22 nt, Human
ccacaucuugaucugcucagcc

SEQ ID NO: 3654024 - RNA, 22 nt, Human
ccacaucuugcucugcugacag

SEQ ID NO: 3654025 - RNA, 19 nt, Human
ccacaugccaagcacugug

SEQ ID NO: 3654026 - RNA, 16 nt, Human
ccacaugggaggcuca

SEQ ID NO: 3654027 - RNA, 19 nt, Human
ccacauggggcugggcagc

SEQ ID NO: 3654028 - RNA, 13 nt, Human
ccacauguccagc

SEQ ID NO: 3654029 - RNA, 17 nt, Human
ccacauguguccauccc

SEQ ID NO: 3654030 - RNA, 17 nt, Human
ccagacacauguccaag

SEQ ID NO: 3654031 - RNA, 22 nt, Human
ccagacacauguccaagaagcc

SEQ ID NO: 3654032 - RNA, 14 nt, Human
ccagacacccagga

SEQ ID NO: 3654033 - RNA, 16 nt, Human
ccagacacccaggacu

SEQ ID NO: 3654034 - RNA, 17 nt, Human
ccagacaccuugacagg

SEQ ID NO: 3654035 - RNA, 11 nt, Human
ccagacacugg

SEQ ID NO: 3654036 - RNA, 13 nt, Human
ccagacacugguu

SEQ ID NO: 3654037 - RNA, 22 nt, Human
ccagacagacaucucugcaccc

SEQ ID NO: 3654038 - RNA, 23 nt, Human
ccagacagagggucacaguguuu

SEQ ID NO: 3654039 - RNA, 14 nt, Human
ccagacagccugua

SEQ ID NO: 3654040 - RNA, 20 nt, Human
ccagacagcucccucugccu

SEQ ID NO: 3654041 - RNA, 17 nt, Human
ccagacauaaaggaaaa

SEQ ID NO: 3654042 - RNA, 22 nt, Human
ccagacauacgaaacacaaacc

SEQ ID NO: 3654043 - RNA, 22 nt, Human
ccagacauucucgcuucccuga

SEQ ID NO: 3654044 - RNA, 21 nt, Human
ccagaccaacguuacucaggg

SEQ ID NO: 3654045 - RNA, 16 nt, Human
ccagaccagagcucug

SEQ ID NO: 3654046 - RNA, 17 nt, Human
ccagaccagagcucugg

SEQ ID NO: 3654047 - RNA, 15 nt, Human
ccagaccauggacac

SEQ ID NO: 3654048 - RNA, 15 nt, Human
ccagacccccacccc

SEQ ID NO: 3654049 - RNA, 12 nt, Human
ccagacccccug

SEQ ID NO: 3654050 - RNA, 16 nt, Human
ccagacccccuggaga

SEQ ID NO: 3654051 - RNA, 16 nt, Human
ccagaccccgacaccg

SEQ ID NO: 3654052 - RNA, 22 nt, Human
ccagaccccucuggccaggaug

SEQ ID NO: 3654053 - RNA, 23 nt, Human
ccagaccccucuggccaggaugg

SEQ ID NO: 3654054 - RNA, 14 nt, Human
ccagacccggcugc

SEQ ID NO: 3654055 - RNA, 16 nt, Human
ccagacccggcugcgu

SEQ ID NO: 3654056 - RNA, 13 nt, Human
ccagaccugagcu

SEQ ID NO: 3654057 - RNA, 20 nt, Human
ccagaccugauccuggaggc

SEQ ID NO: 3654058 - RNA, 21 nt, Human
ccagaccuguuagcagacagg

SEQ ID NO: 3654059 - RNA, 19 nt, Human
ccagaccuuguucacacuc

SEQ ID NO: 3654060 - RNA, 20 nt, Human
ccagacgaugucuucauacc

SEQ ID NO: 3654061 - RNA, 19 nt, Human
ccagacgccugauauugaa

SEQ ID NO: 3654062 - RNA, 22 nt, Human
ccagacgcucauucagcaucug

SEQ ID NO: 3654063 - RNA, 15 nt, Human
ccagacggcuccacu

SEQ ID NO: 3654064 - RNA, 16 nt, Human
ccagacucagagcucu

SEQ ID NO: 3654065 - RNA, 18 nt, Human
ccagacuccaccaagccu

SEQ ID NO: 3654066 - RNA, 20 nt, Human
ccagacuccugacugucucc

SEQ ID NO: 3654067 - RNA, 13 nt, Human
ccagacucuugcc

SEQ ID NO: 3654068 - RNA, 22 nt, Human
ccagacugcagguuggacccca

SEQ ID NO: 3654069 - RNA, 12 nt, Human
ccagacugugga

SEQ ID NO: 3654070 - RNA, 13 nt, Human
ccagacuguggag

SEQ ID NO: 3654071 - RNA, 13 nt, Human
ccagacuguguau

SEQ ID NO: 3654072 - RNA, 13 nt, Human
ccagacuuccuug

SEQ ID NO: 3654073 - RNA, 22 nt, Human
ccagacuuguuggcguaggcua

SEQ ID NO: 3654074 - RNA, 20 nt, Human
ccagacuuuacaugacacag

SEQ ID NO: 3654075 - RNA, 22 nt, Human
ccagacuuuacaugacacagcu

SEQ ID NO: 3654076 - RNA, 20 nt, Human
ccagagaaaggggagcccac

SEQ ID NO: 3654077 - RNA, 22 nt, Human
ccagagaaaugaaagucaguuu

SEQ ID NO: 3654078 - RNA, 23 nt, Human
ccagagaaaugaaagucaguuua

SEQ ID NO: 3654079 - RNA, 14 nt, Human
ccagagaagccccu

SEQ ID NO: 3654080 - RNA, 19 nt, Human
ccagagaaggggugugcau

SEQ ID NO: 3654081 - RNA, 14 nt, Human
ccagagaagugaca

SEQ ID NO: 3654082 - RNA, 17 nt, Human
ccagagaagugacaggg

SEQ ID NO: 3654083 - RNA, 13 nt, Human
ccagagacaggaa

SEQ ID NO: 3654084 - RNA, 15 nt, Human
ccagagacaggaaaa

SEQ ID NO: 3654085 - RNA, 23 nt, Human
ccagagacaggaaaauccucugg

SEQ ID NO: 3654086 - RNA, 20 nt, Human
ccagagacauacuugaaggg

SEQ ID NO: 3654087 - RNA, 13 nt, Human
ccagagacccagc

SEQ ID NO: 3654088 - RNA, 16 nt, Human
ccagagacccagcgga

SEQ ID NO: 3654089 - RNA, 18 nt, Human
ccagagagaagagcccca

SEQ ID NO: 3654090 - RNA, 14 nt, Human
ccagagagagaagu

SEQ ID NO: 3654091 - RNA, 18 nt, Human
ccagagagagaagugccc

SEQ ID NO: 3654092 - RNA, 23 nt, Human
ccagagagagaagugccccugcu

SEQ ID NO: 3654093 - RNA, 13 nt, Human
ccagagagcccga

SEQ ID NO: 3654094 - RNA, 22 nt, Human
ccagagagccuggugcugcugc

SEQ ID NO: 3654095 - RNA, 23 nt, Human
ccagagagggacugacacccaug

SEQ ID NO: 3654096 - RNA, 17 nt, Human
ccagagaguccucugga

SEQ ID NO: 3654097 - RNA, 18 nt, Human
ccagagaguccucuggau

SEQ ID NO: 3654098 - RNA, 15 nt, Human
ccagagaugccucca

SEQ ID NO: 3654099 - RNA, 17 nt, Human
ccagagaugccuccacc

SEQ ID NO: 3654100 - RNA, 22 nt, Human
ccagagauggagguucucucgg

SEQ ID NO: 3654101 - RNA, 22 nt, Human
ccagagaugggacugggagggc

SEQ ID NO: 3654102 - RNA, 18 nt, Human
ccagagcaaagggccagg

SEQ ID NO: 3654103 - RNA, 18 nt, Human
ccagagcaccugcugucu

SEQ ID NO: 3654104 - RNA, 19 nt, Human
ccagagcaccugcugucug

SEQ ID NO: 3654105 - RNA, 11 nt, Human
ccagagcacug

SEQ ID NO: 3654106 - RNA, 16 nt, Human
ccagagcacugcucca

SEQ ID NO: 3654107 - RNA, 12 nt, Human
ccagagcacugg

SEQ ID NO: 3654108 - RNA, 13 nt, Human
ccagagcacugua

SEQ ID NO: 3654109 - RNA, 16 nt, Human
ccagagcacuguauac

SEQ ID NO: 3654110 - RNA, 14 nt, Human
ccagagcagaugca

SEQ ID NO: 3654111 - RNA, 18 nt, Human
ccagagcagaugcagaga

SEQ ID NO: 3654112 - RNA, 15 nt, Human
ccagagcaggaagca

SEQ ID NO: 3654113 - RNA, 21 nt, Human
ccagagcaggaggccccuggc

SEQ ID NO: 3654114 - RNA, 18 nt, Human
ccagagcauuuccaacac

SEQ ID NO: 3654115 - RNA, 22 nt, Human
ccagagcauuuccaacaccaca

SEQ ID NO: 3654116 - RNA, 23 nt, Human
ccagagcauuuccaacaccacag

SEQ ID NO: 3654117 - RNA, 15 nt, Human
ccagagccacacaug

SEQ ID NO: 3654118 - RNA, 12 nt, Human
ccagagccacag

SEQ ID NO: 3654119 - RNA, 11 nt, Human
ccagagcccac

SEQ ID NO: 3654120 - RNA, 14 nt, Human
ccagagcccaccuu

SEQ ID NO: 3654121 - RNA, 20 nt, Human
ccagagcccacuccaucugg

SEQ ID NO: 3654122 - RNA, 18 nt, Human
ccagagcccagcuccaag

SEQ ID NO: 3654123 - RNA, 15 nt, Human
ccagagcccaggcuc

SEQ ID NO: 3654124 - RNA, 19 nt, Human
ccagagccccacacggagg

SEQ ID NO: 3654125 - RNA, 21 nt, Human
ccagagccuggcugcccauca

SEQ ID NO: 3654126 - RNA, 12 nt, Human
ccagagccuggg

SEQ ID NO: 3654127 - RNA, 13 nt, Human
ccagagccugggg

SEQ ID NO: 3654128 - RNA, 14 nt, Human
ccagagccuggggc

SEQ ID NO: 3654129 - RNA, 15 nt, Human
ccagagccuggggcu

SEQ ID NO: 3654130 - RNA, 21 nt, Human
ccagagcgccccucccuagug

SEQ ID NO: 3654131 - RNA, 19 nt, Human
ccagagcgugggagacggu

SEQ ID NO: 3654132 - RNA, 23 nt, Human
ccagagcugaagaguugccccgu

SEQ ID NO: 3654133 - RNA, 13 nt, Human
ccagagcugccac

SEQ ID NO: 3654134 - RNA, 15 nt, Human
ccagagcugccaccu

SEQ ID NO: 3654135 - RNA, 21 nt, Human
ccagagcugggaggcauggcc

SEQ ID NO: 3654136 - RNA, 15 nt, Human
ccagagcugggugag

SEQ ID NO: 3654137 - RNA, 20 nt, Human
ccagagcugggugagugggg

SEQ ID NO: 3654138 - RNA, 18 nt, Human
cuaccugcccuggaacau

SEQ ID NO: 3654139 - RNA, 12 nt, Human
cuaccugcucuc

SEQ ID NO: 3654140 - RNA, 15 nt, Human
cuaccugcucuccaa

SEQ ID NO: 3654141 - RNA, 19 nt, Human
cuaccugcucuccaagucu

SEQ ID NO: 3654142 - RNA, 11 nt, Human
cuaccuggagg

SEQ ID NO: 3654143 - RNA, 16 nt, Human
cuaccuggagggaaga

SEQ ID NO: 3654144 - RNA, 16 nt, Human
cuaccuggucucuccu

SEQ ID NO: 3654145 - RNA, 15 nt, Human
cuaccugugugguac

SEQ ID NO: 3654146 - RNA, 20 nt, Human
cuaccuguucagugucccgg

SEQ ID NO: 3654147 - RNA, 18 nt, Human
cuaccuuccaguuccuca

SEQ ID NO: 3654148 - RNA, 20 nt, Human
cuaccuucuccccagcuccc

SEQ ID NO: 3654149 - RNA, 13 nt, Human
cuaccuucuguag

SEQ ID NO: 3654150 - RNA, 22 nt, Human
cuaccuugaggucuuuugacau

SEQ ID NO: 3654151 - RNA, 23 nt, Human
cuaccuugaggucuuuugacaug

SEQ ID NO: 3654152 - RNA, 16 nt, Human
cuaccuugccccaacc

SEQ ID NO: 3654153 - RNA, 14 nt, Human
cuaccuugugaccc

SEQ ID NO: 3654154 - RNA, 19 nt, Human
cuaccuugugacccagcac

SEQ ID NO: 3654155 - RNA, 22 nt, Human
cuaccuuuaaucagguccugcu

SEQ ID NO: 3654156 - RNA, 21 nt, Human
cuaccuuuggcuuaauuccaa

SEQ ID NO: 3654157 - RNA, 13 nt, Human
cuaccuuuucucu

SEQ ID NO: 3654158 - RNA, 23 nt, Human
cuacgaguaauugcauuugcuuu

SEQ ID NO: 3654159 - RNA, 15 nt, Human
cuacgccaaucaagg

SEQ ID NO: 3654160 - RNA, 19 nt, Human
cuacgccucuucugucccu

SEQ ID NO: 3654161 - RNA, 14 nt, Human
cuacgccugcaugu

SEQ ID NO: 3654162 - RNA, 17 nt, Human
cuacguacaugugaggc

SEQ ID NO: 3654163 - RNA, 16 nt, Human
cuacguuaagggaagg

SEQ ID NO: 3654164 - RNA, 17 nt, Human
cuacguuaccaggcagg

SEQ ID NO: 3654165 - RNA, 18 nt, Human
cuacuaaaaauacaaaca

SEQ ID NO: 3654166 - RNA, 13 nt, Human
cuacuaaaacuac

SEQ ID NO: 3654167 - RNA, 20 nt, Human
cuacuaaguucacauuagaa

SEQ ID NO: 3654168 - RNA, 13 nt, Human
cuacuaaugaugu

SEQ ID NO: 3654169 - RNA, 16 nt, Human
cuacuacaucgcccuc

SEQ ID NO: 3654170 - RNA, 15 nt, Human
cuacuagauugacua

SEQ ID NO: 3654171 - RNA, 17 nt, Human
cuacuagcaaaauaaaa

SEQ ID NO: 3654172 - RNA, 20 nt, Human
cuacuagcaaaauaaaacau

SEQ ID NO: 3654173 - RNA, 15 nt, Human
cuacuauaaagagaa

SEQ ID NO: 3654174 - RNA, 22 nt, Human
cuacucaagcggguggcucugg

SEQ ID NO: 3654175 - RNA, 21 nt, Human
cuagaagccaagggaaagggg

SEQ ID NO: 3654176 - RNA, 19 nt, Human
cuagaaggccacaugucac

SEQ ID NO: 3654177 - RNA, 21 nt, Human
cuagaagggcuagaaccugga

SEQ ID NO: 3654178 - RNA, 22 nt, Human
cuagaaguaacuggugauauau

SEQ ID NO: 3654179 - RNA, 17 nt, Human
cuagaagugggccagga

SEQ ID NO: 3654180 - RNA, 16 nt, Human
cuagaaguuacugaau

SEQ ID NO: 3654181 - RNA, 17 nt, Human
cuagaaguuacugaaug

SEQ ID NO: 3654182 - RNA, 19 nt, Human
cuagaaguuucccuuccuc

SEQ ID NO: 3654183 - RNA, 14 nt, Human
cuagaauacuuuuu

SEQ ID NO: 3654184 - RNA, 19 nt, Human
cuagaauauccuacuucuc

SEQ ID NO: 3654185 - RNA, 19 nt, Human
cuagaaucugcaauucaaa

SEQ ID NO: 3654186 - RNA, 12 nt, Human
cuagaauggaua

SEQ ID NO: 3654187 - RNA, 21 nt, Human
cuagaauugaguguuuaaagu

SEQ ID NO: 3654188 - RNA, 13 nt, Human
cuagaauuuauuc

SEQ ID NO: 3654189 - RNA, 14 nt, Human
cuagaauuucuuua

SEQ ID NO: 3654190 - RNA, 23 nt, Human
cuagaauuugauaugugaacagu

SEQ ID NO: 3654191 - RNA, 21 nt, Human
cuagaauuugauuauuaacau

SEQ ID NO: 3654192 - RNA, 14 nt, Human
cuagaauuuuaagc

SEQ ID NO: 3654193 - RNA, 16 nt, Human
cuagaauuuuaagccu

SEQ ID NO: 3654194 - RNA, 19 nt, Human
cuagaauuuuaagugcuuu

SEQ ID NO: 3654195 - RNA, 16 nt, Human
cuagacaacccugcaa

SEQ ID NO: 3654196 - RNA, 20 nt, Human
cuagacaagauauuguacau

SEQ ID NO: 3654197 - RNA, 13 nt, Human
cuagacaagccag

SEQ ID NO: 3654198 - RNA, 17 nt, Human
cuagacaagccagaacu

SEQ ID NO: 3654199 - RNA, 14 nt, Human
cuagacacacaaag

SEQ ID NO: 3654200 - RNA, 22 nt, Human
cuagacacaugaagguaaauaa

SEQ ID NO: 3654201 - RNA, 23 nt, Human
cuagacacaugaagguaaauaaa

SEQ ID NO: 3654202 - RNA, 19 nt, Human
cuagacaccaaaguucuaa

SEQ ID NO: 3654203 - RNA, 22 nt, Human
cuagacauggagguucuaaggc

SEQ ID NO: 3654204 - RNA, 11 nt, Human
cuagaccaaua

SEQ ID NO: 3654205 - RNA, 21 nt, Human
cuagaccagcagacagagcca

SEQ ID NO: 3654206 - RNA, 22 nt, Human
cuagaccagugagcgcuugggc

SEQ ID NO: 3654207 - RNA, 16 nt, Human
cuagaccuccagcugu

SEQ ID NO: 3654208 - RNA, 17 nt, Human
cuagaccuccagcuguu

SEQ ID NO: 3654209 - RNA, 20 nt, Human
cuagacgagcaggcuucuuc

SEQ ID NO: 3654210 - RNA, 19 nt, Human
cuagacuagcaaucucuuc

SEQ ID NO: 3654211 - RNA, 23 nt, Human
cuagacucaagguucccagagau

SEQ ID NO: 3654212 - RNA, 22 nt, Human
cuagacucggggugcuuccuug

SEQ ID NO: 3654213 - RNA, 15 nt, Human
cuagacucuagacaa

SEQ ID NO: 3654214 - RNA, 14 nt, Human
cuagacuggugacu

SEQ ID NO: 3654215 - RNA, 17 nt, Human
cuagacuggugacugau

SEQ ID NO: 3654216 - RNA, 22 nt, Human
cuagacuggugacugauucuuc

SEQ ID NO: 3654217 - RNA, 18 nt, Human
cuagacugugcuaagaga

SEQ ID NO: 3654218 - RNA, 21 nt, Human
cuagacuuuaggcuuucagcu

SEQ ID NO: 3654219 - RNA, 14 nt, Human
cuagacuuucuguu

SEQ ID NO: 3654220 - RNA, 10 nt, Human
cuagagaaac

SEQ ID NO: 3654221 - RNA, 21 nt, Human
cuagagaaauaagaucuuuuu

SEQ ID NO: 3654222 - RNA, 18 nt, Human
cuagagaaauucuuguua

SEQ ID NO: 3654223 - RNA, 16 nt, Human
cuagagaacgcagccc

SEQ ID NO: 3654224 - RNA, 18 nt, Human
cuagagaacgcagcccua

SEQ ID NO: 3654225 - RNA, 18 nt, Human
cuagagaagacaggcugg

SEQ ID NO: 3654226 - RNA, 22 nt, Human
cuagagaagacaggcuggaaga

SEQ ID NO: 3654227 - RNA, 12 nt, Human
cuagagaagagg

SEQ ID NO: 3654228 - RNA, 16 nt, Human
cuagagaaugcacaga

SEQ ID NO: 3654229 - RNA, 21 nt, Human
cuagagaaugcacagauauac

SEQ ID NO: 3654230 - RNA, 15 nt, Human
cuagagacagaagca

SEQ ID NO: 3654231 - RNA, 20 nt, Human
cuagagacagaagcaggcug

SEQ ID NO: 3654232 - RNA, 22 nt, Human
cuagagacagaagcaggcugga

SEQ ID NO: 3654233 - RNA, 19 nt, Human
cuagagagggaauucucuu

SEQ ID NO: 3654234 - RNA, 21 nt, Human
cuagagagggaggcaagcccu

SEQ ID NO: 3654235 - RNA, 17 nt, Human
cuagagauauuuuguaa

SEQ ID NO: 3654236 - RNA, 21 nt, Human
cuagagaucugguuuugcuau

SEQ ID NO: 3654237 - RNA, 15 nt, Human
cuagagcagcccugg

SEQ ID NO: 3654238 - RNA, 13 nt, Human
cuagagccugccu

SEQ ID NO: 3654239 - RNA, 14 nt, Human
cuagagccugccug

SEQ ID NO: 3654240 - RNA, 17 nt, Human
cuagagccugccuggag

SEQ ID NO: 3654241 - RNA, 18 nt, Human
cuagagccugccuggagc

SEQ ID NO: 3654242 - RNA, 19 nt, Human
cuagagccugccuggagcg

SEQ ID NO: 3654243 - RNA, 12 nt, Human
cuagagcuccuc

SEQ ID NO: 3654244 - RNA, 22 nt, Human
cuagagcuucaagucugugccu

SEQ ID NO: 3654245 - RNA, 23 nt, Human
cuagagcuucaagucugugccug

SEQ ID NO: 3654246 - RNA, 16 nt, Human
cuagaggaagcagcca

SEQ ID NO: 3654247 - RNA, 17 nt, Human
cuagaggccagccccac

SEQ ID NO: 3654248 - RNA, 18 nt, Human
cuagaggccagccccacc

SEQ ID NO: 3654249 - RNA, 23 nt, Human
cuagaggccagccccacccagga

SEQ ID NO: 3654250 - RNA, 21 nt, Human
cuagaggccugacugccaagc

SEQ ID NO: 3654251 - RNA, 15 nt, Human
cuagaggccugagga

SEQ ID NO: 3654252 - RNA, 22 nt, Human
cuagaggccugaggaugagcug

SEQ ID NO: 3654253 - RNA, 18 nt, Human
cuagaggcuuccuucauu

SEQ ID NO: 3654254 - RNA, 23 nt, Human
cuagaggcuuccuucauuuccuc

SEQ ID NO: 3654255 - RNA, 22 nt, Human
cuagaggcuugcauaauaagcu

SEQ ID NO: 3654256 - RNA, 15 nt, Human
cuagagggaccucuc

SEQ ID NO: 3654257 - RNA, 15 nt, Human
cuagagggaggggcc

SEQ ID NO: 3654258 - RNA, 16 nt, Human
cuagagggaggggccu

SEQ ID NO: 3654259 - RNA, 22 nt, Human
cuagaggggggauuuccagcca

SEQ ID NO: 3654260 - RNA, 21 nt, Human
cuagagugaacuugggccacu

SEQ ID NO: 3654261 - RNA, 12 nt, Human
cuagauaaaagc

SEQ ID NO: 3654262 - RNA, 16 nt, Human
cuagauacuguaucau

SEQ ID NO: 3654263 - RNA, 14 nt, Human
cuagauaugaauau

SEQ ID NO: 3654264 - RNA, 14 nt, Human
cuagauauuuuccu

SEQ ID NO: 3654265 - RNA, 18 nt, Human
cuagaucagaugcuccaa

SEQ ID NO: 3654266 - RNA, 20 nt, Human
cuagaucagaugcuccaaga

SEQ ID NO: 3654267 - RNA, 18 nt, Human
cuagaucauaaggcuuca

SEQ ID NO: 3654268 - RNA, 13 nt, Human
cuagauccacaca

SEQ ID NO: 3654269 - RNA, 19 nt, Human
cuagauccacacacagagg

SEQ ID NO: 3654270 - RNA, 15 nt, Human
cuagauccuaagggu

SEQ ID NO: 3654271 - RNA, 17 nt, Human
cuagaugaaguuuuaca

SEQ ID NO: 3654272 - RNA, 13 nt, Human
cuagaugaccuca

SEQ ID NO: 3654273 - RNA, 22 nt, Human
cuagaugagaauucagcugccc

SEQ ID NO: 3654274 - RNA, 21 nt, Human
cuagaugauuaaauaagauuc

SEQ ID NO: 3654275 - RNA, 21 nt, Human
cuagaugauuuuuugaaaguu

SEQ ID NO: 3654276 - RNA, 17 nt, Human
cuagaugcaagucucuu

SEQ ID NO: 3654277 - RNA, 22 nt, Human
cuagauggugcugagaagcuuu

SEQ ID NO: 3654278 - RNA, 16 nt, Human
cuagauguaguauuuu

SEQ ID NO: 3654279 - RNA, 22 nt, Human
cuagauguaguauuuuuuguau

SEQ ID NO: 3654280 - RNA, 23 nt, Human
cuagauguaguauuuuuuguaua

SEQ ID NO: 3654281 - RNA, 15 nt, Human
cuagauuauaucaaa

SEQ ID NO: 3654282 - RNA, 17 nt, Human
cuagauuauaucaaagu

SEQ ID NO: 3654283 - RNA, 17 nt, Human
cuagauucaaagguucu

SEQ ID NO: 3654284 - RNA, 22 nt, Human
cuagauuccauugguccaagau

SEQ ID NO: 3654285 - RNA, 12 nt, Human
cuagauugacua

SEQ ID NO: 3654286 - RNA, 14 nt, Human
cuagauuuaauaua

SEQ ID NO: 3654287 - RNA, 14 nt, Human
cuagauuugggaga

SEQ ID NO: 3654288 - RNA, 16 nt, Human
cuagcaaaagugcaag

SEQ ID NO: 3654289 - RNA, 17 nt, Human
cuagcaaaagugcaaga

SEQ ID NO: 3654290 - RNA, 17 nt, Human
cuagcaaaauaaaacau

SEQ ID NO: 3654291 - RNA, 15 nt, Human
cuagcaagcuggccu

SEQ ID NO: 3654292 - RNA, 16 nt, Human
cuagcaagcuggccuc

SEQ ID NO: 3654293 - RNA, 17 nt, Human
cuagcaagcuggccucu

SEQ ID NO: 3654294 - RNA, 20 nt, Human
cuagcaaucacaacacuggc

SEQ ID NO: 3654295 - RNA, 19 nt, Human
cuagcaaucucuucauuau

SEQ ID NO: 3654296 - RNA, 21 nt, Human
cuaaagaagguuucagaaaga

SEQ ID NO: 3654297 - RNA, 12 nt, Human
cuaaagaccaaa

SEQ ID NO: 3654298 - RNA, 15 nt, Human
cuaaagaccaaacuu

SEQ ID NO: 3654299 - RNA, 16 nt, Human
cuaaagagagaaugua

SEQ ID NO: 3654300 - RNA, 19 nt, Human
cuaaagagagaauguagau

SEQ ID NO: 3654301 - RNA, 16 nt, Human
cuaaagagcccuugcc

SEQ ID NO: 3654302 - RNA, 19 nt, Human
cuaaagagcccuugccucc

SEQ ID NO: 3654303 - RNA, 21 nt, Human
cuaaagagcccuugccucccc

SEQ ID NO: 3654304 - RNA, 21 nt, Human
cuaaagauagagucauugcug

SEQ ID NO: 3654305 - RNA, 18 nt, Human
cuaaagauggaguuucua

SEQ ID NO: 3654306 - RNA, 19 nt, Human
cuaaagauggaguuucuaa

SEQ ID NO: 3654307 - RNA, 13 nt, Human
cuaaagcaggccu

SEQ ID NO: 3654308 - RNA, 14 nt, Human
cuaaagcaugaaau

SEQ ID NO: 3654309 - RNA, 20 nt, Human
cuaaagcaugaaaugugaau

SEQ ID NO: 3654310 - RNA, 14 nt, Human
cuaaagccuuuauu

SEQ ID NO: 3654311 - RNA, 14 nt, Human
cuaaagcucugaca

SEQ ID NO: 3654312 - RNA, 14 nt, Human
cuaaagcugccagc

SEQ ID NO: 3654313 - RNA, 17 nt, Human
cuaaagcugguuuaaug

SEQ ID NO: 3654314 - RNA, 19 nt, Human
cuaaaggaaaaaaccaucc

SEQ ID NO: 3654315 - RNA, 15 nt, Human
cuaaaggcuaccuuu

SEQ ID NO: 3654316 - RNA, 16 nt, Human
cuaaaggcuaccuuug

SEQ ID NO: 3654317 - RNA, 19 nt, Human
cuaaagguguugucccuuc

SEQ ID NO: 3654318 - RNA, 22 nt, Human
cuaaaguacugagcagugauau

SEQ ID NO: 3654319 - RNA, 21 nt, Human
cuacuuugguuucugucugua

SEQ ID NO: 3654320 - RNA, 20 nt, Human
cuacuuuguccuuuuuguua

SEQ ID NO: 3654321 - RNA, 22 nt, Human
cuacuuuuaaagaauuucuuua

SEQ ID NO: 3654322 - RNA, 15 nt, Human
cuacuuuuuaacaga

SEQ ID NO: 3654323 - RNA, 16 nt, Human
cuagaaaaacaggcac

SEQ ID NO: 3654324 - RNA, 23 nt, Human
cuagaaaacauuuuuuuuuuaaa

SEQ ID NO: 3654325 - RNA, 22 nt, Human
cuagaaaacgcgaccuuggccg

SEQ ID NO: 3654326 - RNA, 21 nt, Human
cuagaaacccaagcuccuccu

SEQ ID NO: 3654327 - RNA, 18 nt, Human
cuagaaagaauauuuggu

SEQ ID NO: 3654328 - RNA, 17 nt, Human
cuagaaagcagagauuu

SEQ ID NO: 3654329 - RNA, 17 nt, Human
cuagaaauaugauuuua

SEQ ID NO: 3654330 - RNA, 19 nt, Human
cuagaaauuccccacccug

SEQ ID NO: 3654331 - RNA, 23 nt, Human
cuagaaauuuuucagaugcuucu

SEQ ID NO: 3654332 - RNA, 20 nt, Human
cuagaacacuaacucaccag

SEQ ID NO: 3654333 - RNA, 18 nt, Human
cuagaaccuggaagggcu

SEQ ID NO: 3654334 - RNA, 19 nt, Human
cuagaacucccuuucaaca

SEQ ID NO: 3654335 - RNA, 18 nt, Human
cuagaacucuccaucuua

SEQ ID NO: 3654336 - RNA, 11 nt, Human
cuagaacuuuu

SEQ ID NO: 3654337 - RNA, 18 nt, Human
cuagaacuuuuuuaaaua

SEQ ID NO: 3654338 - RNA, 20 nt, Human
cuagaacuuuuuuaaauaaa

SEQ ID NO: 3654339 - RNA, 21 nt, Human
cuagaacuuuuuuaaauaaac

SEQ ID NO: 3654340 - RNA, 13 nt, Human
cuagaagaaauga

SEQ ID NO: 3654341 - RNA, 16 nt, Human
cuagaagaaaugaaau

SEQ ID NO: 3654342 - RNA, 17 nt, Human
cuagaagaaaugaaauu

SEQ ID NO: 3654343 - RNA, 20 nt, Human
cuagaagagucuauugucuc

SEQ ID NO: 3654344 - RNA, 15 nt, Human
cuagaagaugaauac

SEQ ID NO: 3654345 - RNA, 21 nt, Human
cuagaagaugaauacaaacaa

SEQ ID NO: 3654346 - RNA, 13 nt, Human
cuagaaggccaca

SEQ ID NO: 3654347 - RNA, 20 nt, Human
cuagaagggccaguccugcc

SEQ ID NO: 3654348 - RNA, 23 nt, Human
cuagaagggccaguccugccugg

SEQ ID NO: 3654349 - RNA, 19 nt, Human
cuagaagugggccaggaca

SEQ ID NO: 3654350 - RNA, 15 nt, Human
cuagaaguuacugaa

SEQ ID NO: 3654351 - RNA, 20 nt, Human
cuagaaguuacugaaugcac

SEQ ID NO: 3654352 - RNA, 18 nt, Human
cuagaaguuucccuuccu

SEQ ID NO: 3654353 - RNA, 20 nt, Human
cuagaaguuucccuuccucc

SEQ ID NO: 3654354 - RNA, 22 nt, Human
cuagaaguuucccuuccuccau

SEQ ID NO: 3654355 - RNA, 12 nt, Human
cuagaauacuuu

SEQ ID NO: 3654356 - RNA, 20 nt, Human
ccagcuccuccgugcuuccu

SEQ ID NO: 3654357 - RNA, 12 nt, Human
ccagcuccugac

SEQ ID NO: 3654358 - RNA, 12 nt, Human
ccagcucucagc

SEQ ID NO: 3654359 - RNA, 14 nt, Human
ccagcucucagcca

SEQ ID NO: 3654360 - RNA, 17 nt, Human
ccagcucucccucuggc

SEQ ID NO: 3654361 - RNA, 22 nt, Human
ccagcucucccucuggcccugc

SEQ ID NO: 3654362 - RNA, 23 nt, Human
ccagcucucccucuggcccugcc

SEQ ID NO: 3654363 - RNA, 21 nt, Human
ccagcucugccgucucuggag

SEQ ID NO: 3654364 - RNA, 11 nt, Human
ccagcucuggu

SEQ ID NO: 3654365 - RNA, 12 nt, Human
ccagcucugguc

SEQ ID NO: 3654366 - RNA, 13 nt, Human
ccagcucuggucc

SEQ ID NO: 3654367 - RNA, 22 nt, Human
ccagcucugguccauagagagc

SEQ ID NO: 3654368 - RNA, 17 nt, Human
ccagcucuguucuuccu

SEQ ID NO: 3654369 - RNA, 20 nt, Human
ccagcucuguucuuccucag

SEQ ID NO: 3654370 - RNA, 22 nt, Human
ccagcucuguucuuccucagcc

SEQ ID NO: 3654371 - RNA, 16 nt, Human
ccagcucuuccuagcu

SEQ ID NO: 3654372 - RNA, 14 nt, Human
ccagcucuuuccuc

SEQ ID NO: 3654373 - RNA, 21 nt, Human
ccagcugaaauacugaggggu

SEQ ID NO: 3654374 - RNA, 23 nt, Human
ccagcugacaguccucuccaccu

SEQ ID NO: 3654375 - RNA, 21 nt, Human
ccagcugacaucuugaauccu

SEQ ID NO: 3654376 - RNA, 17 nt, Human
ccagcugacuaaacuuu

SEQ ID NO: 3654377 - RNA, 17 nt, Human
ccagcugagcgccagga

SEQ ID NO: 3654378 - RNA, 17 nt, Human
ccagcugaugacucaag

SEQ ID NO: 3654379 - RNA, 16 nt, Human
ccagcugcaccagagc

SEQ ID NO: 3654380 - RNA, 22 nt, Human
ccagcugcaccccuuccugggc

SEQ ID NO: 3654381 - RNA, 20 nt, Human
ccagcugcaccugccagccu

SEQ ID NO: 3654382 - RNA, 22 nt, Human
ccagcugcaccugccagccugg

SEQ ID NO: 3654383 - RNA, 19 nt, Human
ccagcugcaggaaucaaaa

SEQ ID NO: 3654384 - RNA, 20 nt, Human
ccagcugcaggaaucaaaaa

SEQ ID NO: 3654385 - RNA, 18 nt, Human
ccagcugccccagccaga

SEQ ID NO: 3654386 - RNA, 21 nt, Human
ccagcugcccccagagccaca

SEQ ID NO: 3654387 - RNA, 23 nt, Human
ccagcugcccccagagccacagu

SEQ ID NO: 3654388 - RNA, 16 nt, Human
ccagcugccccucccu

SEQ ID NO: 3654389 - RNA, 19 nt, Human
ccagcugccccucccugcc

SEQ ID NO: 3654390 - RNA, 20 nt, Human
ccagcugcccuaugggccug

SEQ ID NO: 3654391 - RNA, 21 nt, Human
ccagcugcccuaugggccugc

SEQ ID NO: 3654392 - RNA, 20 nt, Human
ccagcugccgaccagagccc

SEQ ID NO: 3654393 - RNA, 13 nt, Human
ccagcugccucuu

SEQ ID NO: 3654394 - RNA, 16 nt, Human
ccagcugcgcuugcuu

SEQ ID NO: 3654395 - RNA, 14 nt, Human
ccagcugcuccccu

SEQ ID NO: 3654396 - RNA, 13 nt, Human
ccagcugcucugc

SEQ ID NO: 3654397 - RNA, 16 nt, Human
ccagcugcucugccca

SEQ ID NO: 3654398 - RNA, 17 nt, Human
ccagcugcucugcccag

SEQ ID NO: 3654399 - RNA, 18 nt, Human
ccagcugcucugcccaga

SEQ ID NO: 3654400 - RNA, 19 nt, Human
ccagcugcucugcccagag

SEQ ID NO: 3654401 - RNA, 20 nt, Human
ccagcugcucugcccagagc

SEQ ID NO: 3654402 - RNA, 23 nt, Human
ccagcugcucugcccagagcugg

SEQ ID NO: 3654403 - RNA, 20 nt, Human
ccagcugcugagauccugga

SEQ ID NO: 3654404 - RNA, 16 nt, Human
ccagcugcugagccgc

SEQ ID NO: 3654405 - RNA, 15 nt, Human
ccagcugcugcucug

SEQ ID NO: 3654406 - RNA, 15 nt, Human
ccagcugcuugggcu

SEQ ID NO: 3654407 - RNA, 23 nt, Human
ccagcugcuugggcuucauccuc

SEQ ID NO: 3654408 - RNA, 13 nt, Human
ccagcuggaggca

SEQ ID NO: 3654409 - RNA, 15 nt, Human
ccagcuggaggcagg

SEQ ID NO: 3654410 - RNA, 17 nt, Human
ccagcuggccgggagcc

SEQ ID NO: 3654411 - RNA, 12 nt, Human
ccagcuggccug

SEQ ID NO: 3654412 - RNA, 13 nt, Human
ccagcuggccugg

SEQ ID NO: 3654413 - RNA, 14 nt, Human
ccagcuggccuuug

SEQ ID NO: 3654414 - RNA, 16 nt, Human
ccagcuggccuuugua

SEQ ID NO: 3654415 - RNA, 19 nt, Human
ccagcugggaggcaagagg

SEQ ID NO: 3654416 - RNA, 18 nt, Human
ccagcugggcucugcaau

SEQ ID NO: 3654417 - RNA, 19 nt, Human
ccagcugggcucugcaauu

SEQ ID NO: 3654418 - RNA, 17 nt, Human
ccagcugggcucugcca

SEQ ID NO: 3654419 - RNA, 21 nt, Human
ccagcugggcucugccacccu

SEQ ID NO: 3654420 - RNA, 17 nt, Human
ccagcuggggccaggcu

SEQ ID NO: 3654421 - RNA, 18 nt, Human
ccagcuggggccaggcug

SEQ ID NO: 3654422 - RNA, 22 nt, Human
ccagcuggggccaggcuggguc

SEQ ID NO: 3654423 - RNA, 22 nt, Human
ccagcuggggcguggggagggc

SEQ ID NO: 3654424 - RNA, 17 nt, Human
ccagcuggguuggaaaa

SEQ ID NO: 3654425 - RNA, 13 nt, Human
ccagcugucugug

SEQ ID NO: 3654426 - RNA, 14 nt, Human
ccagcugugagccu

SEQ ID NO: 3654427 - RNA, 19 nt, Human
ccagcugugagccuuggcu

SEQ ID NO: 3654428 - RNA, 23 nt, Human
ccagcugugcucuggacaggcau

SEQ ID NO: 3654429 - RNA, 23 nt, Human
ccagcugugguuuucuuuugcca

SEQ ID NO: 3654430 - RNA, 22 nt, Human
ccagcuguucugucccuuggag

SEQ ID NO: 3654431 - RNA, 19 nt, Human
ccagcuuaaaggggcuaga

SEQ ID NO: 3654432 - RNA, 21 nt, Human
ccagcuuaaaguaaccggaug

SEQ ID NO: 3654433 - RNA, 16 nt, Human
ccagcuuaucucaggg

SEQ ID NO: 3654434 - RNA, 15 nt, Human
ccagcuucacuucug

SEQ ID NO: 3654435 - RNA, 20 nt, Human
ccagcuucacuucugacucu

SEQ ID NO: 3654436 - RNA, 14 nt, Human
ccagcuuccuucag

SEQ ID NO: 3654437 - RNA, 14 nt, Human
ccagcuucuccagg

SEQ ID NO: 3654438 - RNA, 22 nt, Human
ccagcuugccagaugcugcaga

SEQ ID NO: 3654439 - RNA, 16 nt, Human
ccagcuugcucuucag

SEQ ID NO: 3654440 - RNA, 14 nt, Human
ccagcuuggcucag

SEQ ID NO: 3654441 - RNA, 14 nt, Human
ccagcuugggcaga

SEQ ID NO: 3654442 - RNA, 17 nt, Human
ccagcuugggcagaucu

SEQ ID NO: 3654443 - RNA, 24 nt, Human
ccagcuugggcccagcugggcucu

SEQ ID NO: 3654444 - RNA, 14 nt, Human
ccagcuuggggcca

SEQ ID NO: 3654445 - RNA, 21 nt, Human
ccagcuuggggccaccaaagc

SEQ ID NO: 3654446 - RNA, 18 nt, Human
ccagcuuguggagcccca

SEQ ID NO: 3654447 - RNA, 16 nt, Human
ccagcuuguuauuuau

SEQ ID NO: 3654448 - RNA, 12 nt, Human
ccagcuuucccu

SEQ ID NO: 3654449 - RNA, 19 nt, Human
ccagcuuugcccaacacca

SEQ ID NO: 3654450 - RNA, 22 nt, Human
ccagcuuugcccaacaccagcc

SEQ ID NO: 3654451 - RNA, 16 nt, Human
ccagcuuuuaaccauc

SEQ ID NO: 3654452 - RNA, 16 nt, Human
ccagcuuuucauugcu

SEQ ID NO: 3654453 - RNA, 23 nt, Human
ccagcuuuucccaaaagcccauu

SEQ ID NO: 3654454 - RNA, 18 nt, Human
ccagcuuuuccucccuug

SEQ ID NO: 3654455 - RNA, 15 nt, Human
ccaggaaaaaggaca

SEQ ID NO: 3654456 - RNA, 16 nt, Human
ccaggaaaggcuccag

SEQ ID NO: 3654457 - RNA, 14 nt, Human
ccaggaacugggcc

SEQ ID NO: 3654458 - RNA, 19 nt, Human
ccaggaagaucccccagaa

SEQ ID NO: 3654459 - RNA, 17 nt, Human
ccaggaagccagcaggc

SEQ ID NO: 3654460 - RNA, 22 nt, Human
ccaggaagccagcaggcucuca

SEQ ID NO: 3654461 - RNA, 15 nt, Human
ccaggaagcccagga

SEQ ID NO: 3654462 - RNA, 22 nt, Human
ccaggccaaaggggaccuggaa

SEQ ID NO: 3654463 - RNA, 12 nt, Human
ccaggccaccag

SEQ ID NO: 3654464 - RNA, 15 nt, Human
ccaggccaccaggau

SEQ ID NO: 3654465 - RNA, 16 nt, Human
ccaggccaccucccca

SEQ ID NO: 3654466 - RNA, 22 nt, Human
ccaggccagagggagugacaga

SEQ ID NO: 3654467 - RNA, 12 nt, Human
ccaggccagccu

SEQ ID NO: 3654468 - RNA, 21 nt, Human
ccaggccaggacucugcagcc

SEQ ID NO: 3654469 - RNA, 22 nt, Human
ccaggccaggacucugcagccu

SEQ ID NO: 3654470 - RNA, 23 nt, Human
ccaggccaggacucugcagccuc

SEQ ID NO: 3654471 - RNA, 18 nt, Human
ccaggccaggcauguggc

SEQ ID NO: 3654472 - RNA, 14 nt, Human
ccaggccaucagag

SEQ ID NO: 3654473 - RNA, 22 nt, Human
ccaggccauccggcccccagag

SEQ ID NO: 3654474 - RNA, 16 nt, Human
ccaggccaucuuccag

SEQ ID NO: 3654475 - RNA, 14 nt, Human
ccaggcccacucag

SEQ ID NO: 3654476 - RNA, 18 nt, Human
ccaggcccagccgacccc

SEQ ID NO: 3654477 - RNA, 15 nt, Human
ccaggccccaggaag

SEQ ID NO: 3654478 - RNA, 17 nt, Human
ccaggccccaggaagcc

SEQ ID NO: 3654479 - RNA, 16 nt, Human
ccaggccccaugaccu

SEQ ID NO: 3654480 - RNA, 21 nt, Human
ccaggccccaugaccuccagc

SEQ ID NO: 3654481 - RNA, 19 nt, Human
ccaggcccccaccacacau

SEQ ID NO: 3654482 - RNA, 20 nt, Human
ccaggcccccaccacacauc

SEQ ID NO: 3654483 - RNA, 20 nt, Human
ccaggccccgaggacccaga

SEQ ID NO: 3654484 - RNA, 20 nt, Human
ccaggccccgcucauucuuu

SEQ ID NO: 3654485 - RNA, 14 nt, Human
ccaggccccugcca

SEQ ID NO: 3654486 - RNA, 19 nt, Human
ccaggccccugccacccug

SEQ ID NO: 3654487 - RNA, 15 nt, Human
ccaggccccuggagg

SEQ ID NO: 3654488 - RNA, 23 nt, Human
ccaggccccuggaggcugccucc

SEQ ID NO: 3654489 - RNA, 20 nt, Human
ccaggcccggggcuggcggc

SEQ ID NO: 3654490 - RNA, 16 nt, Human
ccaggcccgucugucc

SEQ ID NO: 3654491 - RNA, 23 nt, Human
ccaggcccgucuguccaucugcc

SEQ ID NO: 3654492 - RNA, 19 nt, Human
ccaggcccuccucucccau

SEQ ID NO: 3654493 - RNA, 15 nt, Human
ccaggcccucugccc

SEQ ID NO: 3654494 - RNA, 17 nt, Human
ccaggcccucugcccac

SEQ ID NO: 3654495 - RNA, 16 nt, Human
ccaggccgcagcucuu

SEQ ID NO: 3654496 - RNA, 17 nt, Human
ccaggccgcagcucuug

SEQ ID NO: 3654497 - RNA, 21 nt, Human
ccaggccgcagcucuugcccu

SEQ ID NO: 3654498 - RNA, 19 nt, Human
ccaggccgcgcccuuuccc

SEQ ID NO: 3654499 - RNA, 18 nt, Human
ccaggccggccagccuca

SEQ ID NO: 3654500 - RNA, 18 nt, Human
ccaggccggcgagcccug

SEQ ID NO: 3654501 - RNA, 18 nt, Human
ccaggccgggccuguaca

SEQ ID NO: 3654502 - RNA, 19 nt, Human
ccaggccgggccuguacag

SEQ ID NO: 3654503 - RNA, 22 nt, Human
ccaggccguccucccgggcccu

SEQ ID NO: 3654504 - RNA, 19 nt, Human
ccaggccuccagcucagca

SEQ ID NO: 3654505 - RNA, 19 nt, Human
ccaggccuccuacagcuug

SEQ ID NO: 3654506 - RNA, 18 nt, Human
ccaggccucuguguccuu

SEQ ID NO: 3654507 - RNA, 19 nt, Human
ccaggccugaaagaggcug

SEQ ID NO: 3654508 - RNA, 16 nt, Human
ccaggccugccuccca

SEQ ID NO: 3654509 - RNA, 19 nt, Human
ccaggccugggucuguguc

SEQ ID NO: 3654510 - RNA, 18 nt, Human
ccaggcgaugugcaagug

SEQ ID NO: 3654511 - RNA, 18 nt, Human
ccaggcgcaggggcucac

SEQ ID NO: 3654512 - RNA, 16 nt, Human
ccaggcgcuagcacag

SEQ ID NO: 3654513 - RNA, 17 nt, Human
ccaggcgggcucaagga

SEQ ID NO: 3654514 - RNA, 24 nt, Human
ccaggcuaauuuuuuuguauuuua

SEQ ID NO: 3654515 - RNA, 18 nt, Human
ccaggcuagcuggagccu

SEQ ID NO: 3654516 - RNA, 20 nt, Human
ccaggcuaguccggacccac

SEQ ID NO: 3654517 - RNA, 17 nt, Human
ccaggcucacucacaga

SEQ ID NO: 3654518 - RNA, 21 nt, Human
cucaaccuguaaauuauuuua

SEQ ID NO: 3654519 - RNA, 16 nt, Human
cucaacguauuguuuc

SEQ ID NO: 3654520 - RNA, 18 nt, Human
cucaacuagcagauacag

SEQ ID NO: 3654521 - RNA, 21 nt, Human
cucaacucuccuccagaguca

SEQ ID NO: 3654522 - RNA, 16 nt, Human
cucaacucugcugagg

SEQ ID NO: 3654523 - RNA, 17 nt, Human
cucaacucugcugaggg

SEQ ID NO: 3654524 - RNA, 18 nt, Human
cucaacucugcugagggu

SEQ ID NO: 3654525 - RNA, 13 nt, Human
cucaacuuucugu

SEQ ID NO: 3654526 - RNA, 13 nt, Human
cucaagaagcagg

SEQ ID NO: 3654527 - RNA, 23 nt, Human
cucaagaagcaggcuacacugac

SEQ ID NO: 3654528 - RNA, 23 nt, Human
cucaagacccuuuuggguuucug

SEQ ID NO: 3654529 - RNA, 16 nt, Human
cucaagacuuccagag

SEQ ID NO: 3654530 - RNA, 16 nt, Human
cucaagaggaaugaaa

SEQ ID NO: 3654531 - RNA, 21 nt, Human
cucaagagggcacugguggcc

SEQ ID NO: 3654532 - RNA, 21 nt, Human
cucaagauacugcuacuguaa

SEQ ID NO: 3654533 - RNA, 18 nt, Human
cucaagaucaaugaaaug

SEQ ID NO: 3654534 - RNA, 16 nt, Human
cucaagaugaaggcaa

SEQ ID NO: 3654535 - RNA, 14 nt, Human
cucaagauucccag

SEQ ID NO: 3654536 - RNA, 17 nt, Human
cucaagcaauccuccug

SEQ ID NO: 3654537 - RNA, 22 nt, Human
cucaagcaauccuccugaguga

SEQ ID NO: 3654538 - RNA, 23 nt, Human
cucaagcagcgaccgcccccucc

SEQ ID NO: 3654539 - RNA, 23 nt, Human
cucaagcagucuacccaccucag

SEQ ID NO: 3654540 - RNA, 20 nt, Human
cucaagccaauccccuccuu

SEQ ID NO: 3654541 - RNA, 16 nt, Human
cucaagcgauucuccu

SEQ ID NO: 3654542 - RNA, 17 nt, Human
cucaagcgauucuccug

SEQ ID NO: 3654543 - RNA, 17 nt, Human
cucaaggaaaggccuga

SEQ ID NO: 3654544 - RNA, 14 nt, Human
cucaaggaaagggg

SEQ ID NO: 3654545 - RNA, 14 nt, Human
cucaaggaaucuuu

SEQ ID NO: 3654546 - RNA, 18 nt, Human
cucaaggacaaagucucc

SEQ ID NO: 3654547 - RNA, 19 nt, Human
cucaaggacaaagucucca

SEQ ID NO: 3654548 - RNA, 22 nt, Human
cucaaggacaaagucuccagcc

SEQ ID NO: 3654549 - RNA, 15 nt, Human
cucaaggacuugaaa

SEQ ID NO: 3654550 - RNA, 20 nt, Human
cucaaggacuugaaagcauc

SEQ ID NO: 3654551 - RNA, 20 nt, Human
cucaaggauaccuucuuauu

SEQ ID NO: 3654552 - RNA, 16 nt, Human
cucaaggccucccaca

SEQ ID NO: 3654553 - RNA, 17 nt, Human
cucaaggccucccacag

SEQ ID NO: 3654554 - RNA, 15 nt, Human
cucaaggcgugagga

SEQ ID NO: 3654555 - RNA, 16 nt, Human
cucaaggcgugaggau

SEQ ID NO: 3654556 - RNA, 20 nt, Human
cucaagggacaaggacacgc

SEQ ID NO: 3654557 - RNA, 18 nt, Human
cucaagggggacugucuu

SEQ ID NO: 3654558 - RNA, 19 nt, Human
cucaaggugggccuugcua

SEQ ID NO: 3654559 - RNA, 20 nt, Human
cucaagguuuuagguucuaa

SEQ ID NO: 3654560 - RNA, 14 nt, Human
cucaaguagcauuu

SEQ ID NO: 3654561 - RNA, 15 nt, Human
cucaaguagcauuua

SEQ ID NO: 3654562 - RNA, 18 nt, Human
cucaagucuucccugauc

SEQ ID NO: 3654563 - RNA, 21 nt, Human
cucaagucuuucucuuucccu

SEQ ID NO: 3654564 - RNA, 18 nt, Human
cucaagugauucuccugc

SEQ ID NO: 3654565 - RNA, 20 nt, Human
cucaagugauucuccugccu

SEQ ID NO: 3654566 - RNA, 14 nt, Human
cucaaguucaagga

SEQ ID NO: 3654567 - RNA, 17 nt, Human
cucaaguucaaggacca

SEQ ID NO: 3654568 - RNA, 13 nt, Human
cucaaguucuaag

SEQ ID NO: 3654569 - RNA, 14 nt, Human
cucaaguucuaaga

SEQ ID NO: 3654570 - RNA, 20 nt, Human
cucaaguuucuucaaucuga

SEQ ID NO: 3654571 - RNA, 19 nt, Human
cucaaguuuuucagaaagc

SEQ ID NO: 3654572 - RNA, 20 nt, Human
cucaaguuuuucagaaagca

SEQ ID NO: 3654573 - RNA, 22 nt, Human
cucaauaaaaucauguacauuu

SEQ ID NO: 3654574 - RNA, 14 nt, Human
cucaauaaaguaca

SEQ ID NO: 3654575 - RNA, 16 nt, Human
cucaauauucaauaaa

SEQ ID NO: 3654576 - RNA, 19 nt, Human
cucaauauucaauaaagcu

SEQ ID NO: 3654577 - RNA, 16 nt, Human
cucaauauuccugaau

SEQ ID NO: 3654578 - RNA, 18 nt, Human
cucaauauuccugaauga

SEQ ID NO: 3654579 - RNA, 16 nt, Human
cucaaucagucucaga

SEQ ID NO: 3654580 - RNA, 15 nt, Human
cucaaucccugagga

SEQ ID NO: 3654581 - RNA, 23 nt, Human
cucaauccuaauuucuccucccu

SEQ ID NO: 3654582 - RNA, 14 nt, Human
cucaauccucuaag

SEQ ID NO: 3654583 - RNA, 17 nt, Human
cucaauccugcaguggg

SEQ ID NO: 3654584 - RNA, 19 nt, Human
cucaaugagcauguuuaga

SEQ ID NO: 3654585 - RNA, 12 nt, Human
cucaaugcucau

SEQ ID NO: 3654586 - RNA, 17 nt, Human
cucaaugcuguuugggu

SEQ ID NO: 3654587 - RNA, 17 nt, Human
cucaaugcuuuauuugu

SEQ ID NO: 3654588 - RNA, 13 nt, Human
cucaauggacugg

SEQ ID NO: 3654589 - RNA, 14 nt, Human
cucaauggacugga

SEQ ID NO: 3654590 - RNA, 16 nt, Human
cucaaugugaccaggg

SEQ ID NO: 3654591 - RNA, 18 nt, Human
cucaauguuuguaauaau

SEQ ID NO: 3654592 - RNA, 19 nt, Human
cucaauucauauuuaugaa

SEQ ID NO: 3654593 - RNA, 12 nt, Human
cucaauuccaac

SEQ ID NO: 3654594 - RNA, 16 nt, Human
cucaauuccaacaguu

SEQ ID NO: 3654595 - RNA, 16 nt, Human
cucaauugcuuuguaa

SEQ ID NO: 3654596 - RNA, 13 nt, Human
cucaauuucuccc

SEQ ID NO: 3654597 - RNA, 16 nt, Human
cucaauuucuccccag

SEQ ID NO: 3654598 - RNA, 16 nt, Human
cucaauuuuugucuca

SEQ ID NO: 3654599 - RNA, 18 nt, Human
cucaauuuuugucucaga

SEQ ID NO: 3654600 - RNA, 11 nt, Human
cucacaaaaga

SEQ ID NO: 3654601 - RNA, 22 nt, Human
cucacaaaccaugcaaaugcua

SEQ ID NO: 3654602 - RNA, 15 nt, Human
cucacaagaagacca

SEQ ID NO: 3654603 - RNA, 14 nt, Human
cucacaaggcagca

SEQ ID NO: 3654604 - RNA, 16 nt, Human
cucacaaggcagcaag

SEQ ID NO: 3654605 - RNA, 19 nt, Human
cucacaaggcagcaaggcc

SEQ ID NO: 3654606 - RNA, 19 nt, Human
ccagugaggcucugcccuu

SEQ ID NO: 3654607 - RNA, 23 nt, Human
ccagugagggacgucagacuugg

SEQ ID NO: 3654608 - RNA, 19 nt, Human
ccagugagucucuggggca

SEQ ID NO: 3654609 - RNA, 19 nt, Human
ccagugauucgagcuauau

SEQ ID NO: 3654610 - RNA, 17 nt, Human
ccagugcaggcuggcca

SEQ ID NO: 3654611 - RNA, 23 nt, Human
ccagugcaguuugguguguccuc

SEQ ID NO: 3654612 - RNA, 15 nt, Human
ccagugcaugguggc

SEQ ID NO: 3654613 - RNA, 22 nt, Human
ccagugcccaaagucuguguga

SEQ ID NO: 3654614 - RNA, 13 nt, Human
ccagugcccauuc

SEQ ID NO: 3654615 - RNA, 14 nt, Human
ccagugcccccacu

SEQ ID NO: 3654616 - RNA, 18 nt, Human
ccagugcccccacugacc

SEQ ID NO: 3654617 - RNA, 16 nt, Human
ccagugcccugauccc

SEQ ID NO: 3654618 - RNA, 15 nt, Human
ccagugcccuggggc

SEQ ID NO: 3654619 - RNA, 20 nt, Human
ccagugccgagaaggaagcc

SEQ ID NO: 3654620 - RNA, 23 nt, Human
ccagugccuuaccuccugcccag

SEQ ID NO: 3654621 - RNA, 16 nt, Human
ccagugcgauucugga

SEQ ID NO: 3654622 - RNA, 20 nt, Human
ccagugcuccaggcacccag

SEQ ID NO: 3654623 - RNA, 18 nt, Human
ccaguggaagaagaaaac

SEQ ID NO: 3654624 - RNA, 16 nt, Human
ccaguggagguuuguc

SEQ ID NO: 3654625 - RNA, 21 nt, Human
ccaguggaugccacagcccag

SEQ ID NO: 3654626 - RNA, 15 nt, Human
ccaguggcagggcac

SEQ ID NO: 3654627 - RNA, 18 nt, Human
ccaguggcagggcacagg

SEQ ID NO: 3654628 - RNA, 19 nt, Human
ccaguggcagggcacaggg

SEQ ID NO: 3654629 - RNA, 22 nt, Human
ccaguggcagggcacagggccu

SEQ ID NO: 3654630 - RNA, 23 nt, Human
ccaguggcagggcacagggccug

SEQ ID NO: 3654631 - RNA, 17 nt, Human
ccaguggccucaacccu

SEQ ID NO: 3654632 - RNA, 16 nt, Human
ccaguggccuggcucc

SEQ ID NO: 3654633 - RNA, 20 nt, Human
ccaguggcguuguugcaugu

SEQ ID NO: 3654634 - RNA, 15 nt, Human
ccaguggcugcugcc

SEQ ID NO: 3654635 - RNA, 16 nt, Human
ccaguggcugcugccc

SEQ ID NO: 3654636 - RNA, 17 nt, Human
ccaguggcugcugccca

SEQ ID NO: 3654637 - RNA, 18 nt, Human
ccaguggcugcugcccag

SEQ ID NO: 3654638 - RNA, 13 nt, Human
ccagugggaagau

SEQ ID NO: 3654639 - RNA, 12 nt, Human
ccagugggaggg

SEQ ID NO: 3654640 - RNA, 19 nt, Human
ccagugggaggggcaggcu

SEQ ID NO: 3654641 - RNA, 20 nt, Human
ccagugggaggggcaggcug

SEQ ID NO: 3654642 - RNA, 23 nt, Human
ccagugggaggggcaggcugaca

SEQ ID NO: 3654643 - RNA, 21 nt, Human
ccaguggggccugaggcuccu

SEQ ID NO: 3654644 - RNA, 14 nt, Human
ccaguggggccugu

SEQ ID NO: 3654645 - RNA, 22 nt, Human
ccaguggggccuguggaaugag

SEQ ID NO: 3654646 - RNA, 13 nt, Human
ccaguggucucac

SEQ ID NO: 3654647 - RNA, 17 nt, Human
ccaguggucucacaugg

SEQ ID NO: 3654648 - RNA, 14 nt, Human
ccagugguugcugu

SEQ ID NO: 3654649 - RNA, 19 nt, Human
ccagugguuuccagucaug

SEQ ID NO: 3654650 - RNA, 22 nt, Human
ccaguguaaucccccaggagaa

SEQ ID NO: 3654651 - RNA, 19 nt, Human
ccagugucaaguugugcuu

SEQ ID NO: 3654652 - RNA, 18 nt, Human
ccaguguccauggacuca

SEQ ID NO: 3654653 - RNA, 14 nt, Human
ccaguguccccucc

SEQ ID NO: 3654654 - RNA, 16 nt, Human
ccaguguccccuccac

SEQ ID NO: 3654655 - RNA, 22 nt, Human
ccaguguccccuccacugucac

SEQ ID NO: 3654656 - RNA, 16 nt, Human
ccagugucuuccugug

SEQ ID NO: 3654657 - RNA, 17 nt, Human
ccagugucuuccugugg

SEQ ID NO: 3654658 - RNA, 13 nt, Human
ccagugucuuucu

SEQ ID NO: 3654659 - RNA, 14 nt, Human
ccagugucuuucuu

SEQ ID NO: 3654660 - RNA, 16 nt, Human
ccagugucuuucuuug

SEQ ID NO: 3654661 - RNA, 14 nt, Human
ccagugugacaagg

SEQ ID NO: 3654662 - RNA, 15 nt, Human
ccagugugcugaugg

SEQ ID NO: 3654663 - RNA, 12 nt, Human
ccaguguggaac

SEQ ID NO: 3654664 - RNA, 18 nt, Human
ccagugugggcuugacca

SEQ ID NO: 3654665 - RNA, 17 nt, Human
ccaguguugccuaagua

SEQ ID NO: 3654666 - RNA, 17 nt, Human
ccaguuaaaaaaaauuu

SEQ ID NO: 3654667 - RNA, 19 nt, Human
ccaguuaaaauguguuucu

SEQ ID NO: 3654668 - RNA, 17 nt, Human
ccaguuaaucuugcuuu

SEQ ID NO: 3654669 - RNA, 18 nt, Human
ccaguuaauuuuuccaac

SEQ ID NO: 3654670 - RNA, 23 nt, Human
ccaguuacuuuccaauucuccuu

SEQ ID NO: 3654671 - RNA, 12 nt, Human
ccaguucaaaaa

SEQ ID NO: 3654672 - RNA, 19 nt, Human
ccaguucaaucucccgcug

SEQ ID NO: 3654673 - RNA, 15 nt, Human
ccaguucagcuuggg

SEQ ID NO: 3654674 - RNA, 18 nt, Human
ccaguucaggagucccaa

SEQ ID NO: 3654675 - RNA, 19 nt, Human
ccaguucaguaccuggagg

SEQ ID NO: 3654676 - RNA, 17 nt, Human
ccaguucauugcacuuu

SEQ ID NO: 3654677 - RNA, 18 nt, Human
ccaguucauugcacuuug

SEQ ID NO: 3654678 - RNA, 21 nt, Human
ccaguuccuuucaaugguuug

SEQ ID NO: 3654679 - RNA, 18 nt, Human
ccaguucgccuggagccc

SEQ ID NO: 3654680 - RNA, 14 nt, Human
ccaguucugcuccu

SEQ ID NO: 3654681 - RNA, 19 nt, Human
ccaguucugcuccucucca

SEQ ID NO: 3654682 - RNA, 14 nt, Human
ccaguugcacuugg

SEQ ID NO: 3654683 - RNA, 12 nt, Human
ccaguugcaguc

SEQ ID NO: 3654684 - RNA, 15 nt, Human
ccaguugccaucugc

SEQ ID NO: 3654685 - RNA, 14 nt, Human
ccaguugccuuuua

SEQ ID NO: 3654686 - RNA, 21 nt, Human
ccaguugcugcuucaauuuau

SEQ ID NO: 3654687 - RNA, 18 nt, Human
ccaguuuauuccagagcu

SEQ ID NO: 3654688 - RNA, 12 nt, Human
ccaguuucugcc

SEQ ID NO: 3654689 - RNA, 13 nt, Human
ccaguuugcagaa

SEQ ID NO: 3654690 - RNA, 23 nt, Human
ccaguuugcagaaaagcaccugc

SEQ ID NO: 3654691 - RNA, 13 nt, Human
ccaguuugcuuug

SEQ ID NO: 3654692 - RNA, 20 nt, Human
ccaguuuggguaaaauacuu

SEQ ID NO: 3654693 - RNA, 22 nt, Human
ccaguuuggguaaaauacuuuu

SEQ ID NO: 3654694 - RNA, 19 nt, Human
ccauaaaacauuaagaaaa

SEQ ID NO: 3654695 - RNA, 22 nt, Human
ccauaaacacccaugaaucaaa

SEQ ID NO: 3654696 - RNA, 16 nt, Human
ccauaaccgcugauuc

SEQ ID NO: 3654697 - RNA, 17 nt, Human
ccauaaccgcugauucu

SEQ ID NO: 3654698 - RNA, 19 nt, Human
ccauaagcaacaauuuuca

SEQ ID NO: 3654699 - RNA, 16 nt, Human
ccauaagcuacugcca

SEQ ID NO: 3654700 - RNA, 20 nt, Human
ccauaauuaugacaguuaua

SEQ ID NO: 3654701 - RNA, 23 nt, Human
ccauaauuuucuucaugcaauga

SEQ ID NO: 3654702 - RNA, 20 nt, Human
ccauaauuuuuuuuuuccuu

SEQ ID NO: 3654703 - RNA, 14 nt, Human
ccauacacacgcug

SEQ ID NO: 3654704 - RNA, 16 nt, Human
ccauacacacgcugcc

SEQ ID NO: 3654705 - RNA, 14 nt, Human
ccauacacccccuc

SEQ ID NO: 3654706 - RNA, 19 nt, Human
ccauacacccccucuucug

SEQ ID NO: 3654707 - RNA, 19 nt, Human
ccauacauaaaagaaauaa

SEQ ID NO: 3654708 - RNA, 13 nt, Human
ccauacauuugug

SEQ ID NO: 3654709 - RNA, 16 nt, Human
ccauacucugucuccc

SEQ ID NO: 3654710 - RNA, 18 nt, Human
ccauacucugucucccua

SEQ ID NO: 3654711 - RNA, 17 nt, Human
ccauacuggccucgccu

SEQ ID NO: 3654712 - RNA, 19 nt, Human
ccauacuuugucugaaaaa

SEQ ID NO: 3654713 - RNA, 16 nt, Human
ccauagaaacaugaca

SEQ ID NO: 3654714 - RNA, 21 nt, Human
ccauagaaacaugacacugac

SEQ ID NO: 3654715 - RNA, 22 nt, Human
ccauagaaacaugacacugacc

SEQ ID NO: 3654716 - RNA, 23 nt, Human
ccauagagagcaagacgcugugc

SEQ ID NO: 3654717 - RNA, 19 nt, Human
ccauagaguacacugccug

SEQ ID NO: 3654718 - RNA, 22 nt, Human
ccauagaguacacugccugccu

SEQ ID NO: 3654719 - RNA, 13 nt, Human
ccauagaguuuaa

SEQ ID NO: 3654720 - RNA, 17 nt, Human
ccauagaguuuaacaca

SEQ ID NO: 3654721 - RNA, 15 nt, Human
ccauagaucuucuga

SEQ ID NO: 3654722 - RNA, 21 nt, Human
ccauagaucuucugaaaugaa

SEQ ID NO: 3654723 - RNA, 22 nt, Human
cucaguccuccccucacagccu

SEQ ID NO: 3654724 - RNA, 23 nt, Human
cucaguccuccccucacagccuc

SEQ ID NO: 3654725 - RNA, 14 nt, Human
cucagucucccuuu

SEQ ID NO: 3654726 - RNA, 15 nt, Human
cucagucucccuuuc

SEQ ID NO: 3654727 - RNA, 14 nt, Human
cucagucucugagc

SEQ ID NO: 3654728 - RNA, 17 nt, Human
cucagucuggcccuucc

SEQ ID NO: 3654729 - RNA, 20 nt, Human
cucagucuggcccuuccuuu

SEQ ID NO: 3654730 - RNA, 22 nt, Human
cucagucuggcccuuccuuuuc

SEQ ID NO: 3654731 - RNA, 15 nt, Human
cucagugaagaauac

SEQ ID NO: 3654732 - RNA, 15 nt, Human
cucagugaaguugcu

SEQ ID NO: 3654733 - RNA, 18 nt, Human
cucagugaaguugcugcu

SEQ ID NO: 3654734 - RNA, 20 nt, Human
cucagugaaguugcugcuuc

SEQ ID NO: 3654735 - RNA, 21 nt, Human
cucagugaaguugcugcuucu

SEQ ID NO: 3654736 - RNA, 23 nt, Human
cucagugcaaccucugcuuccca

SEQ ID NO: 3654737 - RNA, 16 nt, Human
cucagugcauuugugc

SEQ ID NO: 3654738 - RNA, 23 nt, Human
cucagugccaacuguggcugguc

SEQ ID NO: 3654739 - RNA, 16 nt, Human
cucagugcccuccagc

SEQ ID NO: 3654740 - RNA, 15 nt, Human
cucagugcuuuccuc

SEQ ID NO: 3654741 - RNA, 22 nt, Human
cucaguggacuuuccacccccu

SEQ ID NO: 3654742 - RNA, 22 nt, Human
cucaguggcccauggcauuuua

SEQ ID NO: 3654743 - RNA, 18 nt, Human
cucaguggcuucaucugu

SEQ ID NO: 3654744 - RNA, 16 nt, Human
cucaguggggcagagg

SEQ ID NO: 3654745 - RNA, 16 nt, Human
cucaguguauuuguau

SEQ ID NO: 3654746 - RNA, 18 nt, Human
cucagugucauuuaugaa

SEQ ID NO: 3654747 - RNA, 20 nt, Human
cucaguguccucaggggccu

SEQ ID NO: 3654748 - RNA, 21 nt, Human
cucagugucuggcugcagagc

SEQ ID NO: 3654749 - RNA, 22 nt, Human
cucagugucuggcugcagagca

SEQ ID NO: 3654750 - RNA, 13 nt, Human
ccaucugcccagg

SEQ ID NO: 3654751 - RNA, 21 nt, Human
ccaucugcccaggggugcccc

SEQ ID NO: 3654752 - RNA, 23 nt, Human
ccaucugcccaggggugcccccu

SEQ ID NO: 3654753 - RNA, 17 nt, Human
ccaucugccccacaguc

SEQ ID NO: 3654754 - RNA, 20 nt, Human
ccaucugccccacagucucc

SEQ ID NO: 3654755 - RNA, 14 nt, Human
ccaucugcccgccu

SEQ ID NO: 3654756 - RNA, 18 nt, Human
ccaucugcccgccugccc

SEQ ID NO: 3654757 - RNA, 20 nt, Human
ccaucugcgggggcagugcu

SEQ ID NO: 3654758 - RNA, 22 nt, Human
ccaucugcgggggcagugcuca

SEQ ID NO: 3654759 - RNA, 13 nt, Human
ccaucugcuccug

SEQ ID NO: 3654760 - RNA, 14 nt, Human
ccaucuggccuggc

SEQ ID NO: 3654761 - RNA, 15 nt, Human
ccaucuggccuggcc

SEQ ID NO: 3654762 - RNA, 16 nt, Human
ccaucuggccuggccu

SEQ ID NO: 3654763 - RNA, 17 nt, Human
ccaucuggccuggccug

SEQ ID NO: 3654764 - RNA, 23 nt, Human
ccaucugguuaggauggcaggac

SEQ ID NO: 3654765 - RNA, 20 nt, Human
ccaucuguacuugguccaac

SEQ ID NO: 3654766 - RNA, 14 nt, Human
ccaucugugaauaa

SEQ ID NO: 3654767 - RNA, 16 nt, Human
ccaucugugcacgcag

SEQ ID NO: 3654768 - RNA, 19 nt, Human
ccaucuguuuggugggggu

SEQ ID NO: 3654769 - RNA, 15 nt, Human
ccaucuuacuugagc

SEQ ID NO: 3654770 - RNA, 15 nt, Human
ccaucuuaguuugga

SEQ ID NO: 3654771 - RNA, 21 nt, Human
ccaucuucacccaggccuaug

SEQ ID NO: 3654772 - RNA, 14 nt, Human
ccaucuuccaggug

SEQ ID NO: 3654773 - RNA, 15 nt, Human
ccaucuuccaggugg

SEQ ID NO: 3654774 - RNA, 13 nt, Human
ccaucuugccucc

SEQ ID NO: 3654775 - RNA, 15 nt, Human
ccaucuuuacuccca

SEQ ID NO: 3654776 - RNA, 18 nt, Human
ccaucuuugcagguugcu

SEQ ID NO: 3654777 - RNA, 16 nt, Human
ccaucuuuuauucuuu

SEQ ID NO: 3654778 - RNA, 22 nt, Human
ccaucuuuuguuacucuuggga

SEQ ID NO: 3654779 - RNA, 21 nt, Human
ccaugaaaaaaaugaucccca

SEQ ID NO: 3654780 - RNA, 19 nt, Human
ccaugaaaacguuuuauug

SEQ ID NO: 3654781 - RNA, 20 nt, Human
ccaugaaaacguuuuauugu

SEQ ID NO: 3654782 - RNA, 14 nt, Human
ccaugaaagaaaac

SEQ ID NO: 3654783 - RNA, 12 nt, Human
ccaugaacacac

SEQ ID NO: 3654784 - RNA, 17 nt, Human
ccaugaacacacugugu

SEQ ID NO: 3654785 - RNA, 21 nt, Human
ccaugaacacacuguguccug

SEQ ID NO: 3654786 - RNA, 13 nt, Human
ccaugaacuggag

SEQ ID NO: 3654787 - RNA, 15 nt, Human
ccaugaacuuugucc

SEQ ID NO: 3654788 - RNA, 14 nt, Human
ccaugaagaauucc

SEQ ID NO: 3654789 - RNA, 16 nt, Human
ccaugaagacaggaca

SEQ ID NO: 3654790 - RNA, 19 nt, Human
ccaugaagaggaugcugug

SEQ ID NO: 3654791 - RNA, 21 nt, Human
ccaugaagaggaugcugugaa

SEQ ID NO: 3654792 - RNA, 11 nt, Human
ccaugaagccu

SEQ ID NO: 3654793 - RNA, 15 nt, Human
ccaugaaucgcuucu

SEQ ID NO: 3654794 - RNA, 17 nt, Human
ccaugaaucgcuucucu

SEQ ID NO: 3654795 - RNA, 18 nt, Human
ccaugaaucgcuucucuu

SEQ ID NO: 3654796 - RNA, 15 nt, Human
ccaugaauguuccug

SEQ ID NO: 3654797 - RNA, 14 nt, Human
ccaugacaucaaga

SEQ ID NO: 3654798 - RNA, 15 nt, Human
ccaugacccaccccu

SEQ ID NO: 3654799 - RNA, 16 nt, Human
ccaugacccaccccug

SEQ ID NO: 3654800 - RNA, 15 nt, Human
ccaugacccaggcug

SEQ ID NO: 3654801 - RNA, 17 nt, Human
ccaugacccugccucuc

SEQ ID NO: 3654802 - RNA, 20 nt, Human
ccaugacccugccucuccca

SEQ ID NO: 3654803 - RNA, 23 nt, Human
ccaugacccugccucucccaggc

SEQ ID NO: 3654804 - RNA, 14 nt, Human
ccaugaccuccagc

SEQ ID NO: 3654805 - RNA, 21 nt, Human
ccaugaccuccagcuuuccug

SEQ ID NO: 3654806 - RNA, 21 nt, Human
ccaugacgcaaagagagauuu

SEQ ID NO: 3654807 - RNA, 15 nt, Human
ccaugacugcauuuu

SEQ ID NO: 3654808 - RNA, 21 nt, Human
ccaugacugcuugcccuaagc

SEQ ID NO: 3654809 - RNA, 21 nt, Human
ccaugagaagagggccugugg

SEQ ID NO: 3654810 - RNA, 20 nt, Human
ccaugagacccuggugccug

SEQ ID NO: 3654811 - RNA, 21 nt, Human
ccaugagcaccccaaggcugc

SEQ ID NO: 3654812 - RNA, 14 nt, Human
ccaugagccucagc

SEQ ID NO: 3654813 - RNA, 23 nt, Human
ccaugagccucagcauccuggca

SEQ ID NO: 3654814 - RNA, 16 nt, Human
ccaugagcuccagacc

SEQ ID NO: 3654815 - RNA, 17 nt, Human
ccaugagcuccagaccc

SEQ ID NO: 3654816 - RNA, 18 nt, Human
ccaugagcuccagacccc

SEQ ID NO: 3654817 - RNA, 17 nt, Human
ccaugaggaacaaggca

SEQ ID NO: 3654818 - RNA, 20 nt, Human
ccaugaggaacaaggcaagg

SEQ ID NO: 3654819 - RNA, 23 nt, Human
ccaugaggaacaaggcaaggcug

SEQ ID NO: 3654820 - RNA, 23 nt, Human
ccaugaggagaaaaaaagcaugu

SEQ ID NO: 3654821 - RNA, 20 nt, Human
ccaugaggaguugcuguuug

SEQ ID NO: 3654822 - RNA, 17 nt, Human
ccaugagggagaugcca

SEQ ID NO: 3654823 - RNA, 14 nt, Human
ccaugaguccccug

SEQ ID NO: 3654824 - RNA, 23 nt, Human
ccaugaguuggggucuggcagcc

SEQ ID NO: 3654825 - RNA, 17 nt, Human
ccaugaguuugcccugg

SEQ ID NO: 3654826 - RNA, 22 nt, Human
ccaugaugacaacuacagaaaa

SEQ ID NO: 3654827 - RNA, 14 nt, Human
ccaugaugccucug

SEQ ID NO: 3654828 - RNA, 20 nt, Human
ccaugaugccucugucuucu

SEQ ID NO: 3654829 - RNA, 13 nt, Human
ccaugauggccag

SEQ ID NO: 3654830 - RNA, 16 nt, Human
ccaugauguuuagaaa

SEQ ID NO: 3654831 - RNA, 21 nt, Human
ccaugauuaaccacuucagcu

SEQ ID NO: 3654832 - RNA, 20 nt, Human
ccaugcaaggugcccacaug

SEQ ID NO: 3654833 - RNA, 12 nt, Human
ccaugcaccaaa

SEQ ID NO: 3654834 - RNA, 11 nt, Human
ccaugcacugu

SEQ ID NO: 3654835 - RNA, 16 nt, Human
ccaugcacugugaagg

SEQ ID NO: 3654836 - RNA, 19 nt, Human
ccaugcacugugaaggacc

SEQ ID NO: 3654837 - RNA, 20 nt, Human
ccaugcacugugaaggaccc

SEQ ID NO: 3654838 - RNA, 14 nt, Human
ccaugcagaaagca

SEQ ID NO: 3654839 - RNA, 15 nt, Human
ccaugcagaaagcau

SEQ ID NO: 3654840 - RNA, 17 nt, Human
ccaugcaggcccuuuga

SEQ ID NO: 3654841 - RNA, 23 nt, Human
ccaugcagguggugucgggcccu

SEQ ID NO: 3654842 - RNA, 12 nt, Human
ccaugccagccg

SEQ ID NO: 3654843 - RNA, 12 nt, Human
ccaugccagcug

SEQ ID NO: 3654844 - RNA, 15 nt, Human
ccaugccagcuggcc

SEQ ID NO: 3654845 - RNA, 13 nt, Human
ccaugcccaccug

SEQ ID NO: 3654846 - RNA, 15 nt, Human
ccaugcccaccugcc

SEQ ID NO: 3654847 - RNA, 18 nt, Human
ccaugcccaccugcccau

SEQ ID NO: 3654848 - RNA, 15 nt, Human
ccaugccucagcccu

SEQ ID NO: 3654849 - RNA, 16 nt, Human
ccaugccucagcccug

SEQ ID NO: 3654850 - RNA, 16 nt, Human
ccaugccugagggugg

SEQ ID NO: 3654851 - RNA, 17 nt, Human
ccaugccuguccagccu

SEQ ID NO: 3654852 - RNA, 17 nt, Human
ccaugccuguggcugcg

SEQ ID NO: 3654853 - RNA, 20 nt, Human
ccaugcguguuucugacucu

SEQ ID NO: 3654854 - RNA, 13 nt, Human
ccaugcucaucug

SEQ ID NO: 3654855 - RNA, 20 nt, Human
ccaugcucaucugcuggucc

SEQ ID NO: 3654856 - RNA, 16 nt, Human
ccaugcuccucuuccc

SEQ ID NO: 3654857 - RNA, 19 nt, Human
ccaugcuccucuuccccag

SEQ ID NO: 3654858 - RNA, 13 nt, Human
ccaugcuccuggc

SEQ ID NO: 3654859 - RNA, 13 nt, Human
ccaugcugaaggg

SEQ ID NO: 3654860 - RNA, 15 nt, Human
ccaugcugaggccug

SEQ ID NO: 3654861 - RNA, 11 nt, Human
ccaugcugccc

SEQ ID NO: 3654862 - RNA, 18 nt, Human
ccaugcuggagccugugu

SEQ ID NO: 3654863 - RNA, 22 nt, Human
ccaugcuggagccuguguaaca

SEQ ID NO: 3654864 - RNA, 17 nt, Human
ccaugcuggccuugcca

SEQ ID NO: 3654865 - RNA, 23 nt, Human
ccaugcugucuggcacagccugc

SEQ ID NO: 3654866 - RNA, 22 nt, Human
ccaugcuuaacauacccgccua

SEQ ID NO: 3654867 - RNA, 16 nt, Human
ccaugcuuagucacug

SEQ ID NO: 3654868 - RNA, 18 nt, Human
ccaugcuuagucacugcc

SEQ ID NO: 3654869 - RNA, 19 nt, Human
ccaugcuuagucacugccu

SEQ ID NO: 3654870 - RNA, 19 nt, Human
ccauggaacuguuuccuuc

SEQ ID NO: 3654871 - RNA, 22 nt, Human
ccauggacacuacacccagcaa

SEQ ID NO: 3654872 - RNA, 23 nt, Human
ccauggacacuacacccagcaau

SEQ ID NO: 3654873 - RNA, 14 nt, Human
ccauggacacucca

SEQ ID NO: 3654874 - RNA, 15 nt, Human
ccauggacacuccag

SEQ ID NO: 3654875 - RNA, 14 nt, Human
ccauggacaggcug

SEQ ID NO: 3654876 - RNA, 16 nt, Human
ccauggacaggcuggc

SEQ ID NO: 3654877 - RNA, 15 nt, Human
ccauggacucuacac

SEQ ID NO: 3654878 - RNA, 14 nt, Human
ccauggacuuuguu

SEQ ID NO: 3654879 - RNA, 19 nt, Human
ccauggagaaagcugacuu

SEQ ID NO: 3654880 - RNA, 23 nt, Human
ccauggagaaagcugacuuggcu

SEQ ID NO: 3654881 - RNA, 17 nt, Human
ccauggagacaagaagg

SEQ ID NO: 3654882 - RNA, 19 nt, Human
ccauggagagcuggagccu

SEQ ID NO: 3654883 - RNA, 12 nt, Human
ccauggagcccc

SEQ ID NO: 3654884 - RNA, 17 nt, Human
ccauggagccccagccc

SEQ ID NO: 3654885 - RNA, 20 nt, Human
ccauggagccccagcccccu

SEQ ID NO: 3654886 - RNA, 21 nt, Human
ccauggaggcacacagcugca

SEQ ID NO: 3654887 - RNA, 15 nt, Human
ccauggaguggcagc

SEQ ID NO: 3654888 - RNA, 23 nt, Human
ccauggaguggcagcccagccag

SEQ ID NO: 3654889 - RNA, 22 nt, Human
ccauggagugggucuggaggac

SEQ ID NO: 3654890 - RNA, 16 nt, Human
ccauggccagcagcac

SEQ ID NO: 3654891 - RNA, 15 nt, Human
ccauggcccucauua

SEQ ID NO: 3654892 - RNA, 15 nt, Human
ccauggcccucccag

SEQ ID NO: 3654893 - RNA, 22 nt, Human
ccauggccugcaaacugggaac

SEQ ID NO: 3654894 - RNA, 14 nt, Human
ccauggccuuauga

SEQ ID NO: 3654895 - RNA, 14 nt, Human
cuccucaccucaug

SEQ ID NO: 3654896 - RNA, 15 nt, Human
cuccucaccucaugc

SEQ ID NO: 3654897 - RNA, 20 nt, Human
cuccucaccucaugcccacc

SEQ ID NO: 3654898 - RNA, 17 nt, Human
cuccucacucaccuuca

SEQ ID NO: 3654899 - RNA, 16 nt, Human
cuccucacucccuucu

SEQ ID NO: 3654900 - RNA, 14 nt, Human
cuccucagaucuuc

SEQ ID NO: 3654901 - RNA, 13 nt, Human
cuccucagccuga

SEQ ID NO: 3654902 - RNA, 13 nt, Human
cuccucaggacca

SEQ ID NO: 3654903 - RNA, 17 nt, Human
cuccucaggcacacagc

SEQ ID NO: 3654904 - RNA, 23 nt, Human
cuccucaggcacacagcuacucu

SEQ ID NO: 3654905 - RNA, 15 nt, Human
cuccucaucccgugu

SEQ ID NO: 3654906 - RNA, 18 nt, Human
cuccuccaaaggaagucu

SEQ ID NO: 3654907 - RNA, 14 nt, Human
cuccuccaaaggcc

SEQ ID NO: 3654908 - RNA, 15 nt, Human
cuccuccaccgccau

SEQ ID NO: 3654909 - RNA, 22 nt, Human
cuccuccaccgccauggcuucc

SEQ ID NO: 3654910 - RNA, 15 nt, Human
cuccuccaccucaac

SEQ ID NO: 3654911 - RNA, 17 nt, Human
cuccuccacucuccccc

SEQ ID NO: 3654912 - RNA, 15 nt, Human
cuccuccagagucag

SEQ ID NO: 3654913 - RNA, 18 nt, Human
cuccuccagccccugucc

SEQ ID NO: 3654914 - RNA, 16 nt, Human
cuccuccaggaagccu

SEQ ID NO: 3654915 - RNA, 13 nt, Human
cuccuccaggccu

SEQ ID NO: 3654916 - RNA, 15 nt, Human
cuccuccaggccugc

SEQ ID NO: 3654917 - RNA, 11 nt, Human
cuccuccaggg

SEQ ID NO: 3654918 - RNA, 14 nt, Human
cuccuccagggcca

SEQ ID NO: 3654919 - RNA, 21 nt, Human
cuccuccaggguggcagcaac

SEQ ID NO: 3654920 - RNA, 22 nt, Human
cuccucccacccggcugcagag

SEQ ID NO: 3654921 - RNA, 14 nt, Human
cuccucccacugcc

SEQ ID NO: 3654922 - RNA, 15 nt, Human
cuccucccacugccc

SEQ ID NO: 3654923 - RNA, 18 nt, Human
cuccucccacugcccacu

SEQ ID NO: 3654924 - RNA, 11 nt, Human
cuccucccagc

SEQ ID NO: 3654925 - RNA, 12 nt, Human
cuccucccaggg

SEQ ID NO: 3654926 - RNA, 20 nt, Human
cuccucccaugucacugcag

SEQ ID NO: 3654927 - RNA, 22 nt, Human
cuccuccccccuccucugaaac

SEQ ID NO: 3654928 - RNA, 23 nt, Human
cuccuccccuggagggggaaugg

SEQ ID NO: 3654929 - RNA, 15 nt, Human
cuccuccccuuccuc

SEQ ID NO: 3654930 - RNA, 17 nt, Human
cuccuccccuuccucuu

SEQ ID NO: 3654931 - RNA, 15 nt, Human
cuccucccggugccc

SEQ ID NO: 3654932 - RNA, 17 nt, Human
cuccucccggugcccaa

SEQ ID NO: 3654933 - RNA, 16 nt, Human
cuccucccucccucuc

SEQ ID NO: 3654934 - RNA, 21 nt, Human
cuccucccucccucugccggc

SEQ ID NO: 3654935 - RNA, 15 nt, Human
cuccucccucugagg

SEQ ID NO: 3654936 - RNA, 16 nt, Human
cuccucccugcaucug

SEQ ID NO: 3654937 - RNA, 14 nt, Human
cuccucccuggcug

SEQ ID NO: 3654938 - RNA, 18 nt, Human
cuccucccuggcugcccu

SEQ ID NO: 3654939 - RNA, 19 nt, Human
cuccucccuguuauuuuca

SEQ ID NO: 3654940 - RNA, 22 nt, Human
cuccucccuguuauuuucaagu

SEQ ID NO: 3654941 - RNA, 13 nt, Human
cuccuccucccug

SEQ ID NO: 3654942 - RNA, 14 nt, Human
cuccuccuggacuc

SEQ ID NO: 3654943 - RNA, 15 nt, Human
cuccuccuggacucc

SEQ ID NO: 3654944 - RNA, 19 nt, Human
cuccuccuuggugccuggc

SEQ ID NO: 3654945 - RNA, 20 nt, Human
cuccucgacaucacuguuca

SEQ ID NO: 3654946 - RNA, 17 nt, Human
cuccucgagaucccaac

SEQ ID NO: 3654947 - RNA, 21 nt, Human
cuccucgagaucccaacacug

SEQ ID NO: 3654948 - RNA, 14 nt, Human
cuccucgcaagcug

SEQ ID NO: 3654949 - RNA, 23 nt, Human
cuccucggaaccgcucaccuaga

SEQ ID NO: 3654950 - RNA, 18 nt, Human
cuccucggcccccuccau

SEQ ID NO: 3654951 - RNA, 14 nt, Human
cuccucggccuggc

SEQ ID NO: 3654952 - RNA, 19 nt, Human
cuccucggcuggcugucca

SEQ ID NO: 3654953 - RNA, 20 nt, Human
cuccucggcuggcuguccac

SEQ ID NO: 3654954 - RNA, 22 nt, Human
cccaagguucugggugcaggag

SEQ ID NO: 3654955 - RNA, 20 nt, Human
cccaaguaagaggcuggagu

SEQ ID NO: 3654956 - RNA, 18 nt, Human
cccaaguagucugcucac

SEQ ID NO: 3654957 - RNA, 19 nt, Human
cccaaguagucugcucaca

SEQ ID NO: 3654958 - RNA, 18 nt, Human
cccaagucccuguuuucu

SEQ ID NO: 3654959 - RNA, 16 nt, Human
cccaaguccugaagag

SEQ ID NO: 3654960 - RNA, 20 nt, Human
cccaagugagucucucuggg

SEQ ID NO: 3654961 - RNA, 15 nt, Human
cccaagugccaaaga

SEQ ID NO: 3654962 - RNA, 18 nt, Human
cccaagugccagucuugu

SEQ ID NO: 3654963 - RNA, 16 nt, Human
cccaagugugaacaaa

SEQ ID NO: 3654964 - RNA, 21 nt, Human
cccaauaaacauuaagauuga

SEQ ID NO: 3654965 - RNA, 15 nt, Human
cccaauauuauaauu

SEQ ID NO: 3654966 - RNA, 20 nt, Human
cccaaucccagcuaccucaa

SEQ ID NO: 3654967 - RNA, 17 nt, Human
cccaaucccuuuauuac

SEQ ID NO: 3654968 - RNA, 16 nt, Human
cccaaugcacauccau

SEQ ID NO: 3654969 - RNA, 20 nt, Human
cccaaugcacauccauuccc

SEQ ID NO: 3654970 - RNA, 16 nt, Human
cccaaugcacuuuguu

SEQ ID NO: 3654971 - RNA, 14 nt, Human
cccaauuaggaagu

SEQ ID NO: 3654972 - RNA, 15 nt, Human
cccaauuucagacuc

SEQ ID NO: 3654973 - RNA, 15 nt, Human
cccacaaaggcaaag

SEQ ID NO: 3654974 - RNA, 17 nt, Human
cccacaacuccugucua

SEQ ID NO: 3654975 - RNA, 20 nt, Human
cccacaagccucugcccagg

SEQ ID NO: 3654976 - RNA, 22 nt, Human
cccacaagccucugcccaggca

SEQ ID NO: 3654977 - RNA, 13 nt, Human
cccacaaguggug

SEQ ID NO: 3654978 - RNA, 14 nt, Human
cccacaaguggugg

SEQ ID NO: 3654979 - RNA, 22 nt, Human
cccacaaguggugguaacccug

SEQ ID NO: 3654980 - RNA, 22 nt, Human
cccacaauauaaaacuguacuu

SEQ ID NO: 3654981 - RNA, 11 nt, Human
cccacacacac

SEQ ID NO: 3654982 - RNA, 17 nt, Human
cccacacacacacacau

SEQ ID NO: 3654983 - RNA, 14 nt, Human
cccacacacaggug

SEQ ID NO: 3654984 - RNA, 15 nt, Human
cccacacacaggugg

SEQ ID NO: 3654985 - RNA, 20 nt, Human
cccacaccaggccguccucc

SEQ ID NO: 3654986 - RNA, 17 nt, Human
cccacaccauaagcuac

SEQ ID NO: 3654987 - RNA, 19 nt, Human
cccacaccuccacaguuca

SEQ ID NO: 3654988 - RNA, 13 nt, Human
cccacaccuccuc

SEQ ID NO: 3654989 - RNA, 14 nt, Human
cccacaccuggccc

SEQ ID NO: 3654990 - RNA, 16 nt, Human
cccacacucacuccug

SEQ ID NO: 3654991 - RNA, 12 nt, Human
cccacacucaga

SEQ ID NO: 3654992 - RNA, 23 nt, Human
cccacacucccaagguuggagcc

SEQ ID NO: 3654993 - RNA, 19 nt, Human
cccacacuugagaggauga

SEQ ID NO: 3654994 - RNA, 13 nt, Human
cccacagacucaa

SEQ ID NO: 3654995 - RNA, 22 nt, Human
cccacagcacagcucccugcca

SEQ ID NO: 3654996 - RNA, 11 nt, Human
cccacagccca

SEQ ID NO: 3654997 - RNA, 15 nt, Human
cccacagcccacguc

SEQ ID NO: 3654998 - RNA, 15 nt, Human
cccacagcucccacc

SEQ ID NO: 3654999 - RNA, 19 nt, Human
cccacagcucccaccccac

SEQ ID NO: 3655000 - RNA, 13 nt, Human
cccacagcuuggg

SEQ ID NO: 3655001 - RNA, 20 nt, Human
cccacaggaagccugcaguc

SEQ ID NO: 3655002 - RNA, 23 nt, Human
cccacaggaagccugcaguccug

SEQ ID NO: 3655003 - RNA, 16 nt, Human
cccacaggaggugguc

SEQ ID NO: 3655004 - RNA, 21 nt, Human
cccacaggagguggucuggga

SEQ ID NO: 3655005 - RNA, 22 nt, Human
cccacagguguccccagcccac

SEQ ID NO: 3655006 - RNA, 23 nt, Human
cccacagugacucgggcuccugu

SEQ ID NO: 3655007 - RNA, 15 nt, Human
cccacagugcugucu

SEQ ID NO: 3655008 - RNA, 21 nt, Human
cccacagugucaggcacuggg

SEQ ID NO: 3655009 - RNA, 19 nt, Human
cccacauccaacuccagca

SEQ ID NO: 3655010 - RNA, 20 nt, Human
cccacaucccaggcuucacc

SEQ ID NO: 3655011 - RNA, 13 nt, Human
cccacaucccugg

SEQ ID NO: 3655012 - RNA, 17 nt, Human
cccacaucccugggccu

SEQ ID NO: 3655013 - RNA, 21 nt, Human
cccacaucccugggccugcug

SEQ ID NO: 3655014 - RNA, 22 nt, Human
cccacaucccugggccugcugc

SEQ ID NO: 3655015 - RNA, 18 nt, Human
cccacaugaggacaugau

SEQ ID NO: 3655016 - RNA, 12 nt, Human
cccacaugccag

SEQ ID NO: 3655017 - RNA, 19 nt, Human
cccacauggugauguugac

SEQ ID NO: 3655018 - RNA, 14 nt, Human
cccacauguccagc

SEQ ID NO: 3655019 - RNA, 14 nt, Human
cccacauuccgaca

SEQ ID NO: 3655020 - RNA, 18 nt, Human
cccacauucugaugagca

SEQ ID NO: 3655021 - RNA, 19 nt, Human
cccacauuuagucucuuua

SEQ ID NO: 3655022 - RNA, 21 nt, Human
cccacauuuagucucuuuauu

SEQ ID NO: 3655023 - RNA, 17 nt, Human
cccaccaacccucaggg

SEQ ID NO: 3655024 - RNA, 18 nt, Human
cccaccaacccucagggc

SEQ ID NO: 3655025 - RNA, 19 nt, Human
cccaccaacccucagggca

SEQ ID NO: 3655026 - RNA, 14 nt, Human
cccaccacacaaca

SEQ ID NO: 3655027 - RNA, 16 nt, Human
cccaccacacauccca

SEQ ID NO: 3655028 - RNA, 18 nt, Human
cccaccacacaucccagc

SEQ ID NO: 3655029 - RNA, 22 nt, Human
cccaccacacaucccagcccaa

SEQ ID NO: 3655030 - RNA, 20 nt, Human
cccaccaccuaggccacucc

SEQ ID NO: 3655031 - RNA, 20 nt, Human
cccaccacgauguggcccug

SEQ ID NO: 3655032 - RNA, 24 nt, Human
cccaccacgauguggcccuggccu

SEQ ID NO: 3655033 - RNA, 22 nt, Human
cccaccaggcugcucagggcug

SEQ ID NO: 3655034 - RNA, 13 nt, Human
cccaccagggucc

SEQ ID NO: 3655035 - RNA, 13 nt, Human
cccaccagugccu

SEQ ID NO: 3655036 - RNA, 18 nt, Human
cccaccaucaugucuggc

SEQ ID NO: 3655037 - RNA, 15 nt, Human
cccaccaucugcugu

SEQ ID NO: 3655038 - RNA, 17 nt, Human
cccaccaucugcugucu

SEQ ID NO: 3655039 - RNA, 21 nt, Human
cccaccaucugcugucuuuuc

SEQ ID NO: 3655040 - RNA, 14 nt, Human
cuccugauuuuucu

SEQ ID NO: 3655041 - RNA, 15 nt, Human
cuccugcacuguuua

SEQ ID NO: 3655042 - RNA, 20 nt, Human
cuccugcacuuacuugcuua

SEQ ID NO: 3655043 - RNA, 15 nt, Human
cuccugcagccccag

SEQ ID NO: 3655044 - RNA, 14 nt, Human
cuccugcaggcagc

SEQ ID NO: 3655045 - RNA, 16 nt, Human
cuccugcaggcagcca

SEQ ID NO: 3655046 - RNA, 21 nt, Human
cuccugcaggcagccaggcca

SEQ ID NO: 3655047 - RNA, 13 nt, Human
cuccugcaugcag

SEQ ID NO: 3655048 - RNA, 13 nt, Human
cuccugcccagga

SEQ ID NO: 3655049 - RNA, 15 nt, Human
cuccugcccaggaga

SEQ ID NO: 3655050 - RNA, 15 nt, Human
cuccugcccaguccc

SEQ ID NO: 3655051 - RNA, 22 nt, Human
cuccugcccccacaccuggccc

SEQ ID NO: 3655052 - RNA, 22 nt, Human
cuccugcccgcagaccucugga

SEQ ID NO: 3655053 - RNA, 14 nt, Human
cuccugccgcagag

SEQ ID NO: 3655054 - RNA, 16 nt, Human
cuccugccgcagagcu

SEQ ID NO: 3655055 - RNA, 17 nt, Human
cuccugccgcagagcug

SEQ ID NO: 3655056 - RNA, 15 nt, Human
cuccugccggcuccu

SEQ ID NO: 3655057 - RNA, 14 nt, Human
cuccugccuacuca

SEQ ID NO: 3655058 - RNA, 11 nt, Human
cuccugccuca

SEQ ID NO: 3655059 - RNA, 13 nt, Human
cuccugccucagc

SEQ ID NO: 3655060 - RNA, 16 nt, Human
cuccugccucagccuc

SEQ ID NO: 3655061 - RNA, 18 nt, Human
cuccugccucagucuccc

SEQ ID NO: 3655062 - RNA, 18 nt, Human
cuccugccucgaacuggc

SEQ ID NO: 3655063 - RNA, 12 nt, Human
cuccugccucua

SEQ ID NO: 3655064 - RNA, 15 nt, Human
cuccugccuguagca

SEQ ID NO: 3655065 - RNA, 18 nt, Human
cuccugccuuccuccugg

SEQ ID NO: 3655066 - RNA, 19 nt, Human
cuccugccuuccuccuggg

SEQ ID NO: 3655067 - RNA, 21 nt, Human
cuccugccuugaaaaagacau

SEQ ID NO: 3655068 - RNA, 14 nt, Human
cuccugcucugcuc

SEQ ID NO: 3655069 - RNA, 13 nt, Human
cuccugcugcacc

SEQ ID NO: 3655070 - RNA, 14 nt, Human
cuccugcugccaca

SEQ ID NO: 3655071 - RNA, 13 nt, Human
cuccugcugccag

SEQ ID NO: 3655072 - RNA, 15 nt, Human
cuccugcugcucccu

SEQ ID NO: 3655073 - RNA, 17 nt, Human
cuccugcugcucccuca

SEQ ID NO: 3655074 - RNA, 19 nt, Human
cuccugcugcucccucaga

SEQ ID NO: 3655075 - RNA, 22 nt, Human
cuccugcugcucccucagacug

SEQ ID NO: 3655076 - RNA, 13 nt, Human
cuccugcugggca

SEQ ID NO: 3655077 - RNA, 14 nt, Human
cuccugcuguaaau

SEQ ID NO: 3655078 - RNA, 19 nt, Human
cuccugcuuaaucuucaaa

SEQ ID NO: 3655079 - RNA, 18 nt, Human
cuccuggaaaggcucagu

SEQ ID NO: 3655080 - RNA, 19 nt, Human
cuccuggaaaggcucaguc

SEQ ID NO: 3655081 - RNA, 20 nt, Human
cuccuggaaaggcucagucu

SEQ ID NO: 3655082 - RNA, 20 nt, Human
cuccuggaaccuugcugucc

SEQ ID NO: 3655083 - RNA, 23 nt, Human
cuccuggaaccuugcuguccuga

SEQ ID NO: 3655084 - RNA, 15 nt, Human
cuccuggaagcugug

SEQ ID NO: 3655085 - RNA, 17 nt, Human
cuccuggaagcuguguc

SEQ ID NO: 3655086 - RNA, 23 nt, Human
cuccuggaagcuguguccuugca

SEQ ID NO: 3655087 - RNA, 21 nt, Human
cuccuggaccccccuuucaca

SEQ ID NO: 3655088 - RNA, 22 nt, Human
cuccuggacugccuugaauauc

SEQ ID NO: 3655089 - RNA, 19 nt, Human
cuccuggagccuuugaaua

SEQ ID NO: 3655090 - RNA, 16 nt, Human
cuccuggaucucccug

SEQ ID NO: 3655091 - RNA, 20 nt, Human
cuccuggcagaagggagcag

SEQ ID NO: 3655092 - RNA, 18 nt, Human
cuccuggcccacugcauc

SEQ ID NO: 3655093 - RNA, 16 nt, Human
cuccuggcccagccuu

SEQ ID NO: 3655094 - RNA, 14 nt, Human
cuccuggccucaga

SEQ ID NO: 3655095 - RNA, 23 nt, Human
cuccuggccuuuccugguuuuca

SEQ ID NO: 3655096 - RNA, 23 nt, Human
cuccuggcuucccauccccagcg

SEQ ID NO: 3655097 - RNA, 18 nt, Human
cuccugggauuggcugug

SEQ ID NO: 3655098 - RNA, 19 nt, Human
cuccugggcagcugccucc

SEQ ID NO: 3655099 - RNA, 22 nt, Human
cuccugggcagcugccuccccu

SEQ ID NO: 3655100 - RNA, 22 nt, Human
cuccugggccccucaucugcuc

SEQ ID NO: 3655101 - RNA, 23 nt, Human
cuccugggccccucccuaccuca

SEQ ID NO: 3655102 - RNA, 14 nt, Human
cuccugggcccucu

SEQ ID NO: 3655103 - RNA, 17 nt, Human
cuccugggcccucucug

SEQ ID NO: 3655104 - RNA, 19 nt, Human
cuccugggcccucucugcu

SEQ ID NO: 3655105 - RNA, 18 nt, Human
cuccugggcuaagugauc

SEQ ID NO: 3655106 - RNA, 16 nt, Human
cuccuggggccaggcc

SEQ ID NO: 3655107 - RNA, 17 nt, Human
cuccuggggccaggccg

SEQ ID NO: 3655108 - RNA, 22 nt, Human
cuccuggggccaggccgggccu

SEQ ID NO: 3655109 - RNA, 16 nt, Human
cuccuggguugagcug

SEQ ID NO: 3655110 - RNA, 22 nt, Human
cuccuggguugagcuguugccu

SEQ ID NO: 3655111 - RNA, 23 nt, Human
cuccuggguuuuguauucucuga

SEQ ID NO: 3655112 - RNA, 15 nt, Human
cuccuggucuugaga

SEQ ID NO: 3655113 - RNA, 14 nt, Human
cuccuggugggucc

SEQ ID NO: 3655114 - RNA, 15 nt, Human
cuccuggugucaccc

SEQ ID NO: 3655115 - RNA, 18 nt, Human
cuccuggugucaccccag

SEQ ID NO: 3655116 - RNA, 20 nt, Human
cuccuguaacauacuggccu

SEQ ID NO: 3655117 - RNA, 22 nt, Human
cuccuguaacauacuggccugg

SEQ ID NO: 3655118 - RNA, 23 nt, Human
cuccuguaacauacuggccugga

SEQ ID NO: 3655119 - RNA, 21 nt, Human
cuccacucugcuucucugacu

SEQ ID NO: 3655120 - RNA, 13 nt, Human
cuccacugccuuc

SEQ ID NO: 3655121 - RNA, 16 nt, Human
cuccacuggauggagg

SEQ ID NO: 3655122 - RNA, 11 nt, Human
cuccacuguca

SEQ ID NO: 3655123 - RNA, 16 nt, Human
cuccacugucacauug

SEQ ID NO: 3655124 - RNA, 18 nt, Human
cuccacugucacccucca

SEQ ID NO: 3655125 - RNA, 23 nt, Human
cuccacugugccuuugcaaauca

SEQ ID NO: 3655126 - RNA, 21 nt, Human
cuccacuuggucugugagaug

SEQ ID NO: 3655127 - RNA, 13 nt, Human
cuccacuuucagc

SEQ ID NO: 3655128 - RNA, 17 nt, Human
cuccacuuucagcuguc

SEQ ID NO: 3655129 - RNA, 20 nt, Human
cuccacuuucagcugucuuu

SEQ ID NO: 3655130 - RNA, 20 nt, Human
cuccagaaaugucccuuucu

SEQ ID NO: 3655131 - RNA, 17 nt, Human
cuccagaacucuuccuc

SEQ ID NO: 3655132 - RNA, 19 nt, Human
cuccagaacucuuccucca

SEQ ID NO: 3655133 - RNA, 23 nt, Human
cuccagaagauagcuucacccca

SEQ ID NO: 3655134 - RNA, 18 nt, Human
cuccagaagccucuggcu

SEQ ID NO: 3655135 - RNA, 17 nt, Human
cuccagaauuuggaaau

SEQ ID NO: 3655136 - RNA, 19 nt, Human
cuccagaauuuggaaaucc

SEQ ID NO: 3655137 - RNA, 20 nt, Human
cuccagacaaaccagaagca

SEQ ID NO: 3655138 - RNA, 19 nt, Human
cuccagacacauguccaag

SEQ ID NO: 3655139 - RNA, 16 nt, Human
cuccagacccccagca

SEQ ID NO: 3655140 - RNA, 17 nt, Human
cuccagaccccuggcuu

SEQ ID NO: 3655141 - RNA, 18 nt, Human
cuccagaccccuggcuuu

SEQ ID NO: 3655142 - RNA, 19 nt, Human
cuccagaccugauccugga

SEQ ID NO: 3655143 - RNA, 16 nt, Human
cuccagacucucugug

SEQ ID NO: 3655144 - RNA, 18 nt, Human
cuccagagccccacagcc

SEQ ID NO: 3655145 - RNA, 21 nt, Human
cuccagagccccacagcccca

SEQ ID NO: 3655146 - RNA, 13 nt, Human
cuccagagggcac

SEQ ID NO: 3655147 - RNA, 20 nt, Human
cuccagaggggcucagguca

SEQ ID NO: 3655148 - RNA, 16 nt, Human
cuccagagucagaagu

SEQ ID NO: 3655149 - RNA, 14 nt, Human
cuccagaucugcac

SEQ ID NO: 3655150 - RNA, 16 nt, Human
cuccagaugcagggca

SEQ ID NO: 3655151 - RNA, 21 nt, Human
cuccagaugcagggcagucau

SEQ ID NO: 3655152 - RNA, 14 nt, Human
cuccagauuuuuaa

SEQ ID NO: 3655153 - RNA, 16 nt, Human
cuccagauuuuuaaua

SEQ ID NO: 3655154 - RNA, 20 nt, Human
cuccagcaacacagccuggg

SEQ ID NO: 3655155 - RNA, 15 nt, Human
cuccagcaacuucuu

SEQ ID NO: 3655156 - RNA, 22 nt, Human
cuccagcaggcccaugggaggc

SEQ ID NO: 3655157 - RNA, 14 nt, Human
cuccagccaacccc

SEQ ID NO: 3655158 - RNA, 18 nt, Human
cuccagccaaccccugug

SEQ ID NO: 3655159 - RNA, 11 nt, Human
cuccagccagc

SEQ ID NO: 3655160 - RNA, 12 nt, Human
cuccagccagcg

SEQ ID NO: 3655161 - RNA, 14 nt, Human
cuccagccagcgcc

SEQ ID NO: 3655162 - RNA, 21 nt, Human
cuccagccagcgccucccucc

SEQ ID NO: 3655163 - RNA, 21 nt, Human
cuccagccaucaagagacuga

SEQ ID NO: 3655164 - RNA, 23 nt, Human
cuccagccaucaagagacugagu

SEQ ID NO: 3655165 - RNA, 11 nt, Human
cuccagccccu

SEQ ID NO: 3655166 - RNA, 16 nt, Human
cuccagccccucuugg

SEQ ID NO: 3655167 - RNA, 20 nt, Human
cuccagccccucuuggagaa

SEQ ID NO: 3655168 - RNA, 13 nt, Human
cuccagccccugg

SEQ ID NO: 3655169 - RNA, 15 nt, Human
cuccagccccuggau

SEQ ID NO: 3655170 - RNA, 15 nt, Human
cuccagccccugucc

SEQ ID NO: 3655171 - RNA, 23 nt, Human
cuccagccccuucucagaaucua

SEQ ID NO: 3655172 - RNA, 17 nt, Human
cuccagccccuuuccaa

SEQ ID NO: 3655173 - RNA, 12 nt, Human
cuccagccucag

SEQ ID NO: 3655174 - RNA, 12 nt, Human
cuccagccugac

SEQ ID NO: 3655175 - RNA, 13 nt, Human
cuccagccugagc

SEQ ID NO: 3655176 - RNA, 21 nt, Human
cuccagccugcccaagcccag

SEQ ID NO: 3655177 - RNA, 13 nt, Human
cuccagccugggc

SEQ ID NO: 3655178 - RNA, 14 nt, Human
cuccagccugggca

SEQ ID NO: 3655179 - RNA, 20 nt, Human
cuccagccugggcaacacag

SEQ ID NO: 3655180 - RNA, 21 nt, Human
cuccagccuuuggccuuggcu

SEQ ID NO: 3655181 - RNA, 22 nt, Human
cuccagcgaucucuccacugug

SEQ ID NO: 3655182 - RNA, 13 nt, Human
cuccagcgcugag

SEQ ID NO: 3655183 - RNA, 19 nt, Human
cuccagcgucagcugcucc

SEQ ID NO: 3655184 - RNA, 16 nt, Human
cuccagcucaccagcc

SEQ ID NO: 3655185 - RNA, 15 nt, Human
cuccgggaccuggug

SEQ ID NO: 3655186 - RNA, 18 nt, Human
cuccggggagcgcccgcg

SEQ ID NO: 3655187 - RNA, 14 nt, Human
cuccggggccauuu

SEQ ID NO: 3655188 - RNA, 15 nt, Human
cuccgggucuuccua

SEQ ID NO: 3655189 - RNA, 13 nt, Human
cuccggugugccu

SEQ ID NO: 3655190 - RNA, 15 nt, Human
cuccguauuucagac

SEQ ID NO: 3655191 - RNA, 20 nt, Human
cuccguccaggagccugugc

SEQ ID NO: 3655192 - RNA, 23 nt, Human
cuccguccauaucagaacugugc

SEQ ID NO: 3655193 - RNA, 15 nt, Human
cuccguccucgaugg

SEQ ID NO: 3655194 - RNA, 13 nt, Human
cuccguggagcag

SEQ ID NO: 3655195 - RNA, 17 nt, Human
cuccguggaggagguug

SEQ ID NO: 3655196 - RNA, 18 nt, Human
cuccgugugggagaccgg

SEQ ID NO: 3655197 - RNA, 17 nt, Human
cuccguuagcuccugug

SEQ ID NO: 3655198 - RNA, 20 nt, Human
cuccguuggccacuccgaga

SEQ ID NO: 3655199 - RNA, 17 nt, Human
cuccuaaaaggcccaga

SEQ ID NO: 3655200 - RNA, 22 nt, Human
cuccuaagcaacuaggccuuca

SEQ ID NO: 3655201 - RNA, 16 nt, Human
cuccuacaccuaacuc

SEQ ID NO: 3655202 - RNA, 12 nt, Human
cuccuacagccc

SEQ ID NO: 3655203 - RNA, 14 nt, Human
cuccuaccccuccc

SEQ ID NO: 3655204 - RNA, 18 nt, Human
cuccuaccccucccagcu

SEQ ID NO: 3655205 - RNA, 22 nt, Human
cuccuaccgaaaccuugccuuu

SEQ ID NO: 3655206 - RNA, 14 nt, Human
cuccuaccucugcu

SEQ ID NO: 3655207 - RNA, 13 nt, Human
cuccuaccuggua

SEQ ID NO: 3655208 - RNA, 14 nt, Human
cuccuacuccugac

SEQ ID NO: 3655209 - RNA, 12 nt, Human
cuccuacugagg

SEQ ID NO: 3655210 - RNA, 21 nt, Human
cuccuagacugacccugauca

SEQ ID NO: 3655211 - RNA, 19 nt, Human
cuccuaggacauguucccu

SEQ ID NO: 3655212 - RNA, 20 nt, Human
cuccuagggaaaaguucaua

SEQ ID NO: 3655213 - RNA, 14 nt, Human
cuccuaguucuaga

SEQ ID NO: 3655214 - RNA, 19 nt, Human
cuccuaguuugaccucaca

SEQ ID NO: 3655215 - RNA, 23 nt, Human
cuccuaguuugaccucacaguga

SEQ ID NO: 3655216 - RNA, 17 nt, Human
cuccuaguuugggagga

SEQ ID NO: 3655217 - RNA, 15 nt, Human
cuccuauaaucuguc

SEQ ID NO: 3655218 - RNA, 21 nt, Human
cuccuauaaucugucaaaaca

SEQ ID NO: 3655219 - RNA, 15 nt, Human
cuccuauauauuucu

SEQ ID NO: 3655220 - RNA, 17 nt, Human
cuccuauauauuucuau

SEQ ID NO: 3655221 - RNA, 18 nt, Human
cuccuaucaccugucuug

SEQ ID NO: 3655222 - RNA, 14 nt, Human
cuccuaucuucaua

SEQ ID NO: 3655223 - RNA, 17 nt, Human
cuccuaucuucauaucu

SEQ ID NO: 3655224 - RNA, 22 nt, Human
cuccuauggguugucaccaagc

SEQ ID NO: 3655225 - RNA, 18 nt, Human
cuccuauguuuggcugcu

SEQ ID NO: 3655226 - RNA, 15 nt, Human
cuccuauucuauaaa

SEQ ID NO: 3655227 - RNA, 20 nt, Human
cuccuauucuauaaaacucu

SEQ ID NO: 3655228 - RNA, 16 nt, Human
cuccuauuuuuuuaaa

SEQ ID NO: 3655229 - RNA, 14 nt, Human
cuccucaacucacc

SEQ ID NO: 3655230 - RNA, 15 nt, Human
cuccucacacacccu

SEQ ID NO: 3655231 - RNA, 18 nt, Human
cuccucaccccgucuggg

SEQ ID NO: 3655232 - RNA, 19 nt, Human
cuccucaccucaugcccac

SEQ ID NO: 3655233 - RNA, 14 nt, Human
cuccucaccucugg

SEQ ID NO: 3655234 - RNA, 18 nt, Human
cuccucaccucuggacug

SEQ ID NO: 3655235 - RNA, 16 nt, Human
cuccucacugcccgca

SEQ ID NO: 3655236 - RNA, 17 nt, Human
cuccucacugcccgcac

SEQ ID NO: 3655237 - RNA, 11 nt, Human
cuccucagacu

SEQ ID NO: 3655238 - RNA, 12 nt, Human
cuccucagccug

SEQ ID NO: 3655239 - RNA, 24 nt, Human
cuccucagccugaaccccagggcu

SEQ ID NO: 3655240 - RNA, 22 nt, Human
cuccucaggcacacagcuacuc

SEQ ID NO: 3655241 - RNA, 11 nt, Human
cuccucaggga

SEQ ID NO: 3655242 - RNA, 18 nt, Human
cuccucagggcagccucc

SEQ ID NO: 3655243 - RNA, 20 nt, Human
cuccucauccagggcucuga

SEQ ID NO: 3655244 - RNA, 12 nt, Human
cuccucaucccg

SEQ ID NO: 3655245 - RNA, 18 nt, Human
cuccucauucacaucgca

SEQ ID NO: 3655246 - RNA, 15 nt, Human
cuccuccaaaggaag

SEQ ID NO: 3655247 - RNA, 18 nt, Human
cuccuccaaaggcccccu

SEQ ID NO: 3655248 - RNA, 13 nt, Human
cuccuccacauuu

SEQ ID NO: 3655249 - RNA, 16 nt, Human
cuccuccaccgccaug

SEQ ID NO: 3655250 - RNA, 14 nt, Human
cuccuccaccucaa

SEQ ID NO: 3655251 - RNA, 17 nt, Human
cuccuccagccccuguc

SEQ ID NO: 3655252 - RNA, 15 nt, Human
cuccuccagccgcca

SEQ ID NO: 3655253 - RNA, 22 nt, Human
cuccuccagccgccaugcuccu

SEQ ID NO: 3655254 - RNA, 15 nt, Human
cuccuccaggaagcc

SEQ ID NO: 3655255 - RNA, 14 nt, Human
cuccuccaggccug

SEQ ID NO: 3655256 - RNA, 13 nt, Human
cuccuccagggug

SEQ ID NO: 3655257 - RNA, 22 nt, Human
cuccuccaggguggcagcaaca

SEQ ID NO: 3655258 - RNA, 20 nt, Human
cuccucccacccggcugcag

SEQ ID NO: 3655259 - RNA, 13 nt, Human
cuccucccacugc

SEQ ID NO: 3655260 - RNA, 12 nt, Human
cuccucccagcu

SEQ ID NO: 3655261 - RNA, 23 nt, Human
cuccucccagcuuguaggagcug

SEQ ID NO: 3655262 - RNA, 21 nt, Human
cuccucccaggguuuuaacuu

SEQ ID NO: 3655263 - RNA, 19 nt, Human
cuccucccaugucacugca

SEQ ID NO: 3655264 - RNA, 14 nt, Human
cuccuccccaaauc

SEQ ID NO: 3655265 - RNA, 20 nt, Human
cuccuccccacccuccuggc

SEQ ID NO: 3655266 - RNA, 15 nt, Human
cuccuccccuggagg

SEQ ID NO: 3655267 - RNA, 11 nt, Human
cuccucccucc

SEQ ID NO: 3655268 - RNA, 15 nt, Human
cuccucccugaugua

SEQ ID NO: 3655269 - RNA, 16 nt, Human
cuccucccugauguac

SEQ ID NO: 3655270 - RNA, 13 nt, Human
cuccucccugcau

SEQ ID NO: 3655271 - RNA, 23 nt, Human
cuccucccugcaucugaccagca

SEQ ID NO: 3655272 - RNA, 12 nt, Human
cuccucccuggc

SEQ ID NO: 3655273 - RNA, 13 nt, Human
cuccucccuggcu

SEQ ID NO: 3655274 - RNA, 20 nt, Human
cuccucccuggcugcccugg

SEQ ID NO: 3655275 - RNA, 21 nt, Human
cuccucccuggcugcccuggc

SEQ ID NO: 3655276 - RNA, 14 nt, Human
cuccucccuuagcu

SEQ ID NO: 3655277 - RNA, 15 nt, Human
cuccucccuuagcuc

SEQ ID NO: 3655278 - RNA, 13 nt, Human
cuccucccuuccu

SEQ ID NO: 3655279 - RNA, 14 nt, Human
cuccucccuuccuu

SEQ ID NO: 3655280 - RNA, 18 nt, Human
cuccucccuuuccuuccu

SEQ ID NO: 3655281 - RNA, 22 nt, Human
cuccuccgaggugguuuuaaag

SEQ ID NO: 3655282 - RNA, 12 nt, Human
cuccuccucgga

SEQ ID NO: 3655283 - RNA, 13 nt, Human
cuccuccucggaa

SEQ ID NO: 3655284 - RNA, 13 nt, Human
cuccuccucuuuc

SEQ ID NO: 3655285 - RNA, 16 nt, Human
cuccuccucuuucucu

SEQ ID NO: 3655286 - RNA, 13 nt, Human
cuccuccuuccua

SEQ ID NO: 3655287 - RNA, 15 nt, Human
cuccuccuuuuucca

SEQ ID NO: 3655288 - RNA, 17 nt, Human
cuccucgacaucacugu

SEQ ID NO: 3655289 - RNA, 15 nt, Human
cuccucgcaagcugg

SEQ ID NO: 3655290 - RNA, 16 nt, Human
cuccucgcaagcuggg

SEQ ID NO: 3655291 - RNA, 17 nt, Human
cuccucgcaagcugggu

SEQ ID NO: 3655292 - RNA, 19 nt, Human
cuccucgcaagcuggguaa

SEQ ID NO: 3655293 - RNA, 19 nt, Human
cuccucggcccccuccauc

SEQ ID NO: 3655294 - RNA, 15 nt, Human
cuccucggccuggcu

SEQ ID NO: 3655295 - RNA, 16 nt, Human
cuccucggccuggcuc

SEQ ID NO: 3655296 - RNA, 18 nt, Human
cuccucggccuggcuccu

SEQ ID NO: 3655297 - RNA, 13 nt, Human
cuccucuaagcca

SEQ ID NO: 3655298 - RNA, 12 nt, Human
cuccucucccau

SEQ ID NO: 3655299 - RNA, 15 nt, Human
cuccucucccauccc

SEQ ID NO: 3655300 - RNA, 18 nt, Human
cuccucucccauccuuga

SEQ ID NO: 3655301 - RNA, 23 nt, Human
cuccucucccauugucccucugc

SEQ ID NO: 3655302 - RNA, 15 nt, Human
cuccucuccccagca

SEQ ID NO: 3655303 - RNA, 22 nt, Human
cuccucuccccagcccagagac

SEQ ID NO: 3655304 - RNA, 23 nt, Human
cuccucuccccagcccagagaca

SEQ ID NO: 3655305 - RNA, 21 nt, Human
cuccucuccuacucggcucug

SEQ ID NO: 3655306 - RNA, 20 nt, Human
cuccucuccuggaggauugc

SEQ ID NO: 3655307 - RNA, 13 nt, Human
cuccucucugccc

SEQ ID NO: 3655308 - RNA, 17 nt, Human
cuccucugaaacagcug

SEQ ID NO: 3655309 - RNA, 20 nt, Human
cuccucugaaacagcugccu

SEQ ID NO: 3655310 - RNA, 18 nt, Human
cuccucugacucagggcu

SEQ ID NO: 3655311 - RNA, 22 nt, Human
cuccucugacucagggcuccug

SEQ ID NO: 3655312 - RNA, 16 nt, Human
cuccucugcagugccu

SEQ ID NO: 3655313 - RNA, 12 nt, Human
cuccucugccac

SEQ ID NO: 3655314 - RNA, 22 nt, Human
cuccucugcccgggagcucagg

SEQ ID NO: 3655315 - RNA, 14 nt, Human
cuccucugcugcug

SEQ ID NO: 3655316 - RNA, 15 nt, Human
cuccucugcugcugg

SEQ ID NO: 3655317 - RNA, 14 nt, Human
cuccucugcuugcc

SEQ ID NO: 3655318 - RNA, 15 nt, Human
cuccucugcuugcca

SEQ ID NO: 3655319 - RNA, 12 nt, Human
cuccucugggca

SEQ ID NO: 3655320 - RNA, 15 nt, Human
cuccucuguccaggc

SEQ ID NO: 3655321 - RNA, 16 nt, Human
cuccucuguccagggc

SEQ ID NO: 3655322 - RNA, 17 nt, Human
cuccucuguccugcuuc

SEQ ID NO: 3655323 - RNA, 20 nt, Human
cuccucuuaaaaaauaaaaa

SEQ ID NO: 3655324 - RNA, 23 nt, Human
cuccucuucaacugaccagccuc

SEQ ID NO: 3655325 - RNA, 18 nt, Human
cuccucuuccaugcugug

SEQ ID NO: 3655326 - RNA, 17 nt, Human
cuccucuuccccagacg

SEQ ID NO: 3655327 - RNA, 19 nt, Human
cuccucuucugacgugccu

SEQ ID NO: 3655328 - RNA, 16 nt, Human
cccaugccuguccagc

SEQ ID NO: 3655329 - RNA, 14 nt, Human
cccaugcuggagcc

SEQ ID NO: 3655330 - RNA, 15 nt, Human
cccaugcuggagccu

SEQ ID NO: 3655331 - RNA, 16 nt, Human
cccaugcuggagccug

SEQ ID NO: 3655332 - RNA, 17 nt, Human
aaauccaaauauuguua

SEQ ID NO: 3655333 - RNA, 12 nt, Human
aaauccaggacc

SEQ ID NO: 3655334 - RNA, 13 nt, Human
aaauccaggaccc

SEQ ID NO: 3655335 - RNA, 19 nt, Human
aaauccaggacccugccag

SEQ ID NO: 3655336 - RNA, 18 nt, Human
aaauccauacauuugugu

SEQ ID NO: 3655337 - RNA, 20 nt, Human
aaauccauaucuuaaagaaa

SEQ ID NO: 3655338 - RNA, 16 nt, Human
aaauccauuuggaaau

SEQ ID NO: 3655339 - RNA, 18 nt, Human
aaauccauuuggaaaucu

SEQ ID NO: 3655340 - RNA, 13 nt, Human
aaaucccauuauu

SEQ ID NO: 3655341 - RNA, 15 nt, Human
aaaucccauuauuca

SEQ ID NO: 3655342 - RNA, 20 nt, Human
aaaucccauuauucaaaguu

SEQ ID NO: 3655343 - RNA, 12 nt, Human
cuccucuugcca

SEQ ID NO: 3655344 - RNA, 16 nt, Human
cuccucuugccacugc

SEQ ID NO: 3655345 - RNA, 19 nt, Human
cuccucuugccacugccuc

SEQ ID NO: 3655346 - RNA, 20 nt, Human
cuccucuuguaaauaaagcc

SEQ ID NO: 3655347 - RNA, 12 nt, Human
cuccucuuuaaa

SEQ ID NO: 3655348 - RNA, 16 nt, Human
cuccucuuucucuccc

SEQ ID NO: 3655349 - RNA, 17 nt, Human
cuccucuuucucucccc

SEQ ID NO: 3655350 - RNA, 20 nt, Human
cuccucuuucucuccccaac

SEQ ID NO: 3655351 - RNA, 21 nt, Human
cuccucuuuguuuuguuuuaa

SEQ ID NO: 3655352 - RNA, 21 nt, Human
cuccugaaaaaaaaccugaga

SEQ ID NO: 3655353 - RNA, 20 nt, Human
cuccugaaccgcacagcuca

SEQ ID NO: 3655354 - RNA, 23 nt, Human
cuccugaaccgcacagcucagga

SEQ ID NO: 3655355 - RNA, 22 nt, Human
cuccugacacaccugcagccuc

SEQ ID NO: 3655356 - RNA, 15 nt, Human
cuccugacaccccac

SEQ ID NO: 3655357 - RNA, 16 nt, Human
cuccugacaccccacu

SEQ ID NO: 3655358 - RNA, 18 nt, Human
cuccugacacccuucucc

SEQ ID NO: 3655359 - RNA, 20 nt, Human
cuccugacacccuucuccca

SEQ ID NO: 3655360 - RNA, 14 nt, Human
cuccugacacugcu

SEQ ID NO: 3655361 - RNA, 19 nt, Human
cuccugacagaaggugcca

SEQ ID NO: 3655362 - RNA, 22 nt, Human
cuccugaccaguugcagucacu

SEQ ID NO: 3655363 - RNA, 18 nt, Human
cuccugacccauugcugu

SEQ ID NO: 3655364 - RNA, 19 nt, Human
cuccugacccauugcuguu

SEQ ID NO: 3655365 - RNA, 14 nt, Human
cuccugaccugagg

SEQ ID NO: 3655366 - RNA, 15 nt, Human
cuccugacuggugcu

SEQ ID NO: 3655367 - RNA, 19 nt, Human
cuccugagaccccuggccu

SEQ ID NO: 3655368 - RNA, 21 nt, Human
cuccugagaccccuggccucc

SEQ ID NO: 3655369 - RNA, 22 nt, Human
cuccugagaccccuggccuccg

SEQ ID NO: 3655370 - RNA, 12 nt, Human
cuccugagcccc

SEQ ID NO: 3655371 - RNA, 13 nt, Human
cuccugagccccc

SEQ ID NO: 3655372 - RNA, 17 nt, Human
cuccugagcccccagcu

SEQ ID NO: 3655373 - RNA, 20 nt, Human
cuccugagcuaggaagaguc

SEQ ID NO: 3655374 - RNA, 15 nt, Human
cuccugaggacagcu

SEQ ID NO: 3655375 - RNA, 17 nt, Human
cuccugaggacagcugu

SEQ ID NO: 3655376 - RNA, 20 nt, Human
cuccugaggaucagaaagua

SEQ ID NO: 3655377 - RNA, 16 nt, Human
cuccugaggcuuugga

SEQ ID NO: 3655378 - RNA, 20 nt, Human
cuccugagggaggaccuggg

SEQ ID NO: 3655379 - RNA, 23 nt, Human
cuccugaggggcaucugccccuc

SEQ ID NO: 3655380 - RNA, 22 nt, Human
cuccugaguagcugggauuaca

SEQ ID NO: 3655381 - RNA, 16 nt, Human
cuccugagugauccca

SEQ ID NO: 3655382 - RNA, 15 nt, Human
cuccugauuauuuau

SEQ ID NO: 3655383 - RNA, 19 nt, Human
cuccugcacuuacuugcuu

SEQ ID NO: 3655384 - RNA, 12 nt, Human
cuccugcaggca

SEQ ID NO: 3655385 - RNA, 18 nt, Human
cuccugcaggcagccagg

SEQ ID NO: 3655386 - RNA, 19 nt, Human
cuccugccaccacgcccgg

SEQ ID NO: 3655387 - RNA, 14 nt, Human
cuccugcccaccug

SEQ ID NO: 3655388 - RNA, 13 nt, Human
cuccugcccacgg

SEQ ID NO: 3655389 - RNA, 11 nt, Human
cuccugcccag

SEQ ID NO: 3655390 - RNA, 14 nt, Human
cuccugcccaggag

SEQ ID NO: 3655391 - RNA, 18 nt, Human
cuccugcccaguccccca

SEQ ID NO: 3655392 - RNA, 13 nt, Human
cuccugcccccac

SEQ ID NO: 3655393 - RNA, 15 nt, Human
cuccugcccccacac

SEQ ID NO: 3655394 - RNA, 23 nt, Human
cuccugcccccacaccuggcccu

SEQ ID NO: 3655395 - RNA, 20 nt, Human
cuccugcccgcagaccucug

SEQ ID NO: 3655396 - RNA, 13 nt, Human
cuccugccuacuc

SEQ ID NO: 3655397 - RNA, 16 nt, Human
cuccugccuacucacg

SEQ ID NO: 3655398 - RNA, 17 nt, Human
cuccugccucagccucc

SEQ ID NO: 3655399 - RNA, 19 nt, Human
cuccugccucagccucccg

SEQ ID NO: 3655400 - RNA, 20 nt, Human
cuccugccucgaacuggcug

SEQ ID NO: 3655401 - RNA, 15 nt, Human
cuccugccucuacug

SEQ ID NO: 3655402 - RNA, 14 nt, Human
cuccugccuguagc

SEQ ID NO: 3655403 - RNA, 16 nt, Human
cuccugccuguagcag

SEQ ID NO: 3655404 - RNA, 18 nt, Human
cuccugccuguagcagug

SEQ ID NO: 3655405 - RNA, 21 nt, Human
cuccugccuucuguccuggug

SEQ ID NO: 3655406 - RNA, 15 nt, Human
cuccugccuuugccu

SEQ ID NO: 3655407 - RNA, 19 nt, Human
cuccugcguguucucagag

SEQ ID NO: 3655408 - RNA, 23 nt, Human
cuccugcuaacggugcucagggg

SEQ ID NO: 3655409 - RNA, 19 nt, Human
cuccugcugcaccaaccca

SEQ ID NO: 3655410 - RNA, 12 nt, Human
cuccugcugcag

SEQ ID NO: 3655411 - RNA, 12 nt, Human
cuccugcugcca

SEQ ID NO: 3655412 - RNA, 14 nt, Human
cuccugcugccagu

SEQ ID NO: 3655413 - RNA, 18 nt, Human
cuccugcugcucccucag

SEQ ID NO: 3655414 - RNA, 21 nt, Human
cuccugcugcucccucagacu

SEQ ID NO: 3655415 - RNA, 23 nt, Human
cuccugcugcucccucagacugg

SEQ ID NO: 3655416 - RNA, 23 nt, Human
cuccugcuguaaauuuggcuucu

SEQ ID NO: 3655417 - RNA, 22 nt, Human
cuccuggaaaggcucagucuca

SEQ ID NO: 3655418 - RNA, 23 nt, Human
cuccuggaaaggcucagucucag

SEQ ID NO: 3655419 - RNA, 24 nt, Human
cuccuggaaaggcucagucucagg

SEQ ID NO: 3655420 - RNA, 11 nt, Human
cuccuggaaau

SEQ ID NO: 3655421 - RNA, 22 nt, Human
cuccuggaacagaagacagcug

SEQ ID NO: 3655422 - RNA, 21 nt, Human
cuccuggaaccuugcuguccu

SEQ ID NO: 3655423 - RNA, 20 nt, Human
cuccuggaagcuguguccuu

SEQ ID NO: 3655424 - RNA, 22 nt, Human
cuccuggaccccccuuucacag

SEQ ID NO: 3655425 - RNA, 12 nt, Human
cuccuggacucc

SEQ ID NO: 3655426 - RNA, 14 nt, Human
cuccuggacugccu

SEQ ID NO: 3655427 - RNA, 12 nt, Human
cuccuggagccu

SEQ ID NO: 3655428 - RNA, 18 nt, Human
cuccuggccuauccgcug

SEQ ID NO: 3655429 - RNA, 23 nt, Human
cuccuggccuauccgcugccagc

SEQ ID NO: 3655430 - RNA, 12 nt, Human
cuccugggaagg

SEQ ID NO: 3655431 - RNA, 22 nt, Human
cuccugggaaggcuacucaccu

SEQ ID NO: 3655432 - RNA, 23 nt, Human
cuccugggaaggcuacucaccuu

SEQ ID NO: 3655433 - RNA, 15 nt, Human
cuccugggaucugcu

SEQ ID NO: 3655434 - RNA, 16 nt, Human
cuccugggaucugcuc

SEQ ID NO: 3655435 - RNA, 17 nt, Human
cuccugggcagcugccu

SEQ ID NO: 3655436 - RNA, 18 nt, Human
cuccugggcagcugccuc

SEQ ID NO: 3655437 - RNA, 13 nt, Human
cuccugggccccu

SEQ ID NO: 3655438 - RNA, 20 nt, Human
cuccugggcccucucugcuc

SEQ ID NO: 3655439 - RNA, 23 nt, Human
cuccuggggccaggccgggccug

SEQ ID NO: 3655440 - RNA, 18 nt, Human
cuccuggggguucuuucu

SEQ ID NO: 3655441 - RNA, 23 nt, Human
cuccuggggguucuuucuuccuc

SEQ ID NO: 3655442 - RNA, 22 nt, Human
cuccuggguuuuguauucucug

SEQ ID NO: 3655443 - RNA, 18 nt, Human
cuccuggucaccuaggaa

SEQ ID NO: 3655444 - RNA, 13 nt, Human
cuccugguccuag

SEQ ID NO: 3655445 - RNA, 15 nt, Human
cuccuggugccaccu

SEQ ID NO: 3655446 - RNA, 20 nt, Human
cuccugguggguccaggggc

SEQ ID NO: 3655447 - RNA, 13 nt, Human
cuccuggugucac

SEQ ID NO: 3655448 - RNA, 17 nt, Human
cuccuggugucacccca

SEQ ID NO: 3655449 - RNA, 21 nt, Human
cuccuggugucaccccagagc

SEQ ID NO: 3655450 - RNA, 23 nt, Human
cuccuggugucaccccagagcca

SEQ ID NO: 3655451 - RNA, 16 nt, Human
cuccuguaauuccuac

SEQ ID NO: 3655452 - RNA, 14 nt, Human
cuccuguccaaccu

SEQ ID NO: 3655453 - RNA, 18 nt, Human
cuccuguccccugcuaca

SEQ ID NO: 3655454 - RNA, 18 nt, Human
cuccuguccucccucacc

SEQ ID NO: 3655455 - RNA, 10 nt, Human
cuccugucuu

SEQ ID NO: 3655456 - RNA, 17 nt, Human
cuccugucuucccaggg

SEQ ID NO: 3655457 - RNA, 21 nt, Human
cuccugucuucccaggguagc

SEQ ID NO: 3655458 - RNA, 16 nt, Human
cuccugucuucugcuu

SEQ ID NO: 3655459 - RNA, 16 nt, Human
cuccugugcaugggug

SEQ ID NO: 3655460 - RNA, 20 nt, Human
cuccugugcaugggugaagg

SEQ ID NO: 3655461 - RNA, 21 nt, Human
cuccugugcccacaucccagg

SEQ ID NO: 3655462 - RNA, 13 nt, Human
cuccugugcccuu

SEQ ID NO: 3655463 - RNA, 20 nt, Human
cuccugugcuacuuugccuu

SEQ ID NO: 3655464 - RNA, 15 nt, Human
cuccugugcuuuccc

SEQ ID NO: 3655465 - RNA, 22 nt, Human
cuccuguggaaggcagagaaau

SEQ ID NO: 3655466 - RNA, 17 nt, Human
cuccuguggccugccag

SEQ ID NO: 3655467 - RNA, 20 nt, Human
cuccuguggccugccaguca

SEQ ID NO: 3655468 - RNA, 18 nt, Human
cuccugugggagccucgc

SEQ ID NO: 3655469 - RNA, 14 nt, Human
cuccuguguacagg

SEQ ID NO: 3655470 - RNA, 20 nt, Human
cuccugugugugcgccuaca

SEQ ID NO: 3655471 - RNA, 16 nt, Human
cuccuguuagcuccuc

SEQ ID NO: 3655472 - RNA, 22 nt, Human
cuccuguugcacccagcccugg

SEQ ID NO: 3655473 - RNA, 23 nt, Human
cuccuguugcacccagcccuggu

SEQ ID NO: 3655474 - RNA, 16 nt, Human
cuccuguugggagagg

SEQ ID NO: 3655475 - RNA, 18 nt, Human
cuccuguuucccuucccu

SEQ ID NO: 3655476 - RNA, 14 nt, Human
cucucuccacccua

SEQ ID NO: 3655477 - RNA, 12 nt, Human
cucucucccagu

SEQ ID NO: 3655478 - RNA, 19 nt, Human
cucucucccagucuaccca

SEQ ID NO: 3655479 - RNA, 23 nt, Human
cucucucccagucuacccagaga

SEQ ID NO: 3655480 - RNA, 14 nt, Human
cucucucccaugga

SEQ ID NO: 3655481 - RNA, 20 nt, Human
cucucucccauggagcccca

SEQ ID NO: 3655482 - RNA, 19 nt, Human
cucucuccccucaaagucu

SEQ ID NO: 3655483 - RNA, 22 nt, Human
cucucuccccucaaagucugca

SEQ ID NO: 3655484 - RNA, 17 nt, Human
cucucuccuccugccca

SEQ ID NO: 3655485 - RNA, 20 nt, Human
cucucuccuccugcccaccu

SEQ ID NO: 3655486 - RNA, 15 nt, Human
cucucuccuguacuu

SEQ ID NO: 3655487 - RNA, 15 nt, Human
cucucuccuuugcug

SEQ ID NO: 3655488 - RNA, 13 nt, Human
cucucucugacuc

SEQ ID NO: 3655489 - RNA, 16 nt, Human
cucucugaaccccucc

SEQ ID NO: 3655490 - RNA, 20 nt, Human
cucucugaagaugaucauuu

SEQ ID NO: 3655491 - RNA, 19 nt, Human
cucucugaaggaggccacc

SEQ ID NO: 3655492 - RNA, 21 nt, Human
cucucugaaggaggccaccuc

SEQ ID NO: 3655493 - RNA, 18 nt, Human
cucucugcaccguacugu

SEQ ID NO: 3655494 - RNA, 18 nt, Human
cucucugcagccagccca

SEQ ID NO: 3655495 - RNA, 12 nt, Human
cucucugcaggu

SEQ ID NO: 3655496 - RNA, 12 nt, Human
cucucugcccug

SEQ ID NO: 3655497 - RNA, 17 nt, Human
cucucugcccuugauca

SEQ ID NO: 3655498 - RNA, 12 nt, Human
cucucugcucug

SEQ ID NO: 3655499 - RNA, 22 nt, Human
cucucugcucugcgugucaccu

SEQ ID NO: 3655500 - RNA, 12 nt, Human
cucucuggagaa

SEQ ID NO: 3655501 - RNA, 14 nt, Human
cucucuggccuccc

SEQ ID NO: 3655502 - RNA, 15 nt, Human
cucucuggccuccca

SEQ ID NO: 3655503 - RNA, 16 nt, Human
cucucuggccucccac

SEQ ID NO: 3655504 - RNA, 14 nt, Human
cucucuggccuucg

SEQ ID NO: 3655505 - RNA, 17 nt, Human
cucucuggccuuuuccu

SEQ ID NO: 3655506 - RNA, 13 nt, Human
cucucuggcuggg

SEQ ID NO: 3655507 - RNA, 16 nt, Human
cucucugggccucaga

SEQ ID NO: 3655508 - RNA, 21 nt, Human
cucucugggcugacugggcca

SEQ ID NO: 3655509 - RNA, 23 nt, Human
cucucuggggcaggguuauuccu

SEQ ID NO: 3655510 - RNA, 19 nt, Human
cucucuggggccacacaga

SEQ ID NO: 3655511 - RNA, 20 nt, Human
cucucuggggccacacagaa

SEQ ID NO: 3655512 - RNA, 16 nt, Human
cucucuguaauaaacu

SEQ ID NO: 3655513 - RNA, 21 nt, Human
cucucuguaauaaacucauuu

SEQ ID NO: 3655514 - RNA, 17 nt, Human
cucucuguauuuuuucu

SEQ ID NO: 3655515 - RNA, 19 nt, Human
cucucugucccuugcugua

SEQ ID NO: 3655516 - RNA, 23 nt, Human
cucucugucccuugcuguaugcu

SEQ ID NO: 3655517 - RNA, 16 nt, Human
cucucugugcugugga

SEQ ID NO: 3655518 - RNA, 19 nt, Human
cucucugugggcuggcagu

SEQ ID NO: 3655519 - RNA, 15 nt, Human
cucucuuacccuucu

SEQ ID NO: 3655520 - RNA, 19 nt, Human
cucucuuacccuucugugc

SEQ ID NO: 3655521 - RNA, 19 nt, Human
cucucuuagggacagucaa

SEQ ID NO: 3655522 - RNA, 14 nt, Human
cucucuucccucag

SEQ ID NO: 3655523 - RNA, 15 nt, Human
cucucuucccuuucc

SEQ ID NO: 3655524 - RNA, 20 nt, Human
cucucuuccuaucccauccc

SEQ ID NO: 3655525 - RNA, 13 nt, Human
cucucuuccugcc

SEQ ID NO: 3655526 - RNA, 14 nt, Human
cucucuuccugccc

SEQ ID NO: 3655527 - RNA, 15 nt, Human
cucucuuccugcccc

SEQ ID NO: 3655528 - RNA, 14 nt, Human
cucucuucugcucc

SEQ ID NO: 3655529 - RNA, 17 nt, Human
cucucuucugcuccacc

SEQ ID NO: 3655530 - RNA, 16 nt, Human
cucucuugcacccgcc

SEQ ID NO: 3655531 - RNA, 20 nt, Human
cucucuugccgaggagccag

SEQ ID NO: 3655532 - RNA, 13 nt, Human
cucucuugucaga

SEQ ID NO: 3655533 - RNA, 19 nt, Human
cucucuuuauacagcugua

SEQ ID NO: 3655534 - RNA, 17 nt, Human
cucucuuuccuucuugc

SEQ ID NO: 3655535 - RNA, 14 nt, Human
cucucuuuguucuc

SEQ ID NO: 3655536 - RNA, 18 nt, Human
cucucuuuguucucagcu

SEQ ID NO: 3655537 - RNA, 20 nt, Human
cucucuuuguucucagcucc

SEQ ID NO: 3655538 - RNA, 12 nt, Human
cucucuuuucug

SEQ ID NO: 3655539 - RNA, 19 nt, Human
cucucuuuucuguacuucc

SEQ ID NO: 3655540 - RNA, 22 nt, Human
cucucuuuucuguacuuccuga

SEQ ID NO: 3655541 - RNA, 9 nt, Human
cucugaaac

SEQ ID NO: 3655542 - RNA, 15 nt, Human
cucugaaacagcugc

SEQ ID NO: 3655543 - RNA, 18 nt, Human
cucugaaacagcugccuu

SEQ ID NO: 3655544 - RNA, 14 nt, Human
cucugaaagagaaa

SEQ ID NO: 3655545 - RNA, 17 nt, Human
cucugaaagagaaacac

SEQ ID NO: 3655546 - RNA, 16 nt, Human
cucugaaaguuguaca

SEQ ID NO: 3655547 - RNA, 15 nt, Human
cucugaaaucuuccc

SEQ ID NO: 3655548 - RNA, 23 nt, Human
cucugaaaucuucccaugcauuc

SEQ ID NO: 3655549 - RNA, 15 nt, Human
cucuuuuuuacaaag

SEQ ID NO: 3655550 - RNA, 21 nt, Human
cucuuuuuuacucauugaaau

SEQ ID NO: 3655551 - RNA, 22 nt, Human
cucuuuuuuacucauugaaaug

SEQ ID NO: 3655552 - RNA, 19 nt, Human
cucuuuuuuguuuguuucu

SEQ ID NO: 3655553 - RNA, 16 nt, Human
cucuuuuuuuggccca

SEQ ID NO: 3655554 - RNA, 18 nt, Human
cucuuuuuuuggcccagg

SEQ ID NO: 3655555 - RNA, 20 nt, Human
cugaaaaaaaguuuacaagu

SEQ ID NO: 3655556 - RNA, 15 nt, Human
cugaaaaaauauaug

SEQ ID NO: 3655557 - RNA, 15 nt, Human
cugaaaaaguagauu

SEQ ID NO: 3655558 - RNA, 19 nt, Human
cugaaaaaguagauugagu

SEQ ID NO: 3655559 - RNA, 17 nt, Human
cugaaaaaucacauccu

SEQ ID NO: 3655560 - RNA, 19 nt, Human
cugaaaaaucuaagugaua

SEQ ID NO: 3655561 - RNA, 22 nt, Human
cugaaaaaucuaagugauauaa

SEQ ID NO: 3655562 - RNA, 15 nt, Human
cugaaaaauuccuuu

SEQ ID NO: 3655563 - RNA, 21 nt, Human
cugaaaaccaucuggccuggc

SEQ ID NO: 3655564 - RNA, 15 nt, Human
cugaaaacccagaga

SEQ ID NO: 3655565 - RNA, 16 nt, Human
cugaaaacggcccucu

SEQ ID NO: 3655566 - RNA, 22 nt, Human
cugaaaacuggaauaagaagca

SEQ ID NO: 3655567 - RNA, 14 nt, Human
cugaaaagaaauaa

SEQ ID NO: 3655568 - RNA, 16 nt, Human
cugaaaagaaauaaua

SEQ ID NO: 3655569 - RNA, 12 nt, Human
cugaaaagaagg

SEQ ID NO: 3655570 - RNA, 17 nt, Human
cugaaaagguuuaugaa

SEQ ID NO: 3655571 - RNA, 22 nt, Human
cugaaaaguguguauauauuuu

SEQ ID NO: 3655572 - RNA, 15 nt, Human
cugaaaauauaaaac

SEQ ID NO: 3655573 - RNA, 15 nt, Human
cugaaaaucuaauau

SEQ ID NO: 3655574 - RNA, 16 nt, Human
cugaaaaucuaauauu

SEQ ID NO: 3655575 - RNA, 12 nt, Human
cugaaaaugugc

SEQ ID NO: 3655576 - RNA, 22 nt, Human
cugaaaauguuuuucugccagg

SEQ ID NO: 3655577 - RNA, 18 nt, Human
cugaaaauucgaaccagg

SEQ ID NO: 3655578 - RNA, 22 nt, Human
cugaaaauugaugggauuuggu

SEQ ID NO: 3655579 - RNA, 19 nt, Human
cugaaaauugccuuucugu

SEQ ID NO: 3655580 - RNA, 20 nt, Human
cugaaaauugccuuucugug

SEQ ID NO: 3655581 - RNA, 15 nt, Human
cugaaacaacaaaua

SEQ ID NO: 3655582 - RNA, 16 nt, Human
cugaaacaacuuggaa

SEQ ID NO: 3655583 - RNA, 20 nt, Human
cugaaacaacuuggaaagau

SEQ ID NO: 3655584 - RNA, 18 nt, Human
cugaaacacgaaacuugu

SEQ ID NO: 3655585 - RNA, 20 nt, Human
cugaaacacgaaacuuguua

SEQ ID NO: 3655586 - RNA, 21 nt, Human
cugaaacacgaaacuuguuau

SEQ ID NO: 3655587 - RNA, 11 nt, Human
cugaaacagcu

SEQ ID NO: 3655588 - RNA, 13 nt, Human
cugaaacauuuca

SEQ ID NO: 3655589 - RNA, 14 nt, Human
cugaaaccaguguu

SEQ ID NO: 3655590 - RNA, 20 nt, Human
cugaaaccuaguacugcccc

SEQ ID NO: 3655591 - RNA, 19 nt, Human
cugaaacgcuccuuugugu

SEQ ID NO: 3655592 - RNA, 16 nt, Human
cugaaacuaaugaaag

SEQ ID NO: 3655593 - RNA, 20 nt, Human
cugaaacuauauuuugucau

SEQ ID NO: 3655594 - RNA, 22 nt, Human
cugaaacuuauuuuuuucugau

SEQ ID NO: 3655595 - RNA, 13 nt, Human
cugaaacuucccu

SEQ ID NO: 3655596 - RNA, 14 nt, Human
cugaaagaggccaa

SEQ ID NO: 3655597 - RNA, 18 nt, Human
cugaaagaggccaaacag

SEQ ID NO: 3655598 - RNA, 11 nt, Human
cugaaagccac

SEQ ID NO: 3655599 - RNA, 14 nt, Human
cugaaagccagcug

SEQ ID NO: 3655600 - RNA, 16 nt, Human
cugaaagccauggaga

SEQ ID NO: 3655601 - RNA, 23 nt, Human
cugaaagccauuuguuggggcag

SEQ ID NO: 3655602 - RNA, 17 nt, Human
cugaaagcccugagcuu

SEQ ID NO: 3655603 - RNA, 19 nt, Human
cugaaagcccugagcuuuc

SEQ ID NO: 3655604 - RNA, 19 nt, Human
cugaaaggcaguagucauu

SEQ ID NO: 3655605 - RNA, 15 nt, Human
cugaaaguuacccac

SEQ ID NO: 3655606 - RNA, 18 nt, Human
cugaaaguuacccacuga

SEQ ID NO: 3655607 - RNA, 12 nt, Human
cugaaaguucuu

SEQ ID NO: 3655608 - RNA, 13 nt, Human
cugaaaguuuugu

SEQ ID NO: 3655609 - RNA, 15 nt, Human
cugaaaguuuuguaa

SEQ ID NO: 3655610 - RNA, 16 nt, Human
cugaaaguuuuguaaa

SEQ ID NO: 3655611 - RNA, 20 nt, Human
cugaaaguuuuguaaaagaa

SEQ ID NO: 3655612 - RNA, 22 nt, Human
cugaaaguuuuguaaaagaaau

SEQ ID NO: 3655613 - RNA, 13 nt, Human
cugaaauaaaagc

SEQ ID NO: 3655614 - RNA, 21 nt, Human
cugaaauaaacgucuuaaaua

SEQ ID NO: 3655615 - RNA, 18 nt, Human
cugaaauaggaaacaagu

SEQ ID NO: 3655616 - RNA, 18 nt, Human
cugaaauauacacacagc

SEQ ID NO: 3655617 - RNA, 15 nt, Human
cugaaauccugguuc

SEQ ID NO: 3655618 - RNA, 23 nt, Human
cugaaaucuucccaugcauucug

SEQ ID NO: 3655619 - RNA, 18 nt, Human
cugaaaugaaacaaauaa

SEQ ID NO: 3655620 - RNA, 21 nt, Human
cugaaauggacuuuuguacau

SEQ ID NO: 3655621 - RNA, 16 nt, Human
cucugaggcuuccaga

SEQ ID NO: 3655622 - RNA, 20 nt, Human
cucugaggggcuaccaggaa

SEQ ID NO: 3655623 - RNA, 22 nt, Human
cucugaggugccugucccaccc

SEQ ID NO: 3655624 - RNA, 22 nt, Human
cucugaguagggcaauggaaau

SEQ ID NO: 3655625 - RNA, 17 nt, Human
cucugaguccuggccca

SEQ ID NO: 3655626 - RNA, 12 nt, Human
cucugaguguga

SEQ ID NO: 3655627 - RNA, 17 nt, Human
cucugaguguuuuauga

SEQ ID NO: 3655628 - RNA, 20 nt, Human
cucugaguuccggcaccagu

SEQ ID NO: 3655629 - RNA, 16 nt, Human
cucugaguuuaccauu

SEQ ID NO: 3655630 - RNA, 18 nt, Human
cucugaguuuaccauuug

SEQ ID NO: 3655631 - RNA, 21 nt, Human
cucugaguuuaccauuuguaa

SEQ ID NO: 3655632 - RNA, 16 nt, Human
cucugauacuuuuuug

SEQ ID NO: 3655633 - RNA, 17 nt, Human
cucugauacuuuuuuga

SEQ ID NO: 3655634 - RNA, 13 nt, Human
cucugauauggga

SEQ ID NO: 3655635 - RNA, 15 nt, Human
cucugauaugggacu

SEQ ID NO: 3655636 - RNA, 16 nt, Human
cucugauaugggacug

SEQ ID NO: 3655637 - RNA, 19 nt, Human
cucugauaugggacugagc

SEQ ID NO: 3655638 - RNA, 17 nt, Human
cucugauccuucuuccu

SEQ ID NO: 3655639 - RNA, 22 nt, Human
cucugaucuccauaaacaugaa

SEQ ID NO: 3655640 - RNA, 22 nt, Human
cucugaugaaaaauugcugacu

SEQ ID NO: 3655641 - RNA, 17 nt, Human
cucugaugaagaggagu

SEQ ID NO: 3655642 - RNA, 14 nt, Human
cucugaugcagcuu

SEQ ID NO: 3655643 - RNA, 15 nt, Human
cucugauuuucaaag

SEQ ID NO: 3655644 - RNA, 18 nt, Human
cucugauuuucaaagcuu

SEQ ID NO: 3655645 - RNA, 15 nt, Human
cucugcaaacugccu

SEQ ID NO: 3655646 - RNA, 16 nt, Human
cucugcaaacugccuu

SEQ ID NO: 3655647 - RNA, 16 nt, Human
cucugcaaaggaaaua

SEQ ID NO: 3655648 - RNA, 18 nt, Human
cucugcaaucuucucaga

SEQ ID NO: 3655649 - RNA, 17 nt, Human
cucugcaauuccccucu

SEQ ID NO: 3655650 - RNA, 22 nt, Human
cucugcaauuccccucugcugc

SEQ ID NO: 3655651 - RNA, 10 nt, Human
cucugcacag

SEQ ID NO: 3655652 - RNA, 15 nt, Human
cucugcacaugucuu

SEQ ID NO: 3655653 - RNA, 18 nt, Human
cucugcacaugucuugua

SEQ ID NO: 3655654 - RNA, 20 nt, Human
cucugcacuacuccucugca

SEQ ID NO: 3655655 - RNA, 19 nt, Human
cucugcacucccaccugac

SEQ ID NO: 3655656 - RNA, 23 nt, Human
cucugcacucccaccugacacac

SEQ ID NO: 3655657 - RNA, 14 nt, Human
cucugcacuccccu

SEQ ID NO: 3655658 - RNA, 18 nt, Human
cucugcagacuucccagc

SEQ ID NO: 3655659 - RNA, 18 nt, Human
cucugcagcaauaaagca

SEQ ID NO: 3655660 - RNA, 14 nt, Human
cucugcagcccagg

SEQ ID NO: 3655661 - RNA, 12 nt, Human
cucugcagccuc

SEQ ID NO: 3655662 - RNA, 15 nt, Human
cucugcagccucaga

SEQ ID NO: 3655663 - RNA, 16 nt, Human
cucugcagccucagag

SEQ ID NO: 3655664 - RNA, 19 nt, Human
cucugcagccucagagaca

SEQ ID NO: 3655665 - RNA, 18 nt, Human
cucugcagcugaccucug

SEQ ID NO: 3655666 - RNA, 14 nt, Human
cucugcaggcaccu

SEQ ID NO: 3655667 - RNA, 19 nt, Human
cucugcaggcuuaauaaaa

SEQ ID NO: 3655668 - RNA, 23 nt, Human
cucugcaggcuuaauaaaaauga

SEQ ID NO: 3655669 - RNA, 14 nt, Human
cucugcaggucccu

SEQ ID NO: 3655670 - RNA, 23 nt, Human
cucugcaggucccuaauaaagcu

SEQ ID NO: 3655671 - RNA, 19 nt, Human
cucugcaguacuugaugua

SEQ ID NO: 3655672 - RNA, 15 nt, Human
cucugcagucccagc

SEQ ID NO: 3655673 - RNA, 20 nt, Human
cucugcaguccuacucaagc

SEQ ID NO: 3655674 - RNA, 14 nt, Human
cucugcagucucua

SEQ ID NO: 3655675 - RNA, 16 nt, Human
cucugcagugccuugg

SEQ ID NO: 3655676 - RNA, 23 nt, Human
cucugcauacucauuaggauggc

SEQ ID NO: 3655677 - RNA, 15 nt, Human
cucugcaucccagca

SEQ ID NO: 3655678 - RNA, 17 nt, Human
cucugcaucccagcacc

SEQ ID NO: 3655679 - RNA, 22 nt, Human
cucugcaucuacucccaaguau

SEQ ID NO: 3655680 - RNA, 18 nt, Human
cucugcaugcggcccagc

SEQ ID NO: 3655681 - RNA, 19 nt, Human
cucugcaugcggcccagcc

SEQ ID NO: 3655682 - RNA, 21 nt, Human
cucugcaugcggcccagcccg

SEQ ID NO: 3655683 - RNA, 14 nt, Human
cucugcauucuagu

SEQ ID NO: 3655684 - RNA, 23 nt, Human
cucugcauuugucuauucuccag

SEQ ID NO: 3655685 - RNA, 23 nt, Human
cucugccaacuucuucagagcug

SEQ ID NO: 3655686 - RNA, 14 nt, Human
cucugccaccagag

SEQ ID NO: 3655687 - RNA, 20 nt, Human
cucugccacccuaccuguuc

SEQ ID NO: 3655688 - RNA, 13 nt, Human
cucugccaccucc

SEQ ID NO: 3655689 - RNA, 22 nt, Human
cucugccagaagauccccucag

SEQ ID NO: 3655690 - RNA, 16 nt, Human
cucugccagcaaagag

SEQ ID NO: 3655691 - RNA, 14 nt, Human
cucugccaguccug

SEQ ID NO: 3655692 - RNA, 13 nt, Human
cucugccagugac
